United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 15

SEQ ID NO: 632069 - DNA, 13 bp, D. melanogaster
ggcaggcagcagc

SEQ ID NO: 632070 - DNA, 13 bp, D. melanogaster
ggcaggcagccag

SEQ ID NO: 632071 - DNA, 13 bp, D. melanogaster
ggcaggcaggcag

SEQ ID NO: 632072 - DNA, 14 bp, D. melanogaster
ggcaggcaggcagt

SEQ ID NO: 632073 - DNA, 13 bp, D. melanogaster
ggcaggctcattt

SEQ ID NO: 632074 - DNA, 13 bp, D. melanogaster
ggcagggaaatgg

SEQ ID NO: 632075 - DNA, 13 bp, D. melanogaster
ggcagggcaaaca

SEQ ID NO: 632076 - DNA, 14 bp, D. melanogaster
ggcagggcagggca

SEQ ID NO: 632077 - DNA, 13 bp, D. melanogaster
ggcagggttggta

SEQ ID NO: 632078 - DNA, 13 bp, D. melanogaster
ggcaggtgcaaaa

SEQ ID NO: 632079 - DNA, 13 bp, D. melanogaster
ggcaggtggaaaa

SEQ ID NO: 632080 - DNA, 13 bp, D. melanogaster
ggcagtacgagta

SEQ ID NO: 632081 - DNA, 13 bp, D. melanogaster
ggcagtagccaaa

SEQ ID NO: 632082 - DNA, 13 bp, D. melanogaster
ggcagtcagtcgc

SEQ ID NO: 632083 - DNA, 13 bp, D. melanogaster
ggcagtgaaagtg

SEQ ID NO: 632084 - DNA, 13 bp, D. melanogaster
ggcagtgatgaca

SEQ ID NO: 632085 - DNA, 14 bp, D. melanogaster
ggcagtgatttctt

SEQ ID NO: 632086 - DNA, 13 bp, D. melanogaster
ggcagtgcaaaca

SEQ ID NO: 632087 - DNA, 13 bp, D. melanogaster
ggcagtgcaattt

SEQ ID NO: 632088 - DNA, 13 bp, D. melanogaster
ggcagtgccaaaa

SEQ ID NO: 632089 - DNA, 13 bp, D. melanogaster
ggcagtggaaaag

SEQ ID NO: 632090 - DNA, 13 bp, D. melanogaster
ggcagtggaaaat

SEQ ID NO: 632091 - DNA, 13 bp, D. melanogaster
ggcagtggaccaa

SEQ ID NO: 632092 - DNA, 14 bp, D. melanogaster
ggcagtggaccaat

SEQ ID NO: 632093 - DNA, 13 bp, D. melanogaster
ggcagtggcaaca

SEQ ID NO: 632094 - DNA, 14 bp, D. melanogaster
ggcagtggcaatgg

SEQ ID NO: 632095 - DNA, 13 bp, D. melanogaster
ggcagtgggtggc

SEQ ID NO: 632096 - DNA, 13 bp, D. melanogaster
ggcagtgtgtgtg

SEQ ID NO: 632097 - DNA, 14 bp, D. melanogaster
ggcagtgtgtgtgt

SEQ ID NO: 632098 - DNA, 13 bp, D. melanogaster
ggcagttggccag

SEQ ID NO: 632099 - DNA, 13 bp, D. melanogaster
ggcataaaaacaa

SEQ ID NO: 632100 - DNA, 13 bp, D. melanogaster
ggcataaaaataa

SEQ ID NO: 632101 - DNA, 13 bp, D. melanogaster
ggcataaaataga

SEQ ID NO: 632102 - DNA, 13 bp, D. melanogaster
ggcataaacaaaa

SEQ ID NO: 632103 - DNA, 14 bp, D. melanogaster
ggcataaataaata

SEQ ID NO: 632104 - DNA, 13 bp, D. melanogaster
ggcataaattaaa

SEQ ID NO: 632105 - DNA, 13 bp, D. melanogaster
ggcataaattatt

SEQ ID NO: 632106 - DNA, 13 bp, D. melanogaster
ggcataaattgca

SEQ ID NO: 632107 - DNA, 13 bp, D. melanogaster
ggcataattaatt

SEQ ID NO: 632108 - DNA, 13 bp, D. melanogaster
ggcatacaaaaaa

SEQ ID NO: 632109 - DNA, 13 bp, D. melanogaster
ggcatacaaaatt

SEQ ID NO: 632110 - DNA, 13 bp, D. melanogaster
ggcatacatacat

SEQ ID NO: 632111 - DNA, 13 bp, D. melanogaster
ggcatacttttgg

SEQ ID NO: 632112 - DNA, 13 bp, D. melanogaster
ggcatataaaaaa

SEQ ID NO: 632113 - DNA, 13 bp, D. melanogaster
ggcatatacatac

SEQ ID NO: 632114 - DNA, 14 bp, D. melanogaster
ggcatatacataca

SEQ ID NO: 632115 - DNA, 13 bp, D. melanogaster
ggcatatccataa

SEQ ID NO: 632116 - DNA, 13 bp, D. melanogaster
ggcatatcgatag

SEQ ID NO: 632117 - DNA, 13 bp, D. melanogaster
ggcatatggcata

SEQ ID NO: 632118 - DNA, 13 bp, D. melanogaster
ggcatattaaaaa

SEQ ID NO: 632119 - DNA, 13 bp, D. melanogaster
ggcatatttatta

SEQ ID NO: 632120 - DNA, 13 bp, D. melanogaster
ggcatattttaaa

SEQ ID NO: 632121 - DNA, 13 bp, D. melanogaster
ggcatattttgtc

SEQ ID NO: 632122 - DNA, 13 bp, D. melanogaster
ggcatatttttat

SEQ ID NO: 632123 - DNA, 13 bp, D. melanogaster
ggcatcagcagca

SEQ ID NO: 632124 - DNA, 13 bp, D. melanogaster
ggcatcagcatca

SEQ ID NO: 632125 - DNA, 14 bp, D. melanogaster
ggcatcagcatcag

SEQ ID NO: 632126 - DNA, 15 bp, D. melanogaster
ggcatcctgatgact

SEQ ID NO: 632127 - DNA, 13 bp, D. melanogaster
ggcatcctgcgag

SEQ ID NO: 632128 - DNA, 13 bp, D. melanogaster
ggcatcggcatcg

SEQ ID NO: 632129 - DNA, 14 bp, D. melanogaster
ggcatcggcatcgg

SEQ ID NO: 632130 - DNA, 13 bp, D. melanogaster
ggcatcgggcatc

SEQ ID NO: 632131 - DNA, 13 bp, D. melanogaster
ggcatgcaaataa

SEQ ID NO: 632132 - DNA, 13 bp, D. melanogaster
ggcatgcattgtg

SEQ ID NO: 632133 - DNA, 13 bp, D. melanogaster
ggcatggaaatgg

SEQ ID NO: 632134 - DNA, 13 bp, D. melanogaster
ggcatggactggg

SEQ ID NO: 632135 - DNA, 13 bp, D. melanogaster
ggcatggagtcca

SEQ ID NO: 632136 - DNA, 13 bp, D. melanogaster
ggcatggctgctg

SEQ ID NO: 632137 - DNA, 13 bp, D. melanogaster
ggcatgggcatgg

SEQ ID NO: 632138 - DNA, 13 bp, D. melanogaster
ggcatggtgatca

SEQ ID NO: 632139 - DNA, 13 bp, D. melanogaster
ggcatgtccagca

SEQ ID NO: 632140 - DNA, 14 bp, D. melanogaster
ggcatgtggctggc

SEQ ID NO: 632141 - DNA, 13 bp, D. melanogaster
ggcatgtgtgtgt

SEQ ID NO: 632142 - DNA, 13 bp, D. melanogaster
ggcatgttcatta

SEQ ID NO: 632143 - DNA, 13 bp, D. melanogaster
ggcattaaaaaca

SEQ ID NO: 632144 - DNA, 13 bp, D. melanogaster
ggcattaaggcag

SEQ ID NO: 632145 - DNA, 14 bp, D. melanogaster
ggcattaatgaaaa

SEQ ID NO: 632146 - DNA, 13 bp, D. melanogaster
ggcattagcatta

SEQ ID NO: 632147 - DNA, 13 bp, D. melanogaster
ggcattataagcc

SEQ ID NO: 632148 - DNA, 13 bp, D. melanogaster
ggcattatcaatg

SEQ ID NO: 632149 - DNA, 14 bp, D. melanogaster
ggcattatctacaa

SEQ ID NO: 632150 - DNA, 13 bp, D. melanogaster
ggcattatgcaaa

SEQ ID NO: 632151 - DNA, 13 bp, D. melanogaster
ggcattcaaaaat

SEQ ID NO: 632152 - DNA, 13 bp, D. melanogaster
ggcattcaaaatg

SEQ ID NO: 632153 - DNA, 13 bp, D. melanogaster
ggcattcaaattg

SEQ ID NO: 632154 - DNA, 13 bp, D. melanogaster
ggcattccacatt

SEQ ID NO: 632155 - DNA, 13 bp, D. melanogaster
ggcattccatttt

SEQ ID NO: 632156 - DNA, 13 bp, D. melanogaster
ggcattcctattg

SEQ ID NO: 632157 - DNA, 13 bp, D. melanogaster
ggcattcgaaaaa

SEQ ID NO: 632158 - DNA, 13 bp, D. melanogaster
ggcattcgcattc

SEQ ID NO: 632159 - DNA, 13 bp, D. melanogaster
ggcattcggcatt

SEQ ID NO: 632160 - DNA, 13 bp, D. melanogaster
ggcattctatgat

SEQ ID NO: 632161 - DNA, 13 bp, D. melanogaster
ggcattgaagcaa

SEQ ID NO: 632162 - DNA, 13 bp, D. melanogaster
ggcattgccaagg

SEQ ID NO: 632163 - DNA, 13 bp, D. melanogaster
ggcattggcattg

SEQ ID NO: 632164 - DNA, 13 bp, D. melanogaster
ggcattggcattt

SEQ ID NO: 632165 - DNA, 14 bp, D. melanogaster
ggcattggcattta

SEQ ID NO: 632166 - DNA, 13 bp, D. melanogaster
ggcattgggcatt

SEQ ID NO: 632167 - DNA, 14 bp, D. melanogaster
ggcattgggcattg

SEQ ID NO: 632168 - DNA, 13 bp, D. melanogaster
ggcattgtgcaaa

SEQ ID NO: 632169 - DNA, 13 bp, D. melanogaster
ggcattgttgttg

SEQ ID NO: 632170 - DNA, 14 bp, D. melanogaster
ggcattgtttctgt

SEQ ID NO: 632171 - DNA, 13 bp, D. melanogaster
ggcattgtttgcc

SEQ ID NO: 632172 - DNA, 13 bp, D. melanogaster
ggcattgttttgg

SEQ ID NO: 632173 - DNA, 13 bp, D. melanogaster
ggcattgttttgt

SEQ ID NO: 632174 - DNA, 13 bp, D. melanogaster
ggcatttaaaatt

SEQ ID NO: 632175 - DNA, 13 bp, D. melanogaster
ggcatttaattaa

SEQ ID NO: 632176 - DNA, 13 bp, D. melanogaster
ggcatttatcaaa

SEQ ID NO: 632177 - DNA, 13 bp, D. melanogaster
ggcatttatgaca

SEQ ID NO: 632178 - DNA, 13 bp, D. melanogaster
ggcatttcccaaa

SEQ ID NO: 632179 - DNA, 13 bp, D. melanogaster
ggcatttcgagcg

SEQ ID NO: 632180 - DNA, 13 bp, D. melanogaster
ggcatttcgctaa

SEQ ID NO: 632181 - DNA, 13 bp, D. melanogaster
ggcatttcgtaat

SEQ ID NO: 632182 - DNA, 13 bp, D. melanogaster
ggcatttgatttg

SEQ ID NO: 632183 - DNA, 13 bp, D. melanogaster
ggcatttgcaatt

SEQ ID NO: 632184 - DNA, 13 bp, D. melanogaster
ggcatttgcatgg

SEQ ID NO: 632185 - DNA, 13 bp, D. melanogaster
ggcatttgcattt

SEQ ID NO: 632186 - DNA, 13 bp, D. melanogaster
ggcatttggcaaa

SEQ ID NO: 632187 - DNA, 13 bp, D. melanogaster
ggcatttggcatt

SEQ ID NO: 632188 - DNA, 13 bp, D. melanogaster
ggcatttggccaa

SEQ ID NO: 632189 - DNA, 13 bp, D. melanogaster
ggcatttggcctg

SEQ ID NO: 632190 - DNA, 13 bp, D. melanogaster
ggcatttggcttt

SEQ ID NO: 632191 - DNA, 13 bp, D. melanogaster
ggcatttgtatgc

SEQ ID NO: 632192 - DNA, 13 bp, D. melanogaster
ggcatttgtttaa

SEQ ID NO: 632193 - DNA, 13 bp, D. melanogaster
ggcatttgtttat

SEQ ID NO: 632194 - DNA, 13 bp, D. melanogaster
ggcattttaagtg

SEQ ID NO: 632195 - DNA, 13 bp, D. melanogaster
ggcattttctttg

SEQ ID NO: 632196 - DNA, 14 bp, D. melanogaster
ggcattttgcaatt

SEQ ID NO: 632197 - DNA, 13 bp, D. melanogaster
ggcattttgcatt

SEQ ID NO: 632198 - DNA, 14 bp, D. melanogaster
ggcattttggtgtt

SEQ ID NO: 632199 - DNA, 13 bp, D. melanogaster
ggcattttggttt

SEQ ID NO: 632200 - DNA, 13 bp, D. melanogaster
ggcatttttaatt

SEQ ID NO: 632201 - DNA, 13 bp, D. melanogaster
ggcatttttatat

SEQ ID NO: 632202 - DNA, 13 bp, D. melanogaster
ggcatttttatgt

SEQ ID NO: 632203 - DNA, 13 bp, D. melanogaster
ggcatttttcgaa

SEQ ID NO: 632204 - DNA, 13 bp, D. melanogaster
ggcatttttgaca

SEQ ID NO: 632205 - DNA, 13 bp, D. melanogaster
ggcatttttgatt

SEQ ID NO: 632206 - DNA, 13 bp, D. melanogaster
ggcatttttggca

SEQ ID NO: 632207 - DNA, 13 bp, D. melanogaster
ggcatttttgtgt

SEQ ID NO: 632208 - DNA, 13 bp, D. melanogaster
ggccaaaaaactg

SEQ ID NO: 632209 - DNA, 13 bp, D. melanogaster
ggccaaaaaagtt

SEQ ID NO: 632210 - DNA, 13 bp, D. melanogaster
ggccaaaaaatag

SEQ ID NO: 632211 - DNA, 13 bp, D. melanogaster
ggccaaaaaatcg

SEQ ID NO: 632212 - DNA, 14 bp, D. melanogaster
ggccaaaaacaaat

SEQ ID NO: 632213 - DNA, 13 bp, D. melanogaster
ggccaaaaaccca

SEQ ID NO: 632214 - DNA, 13 bp, D. melanogaster
ggccaaaaaccga

SEQ ID NO: 632215 - DNA, 13 bp, D. melanogaster
ggccaaaaacgag

SEQ ID NO: 632216 - DNA, 13 bp, D. melanogaster
ggccaaaaacttt

SEQ ID NO: 632217 - DNA, 13 bp, D. melanogaster
ggccaaaaagaat

SEQ ID NO: 632218 - DNA, 13 bp, D. melanogaster
ggccaaaaagaca

SEQ ID NO: 632219 - DNA, 13 bp, D. melanogaster
ggccaaaaagaga

SEQ ID NO: 632220 - DNA, 13 bp, D. melanogaster
ggccaaaaagcaa

SEQ ID NO: 632221 - DNA, 14 bp, D. melanogaster
ggccaaaaagcaaa

SEQ ID NO: 632222 - DNA, 14 bp, D. melanogaster
ggccaaaaagccaa

SEQ ID NO: 632223 - DNA, 13 bp, D. melanogaster
ggccaaaaagccg

SEQ ID NO: 632224 - DNA, 13 bp, D. melanogaster
ggccaaaaagcga

SEQ ID NO: 632225 - DNA, 13 bp, D. melanogaster
ggccaaaaagggc

SEQ ID NO: 632226 - DNA, 13 bp, D. melanogaster
ggccaaaaagttt

SEQ ID NO: 632227 - DNA, 13 bp, D. melanogaster
ggccaaaaataaa

SEQ ID NO: 632228 - DNA, 14 bp, D. melanogaster
ggccaaaaataaat

SEQ ID NO: 632229 - DNA, 13 bp, D. melanogaster
ggccaaaaataga

SEQ ID NO: 632230 - DNA, 13 bp, D. melanogaster
ggccaaaaatcac

SEQ ID NO: 632231 - DNA, 13 bp, D. melanogaster
ggccaaaaatgaa

SEQ ID NO: 632232 - DNA, 13 bp, D. melanogaster
ggccaaaacaaat

SEQ ID NO: 632233 - DNA, 13 bp, D. melanogaster
ggccaaaacaact

SEQ ID NO: 632234 - DNA, 13 bp, D. melanogaster
ggccaaaacaatt

SEQ ID NO: 632235 - DNA, 13 bp, D. melanogaster
ggccaaaacagca

SEQ ID NO: 632236 - DNA, 13 bp, D. melanogaster
ggccaaaaccatt

SEQ ID NO: 632237 - DNA, 13 bp, D. melanogaster
ggccaaaaccgaa

SEQ ID NO: 632238 - DNA, 13 bp, D. melanogaster
ggccaaaacgaag

SEQ ID NO: 632239 - DNA, 13 bp, D. melanogaster
ggccaaaacggaa

SEQ ID NO: 632240 - DNA, 13 bp, D. melanogaster
ggccaaaacggag

SEQ ID NO: 632241 - DNA, 13 bp, D. melanogaster
ggccaaaactgaa

SEQ ID NO: 632242 - DNA, 13 bp, D. melanogaster
ggccaaaagaaac

SEQ ID NO: 632243 - DNA, 13 bp, D. melanogaster
ggccaaaagagag

SEQ ID NO: 632244 - DNA, 13 bp, D. melanogaster
ggccaaaagagca

SEQ ID NO: 632245 - DNA, 13 bp, D. melanogaster
ggccaaaagagcg

SEQ ID NO: 632246 - DNA, 13 bp, D. melanogaster
ggccaaaagagtg

SEQ ID NO: 632247 - DNA, 13 bp, D. melanogaster
ggccaaaagcaaa

SEQ ID NO: 632248 - DNA, 13 bp, D. melanogaster
ggccaaaagcaga

SEQ ID NO: 632249 - DNA, 13 bp, D. melanogaster
ggccaaaagcagc

SEQ ID NO: 632250 - DNA, 13 bp, D. melanogaster
ggccaaaagcagt

SEQ ID NO: 632251 - DNA, 13 bp, D. melanogaster
ggccaaaagccac

SEQ ID NO: 632252 - DNA, 13 bp, D. melanogaster
ggccaaaagcgaa

SEQ ID NO: 632253 - DNA, 13 bp, D. melanogaster
ggccaaaagctgc

SEQ ID NO: 632254 - DNA, 13 bp, D. melanogaster
ggccaaaaggaaa

SEQ ID NO: 632255 - DNA, 13 bp, D. melanogaster
ggccaaaaggaat

SEQ ID NO: 632256 - DNA, 13 bp, D. melanogaster
ggccaaaaggaca

SEQ ID NO: 632257 - DNA, 13 bp, D. melanogaster
ggccaaaaggagg

SEQ ID NO: 632258 - DNA, 13 bp, D. melanogaster
ggccaaaaggcca

SEQ ID NO: 632259 - DNA, 13 bp, D. melanogaster
ggccaaaaggcgg

SEQ ID NO: 632260 - DNA, 14 bp, D. melanogaster
ggccaaaagggaaa

SEQ ID NO: 632261 - DNA, 13 bp, D. melanogaster
ggccaaaagtaaa

SEQ ID NO: 632262 - DNA, 13 bp, D. melanogaster
ggccaaaagtgaa

SEQ ID NO: 632263 - DNA, 13 bp, D. melanogaster
ggccaaaagtgtg

SEQ ID NO: 632264 - DNA, 13 bp, D. melanogaster
ggccaaaataaaa

SEQ ID NO: 632265 - DNA, 13 bp, D. melanogaster
ggccaaaatagac

SEQ ID NO: 632266 - DNA, 13 bp, D. melanogaster
ggccaaaatcgaa

SEQ ID NO: 632267 - DNA, 14 bp, D. melanogaster
ggccaaaatgaaaa

SEQ ID NO: 632268 - DNA, 13 bp, D. melanogaster
ggccaaaatgatt

SEQ ID NO: 632269 - DNA, 13 bp, D. melanogaster
ggccaaaatgcaa

SEQ ID NO: 632270 - DNA, 13 bp, D. melanogaster
ggccaaaatgcat

SEQ ID NO: 632271 - DNA, 13 bp, D. melanogaster
ggccaaaatgggc

SEQ ID NO: 632272 - DNA, 13 bp, D. melanogaster
ggccaaaatgttt

SEQ ID NO: 632273 - DNA, 13 bp, D. melanogaster
ggccaaacaaatg

SEQ ID NO: 632274 - DNA, 13 bp, D. melanogaster
ggccaaacaaatt

SEQ ID NO: 632275 - DNA, 13 bp, D. melanogaster
ggccaaacacaaa

SEQ ID NO: 632276 - DNA, 13 bp, D. melanogaster
ggccaaacagaaa

SEQ ID NO: 632277 - DNA, 13 bp, D. melanogaster
ggccaaacatttg

SEQ ID NO: 632278 - DNA, 13 bp, D. melanogaster
ggccaaacggcgg

SEQ ID NO: 632279 - DNA, 13 bp, D. melanogaster
ggccaaactgatt

SEQ ID NO: 632280 - DNA, 13 bp, D. melanogaster
ggccaaacttttt

SEQ ID NO: 632281 - DNA, 13 bp, D. melanogaster
ggccaaagccaaa

SEQ ID NO: 632282 - DNA, 13 bp, D. melanogaster
ggccaaagcgaaa

SEQ ID NO: 632283 - DNA, 13 bp, D. melanogaster
ggccaaaggcagc

SEQ ID NO: 632284 - DNA, 13 bp, D. melanogaster
ggccaaaggcatt

SEQ ID NO: 632285 - DNA, 13 bp, D. melanogaster
ggccaaagtgcaa

SEQ ID NO: 632286 - DNA, 13 bp, D. melanogaster
ggccaaagtgttt

SEQ ID NO: 632287 - DNA, 13 bp, D. melanogaster
ggccaaagttttc

SEQ ID NO: 632288 - DNA, 13 bp, D. melanogaster
ggccaaataacaa

SEQ ID NO: 632289 - DNA, 13 bp, D. melanogaster
ggccaaatcaatt

SEQ ID NO: 632290 - DNA, 13 bp, D. melanogaster
ggccaaatcagct

SEQ ID NO: 632291 - DNA, 13 bp, D. melanogaster
ggccaaatcgaaa

SEQ ID NO: 632292 - DNA, 13 bp, D. melanogaster
ggccaaatgcaat

SEQ ID NO: 632293 - DNA, 13 bp, D. melanogaster
ggccaaatgcttg

SEQ ID NO: 632294 - DNA, 13 bp, D. melanogaster
ggccaaatggagg

SEQ ID NO: 632295 - DNA, 13 bp, D. melanogaster
ggccaaatggcaa

SEQ ID NO: 632296 - DNA, 13 bp, D. melanogaster
ggccaaatggcat

SEQ ID NO: 632297 - DNA, 14 bp, D. melanogaster
ggccaaatggcatt

SEQ ID NO: 632298 - DNA, 13 bp, D. melanogaster
ggccaaatgggaa

SEQ ID NO: 632299 - DNA, 13 bp, D. melanogaster
ggccaaatgtgtt

SEQ ID NO: 632300 - DNA, 13 bp, D. melanogaster
ggccaaattaaat

SEQ ID NO: 632301 - DNA, 13 bp, D. melanogaster
ggccaaattgaat

SEQ ID NO: 632302 - DNA, 13 bp, D. melanogaster
ggccaacaaaaat

SEQ ID NO: 632303 - DNA, 13 bp, D. melanogaster
ggccaacaaaatg

SEQ ID NO: 632304 - DNA, 13 bp, D. melanogaster
ggccaacaaacaa

SEQ ID NO: 632305 - DNA, 13 bp, D. melanogaster
ggccaacaaacac

SEQ ID NO: 632306 - DNA, 13 bp, D. melanogaster
ggccaacaaatgc

SEQ ID NO: 632307 - DNA, 13 bp, D. melanogaster
ggccaacaaattg

SEQ ID NO: 632308 - DNA, 13 bp, D. melanogaster
ggccaacaacaaa

SEQ ID NO: 632309 - DNA, 13 bp, D. melanogaster
ggccaacaacaac

SEQ ID NO: 632310 - DNA, 14 bp, D. melanogaster
ggccaacaacaaca

SEQ ID NO: 632311 - DNA, 13 bp, D. melanogaster
ggccaacaacagc

SEQ ID NO: 632312 - DNA, 13 bp, D. melanogaster
ggccaacaatgtt

SEQ ID NO: 632313 - DNA, 13 bp, D. melanogaster
ggccaacagagtg

SEQ ID NO: 632314 - DNA, 13 bp, D. melanogaster
ggccaacagcagc

SEQ ID NO: 632315 - DNA, 13 bp, D. melanogaster
ggccaacagctgc

SEQ ID NO: 632316 - DNA, 13 bp, D. melanogaster
ggccaacatgatc

SEQ ID NO: 632317 - DNA, 13 bp, D. melanogaster
ggccaaccaacca

SEQ ID NO: 632318 - DNA, 13 bp, D. melanogaster
ggccaacgaaaaa

SEQ ID NO: 632319 - DNA, 13 bp, D. melanogaster
ggccaacgaaaat

SEQ ID NO: 632320 - DNA, 13 bp, D. melanogaster
ggccaacgcggcg

SEQ ID NO: 632321 - DNA, 13 bp, D. melanogaster
ggccaacgctgcg

SEQ ID NO: 632322 - DNA, 13 bp, D. melanogaster
ggccaacggggcg

SEQ ID NO: 632323 - DNA, 13 bp, D. melanogaster
ggccaactgcagc

SEQ ID NO: 632324 - DNA, 13 bp, D. melanogaster
ggccaacttaatg

SEQ ID NO: 632325 - DNA, 13 bp, D. melanogaster
ggccaacttcctt

SEQ ID NO: 632326 - DNA, 13 bp, D. melanogaster
ggccaacttttca

SEQ ID NO: 632327 - DNA, 13 bp, D. melanogaster
ggccaagaaaaca

SEQ ID NO: 632328 - DNA, 13 bp, D. melanogaster
ggccaagaaaagc

SEQ ID NO: 632329 - DNA, 13 bp, D. melanogaster
ggccaagaaacaa

SEQ ID NO: 632330 - DNA, 13 bp, D. melanogaster
ggccaagaaattg

SEQ ID NO: 632331 - DNA, 13 bp, D. melanogaster
ggccaagaaattt

SEQ ID NO: 632332 - DNA, 13 bp, D. melanogaster
ggccaagaacaaa

SEQ ID NO: 632333 - DNA, 13 bp, D. melanogaster
ggccaagaagaag

SEQ ID NO: 632334 - DNA, 13 bp, D. melanogaster
ggccaagaatttt

SEQ ID NO: 632335 - DNA, 13 bp, D. melanogaster
ggccaagacaatg

SEQ ID NO: 632336 - DNA, 13 bp, D. melanogaster
ggccaagacggcg

SEQ ID NO: 632337 - DNA, 13 bp, D. melanogaster
ggccaagatttat

SEQ ID NO: 632338 - DNA, 13 bp, D. melanogaster
ggccaagcagagt

SEQ ID NO: 632339 - DNA, 13 bp, D. melanogaster
ggccaagccaaaa

SEQ ID NO: 632340 - DNA, 13 bp, D. melanogaster
ggccaagccaagc

SEQ ID NO: 632341 - DNA, 13 bp, D. melanogaster
ggccaaggaattt

SEQ ID NO: 632342 - DNA, 13 bp, D. melanogaster
ggccaaggagcag

SEQ ID NO: 632343 - DNA, 13 bp, D. melanogaster
ggccaaggttttt

SEQ ID NO: 632344 - DNA, 13 bp, D. melanogaster
ggccaagtcaaag

SEQ ID NO: 632345 - DNA, 13 bp, D. melanogaster
ggccaagtcaagt

SEQ ID NO: 632346 - DNA, 13 bp, D. melanogaster
ggccaagtgaaat

SEQ ID NO: 632347 - DNA, 13 bp, D. melanogaster
ggccaagtgccag

SEQ ID NO: 632348 - DNA, 13 bp, D. melanogaster
ggccaagtggcag

SEQ ID NO: 632349 - DNA, 13 bp, D. melanogaster
ggccaagtggctg

SEQ ID NO: 632350 - DNA, 13 bp, D. melanogaster
ggccaagtgggtg

SEQ ID NO: 632351 - DNA, 14 bp, D. melanogaster
ggccaagtgggtgg

SEQ ID NO: 632352 - DNA, 13 bp, D. melanogaster
ggccaagtgtttg

SEQ ID NO: 632353 - DNA, 13 bp, D. melanogaster
ggccaagttaatg

SEQ ID NO: 632354 - DNA, 13 bp, D. melanogaster
ggccaagttgttg

SEQ ID NO: 632355 - DNA, 13 bp, D. melanogaster
ggccaagttgttt

SEQ ID NO: 632356 - DNA, 13 bp, D. melanogaster
ggccaataaatta

SEQ ID NO: 632357 - DNA, 13 bp, D. melanogaster
ggccaataaattt

SEQ ID NO: 632358 - DNA, 14 bp, D. melanogaster
ggccaataattttg

SEQ ID NO: 632359 - DNA, 13 bp, D. melanogaster
ggccaatatggac

SEQ ID NO: 632360 - DNA, 13 bp, D. melanogaster
ggccaatcaaagt

SEQ ID NO: 632361 - DNA, 13 bp, D. melanogaster
ggccaattggcaa

SEQ ID NO: 632362 - DNA, 13 bp, D. melanogaster
ggccaattggcca

SEQ ID NO: 632363 - DNA, 13 bp, D. melanogaster
ggccaatttgttt

SEQ ID NO: 632364 - DNA, 13 bp, D. melanogaster
ggccacaaaaaac

SEQ ID NO: 632365 - DNA, 13 bp, D. melanogaster
ggccacaaaaact

SEQ ID NO: 632366 - DNA, 13 bp, D. melanogaster
ggccacaaaaata

SEQ ID NO: 632367 - DNA, 13 bp, D. melanogaster
ggccacaaaaatt

SEQ ID NO: 632368 - DNA, 13 bp, D. melanogaster
ggccacaaaacca

SEQ ID NO: 632369 - DNA, 13 bp, D. melanogaster
ggccacaaaaggc

SEQ ID NO: 632370 - DNA, 13 bp, D. melanogaster
ggccacaaaataa

SEQ ID NO: 632371 - DNA, 13 bp, D. melanogaster
ggccacaaacaaa

SEQ ID NO: 632372 - DNA, 13 bp, D. melanogaster
ggccacaacaaca

SEQ ID NO: 632373 - DNA, 13 bp, D. melanogaster
ggccacaatgtgt

SEQ ID NO: 632374 - DNA, 13 bp, D. melanogaster
ggccacacaaaaa

SEQ ID NO: 632375 - DNA, 14 bp, D. melanogaster
ggccacacacacac

SEQ ID NO: 632376 - DNA, 13 bp, D. melanogaster
ggccacaccaagg

SEQ ID NO: 632377 - DNA, 13 bp, D. melanogaster
ggccacatgaaaa

SEQ ID NO: 632378 - DNA, 13 bp, D. melanogaster
ggccacatttaaa

SEQ ID NO: 632379 - DNA, 13 bp, D. melanogaster
ggccaccaactcc

SEQ ID NO: 632380 - DNA, 13 bp, D. melanogaster
ggccaccgaaaaa

SEQ ID NO: 632381 - DNA, 13 bp, D. melanogaster
ggccaccgaatgg

SEQ ID NO: 632382 - DNA, 13 bp, D. melanogaster
ggccacgagttca

SEQ ID NO: 632383 - DNA, 14 bp, D. melanogaster
ggccacgcccacac

SEQ ID NO: 632384 - DNA, 14 bp, D. melanogaster
ggccacgcccactt

SEQ ID NO: 632385 - DNA, 13 bp, D. melanogaster
ggccacgcccatt

SEQ ID NO: 632386 - DNA, 14 bp, D. melanogaster
ggccacgcccccaa

SEQ ID NO: 632387 - DNA, 13 bp, D. melanogaster
ggccacgccccct

SEQ ID NO: 632388 - DNA, 14 bp, D. melanogaster
ggccacgccccctg

SEQ ID NO: 632389 - DNA, 13 bp, D. melanogaster
ggccacgcccctc

SEQ ID NO: 632390 - DNA, 13 bp, D. melanogaster
ggccacgcccctt

SEQ ID NO: 632391 - DNA, 13 bp, D. melanogaster
ggccacggttcca

SEQ ID NO: 632392 - DNA, 13 bp, D. melanogaster
ggccactcaaatt

SEQ ID NO: 632393 - DNA, 13 bp, D. melanogaster
ggccacttggcca

SEQ ID NO: 632394 - DNA, 14 bp, D. melanogaster
ggccagaagctttt

SEQ ID NO: 632395 - DNA, 13 bp, D. melanogaster
ggccagacaaaag

SEQ ID NO: 632396 - DNA, 13 bp, D. melanogaster
ggccagcaaaaaa

SEQ ID NO: 632397 - DNA, 13 bp, D. melanogaster
ggccagcaaaaac

SEQ ID NO: 632398 - DNA, 13 bp, D. melanogaster
ggccagcaaacaa

SEQ ID NO: 632399 - DNA, 14 bp, D. melanogaster
ggccagcaacaaca

SEQ ID NO: 632400 - DNA, 13 bp, D. melanogaster
ggccagcaacttt

SEQ ID NO: 632401 - DNA, 14 bp, D. melanogaster
ggccagcaagctga

SEQ ID NO: 632402 - DNA, 13 bp, D. melanogaster
ggccagcagaaaa

SEQ ID NO: 632403 - DNA, 13 bp, D. melanogaster
ggccagccagcca

SEQ ID NO: 632404 - DNA, 14 bp, D. melanogaster
ggccagccagccag

SEQ ID NO: 632405 - DNA, 13 bp, D. melanogaster
ggccagcggcaaa

SEQ ID NO: 632406 - DNA, 14 bp, D. melanogaster
ggccagcggccagc

SEQ ID NO: 632407 - DNA, 13 bp, D. melanogaster
ggccagctccttt

SEQ ID NO: 632408 - DNA, 13 bp, D. melanogaster
ggccagctgaaaa

SEQ ID NO: 632409 - DNA, 13 bp, D. melanogaster
ggccaggaaactg

SEQ ID NO: 632410 - DNA, 14 bp, D. melanogaster
ggccaggaaactgc

SEQ ID NO: 632411 - DNA, 13 bp, D. melanogaster
ggccaggacaatg

SEQ ID NO: 632412 - DNA, 13 bp, D. melanogaster
ggccaggacattc

SEQ ID NO: 632413 - DNA, 13 bp, D. melanogaster
ggccaggacgaaa

SEQ ID NO: 632414 - DNA, 13 bp, D. melanogaster
ggccaggccaaaa

SEQ ID NO: 632415 - DNA, 14 bp, D. melanogaster
ggccaggccaaaaa

SEQ ID NO: 632416 - DNA, 13 bp, D. melanogaster
ggccaggccaact

SEQ ID NO: 632417 - DNA, 13 bp, D. melanogaster
ggccaggccagca

SEQ ID NO: 632418 - DNA, 14 bp, D. melanogaster
ggccaggccaggcc

SEQ ID NO: 632419 - DNA, 13 bp, D. melanogaster
ggccaggcccaaa

SEQ ID NO: 632420 - DNA, 13 bp, D. melanogaster
ggccagggagcga

SEQ ID NO: 632421 - DNA, 14 bp, D. melanogaster
ggccagggagcgaa

SEQ ID NO: 632422 - DNA, 13 bp, D. melanogaster
ggccaggtcgcac

SEQ ID NO: 632423 - DNA, 13 bp, D. melanogaster
ggccaggttaaaa

SEQ ID NO: 632424 - DNA, 13 bp, D. melanogaster
ggccagtggccac

SEQ ID NO: 632425 - DNA, 13 bp, D. melanogaster
ggccataaaaagc

SEQ ID NO: 632426 - DNA, 13 bp, D. melanogaster
ggccataaaaatg

SEQ ID NO: 632427 - DNA, 14 bp, D. melanogaster
ggccataaaaatgg

SEQ ID NO: 632428 - DNA, 13 bp, D. melanogaster
ggccataaaacaa

SEQ ID NO: 632429 - DNA, 13 bp, D. melanogaster
ggccataaaacac

SEQ ID NO: 632430 - DNA, 13 bp, D. melanogaster
ggccataaaacgc

SEQ ID NO: 632431 - DNA, 13 bp, D. melanogaster
ggccataaaagtg

SEQ ID NO: 632432 - DNA, 13 bp, D. melanogaster
ggccataaacaac

SEQ ID NO: 632433 - DNA, 13 bp, D. melanogaster
ggccataaaccaa

SEQ ID NO: 632434 - DNA, 13 bp, D. melanogaster
ggccataaataaa

SEQ ID NO: 632435 - DNA, 13 bp, D. melanogaster
ggccataaatatt

SEQ ID NO: 632436 - DNA, 13 bp, D. melanogaster
ggccataaatcat

SEQ ID NO: 632437 - DNA, 13 bp, D. melanogaster
ggccataaatctt

SEQ ID NO: 632438 - DNA, 13 bp, D. melanogaster
ggccataaattcc

SEQ ID NO: 632439 - DNA, 13 bp, D. melanogaster
ggccataaattgt

SEQ ID NO: 632440 - DNA, 13 bp, D. melanogaster
ggccataacaata

SEQ ID NO: 632441 - DNA, 13 bp, D. melanogaster
ggccataataaat

SEQ ID NO: 632442 - DNA, 13 bp, D. melanogaster
ggccataattaaa

SEQ ID NO: 632443 - DNA, 13 bp, D. melanogaster
ggccatagaaatt

SEQ ID NO: 632444 - DNA, 13 bp, D. melanogaster
ggccatcaatcaa

SEQ ID NO: 632445 - DNA, 13 bp, D. melanogaster
ggccatcaatcag

SEQ ID NO: 632446 - DNA, 14 bp, D. melanogaster
ggccatcatcatca

SEQ ID NO: 632447 - DNA, 13 bp, D. melanogaster
ggccatctggcgg

SEQ ID NO: 632448 - DNA, 13 bp, D. melanogaster
ggccatgcaaatg

SEQ ID NO: 632449 - DNA, 13 bp, D. melanogaster
ggccatggccaaa

SEQ ID NO: 632450 - DNA, 13 bp, D. melanogaster
ggccatggccaat

SEQ ID NO: 632451 - DNA, 13 bp, D. melanogaster
ggccatgtttatt

SEQ ID NO: 632452 - DNA, 13 bp, D. melanogaster
ggccattaaaaaa

SEQ ID NO: 632453 - DNA, 13 bp, D. melanogaster
ggccattaaaacc

SEQ ID NO: 632454 - DNA, 13 bp, D. melanogaster
ggccattacctct

SEQ ID NO: 632455 - DNA, 13 bp, D. melanogaster
ggccattcaggaa

SEQ ID NO: 632456 - DNA, 13 bp, D. melanogaster
ggccatttaattt

SEQ ID NO: 632457 - DNA, 13 bp, D. melanogaster
ggccatttacttt

SEQ ID NO: 632458 - DNA, 13 bp, D. melanogaster
ggccatttccatt

SEQ ID NO: 632459 - DNA, 13 bp, D. melanogaster
ggccatttggcaa

SEQ ID NO: 632460 - DNA, 13 bp, D. melanogaster
ggccatttggcca

SEQ ID NO: 632461 - DNA, 13 bp, D. melanogaster
ggccatttgttat

SEQ ID NO: 632462 - DNA, 13 bp, D. melanogaster
ggccatttttcgc

SEQ ID NO: 632463 - DNA, 13 bp, D. melanogaster
ggcccaaaaacaa

SEQ ID NO: 632464 - DNA, 13 bp, D. melanogaster
ggcccaaaaagat

SEQ ID NO: 632465 - DNA, 14 bp, D. melanogaster
ggcccaaaaagata

SEQ ID NO: 632466 - DNA, 13 bp, D. melanogaster
ggcccaaaacttt

SEQ ID NO: 632467 - DNA, 13 bp, D. melanogaster
ggcccaaaagaaa

SEQ ID NO: 632468 - DNA, 13 bp, D. melanogaster
ggcccaaaagcga

SEQ ID NO: 632469 - DNA, 13 bp, D. melanogaster
ggcccaaacaatg

SEQ ID NO: 632470 - DNA, 13 bp, D. melanogaster
ggcccaaaccgaa

SEQ ID NO: 632471 - DNA, 13 bp, D. melanogaster
ggcccaaactatg

SEQ ID NO: 632472 - DNA, 13 bp, D. melanogaster
ggcccaaagcaaa

SEQ ID NO: 632473 - DNA, 13 bp, D. melanogaster
ggcccaaataaat

SEQ ID NO: 632474 - DNA, 14 bp, D. melanogaster
ggcccaactaatta

SEQ ID NO: 632475 - DNA, 13 bp, D. melanogaster
ggcccaagaacgc

SEQ ID NO: 632476 - DNA, 13 bp, D. melanogaster
ggcccactgtgcg

SEQ ID NO: 632477 - DNA, 13 bp, D. melanogaster
ggcccagccacct

SEQ ID NO: 632478 - DNA, 13 bp, D. melanogaster
ggcccataaatta

SEQ ID NO: 632479 - DNA, 13 bp, D. melanogaster
ggccccaaaaaaa

SEQ ID NO: 632480 - DNA, 13 bp, D. melanogaster
ggcccccacatcc

SEQ ID NO: 632481 - DNA, 14 bp, D. melanogaster
ggcccgaatggagt

SEQ ID NO: 632482 - DNA, 13 bp, D. melanogaster
ggccgaaaaagaa

SEQ ID NO: 632483 - DNA, 13 bp, D. melanogaster
ggccgaaatcaat

SEQ ID NO: 632484 - DNA, 13 bp, D. melanogaster
ggccgacagtttg

SEQ ID NO: 632485 - DNA, 14 bp, D. melanogaster
ggccgatggcatta

SEQ ID NO: 632486 - DNA, 13 bp, D. melanogaster
ggccgcaggacat

SEQ ID NO: 632487 - DNA, 13 bp, D. melanogaster
ggccgtaacaaca

SEQ ID NO: 632488 - DNA, 13 bp, D. melanogaster
ggccgtccatcac

SEQ ID NO: 632489 - DNA, 13 bp, D. melanogaster
ggccgtcgagcca

SEQ ID NO: 632490 - DNA, 13 bp, D. melanogaster
ggccgttacgcat

SEQ ID NO: 632491 - DNA, 13 bp, D. melanogaster
ggcctaaacgttt

SEQ ID NO: 632492 - DNA, 14 bp, D. melanogaster
ggcctccaccaatt

SEQ ID NO: 632493 - DNA, 13 bp, D. melanogaster
ggcctcgcttttc

SEQ ID NO: 632494 - DNA, 13 bp, D. melanogaster
ggcctctgttata

SEQ ID NO: 632495 - DNA, 13 bp, D. melanogaster
ggcctgatcagcc

SEQ ID NO: 632496 - DNA, 13 bp, D. melanogaster
ggcctgcaagtag

SEQ ID NO: 632497 - DNA, 13 bp, D. melanogaster
ggcctggccaaaa

SEQ ID NO: 632498 - DNA, 14 bp, D. melanogaster
ggcctggccaaaaa

SEQ ID NO: 632499 - DNA, 13 bp, D. melanogaster
ggcctggccaagt

SEQ ID NO: 632500 - DNA, 13 bp, D. melanogaster
ggccttattgaca

SEQ ID NO: 632501 - DNA, 15 bp, D. melanogaster
ggccttcttctcggt

SEQ ID NO: 632502 - DNA, 13 bp, D. melanogaster
ggcctttgtttgc

SEQ ID NO: 632503 - DNA, 13 bp, D. melanogaster
ggcctttttgaat

SEQ ID NO: 632504 - DNA, 13 bp, D. melanogaster
ggcctttttgtaa

SEQ ID NO: 632505 - DNA, 13 bp, D. melanogaster
ggcgaaaaaatcg

SEQ ID NO: 632506 - DNA, 13 bp, D. melanogaster
ggcgaaaaacaat

SEQ ID NO: 632507 - DNA, 13 bp, D. melanogaster
ggcgaaaaacttt

SEQ ID NO: 632508 - DNA, 13 bp, D. melanogaster
ggcgaaaaagttt

SEQ ID NO: 632509 - DNA, 14 bp, D. melanogaster
ggcgaaaaatcaaa

SEQ ID NO: 632510 - DNA, 13 bp, D. melanogaster
ggcgaaaaatgca

SEQ ID NO: 632511 - DNA, 13 bp, D. melanogaster
ggcgaaaacaaag

SEQ ID NO: 632512 - DNA, 13 bp, D. melanogaster
ggcgaaaagaaat

SEQ ID NO: 632513 - DNA, 13 bp, D. melanogaster
ggcgaaaagcgaa

SEQ ID NO: 632514 - DNA, 14 bp, D. melanogaster
ggcgaaaagtgaaa

SEQ ID NO: 632515 - DNA, 13 bp, D. melanogaster
ggcgaaaagtggg

SEQ ID NO: 632516 - DNA, 13 bp, D. melanogaster
ggcgaaaataaat

SEQ ID NO: 632517 - DNA, 14 bp, D. melanogaster
ggcgaaaataaata

SEQ ID NO: 632518 - DNA, 13 bp, D. melanogaster
ggcgaaaatgcga

SEQ ID NO: 632519 - DNA, 13 bp, D. melanogaster
ggcgaaacaacaa

SEQ ID NO: 632520 - DNA, 13 bp, D. melanogaster
ggcgaaacttttg

SEQ ID NO: 632521 - DNA, 13 bp, D. melanogaster
ggcgaaagagatg

SEQ ID NO: 632522 - DNA, 13 bp, D. melanogaster
ggcgaaagcaaaa

SEQ ID NO: 632523 - DNA, 13 bp, D. melanogaster
ggcgaaagccaaa

SEQ ID NO: 632524 - DNA, 13 bp, D. melanogaster
ggcgaaaggcaaa

SEQ ID NO: 632525 - DNA, 14 bp, D. melanogaster
ggcgaaagtaataa

SEQ ID NO: 632526 - DNA, 13 bp, D. melanogaster
ggcgaaagttttg

SEQ ID NO: 632527 - DNA, 13 bp, D. melanogaster
ggcgaaatggaaa

SEQ ID NO: 632528 - DNA, 13 bp, D. melanogaster
ggcgaaatttttg

SEQ ID NO: 632529 - DNA, 13 bp, D. melanogaster
ggcgaacaaaaac

SEQ ID NO: 632530 - DNA, 13 bp, D. melanogaster
ggcgaacaacaaa

SEQ ID NO: 632531 - DNA, 13 bp, D. melanogaster
ggcgaactgcatc

SEQ ID NO: 632532 - DNA, 13 bp, D. melanogaster
ggcgaagagttga

SEQ ID NO: 632533 - DNA, 13 bp, D. melanogaster
ggcgaaggggcgt

SEQ ID NO: 632534 - DNA, 14 bp, D. melanogaster
ggcgaagtgtacaa

SEQ ID NO: 632535 - DNA, 13 bp, D. melanogaster
ggcgaatgcgaat

SEQ ID NO: 632536 - DNA, 13 bp, D. melanogaster
ggcgaatggaaaa

SEQ ID NO: 632537 - DNA, 13 bp, D. melanogaster
ggcgaatggcaaa

SEQ ID NO: 632538 - DNA, 13 bp, D. melanogaster
ggcgacaacaaca

SEQ ID NO: 632539 - DNA, 14 bp, D. melanogaster
ggcgacaacaacaa

SEQ ID NO: 632540 - DNA, 13 bp, D. melanogaster
ggcgacaacgaca

SEQ ID NO: 632541 - DNA, 13 bp, D. melanogaster
ggcgacacacaca

SEQ ID NO: 632542 - DNA, 13 bp, D. melanogaster
ggcgacactattt

SEQ ID NO: 632543 - DNA, 13 bp, D. melanogaster
ggcgacatgggtg

SEQ ID NO: 632544 - DNA, 14 bp, D. melanogaster
ggcgacgacgacga

SEQ ID NO: 632545 - DNA, 13 bp, D. melanogaster
ggcgacgtcgacg

SEQ ID NO: 632546 - DNA, 13 bp, D. melanogaster
ggcgactacaacg

SEQ ID NO: 632547 - DNA, 13 bp, D. melanogaster
ggcgactgcgacg

SEQ ID NO: 632548 - DNA, 13 bp, D. melanogaster
ggcgagagcgaga

SEQ ID NO: 632549 - DNA, 13 bp, D. melanogaster
ggcgagcaaacaa

SEQ ID NO: 632550 - DNA, 13 bp, D. melanogaster
ggcgagcataatt

SEQ ID NO: 632551 - DNA, 13 bp, D. melanogaster
ggcgagcgagcga

SEQ ID NO: 632552 - DNA, 13 bp, D. melanogaster
ggcgaggaaaatg

SEQ ID NO: 632553 - DNA, 13 bp, D. melanogaster
ggcgagtgtgtgt

SEQ ID NO: 632554 - DNA, 13 bp, D. melanogaster
ggcgataagaaat

SEQ ID NO: 632555 - DNA, 13 bp, D. melanogaster
ggcgatgacgatg

SEQ ID NO: 632556 - DNA, 14 bp, D. melanogaster
ggcgatgacgatga

SEQ ID NO: 632557 - DNA, 14 bp, D. melanogaster
ggcgatggcaatgg

SEQ ID NO: 632558 - DNA, 13 bp, D. melanogaster
ggcgatggcgatg

SEQ ID NO: 632559 - DNA, 14 bp, D. melanogaster
ggcgatggcgatga

SEQ ID NO: 632560 - DNA, 13 bp, D. melanogaster
ggcgatggcgttg

SEQ ID NO: 632561 - DNA, 13 bp, D. melanogaster
ggcgatgggcgat

SEQ ID NO: 632562 - DNA, 13 bp, D. melanogaster
ggcgatgggcggt

SEQ ID NO: 632563 - DNA, 14 bp, D. melanogaster
ggcgatgggcggtg

SEQ ID NO: 632564 - DNA, 13 bp, D. melanogaster
ggcgatggggatg

SEQ ID NO: 632565 - DNA, 13 bp, D. melanogaster
ggcgatgggtggt

SEQ ID NO: 632566 - DNA, 13 bp, D. melanogaster
ggcgatggtgatg

SEQ ID NO: 632567 - DNA, 13 bp, D. melanogaster
ggcgatttctggt

SEQ ID NO: 632568 - DNA, 13 bp, D. melanogaster
ggcgatttgttgc

SEQ ID NO: 632569 - DNA, 14 bp, D. melanogaster
ggcgattttaacaa

SEQ ID NO: 632570 - DNA, 14 bp, D. melanogaster
ggcgattttcttgg

SEQ ID NO: 632571 - DNA, 13 bp, D. melanogaster
ggcgcaaaagttt

SEQ ID NO: 632572 - DNA, 13 bp, D. melanogaster
ggcgcaaacatat

SEQ ID NO: 632573 - DNA, 13 bp, D. melanogaster
ggcgcacaaaaaa

SEQ ID NO: 632574 - DNA, 13 bp, D. melanogaster
ggcgcacaattaa

SEQ ID NO: 632575 - DNA, 13 bp, D. melanogaster
ggcgcacatggcg

SEQ ID NO: 632576 - DNA, 13 bp, D. melanogaster
ggcgcacgcacac

SEQ ID NO: 632577 - DNA, 13 bp, D. melanogaster
ggcgcagaggaaa

SEQ ID NO: 632578 - DNA, 13 bp, D. melanogaster
ggcgcagcgcaga

SEQ ID NO: 632579 - DNA, 13 bp, D. melanogaster
ggcgcagtcgcag

SEQ ID NO: 632580 - DNA, 14 bp, D. melanogaster
ggcgcagtcgcagt

SEQ ID NO: 632581 - DNA, 13 bp, D. melanogaster
ggcgcagttttaa

SEQ ID NO: 632582 - DNA, 13 bp, D. melanogaster
ggcgcatgcgcaa

SEQ ID NO: 632583 - DNA, 13 bp, D. melanogaster
ggcgccacaaaaa

SEQ ID NO: 632584 - DNA, 13 bp, D. melanogaster
ggcgccaggtgcg

SEQ ID NO: 632585 - DNA, 13 bp, D. melanogaster
ggcgccatttgac

SEQ ID NO: 632586 - DNA, 13 bp, D. melanogaster
ggcgccgtctgca

SEQ ID NO: 632587 - DNA, 13 bp, D. melanogaster
ggcgcctaaattg

SEQ ID NO: 632588 - DNA, 13 bp, D. melanogaster
ggcgcgaaagaga

SEQ ID NO: 632589 - DNA, 13 bp, D. melanogaster
ggcgcgagtgtca

SEQ ID NO: 632590 - DNA, 13 bp, D. melanogaster
ggcgcggcaaaaa

SEQ ID NO: 632591 - DNA, 13 bp, D. melanogaster
ggcgcgggcacac

SEQ ID NO: 632592 - DNA, 13 bp, D. melanogaster
ggcgcgtgtgtgt

SEQ ID NO: 632593 - DNA, 14 bp, D. melanogaster
ggcgctgagcaact

SEQ ID NO: 632594 - DNA, 13 bp, D. melanogaster
ggcgctgcgaaaa

SEQ ID NO: 632595 - DNA, 13 bp, D. melanogaster
ggcgctgctgctg

SEQ ID NO: 632596 - DNA, 13 bp, D. melanogaster
ggcgcttgagcga

SEQ ID NO: 632597 - DNA, 13 bp, D. melanogaster
ggcggaaaaatgg

SEQ ID NO: 632598 - DNA, 13 bp, D. melanogaster
ggcggaaaacaaa

SEQ ID NO: 632599 - DNA, 13 bp, D. melanogaster
ggcggaaaagcag

SEQ ID NO: 632600 - DNA, 13 bp, D. melanogaster
ggcggaaaagcca

SEQ ID NO: 632601 - DNA, 13 bp, D. melanogaster
ggcggaaaagcga

SEQ ID NO: 632602 - DNA, 13 bp, D. melanogaster
ggcggaaaagcgg

SEQ ID NO: 632603 - DNA, 13 bp, D. melanogaster
ggcggaaaagtgg

SEQ ID NO: 632604 - DNA, 13 bp, D. melanogaster
ggcggaaaattca

SEQ ID NO: 632605 - DNA, 13 bp, D. melanogaster
ggcggaaacggaa

SEQ ID NO: 632606 - DNA, 14 bp, D. melanogaster
ggcggaaacggaag

SEQ ID NO: 632607 - DNA, 13 bp, D. melanogaster
ggcggaaattaaa

SEQ ID NO: 632608 - DNA, 13 bp, D. melanogaster
ggcggacaaacaa

SEQ ID NO: 632609 - DNA, 13 bp, D. melanogaster
ggcggagcagcag

SEQ ID NO: 632610 - DNA, 13 bp, D. melanogaster
ggcggatgaacga

SEQ ID NO: 632611 - DNA, 13 bp, D. melanogaster
ggcggcaaaaaaa

SEQ ID NO: 632612 - DNA, 13 bp, D. melanogaster
ggcggcaaaaggg

SEQ ID NO: 632613 - DNA, 13 bp, D. melanogaster
ggcggcaaaagtt

SEQ ID NO: 632614 - DNA, 13 bp, D. melanogaster
ggcggcaacaaaa

SEQ ID NO: 632615 - DNA, 13 bp, D. melanogaster
ggcggcaacaaca

SEQ ID NO: 632616 - DNA, 14 bp, D. melanogaster
ggcggcaacaacaa

SEQ ID NO: 632617 - DNA, 13 bp, D. melanogaster
ggcggcaactttt

SEQ ID NO: 632618 - DNA, 13 bp, D. melanogaster
ggcggcaagaaaa

SEQ ID NO: 632619 - DNA, 13 bp, D. melanogaster
ggcggcaattatg

SEQ ID NO: 632620 - DNA, 13 bp, D. melanogaster
ggcggcactcgca

SEQ ID NO: 632621 - DNA, 13 bp, D. melanogaster
ggcggcagcaaca

SEQ ID NO: 632622 - DNA, 14 bp, D. melanogaster
ggcggcagcagcag

SEQ ID NO: 632623 - DNA, 13 bp, D. melanogaster
ggcggccaaaaaa

SEQ ID NO: 632624 - DNA, 13 bp, D. melanogaster
ggcggccattttg

SEQ ID NO: 632625 - DNA, 13 bp, D. melanogaster
ggcggcgcagtcg

SEQ ID NO: 632626 - DNA, 13 bp, D. melanogaster
ggcggcggcaaaa

SEQ ID NO: 632627 - DNA, 13 bp, D. melanogaster
ggcggctcttcaa

SEQ ID NO: 632628 - DNA, 13 bp, D. melanogaster
ggcggcttaaaaa

SEQ ID NO: 632629 - DNA, 13 bp, D. melanogaster
ggcgggaaaactg

SEQ ID NO: 632630 - DNA, 13 bp, D. melanogaster
ggcgggaaaagcg

SEQ ID NO: 632631 - DNA, 13 bp, D. melanogaster
ggcggggaaagat

SEQ ID NO: 632632 - DNA, 13 bp, D. melanogaster
ggcggggcaaaaa

SEQ ID NO: 632633 - DNA, 13 bp, D. melanogaster
ggcggtccaatac

SEQ ID NO: 632634 - DNA, 14 bp, D. melanogaster
ggcggtgccaccgt

SEQ ID NO: 632635 - DNA, 13 bp, D. melanogaster
ggcggtggaaaaa

SEQ ID NO: 632636 - DNA, 13 bp, D. melanogaster
ggcggtggaaaat

SEQ ID NO: 632637 - DNA, 13 bp, D. melanogaster
ggcggtggcaaat

SEQ ID NO: 632638 - DNA, 13 bp, D. melanogaster
ggcggtggcagtg

SEQ ID NO: 632639 - DNA, 14 bp, D. melanogaster
ggcgtatacgcaac

SEQ ID NO: 632640 - DNA, 14 bp, D. melanogaster
ggcgtatacgcaat

SEQ ID NO: 632641 - DNA, 14 bp, D. melanogaster
ggcgtatacgcgat

SEQ ID NO: 632642 - DNA, 14 bp, D. melanogaster
ggcgtatacgtaat

SEQ ID NO: 632643 - DNA, 14 bp, D. melanogaster
ggcgtatacgtgat

SEQ ID NO: 632644 - DNA, 14 bp, D. melanogaster
ggcgtatacttaat

SEQ ID NO: 632645 - DNA, 14 bp, D. melanogaster
ggcgtatacttgat

SEQ ID NO: 632646 - DNA, 14 bp, D. melanogaster
ggcgtatgagcaat

SEQ ID NO: 632647 - DNA, 14 bp, D. melanogaster
ggcgtatgagcgat

SEQ ID NO: 632648 - DNA, 14 bp, D. melanogaster
ggcgtatgagtaat

SEQ ID NO: 632649 - DNA, 13 bp, D. melanogaster
ggcgtatgcgcaa

SEQ ID NO: 632650 - DNA, 14 bp, D. melanogaster
ggcgtatgcgcaac

SEQ ID NO: 632651 - DNA, 14 bp, D. melanogaster
ggcgtatgcgcaat

SEQ ID NO: 632652 - DNA, 14 bp, D. melanogaster
ggcgtatgcgtaat

SEQ ID NO: 632653 - DNA, 14 bp, D. melanogaster
ggcgtatgcgttat

SEQ ID NO: 632654 - DNA, 14 bp, D. melanogaster
ggcgtatgcttgat

SEQ ID NO: 632655 - DNA, 13 bp, D. melanogaster
ggcgtatgtgcaa

SEQ ID NO: 632656 - DNA, 14 bp, D. melanogaster
ggcgtatgtgtaat

SEQ ID NO: 632657 - DNA, 13 bp, D. melanogaster
ggcgtcgacgtcg

SEQ ID NO: 632658 - DNA, 14 bp, D. melanogaster
ggcgtcgcagtcgc

SEQ ID NO: 632659 - DNA, 13 bp, D. melanogaster
ggcgtcgctgcct

SEQ ID NO: 632660 - DNA, 13 bp, D. melanogaster
ggcgtcgtcgtcg

SEQ ID NO: 632661 - DNA, 14 bp, D. melanogaster
ggcgtcgttgagtt

SEQ ID NO: 632662 - DNA, 14 bp, D. melanogaster
ggcgtcgtttatct

SEQ ID NO: 632663 - DNA, 13 bp, D. melanogaster
ggcgtggcaaaaa

SEQ ID NO: 632664 - DNA, 14 bp, D. melanogaster
ggcgtggcaaaaag

SEQ ID NO: 632665 - DNA, 13 bp, D. melanogaster
ggcgtggcaaaat

SEQ ID NO: 632666 - DNA, 13 bp, D. melanogaster
ggcgtggcaaatg

SEQ ID NO: 632667 - DNA, 13 bp, D. melanogaster
ggcgtggcaacaa

SEQ ID NO: 632668 - DNA, 13 bp, D. melanogaster
ggcgtggcaatgg

SEQ ID NO: 632669 - DNA, 13 bp, D. melanogaster
ggcgtggcacatg

SEQ ID NO: 632670 - DNA, 13 bp, D. melanogaster
ggcgtggcaccgc

SEQ ID NO: 632671 - DNA, 14 bp, D. melanogaster
ggcgtggcagccgc

SEQ ID NO: 632672 - DNA, 13 bp, D. melanogaster
ggcgtggcaggac

SEQ ID NO: 632673 - DNA, 13 bp, D. melanogaster
ggcgtggcaggtg

SEQ ID NO: 632674 - DNA, 13 bp, D. melanogaster
ggcgtggcagtgc

SEQ ID NO: 632675 - DNA, 13 bp, D. melanogaster
ggcgtggcagttc

SEQ ID NO: 632676 - DNA, 13 bp, D. melanogaster
ggcgtggcagttt

SEQ ID NO: 632677 - DNA, 14 bp, D. melanogaster
ggcgtggcagtttt

SEQ ID NO: 632678 - DNA, 13 bp, D. melanogaster
ggcgttgatggca

SEQ ID NO: 632679 - DNA, 13 bp, D. melanogaster
ggcgttgcagttt

SEQ ID NO: 632680 - DNA, 13 bp, D. melanogaster
ggcgttgccagat

SEQ ID NO: 632681 - DNA, 13 bp, D. melanogaster
ggcgttggcatca

SEQ ID NO: 632682 - DNA, 13 bp, D. melanogaster
ggcgttggccaaa

SEQ ID NO: 632683 - DNA, 13 bp, D. melanogaster
ggcgtttaattaa

SEQ ID NO: 632684 - DNA, 13 bp, D. melanogaster
ggcgttttcattt

SEQ ID NO: 632685 - DNA, 13 bp, D. melanogaster
ggcgttttggcca

SEQ ID NO: 632686 - DNA, 13 bp, D. melanogaster
ggctaaaaaacaa

SEQ ID NO: 632687 - DNA, 13 bp, D. melanogaster
ggctaaaaaagca

SEQ ID NO: 632688 - DNA, 13 bp, D. melanogaster
ggctaaaaatgat

SEQ ID NO: 632689 - DNA, 13 bp, D. melanogaster
ggctaaaaatgct

SEQ ID NO: 632690 - DNA, 13 bp, D. melanogaster
ggctaaaagagcc

SEQ ID NO: 632691 - DNA, 13 bp, D. melanogaster
ggctaaaagcttt

SEQ ID NO: 632692 - DNA, 13 bp, D. melanogaster
ggctaaacaaaaa

SEQ ID NO: 632693 - DNA, 13 bp, D. melanogaster
ggctaaacaattt

SEQ ID NO: 632694 - DNA, 13 bp, D. melanogaster
ggctaaatacaaa

SEQ ID NO: 632695 - DNA, 13 bp, D. melanogaster
ggctaaatggaaa

SEQ ID NO: 632696 - DNA, 13 bp, D. melanogaster
ggctaacaaaagt

SEQ ID NO: 632697 - DNA, 13 bp, D. melanogaster
ggctaaggaaatt

SEQ ID NO: 632698 - DNA, 13 bp, D. melanogaster
ggctaataaatat

SEQ ID NO: 632699 - DNA, 13 bp, D. melanogaster
ggctaatgaaaat

SEQ ID NO: 632700 - DNA, 13 bp, D. melanogaster
ggctaattaactc

SEQ ID NO: 632701 - DNA, 13 bp, D. melanogaster
ggctaattcaatt

SEQ ID NO: 632702 - DNA, 13 bp, D. melanogaster
ggctaattgaaaa

SEQ ID NO: 632703 - DNA, 13 bp, D. melanogaster
ggctacaaaaaaa

SEQ ID NO: 632704 - DNA, 13 bp, D. melanogaster
ggctacaaaatct

SEQ ID NO: 632705 - DNA, 13 bp, D. melanogaster
ggctaccttacgc

SEQ ID NO: 632706 - DNA, 13 bp, D. melanogaster
ggctagatcgact

SEQ ID NO: 632707 - DNA, 14 bp, D. melanogaster
ggctagttttccca

SEQ ID NO: 632708 - DNA, 13 bp, D. melanogaster
ggctataaaataa

SEQ ID NO: 632709 - DNA, 13 bp, D. melanogaster
ggctataaatcaa

SEQ ID NO: 632710 - DNA, 13 bp, D. melanogaster
ggctataataaaa

SEQ ID NO: 632711 - DNA, 13 bp, D. melanogaster
ggctatcccaaaa

SEQ ID NO: 632712 - DNA, 13 bp, D. melanogaster
ggctatgaaccca

SEQ ID NO: 632713 - DNA, 14 bp, D. melanogaster
ggctatggctatgg

SEQ ID NO: 632714 - DNA, 13 bp, D. melanogaster
ggctatgtgtgtg

SEQ ID NO: 632715 - DNA, 13 bp, D. melanogaster
ggctattaaaatt

SEQ ID NO: 632716 - DNA, 13 bp, D. melanogaster
ggctatttgaagg

SEQ ID NO: 632717 - DNA, 13 bp, D. melanogaster
ggctatttttaaa

SEQ ID NO: 632718 - DNA, 13 bp, D. melanogaster
ggctcaacacctg

SEQ ID NO: 632719 - DNA, 13 bp, D. melanogaster
ggctcacacacac

SEQ ID NO: 632720 - DNA, 13 bp, D. melanogaster
ggctcacttggcg

SEQ ID NO: 632721 - DNA, 13 bp, D. melanogaster
ggctcattaaaat

SEQ ID NO: 632722 - DNA, 13 bp, D. melanogaster
ggctcatttgaaa

SEQ ID NO: 632723 - DNA, 13 bp, D. melanogaster
ggctcatttgcat

SEQ ID NO: 632724 - DNA, 13 bp, D. melanogaster
ggctccaccctcg

SEQ ID NO: 632725 - DNA, 13 bp, D. melanogaster
ggctcccagtaga

SEQ ID NO: 632726 - DNA, 14 bp, D. melanogaster
ggctccgagctgtg

SEQ ID NO: 632727 - DNA, 13 bp, D. melanogaster
ggctcctccttcc

SEQ ID NO: 632728 - DNA, 13 bp, D. melanogaster
ggctctacacact

SEQ ID NO: 632729 - DNA, 13 bp, D. melanogaster
ggctctctctctc

SEQ ID NO: 632730 - DNA, 13 bp, D. melanogaster
ggctctctgactg

SEQ ID NO: 632731 - DNA, 13 bp, D. melanogaster
ggctctggagaaa

SEQ ID NO: 632732 - DNA, 14 bp, D. melanogaster
ggctctggagaaaa

SEQ ID NO: 632733 - DNA, 13 bp, D. melanogaster
ggctctgtgtgtg

SEQ ID NO: 632734 - DNA, 13 bp, D. melanogaster
ggctcttaaaaat

SEQ ID NO: 632735 - DNA, 13 bp, D. melanogaster
ggctctttaattg

SEQ ID NO: 632736 - DNA, 13 bp, D. melanogaster
ggctcttttagcc

SEQ ID NO: 632737 - DNA, 13 bp, D. melanogaster
ggctgaaaatgaa

SEQ ID NO: 632738 - DNA, 13 bp, D. melanogaster
ggctgaaaatttt

SEQ ID NO: 632739 - DNA, 13 bp, D. melanogaster
ggctgaaactgaa

SEQ ID NO: 632740 - DNA, 13 bp, D. melanogaster
ggctgactgactg

SEQ ID NO: 632741 - DNA, 14 bp, D. melanogaster
ggctgactgactga

SEQ ID NO: 632742 - DNA, 13 bp, D. melanogaster
ggctgagaactgg

SEQ ID NO: 632743 - DNA, 13 bp, D. melanogaster
ggctgagctttcg

SEQ ID NO: 632744 - DNA, 13 bp, D. melanogaster
ggctgatcaggcc

SEQ ID NO: 632745 - DNA, 13 bp, D. melanogaster
ggctgatgttgct

SEQ ID NO: 632746 - DNA, 13 bp, D. melanogaster
ggctgcaaaataa

SEQ ID NO: 632747 - DNA, 13 bp, D. melanogaster
ggctgcaacaaca

SEQ ID NO: 632748 - DNA, 13 bp, D. melanogaster
ggctgcaactgca

SEQ ID NO: 632749 - DNA, 14 bp, D. melanogaster
ggctgcaaggtcaa

SEQ ID NO: 632750 - DNA, 13 bp, D. melanogaster
ggctgcaagtctt

SEQ ID NO: 632751 - DNA, 13 bp, D. melanogaster
ggctgcacacaca

SEQ ID NO: 632752 - DNA, 13 bp, D. melanogaster
ggctgcaccgcaa

SEQ ID NO: 632753 - DNA, 13 bp, D. melanogaster
ggctgcagcagca

SEQ ID NO: 632754 - DNA, 13 bp, D. melanogaster
ggctgcatagtgc

SEQ ID NO: 632755 - DNA, 13 bp, D. melanogaster
ggctgccaaaaaa

SEQ ID NO: 632756 - DNA, 14 bp, D. melanogaster
ggctgccaaaaagt

SEQ ID NO: 632757 - DNA, 13 bp, D. melanogaster
ggctgccaaattg

SEQ ID NO: 632758 - DNA, 13 bp, D. melanogaster
ggctgccacaaaa

SEQ ID NO: 632759 - DNA, 14 bp, D. melanogaster
ggctgccacgcccc

SEQ ID NO: 632760 - DNA, 13 bp, D. melanogaster
ggctgccattgcc

SEQ ID NO: 632761 - DNA, 13 bp, D. melanogaster
ggctgccattgtt

SEQ ID NO: 632762 - DNA, 13 bp, D. melanogaster
ggctgccttttgt

SEQ ID NO: 632763 - DNA, 13 bp, D. melanogaster
ggctgcgaaggaa

SEQ ID NO: 632764 - DNA, 13 bp, D. melanogaster
ggctgcgactgcg

SEQ ID NO: 632765 - DNA, 13 bp, D. melanogaster
ggctgcgcatgcg

SEQ ID NO: 632766 - DNA, 14 bp, D. melanogaster
ggctgcgcatgcgc

SEQ ID NO: 632767 - DNA, 13 bp, D. melanogaster
ggctgcgctgcca

SEQ ID NO: 632768 - DNA, 13 bp, D. melanogaster
ggctgcgttttat

SEQ ID NO: 632769 - DNA, 13 bp, D. melanogaster
ggctgctcagctt

SEQ ID NO: 632770 - DNA, 13 bp, D. melanogaster
ggctgctcctgct

SEQ ID NO: 632771 - DNA, 13 bp, D. melanogaster
ggctgctccttct

SEQ ID NO: 632772 - DNA, 13 bp, D. melanogaster
ggctgctgagctg

SEQ ID NO: 632773 - DNA, 14 bp, D. melanogaster
ggctgctgagctgg

SEQ ID NO: 632774 - DNA, 13 bp, D. melanogaster
ggctgctgcactt

SEQ ID NO: 632775 - DNA, 13 bp, D. melanogaster
ggctgctgcagct

SEQ ID NO: 632776 - DNA, 13 bp, D. melanogaster
ggctgctgcagtt

SEQ ID NO: 632777 - DNA, 13 bp, D. melanogaster
ggctgctgctgct

SEQ ID NO: 632778 - DNA, 14 bp, D. melanogaster
ggctgctgctgctg

SEQ ID NO: 632779 - DNA, 13 bp, D. melanogaster
ggctgctgttgtt

SEQ ID NO: 632780 - DNA, 13 bp, D. melanogaster
ggctgctttgttt

SEQ ID NO: 632781 - DNA, 13 bp, D. melanogaster
ggctggaaaagcg

SEQ ID NO: 632782 - DNA, 13 bp, D. melanogaster
ggctggatggatg

SEQ ID NO: 632783 - DNA, 13 bp, D. melanogaster
ggctggatttgtt

SEQ ID NO: 632784 - DNA, 14 bp, D. melanogaster
ggctggcaaacaaa

SEQ ID NO: 632785 - DNA, 13 bp, D. melanogaster
ggctggcaaatta

SEQ ID NO: 632786 - DNA, 13 bp, D. melanogaster
ggctggcaacaac

SEQ ID NO: 632787 - DNA, 13 bp, D. melanogaster
ggctggcaattaa

SEQ ID NO: 632788 - DNA, 13 bp, D. melanogaster
ggctggcaggcag

SEQ ID NO: 632789 - DNA, 13 bp, D. melanogaster
ggctggccaaaaa

SEQ ID NO: 632790 - DNA, 13 bp, D. melanogaster
ggctggccaaaag

SEQ ID NO: 632791 - DNA, 13 bp, D. melanogaster
ggctggccaaatg

SEQ ID NO: 632792 - DNA, 14 bp, D. melanogaster
ggctggccagcgct

SEQ ID NO: 632793 - DNA, 13 bp, D. melanogaster
ggctggctgagtg

SEQ ID NO: 632794 - DNA, 13 bp, D. melanogaster
ggctggctgcctt

SEQ ID NO: 632795 - DNA, 13 bp, D. melanogaster
ggctggctggcca

SEQ ID NO: 632796 - DNA, 13 bp, D. melanogaster
ggctggctggccg

SEQ ID NO: 632797 - DNA, 13 bp, D. melanogaster
ggctggctggctc

SEQ ID NO: 632798 - DNA, 13 bp, D. melanogaster
ggctgggaaaaag

SEQ ID NO: 632799 - DNA, 13 bp, D. melanogaster
ggctgggcaaaca

SEQ ID NO: 632800 - DNA, 13 bp, D. melanogaster
ggctggttggctt

SEQ ID NO: 632801 - DNA, 13 bp, D. melanogaster
ggctgtgacaaag

SEQ ID NO: 632802 - DNA, 13 bp, D. melanogaster
ggctgtgctggct

SEQ ID NO: 632803 - DNA, 13 bp, D. melanogaster
ggctgtgtgagtg

SEQ ID NO: 632804 - DNA, 13 bp, D. melanogaster
ggctgtgtgcgtg

SEQ ID NO: 632805 - DNA, 13 bp, D. melanogaster
ggctgttatctgc

SEQ ID NO: 632806 - DNA, 13 bp, D. melanogaster
ggctgttctgcag

SEQ ID NO: 632807 - DNA, 13 bp, D. melanogaster
ggctgttctgttg

SEQ ID NO: 632808 - DNA, 18 bp, D. melanogaster
ggctgttctgttgcccaa

SEQ ID NO: 632809 - DNA, 13 bp, D. melanogaster
ggctgttgctgtt

SEQ ID NO: 632810 - DNA, 14 bp, D. melanogaster
ggctgttgctgttg

SEQ ID NO: 632811 - DNA, 13 bp, D. melanogaster
ggcttaaaaaaaa

SEQ ID NO: 632812 - DNA, 14 bp, D. melanogaster
ggcttaaaaaaaaa

SEQ ID NO: 632813 - DNA, 13 bp, D. melanogaster
ggcttaaaaaata

SEQ ID NO: 632814 - DNA, 13 bp, D. melanogaster
ggcttaaaaagta

SEQ ID NO: 632815 - DNA, 13 bp, D. melanogaster
ggcttaaaattac

SEQ ID NO: 632816 - DNA, 14 bp, D. melanogaster
ggcttaaatagatt

SEQ ID NO: 632817 - DNA, 13 bp, D. melanogaster
ggcttaaatatat

SEQ ID NO: 632818 - DNA, 13 bp, D. melanogaster
ggcttaaatttat

SEQ ID NO: 632819 - DNA, 13 bp, D. melanogaster
ggcttaattaaaa

SEQ ID NO: 632820 - DNA, 13 bp, D. melanogaster
ggcttaattgaaa

SEQ ID NO: 632821 - DNA, 13 bp, D. melanogaster
ggcttatgaatcg

SEQ ID NO: 632822 - DNA, 13 bp, D. melanogaster
ggcttatttatat

SEQ ID NO: 632823 - DNA, 13 bp, D. melanogaster
ggcttcaaaaata

SEQ ID NO: 632824 - DNA, 13 bp, D. melanogaster
ggcttcaatgtgc

SEQ ID NO: 632825 - DNA, 13 bp, D. melanogaster
ggcttccggttgc

SEQ ID NO: 632826 - DNA, 13 bp, D. melanogaster
ggcttcgctgcag

SEQ ID NO: 632827 - DNA, 13 bp, D. melanogaster
ggcttcggcaagg

SEQ ID NO: 632828 - DNA, 13 bp, D. melanogaster
ggcttctcctcca

SEQ ID NO: 632829 - DNA, 13 bp, D. melanogaster
ggcttcttcacac

SEQ ID NO: 632830 - DNA, 13 bp, D. melanogaster
ggcttctttctat

SEQ ID NO: 632831 - DNA, 13 bp, D. melanogaster
ggcttggaaaatg

SEQ ID NO: 632832 - DNA, 13 bp, D. melanogaster
ggcttggcttggc

SEQ ID NO: 632833 - DNA, 13 bp, D. melanogaster
ggcttggctttgg

SEQ ID NO: 632834 - DNA, 13 bp, D. melanogaster
ggcttgtggaatg

SEQ ID NO: 632835 - DNA, 13 bp, D. melanogaster
ggcttgtttccca

SEQ ID NO: 632836 - DNA, 13 bp, D. melanogaster
ggctttaacttta

SEQ ID NO: 632837 - DNA, 14 bp, D. melanogaster
ggctttaactttaa

SEQ ID NO: 632838 - DNA, 13 bp, D. melanogaster
ggctttaaggtgt

SEQ ID NO: 632839 - DNA, 13 bp, D. melanogaster
ggctttaatggca

SEQ ID NO: 632840 - DNA, 13 bp, D. melanogaster
ggctttagaggct

SEQ ID NO: 632841 - DNA, 13 bp, D. melanogaster
ggctttagggcgt

SEQ ID NO: 632842 - DNA, 14 bp, D. melanogaster
ggctttagggcgtt

SEQ ID NO: 632843 - DNA, 13 bp, D. melanogaster
ggctttagttttt

SEQ ID NO: 632844 - DNA, 13 bp, D. melanogaster
ggctttatggcca

SEQ ID NO: 632845 - DNA, 13 bp, D. melanogaster
ggctttcactttc

SEQ ID NO: 632846 - DNA, 13 bp, D. melanogaster
ggctttcggttgc

SEQ ID NO: 632847 - DNA, 13 bp, D. melanogaster
ggctttctcgagc

SEQ ID NO: 632848 - DNA, 13 bp, D. melanogaster
ggctttctttgcc

SEQ ID NO: 632849 - DNA, 13 bp, D. melanogaster
ggctttctttgct

SEQ ID NO: 632850 - DNA, 13 bp, D. melanogaster
ggctttgcattgc

SEQ ID NO: 632851 - DNA, 14 bp, D. melanogaster
ggctttgcattgct

SEQ ID NO: 632852 - DNA, 14 bp, D. melanogaster
ggctttggaatcat

SEQ ID NO: 632853 - DNA, 13 bp, D. melanogaster
ggctttggatttg

SEQ ID NO: 632854 - DNA, 13 bp, D. melanogaster
ggctttggcattg

SEQ ID NO: 632855 - DNA, 13 bp, D. melanogaster
ggctttggccttt

SEQ ID NO: 632856 - DNA, 13 bp, D. melanogaster
ggctttggcgatg

SEQ ID NO: 632857 - DNA, 14 bp, D. melanogaster
ggctttggcgatgc

SEQ ID NO: 632858 - DNA, 13 bp, D. melanogaster
ggctttggctaat

SEQ ID NO: 632859 - DNA, 13 bp, D. melanogaster
ggctttggcttcg

SEQ ID NO: 632860 - DNA, 13 bp, D. melanogaster
ggctttggcttta

SEQ ID NO: 632861 - DNA, 14 bp, D. melanogaster
ggctttggctttgg

SEQ ID NO: 632862 - DNA, 13 bp, D. melanogaster
ggctttggtcccg

SEQ ID NO: 632863 - DNA, 13 bp, D. melanogaster
ggctttggtgctt

SEQ ID NO: 632864 - DNA, 13 bp, D. melanogaster
ggctttgtttctc

SEQ ID NO: 632865 - DNA, 13 bp, D. melanogaster
ggctttgtttgca

SEQ ID NO: 632866 - DNA, 13 bp, D. melanogaster
ggcttttaaaatt

SEQ ID NO: 632867 - DNA, 13 bp, D. melanogaster
ggcttttaagttt

SEQ ID NO: 632868 - DNA, 13 bp, D. melanogaster
ggcttttaattaa

SEQ ID NO: 632869 - DNA, 13 bp, D. melanogaster
ggcttttaatttt

SEQ ID NO: 632870 - DNA, 13 bp, D. melanogaster
ggcttttcatatt

SEQ ID NO: 632871 - DNA, 14 bp, D. melanogaster
ggcttttgaaataa

SEQ ID NO: 632872 - DNA, 13 bp, D. melanogaster
ggcttttggccaa

SEQ ID NO: 632873 - DNA, 13 bp, D. melanogaster
ggcttttggccat

SEQ ID NO: 632874 - DNA, 13 bp, D. melanogaster
ggcttttggcttt

SEQ ID NO: 632875 - DNA, 13 bp, D. melanogaster
gggaaaaacatca

SEQ ID NO: 632876 - DNA, 13 bp, D. melanogaster
gggaaaaactttc

SEQ ID NO: 632877 - DNA, 13 bp, D. melanogaster
gggaaaaactttt

SEQ ID NO: 632878 - DNA, 13 bp, D. melanogaster
gggaaaaagtgca

SEQ ID NO: 632879 - DNA, 13 bp, D. melanogaster
gggaaaaatatat

SEQ ID NO: 632880 - DNA, 13 bp, D. melanogaster
gggaaaaatgcaa

SEQ ID NO: 632881 - DNA, 13 bp, D. melanogaster
gggaaaaatgctg

SEQ ID NO: 632882 - DNA, 13 bp, D. melanogaster
gggaaaaccagga

SEQ ID NO: 632883 - DNA, 13 bp, D. melanogaster
gggaaaactctgg

SEQ ID NO: 632884 - DNA, 13 bp, D. melanogaster
gggaaaactcttt

SEQ ID NO: 632885 - DNA, 13 bp, D. melanogaster
gggaaaactgaaa

SEQ ID NO: 632886 - DNA, 13 bp, D. melanogaster
gggaaaactgcaa

SEQ ID NO: 632887 - DNA, 13 bp, D. melanogaster
gggaaaactggga

SEQ ID NO: 632888 - DNA, 13 bp, D. melanogaster
gggaaaacttaaa

SEQ ID NO: 632889 - DNA, 13 bp, D. melanogaster
gggaaaacttaat

SEQ ID NO: 632890 - DNA, 13 bp, D. melanogaster
gggaaaactttgc

SEQ ID NO: 632891 - DNA, 13 bp, D. melanogaster
gggaaaagcaaat

SEQ ID NO: 632892 - DNA, 13 bp, D. melanogaster
gggaaaagctgga

SEQ ID NO: 632893 - DNA, 13 bp, D. melanogaster
gggaaaagtgcaa

SEQ ID NO: 632894 - DNA, 13 bp, D. melanogaster
gggaaaagtgcag

SEQ ID NO: 632895 - DNA, 13 bp, D. melanogaster
gggaaaataacaa

SEQ ID NO: 632896 - DNA, 13 bp, D. melanogaster
gggaaaatatata

SEQ ID NO: 632897 - DNA, 13 bp, D. melanogaster
gggaaaatatttg

SEQ ID NO: 632898 - DNA, 13 bp, D. melanogaster
gggaaaatatttt

SEQ ID NO: 632899 - DNA, 13 bp, D. melanogaster
gggaaaatcaaat

SEQ ID NO: 632900 - DNA, 13 bp, D. melanogaster
gggaaaatcaatt

SEQ ID NO: 632901 - DNA, 13 bp, D. melanogaster
gggaaaatcgaaa

SEQ ID NO: 632902 - DNA, 13 bp, D. melanogaster
gggaaaatcggaa

SEQ ID NO: 632903 - DNA, 13 bp, D. melanogaster
gggaaaatgcaat

SEQ ID NO: 632904 - DNA, 13 bp, D. melanogaster
gggaaaatggcaa

SEQ ID NO: 632905 - DNA, 13 bp, D. melanogaster
gggaaaatggtgg

SEQ ID NO: 632906 - DNA, 13 bp, D. melanogaster
gggaaaatgtaaa

SEQ ID NO: 632907 - DNA, 13 bp, D. melanogaster
gggaaaatgtgaa

SEQ ID NO: 632908 - DNA, 13 bp, D. melanogaster
gggaaaatgtgga

SEQ ID NO: 632909 - DNA, 13 bp, D. melanogaster
gggaaaatgttcc

SEQ ID NO: 632910 - DNA, 13 bp, D. melanogaster
gggaaaattatga

SEQ ID NO: 632911 - DNA, 13 bp, D. melanogaster
gggaaacaagagt

SEQ ID NO: 632912 - DNA, 13 bp, D. melanogaster
gggaaacaataaa

SEQ ID NO: 632913 - DNA, 13 bp, D. melanogaster
gggaaaccaacag

SEQ ID NO: 632914 - DNA, 13 bp, D. melanogaster
gggaaaccactga

SEQ ID NO: 632915 - DNA, 13 bp, D. melanogaster
gggaaacggaaac

SEQ ID NO: 632916 - DNA, 13 bp, D. melanogaster
gggaaagataatc

SEQ ID NO: 632917 - DNA, 13 bp, D. melanogaster
gggaaagtgaaac

SEQ ID NO: 632918 - DNA, 13 bp, D. melanogaster
gggaaagtgggcg

SEQ ID NO: 632919 - DNA, 13 bp, D. melanogaster
gggaaatacaaaa

SEQ ID NO: 632920 - DNA, 13 bp, D. melanogaster
gggaaatatattt

SEQ ID NO: 632921 - DNA, 13 bp, D. melanogaster
gggaaatattcaa

SEQ ID NO: 632922 - DNA, 13 bp, D. melanogaster
gggaaatccgccg

SEQ ID NO: 632923 - DNA, 13 bp, D. melanogaster
gggaaatcgaaat

SEQ ID NO: 632924 - DNA, 13 bp, D. melanogaster
gggaaatcggaaa

SEQ ID NO: 632925 - DNA, 13 bp, D. melanogaster
gggaaatgaaatg

SEQ ID NO: 632926 - DNA, 14 bp, D. melanogaster
gggaaatgagctag

SEQ ID NO: 632927 - DNA, 14 bp, D. melanogaster
gggaaatgcaattt

SEQ ID NO: 632928 - DNA, 13 bp, D. melanogaster
gggaaatgcgaaa

SEQ ID NO: 632929 - DNA, 14 bp, D. melanogaster
gggaaatgcgaaaa

SEQ ID NO: 632930 - DNA, 13 bp, D. melanogaster
gggaaatgcgaat

SEQ ID NO: 632931 - DNA, 14 bp, D. melanogaster
gggaaatggaaaat

SEQ ID NO: 632932 - DNA, 13 bp, D. melanogaster
gggaaatggaaat

SEQ ID NO: 632933 - DNA, 13 bp, D. melanogaster
gggaaatggaatt

SEQ ID NO: 632934 - DNA, 14 bp, D. melanogaster
gggaaatggagttt

SEQ ID NO: 632935 - DNA, 13 bp, D. melanogaster
gggaaatggcgaa

SEQ ID NO: 632936 - DNA, 13 bp, D. melanogaster
gggaaatggcttt

SEQ ID NO: 632937 - DNA, 14 bp, D. melanogaster
gggaaatgggaaat

SEQ ID NO: 632938 - DNA, 13 bp, D. melanogaster
gggaaatgggcaa

SEQ ID NO: 632939 - DNA, 13 bp, D. melanogaster
gggaaatggtaaa

SEQ ID NO: 632940 - DNA, 15 bp, D. melanogaster
gggaaatgtaagaag

SEQ ID NO: 632941 - DNA, 13 bp, D. melanogaster
gggaaatgtgcaa

SEQ ID NO: 632942 - DNA, 13 bp, D. melanogaster
gggaaatgtgtgt

SEQ ID NO: 632943 - DNA, 13 bp, D. melanogaster
gggaaatgttctt

SEQ ID NO: 632944 - DNA, 13 bp, D. melanogaster
gggaaattaataa

SEQ ID NO: 632945 - DNA, 13 bp, D. melanogaster
gggaaattattat

SEQ ID NO: 632946 - DNA, 13 bp, D. melanogaster
gggaaattcaaaa

SEQ ID NO: 632947 - DNA, 14 bp, D. melanogaster
gggaaattcaaagt

SEQ ID NO: 632948 - DNA, 13 bp, D. melanogaster
gggaaattccccg

SEQ ID NO: 632949 - DNA, 14 bp, D. melanogaster
gggaaattgaaaat

SEQ ID NO: 632950 - DNA, 13 bp, D. melanogaster
gggaaattgaatt

SEQ ID NO: 632951 - DNA, 13 bp, D. melanogaster
gggaaattgcatt

SEQ ID NO: 632952 - DNA, 13 bp, D. melanogaster
gggaaattgtgaa

SEQ ID NO: 632953 - DNA, 13 bp, D. melanogaster
gggaaatttaaat

SEQ ID NO: 632954 - DNA, 13 bp, D. melanogaster
gggaacacctgcc

SEQ ID NO: 632955 - DNA, 13 bp, D. melanogaster
gggaacgccagta

SEQ ID NO: 632956 - DNA, 13 bp, D. melanogaster
gggaacgggaacg

SEQ ID NO: 632957 - DNA, 14 bp, D. melanogaster
gggaacgggaatgg

SEQ ID NO: 632958 - DNA, 13 bp, D. melanogaster
gggaactggaaac

SEQ ID NO: 632959 - DNA, 13 bp, D. melanogaster
gggaactgggaac

SEQ ID NO: 632960 - DNA, 13 bp, D. melanogaster
gggaactgggagc

SEQ ID NO: 632961 - DNA, 13 bp, D. melanogaster
gggaagacaaaat

SEQ ID NO: 632962 - DNA, 13 bp, D. melanogaster
gggaagctggagt

SEQ ID NO: 632963 - DNA, 13 bp, D. melanogaster
gggaataaaaatg

SEQ ID NO: 632964 - DNA, 13 bp, D. melanogaster
gggaataccaaat

SEQ ID NO: 632965 - DNA, 13 bp, D. melanogaster
gggaatattgtga

SEQ ID NO: 632966 - DNA, 13 bp, D. melanogaster
gggaatcggaatc

SEQ ID NO: 632967 - DNA, 14 bp, D. melanogaster
gggaatcggaatcg

SEQ ID NO: 632968 - DNA, 13 bp, D. melanogaster
gggaatggaaaat

SEQ ID NO: 632969 - DNA, 13 bp, D. melanogaster
gggaatggagaat

SEQ ID NO: 632970 - DNA, 14 bp, D. melanogaster
gggaatggcaatgg

SEQ ID NO: 632971 - DNA, 14 bp, D. melanogaster
gggaatgggaaatg

SEQ ID NO: 632972 - DNA, 13 bp, D. melanogaster
gggaatgggaatc

SEQ ID NO: 632973 - DNA, 14 bp, D. melanogaster
gggaatgggaatga

SEQ ID NO: 632974 - DNA, 13 bp, D. melanogaster
gggaatgggaatt

SEQ ID NO: 632975 - DNA, 13 bp, D. melanogaster
gggaatgggactg

SEQ ID NO: 632976 - DNA, 14 bp, D. melanogaster
gggaatgggcatgg

SEQ ID NO: 632977 - DNA, 13 bp, D. melanogaster
gggaatggggcaa

SEQ ID NO: 632978 - DNA, 13 bp, D. melanogaster
gggaatgtcatcg

SEQ ID NO: 632979 - DNA, 13 bp, D. melanogaster
gggaatgtccaag

SEQ ID NO: 632980 - DNA, 13 bp, D. melanogaster
gggaattctgttt

SEQ ID NO: 632981 - DNA, 13 bp, D. melanogaster
gggaattcttaaa

SEQ ID NO: 632982 - DNA, 13 bp, D. melanogaster
gggaatttatgaa

SEQ ID NO: 632983 - DNA, 13 bp, D. melanogaster
gggaatttgtgct

SEQ ID NO: 632984 - DNA, 13 bp, D. melanogaster
gggaattttttat

SEQ ID NO: 632985 - DNA, 13 bp, D. melanogaster
gggacatggaaaa

SEQ ID NO: 632986 - DNA, 13 bp, D. melanogaster
gggacatggaaag

SEQ ID NO: 632987 - DNA, 14 bp, D. melanogaster
gggacatggaaagt

SEQ ID NO: 632988 - DNA, 13 bp, D. melanogaster
gggacatttggtt

SEQ ID NO: 632989 - DNA, 13 bp, D. melanogaster
gggactgcgactg

SEQ ID NO: 632990 - DNA, 14 bp, D. melanogaster
gggactttgatatt

SEQ ID NO: 632991 - DNA, 13 bp, D. melanogaster
gggagagcgagat

SEQ ID NO: 632992 - DNA, 14 bp, D. melanogaster
gggagagcgagata

SEQ ID NO: 632993 - DNA, 13 bp, D. melanogaster
gggagatccaaac

SEQ ID NO: 632994 - DNA, 14 bp, D. melanogaster
gggagctgaccaaa

SEQ ID NO: 632995 - DNA, 14 bp, D. melanogaster
gggagctgggagct

SEQ ID NO: 632996 - DNA, 13 bp, D. melanogaster
gggaggtcgttgc

SEQ ID NO: 632997 - DNA, 13 bp, D. melanogaster
gggagtcgagtgc

SEQ ID NO: 632998 - DNA, 13 bp, D. melanogaster
gggagtcgcgaat

SEQ ID NO: 632999 - DNA, 14 bp, D. melanogaster
gggagtgagccgaa

SEQ ID NO: 633000 - DNA, 13 bp, D. melanogaster
gggagtggcagga

SEQ ID NO: 633001 - DNA, 13 bp, D. melanogaster
gggagttcatctg

SEQ ID NO: 633002 - DNA, 13 bp, D. melanogaster
gggagttgggaaa

SEQ ID NO: 633003 - DNA, 13 bp, D. melanogaster
gggataaattgga

SEQ ID NO: 633004 - DNA, 14 bp, D. melanogaster
gggataaattggag

SEQ ID NO: 633005 - DNA, 13 bp, D. melanogaster
gggatactacgga

SEQ ID NO: 633006 - DNA, 13 bp, D. melanogaster
gggatagggattg

SEQ ID NO: 633007 - DNA, 13 bp, D. melanogaster
gggatatgattaa

SEQ ID NO: 633008 - DNA, 13 bp, D. melanogaster
gggatcgatgaaa

SEQ ID NO: 633009 - DNA, 14 bp, D. melanogaster
gggatcggaatcgg

SEQ ID NO: 633010 - DNA, 14 bp, D. melanogaster
gggatcgggatcgg

SEQ ID NO: 633011 - DNA, 13 bp, D. melanogaster
gggatcgggatct

SEQ ID NO: 633012 - DNA, 13 bp, D. melanogaster
gggatctgccaag

SEQ ID NO: 633013 - DNA, 13 bp, D. melanogaster
gggatctgggatc

SEQ ID NO: 633014 - DNA, 13 bp, D. melanogaster
gggatgatgatga

SEQ ID NO: 633015 - DNA, 13 bp, D. melanogaster
gggatgcaaaccg

SEQ ID NO: 633016 - DNA, 13 bp, D. melanogaster
gggatgggatgcg

SEQ ID NO: 633017 - DNA, 13 bp, D. melanogaster
gggatgggcatga

SEQ ID NO: 633018 - DNA, 13 bp, D. melanogaster
gggattggattgg

SEQ ID NO: 633019 - DNA, 13 bp, D. melanogaster
gggattggcagtc

SEQ ID NO: 633020 - DNA, 13 bp, D. melanogaster
gggattgtcggtg

SEQ ID NO: 633021 - DNA, 13 bp, D. melanogaster
gggatttatttat

SEQ ID NO: 633022 - DNA, 14 bp, D. melanogaster
gggatttcatcaaa

SEQ ID NO: 633023 - DNA, 14 bp, D. melanogaster
gggatttggcctaa

SEQ ID NO: 633024 - DNA, 13 bp, D. melanogaster
gggattttaattc

SEQ ID NO: 633025 - DNA, 14 bp, D. melanogaster
gggcaaaaaaaact

SEQ ID NO: 633026 - DNA, 13 bp, D. melanogaster
gggcaaaaaactg

SEQ ID NO: 633027 - DNA, 13 bp, D. melanogaster
gggcaaaaacaac

SEQ ID NO: 633028 - DNA, 13 bp, D. melanogaster
gggcaaaagatcc

SEQ ID NO: 633029 - DNA, 13 bp, D. melanogaster
gggcaaaaggggc

SEQ ID NO: 633030 - DNA, 13 bp, D. melanogaster
gggcaaaagtttc

SEQ ID NO: 633031 - DNA, 13 bp, D. melanogaster
gggcaaacaaaat

SEQ ID NO: 633032 - DNA, 14 bp, D. melanogaster
gggcaaacaaacaa

SEQ ID NO: 633033 - DNA, 13 bp, D. melanogaster
gggcaaacaaagc

SEQ ID NO: 633034 - DNA, 13 bp, D. melanogaster
gggcaaacataaa

SEQ ID NO: 633035 - DNA, 13 bp, D. melanogaster
gggcaaacgaaaa

SEQ ID NO: 633036 - DNA, 13 bp, D. melanogaster
gggcaaacgaaat

SEQ ID NO: 633037 - DNA, 14 bp, D. melanogaster
gggcaaacgaaatt

SEQ ID NO: 633038 - DNA, 13 bp, D. melanogaster
gggcaaacgattc

SEQ ID NO: 633039 - DNA, 13 bp, D. melanogaster
gggcaaacgtggg

SEQ ID NO: 633040 - DNA, 13 bp, D. melanogaster
gggcaaataataa

SEQ ID NO: 633041 - DNA, 13 bp, D. melanogaster
gggcaaatacaaa

SEQ ID NO: 633042 - DNA, 13 bp, D. melanogaster
gggcaaatggaaa

SEQ ID NO: 633043 - DNA, 13 bp, D. melanogaster
gggcaaatggcaa

SEQ ID NO: 633044 - DNA, 13 bp, D. melanogaster
gggcaaattgaat

SEQ ID NO: 633045 - DNA, 13 bp, D. melanogaster
gggcaacaaaagt

SEQ ID NO: 633046 - DNA, 13 bp, D. melanogaster
gggcaacaacaaa

SEQ ID NO: 633047 - DNA, 14 bp, D. melanogaster
gggcaacaacaaaa

SEQ ID NO: 633048 - DNA, 13 bp, D. melanogaster
gggcaacaacaac

SEQ ID NO: 633049 - DNA, 13 bp, D. melanogaster
gggcaacaacaag

SEQ ID NO: 633050 - DNA, 14 bp, D. melanogaster
gggcaacaacaagt

SEQ ID NO: 633051 - DNA, 13 bp, D. melanogaster
gggcaacagcttg

SEQ ID NO: 633052 - DNA, 13 bp, D. melanogaster
gggcaacgcatcc

SEQ ID NO: 633053 - DNA, 13 bp, D. melanogaster
gggcaaggaacca

SEQ ID NO: 633054 - DNA, 13 bp, D. melanogaster
gggcaagtaatta

SEQ ID NO: 633055 - DNA, 13 bp, D. melanogaster
gggcaagtgcagc

SEQ ID NO: 633056 - DNA, 13 bp, D. melanogaster
gggcaataaataa

SEQ ID NO: 633057 - DNA, 14 bp, D. melanogaster
gggcaatcgaaaaa

SEQ ID NO: 633058 - DNA, 13 bp, D. melanogaster
gggcaatgccagc

SEQ ID NO: 633059 - DNA, 13 bp, D. melanogaster
gggcaatggaaaa

SEQ ID NO: 633060 - DNA, 13 bp, D. melanogaster
gggcaatggaaat

SEQ ID NO: 633061 - DNA, 13 bp, D. melanogaster
gggcaatggcaat

SEQ ID NO: 633062 - DNA, 13 bp, D. melanogaster
gggcacaaaaaca

SEQ ID NO: 633063 - DNA, 13 bp, D. melanogaster
gggcacaaaacaa

SEQ ID NO: 633064 - DNA, 13 bp, D. melanogaster
gggcacacacaca

SEQ ID NO: 633065 - DNA, 13 bp, D. melanogaster
gggcacatctgcc

SEQ ID NO: 633066 - DNA, 13 bp, D. melanogaster
gggcacggtggtt

SEQ ID NO: 633067 - DNA, 13 bp, D. melanogaster
gggcagaaaaagt

SEQ ID NO: 633068 - DNA, 13 bp, D. melanogaster
gggcagaatcgtt

SEQ ID NO: 633069 - DNA, 13 bp, D. melanogaster
gggcagcaaaaaa

SEQ ID NO: 633070 - DNA, 13 bp, D. melanogaster
gggcagcaacaac

SEQ ID NO: 633071 - DNA, 13 bp, D. melanogaster
gggcagcagcaac

SEQ ID NO: 633072 - DNA, 13 bp, D. melanogaster
gggcagcagctgc

SEQ ID NO: 633073 - DNA, 13 bp, D. melanogaster
gggcaggaaaaac

SEQ ID NO: 633074 - DNA, 13 bp, D. melanogaster
gggcaggcaaaaa

SEQ ID NO: 633075 - DNA, 13 bp, D. melanogaster
gggcaggcaggca

SEQ ID NO: 633076 - DNA, 13 bp, D. melanogaster
gggcagtgggcag

SEQ ID NO: 633077 - DNA, 13 bp, D. melanogaster
gggcataaattaa

SEQ ID NO: 633078 - DNA, 13 bp, D. melanogaster
gggcataagcctc

SEQ ID NO: 633079 - DNA, 13 bp, D. melanogaster
gggcatatatgta

SEQ ID NO: 633080 - DNA, 13 bp, D. melanogaster
gggcatcctgatg

SEQ ID NO: 633081 - DNA, 14 bp, D. melanogaster
gggcatgggcatgg

SEQ ID NO: 633082 - DNA, 13 bp, D. melanogaster
gggcatggggcat

SEQ ID NO: 633083 - DNA, 14 bp, D. melanogaster
gggcatggggcatg

SEQ ID NO: 633084 - DNA, 13 bp, D. melanogaster
gggcattgaggga

SEQ ID NO: 633085 - DNA, 13 bp, D. melanogaster
gggcattggcatt

SEQ ID NO: 633086 - DNA, 13 bp, D. melanogaster
gggcattgggcat

SEQ ID NO: 633087 - DNA, 13 bp, D. melanogaster
gggcatttggcct

SEQ ID NO: 633088 - DNA, 13 bp, D. melanogaster
gggccaaaaagaa

SEQ ID NO: 633089 - DNA, 13 bp, D. melanogaster
gggccaaaaccaa

SEQ ID NO: 633090 - DNA, 13 bp, D. melanogaster
gggccaaaagaaa

SEQ ID NO: 633091 - DNA, 14 bp, D. melanogaster
gggccaaaagcaaa

SEQ ID NO: 633092 - DNA, 13 bp, D. melanogaster
gggccaaaagcga

SEQ ID NO: 633093 - DNA, 13 bp, D. melanogaster
gggccaaaaggac

SEQ ID NO: 633094 - DNA, 13 bp, D. melanogaster
gggccaaaaggag

SEQ ID NO: 633095 - DNA, 13 bp, D. melanogaster
gggccaaaaggga

SEQ ID NO: 633096 - DNA, 13 bp, D. melanogaster
gggccaaaagggg

SEQ ID NO: 633097 - DNA, 13 bp, D. melanogaster
gggccaaaatgaa

SEQ ID NO: 633098 - DNA, 13 bp, D. melanogaster
gggccaaaggaaa

SEQ ID NO: 633099 - DNA, 13 bp, D. melanogaster
gggccaaagtttt

SEQ ID NO: 633100 - DNA, 13 bp, D. melanogaster
gggccaaatggaa

SEQ ID NO: 633101 - DNA, 13 bp, D. melanogaster
gggccaacaacaa

SEQ ID NO: 633102 - DNA, 13 bp, D. melanogaster
gggccaacgaaaa

SEQ ID NO: 633103 - DNA, 14 bp, D. melanogaster
gggccaacttcctt

SEQ ID NO: 633104 - DNA, 13 bp, D. melanogaster
gggccaaggaaaa

SEQ ID NO: 633105 - DNA, 13 bp, D. melanogaster
gggccaagttact

SEQ ID NO: 633106 - DNA, 13 bp, D. melanogaster
gggccaatatgga

SEQ ID NO: 633107 - DNA, 13 bp, D. melanogaster
gggccacaaaaag

SEQ ID NO: 633108 - DNA, 13 bp, D. melanogaster
gggccaggccaag

SEQ ID NO: 633109 - DNA, 13 bp, D. melanogaster
gggccataaaaac

SEQ ID NO: 633110 - DNA, 13 bp, D. melanogaster
gggccataaacat

SEQ ID NO: 633111 - DNA, 14 bp, D. melanogaster
gggccatcaatacg

SEQ ID NO: 633112 - DNA, 13 bp, D. melanogaster
gggccattaaaat

SEQ ID NO: 633113 - DNA, 13 bp, D. melanogaster
gggccattcttct

SEQ ID NO: 633114 - DNA, 13 bp, D. melanogaster
gggcccagccacc

SEQ ID NO: 633115 - DNA, 13 bp, D. melanogaster
gggcccataaaaa

SEQ ID NO: 633116 - DNA, 13 bp, D. melanogaster
gggccgaaatcaa

SEQ ID NO: 633117 - DNA, 13 bp, D. melanogaster
gggcctcttctcc

SEQ ID NO: 633118 - DNA, 13 bp, D. melanogaster
gggcgaacccact

SEQ ID NO: 633119 - DNA, 13 bp, D. melanogaster
gggcgaagtgtac

SEQ ID NO: 633120 - DNA, 13 bp, D. melanogaster
gggcgatgttctg

SEQ ID NO: 633121 - DNA, 13 bp, D. melanogaster
gggcgattccaag

SEQ ID NO: 633122 - DNA, 13 bp, D. melanogaster
gggcgccacaaaa

SEQ ID NO: 633123 - DNA, 13 bp, D. melanogaster
gggcggaaaatgg

SEQ ID NO: 633124 - DNA, 13 bp, D. melanogaster
gggcgtatacgca

SEQ ID NO: 633125 - DNA, 13 bp, D. melanogaster
gggcgtatacttg

SEQ ID NO: 633126 - DNA, 13 bp, D. melanogaster
gggcgtatgcgta

SEQ ID NO: 633127 - DNA, 13 bp, D. melanogaster
gggcgtatgcgtg

SEQ ID NO: 633128 - DNA, 13 bp, D. melanogaster
gggcgtggcaaaa

SEQ ID NO: 633129 - DNA, 13 bp, D. melanogaster
gggcgtggcaaat

SEQ ID NO: 633130 - DNA, 13 bp, D. melanogaster
gggcgtggcaaca

SEQ ID NO: 633131 - DNA, 14 bp, D. melanogaster
gggcgtggcaacat

SEQ ID NO: 633132 - DNA, 13 bp, D. melanogaster
gggcgtggcaacg

SEQ ID NO: 633133 - DNA, 13 bp, D. melanogaster
gggcgtggcaagc

SEQ ID NO: 633134 - DNA, 13 bp, D. melanogaster
gggcgtggcaagt

SEQ ID NO: 633135 - DNA, 13 bp, D. melanogaster
gggcgtggcacag

SEQ ID NO: 633136 - DNA, 13 bp, D. melanogaster
gggcgtggcacat

SEQ ID NO: 633137 - DNA, 14 bp, D. melanogaster
gggcgtggcacatg

SEQ ID NO: 633138 - DNA, 13 bp, D. melanogaster
gggcgtggcacga

SEQ ID NO: 633139 - DNA, 13 bp, D. melanogaster
gggcgtggcacgg

SEQ ID NO: 633140 - DNA, 13 bp, D. melanogaster
gggcgtggcactc

SEQ ID NO: 633141 - DNA, 14 bp, D. melanogaster
gggcgtggcagccg

SEQ ID NO: 633142 - DNA, 13 bp, D. melanogaster
gggcgtggcagct

SEQ ID NO: 633143 - DNA, 14 bp, D. melanogaster
gggcgtggcagctg

SEQ ID NO: 633144 - DNA, 13 bp, D. melanogaster
gggcgtggcagga

SEQ ID NO: 633145 - DNA, 14 bp, D. melanogaster
gggcgtggcaggtg

SEQ ID NO: 633146 - DNA, 14 bp, D. melanogaster
gggcgtggcagtgg

SEQ ID NO: 633147 - DNA, 13 bp, D. melanogaster
gggcgtggcatgc

SEQ ID NO: 633148 - DNA, 13 bp, D. melanogaster
gggcgtggcatgg

SEQ ID NO: 633149 - DNA, 13 bp, D. melanogaster
gggcgtggcattg

SEQ ID NO: 633150 - DNA, 13 bp, D. melanogaster
gggcgtggccagg

SEQ ID NO: 633151 - DNA, 13 bp, D. melanogaster
gggcgtggcgcac

SEQ ID NO: 633152 - DNA, 13 bp, D. melanogaster
gggcgtggctgag

SEQ ID NO: 633153 - DNA, 13 bp, D. melanogaster
gggcgtggctgca

SEQ ID NO: 633154 - DNA, 13 bp, D. melanogaster
gggcgtggctgga

SEQ ID NO: 633155 - DNA, 13 bp, D. melanogaster
gggcgtggctgtt

SEQ ID NO: 633156 - DNA, 13 bp, D. melanogaster
gggcgtgtcagtt

SEQ ID NO: 633157 - DNA, 13 bp, D. melanogaster
gggcgttaaagtg

SEQ ID NO: 633158 - DNA, 13 bp, D. melanogaster
gggctaatccgaa

SEQ ID NO: 633159 - DNA, 13 bp, D. melanogaster
gggctatatatat

SEQ ID NO: 633160 - DNA, 13 bp, D. melanogaster
gggctattatatt

SEQ ID NO: 633161 - DNA, 13 bp, D. melanogaster
gggctcctccttc

SEQ ID NO: 633162 - DNA, 13 bp, D. melanogaster
gggctcgccacag

SEQ ID NO: 633163 - DNA, 13 bp, D. melanogaster
gggctgcagttct

SEQ ID NO: 633164 - DNA, 13 bp, D. melanogaster
gggctgctgctgc

SEQ ID NO: 633165 - DNA, 14 bp, D. melanogaster
gggctggctggctg

SEQ ID NO: 633166 - DNA, 13 bp, D. melanogaster
gggctgggaaatg

SEQ ID NO: 633167 - DNA, 13 bp, D. melanogaster
gggctggggaaaa

SEQ ID NO: 633168 - DNA, 13 bp, D. melanogaster
gggctgttttgag

SEQ ID NO: 633169 - DNA, 13 bp, D. melanogaster
gggcttgactttt

SEQ ID NO: 633170 - DNA, 13 bp, D. melanogaster
ggggaaaaacata

SEQ ID NO: 633171 - DNA, 13 bp, D. melanogaster
ggggaaaacaaat

SEQ ID NO: 633172 - DNA, 13 bp, D. melanogaster
ggggaaaacgctt

SEQ ID NO: 633173 - DNA, 13 bp, D. melanogaster
ggggaaaactgga

SEQ ID NO: 633174 - DNA, 13 bp, D. melanogaster
ggggaaaactttg

SEQ ID NO: 633175 - DNA, 13 bp, D. melanogaster
ggggaaaagtcgg

SEQ ID NO: 633176 - DNA, 13 bp, D. melanogaster
ggggaaaagtgca

SEQ ID NO: 633177 - DNA, 13 bp, D. melanogaster
ggggaaaatcgag

SEQ ID NO: 633178 - DNA, 13 bp, D. melanogaster
ggggaaaatgcga

SEQ ID NO: 633179 - DNA, 13 bp, D. melanogaster
ggggaaaatgtat

SEQ ID NO: 633180 - DNA, 13 bp, D. melanogaster
ggggaaaatgtgg

SEQ ID NO: 633181 - DNA, 13 bp, D. melanogaster
ggggaaaattcaa

SEQ ID NO: 633182 - DNA, 13 bp, D. melanogaster
ggggaaaattgca

SEQ ID NO: 633183 - DNA, 13 bp, D. melanogaster
ggggaaacaactg

SEQ ID NO: 633184 - DNA, 13 bp, D. melanogaster
ggggaaagataat

SEQ ID NO: 633185 - DNA, 13 bp, D. melanogaster
ggggaaatataaa

SEQ ID NO: 633186 - DNA, 13 bp, D. melanogaster
ggggaaattgaaa

SEQ ID NO: 633187 - DNA, 13 bp, D. melanogaster
ggggaagtcgact

SEQ ID NO: 633188 - DNA, 13 bp, D. melanogaster
ggggaatcccctt

SEQ ID NO: 633189 - DNA, 13 bp, D. melanogaster
ggggaatcgggaa

SEQ ID NO: 633190 - DNA, 14 bp, D. melanogaster
ggggacatggaaag

SEQ ID NO: 633191 - DNA, 13 bp, D. melanogaster
ggggagtggcagc

SEQ ID NO: 633192 - DNA, 13 bp, D. melanogaster
ggggatcgcgact

SEQ ID NO: 633193 - DNA, 14 bp, D. melanogaster
ggggatctggaaga

SEQ ID NO: 633194 - DNA, 13 bp, D. melanogaster
ggggatctgggga

SEQ ID NO: 633195 - DNA, 13 bp, D. melanogaster
ggggatgaacgtt

SEQ ID NO: 633196 - DNA, 13 bp, D. melanogaster
ggggattccccca

SEQ ID NO: 633197 - DNA, 13 bp, D. melanogaster
ggggcaaaaaaca

SEQ ID NO: 633198 - DNA, 14 bp, D. melanogaster
ggggcaacaacaaa

SEQ ID NO: 633199 - DNA, 13 bp, D. melanogaster
ggggcaagggact

SEQ ID NO: 633200 - DNA, 13 bp, D. melanogaster
ggggcaatggcaa

SEQ ID NO: 633201 - DNA, 13 bp, D. melanogaster
ggggcacaaaaaa

SEQ ID NO: 633202 - DNA, 13 bp, D. melanogaster
ggggcagcaaaca

SEQ ID NO: 633203 - DNA, 13 bp, D. melanogaster
ggggcagcaacaa

SEQ ID NO: 633204 - DNA, 13 bp, D. melanogaster
ggggcatgtggca

SEQ ID NO: 633205 - DNA, 14 bp, D. melanogaster
ggggcattggcatt

SEQ ID NO: 633206 - DNA, 13 bp, D. melanogaster
ggggcatttggcc

SEQ ID NO: 633207 - DNA, 13 bp, D. melanogaster
ggggccaaaaaaa

SEQ ID NO: 633208 - DNA, 14 bp, D. melanogaster
ggggcgtatacgca

SEQ ID NO: 633209 - DNA, 13 bp, D. melanogaster
ggggcgtggcaaa

SEQ ID NO: 633210 - DNA, 13 bp, D. melanogaster
ggggcgtggcaag

SEQ ID NO: 633211 - DNA, 14 bp, D. melanogaster
ggggcgtggcaagg

SEQ ID NO: 633212 - DNA, 13 bp, D. melanogaster
ggggcgtggcaat

SEQ ID NO: 633213 - DNA, 14 bp, D. melanogaster
ggggcgtggcaatg

SEQ ID NO: 633214 - DNA, 13 bp, D. melanogaster
ggggcgtggcacc

SEQ ID NO: 633215 - DNA, 13 bp, D. melanogaster
ggggcgtggcact

SEQ ID NO: 633216 - DNA, 14 bp, D. melanogaster
ggggcgtggcactg

SEQ ID NO: 633217 - DNA, 13 bp, D. melanogaster
ggggcgtggcagc

SEQ ID NO: 633218 - DNA, 14 bp, D. melanogaster
ggggcgtggcagct

SEQ ID NO: 633219 - DNA, 13 bp, D. melanogaster
ggggcgtggcata

SEQ ID NO: 633220 - DNA, 14 bp, D. melanogaster
ggggcgtggcattg

SEQ ID NO: 633221 - DNA, 13 bp, D. melanogaster
ggggcgtggccaa

SEQ ID NO: 633222 - DNA, 13 bp, D. melanogaster
ggggcgtggccca

SEQ ID NO: 633223 - DNA, 13 bp, D. melanogaster
gggggagtggcaa

SEQ ID NO: 633224 - DNA, 13 bp, D. melanogaster
gggggagtggcac

SEQ ID NO: 633225 - DNA, 13 bp, D. melanogaster
gggggcgtggcac

SEQ ID NO: 633226 - DNA, 14 bp, D. melanogaster
gggggcgtggcact

SEQ ID NO: 633227 - DNA, 14 bp, D. melanogaster
gggggcgtggcaga

SEQ ID NO: 633228 - DNA, 14 bp, D. melanogaster
gggggcgtggcagt

SEQ ID NO: 633229 - DNA, 13 bp, D. melanogaster
gggggcgtggcat

SEQ ID NO: 633230 - DNA, 13 bp, D. melanogaster
gggggcgtggcca

SEQ ID NO: 633231 - DNA, 14 bp, D. melanogaster
gggggcgtggccag

SEQ ID NO: 633232 - DNA, 14 bp, D. melanogaster
gggggcgtggccat

SEQ ID NO: 633233 - DNA, 14 bp, D. melanogaster
gggggcgtggccca

SEQ ID NO: 633234 - DNA, 14 bp, D. melanogaster
gggggcgtggccga

SEQ ID NO: 633235 - DNA, 13 bp, D. melanogaster
gggggctcgtcca

SEQ ID NO: 633236 - DNA, 13 bp, D. melanogaster
gggggtggtgcca

SEQ ID NO: 633237 - DNA, 13 bp, D. melanogaster
ggggtatctgata

SEQ ID NO: 633238 - DNA, 13 bp, D. melanogaster
ggggtcagaggtc

SEQ ID NO: 633239 - DNA, 14 bp, D. melanogaster
ggggtcaggggtca

SEQ ID NO: 633240 - DNA, 14 bp, D. melanogaster
ggggtctggtttta

SEQ ID NO: 633241 - DNA, 13 bp, D. melanogaster
ggggtgtggaaaa

SEQ ID NO: 633242 - DNA, 13 bp, D. melanogaster
ggggttaaaaaaa

SEQ ID NO: 633243 - DNA, 13 bp, D. melanogaster
ggggttgggaaaa

SEQ ID NO: 633244 - DNA, 13 bp, D. melanogaster
ggggttttccaag

SEQ ID NO: 633245 - DNA, 14 bp, D. melanogaster
ggggttttccaagg

SEQ ID NO: 633246 - DNA, 14 bp, D. melanogaster
ggggttttctccat

SEQ ID NO: 633247 - DNA, 13 bp, D. melanogaster
gggtaaacaaaaa

SEQ ID NO: 633248 - DNA, 13 bp, D. melanogaster
gggtaacatcatc

SEQ ID NO: 633249 - DNA, 14 bp, D. melanogaster
gggtaacatcatca

SEQ ID NO: 633250 - DNA, 13 bp, D. melanogaster
gggtaacttcaaa

SEQ ID NO: 633251 - DNA, 13 bp, D. melanogaster
gggtaagcaattg

SEQ ID NO: 633252 - DNA, 13 bp, D. melanogaster
gggtatacaaatt

SEQ ID NO: 633253 - DNA, 13 bp, D. melanogaster
gggtatcagatag

SEQ ID NO: 633254 - DNA, 13 bp, D. melanogaster
gggtatctgtatc

SEQ ID NO: 633255 - DNA, 13 bp, D. melanogaster
gggtatgctagat

SEQ ID NO: 633256 - DNA, 13 bp, D. melanogaster
gggtatgggaaaa

SEQ ID NO: 633257 - DNA, 14 bp, D. melanogaster
gggtatgggaatgg

SEQ ID NO: 633258 - DNA, 14 bp, D. melanogaster
gggtatttattcaa

SEQ ID NO: 633259 - DNA, 14 bp, D. melanogaster
gggtatttgatagt

SEQ ID NO: 633260 - DNA, 13 bp, D. melanogaster
gggtatttgccag

SEQ ID NO: 633261 - DNA, 13 bp, D. melanogaster
gggtcaaaactgc

SEQ ID NO: 633262 - DNA, 13 bp, D. melanogaster
gggtcaaagggca

SEQ ID NO: 633263 - DNA, 13 bp, D. melanogaster
gggtcacaaatgt

SEQ ID NO: 633264 - DNA, 13 bp, D. melanogaster
gggtcaccgggtt

SEQ ID NO: 633265 - DNA, 13 bp, D. melanogaster
gggtcagaggtca

SEQ ID NO: 633266 - DNA, 13 bp, D. melanogaster
gggtcagaggtcg

SEQ ID NO: 633267 - DNA, 13 bp, D. melanogaster
gggtcaggggtca

SEQ ID NO: 633268 - DNA, 13 bp, D. melanogaster
gggtccgctttgt

SEQ ID NO: 633269 - DNA, 13 bp, D. melanogaster
gggtctcattcgt

SEQ ID NO: 633270 - DNA, 13 bp, D. melanogaster
gggtctgaaataa

SEQ ID NO: 633271 - DNA, 13 bp, D. melanogaster
gggtctttgaact

SEQ ID NO: 633272 - DNA, 13 bp, D. melanogaster
gggtcttttcggc

SEQ ID NO: 633273 - DNA, 13 bp, D. melanogaster
gggtgaacctcgt

SEQ ID NO: 633274 - DNA, 13 bp, D. melanogaster
gggtgcaaaaaaa

SEQ ID NO: 633275 - DNA, 13 bp, D. melanogaster
gggtgcattccac

SEQ ID NO: 633276 - DNA, 13 bp, D. melanogaster
gggtggcaaatgg

SEQ ID NO: 633277 - DNA, 13 bp, D. melanogaster
gggtggcaagtgg

SEQ ID NO: 633278 - DNA, 13 bp, D. melanogaster
gggtggcactttt

SEQ ID NO: 633279 - DNA, 14 bp, D. melanogaster
gggtggcgccaagc

SEQ ID NO: 633280 - DNA, 13 bp, D. melanogaster
gggtggcttcgag

SEQ ID NO: 633281 - DNA, 13 bp, D. melanogaster
gggtgggtgactt

SEQ ID NO: 633282 - DNA, 14 bp, D. melanogaster
gggtggtgcagtgg

SEQ ID NO: 633283 - DNA, 13 bp, D. melanogaster
gggtggtgtgcca

SEQ ID NO: 633284 - DNA, 13 bp, D. melanogaster
gggtgtcaaaaaa

SEQ ID NO: 633285 - DNA, 13 bp, D. melanogaster
gggtgtgcgagtg

SEQ ID NO: 633286 - DNA, 13 bp, D. melanogaster
gggttactatgat

SEQ ID NO: 633287 - DNA, 13 bp, D. melanogaster
gggttcggaaaaa

SEQ ID NO: 633288 - DNA, 14 bp, D. melanogaster
gggttcttaactcc

SEQ ID NO: 633289 - DNA, 13 bp, D. melanogaster
gggttggaaaatt

SEQ ID NO: 633290 - DNA, 13 bp, D. melanogaster
gggttgtatccac

SEQ ID NO: 633291 - DNA, 13 bp, D. melanogaster
gggttttctccat

SEQ ID NO: 633292 - DNA, 13 bp, D. melanogaster
gggttttgaatat

SEQ ID NO: 633293 - DNA, 13 bp, D. melanogaster
gggttttgccaaa

SEQ ID NO: 633294 - DNA, 14 bp, D. melanogaster
gggttttgctatgt

SEQ ID NO: 633295 - DNA, 13 bp, D. melanogaster
gggttttggccaa

SEQ ID NO: 633296 - DNA, 13 bp, D. melanogaster
gggtttttccttg

SEQ ID NO: 633297 - DNA, 14 bp, D. melanogaster
ggtaaaataagaca

SEQ ID NO: 633298 - DNA, 13 bp, D. melanogaster
ggtaaaatgaaat

SEQ ID NO: 633299 - DNA, 13 bp, D. melanogaster
ggtaaacaaaaat

SEQ ID NO: 633300 - DNA, 13 bp, D. melanogaster
ggtaaacaaattt

SEQ ID NO: 633301 - DNA, 13 bp, D. melanogaster
ggtaaacagtttc

SEQ ID NO: 633302 - DNA, 13 bp, D. melanogaster
ggtaaacccaaat

SEQ ID NO: 633303 - DNA, 13 bp, D. melanogaster
ggtaaactaggca

SEQ ID NO: 633304 - DNA, 13 bp, D. melanogaster
ggtaaagtatttg

SEQ ID NO: 633305 - DNA, 14 bp, D. melanogaster
ggtaaatacgttat

SEQ ID NO: 633306 - DNA, 13 bp, D. melanogaster
ggtaaatattatt

SEQ ID NO: 633307 - DNA, 14 bp, D. melanogaster
ggtaaatatttatt

SEQ ID NO: 633308 - DNA, 13 bp, D. melanogaster
ggtaaatgccaat

SEQ ID NO: 633309 - DNA, 13 bp, D. melanogaster
ggtaaatggaaaa

SEQ ID NO: 633310 - DNA, 13 bp, D. melanogaster
ggtaacaataata

SEQ ID NO: 633311 - DNA, 14 bp, D. melanogaster
ggtaacatcatgat

SEQ ID NO: 633312 - DNA, 13 bp, D. melanogaster
ggtaaggggtaac

SEQ ID NO: 633313 - DNA, 13 bp, D. melanogaster
ggtaaggtaaggt

SEQ ID NO: 633314 - DNA, 13 bp, D. melanogaster
ggtaagtctcgca

SEQ ID NO: 633315 - DNA, 13 bp, D. melanogaster
ggtaataaaattt

SEQ ID NO: 633316 - DNA, 13 bp, D. melanogaster
ggtaatatatata

SEQ ID NO: 633317 - DNA, 13 bp, D. melanogaster
ggtaattattaat

SEQ ID NO: 633318 - DNA, 13 bp, D. melanogaster
ggtaattgcattt

SEQ ID NO: 633319 - DNA, 13 bp, D. melanogaster
ggtaattgctatt

SEQ ID NO: 633320 - DNA, 13 bp, D. melanogaster
ggtaattgtaaaa

SEQ ID NO: 633321 - DNA, 14 bp, D. melanogaster
ggtaattgtaaaat

SEQ ID NO: 633322 - DNA, 13 bp, D. melanogaster
ggtaattgttata

SEQ ID NO: 633323 - DNA, 13 bp, D. melanogaster
ggtaatttaaata

SEQ ID NO: 633324 - DNA, 13 bp, D. melanogaster
ggtaatttgatgt

SEQ ID NO: 633325 - DNA, 13 bp, D. melanogaster
ggtaattttaaaa

SEQ ID NO: 633326 - DNA, 13 bp, D. melanogaster
ggtacacacacac

SEQ ID NO: 633327 - DNA, 13 bp, D. melanogaster
ggtacactacatt

SEQ ID NO: 633328 - DNA, 13 bp, D. melanogaster
ggtaccatcatca

SEQ ID NO: 633329 - DNA, 13 bp, D. melanogaster
ggtacctttttgt

SEQ ID NO: 633330 - DNA, 13 bp, D. melanogaster
ggtactgaaggag

SEQ ID NO: 633331 - DNA, 13 bp, D. melanogaster
ggtactggtactg

SEQ ID NO: 633332 - DNA, 14 bp, D. melanogaster
ggtagacatttctt

SEQ ID NO: 633333 - DNA, 13 bp, D. melanogaster
ggtagagttagaa

SEQ ID NO: 633334 - DNA, 13 bp, D. melanogaster
ggtagatagatag

SEQ ID NO: 633335 - DNA, 13 bp, D. melanogaster
ggtagattaagtt

SEQ ID NO: 633336 - DNA, 13 bp, D. melanogaster
ggtaggaaaatgt

SEQ ID NO: 633337 - DNA, 13 bp, D. melanogaster
ggtaggaaaatta

SEQ ID NO: 633338 - DNA, 13 bp, D. melanogaster
ggtagtaattgat

SEQ ID NO: 633339 - DNA, 14 bp, D. melanogaster
ggtagtagtagtag

SEQ ID NO: 633340 - DNA, 13 bp, D. melanogaster
ggtagtggcaaaa

SEQ ID NO: 633341 - DNA, 14 bp, D. melanogaster
ggtagttggtagtt

SEQ ID NO: 633342 - DNA, 13 bp, D. melanogaster
ggtataaaaatgt

SEQ ID NO: 633343 - DNA, 13 bp, D. melanogaster
ggtataaataaat

SEQ ID NO: 633344 - DNA, 13 bp, D. melanogaster
ggtataaatattt

SEQ ID NO: 633345 - DNA, 13 bp, D. melanogaster
ggtataacattcc

SEQ ID NO: 633346 - DNA, 14 bp, D. melanogaster
ggtataattggctt

SEQ ID NO: 633347 - DNA, 13 bp, D. melanogaster
ggtatacatacat

SEQ ID NO: 633348 - DNA, 13 bp, D. melanogaster
ggtatacatatgt

SEQ ID NO: 633349 - DNA, 13 bp, D. melanogaster
ggtatacccacaa

SEQ ID NO: 633350 - DNA, 13 bp, D. melanogaster
ggtatatatataa

SEQ ID NO: 633351 - DNA, 13 bp, D. melanogaster
ggtatatatgata

SEQ ID NO: 633352 - DNA, 13 bp, D. melanogaster
ggtatatatgtat

SEQ ID NO: 633353 - DNA, 13 bp, D. melanogaster
ggtatatggtata

SEQ ID NO: 633354 - DNA, 14 bp, D. melanogaster
ggtatatggtatat

SEQ ID NO: 633355 - DNA, 13 bp, D. melanogaster
ggtatatgtatgt

SEQ ID NO: 633356 - DNA, 13 bp, D. melanogaster
ggtatatttatat

SEQ ID NO: 633357 - DNA, 13 bp, D. melanogaster
ggtatccacattt

SEQ ID NO: 633358 - DNA, 14 bp, D. melanogaster
ggtatccacatttg

SEQ ID NO: 633359 - DNA, 13 bp, D. melanogaster
ggtatccgatagt

SEQ ID NO: 633360 - DNA, 13 bp, D. melanogaster
ggtatcggtatcg

SEQ ID NO: 633361 - DNA, 13 bp, D. melanogaster
ggtatctgccaca

SEQ ID NO: 633362 - DNA, 13 bp, D. melanogaster
ggtatctgtatct

SEQ ID NO: 633363 - DNA, 14 bp, D. melanogaster
ggtatctgtatctg

SEQ ID NO: 633364 - DNA, 13 bp, D. melanogaster
ggtatctgtgtgt

SEQ ID NO: 633365 - DNA, 13 bp, D. melanogaster
ggtatgaattttc

SEQ ID NO: 633366 - DNA, 13 bp, D. melanogaster
ggtatgggaatgg

SEQ ID NO: 633367 - DNA, 14 bp, D. melanogaster
ggtatgggtatggc

SEQ ID NO: 633368 - DNA, 13 bp, D. melanogaster
ggtatgtacatat

SEQ ID NO: 633369 - DNA, 13 bp, D. melanogaster
ggtattcgaatgc

SEQ ID NO: 633370 - DNA, 13 bp, D. melanogaster
ggtattgataaca

SEQ ID NO: 633371 - DNA, 13 bp, D. melanogaster
ggtattgggaaat

SEQ ID NO: 633372 - DNA, 13 bp, D. melanogaster
ggtattgggcaag

SEQ ID NO: 633373 - DNA, 13 bp, D. melanogaster
ggtattggtattg

SEQ ID NO: 633374 - DNA, 14 bp, D. melanogaster
ggtatttaatggaa

SEQ ID NO: 633375 - DNA, 13 bp, D. melanogaster
ggtatttgatagt

SEQ ID NO: 633376 - DNA, 13 bp, D. melanogaster
ggtatttgcaggg

SEQ ID NO: 633377 - DNA, 13 bp, D. melanogaster
ggtattttaaaat

SEQ ID NO: 633378 - DNA, 13 bp, D. melanogaster
ggtcaaaaacaaa

SEQ ID NO: 633379 - DNA, 14 bp, D. melanogaster
ggtcaaaaacaaag

SEQ ID NO: 633380 - DNA, 13 bp, D. melanogaster
ggtcaaaaatagt

SEQ ID NO: 633381 - DNA, 13 bp, D. melanogaster
ggtcaaaaccagg

SEQ ID NO: 633382 - DNA, 13 bp, D. melanogaster
ggtcaaaactatt

SEQ ID NO: 633383 - DNA, 13 bp, D. melanogaster
ggtcaaaactttc

SEQ ID NO: 633384 - DNA, 13 bp, D. melanogaster
ggtcaaattattt

SEQ ID NO: 633385 - DNA, 13 bp, D. melanogaster
ggtcaacggggga

SEQ ID NO: 633386 - DNA, 13 bp, D. melanogaster
ggtcaacggtcaa

SEQ ID NO: 633387 - DNA, 13 bp, D. melanogaster
ggtcaagcgaatg

SEQ ID NO: 633388 - DNA, 13 bp, D. melanogaster
ggtcaatgatttg

SEQ ID NO: 633389 - DNA, 13 bp, D. melanogaster
ggtcaccgccgaa

SEQ ID NO: 633390 - DNA, 13 bp, D. melanogaster
ggtcactgcactc

SEQ ID NO: 633391 - DNA, 13 bp, D. melanogaster
ggtcactggcaat

SEQ ID NO: 633392 - DNA, 13 bp, D. melanogaster
ggtcagcaaacgc

SEQ ID NO: 633393 - DNA, 13 bp, D. melanogaster
ggtcagctcccct

SEQ ID NO: 633394 - DNA, 13 bp, D. melanogaster
ggtcaggaggagc

SEQ ID NO: 633395 - DNA, 13 bp, D. melanogaster
ggtcaggggtcag

SEQ ID NO: 633396 - DNA, 13 bp, D. melanogaster
ggtcatcaaataa

SEQ ID NO: 633397 - DNA, 13 bp, D. melanogaster
ggtcatttctgta

SEQ ID NO: 633398 - DNA, 13 bp, D. melanogaster
ggtcattttatct

SEQ ID NO: 633399 - DNA, 13 bp, D. melanogaster
ggtcatttttaat

SEQ ID NO: 633400 - DNA, 13 bp, D. melanogaster
ggtcattttttgt

SEQ ID NO: 633401 - DNA, 14 bp, D. melanogaster
ggtcattttttgta

SEQ ID NO: 633402 - DNA, 13 bp, D. melanogaster
ggtccagaagaac

SEQ ID NO: 633403 - DNA, 13 bp, D. melanogaster
ggtcctgctcctg

SEQ ID NO: 633404 - DNA, 13 bp, D. melanogaster
ggtccttcgtcct

SEQ ID NO: 633405 - DNA, 13 bp, D. melanogaster
ggtcctttggcca

SEQ ID NO: 633406 - DNA, 13 bp, D. melanogaster
ggtccttttgaaa

SEQ ID NO: 633407 - DNA, 13 bp, D. melanogaster
ggtcgaaaaaagc

SEQ ID NO: 633408 - DNA, 13 bp, D. melanogaster
ggtcgaaaacgct

SEQ ID NO: 633409 - DNA, 13 bp, D. melanogaster
ggtcgaaaatgat

SEQ ID NO: 633410 - DNA, 14 bp, D. melanogaster
ggtcgacgatgtgg

SEQ ID NO: 633411 - DNA, 13 bp, D. melanogaster
ggtcgagcaaaat

SEQ ID NO: 633412 - DNA, 13 bp, D. melanogaster
ggtcgattttgag

SEQ ID NO: 633413 - DNA, 13 bp, D. melanogaster
ggtcggaaaaatc

SEQ ID NO: 633414 - DNA, 14 bp, D. melanogaster
ggtcggaaaaatcg

SEQ ID NO: 633415 - DNA, 13 bp, D. melanogaster
ggtcggaaaatgg

SEQ ID NO: 633416 - DNA, 13 bp, D. melanogaster
ggtcggaattcaa

SEQ ID NO: 633417 - DNA, 13 bp, D. melanogaster
ggtcggtcggtca

SEQ ID NO: 633418 - DNA, 13 bp, D. melanogaster
ggtcgtaccaaag

SEQ ID NO: 633419 - DNA, 19 bp, D. melanogaster
ggtctcccactaagggact

SEQ ID NO: 633420 - DNA, 13 bp, D. melanogaster
ggtctccttgggc

SEQ ID NO: 633421 - DNA, 13 bp, D. melanogaster
ggtctgatggcca

SEQ ID NO: 633422 - DNA, 13 bp, D. melanogaster
ggtctgctggcca

SEQ ID NO: 633423 - DNA, 13 bp, D. melanogaster
ggtctgggatttt

SEQ ID NO: 633424 - DNA, 13 bp, D. melanogaster
ggtctggggtctg

SEQ ID NO: 633425 - DNA, 13 bp, D. melanogaster
ggtcttccaatta

SEQ ID NO: 633426 - DNA, 13 bp, D. melanogaster
ggtcttcctcatt

SEQ ID NO: 633427 - DNA, 14 bp, D. melanogaster
ggtcttggtcttgg

SEQ ID NO: 633428 - DNA, 14 bp, D. melanogaster
ggtctttatgacct

SEQ ID NO: 633429 - DNA, 13 bp, D. melanogaster
ggtgaaaaacaaa

SEQ ID NO: 633430 - DNA, 13 bp, D. melanogaster
ggtgaaaagtggg

SEQ ID NO: 633431 - DNA, 13 bp, D. melanogaster
ggtgaaaggtgaa

SEQ ID NO: 633432 - DNA, 13 bp, D. melanogaster
ggtgaaattcgtt

SEQ ID NO: 633433 - DNA, 13 bp, D. melanogaster
ggtgaagaaacag

SEQ ID NO: 633434 - DNA, 13 bp, D. melanogaster
ggtgaatcgtatt

SEQ ID NO: 633435 - DNA, 13 bp, D. melanogaster
ggtgaatggtgaa

SEQ ID NO: 633436 - DNA, 13 bp, D. melanogaster
ggtgaatgtgaat

SEQ ID NO: 633437 - DNA, 13 bp, D. melanogaster
ggtgacaggcatt

SEQ ID NO: 633438 - DNA, 13 bp, D. melanogaster
ggtgacattaaga

SEQ ID NO: 633439 - DNA, 13 bp, D. melanogaster
ggtgaccccgatt

SEQ ID NO: 633440 - DNA, 14 bp, D. melanogaster
ggtgacggccaaaa

SEQ ID NO: 633441 - DNA, 13 bp, D. melanogaster
ggtgagcggcaaa

SEQ ID NO: 633442 - DNA, 13 bp, D. melanogaster
ggtgagctgcaca

SEQ ID NO: 633443 - DNA, 13 bp, D. melanogaster
ggtgagctggtga

SEQ ID NO: 633444 - DNA, 14 bp, D. melanogaster
ggtgaggatatcga

SEQ ID NO: 633445 - DNA, 13 bp, D. melanogaster
ggtgatcagcgat

SEQ ID NO: 633446 - DNA, 13 bp, D. melanogaster
ggtgatcagcgtt

SEQ ID NO: 633447 - DNA, 13 bp, D. melanogaster
ggtgatcatgtct

SEQ ID NO: 633448 - DNA, 14 bp, D. melanogaster
ggtgatccagaaac

SEQ ID NO: 633449 - DNA, 13 bp, D. melanogaster
ggtgatctttata

SEQ ID NO: 633450 - DNA, 13 bp, D. melanogaster
ggtgatgatggtg

SEQ ID NO: 633451 - DNA, 13 bp, D. melanogaster
ggtgatggacaat

SEQ ID NO: 633452 - DNA, 13 bp, D. melanogaster
ggtgatggcatta

SEQ ID NO: 633453 - DNA, 13 bp, D. melanogaster
ggtgatggcgatg

SEQ ID NO: 633454 - DNA, 14 bp, D. melanogaster
ggtgatggtgatga

SEQ ID NO: 633455 - DNA, 13 bp, D. melanogaster
ggtgatgttcttc

SEQ ID NO: 633456 - DNA, 13 bp, D. melanogaster
ggtgcaaaaatag

SEQ ID NO: 633457 - DNA, 13 bp, D. melanogaster
ggtgcaaaaggag

SEQ ID NO: 633458 - DNA, 13 bp, D. melanogaster
ggtgcaattaaaa

SEQ ID NO: 633459 - DNA, 13 bp, D. melanogaster
ggtgcagatgcag

SEQ ID NO: 633460 - DNA, 13 bp, D. melanogaster
ggtgcatggtgca

SEQ ID NO: 633461 - DNA, 14 bp, D. melanogaster
ggtgcattgctcaa

SEQ ID NO: 633462 - DNA, 13 bp, D. melanogaster
ggtgccaattcga

SEQ ID NO: 633463 - DNA, 13 bp, D. melanogaster
ggtgccagaggga

SEQ ID NO: 633464 - DNA, 13 bp, D. melanogaster
ggtgcctcccatt

SEQ ID NO: 633465 - DNA, 13 bp, D. melanogaster
ggtgcctttcttg

SEQ ID NO: 633466 - DNA, 13 bp, D. melanogaster
ggtgcgaaagaga

SEQ ID NO: 633467 - DNA, 13 bp, D. melanogaster
ggtgcggaaagca

SEQ ID NO: 633468 - DNA, 13 bp, D. melanogaster
ggtgcgtgccaca

SEQ ID NO: 633469 - DNA, 13 bp, D. melanogaster
ggtgcgtgtgaag

SEQ ID NO: 633470 - DNA, 13 bp, D. melanogaster
ggtgctcttttgg

SEQ ID NO: 633471 - DNA, 13 bp, D. melanogaster
ggtgctgctgctg

SEQ ID NO: 633472 - DNA, 14 bp, D. melanogaster
ggtgctgctgctgt

SEQ ID NO: 633473 - DNA, 14 bp, D. melanogaster
ggtgctggacatgc

SEQ ID NO: 633474 - DNA, 13 bp, D. melanogaster
ggtgctgggtgct

SEQ ID NO: 633475 - DNA, 14 bp, D. melanogaster
ggtgctggtgttgc

SEQ ID NO: 633476 - DNA, 13 bp, D. melanogaster
ggtggaaaaacaa

SEQ ID NO: 633477 - DNA, 13 bp, D. melanogaster
ggtggaaaaagtg

SEQ ID NO: 633478 - DNA, 13 bp, D. melanogaster
ggtggaaaaatca

SEQ ID NO: 633479 - DNA, 13 bp, D. melanogaster
ggtggaaaaatgg

SEQ ID NO: 633480 - DNA, 13 bp, D. melanogaster
ggtggaaaacaaa

SEQ ID NO: 633481 - DNA, 13 bp, D. melanogaster
ggtggaaaacttt

SEQ ID NO: 633482 - DNA, 13 bp, D. melanogaster
ggtggaaaagcca

SEQ ID NO: 633483 - DNA, 13 bp, D. melanogaster
ggtggaaaagctg

SEQ ID NO: 633484 - DNA, 13 bp, D. melanogaster
ggtggaaaaggtg

SEQ ID NO: 633485 - DNA, 14 bp, D. melanogaster
ggtggaaaaggtgc

SEQ ID NO: 633486 - DNA, 13 bp, D. melanogaster
ggtggaaaatcgg

SEQ ID NO: 633487 - DNA, 13 bp, D. melanogaster
ggtggaaaatgaa

SEQ ID NO: 633488 - DNA, 13 bp, D. melanogaster
ggtggaaaatgcg

SEQ ID NO: 633489 - DNA, 13 bp, D. melanogaster
ggtggaaaatggg

SEQ ID NO: 633490 - DNA, 13 bp, D. melanogaster
ggtggaaaatgtg

SEQ ID NO: 633491 - DNA, 13 bp, D. melanogaster
ggtggaaacagag

SEQ ID NO: 633492 - DNA, 13 bp, D. melanogaster
ggtggaaaggggc

SEQ ID NO: 633493 - DNA, 13 bp, D. melanogaster
ggtggaaaggtcc

SEQ ID NO: 633494 - DNA, 13 bp, D. melanogaster
ggtggaataaaca

SEQ ID NO: 633495 - DNA, 13 bp, D. melanogaster
ggtggaatatttc

SEQ ID NO: 633496 - DNA, 13 bp, D. melanogaster
ggtggaatccaga

SEQ ID NO: 633497 - DNA, 13 bp, D. melanogaster
ggtggacattgat

SEQ ID NO: 633498 - DNA, 13 bp, D. melanogaster
ggtggactccatg

SEQ ID NO: 633499 - DNA, 13 bp, D. melanogaster
ggtggaggcctgg

SEQ ID NO: 633500 - DNA, 13 bp, D. melanogaster
ggtggatagtttc

SEQ ID NO: 633501 - DNA, 13 bp, D. melanogaster
ggtggatgagcat

SEQ ID NO: 633502 - DNA, 13 bp, D. melanogaster
ggtggcaaaaagg

SEQ ID NO: 633503 - DNA, 13 bp, D. melanogaster
ggtggcaaagtgg

SEQ ID NO: 633504 - DNA, 13 bp, D. melanogaster
ggtggcaaatggc

SEQ ID NO: 633505 - DNA, 13 bp, D. melanogaster
ggtggcaaccctg

SEQ ID NO: 633506 - DNA, 13 bp, D. melanogaster
ggtggcaactctg

SEQ ID NO: 633507 - DNA, 13 bp, D. melanogaster
ggtggcaaggaca

SEQ ID NO: 633508 - DNA, 14 bp, D. melanogaster
ggtggcaagtggca

SEQ ID NO: 633509 - DNA, 13 bp, D. melanogaster
ggtggcaccgcca

SEQ ID NO: 633510 - DNA, 14 bp, D. melanogaster
ggtggcaccgccat

SEQ ID NO: 633511 - DNA, 13 bp, D. melanogaster
ggtggcacgctga

SEQ ID NO: 633512 - DNA, 13 bp, D. melanogaster
ggtggcagagtgg

SEQ ID NO: 633513 - DNA, 13 bp, D. melanogaster
ggtggcagcaaca

SEQ ID NO: 633514 - DNA, 13 bp, D. melanogaster
ggtggcagccaca

SEQ ID NO: 633515 - DNA, 13 bp, D. melanogaster
ggtggcagtgggt

SEQ ID NO: 633516 - DNA, 13 bp, D. melanogaster
ggtggcatggtga

SEQ ID NO: 633517 - DNA, 13 bp, D. melanogaster
ggtggcatttttc

SEQ ID NO: 633518 - DNA, 14 bp, D. melanogaster
ggtggcatttttct

SEQ ID NO: 633519 - DNA, 13 bp, D. melanogaster
ggtggccaaaaca

SEQ ID NO: 633520 - DNA, 13 bp, D. melanogaster
ggtggccaaatgg

SEQ ID NO: 633521 - DNA, 14 bp, D. melanogaster
ggtggccatgcaaa

SEQ ID NO: 633522 - DNA, 14 bp, D. melanogaster
ggtggccattatgg

SEQ ID NO: 633523 - DNA, 13 bp, D. melanogaster
ggtggcctgctcg

SEQ ID NO: 633524 - DNA, 13 bp, D. melanogaster
ggtggcctgcttg

SEQ ID NO: 633525 - DNA, 13 bp, D. melanogaster
ggtggcgatggtg

SEQ ID NO: 633526 - DNA, 13 bp, D. melanogaster
ggtggcgccacct

SEQ ID NO: 633527 - DNA, 13 bp, D. melanogaster
ggtggcggatgaa

SEQ ID NO: 633528 - DNA, 14 bp, D. melanogaster
ggtggcgtatacgt

SEQ ID NO: 633529 - DNA, 13 bp, D. melanogaster
ggtggctcagtgg

SEQ ID NO: 633530 - DNA, 13 bp, D. melanogaster
ggtggctgctccc

SEQ ID NO: 633531 - DNA, 13 bp, D. melanogaster
ggtggctgctgct

SEQ ID NO: 633532 - DNA, 13 bp, D. melanogaster
ggtggctggatgg

SEQ ID NO: 633533 - DNA, 13 bp, D. melanogaster
ggtgggaaaatcg

SEQ ID NO: 633534 - DNA, 13 bp, D. melanogaster
ggtgggaaaatgg

SEQ ID NO: 633535 - DNA, 13 bp, D. melanogaster
ggtgggagcgaga

SEQ ID NO: 633536 - DNA, 14 bp, D. melanogaster
ggtgggcaaacgat

SEQ ID NO: 633537 - DNA, 13 bp, D. melanogaster
ggtgggcggaaaa

SEQ ID NO: 633538 - DNA, 13 bp, D. melanogaster
ggtgggcgtggca

SEQ ID NO: 633539 - DNA, 14 bp, D. melanogaster
ggtgggcgtggcac

SEQ ID NO: 633540 - DNA, 15 bp, D. melanogaster
ggtgggcgtggcagg

SEQ ID NO: 633541 - DNA, 14 bp, D. melanogaster
ggtgggcgtggcca

SEQ ID NO: 633542 - DNA, 13 bp, D. melanogaster
ggtgggtcgacga

SEQ ID NO: 633543 - DNA, 13 bp, D. melanogaster
ggtgggtggaaaa

SEQ ID NO: 633544 - DNA, 13 bp, D. melanogaster
ggtgggtggcatt

SEQ ID NO: 633545 - DNA, 14 bp, D. melanogaster
ggtgggtggtggca

SEQ ID NO: 633546 - DNA, 13 bp, D. melanogaster
ggtgggtgtggca

SEQ ID NO: 633547 - DNA, 13 bp, D. melanogaster
ggtggtaaccaaa

SEQ ID NO: 633548 - DNA, 13 bp, D. melanogaster
ggtggtgaccccg

SEQ ID NO: 633549 - DNA, 13 bp, D. melanogaster
ggtggtgatgagc

SEQ ID NO: 633550 - DNA, 13 bp, D. melanogaster
ggtggtgatgatg

SEQ ID NO: 633551 - DNA, 13 bp, D. melanogaster
ggtggtgcaggtg

SEQ ID NO: 633552 - DNA, 13 bp, D. melanogaster
ggtggtgcagtgg

SEQ ID NO: 633553 - DNA, 13 bp, D. melanogaster
ggtggtgctgatg

SEQ ID NO: 633554 - DNA, 14 bp, D. melanogaster
ggtggtgctgctgc

SEQ ID NO: 633555 - DNA, 13 bp, D. melanogaster
ggtggtggaaaat

SEQ ID NO: 633556 - DNA, 14 bp, D. melanogaster
ggtggtgggcggaa

SEQ ID NO: 633557 - DNA, 13 bp, D. melanogaster
ggtggtggtgcaa

SEQ ID NO: 633558 - DNA, 13 bp, D. melanogaster
ggtggtggtgcag

SEQ ID NO: 633559 - DNA, 13 bp, D. melanogaster
ggtggttaccggc

SEQ ID NO: 633560 - DNA, 13 bp, D. melanogaster
ggtggttcagtgg

SEQ ID NO: 633561 - DNA, 14 bp, D. melanogaster
ggtggttcagtggt

SEQ ID NO: 633562 - DNA, 13 bp, D. melanogaster
ggtgtaaaagttt

SEQ ID NO: 633563 - DNA, 13 bp, D. melanogaster
ggtgtacaaagaa

SEQ ID NO: 633564 - DNA, 13 bp, D. melanogaster
ggtgtacattaag

SEQ ID NO: 633565 - DNA, 13 bp, D. melanogaster
ggtgtatctaaag

SEQ ID NO: 633566 - DNA, 14 bp, D. melanogaster
ggtgtatctgtatc

SEQ ID NO: 633567 - DNA, 13 bp, D. melanogaster
ggtgtcctgggtg

SEQ ID NO: 633568 - DNA, 14 bp, D. melanogaster
ggtgtcctttggat

SEQ ID NO: 633569 - DNA, 13 bp, D. melanogaster
ggtgtgaaaaatg

SEQ ID NO: 633570 - DNA, 13 bp, D. melanogaster
ggtgtgcattctg

SEQ ID NO: 633571 - DNA, 13 bp, D. melanogaster
ggtgtgcgtgtga

SEQ ID NO: 633572 - DNA, 13 bp, D. melanogaster
ggtgtgcgtgtgc

SEQ ID NO: 633573 - DNA, 14 bp, D. melanogaster
ggtgtggcagtttt

SEQ ID NO: 633574 - DNA, 14 bp, D. melanogaster
ggtgtgtggcagct

SEQ ID NO: 633575 - DNA, 13 bp, D. melanogaster
ggtgtgttgctga

SEQ ID NO: 633576 - DNA, 13 bp, D. melanogaster
ggtgttataaggt

SEQ ID NO: 633577 - DNA, 13 bp, D. melanogaster
ggtgttccaaagg

SEQ ID NO: 633578 - DNA, 13 bp, D. melanogaster
ggtgttcccagaa

SEQ ID NO: 633579 - DNA, 14 bp, D. melanogaster
ggtgttgctgctga

SEQ ID NO: 633580 - DNA, 13 bp, D. melanogaster
ggtgtttaacttt

SEQ ID NO: 633581 - DNA, 13 bp, D. melanogaster
ggtgtttccaaaa

SEQ ID NO: 633582 - DNA, 13 bp, D. melanogaster
ggtgtttctatgt

SEQ ID NO: 633583 - DNA, 13 bp, D. melanogaster
ggttaaagttaaa

SEQ ID NO: 633584 - DNA, 13 bp, D. melanogaster
ggttaaatttatt

SEQ ID NO: 633585 - DNA, 14 bp, D. melanogaster
ggttaaatttatta

SEQ ID NO: 633586 - DNA, 13 bp, D. melanogaster
ggttaagcgcgac

SEQ ID NO: 633587 - DNA, 13 bp, D. melanogaster
ggttaagtggaaa

SEQ ID NO: 633588 - DNA, 13 bp, D. melanogaster
ggttaagttccag

SEQ ID NO: 633589 - DNA, 13 bp, D. melanogaster
ggttaatgaattt

SEQ ID NO: 633590 - DNA, 13 bp, D. melanogaster
ggttaattaaaat

SEQ ID NO: 633591 - DNA, 13 bp, D. melanogaster
ggttacttcagta

SEQ ID NO: 633592 - DNA, 13 bp, D. melanogaster
ggttactttccac

SEQ ID NO: 633593 - DNA, 13 bp, D. melanogaster
ggttataaaatat

SEQ ID NO: 633594 - DNA, 13 bp, D. melanogaster
ggttataattatt

SEQ ID NO: 633595 - DNA, 13 bp, D. melanogaster
ggttatagtttat

SEQ ID NO: 633596 - DNA, 13 bp, D. melanogaster
ggttatatacata

SEQ ID NO: 633597 - DNA, 13 bp, D. melanogaster
ggttatatttcct

SEQ ID NO: 633598 - DNA, 13 bp, D. melanogaster
ggttatcaaagag

SEQ ID NO: 633599 - DNA, 13 bp, D. melanogaster
ggttatcattgta

SEQ ID NO: 633600 - DNA, 14 bp, D. melanogaster
ggttatctattata

SEQ ID NO: 633601 - DNA, 14 bp, D. melanogaster
ggttatctatttta

SEQ ID NO: 633602 - DNA, 13 bp, D. melanogaster
ggttatctttccc

SEQ ID NO: 633603 - DNA, 13 bp, D. melanogaster
ggttatggttatg

SEQ ID NO: 633604 - DNA, 13 bp, D. melanogaster
ggttatttaaata

SEQ ID NO: 633605 - DNA, 14 bp, D. melanogaster
ggttcaacagcgac

SEQ ID NO: 633606 - DNA, 13 bp, D. melanogaster
ggttcaactattt

SEQ ID NO: 633607 - DNA, 13 bp, D. melanogaster
ggttcagatgcga

SEQ ID NO: 633608 - DNA, 13 bp, D. melanogaster
ggttcagctaacc

SEQ ID NO: 633609 - DNA, 13 bp, D. melanogaster
ggttcaggttcag

SEQ ID NO: 633610 - DNA, 13 bp, D. melanogaster
ggttcagtggttc

SEQ ID NO: 633611 - DNA, 13 bp, D. melanogaster
ggttcagttcagt

SEQ ID NO: 633612 - DNA, 13 bp, D. melanogaster
ggttcagttcggt

SEQ ID NO: 633613 - DNA, 14 bp, D. melanogaster
ggttcagttcggtt

SEQ ID NO: 633614 - DNA, 13 bp, D. melanogaster
ggttcagtttggt

SEQ ID NO: 633615 - DNA, 13 bp, D. melanogaster
ggttcatcatctt

SEQ ID NO: 633616 - DNA, 13 bp, D. melanogaster
ggttcccccacca

SEQ ID NO: 633617 - DNA, 13 bp, D. melanogaster
ggttcccctaccg

SEQ ID NO: 633618 - DNA, 13 bp, D. melanogaster
ggttcctttaagt

SEQ ID NO: 633619 - DNA, 13 bp, D. melanogaster
ggttcgactattt

SEQ ID NO: 633620 - DNA, 13 bp, D. melanogaster
ggttcgcttcggt

SEQ ID NO: 633621 - DNA, 14 bp, D. melanogaster
ggttcggttcggtt

SEQ ID NO: 633622 - DNA, 13 bp, D. melanogaster
ggttcttattgga

SEQ ID NO: 633623 - DNA, 13 bp, D. melanogaster
ggttcttgaggat

SEQ ID NO: 633624 - DNA, 13 bp, D. melanogaster
ggttgaaaaacat

SEQ ID NO: 633625 - DNA, 13 bp, D. melanogaster
ggttgagattaag

SEQ ID NO: 633626 - DNA, 13 bp, D. melanogaster
ggttgagattcag

SEQ ID NO: 633627 - DNA, 13 bp, D. melanogaster
ggttgattacatg

SEQ ID NO: 633628 - DNA, 14 bp, D. melanogaster
ggttgattacctgc

SEQ ID NO: 633629 - DNA, 13 bp, D. melanogaster
ggttgcagctcct

SEQ ID NO: 633630 - DNA, 13 bp, D. melanogaster
ggttgccagttgc

SEQ ID NO: 633631 - DNA, 13 bp, D. melanogaster
ggttgctcggatg

SEQ ID NO: 633632 - DNA, 13 bp, D. melanogaster
ggttggaaaaaaa

SEQ ID NO: 633633 - DNA, 13 bp, D. melanogaster
ggttggaaaatgg

SEQ ID NO: 633634 - DNA, 13 bp, D. melanogaster
ggttggctggatg

SEQ ID NO: 633635 - DNA, 13 bp, D. melanogaster
ggttgggtctgaa

SEQ ID NO: 633636 - DNA, 13 bp, D. melanogaster
ggttgtcaagaat

SEQ ID NO: 633637 - DNA, 13 bp, D. melanogaster
ggttgtcagctgc

SEQ ID NO: 633638 - DNA, 13 bp, D. melanogaster
ggttgtgcctcca

SEQ ID NO: 633639 - DNA, 13 bp, D. melanogaster
ggttgtgcgtggc

SEQ ID NO: 633640 - DNA, 13 bp, D. melanogaster
ggttgtgtactta

SEQ ID NO: 633641 - DNA, 13 bp, D. melanogaster
ggttgttaaggcg

SEQ ID NO: 633642 - DNA, 14 bp, D. melanogaster
ggttgttgctgctg

SEQ ID NO: 633643 - DNA, 13 bp, D. melanogaster
ggttgtttccttc

SEQ ID NO: 633644 - DNA, 59 bp, D. melanogaster
ggtttaaataggtgacatgagaatcgcatcttaaagtaaatggcctacgcagaggccta

SEQ ID NO: 633645 - DNA, 13 bp, D. melanogaster
ggtttataaataa

SEQ ID NO: 633646 - DNA, 13 bp, D. melanogaster
ggtttatatatat

SEQ ID NO: 633647 - DNA, 13 bp, D. melanogaster
ggtttattaaaat

SEQ ID NO: 633648 - DNA, 13 bp, D. melanogaster
ggtttcaaaaata

SEQ ID NO: 633649 - DNA, 13 bp, D. melanogaster
ggtttcagacacc

SEQ ID NO: 633650 - DNA, 13 bp, D. melanogaster
ggtttcaggaaaa

SEQ ID NO: 633651 - DNA, 13 bp, D. melanogaster
ggtttcatcgaca

SEQ ID NO: 633652 - DNA, 13 bp, D. melanogaster
ggtttcattaatt

SEQ ID NO: 633653 - DNA, 13 bp, D. melanogaster
ggtttcatttaat

SEQ ID NO: 633654 - DNA, 13 bp, D. melanogaster
ggtttcctgggct

SEQ ID NO: 633655 - DNA, 13 bp, D. melanogaster
ggtttcgattttg

SEQ ID NO: 633656 - DNA, 13 bp, D. melanogaster
ggtttcggataac

SEQ ID NO: 633657 - DNA, 13 bp, D. melanogaster
ggtttcggttcgg

SEQ ID NO: 633658 - DNA, 13 bp, D. melanogaster
ggtttcggtttca

SEQ ID NO: 633659 - DNA, 13 bp, D. melanogaster
ggtttcggtttcg

SEQ ID NO: 633660 - DNA, 13 bp, D. melanogaster
ggtttcggtttct

SEQ ID NO: 633661 - DNA, 13 bp, D. melanogaster
ggtttcttcaata

SEQ ID NO: 633662 - DNA, 13 bp, D. melanogaster
ggtttcttcggga

SEQ ID NO: 633663 - DNA, 13 bp, D. melanogaster
ggtttgaaaaaaa

SEQ ID NO: 633664 - DNA, 13 bp, D. melanogaster
ggtttgctaagcg

SEQ ID NO: 633665 - DNA, 13 bp, D. melanogaster
ggtttggccatat

SEQ ID NO: 633666 - DNA, 13 bp, D. melanogaster
ggttttaaaaatg

SEQ ID NO: 633667 - DNA, 13 bp, D. melanogaster
ggttttaaatacc

SEQ ID NO: 633668 - DNA, 13 bp, D. melanogaster
ggttttaaatgtt

SEQ ID NO: 633669 - DNA, 13 bp, D. melanogaster
ggttttaacgact

SEQ ID NO: 633670 - DNA, 13 bp, D. melanogaster
ggttttaagttgt

SEQ ID NO: 633671 - DNA, 13 bp, D. melanogaster
ggttttaataatt

SEQ ID NO: 633672 - DNA, 13 bp, D. melanogaster
ggttttaattgaa

SEQ ID NO: 633673 - DNA, 13 bp, D. melanogaster
ggttttataaata

SEQ ID NO: 633674 - DNA, 13 bp, D. melanogaster
ggttttatttcgg

SEQ ID NO: 633675 - DNA, 13 bp, D. melanogaster
ggttttcaaattt

SEQ ID NO: 633676 - DNA, 13 bp, D. melanogaster
ggttttcctttgg

SEQ ID NO: 633677 - DNA, 13 bp, D. melanogaster
ggttttcgattcg

SEQ ID NO: 633678 - DNA, 13 bp, D. melanogaster
ggttttgataacc

SEQ ID NO: 633679 - DNA, 13 bp, D. melanogaster
ggttttgcaatat

SEQ ID NO: 633680 - DNA, 13 bp, D. melanogaster
ggttttgccaaaa

SEQ ID NO: 633681 - DNA, 13 bp, D. melanogaster
ggttttgctatgt

SEQ ID NO: 633682 - DNA, 13 bp, D. melanogaster
ggttttggtgaaa

SEQ ID NO: 633683 - DNA, 13 bp, D. melanogaster
ggtttttacattt

SEQ ID NO: 633684 - DNA, 14 bp, D. melanogaster
ggtttttacattta

SEQ ID NO: 633685 - DNA, 13 bp, D. melanogaster
ggtttttatggcc

SEQ ID NO: 633686 - DNA, 13 bp, D. melanogaster
ggtttttattcat

SEQ ID NO: 633687 - DNA, 13 bp, D. melanogaster
ggtttttggccaa

SEQ ID NO: 633688 - DNA, 14 bp, D. melanogaster
ggtttttttgaaaa

SEQ ID NO: 633689 - DNA, 13 bp, D. melanogaster
gtaaaaaatccaa

SEQ ID NO: 633690 - DNA, 13 bp, D. melanogaster
gtaaaaaatgtat

SEQ ID NO: 633691 - DNA, 13 bp, D. melanogaster
gtaaaaagaatgt

SEQ ID NO: 633692 - DNA, 14 bp, D. melanogaster
gtaaaaagaatgtt

SEQ ID NO: 633693 - DNA, 13 bp, D. melanogaster
gtaaaaagtaaac

SEQ ID NO: 633694 - DNA, 13 bp, D. melanogaster
gtaaaaagttttc

SEQ ID NO: 633695 - DNA, 13 bp, D. melanogaster
gtaaaaatatcaa

SEQ ID NO: 633696 - DNA, 13 bp, D. melanogaster
gtaaaaatatgtt

SEQ ID NO: 633697 - DNA, 13 bp, D. melanogaster
gtaaaaatctata

SEQ ID NO: 633698 - DNA, 13 bp, D. melanogaster
gtaaaaatgttta

SEQ ID NO: 633699 - DNA, 13 bp, D. melanogaster
gtaaaaattatgt

SEQ ID NO: 633700 - DNA, 13 bp, D. melanogaster
gtaaaaattgatt

SEQ ID NO: 633701 - DNA, 13 bp, D. melanogaster
gtaaaacaaaatg

SEQ ID NO: 633702 - DNA, 13 bp, D. melanogaster
gtaaaacaaatat

SEQ ID NO: 633703 - DNA, 13 bp, D. melanogaster
gtaaaacattttc

SEQ ID NO: 633704 - DNA, 13 bp, D. melanogaster
gtaaaaccaacat

SEQ ID NO: 633705 - DNA, 13 bp, D. melanogaster
gtaaaactataaa

SEQ ID NO: 633706 - DNA, 13 bp, D. melanogaster
gtaaaactcttaa

SEQ ID NO: 633707 - DNA, 14 bp, D. melanogaster
gtaaaactgaaaat

SEQ ID NO: 633708 - DNA, 13 bp, D. melanogaster
gtaaaacttaaaa

SEQ ID NO: 633709 - DNA, 13 bp, D. melanogaster
gtaaaagccaaaa

SEQ ID NO: 633710 - DNA, 13 bp, D. melanogaster
gtaaaagcgaaaa

SEQ ID NO: 633711 - DNA, 13 bp, D. melanogaster
gtaaaaggatata

SEQ ID NO: 633712 - DNA, 13 bp, D. melanogaster
gtaaaagtgttta

SEQ ID NO: 633713 - DNA, 13 bp, D. melanogaster
gtaaaagttgaaa

SEQ ID NO: 633714 - DNA, 13 bp, D. melanogaster
gtaaaataaatac

SEQ ID NO: 633715 - DNA, 13 bp, D. melanogaster
gtaaaataaatca

SEQ ID NO: 633716 - DNA, 13 bp, D. melanogaster
gtaaaataattgt

SEQ ID NO: 633717 - DNA, 13 bp, D. melanogaster
gtaaaatattcaa

SEQ ID NO: 633718 - DNA, 14 bp, D. melanogaster
gtaaaatattcaaa

SEQ ID NO: 633719 - DNA, 13 bp, D. melanogaster
gtaaaatcaaaat

SEQ ID NO: 633720 - DNA, 13 bp, D. melanogaster
gtaaaatcagaga

SEQ ID NO: 633721 - DNA, 13 bp, D. melanogaster
gtaaaatgcaata

SEQ ID NO: 633722 - DNA, 13 bp, D. melanogaster
gtaaaatgcgaaa

SEQ ID NO: 633723 - DNA, 13 bp, D. melanogaster
gtaaaatggtata

SEQ ID NO: 633724 - DNA, 13 bp, D. melanogaster
gtaaaatgttaaa

SEQ ID NO: 633725 - DNA, 13 bp, D. melanogaster
gtaaaatgtttgc

SEQ ID NO: 633726 - DNA, 13 bp, D. melanogaster
gtaaaattaagtt

SEQ ID NO: 633727 - DNA, 13 bp, D. melanogaster
gtaaaattgattt

SEQ ID NO: 633728 - DNA, 13 bp, D. melanogaster
gtaaaatttgttt

SEQ ID NO: 633729 - DNA, 14 bp, D. melanogaster
gtaaaatttgtttg

SEQ ID NO: 633730 - DNA, 13 bp, D. melanogaster
gtaaaattttgaa

SEQ ID NO: 633731 - DNA, 13 bp, D. melanogaster
gtaaacaaaacat

SEQ ID NO: 633732 - DNA, 13 bp, D. melanogaster
gtaaacaaaacga

SEQ ID NO: 633733 - DNA, 13 bp, D. melanogaster
gtaaacaaaagcg

SEQ ID NO: 633734 - DNA, 13 bp, D. melanogaster
gtaaacaaaatag

SEQ ID NO: 633735 - DNA, 13 bp, D. melanogaster
gtaaacaaacagt

SEQ ID NO: 633736 - DNA, 13 bp, D. melanogaster
gtaaacaaacgaa

SEQ ID NO: 633737 - DNA, 13 bp, D. melanogaster
gtaaacaaagaag

SEQ ID NO: 633738 - DNA, 13 bp, D. melanogaster
gtaaacaaatcaa

SEQ ID NO: 633739 - DNA, 14 bp, D. melanogaster
gtaaacaaatcaaa

SEQ ID NO: 633740 - DNA, 13 bp, D. melanogaster
gtaaacaaatcga

SEQ ID NO: 633741 - DNA, 13 bp, D. melanogaster
gtaaacaaatgct

SEQ ID NO: 633742 - DNA, 14 bp, D. melanogaster
gtaaacaaattaaa

SEQ ID NO: 633743 - DNA, 13 bp, D. melanogaster
gtaaacaaattat

SEQ ID NO: 633744 - DNA, 13 bp, D. melanogaster
gtaaacaaattgc

SEQ ID NO: 633745 - DNA, 13 bp, D. melanogaster
gtaaacaacaaat

SEQ ID NO: 633746 - DNA, 13 bp, D. melanogaster
gtaaacaacaatt

SEQ ID NO: 633747 - DNA, 14 bp, D. melanogaster
gtaaacaagaaatt

SEQ ID NO: 633748 - DNA, 13 bp, D. melanogaster
gtaaacaataaat

SEQ ID NO: 633749 - DNA, 13 bp, D. melanogaster
gtaaacaatattt

SEQ ID NO: 633750 - DNA, 13 bp, D. melanogaster
gtaaacaatgcaa

SEQ ID NO: 633751 - DNA, 13 bp, D. melanogaster
gtaaacaatttgt

SEQ ID NO: 633752 - DNA, 14 bp, D. melanogaster
gtaaacaattttaa

SEQ ID NO: 633753 - DNA, 13 bp, D. melanogaster
gtaaacaattttt

SEQ ID NO: 633754 - DNA, 13 bp, D. melanogaster
gtaaacacatttt

SEQ ID NO: 633755 - DNA, 13 bp, D. melanogaster
gtaaacaccccac

SEQ ID NO: 633756 - DNA, 13 bp, D. melanogaster
gtaaacagccaaa

SEQ ID NO: 633757 - DNA, 13 bp, D. melanogaster
gtaaacatatata

SEQ ID NO: 633758 - DNA, 13 bp, D. melanogaster
gtaaacatatatt

SEQ ID NO: 633759 - DNA, 13 bp, D. melanogaster
gtaaacatgaaaa

SEQ ID NO: 633760 - DNA, 13 bp, D. melanogaster
gtaaacatttggc

SEQ ID NO: 633761 - DNA, 13 bp, D. melanogaster
gtaaacatttttt

SEQ ID NO: 633762 - DNA, 13 bp, D. melanogaster
gtaaacgttttta

SEQ ID NO: 633763 - DNA, 13 bp, D. melanogaster
gtaaactattttt

SEQ ID NO: 633764 - DNA, 13 bp, D. melanogaster
gtaaactgcatta

SEQ ID NO: 633765 - DNA, 13 bp, D. melanogaster
gtaaacttaaaag

SEQ ID NO: 633766 - DNA, 13 bp, D. melanogaster
gtaaacttggaat

SEQ ID NO: 633767 - DNA, 13 bp, D. melanogaster
gtaaagaaatcaa

SEQ ID NO: 633768 - DNA, 13 bp, D. melanogaster
gtaaagaattttg

SEQ ID NO: 633769 - DNA, 14 bp, D. melanogaster
gtaaagaattttgc

SEQ ID NO: 633770 - DNA, 13 bp, D. melanogaster
gtaaagataattt

SEQ ID NO: 633771 - DNA, 13 bp, D. melanogaster
gtaaagctttaaa

SEQ ID NO: 633772 - DNA, 13 bp, D. melanogaster
gtaaaggagataa

SEQ ID NO: 633773 - DNA, 13 bp, D. melanogaster
gtaaaggattttc

SEQ ID NO: 633774 - DNA, 13 bp, D. melanogaster
gtaaaggcagctc

SEQ ID NO: 633775 - DNA, 13 bp, D. melanogaster
gtaaagtaaaagg

SEQ ID NO: 633776 - DNA, 13 bp, D. melanogaster
gtaaagtaaaagt

SEQ ID NO: 633777 - DNA, 13 bp, D. melanogaster
gtaaagtaaagta

SEQ ID NO: 633778 - DNA, 14 bp, D. melanogaster
gtaaagtaaagtaa

SEQ ID NO: 633779 - DNA, 13 bp, D. melanogaster
gtaaagtaaatat

SEQ ID NO: 633780 - DNA, 13 bp, D. melanogaster
gtaaagtgaacta

SEQ ID NO: 633781 - DNA, 14 bp, D. melanogaster
gtaaagtgaactaa

SEQ ID NO: 633782 - DNA, 13 bp, D. melanogaster
gtaaagtgcaatt

SEQ ID NO: 633783 - DNA, 13 bp, D. melanogaster
gtaaagtgcagtt

SEQ ID NO: 633784 - DNA, 13 bp, D. melanogaster
gtaaagtggaaaa

SEQ ID NO: 633785 - DNA, 13 bp, D. melanogaster
gtaaagtgtaata

SEQ ID NO: 633786 - DNA, 13 bp, D. melanogaster
gtaaagtttattt

SEQ ID NO: 633787 - DNA, 13 bp, D. melanogaster
gtaaataaaacta

SEQ ID NO: 633788 - DNA, 13 bp, D. melanogaster
gtaaataaaatgt

SEQ ID NO: 633789 - DNA, 13 bp, D. melanogaster
gtaaataaacaat

SEQ ID NO: 633790 - DNA, 14 bp, D. melanogaster
gtaaataaataaac

SEQ ID NO: 633791 - DNA, 13 bp, D. melanogaster
gtaaataaatcaa

SEQ ID NO: 633792 - DNA, 13 bp, D. melanogaster
gtaaataaattgt

SEQ ID NO: 633793 - DNA, 13 bp, D. melanogaster
gtaaataagtttt

SEQ ID NO: 633794 - DNA, 13 bp, D. melanogaster
gtaaatacataaa

SEQ ID NO: 633795 - DNA, 14 bp, D. melanogaster
gtaaatacataaaa

SEQ ID NO: 633796 - DNA, 13 bp, D. melanogaster
gtaaatacataca

SEQ ID NO: 633797 - DNA, 14 bp, D. melanogaster
gtaaatacatatat

SEQ ID NO: 633798 - DNA, 13 bp, D. melanogaster
gtaaatacgttat

SEQ ID NO: 633799 - DNA, 13 bp, D. melanogaster
gtaaatagcaaat

SEQ ID NO: 633800 - DNA, 13 bp, D. melanogaster
gtaaatagtaaat

SEQ ID NO: 633801 - DNA, 13 bp, D. melanogaster
gtaaatagtattt

SEQ ID NO: 633802 - DNA, 14 bp, D. melanogaster
gtaaatagtccccg

SEQ ID NO: 633803 - DNA, 14 bp, D. melanogaster
gtaaatatcaactt

SEQ ID NO: 633804 - DNA, 13 bp, D. melanogaster
gtaaatatgtatg

SEQ ID NO: 633805 - DNA, 13 bp, D. melanogaster
gtaaatatgtatt

SEQ ID NO: 633806 - DNA, 13 bp, D. melanogaster
gtaaatatgtttg

SEQ ID NO: 633807 - DNA, 13 bp, D. melanogaster
gtaaatatttaag

SEQ ID NO: 633808 - DNA, 13 bp, D. melanogaster
gtaaatatttcat

SEQ ID NO: 633809 - DNA, 13 bp, D. melanogaster
gtaaatattttga

SEQ ID NO: 633810 - DNA, 13 bp, D. melanogaster
gtaaatattttgg

SEQ ID NO: 633811 - DNA, 13 bp, D. melanogaster
gtaaatatttttg

SEQ ID NO: 633812 - DNA, 13 bp, D. melanogaster
gtaaatcaaaaga

SEQ ID NO: 633813 - DNA, 13 bp, D. melanogaster
gtaaatcaaatga

SEQ ID NO: 633814 - DNA, 13 bp, D. melanogaster
gtaaatgaaatga

SEQ ID NO: 633815 - DNA, 14 bp, D. melanogaster
gtaaatgaaatgaa

SEQ ID NO: 633816 - DNA, 13 bp, D. melanogaster
gtaaatgaacaaa

SEQ ID NO: 633817 - DNA, 13 bp, D. melanogaster
gtaaatgaattat

SEQ ID NO: 633818 - DNA, 13 bp, D. melanogaster
gtaaatgcagttt

SEQ ID NO: 633819 - DNA, 13 bp, D. melanogaster
gtaaatgctttaa

SEQ ID NO: 633820 - DNA, 13 bp, D. melanogaster
gtaaatggatctt

SEQ ID NO: 633821 - DNA, 14 bp, D. melanogaster
gtaaatgtaaatgt

SEQ ID NO: 633822 - DNA, 13 bp, D. melanogaster
gtaaatgttaatt

SEQ ID NO: 633823 - DNA, 13 bp, D. melanogaster
gtaaattacaaat

SEQ ID NO: 633824 - DNA, 13 bp, D. melanogaster
gtaaattacattt

SEQ ID NO: 633825 - DNA, 14 bp, D. melanogaster
gtaaattacttgtt

SEQ ID NO: 633826 - DNA, 13 bp, D. melanogaster
gtaaattatgaaa

SEQ ID NO: 633827 - DNA, 13 bp, D. melanogaster
gtaaattattgtg

SEQ ID NO: 633828 - DNA, 13 bp, D. melanogaster
gtaaattattgtt

SEQ ID NO: 633829 - DNA, 14 bp, D. melanogaster
gtaaattcaattaa

SEQ ID NO: 633830 - DNA, 13 bp, D. melanogaster
gtaaattcaattt

SEQ ID NO: 633831 - DNA, 14 bp, D. melanogaster
gtaaattgaataag

SEQ ID NO: 633832 - DNA, 13 bp, D. melanogaster
gtaaattgcaaat

SEQ ID NO: 633833 - DNA, 13 bp, D. melanogaster
gtaaattgcaatt

SEQ ID NO: 633834 - DNA, 13 bp, D. melanogaster
gtaaattgcataa

SEQ ID NO: 633835 - DNA, 13 bp, D. melanogaster
gtaaattgtaaat

SEQ ID NO: 633836 - DNA, 14 bp, D. melanogaster
gtaaattgtaacaa

SEQ ID NO: 633837 - DNA, 13 bp, D. melanogaster
gtaaattgtataa

SEQ ID NO: 633838 - DNA, 13 bp, D. melanogaster
gtaaattgtattt

SEQ ID NO: 633839 - DNA, 13 bp, D. melanogaster
gtaaattgtttta

SEQ ID NO: 633840 - DNA, 14 bp, D. melanogaster
gtaaatttaacatg

SEQ ID NO: 633841 - DNA, 13 bp, D. melanogaster
gtaaatttcatta

SEQ ID NO: 633842 - DNA, 13 bp, D. melanogaster
gtaaatttccatt

SEQ ID NO: 633843 - DNA, 13 bp, D. melanogaster
gtaaatttgtaaa

SEQ ID NO: 633844 - DNA, 13 bp, D. melanogaster
gtaaatttgtttg

SEQ ID NO: 633845 - DNA, 13 bp, D. melanogaster
gtaaattttaatg

SEQ ID NO: 633846 - DNA, 14 bp, D. melanogaster
gtaaattttaatgg

SEQ ID NO: 633847 - DNA, 13 bp, D. melanogaster
gtaacaaaatatg

SEQ ID NO: 633848 - DNA, 13 bp, D. melanogaster
gtaacaaaatatt

SEQ ID NO: 633849 - DNA, 13 bp, D. melanogaster
gtaacaataataa

SEQ ID NO: 633850 - DNA, 14 bp, D. melanogaster
gtaacacacacaca

SEQ ID NO: 633851 - DNA, 13 bp, D. melanogaster
gtaacactgcaat

SEQ ID NO: 633852 - DNA, 13 bp, D. melanogaster
gtaacactgtact

SEQ ID NO: 633853 - DNA, 13 bp, D. melanogaster
gtaacataatcaa

SEQ ID NO: 633854 - DNA, 13 bp, D. melanogaster
gtaacatactttt

SEQ ID NO: 633855 - DNA, 14 bp, D. melanogaster
gtaacatatctggg

SEQ ID NO: 633856 - DNA, 13 bp, D. melanogaster
gtaacatcatcat

SEQ ID NO: 633857 - DNA, 13 bp, D. melanogaster
gtaaccacatttc

SEQ ID NO: 633858 - DNA, 15 bp, D. melanogaster
gtaaccacatttctg

SEQ ID NO: 633859 - DNA, 13 bp, D. melanogaster
gtaacgaaacgaa

SEQ ID NO: 633860 - DNA, 13 bp, D. melanogaster
gtaacgacgctgc

SEQ ID NO: 633861 - DNA, 14 bp, D. melanogaster
gtaactaaaccaaa

SEQ ID NO: 633862 - DNA, 13 bp, D. melanogaster
gtaactaaattaa

SEQ ID NO: 633863 - DNA, 13 bp, D. melanogaster
gtaactggagtaa

SEQ ID NO: 633864 - DNA, 13 bp, D. melanogaster
gtaactggtaact

SEQ ID NO: 633865 - DNA, 13 bp, D. melanogaster
gtaactggtataa

SEQ ID NO: 633866 - DNA, 13 bp, D. melanogaster
gtaactgtaacac

SEQ ID NO: 633867 - DNA, 13 bp, D. melanogaster
gtaactgtaactg

SEQ ID NO: 633868 - DNA, 13 bp, D. melanogaster
gtaacttatttaa

SEQ ID NO: 633869 - DNA, 14 bp, D. melanogaster
gtaacttatttaat

SEQ ID NO: 633870 - DNA, 13 bp, D. melanogaster
gtaactttaaaaa

SEQ ID NO: 633871 - DNA, 13 bp, D. melanogaster
gtaactttttaaa

SEQ ID NO: 633872 - DNA, 14 bp, D. melanogaster
gtaagaaactaatt

SEQ ID NO: 633873 - DNA, 13 bp, D. melanogaster
gtaagaaactcca

SEQ ID NO: 633874 - DNA, 13 bp, D. melanogaster
gtaagaaatatgt

SEQ ID NO: 633875 - DNA, 13 bp, D. melanogaster
gtaagaatacata

SEQ ID NO: 633876 - DNA, 13 bp, D. melanogaster
gtaagaatatttt

SEQ ID NO: 633877 - DNA, 13 bp, D. melanogaster
gtaagatcaaatt

SEQ ID NO: 633878 - DNA, 13 bp, D. melanogaster
gtaagcaaataaa

SEQ ID NO: 633879 - DNA, 13 bp, D. melanogaster
gtaagcaaatatt

SEQ ID NO: 633880 - DNA, 13 bp, D. melanogaster
gtaagcaaatcaa

SEQ ID NO: 633881 - DNA, 13 bp, D. melanogaster
gtaagcaattgta

SEQ ID NO: 633882 - DNA, 13 bp, D. melanogaster
gtaagcccgaaga

SEQ ID NO: 633883 - DNA, 13 bp, D. melanogaster
gtaagcctctggt

SEQ ID NO: 633884 - DNA, 13 bp, D. melanogaster
gtaagtaagtaaa

SEQ ID NO: 633885 - DNA, 13 bp, D. melanogaster
gtaagtgaaatat

SEQ ID NO: 633886 - DNA, 13 bp, D. melanogaster
gtaagtgtgtgcg

SEQ ID NO: 633887 - DNA, 13 bp, D. melanogaster
gtaataaaaatca

SEQ ID NO: 633888 - DNA, 13 bp, D. melanogaster
gtaataaaaatgt

SEQ ID NO: 633889 - DNA, 13 bp, D. melanogaster
gtaataaaacata

SEQ ID NO: 633890 - DNA, 13 bp, D. melanogaster
gtaataaaattcc

SEQ ID NO: 633891 - DNA, 13 bp, D. melanogaster
gtaataaacacaa

SEQ ID NO: 633892 - DNA, 13 bp, D. melanogaster
gtaataaaccaat

SEQ ID NO: 633893 - DNA, 13 bp, D. melanogaster
gtaataaagtcaa

SEQ ID NO: 633894 - DNA, 13 bp, D. melanogaster
gtaataaatatgt

SEQ ID NO: 633895 - DNA, 13 bp, D. melanogaster
gtaataaatcaaa

SEQ ID NO: 633896 - DNA, 13 bp, D. melanogaster
gtaataaatgttt

SEQ ID NO: 633897 - DNA, 13 bp, D. melanogaster
gtaataaattgaa

SEQ ID NO: 633898 - DNA, 13 bp, D. melanogaster
gtaataaattgca

SEQ ID NO: 633899 - DNA, 13 bp, D. melanogaster
gtaataacaataa

SEQ ID NO: 633900 - DNA, 14 bp, D. melanogaster
gtaataacaataat

SEQ ID NO: 633901 - DNA, 14 bp, D. melanogaster
gtaataagcacaaa

SEQ ID NO: 633902 - DNA, 13 bp, D. melanogaster
gtaataataacaa

SEQ ID NO: 633903 - DNA, 13 bp, D. melanogaster
gtaataatttgta

SEQ ID NO: 633904 - DNA, 13 bp, D. melanogaster
gtaatacaaacaa

SEQ ID NO: 633905 - DNA, 13 bp, D. melanogaster
gtaatataattgt

SEQ ID NO: 633906 - DNA, 13 bp, D. melanogaster
gtaatatacattt

SEQ ID NO: 633907 - DNA, 13 bp, D. melanogaster
gtaatatatcaaa

SEQ ID NO: 633908 - DNA, 14 bp, D. melanogaster
gtaatatatcaaat

SEQ ID NO: 633909 - DNA, 13 bp, D. melanogaster
gtaatatcaaaga

SEQ ID NO: 633910 - DNA, 13 bp, D. melanogaster
gtaatatgtaaat

SEQ ID NO: 633911 - DNA, 14 bp, D. melanogaster
gtaatatgtaatat

SEQ ID NO: 633912 - DNA, 14 bp, D. melanogaster
gtaatatgtatgta

SEQ ID NO: 633913 - DNA, 13 bp, D. melanogaster
gtaatattgaatt

SEQ ID NO: 633914 - DNA, 13 bp, D. melanogaster
gtaatattgttat

SEQ ID NO: 633915 - DNA, 13 bp, D. melanogaster
gtaatatttatgt

SEQ ID NO: 633916 - DNA, 13 bp, D. melanogaster
gtaatatttgtat

SEQ ID NO: 633917 - DNA, 13 bp, D. melanogaster
gtaatcaagacaa

SEQ ID NO: 633918 - DNA, 13 bp, D. melanogaster
gtaatcatttttt

SEQ ID NO: 633919 - DNA, 14 bp, D. melanogaster
gtaatcggttcgta

SEQ ID NO: 633920 - DNA, 13 bp, D. melanogaster
gtaatcgtaatcg

SEQ ID NO: 633921 - DNA, 13 bp, D. melanogaster
gtaatctttgaaa

SEQ ID NO: 633922 - DNA, 13 bp, D. melanogaster
gtaatgaaatatt

SEQ ID NO: 633923 - DNA, 13 bp, D. melanogaster
gtaatgaaatgaa

SEQ ID NO: 633924 - DNA, 13 bp, D. melanogaster
gtaatgatgaact

SEQ ID NO: 633925 - DNA, 13 bp, D. melanogaster
gtaatgattgcag

SEQ ID NO: 633926 - DNA, 13 bp, D. melanogaster
gtaatgcatttat

SEQ ID NO: 633927 - DNA, 13 bp, D. melanogaster
gtaatgcttacca

SEQ ID NO: 633928 - DNA, 13 bp, D. melanogaster
gtaatggtaatgg

SEQ ID NO: 633929 - DNA, 13 bp, D. melanogaster
gtaatgtttatta

SEQ ID NO: 633930 - DNA, 13 bp, D. melanogaster
gtaattaaaagta

SEQ ID NO: 633931 - DNA, 13 bp, D. melanogaster
gtaattaaatttc

SEQ ID NO: 633932 - DNA, 13 bp, D. melanogaster
gtaattaacattt

SEQ ID NO: 633933 - DNA, 14 bp, D. melanogaster
gtaattaatttgta

SEQ ID NO: 633934 - DNA, 13 bp, D. melanogaster
gtaattagctgct

SEQ ID NO: 633935 - DNA, 13 bp, D. melanogaster
gtaattagtttaa

SEQ ID NO: 633936 - DNA, 13 bp, D. melanogaster
gtaattattgaat

SEQ ID NO: 633937 - DNA, 13 bp, D. melanogaster
gtaattatttact

SEQ ID NO: 633938 - DNA, 13 bp, D. melanogaster
gtaattcaaataa

SEQ ID NO: 633939 - DNA, 13 bp, D. melanogaster
gtaattcaataaa

SEQ ID NO: 633940 - DNA, 13 bp, D. melanogaster
gtaattctttttc

SEQ ID NO: 633941 - DNA, 13 bp, D. melanogaster
gtaattgaaattt

SEQ ID NO: 633942 - DNA, 13 bp, D. melanogaster
gtaattgaattgc

SEQ ID NO: 633943 - DNA, 13 bp, D. melanogaster
gtaattgatattt

SEQ ID NO: 633944 - DNA, 13 bp, D. melanogaster
gtaattgcaaaat

SEQ ID NO: 633945 - DNA, 14 bp, D. melanogaster
gtaattgcaaaatc

SEQ ID NO: 633946 - DNA, 13 bp, D. melanogaster
gtaattgcatcgt

SEQ ID NO: 633947 - DNA, 13 bp, D. melanogaster
gtaattgctgtcg

SEQ ID NO: 633948 - DNA, 13 bp, D. melanogaster
gtaattgcttgca

SEQ ID NO: 633949 - DNA, 14 bp, D. melanogaster
gtaattgtaaaatt

SEQ ID NO: 633950 - DNA, 13 bp, D. melanogaster
gtaattgtaataa

SEQ ID NO: 633951 - DNA, 14 bp, D. melanogaster
gtaattgtaattgc

SEQ ID NO: 633952 - DNA, 13 bp, D. melanogaster
gtaattgttgtgg

SEQ ID NO: 633953 - DNA, 14 bp, D. melanogaster
gtaattgttttaaa

SEQ ID NO: 633954 - DNA, 13 bp, D. melanogaster
gtaatttaaggtt

SEQ ID NO: 633955 - DNA, 13 bp, D. melanogaster
gtaatttattgat

SEQ ID NO: 633956 - DNA, 13 bp, D. melanogaster
gtaatttcattaa

SEQ ID NO: 633957 - DNA, 13 bp, D. melanogaster
gtaatttgtgctc

SEQ ID NO: 633958 - DNA, 13 bp, D. melanogaster
gtaattttaagcc

SEQ ID NO: 633959 - DNA, 13 bp, D. melanogaster
gtaattttcaaat

SEQ ID NO: 633960 - DNA, 13 bp, D. melanogaster
gtaattttggctt

SEQ ID NO: 633961 - DNA, 13 bp, D. melanogaster
gtaattttgttgc

SEQ ID NO: 633962 - DNA, 13 bp, D. melanogaster
gtaatttttcata

SEQ ID NO: 633963 - DNA, 13 bp, D. melanogaster
gtacaaaaaatat

SEQ ID NO: 633964 - DNA, 13 bp, D. melanogaster
gtacaaaaacagt

SEQ ID NO: 633965 - DNA, 15 bp, D. melanogaster
gtacaaaaacagtct

SEQ ID NO: 633966 - DNA, 13 bp, D. melanogaster
gtacaaaactaaa

SEQ ID NO: 633967 - DNA, 13 bp, D. melanogaster
gtacaaacacaaa

SEQ ID NO: 633968 - DNA, 13 bp, D. melanogaster
gtacaaacatata

SEQ ID NO: 633969 - DNA, 13 bp, D. melanogaster
gtacaaagtgacc

SEQ ID NO: 633970 - DNA, 14 bp, D. melanogaster
gtacaaagtgacca

SEQ ID NO: 633971 - DNA, 13 bp, D. melanogaster
gtacaaatacaaa

SEQ ID NO: 633972 - DNA, 13 bp, D. melanogaster
gtacaaatgcact

SEQ ID NO: 633973 - DNA, 13 bp, D. melanogaster
gtacaaatggttt

SEQ ID NO: 633974 - DNA, 13 bp, D. melanogaster
gtacaaattaata

SEQ ID NO: 633975 - DNA, 14 bp, D. melanogaster
gtacaaattaataa

SEQ ID NO: 633976 - DNA, 13 bp, D. melanogaster
gtacaaatttatt

SEQ ID NO: 633977 - DNA, 13 bp, D. melanogaster
gtacaaattttct

SEQ ID NO: 633978 - DNA, 13 bp, D. melanogaster
gtacaacaaaatt

SEQ ID NO: 633979 - DNA, 14 bp, D. melanogaster
gtacaacaaaatta

SEQ ID NO: 633980 - DNA, 13 bp, D. melanogaster
gtacaacaacaac

SEQ ID NO: 633981 - DNA, 13 bp, D. melanogaster
gtacaacaatttg

SEQ ID NO: 633982 - DNA, 13 bp, D. melanogaster
gtacaacagaaca

SEQ ID NO: 633983 - DNA, 13 bp, D. melanogaster
gtacaagtacaag

SEQ ID NO: 633984 - DNA, 13 bp, D. melanogaster
gtacaataataga

SEQ ID NO: 633985 - DNA, 13 bp, D. melanogaster
gtacaatacaata

SEQ ID NO: 633986 - DNA, 13 bp, D. melanogaster
gtacaatacataa

SEQ ID NO: 633987 - DNA, 14 bp, D. melanogaster
gtacaatacataaa

SEQ ID NO: 633988 - DNA, 13 bp, D. melanogaster
gtacaatatttgt

SEQ ID NO: 633989 - DNA, 13 bp, D. melanogaster
gtacacaaaaatt

SEQ ID NO: 633990 - DNA, 13 bp, D. melanogaster
gtacacaaaatat

SEQ ID NO: 633991 - DNA, 13 bp, D. melanogaster
gtacacaacatcc

SEQ ID NO: 633992 - DNA, 13 bp, D. melanogaster
gtacacaagaaat

SEQ ID NO: 633993 - DNA, 13 bp, D. melanogaster
gtacacacaaaaa

SEQ ID NO: 633994 - DNA, 13 bp, D. melanogaster
gtacacacacaaa

SEQ ID NO: 633995 - DNA, 14 bp, D. melanogaster
gtacacacacacat

SEQ ID NO: 633996 - DNA, 14 bp, D. melanogaster
gtacacacatacat

SEQ ID NO: 633997 - DNA, 13 bp, D. melanogaster
gtacacagagaaa

SEQ ID NO: 633998 - DNA, 13 bp, D. melanogaster
gtacacagcaaca

SEQ ID NO: 633999 - DNA, 13 bp, D. melanogaster
gtacacataaaaa

SEQ ID NO: 634000 - DNA, 13 bp, D. melanogaster
gtacacatacata

SEQ ID NO: 634001 - DNA, 13 bp, D. melanogaster
gtacacatgtcca

SEQ ID NO: 634002 - DNA, 13 bp, D. melanogaster
gtacactcaaaac

SEQ ID NO: 634003 - DNA, 13 bp, D. melanogaster
gtacactcgaaaa

SEQ ID NO: 634004 - DNA, 14 bp, D. melanogaster
gtacactcgaaaaa

SEQ ID NO: 634005 - DNA, 13 bp, D. melanogaster
gtacactgagaaa

SEQ ID NO: 634006 - DNA, 14 bp, D. melanogaster
gtacactgagcgaa

SEQ ID NO: 634007 - DNA, 13 bp, D. melanogaster
gtacagatacaga

SEQ ID NO: 634008 - DNA, 14 bp, D. melanogaster
gtacagcatcacat

SEQ ID NO: 634009 - DNA, 13 bp, D. melanogaster
gtacaggagcgtt

SEQ ID NO: 634010 - DNA, 13 bp, D. melanogaster
gtacaggcccatc

SEQ ID NO: 634011 - DNA, 13 bp, D. melanogaster
gtacagtgaacac

SEQ ID NO: 634012 - DNA, 13 bp, D. melanogaster
gtacagtgaagcc

SEQ ID NO: 634013 - DNA, 13 bp, D. melanogaster
gtacagtgccaac

SEQ ID NO: 634014 - DNA, 13 bp, D. melanogaster
gtacagtgtaccc

SEQ ID NO: 634015 - DNA, 13 bp, D. melanogaster
gtacataaaagta

SEQ ID NO: 634016 - DNA, 14 bp, D. melanogaster
gtacataaatatgt

SEQ ID NO: 634017 - DNA, 14 bp, D. melanogaster
gtacataaatattt

SEQ ID NO: 634018 - DNA, 13 bp, D. melanogaster
gtacataagtatg

SEQ ID NO: 634019 - DNA, 13 bp, D. melanogaster
gtacataatatat

SEQ ID NO: 634020 - DNA, 13 bp, D. melanogaster
gtacataatgctt

SEQ ID NO: 634021 - DNA, 13 bp, D. melanogaster
gtacatacaaaca

SEQ ID NO: 634022 - DNA, 14 bp, D. melanogaster
gtacatacacacat

SEQ ID NO: 634023 - DNA, 13 bp, D. melanogaster
gtacatacatacg

SEQ ID NO: 634024 - DNA, 14 bp, D. melanogaster
gtacatacatataa

SEQ ID NO: 634025 - DNA, 14 bp, D. melanogaster
gtacatacatatag

SEQ ID NO: 634026 - DNA, 14 bp, D. melanogaster
gtacatacatatat

SEQ ID NO: 634027 - DNA, 15 bp, D. melanogaster
gtacatacatatata

SEQ ID NO: 634028 - DNA, 15 bp, D. melanogaster
gtacatacatatatg

SEQ ID NO: 634029 - DNA, 14 bp, D. melanogaster
gtacatacatatct

SEQ ID NO: 634030 - DNA, 13 bp, D. melanogaster
gtacatacatatt

SEQ ID NO: 634031 - DNA, 14 bp, D. melanogaster
gtacatacatgcat

SEQ ID NO: 634032 - DNA, 13 bp, D. melanogaster
gtacatacatgta

SEQ ID NO: 634033 - DNA, 14 bp, D. melanogaster
gtacatacatgtgt

SEQ ID NO: 634034 - DNA, 13 bp, D. melanogaster
gtacatacgagta

SEQ ID NO: 634035 - DNA, 13 bp, D. melanogaster
gtacatacgtaga

SEQ ID NO: 634036 - DNA, 13 bp, D. melanogaster
gtacatatacaca

SEQ ID NO: 634037 - DNA, 14 bp, D. melanogaster
gtacatatacatat

SEQ ID NO: 634038 - DNA, 14 bp, D. melanogaster
gtacatatataata

SEQ ID NO: 634039 - DNA, 14 bp, D. melanogaster
gtacatatatacac

SEQ ID NO: 634040 - DNA, 14 bp, D. melanogaster
gtacatatatagta

SEQ ID NO: 634041 - DNA, 14 bp, D. melanogaster
gtacatatatatac

SEQ ID NO: 634042 - DNA, 14 bp, D. melanogaster
gtacatatatatgt

SEQ ID NO: 634043 - DNA, 13 bp, D. melanogaster
gtacatatatatt

SEQ ID NO: 634044 - DNA, 13 bp, D. melanogaster
gtacatatatcaa

SEQ ID NO: 634045 - DNA, 13 bp, D. melanogaster
gtacatatatccc

SEQ ID NO: 634046 - DNA, 14 bp, D. melanogaster
gtacatatatgtaa

SEQ ID NO: 634047 - DNA, 14 bp, D. melanogaster
gtacatatatgtac

SEQ ID NO: 634048 - DNA, 15 bp, D. melanogaster
gtacatatatgtata

SEQ ID NO: 634049 - DNA, 13 bp, D. melanogaster
gtacatatattat

SEQ ID NO: 634050 - DNA, 13 bp, D. melanogaster
gtacatatgcaaa

SEQ ID NO: 634051 - DNA, 14 bp, D. melanogaster
gtacatatgcatgt

SEQ ID NO: 634052 - DNA, 13 bp, D. melanogaster
gtacatatgtaaa

SEQ ID NO: 634053 - DNA, 14 bp, D. melanogaster
gtacatatgtacaa

SEQ ID NO: 634054 - DNA, 14 bp, D. melanogaster
gtacatatgtatat

SEQ ID NO: 634055 - DNA, 16 bp, D. melanogaster
gtacatatgtatgtat

SEQ ID NO: 634056 - DNA, 13 bp, D. melanogaster
gtacatatgtatt

SEQ ID NO: 634057 - DNA, 13 bp, D. melanogaster
gtacatgaaataa

SEQ ID NO: 634058 - DNA, 13 bp, D. melanogaster
gtacatgcataca

SEQ ID NO: 634059 - DNA, 13 bp, D. melanogaster
gtacatgcatatg

SEQ ID NO: 634060 - DNA, 13 bp, D. melanogaster
gtacatgtatata

SEQ ID NO: 634061 - DNA, 13 bp, D. melanogaster
gtacatgtatatg

SEQ ID NO: 634062 - DNA, 13 bp, D. melanogaster
gtacattggcatt

SEQ ID NO: 634063 - DNA, 13 bp, D. melanogaster
gtacattgtttaa

SEQ ID NO: 634064 - DNA, 13 bp, D. melanogaster
gtacatttaaaaa

SEQ ID NO: 634065 - DNA, 13 bp, D. melanogaster
gtacatttaaata

SEQ ID NO: 634066 - DNA, 13 bp, D. melanogaster
gtacatttagcaa

SEQ ID NO: 634067 - DNA, 13 bp, D. melanogaster
gtacatttgtata

SEQ ID NO: 634068 - DNA, 13 bp, D. melanogaster
gtacattttctat

SEQ ID NO: 634069 - DNA, 14 bp, D. melanogaster
gtacattttgtgta

SEQ ID NO: 634070 - DNA, 13 bp, D. melanogaster
gtacatttttatt

SEQ ID NO: 634071 - DNA, 14 bp, D. melanogaster
gtacattttttatt

SEQ ID NO: 634072 - DNA, 14 bp, D. melanogaster
gtaccagtaccagt

SEQ ID NO: 634073 - DNA, 13 bp, D. melanogaster
gtaccattataaa

SEQ ID NO: 634074 - DNA, 13 bp, D. melanogaster
gtaccattttata

SEQ ID NO: 634075 - DNA, 13 bp, D. melanogaster
gtacccaagaaat

SEQ ID NO: 634076 - DNA, 13 bp, D. melanogaster
gtaccgctccaca

SEQ ID NO: 634077 - DNA, 13 bp, D. melanogaster
gtacctacatata

SEQ ID NO: 634078 - DNA, 13 bp, D. melanogaster
gtacctcaaacta

SEQ ID NO: 634079 - DNA, 13 bp, D. melanogaster
gtacctttttgtg

SEQ ID NO: 634080 - DNA, 13 bp, D. melanogaster
gtacgacctcttc

SEQ ID NO: 634081 - DNA, 13 bp, D. melanogaster
gtacgagtacgag

SEQ ID NO: 634082 - DNA, 13 bp, D. melanogaster
gtacgagtatata

SEQ ID NO: 634083 - DNA, 13 bp, D. melanogaster
gtacgagtatatg

SEQ ID NO: 634084 - DNA, 13 bp, D. melanogaster
gtacgagtatatt

SEQ ID NO: 634085 - DNA, 13 bp, D. melanogaster
gtacgagtatctg

SEQ ID NO: 634086 - DNA, 13 bp, D. melanogaster
gtacgagtatttg

SEQ ID NO: 634087 - DNA, 13 bp, D. melanogaster
gtacgagtgtgtg

SEQ ID NO: 634088 - DNA, 13 bp, D. melanogaster
gtacgatcatgtg

SEQ ID NO: 634089 - DNA, 13 bp, D. melanogaster
gtacgatttcgaa

SEQ ID NO: 634090 - DNA, 13 bp, D. melanogaster
gtacgcacacaca

SEQ ID NO: 634091 - DNA, 14 bp, D. melanogaster
gtacgcacacacac

SEQ ID NO: 634092 - DNA, 13 bp, D. melanogaster
gtacggccgccac

SEQ ID NO: 634093 - DNA, 13 bp, D. melanogaster
gtacggctcgatt

SEQ ID NO: 634094 - DNA, 14 bp, D. melanogaster
gtacgtatacgtaa

SEQ ID NO: 634095 - DNA, 13 bp, D. melanogaster
gtacgtatgtatg

SEQ ID NO: 634096 - DNA, 14 bp, D. melanogaster
gtacgtatgtatgt

SEQ ID NO: 634097 - DNA, 14 bp, D. melanogaster
gtacgtggatgtat

SEQ ID NO: 634098 - DNA, 13 bp, D. melanogaster
gtacgtgtatatg

SEQ ID NO: 634099 - DNA, 14 bp, D. melanogaster
gtacgtgtgtgtgt

SEQ ID NO: 634100 - DNA, 13 bp, D. melanogaster
gtacgtgtttaat

SEQ ID NO: 634101 - DNA, 13 bp, D. melanogaster
gtactaaaacaaa

SEQ ID NO: 634102 - DNA, 13 bp, D. melanogaster
gtactaaatgtac

SEQ ID NO: 634103 - DNA, 14 bp, D. melanogaster
gtactaaatgtacc

SEQ ID NO: 634104 - DNA, 13 bp, D. melanogaster
gtactaattgcca

SEQ ID NO: 634105 - DNA, 13 bp, D. melanogaster
gtactacaaaaag

SEQ ID NO: 634106 - DNA, 13 bp, D. melanogaster
gtactataaatat

SEQ ID NO: 634107 - DNA, 13 bp, D. melanogaster
gtactcagtactc

SEQ ID NO: 634108 - DNA, 13 bp, D. melanogaster
gtactcgtactcg

SEQ ID NO: 634109 - DNA, 13 bp, D. melanogaster
gtactgccaataa

SEQ ID NO: 634110 - DNA, 14 bp, D. melanogaster
gtactgccaataaa

SEQ ID NO: 634111 - DNA, 14 bp, D. melanogaster
gtactggtactggt

SEQ ID NO: 634112 - DNA, 13 bp, D. melanogaster
gtacttaaatatt

SEQ ID NO: 634113 - DNA, 13 bp, D. melanogaster
gtacttatatttt

SEQ ID NO: 634114 - DNA, 13 bp, D. melanogaster
gtacttatgtata

SEQ ID NO: 634115 - DNA, 13 bp, D. melanogaster
gtacttctcgcca

SEQ ID NO: 634116 - DNA, 13 bp, D. melanogaster
gtacttctttttg

SEQ ID NO: 634117 - DNA, 13 bp, D. melanogaster
gtacttggaccaa

SEQ ID NO: 634118 - DNA, 13 bp, D. melanogaster
gtacttgtacttg

SEQ ID NO: 634119 - DNA, 14 bp, D. melanogaster
gtacttgtacttgt

SEQ ID NO: 634120 - DNA, 14 bp, D. melanogaster
gtacttgtgtgtgt

SEQ ID NO: 634121 - DNA, 13 bp, D. melanogaster
gtactttagaata

SEQ ID NO: 634122 - DNA, 13 bp, D. melanogaster
gtacttttattac

SEQ ID NO: 634123 - DNA, 13 bp, D. melanogaster
gtagaaaatatgt

SEQ ID NO: 634124 - DNA, 13 bp, D. melanogaster
gtagaaactaaaa

SEQ ID NO: 634125 - DNA, 15 bp, D. melanogaster
gtagaaattgttagc

SEQ ID NO: 634126 - DNA, 13 bp, D. melanogaster
gtagaagaaatcc

SEQ ID NO: 634127 - DNA, 13 bp, D. melanogaster
gtagaatatctta

SEQ ID NO: 634128 - DNA, 14 bp, D. melanogaster
gtagaatatcttaa

SEQ ID NO: 634129 - DNA, 13 bp, D. melanogaster
gtagacatttctt

SEQ ID NO: 634130 - DNA, 14 bp, D. melanogaster
gtagacgaagaaga

SEQ ID NO: 634131 - DNA, 13 bp, D. melanogaster
gtagactgcggct

SEQ ID NO: 634132 - DNA, 13 bp, D. melanogaster
gtagagaattttt

SEQ ID NO: 634133 - DNA, 13 bp, D. melanogaster
gtagagtaaaagg

SEQ ID NO: 634134 - DNA, 13 bp, D. melanogaster
gtagagtagagta

SEQ ID NO: 634135 - DNA, 13 bp, D. melanogaster
gtagatatataca

SEQ ID NO: 634136 - DNA, 13 bp, D. melanogaster
gtagatgatgtgg

SEQ ID NO: 634137 - DNA, 13 bp, D. melanogaster
gtagatgtagatg

SEQ ID NO: 634138 - DNA, 14 bp, D. melanogaster
gtagatgtgaagtt

SEQ ID NO: 634139 - DNA, 13 bp, D. melanogaster
gtagcaaaaataa

SEQ ID NO: 634140 - DNA, 13 bp, D. melanogaster
gtagcaacaagca

SEQ ID NO: 634141 - DNA, 13 bp, D. melanogaster
gtagcacacacac

SEQ ID NO: 634142 - DNA, 13 bp, D. melanogaster
gtagcacactttt

SEQ ID NO: 634143 - DNA, 14 bp, D. melanogaster
gtagcagcagcagc

SEQ ID NO: 634144 - DNA, 13 bp, D. melanogaster
gtagcagtagcag

SEQ ID NO: 634145 - DNA, 13 bp, D. melanogaster
gtagcatacttat

SEQ ID NO: 634146 - DNA, 13 bp, D. melanogaster
gtagcatactttc

SEQ ID NO: 634147 - DNA, 13 bp, D. melanogaster
gtagcatactttt

SEQ ID NO: 634148 - DNA, 13 bp, D. melanogaster
gtagcattgttaa

SEQ ID NO: 634149 - DNA, 13 bp, D. melanogaster
gtagcattttgca

SEQ ID NO: 634150 - DNA, 13 bp, D. melanogaster
gtagccacaacaa

SEQ ID NO: 634151 - DNA, 13 bp, D. melanogaster
gtagccagttgtt

SEQ ID NO: 634152 - DNA, 13 bp, D. melanogaster
gtagccctgaaaa

SEQ ID NO: 634153 - DNA, 13 bp, D. melanogaster
gtagcgtagtttt

SEQ ID NO: 634154 - DNA, 13 bp, D. melanogaster
gtagctaaagcca

SEQ ID NO: 634155 - DNA, 13 bp, D. melanogaster
gtagctgctgttg

SEQ ID NO: 634156 - DNA, 13 bp, D. melanogaster
gtagctggatctc

SEQ ID NO: 634157 - DNA, 13 bp, D. melanogaster
gtaggaaaacaaa

SEQ ID NO: 634158 - DNA, 13 bp, D. melanogaster
gtaggagaagtac

SEQ ID NO: 634159 - DNA, 13 bp, D. melanogaster
gtaggagcaggag

SEQ ID NO: 634160 - DNA, 14 bp, D. melanogaster
gtaggcaacacttt

SEQ ID NO: 634161 - DNA, 13 bp, D. melanogaster
gtaggcaacataa

SEQ ID NO: 634162 - DNA, 13 bp, D. melanogaster
gtaggcgtggcaa

SEQ ID NO: 634163 - DNA, 13 bp, D. melanogaster
gtaggttgtaggt

SEQ ID NO: 634164 - DNA, 13 bp, D. melanogaster
gtagtaagaaata

SEQ ID NO: 634165 - DNA, 13 bp, D. melanogaster
gtagtagcagcag

SEQ ID NO: 634166 - DNA, 13 bp, D. melanogaster
gtagtagttttta

SEQ ID NO: 634167 - DNA, 14 bp, D. melanogaster
gtagtgacgaagcg

SEQ ID NO: 634168 - DNA, 14 bp, D. melanogaster
gtagtggaaatttg

SEQ ID NO: 634169 - DNA, 13 bp, D. melanogaster
gtagtggtagtgg

SEQ ID NO: 634170 - DNA, 13 bp, D. melanogaster
gtagttaatccaa

SEQ ID NO: 634171 - DNA, 13 bp, D. melanogaster
gtagttagttagt

SEQ ID NO: 634172 - DNA, 13 bp, D. melanogaster
gtagttgctgctg

SEQ ID NO: 634173 - DNA, 14 bp, D. melanogaster
gtagttgctgttgt

SEQ ID NO: 634174 - DNA, 14 bp, D. melanogaster
gtagttggtagttg

SEQ ID NO: 634175 - DNA, 14 bp, D. melanogaster
gtagttgtagtagt

SEQ ID NO: 634176 - DNA, 13 bp, D. melanogaster
gtagttgtagttg

SEQ ID NO: 634177 - DNA, 13 bp, D. melanogaster
gtagtttaaacaa

SEQ ID NO: 634178 - DNA, 13 bp, D. melanogaster
gtagtttgcaata

SEQ ID NO: 634179 - DNA, 13 bp, D. melanogaster
gtagtttgcagta

SEQ ID NO: 634180 - DNA, 13 bp, D. melanogaster
gtagtttttctgc

SEQ ID NO: 634181 - DNA, 13 bp, D. melanogaster
gtagtttttgatg

SEQ ID NO: 634182 - DNA, 13 bp, D. melanogaster
gtagtttttgcca

SEQ ID NO: 634183 - DNA, 13 bp, D. melanogaster
gtataaaaaatac

SEQ ID NO: 634184 - DNA, 13 bp, D. melanogaster
gtataaaaatcaa

SEQ ID NO: 634185 - DNA, 13 bp, D. melanogaster
gtataaaaatcat

SEQ ID NO: 634186 - DNA, 13 bp, D. melanogaster
gtataaaacatat

SEQ ID NO: 634187 - DNA, 13 bp, D. melanogaster
gtataaacaaaat

SEQ ID NO: 634188 - DNA, 13 bp, D. melanogaster
gtataaacaaata

SEQ ID NO: 634189 - DNA, 13 bp, D. melanogaster
gtataaacaaatt

SEQ ID NO: 634190 - DNA, 13 bp, D. melanogaster
gtataaactataa

SEQ ID NO: 634191 - DNA, 13 bp, D. melanogaster
gtataaagtatat

SEQ ID NO: 634192 - DNA, 14 bp, D. melanogaster
gtataaagtatata

SEQ ID NO: 634193 - DNA, 13 bp, D. melanogaster
gtataaagtattt

SEQ ID NO: 634194 - DNA, 13 bp, D. melanogaster
gtataaatgtata

SEQ ID NO: 634195 - DNA, 13 bp, D. melanogaster
gtataaattgtat

SEQ ID NO: 634196 - DNA, 13 bp, D. melanogaster
gtataaattgttt

SEQ ID NO: 634197 - DNA, 13 bp, D. melanogaster
gtataaatttcca

SEQ ID NO: 634198 - DNA, 13 bp, D. melanogaster
gtataacatagcg

SEQ ID NO: 634199 - DNA, 13 bp, D. melanogaster
gtataaccttttt

SEQ ID NO: 634200 - DNA, 14 bp, D. melanogaster
gtataagaattcaa

SEQ ID NO: 634201 - DNA, 13 bp, D. melanogaster
gtataagcttaaa

SEQ ID NO: 634202 - DNA, 13 bp, D. melanogaster
gtataatcaattc

SEQ ID NO: 634203 - DNA, 13 bp, D. melanogaster
gtataatcggcga

SEQ ID NO: 634204 - DNA, 13 bp, D. melanogaster
gtataatggcctt

SEQ ID NO: 634205 - DNA, 13 bp, D. melanogaster
gtataattggctt

SEQ ID NO: 634206 - DNA, 13 bp, D. melanogaster
gtataatttatga

SEQ ID NO: 634207 - DNA, 13 bp, D. melanogaster
gtataatttgcaa

SEQ ID NO: 634208 - DNA, 13 bp, D. melanogaster
gtatacaaaatat

SEQ ID NO: 634209 - DNA, 13 bp, D. melanogaster
gtatacaaattta

SEQ ID NO: 634210 - DNA, 13 bp, D. melanogaster
gtatacatacata

SEQ ID NO: 634211 - DNA, 13 bp, D. melanogaster
gtatacatataaa

SEQ ID NO: 634212 - DNA, 13 bp, D. melanogaster
gtatacatatata

SEQ ID NO: 634213 - DNA, 15 bp, D. melanogaster
gtatacatatgtata

SEQ ID NO: 634214 - DNA, 13 bp, D. melanogaster
gtatacatatttt

SEQ ID NO: 634215 - DNA, 13 bp, D. melanogaster
gtatacatttaaa

SEQ ID NO: 634216 - DNA, 13 bp, D. melanogaster
gtatacatttata

SEQ ID NO: 634217 - DNA, 13 bp, D. melanogaster
gtatacgaaatat

SEQ ID NO: 634218 - DNA, 13 bp, D. melanogaster
gtatacgcaacgt

SEQ ID NO: 634219 - DNA, 14 bp, D. melanogaster
gtatacgcaacgtg

SEQ ID NO: 634220 - DNA, 14 bp, D. melanogaster
gtatacgcaacgtt

SEQ ID NO: 634221 - DNA, 13 bp, D. melanogaster
gtatacgcaatgt

SEQ ID NO: 634222 - DNA, 14 bp, D. melanogaster
gtatacgcaatgtg

SEQ ID NO: 634223 - DNA, 13 bp, D. melanogaster
gtatacgcacagt

SEQ ID NO: 634224 - DNA, 13 bp, D. melanogaster
gtatacgcagcgt

SEQ ID NO: 634225 - DNA, 14 bp, D. melanogaster
gtatacgcagcgtg

SEQ ID NO: 634226 - DNA, 13 bp, D. melanogaster
gtatacgcagtgg

SEQ ID NO: 634227 - DNA, 13 bp, D. melanogaster
gtatacgcagtgt

SEQ ID NO: 634228 - DNA, 14 bp, D. melanogaster
gtatacgcagtgtg

SEQ ID NO: 634229 - DNA, 13 bp, D. melanogaster
gtatacgccccgt

SEQ ID NO: 634230 - DNA, 14 bp, D. melanogaster
gtatacgccccgtt

SEQ ID NO: 634231 - DNA, 13 bp, D. melanogaster
gtatacgccgtgt

SEQ ID NO: 634232 - DNA, 13 bp, D. melanogaster
gtatacgtatgta

SEQ ID NO: 634233 - DNA, 13 bp, D. melanogaster
gtatacgtattat

SEQ ID NO: 634234 - DNA, 13 bp, D. melanogaster
gtatacttgattt

SEQ ID NO: 634235 - DNA, 13 bp, D. melanogaster
gtatagaaaaact

SEQ ID NO: 634236 - DNA, 13 bp, D. melanogaster
gtatagaaaatat

SEQ ID NO: 634237 - DNA, 13 bp, D. melanogaster
gtatagggcaatt

SEQ ID NO: 634238 - DNA, 13 bp, D. melanogaster
gtatagtttatat

SEQ ID NO: 634239 - DNA, 13 bp, D. melanogaster
gtatataaaacaa

SEQ ID NO: 634240 - DNA, 13 bp, D. melanogaster
gtatataaataca

SEQ ID NO: 634241 - DNA, 13 bp, D. melanogaster
gtatataatgtat

SEQ ID NO: 634242 - DNA, 14 bp, D. melanogaster
gtatataatgtata

SEQ ID NO: 634243 - DNA, 13 bp, D. melanogaster
gtatatacaattt

SEQ ID NO: 634244 - DNA, 14 bp, D. melanogaster
gtatatacacatat

SEQ ID NO: 634245 - DNA, 13 bp, D. melanogaster
gtatatacataaa

SEQ ID NO: 634246 - DNA, 14 bp, D. melanogaster
gtatatacatatac

SEQ ID NO: 634247 - DNA, 15 bp, D. melanogaster
gtatatacatatatg

SEQ ID NO: 634248 - DNA, 14 bp, D. melanogaster
gtatatacatattt

SEQ ID NO: 634249 - DNA, 13 bp, D. melanogaster
gtatataccatat

SEQ ID NO: 634250 - DNA, 13 bp, D. melanogaster
gtatatactgacc

SEQ ID NO: 634251 - DNA, 14 bp, D. melanogaster
gtatatacttttat

SEQ ID NO: 634252 - DNA, 14 bp, D. melanogaster
gtatatagatatat

SEQ ID NO: 634253 - DNA, 13 bp, D. melanogaster
gtatatagtatag

SEQ ID NO: 634254 - DNA, 13 bp, D. melanogaster
gtatatagtatat

SEQ ID NO: 634255 - DNA, 14 bp, D. melanogaster
gtatatagtatata

SEQ ID NO: 634256 - DNA, 13 bp, D. melanogaster
gtatatagtgtat

SEQ ID NO: 634257 - DNA, 14 bp, D. melanogaster
gtatatataaacat

SEQ ID NO: 634258 - DNA, 13 bp, D. melanogaster
gtatatataaatc

SEQ ID NO: 634259 - DNA, 13 bp, D. melanogaster
gtatatataaatg

SEQ ID NO: 634260 - DNA, 14 bp, D. melanogaster
gtatatatacacat

SEQ ID NO: 634261 - DNA, 14 bp, D. melanogaster
gtatatatacatat

SEQ ID NO: 634262 - DNA, 13 bp, D. melanogaster
gtatatatagatt

SEQ ID NO: 634263 - DNA, 14 bp, D. melanogaster
gtatatatatacaa

SEQ ID NO: 634264 - DNA, 14 bp, D. melanogaster
gtatatatatacat

SEQ ID NO: 634265 - DNA, 13 bp, D. melanogaster
gtatatatatagt

SEQ ID NO: 634266 - DNA, 14 bp, D. melanogaster
gtatatatatatag

SEQ ID NO: 634267 - DNA, 13 bp, D. melanogaster
gtatatatatatc

SEQ ID NO: 634268 - DNA, 13 bp, D. melanogaster
gtatatatatgta

SEQ ID NO: 634269 - DNA, 13 bp, D. melanogaster
gtatatatatgtg

SEQ ID NO: 634270 - DNA, 13 bp, D. melanogaster
gtatatatattgt

SEQ ID NO: 634271 - DNA, 13 bp, D. melanogaster
gtatatatggatg

SEQ ID NO: 634272 - DNA, 13 bp, D. melanogaster
gtatatatgtaca

SEQ ID NO: 634273 - DNA, 14 bp, D. melanogaster
gtatatatgtacat

SEQ ID NO: 634274 - DNA, 14 bp, D. melanogaster
gtatatatgtacgt

SEQ ID NO: 634275 - DNA, 13 bp, D. melanogaster
gtatatatgtata

SEQ ID NO: 634276 - DNA, 14 bp, D. melanogaster
gtatatatgtatat

SEQ ID NO: 634277 - DNA, 13 bp, D. melanogaster
gtatatattcttg

SEQ ID NO: 634278 - DNA, 13 bp, D. melanogaster
gtatatatttact

SEQ ID NO: 634279 - DNA, 13 bp, D. melanogaster
gtatatattttgg

SEQ ID NO: 634280 - DNA, 13 bp, D. melanogaster
gtatatcagatgt

SEQ ID NO: 634281 - DNA, 13 bp, D. melanogaster
gtatatcgtatat

SEQ ID NO: 634282 - DNA, 13 bp, D. melanogaster
gtatatgaatgta

SEQ ID NO: 634283 - DNA, 13 bp, D. melanogaster
gtatatgctatat

SEQ ID NO: 634284 - DNA, 13 bp, D. melanogaster
gtatatggaatat

SEQ ID NO: 634285 - DNA, 13 bp, D. melanogaster
gtatatggatata

SEQ ID NO: 634286 - DNA, 14 bp, D. melanogaster
gtatatggtatata

SEQ ID NO: 634287 - DNA, 13 bp, D. melanogaster
gtatatgtacata

SEQ ID NO: 634288 - DNA, 14 bp, D. melanogaster
gtatatgtacatat

SEQ ID NO: 634289 - DNA, 13 bp, D. melanogaster
gtatatgtacgta

SEQ ID NO: 634290 - DNA, 13 bp, D. melanogaster
gtatatgtataag

SEQ ID NO: 634291 - DNA, 13 bp, D. melanogaster
gtatatgtatatc

SEQ ID NO: 634292 - DNA, 13 bp, D. melanogaster
gtatatgtatatg

SEQ ID NO: 634293 - DNA, 14 bp, D. melanogaster
gtatatgtatatgt

SEQ ID NO: 634294 - DNA, 14 bp, D. melanogaster
gtatatgtatatta

SEQ ID NO: 634295 - DNA, 14 bp, D. melanogaster
gtatatgtatgcat

SEQ ID NO: 634296 - DNA, 13 bp, D. melanogaster
gtatatgtatgta

SEQ ID NO: 634297 - DNA, 14 bp, D. melanogaster
gtatatgtatgtat

SEQ ID NO: 634298 - DNA, 13 bp, D. melanogaster
gtatatgtatgtg

SEQ ID NO: 634299 - DNA, 14 bp, D. melanogaster
gtatatgtatgtgc

SEQ ID NO: 634300 - DNA, 13 bp, D. melanogaster
gtatatgtatgtt

SEQ ID NO: 634301 - DNA, 13 bp, D. melanogaster
gtatatgtattat

SEQ ID NO: 634302 - DNA, 13 bp, D. melanogaster
gtatatgtattgt

SEQ ID NO: 634303 - DNA, 14 bp, D. melanogaster
gtatatgtgtatgt

SEQ ID NO: 634304 - DNA, 13 bp, D. melanogaster
gtatatgtgtgtg

SEQ ID NO: 634305 - DNA, 13 bp, D. melanogaster
gtatatgtttata

SEQ ID NO: 634306 - DNA, 13 bp, D. melanogaster
gtatattatgtat

SEQ ID NO: 634307 - DNA, 13 bp, D. melanogaster
gtatattattatc

SEQ ID NO: 634308 - DNA, 13 bp, D. melanogaster
gtatattgtatat

SEQ ID NO: 634309 - DNA, 13 bp, D. melanogaster
gtatattgtgtat

SEQ ID NO: 634310 - DNA, 13 bp, D. melanogaster
gtatatttacaaa

SEQ ID NO: 634311 - DNA, 13 bp, D. melanogaster
gtatatttactta

SEQ ID NO: 634312 - DNA, 13 bp, D. melanogaster
gtatatttatgct

SEQ ID NO: 634313 - DNA, 13 bp, D. melanogaster
gtatatttgtaca

SEQ ID NO: 634314 - DNA, 13 bp, D. melanogaster
gtatattttaaac

SEQ ID NO: 634315 - DNA, 13 bp, D. melanogaster
gtatattttgcat

SEQ ID NO: 634316 - DNA, 14 bp, D. melanogaster
gtatatttttatct

SEQ ID NO: 634317 - DNA, 13 bp, D. melanogaster
gtatcaaaatcat

SEQ ID NO: 634318 - DNA, 13 bp, D. melanogaster
gtatcaattaaaa

SEQ ID NO: 634319 - DNA, 14 bp, D. melanogaster
gtatcaattaaaac

SEQ ID NO: 634320 - DNA, 13 bp, D. melanogaster
gtatcagtatcag

SEQ ID NO: 634321 - DNA, 14 bp, D. melanogaster
gtatcagtatcagt

SEQ ID NO: 634322 - DNA, 13 bp, D. melanogaster
gtatccaacaagc

SEQ ID NO: 634323 - DNA, 13 bp, D. melanogaster
gtatccaagtatc

SEQ ID NO: 634324 - DNA, 14 bp, D. melanogaster
gtatcccttttggc

SEQ ID NO: 634325 - DNA, 13 bp, D. melanogaster
gtatccgcatctg

SEQ ID NO: 634326 - DNA, 13 bp, D. melanogaster
gtatccgtatcca

SEQ ID NO: 634327 - DNA, 13 bp, D. melanogaster
gtatccgtatccg

SEQ ID NO: 634328 - DNA, 14 bp, D. melanogaster
gtatccgtatccgt

SEQ ID NO: 634329 - DNA, 13 bp, D. melanogaster
gtatccgtatctc

SEQ ID NO: 634330 - DNA, 13 bp, D. melanogaster
gtatccgtatctg

SEQ ID NO: 634331 - DNA, 14 bp, D. melanogaster
gtatccgtatctgt

SEQ ID NO: 634332 - DNA, 13 bp, D. melanogaster
gtatccgtatctt

SEQ ID NO: 634333 - DNA, 13 bp, D. melanogaster
gtatcctcgcagc

SEQ ID NO: 634334 - DNA, 13 bp, D. melanogaster
gtatcctggctgc

SEQ ID NO: 634335 - DNA, 13 bp, D. melanogaster
gtatcctttaaat

SEQ ID NO: 634336 - DNA, 14 bp, D. melanogaster
gtatcgatcacttt

SEQ ID NO: 634337 - DNA, 13 bp, D. melanogaster
gtatcggaaaatt

SEQ ID NO: 634338 - DNA, 13 bp, D. melanogaster
gtatcgtatcgta

SEQ ID NO: 634339 - DNA, 14 bp, D. melanogaster
gtatcgtatcgtat

SEQ ID NO: 634340 - DNA, 13 bp, D. melanogaster
gtatctaaaatat

SEQ ID NO: 634341 - DNA, 13 bp, D. melanogaster
gtatctaaagatc

SEQ ID NO: 634342 - DNA, 13 bp, D. melanogaster
gtatctacataca

SEQ ID NO: 634343 - DNA, 13 bp, D. melanogaster
gtatctagtatct

SEQ ID NO: 634344 - DNA, 14 bp, D. melanogaster
gtatctataagata

SEQ ID NO: 634345 - DNA, 13 bp, D. melanogaster
gtatctatctatc

SEQ ID NO: 634346 - DNA, 14 bp, D. melanogaster
gtatctatgtatct

SEQ ID NO: 634347 - DNA, 13 bp, D. melanogaster
gtatctattaaaa

SEQ ID NO: 634348 - DNA, 13 bp, D. melanogaster
gtatctcaaagat

SEQ ID NO: 634349 - DNA, 14 bp, D. melanogaster
gtatctcaaagata

SEQ ID NO: 634350 - DNA, 14 bp, D. melanogaster
gtatctcacagata

SEQ ID NO: 634351 - DNA, 13 bp, D. melanogaster
gtatctcacggat

SEQ ID NO: 634352 - DNA, 13 bp, D. melanogaster
gtatctcatagat

SEQ ID NO: 634353 - DNA, 13 bp, D. melanogaster
gtatctcatggat

SEQ ID NO: 634354 - DNA, 13 bp, D. melanogaster
gtatctcgtatct

SEQ ID NO: 634355 - DNA, 13 bp, D. melanogaster
gtatctctatctc

SEQ ID NO: 634356 - DNA, 13 bp, D. melanogaster
gtatctctatctg

SEQ ID NO: 634357 - DNA, 13 bp, D. melanogaster
gtatctctttttc

SEQ ID NO: 634358 - DNA, 14 bp, D. melanogaster
gtatctgaaagata

SEQ ID NO: 634359 - DNA, 13 bp, D. melanogaster
gtatctgaaggat

SEQ ID NO: 634360 - DNA, 13 bp, D. melanogaster
gtatctgaatctg

SEQ ID NO: 634361 - DNA, 13 bp, D. melanogaster
gtatctgacggat

SEQ ID NO: 634362 - DNA, 14 bp, D. melanogaster
gtatctgagtatct

SEQ ID NO: 634363 - DNA, 14 bp, D. melanogaster
gtatctgatagtcg

SEQ ID NO: 634364 - DNA, 13 bp, D. melanogaster
gtatctgatggat

SEQ ID NO: 634365 - DNA, 14 bp, D. melanogaster
gtatctgcaagata

SEQ ID NO: 634366 - DNA, 13 bp, D. melanogaster
gtatctgcatctg

SEQ ID NO: 634367 - DNA, 13 bp, D. melanogaster
gtatctgccaagt

SEQ ID NO: 634368 - DNA, 13 bp, D. melanogaster
gtatctgccacag

SEQ ID NO: 634369 - DNA, 13 bp, D. melanogaster
gtatctgccagat

SEQ ID NO: 634370 - DNA, 14 bp, D. melanogaster
gtatctgccagata

SEQ ID NO: 634371 - DNA, 13 bp, D. melanogaster
gtatctgcgagat

SEQ ID NO: 634372 - DNA, 14 bp, D. melanogaster
gtatctgcgagata

SEQ ID NO: 634373 - DNA, 13 bp, D. melanogaster
gtatctgcgcatg

SEQ ID NO: 634374 - DNA, 13 bp, D. melanogaster
gtatctgcgtatc

SEQ ID NO: 634375 - DNA, 14 bp, D. melanogaster
gtatctgcgtatct

SEQ ID NO: 634376 - DNA, 13 bp, D. melanogaster
gtatctgctagat

SEQ ID NO: 634377 - DNA, 13 bp, D. melanogaster
gtatctgctggat

SEQ ID NO: 634378 - DNA, 13 bp, D. melanogaster
gtatctggatctg

SEQ ID NO: 634379 - DNA, 13 bp, D. melanogaster
gtatctggcggat

SEQ ID NO: 634380 - DNA, 13 bp, D. melanogaster
gtatctgggcatc

SEQ ID NO: 634381 - DNA, 13 bp, D. melanogaster
gtatctggtatct

SEQ ID NO: 634382 - DNA, 14 bp, D. melanogaster
gtatctggtatctg

SEQ ID NO: 634383 - DNA, 13 bp, D. melanogaster
gtatctgtaagat

SEQ ID NO: 634384 - DNA, 13 bp, D. melanogaster
gtatctgtagctg

SEQ ID NO: 634385 - DNA, 13 bp, D. melanogaster
gtatctgtatatc

SEQ ID NO: 634386 - DNA, 13 bp, D. melanogaster
gtatctgtatatt

SEQ ID NO: 634387 - DNA, 13 bp, D. melanogaster
gtatctgtatccg

SEQ ID NO: 634388 - DNA, 13 bp, D. melanogaster
gtatctgtatcgg

SEQ ID NO: 634389 - DNA, 14 bp, D. melanogaster
gtatctgtatctac

SEQ ID NO: 634390 - DNA, 14 bp, D. melanogaster
gtatctgtatctat

SEQ ID NO: 634391 - DNA, 14 bp, D. melanogaster
gtatctgtatctga

SEQ ID NO: 634392 - DNA, 13 bp, D. melanogaster
gtatctgtatgtg

SEQ ID NO: 634393 - DNA, 13 bp, D. melanogaster
gtatctgtatttg

SEQ ID NO: 634394 - DNA, 13 bp, D. melanogaster
gtatctgtatttt

SEQ ID NO: 634395 - DNA, 13 bp, D. melanogaster
gtatctgtcggat

SEQ ID NO: 634396 - DNA, 14 bp, D. melanogaster
gtatctgtgagata

SEQ ID NO: 634397 - DNA, 14 bp, D. melanogaster
gtatctgtgtatct

SEQ ID NO: 634398 - DNA, 13 bp, D. melanogaster
gtatctgtgtgag

SEQ ID NO: 634399 - DNA, 14 bp, D. melanogaster
gtatctgtgtgcgc

SEQ ID NO: 634400 - DNA, 13 bp, D. melanogaster
gtatctgtgtgct

SEQ ID NO: 634401 - DNA, 13 bp, D. melanogaster
gtatctgtgtgtg

SEQ ID NO: 634402 - DNA, 14 bp, D. melanogaster
gtatctgtgtttgt

SEQ ID NO: 634403 - DNA, 13 bp, D. melanogaster
gtatctgttggat

SEQ ID NO: 634404 - DNA, 14 bp, D. melanogaster
gtatctgtttctgt

SEQ ID NO: 634405 - DNA, 13 bp, D. melanogaster
gtatcttaaaaat

SEQ ID NO: 634406 - DNA, 13 bp, D. melanogaster
gtatcttaaagat

SEQ ID NO: 634407 - DNA, 14 bp, D. melanogaster
gtatcttaaagata

SEQ ID NO: 634408 - DNA, 13 bp, D. melanogaster
gtatcttacagat

SEQ ID NO: 634409 - DNA, 14 bp, D. melanogaster
gtatcttacagata

SEQ ID NO: 634410 - DNA, 14 bp, D. melanogaster
gtatcttatagtcg

SEQ ID NO: 634411 - DNA, 13 bp, D. melanogaster
gtatcttgtaagt

SEQ ID NO: 634412 - DNA, 13 bp, D. melanogaster
gtatcttgtagat

SEQ ID NO: 634413 - DNA, 13 bp, D. melanogaster
gtatcttgtatct

SEQ ID NO: 634414 - DNA, 14 bp, D. melanogaster
gtatcttgtatctt

SEQ ID NO: 634415 - DNA, 14 bp, D. melanogaster
gtatctttaagata

SEQ ID NO: 634416 - DNA, 13 bp, D. melanogaster
gtatctttagaag

SEQ ID NO: 634417 - DNA, 13 bp, D. melanogaster
gtatctttatctg

SEQ ID NO: 634418 - DNA, 13 bp, D. melanogaster
gtatctttcggat

SEQ ID NO: 634419 - DNA, 13 bp, D. melanogaster
gtatctttgagat

SEQ ID NO: 634420 - DNA, 14 bp, D. melanogaster
gtatctttgcatct

SEQ ID NO: 634421 - DNA, 13 bp, D. melanogaster
gtatctttgtatc

SEQ ID NO: 634422 - DNA, 14 bp, D. melanogaster
gtatctttgtatct

SEQ ID NO: 634423 - DNA, 13 bp, D. melanogaster
gtatcttttagtt

SEQ ID NO: 634424 - DNA, 13 bp, D. melanogaster
gtatgaaaaggtt

SEQ ID NO: 634425 - DNA, 13 bp, D. melanogaster
gtatgaaaattgg

SEQ ID NO: 634426 - DNA, 13 bp, D. melanogaster
gtatgaaatatat

SEQ ID NO: 634427 - DNA, 13 bp, D. melanogaster
gtatgaacgttga

SEQ ID NO: 634428 - DNA, 13 bp, D. melanogaster
gtatgaacttcat

SEQ ID NO: 634429 - DNA, 13 bp, D. melanogaster
gtatgaataatat

SEQ ID NO: 634430 - DNA, 13 bp, D. melanogaster
gtatgaatatata

SEQ ID NO: 634431 - DNA, 13 bp, D. melanogaster
gtatgagaccctg

SEQ ID NO: 634432 - DNA, 13 bp, D. melanogaster
gtatgagcaatgc

SEQ ID NO: 634433 - DNA, 13 bp, D. melanogaster
gtatgatttcttt

SEQ ID NO: 634434 - DNA, 13 bp, D. melanogaster
gtatgcaaataag

SEQ ID NO: 634435 - DNA, 13 bp, D. melanogaster
gtatgcaaatatt

SEQ ID NO: 634436 - DNA, 14 bp, D. melanogaster
gtatgcaacaaaaa

SEQ ID NO: 634437 - DNA, 13 bp, D. melanogaster
gtatgcacatatg

SEQ ID NO: 634438 - DNA, 13 bp, D. melanogaster
gtatgcagttaca

SEQ ID NO: 634439 - DNA, 13 bp, D. melanogaster
gtatgcatatatg

SEQ ID NO: 634440 - DNA, 14 bp, D. melanogaster
gtatgcatatatgt

SEQ ID NO: 634441 - DNA, 13 bp, D. melanogaster
gtatgcatatgca

SEQ ID NO: 634442 - DNA, 13 bp, D. melanogaster
gtatgcatgtata

SEQ ID NO: 634443 - DNA, 13 bp, D. melanogaster
gtatgccactggt

SEQ ID NO: 634444 - DNA, 13 bp, D. melanogaster
gtatgcggcagcg

SEQ ID NO: 634445 - DNA, 13 bp, D. melanogaster
gtatgcgttatat

SEQ ID NO: 634446 - DNA, 13 bp, D. melanogaster
gtatgctgttcaa

SEQ ID NO: 634447 - DNA, 13 bp, D. melanogaster
gtatggaacaatt

SEQ ID NO: 634448 - DNA, 14 bp, D. melanogaster
gtatggaacaattc

SEQ ID NO: 634449 - DNA, 13 bp, D. melanogaster
gtatggaatttat

SEQ ID NO: 634450 - DNA, 13 bp, D. melanogaster
gtatggatgtatg

SEQ ID NO: 634451 - DNA, 13 bp, D. melanogaster
gtatggctttggt

SEQ ID NO: 634452 - DNA, 13 bp, D. melanogaster
gtatgggtatggc

SEQ ID NO: 634453 - DNA, 14 bp, D. melanogaster
gtatggtatggtat

SEQ ID NO: 634454 - DNA, 13 bp, D. melanogaster
gtatggtatggtt

SEQ ID NO: 634455 - DNA, 13 bp, D. melanogaster
gtatgtaaataaa

SEQ ID NO: 634456 - DNA, 13 bp, D. melanogaster
gtatgtaaatgtt

SEQ ID NO: 634457 - DNA, 13 bp, D. melanogaster
gtatgtaatatgt

SEQ ID NO: 634458 - DNA, 13 bp, D. melanogaster
gtatgtacaaatg

SEQ ID NO: 634459 - DNA, 14 bp, D. melanogaster
gtatgtacatacac

SEQ ID NO: 634460 - DNA, 15 bp, D. melanogaster
gtatgtacatacatg

SEQ ID NO: 634461 - DNA, 13 bp, D. melanogaster
gtatgtacatact

SEQ ID NO: 634462 - DNA, 14 bp, D. melanogaster
gtatgtacatatac

SEQ ID NO: 634463 - DNA, 13 bp, D. melanogaster
gtatgtacatttt

SEQ ID NO: 634464 - DNA, 13 bp, D. melanogaster
gtatgtacgagta

SEQ ID NO: 634465 - DNA, 14 bp, D. melanogaster
gtatgtacgtatgt

SEQ ID NO: 634466 - DNA, 13 bp, D. melanogaster
gtatgtactatat

SEQ ID NO: 634467 - DNA, 13 bp, D. melanogaster
gtatgtagtacat

SEQ ID NO: 634468 - DNA, 13 bp, D. melanogaster
gtatgtatacata

SEQ ID NO: 634469 - DNA, 13 bp, D. melanogaster
gtatgtatataca

SEQ ID NO: 634470 - DNA, 14 bp, D. melanogaster
gtatgtatatacat

SEQ ID NO: 634471 - DNA, 13 bp, D. melanogaster
gtatgtatatata

SEQ ID NO: 634472 - DNA, 14 bp, D. melanogaster
gtatgtatatataa

SEQ ID NO: 634473 - DNA, 15 bp, D. melanogaster
gtatgtatatataca

SEQ ID NO: 634474 - DNA, 14 bp, D. melanogaster
gtatgtatatatat

SEQ ID NO: 634475 - DNA, 13 bp, D. melanogaster
gtatgtatatatg

SEQ ID NO: 634476 - DNA, 13 bp, D. melanogaster
gtatgtatatatt

SEQ ID NO: 634477 - DNA, 13 bp, D. melanogaster
gtatgtatatcta

SEQ ID NO: 634478 - DNA, 13 bp, D. melanogaster
gtatgtatatgca

SEQ ID NO: 634479 - DNA, 14 bp, D. melanogaster
gtatgtatatgcat

SEQ ID NO: 634480 - DNA, 13 bp, D. melanogaster
gtatgtatatgcc

SEQ ID NO: 634481 - DNA, 13 bp, D. melanogaster
gtatgtatattga

SEQ ID NO: 634482 - DNA, 13 bp, D. melanogaster
gtatgtatatttg

SEQ ID NO: 634483 - DNA, 14 bp, D. melanogaster
gtatgtatatttgt

SEQ ID NO: 634484 - DNA, 13 bp, D. melanogaster
gtatgtatgaatg

SEQ ID NO: 634485 - DNA, 14 bp, D. melanogaster
gtatgtatgaatgt

SEQ ID NO: 634486 - DNA, 14 bp, D. melanogaster
gtatgtatgcacat

SEQ ID NO: 634487 - DNA, 15 bp, D. melanogaster
gtatgtatgtacatg

SEQ ID NO: 634488 - DNA, 14 bp, D. melanogaster
gtatgtatgtactt

SEQ ID NO: 634489 - DNA, 13 bp, D. melanogaster
gtatgtatgtaga

SEQ ID NO: 634490 - DNA, 14 bp, D. melanogaster
gtatgtatgtatac

SEQ ID NO: 634491 - DNA, 15 bp, D. melanogaster
gtatgtatgtatata

SEQ ID NO: 634492 - DNA, 15 bp, D. melanogaster
gtatgtatgtatatg

SEQ ID NO: 634493 - DNA, 14 bp, D. melanogaster
gtatgtatgtatta

SEQ ID NO: 634494 - DNA, 13 bp, D. melanogaster
gtatgtatgtgcc

SEQ ID NO: 634495 - DNA, 13 bp, D. melanogaster
gtatgtatgtggg

SEQ ID NO: 634496 - DNA, 13 bp, D. melanogaster
gtatgtatgtgta

SEQ ID NO: 634497 - DNA, 13 bp, D. melanogaster
gtatgtatgtgtg

SEQ ID NO: 634498 - DNA, 13 bp, D. melanogaster
gtatgtatgtttg

SEQ ID NO: 634499 - DNA, 13 bp, D. melanogaster
gtatgtatttcaa

SEQ ID NO: 634500 - DNA, 13 bp, D. melanogaster
gtatgtatttgca

SEQ ID NO: 634501 - DNA, 13 bp, D. melanogaster
gtatgtccgtatg

SEQ ID NO: 634502 - DNA, 14 bp, D. melanogaster
gtatgtccgtatgt

SEQ ID NO: 634503 - DNA, 13 bp, D. melanogaster
gtatgtgaaatat

SEQ ID NO: 634504 - DNA, 14 bp, D. melanogaster
gtatgtgaatatgt

SEQ ID NO: 634505 - DNA, 14 bp, D. melanogaster
gtatgtgcatatgt

SEQ ID NO: 634506 - DNA, 14 bp, D. melanogaster
gtatgtgcgtgtgt

SEQ ID NO: 634507 - DNA, 13 bp, D. melanogaster
gtatgtggaaaat

SEQ ID NO: 634508 - DNA, 13 bp, D. melanogaster
gtatgtggcactg

SEQ ID NO: 634509 - DNA, 13 bp, D. melanogaster
gtatgtgtacaca

SEQ ID NO: 634510 - DNA, 13 bp, D. melanogaster
gtatgtgtacctc

SEQ ID NO: 634511 - DNA, 14 bp, D. melanogaster
gtatgtgtatgtgc

SEQ ID NO: 634512 - DNA, 14 bp, D. melanogaster
gtatgtgtatgtgt

SEQ ID NO: 634513 - DNA, 13 bp, D. melanogaster
gtatgtgtatttg

SEQ ID NO: 634514 - DNA, 13 bp, D. melanogaster
gtatgtgtgcaca

SEQ ID NO: 634515 - DNA, 13 bp, D. melanogaster
gtatgtgtgcttt

SEQ ID NO: 634516 - DNA, 13 bp, D. melanogaster
gtatgtgtgtaat

SEQ ID NO: 634517 - DNA, 13 bp, D. melanogaster
gtatgtgtgtatt

SEQ ID NO: 634518 - DNA, 13 bp, D. melanogaster
gtatgtgtgtgct

SEQ ID NO: 634519 - DNA, 14 bp, D. melanogaster
gtatgtgtgtgtgc

SEQ ID NO: 634520 - DNA, 13 bp, D. melanogaster
gtatgttatgtat

SEQ ID NO: 634521 - DNA, 13 bp, D. melanogaster
gtatgtttgtata

SEQ ID NO: 634522 - DNA, 13 bp, D. melanogaster
gtattaaaactgt

SEQ ID NO: 634523 - DNA, 13 bp, D. melanogaster
gtattaaacaaaa

SEQ ID NO: 634524 - DNA, 13 bp, D. melanogaster
gtattaaaccaaa

SEQ ID NO: 634525 - DNA, 14 bp, D. melanogaster
gtattaaagcaata

SEQ ID NO: 634526 - DNA, 13 bp, D. melanogaster
gtattaacattaa

SEQ ID NO: 634527 - DNA, 13 bp, D. melanogaster
gtattaatcatat

SEQ ID NO: 634528 - DNA, 13 bp, D. melanogaster
gtattatagacca

SEQ ID NO: 634529 - DNA, 13 bp, D. melanogaster
gtattatatatac

SEQ ID NO: 634530 - DNA, 13 bp, D. melanogaster
gtattatatgtat

SEQ ID NO: 634531 - DNA, 13 bp, D. melanogaster
gtattatgaatgt

SEQ ID NO: 634532 - DNA, 13 bp, D. melanogaster
gtattatttggaa

SEQ ID NO: 634533 - DNA, 14 bp, D. melanogaster
gtattatttggaag

SEQ ID NO: 634534 - DNA, 13 bp, D. melanogaster
gtattcaaaatgc

SEQ ID NO: 634535 - DNA, 13 bp, D. melanogaster
gtattcaaaatgt

SEQ ID NO: 634536 - DNA, 13 bp, D. melanogaster
gtattcaaaattc

SEQ ID NO: 634537 - DNA, 13 bp, D. melanogaster
gtattcatttcaa

SEQ ID NO: 634538 - DNA, 13 bp, D. melanogaster
gtattccagagaa

SEQ ID NO: 634539 - DNA, 13 bp, D. melanogaster
gtattcggctttc

SEQ ID NO: 634540 - DNA, 13 bp, D. melanogaster
gtattcgtattcg

SEQ ID NO: 634541 - DNA, 13 bp, D. melanogaster
gtattcgtatttg

SEQ ID NO: 634542 - DNA, 13 bp, D. melanogaster
gtattcgtatttt

SEQ ID NO: 634543 - DNA, 13 bp, D. melanogaster
gtattctatatat

SEQ ID NO: 634544 - DNA, 14 bp, D. melanogaster
gtattcttgttgtt

SEQ ID NO: 634545 - DNA, 13 bp, D. melanogaster
gtattgaaaataa

SEQ ID NO: 634546 - DNA, 13 bp, D. melanogaster
gtattgaaaatat

SEQ ID NO: 634547 - DNA, 13 bp, D. melanogaster
gtattgaaaattt

SEQ ID NO: 634548 - DNA, 13 bp, D. melanogaster
gtattgattttcc

SEQ ID NO: 634549 - DNA, 14 bp, D. melanogaster
gtattgccacagca

SEQ ID NO: 634550 - DNA, 13 bp, D. melanogaster
gtattgcttttat

SEQ ID NO: 634551 - DNA, 13 bp, D. melanogaster
gtattggaggatt

SEQ ID NO: 634552 - DNA, 13 bp, D. melanogaster
gtattgggtattt

SEQ ID NO: 634553 - DNA, 13 bp, D. melanogaster
gtattggtaatta

SEQ ID NO: 634554 - DNA, 14 bp, D. melanogaster
gtattggtattggt

SEQ ID NO: 634555 - DNA, 13 bp, D. melanogaster
gtattgtaaattt

SEQ ID NO: 634556 - DNA, 14 bp, D. melanogaster
gtattgtatatata

SEQ ID NO: 634557 - DNA, 13 bp, D. melanogaster
gtattgtatatgt

SEQ ID NO: 634558 - DNA, 13 bp, D. melanogaster
gtattgtatttaa

SEQ ID NO: 634559 - DNA, 13 bp, D. melanogaster
gtattgttttaaa

SEQ ID NO: 634560 - DNA, 13 bp, D. melanogaster
gtatttaaaaaca

SEQ ID NO: 634561 - DNA, 13 bp, D. melanogaster
gtatttaaaaact

SEQ ID NO: 634562 - DNA, 13 bp, D. melanogaster
gtatttaaaagat

SEQ ID NO: 634563 - DNA, 13 bp, D. melanogaster
gtatttaaattca

SEQ ID NO: 634564 - DNA, 13 bp, D. melanogaster
gtatttaacaaaa

SEQ ID NO: 634565 - DNA, 13 bp, D. melanogaster
gtatttaagcgat

SEQ ID NO: 634566 - DNA, 13 bp, D. melanogaster
gtatttaatattc

SEQ ID NO: 634567 - DNA, 13 bp, D. melanogaster
gtatttaatgaat

SEQ ID NO: 634568 - DNA, 13 bp, D. melanogaster
gtatttacacaca

SEQ ID NO: 634569 - DNA, 13 bp, D. melanogaster
gtatttacatttt

SEQ ID NO: 634570 - DNA, 13 bp, D. melanogaster
gtatttacttaaa

SEQ ID NO: 634571 - DNA, 13 bp, D. melanogaster
gtatttataaaca

SEQ ID NO: 634572 - DNA, 13 bp, D. melanogaster
gtatttatatatg

SEQ ID NO: 634573 - DNA, 13 bp, D. melanogaster
gtatttatatttc

SEQ ID NO: 634574 - DNA, 13 bp, D. melanogaster
gtatttattaaga

SEQ ID NO: 634575 - DNA, 13 bp, D. melanogaster
gtatttcaatttt

SEQ ID NO: 634576 - DNA, 13 bp, D. melanogaster
gtatttcacatgg

SEQ ID NO: 634577 - DNA, 13 bp, D. melanogaster
gtatttcataatt

SEQ ID NO: 634578 - DNA, 13 bp, D. melanogaster
gtatttcatttgc

SEQ ID NO: 634579 - DNA, 13 bp, D. melanogaster
gtatttccatatt

SEQ ID NO: 634580 - DNA, 13 bp, D. melanogaster
gtatttcccattt

SEQ ID NO: 634581 - DNA, 14 bp, D. melanogaster
gtatttcgtatttt

SEQ ID NO: 634582 - DNA, 13 bp, D. melanogaster
gtatttcgttgtt

SEQ ID NO: 634583 - DNA, 13 bp, D. melanogaster
gtatttctatata

SEQ ID NO: 634584 - DNA, 13 bp, D. melanogaster
gtatttctgtatt

SEQ ID NO: 634585 - DNA, 13 bp, D. melanogaster
gtatttcttaaat

SEQ ID NO: 634586 - DNA, 13 bp, D. melanogaster
gtatttgaaatgt

SEQ ID NO: 634587 - DNA, 13 bp, D. melanogaster
gtatttgaacaat

SEQ ID NO: 634588 - DNA, 13 bp, D. melanogaster
gtatttgaattgc

SEQ ID NO: 634589 - DNA, 13 bp, D. melanogaster
gtatttgatttca

SEQ ID NO: 634590 - DNA, 13 bp, D. melanogaster
gtatttgatttgc

SEQ ID NO: 634591 - DNA, 13 bp, D. melanogaster
gtatttgcaacat

SEQ ID NO: 634592 - DNA, 13 bp, D. melanogaster
gtatttgcattta

SEQ ID NO: 634593 - DNA, 13 bp, D. melanogaster
gtatttgcatttc

SEQ ID NO: 634594 - DNA, 13 bp, D. melanogaster
gtatttgctttaa

SEQ ID NO: 634595 - DNA, 13 bp, D. melanogaster
gtatttgctttat

SEQ ID NO: 634596 - DNA, 13 bp, D. melanogaster
gtatttgcttttg

SEQ ID NO: 634597 - DNA, 13 bp, D. melanogaster
gtatttggttgta

SEQ ID NO: 634598 - DNA, 14 bp, D. melanogaster
gtatttgtaaatgt

SEQ ID NO: 634599 - DNA, 13 bp, D. melanogaster
gtatttgtatatg

SEQ ID NO: 634600 - DNA, 13 bp, D. melanogaster
gtatttgtatctc

SEQ ID NO: 634601 - DNA, 13 bp, D. melanogaster
gtatttgtatctg

SEQ ID NO: 634602 - DNA, 14 bp, D. melanogaster
gtatttgtatctgt

SEQ ID NO: 634603 - DNA, 13 bp, D. melanogaster
gtatttgtattca

SEQ ID NO: 634604 - DNA, 13 bp, D. melanogaster
gtatttgtatttc

SEQ ID NO: 634605 - DNA, 13 bp, D. melanogaster
gtattttatattc

SEQ ID NO: 634606 - DNA, 13 bp, D. melanogaster
gtattttcaaaat

SEQ ID NO: 634607 - DNA, 13 bp, D. melanogaster
gtattttcaatat

SEQ ID NO: 634608 - DNA, 13 bp, D. melanogaster
gtattttcgaaat

SEQ ID NO: 634609 - DNA, 13 bp, D. melanogaster
gtattttcgtatt

SEQ ID NO: 634610 - DNA, 13 bp, D. melanogaster
gtattttctaaaa

SEQ ID NO: 634611 - DNA, 13 bp, D. melanogaster
gtattttctcaat

SEQ ID NO: 634612 - DNA, 14 bp, D. melanogaster
gtattttctgttaa

SEQ ID NO: 634613 - DNA, 13 bp, D. melanogaster
gtattttgaaatt

SEQ ID NO: 634614 - DNA, 13 bp, D. melanogaster
gtattttgatcaa

SEQ ID NO: 634615 - DNA, 13 bp, D. melanogaster
gtattttgatcat

SEQ ID NO: 634616 - DNA, 13 bp, D. melanogaster
gtattttgcatga

SEQ ID NO: 634617 - DNA, 13 bp, D. melanogaster
gtattttggaact

SEQ ID NO: 634618 - DNA, 13 bp, D. melanogaster
gtatttttaacga

SEQ ID NO: 634619 - DNA, 13 bp, D. melanogaster
gtatttttagcta

SEQ ID NO: 634620 - DNA, 13 bp, D. melanogaster
gtatttttcattc

SEQ ID NO: 634621 - DNA, 13 bp, D. melanogaster
gtatttttggaaa

SEQ ID NO: 634622 - DNA, 13 bp, D. melanogaster
gtattttttgaaa

SEQ ID NO: 634623 - DNA, 13 bp, D. melanogaster
gtcaaaaaaatag

SEQ ID NO: 634624 - DNA, 13 bp, D. melanogaster
gtcaaaaaatttt

SEQ ID NO: 634625 - DNA, 13 bp, D. melanogaster
gtcaaaaatagtt

SEQ ID NO: 634626 - DNA, 13 bp, D. melanogaster
gtcaaaaatgaac

SEQ ID NO: 634627 - DNA, 13 bp, D. melanogaster
gtcaaaacaaaag

SEQ ID NO: 634628 - DNA, 13 bp, D. melanogaster
gtcaaaacaagaa

SEQ ID NO: 634629 - DNA, 13 bp, D. melanogaster
gtcaaaagaagac

SEQ ID NO: 634630 - DNA, 13 bp, D. melanogaster
gtcaaaataaaca

SEQ ID NO: 634631 - DNA, 13 bp, D. melanogaster
gtcaaaatacaag

SEQ ID NO: 634632 - DNA, 13 bp, D. melanogaster
gtcaaaatatttg

SEQ ID NO: 634633 - DNA, 13 bp, D. melanogaster
gtcaaaatatttt

SEQ ID NO: 634634 - DNA, 13 bp, D. melanogaster
gtcaaaatgcaga

SEQ ID NO: 634635 - DNA, 13 bp, D. melanogaster
gtcaaagaacttt

SEQ ID NO: 634636 - DNA, 13 bp, D. melanogaster
gtcaaagtcaatg

SEQ ID NO: 634637 - DNA, 13 bp, D. melanogaster
gtcaaatgaaaat

SEQ ID NO: 634638 - DNA, 13 bp, D. melanogaster
gtcaaatgaaatg

SEQ ID NO: 634639 - DNA, 13 bp, D. melanogaster
gtcaaatggaaaa

SEQ ID NO: 634640 - DNA, 13 bp, D. melanogaster
gtcaaatggcaac

SEQ ID NO: 634641 - DNA, 13 bp, D. melanogaster
gtcaaatggcgcc

SEQ ID NO: 634642 - DNA, 13 bp, D. melanogaster
gtcaaatgttttg

SEQ ID NO: 634643 - DNA, 13 bp, D. melanogaster
gtcaaattcaagt

SEQ ID NO: 634644 - DNA, 13 bp, D. melanogaster
gtcaaattgaaaa

SEQ ID NO: 634645 - DNA, 13 bp, D. melanogaster
gtcaacaaaatgc

SEQ ID NO: 634646 - DNA, 13 bp, D. melanogaster
gtcaacaaagcga

SEQ ID NO: 634647 - DNA, 13 bp, D. melanogaster
gtcaacaactttg

SEQ ID NO: 634648 - DNA, 13 bp, D. melanogaster
gtcaacaagccaa

SEQ ID NO: 634649 - DNA, 14 bp, D. melanogaster
gtcaacaagccaag

SEQ ID NO: 634650 - DNA, 13 bp, D. melanogaster
gtcaacacgatta

SEQ ID NO: 634651 - DNA, 13 bp, D. melanogaster
gtcaacagcaaca

SEQ ID NO: 634652 - DNA, 13 bp, D. melanogaster
gtcaacagctacc

SEQ ID NO: 634653 - DNA, 13 bp, D. melanogaster
gtcaacatgttgc

SEQ ID NO: 634654 - DNA, 13 bp, D. melanogaster
gtcaacattttgt

SEQ ID NO: 634655 - DNA, 13 bp, D. melanogaster
gtcaaccacgatg

SEQ ID NO: 634656 - DNA, 13 bp, D. melanogaster
gtcaacgaaatgg

SEQ ID NO: 634657 - DNA, 13 bp, D. melanogaster
gtcaactgacggg

SEQ ID NO: 634658 - DNA, 13 bp, D. melanogaster
gtcaactgctaat

SEQ ID NO: 634659 - DNA, 13 bp, D. melanogaster
gtcaagaaaaagg

SEQ ID NO: 634660 - DNA, 13 bp, D. melanogaster
gtcaagaaactct

SEQ ID NO: 634661 - DNA, 13 bp, D. melanogaster
gtcaagcttaaat

SEQ ID NO: 634662 - DNA, 13 bp, D. melanogaster
gtcaaggaaatga

SEQ ID NO: 634663 - DNA, 13 bp, D. melanogaster
gtcaagggctttg

SEQ ID NO: 634664 - DNA, 13 bp, D. melanogaster
gtcaagtcaagtc

SEQ ID NO: 634665 - DNA, 13 bp, D. melanogaster
gtcaagtcgagag

SEQ ID NO: 634666 - DNA, 13 bp, D. melanogaster
gtcaagtgcagtg

SEQ ID NO: 634667 - DNA, 14 bp, D. melanogaster
gtcaagtggaagaa

SEQ ID NO: 634668 - DNA, 13 bp, D. melanogaster
gtcaagttcaagt

SEQ ID NO: 634669 - DNA, 13 bp, D. melanogaster
gtcaagttcttca

SEQ ID NO: 634670 - DNA, 13 bp, D. melanogaster
gtcaataaataaa

SEQ ID NO: 634671 - DNA, 13 bp, D. melanogaster
gtcaatatttatt

SEQ ID NO: 634672 - DNA, 14 bp, D. melanogaster
gtcaatcaatcaat

SEQ ID NO: 634673 - DNA, 13 bp, D. melanogaster
gtcaatggcaatg

SEQ ID NO: 634674 - DNA, 13 bp, D. melanogaster
gtcaattaaaaac

SEQ ID NO: 634675 - DNA, 13 bp, D. melanogaster
gtcaattccattc

SEQ ID NO: 634676 - DNA, 13 bp, D. melanogaster
gtcaattgcaaaa

SEQ ID NO: 634677 - DNA, 13 bp, D. melanogaster
gtcaatttatatt

SEQ ID NO: 634678 - DNA, 13 bp, D. melanogaster
gtcaatttcaatt

SEQ ID NO: 634679 - DNA, 13 bp, D. melanogaster
gtcaatttcattt

SEQ ID NO: 634680 - DNA, 13 bp, D. melanogaster
gtcaatttgtcaa

SEQ ID NO: 634681 - DNA, 13 bp, D. melanogaster
gtcacaaaaggaa

SEQ ID NO: 634682 - DNA, 13 bp, D. melanogaster
gtcacaacaacaa

SEQ ID NO: 634683 - DNA, 13 bp, D. melanogaster
gtcacaattgcac

SEQ ID NO: 634684 - DNA, 13 bp, D. melanogaster
gtcacacgaaact

SEQ ID NO: 634685 - DNA, 13 bp, D. melanogaster
gtcacacgcacac

SEQ ID NO: 634686 - DNA, 13 bp, D. melanogaster
gtcacagaacttt

SEQ ID NO: 634687 - DNA, 13 bp, D. melanogaster
gtcacagagcaaa

SEQ ID NO: 634688 - DNA, 13 bp, D. melanogaster
gtcacagtcgcag

SEQ ID NO: 634689 - DNA, 13 bp, D. melanogaster
gtcacattggcac

SEQ ID NO: 634690 - DNA, 13 bp, D. melanogaster
gtcacatttttat

SEQ ID NO: 634691 - DNA, 13 bp, D. melanogaster
gtcacccgctgcg

SEQ ID NO: 634692 - DNA, 13 bp, D. melanogaster
gtcacggttgtgc

SEQ ID NO: 634693 - DNA, 13 bp, D. melanogaster
gtcactacaagat

SEQ ID NO: 634694 - DNA, 13 bp, D. melanogaster
gtcactgcactcg

SEQ ID NO: 634695 - DNA, 13 bp, D. melanogaster
gtcagaaattcgt

SEQ ID NO: 634696 - DNA, 13 bp, D. melanogaster
gtcagaacaacta

SEQ ID NO: 634697 - DNA, 13 bp, D. melanogaster
gtcagcaaaacaa

SEQ ID NO: 634698 - DNA, 13 bp, D. melanogaster
gtcagcacccaag

SEQ ID NO: 634699 - DNA, 13 bp, D. melanogaster
gtcagcacttggc

SEQ ID NO: 634700 - DNA, 13 bp, D. melanogaster
gtcagcagtcagc

SEQ ID NO: 634701 - DNA, 13 bp, D. melanogaster
gtcagcagtttgg

SEQ ID NO: 634702 - DNA, 13 bp, D. melanogaster
gtcagcatcccca

SEQ ID NO: 634703 - DNA, 13 bp, D. melanogaster
gtcagcattttgg

SEQ ID NO: 634704 - DNA, 14 bp, D. melanogaster
gtcagcattttggg

SEQ ID NO: 634705 - DNA, 13 bp, D. melanogaster
gtcagccagccaa

SEQ ID NO: 634706 - DNA, 13 bp, D. melanogaster
gtcagccagtcaa

SEQ ID NO: 634707 - DNA, 14 bp, D. melanogaster
gtcagccatcatca

SEQ ID NO: 634708 - DNA, 13 bp, D. melanogaster
gtcagcgaaagca

SEQ ID NO: 634709 - DNA, 14 bp, D. melanogaster
gtcagcgaaagcaa

SEQ ID NO: 634710 - DNA, 13 bp, D. melanogaster
gtcagcgcggcag

SEQ ID NO: 634711 - DNA, 13 bp, D. melanogaster
gtcagctaataaa

SEQ ID NO: 634712 - DNA, 13 bp, D. melanogaster
gtcagctgcaaaa

SEQ ID NO: 634713 - DNA, 14 bp, D. melanogaster
gtcagctgcaaaaa

SEQ ID NO: 634714 - DNA, 13 bp, D. melanogaster
gtcagctgcagtt

SEQ ID NO: 634715 - DNA, 13 bp, D. melanogaster
gtcagctgggcgt

SEQ ID NO: 634716 - DNA, 13 bp, D. melanogaster
gtcagcttaagca

SEQ ID NO: 634717 - DNA, 14 bp, D. melanogaster
gtcaggaaatcaaa

SEQ ID NO: 634718 - DNA, 13 bp, D. melanogaster
gtcaggaggagca

SEQ ID NO: 634719 - DNA, 13 bp, D. melanogaster
gtcaggctttagg

SEQ ID NO: 634720 - DNA, 13 bp, D. melanogaster
gtcaggggtcagg

SEQ ID NO: 634721 - DNA, 13 bp, D. melanogaster
gtcagtcactcag

SEQ ID NO: 634722 - DNA, 13 bp, D. melanogaster
gtcagtcaggcag

SEQ ID NO: 634723 - DNA, 13 bp, D. melanogaster
gtcagtcagtcaa

SEQ ID NO: 634724 - DNA, 14 bp, D. melanogaster
gtcagtcagtcaat

SEQ ID NO: 634725 - DNA, 14 bp, D. melanogaster
gtcagtcagtcagg

SEQ ID NO: 634726 - DNA, 13 bp, D. melanogaster
gtcagtcagtcgg

SEQ ID NO: 634727 - DNA, 14 bp, D. melanogaster
gtcagtcagtcggt

SEQ ID NO: 634728 - DNA, 13 bp, D. melanogaster
gtcagtcagtttg

SEQ ID NO: 634729 - DNA, 13 bp, D. melanogaster
gtcagtgcggcag

SEQ ID NO: 634730 - DNA, 13 bp, D. melanogaster
gtcagtgtgatgg

SEQ ID NO: 634731 - DNA, 13 bp, D. melanogaster
gtcagttagccag

SEQ ID NO: 634732 - DNA, 13 bp, D. melanogaster
gtcagttggccag

SEQ ID NO: 634733 - DNA, 13 bp, D. melanogaster
gtcagtttgtcag

SEQ ID NO: 634734 - DNA, 13 bp, D. melanogaster
gtcagttttcgat

SEQ ID NO: 634735 - DNA, 13 bp, D. melanogaster
gtcataaaataat

SEQ ID NO: 634736 - DNA, 13 bp, D. melanogaster
gtcataaattttc

SEQ ID NO: 634737 - DNA, 13 bp, D. melanogaster
gtcataataaata

SEQ ID NO: 634738 - DNA, 13 bp, D. melanogaster
gtcataatcttca

SEQ ID NO: 634739 - DNA, 14 bp, D. melanogaster
gtcataatttttat

SEQ ID NO: 634740 - DNA, 13 bp, D. melanogaster
gtcatagaaaata

SEQ ID NO: 634741 - DNA, 14 bp, D. melanogaster
gtcatagaaaatag

SEQ ID NO: 634742 - DNA, 13 bp, D. melanogaster
gtcatatcttgag

SEQ ID NO: 634743 - DNA, 13 bp, D. melanogaster
gtcatcaatcaaa

SEQ ID NO: 634744 - DNA, 13 bp, D. melanogaster
gtcatcagcatca

SEQ ID NO: 634745 - DNA, 13 bp, D. melanogaster
gtcatcaggatgc

SEQ ID NO: 634746 - DNA, 13 bp, D. melanogaster
gtcatcatcagca

SEQ ID NO: 634747 - DNA, 14 bp, D. melanogaster
gtcatcatcatcgc

SEQ ID NO: 634748 - DNA, 13 bp, D. melanogaster
gtcatcattatca

SEQ ID NO: 634749 - DNA, 13 bp, D. melanogaster
gtcatccagctga

SEQ ID NO: 634750 - DNA, 13 bp, D. melanogaster
gtcatccctctct

SEQ ID NO: 634751 - DNA, 13 bp, D. melanogaster
gtcatccggcaaa

SEQ ID NO: 634752 - DNA, 14 bp, D. melanogaster
gtcatccggcaaaa

SEQ ID NO: 634753 - DNA, 13 bp, D. melanogaster
gtcatcgcaaagt

SEQ ID NO: 634754 - DNA, 13 bp, D. melanogaster
gtcatcgccacgt

SEQ ID NO: 634755 - DNA, 13 bp, D. melanogaster
gtcatcgtcatcg

SEQ ID NO: 634756 - DNA, 13 bp, D. melanogaster
gtcatcgtcgtca

SEQ ID NO: 634757 - DNA, 13 bp, D. melanogaster
gtcatctacactg

SEQ ID NO: 634758 - DNA, 14 bp, D. melanogaster
gtcatctggggcca

SEQ ID NO: 634759 - DNA, 13 bp, D. melanogaster
gtcatgtgtgtgt

SEQ ID NO: 634760 - DNA, 13 bp, D. melanogaster
gtcattacgaata

SEQ ID NO: 634761 - DNA, 13 bp, D. melanogaster
gtcattattattg

SEQ ID NO: 634762 - DNA, 13 bp, D. melanogaster
gtcattgactttt

SEQ ID NO: 634763 - DNA, 13 bp, D. melanogaster
gtcattgtcattg

SEQ ID NO: 634764 - DNA, 13 bp, D. melanogaster
gtcattgtttttg

SEQ ID NO: 634765 - DNA, 13 bp, D. melanogaster
gtcatttgatttg

SEQ ID NO: 634766 - DNA, 13 bp, D. melanogaster
gtcattttcaaca

SEQ ID NO: 634767 - DNA, 13 bp, D. melanogaster
gtcattttgaata

SEQ ID NO: 634768 - DNA, 13 bp, D. melanogaster
gtccaaaaaccaa

SEQ ID NO: 634769 - DNA, 13 bp, D. melanogaster
gtccaaaaattaa

SEQ ID NO: 634770 - DNA, 13 bp, D. melanogaster
gtccaaaaatttg

SEQ ID NO: 634771 - DNA, 13 bp, D. melanogaster
gtccaaaatatca

SEQ ID NO: 634772 - DNA, 13 bp, D. melanogaster
gtccaaaatgcag

SEQ ID NO: 634773 - DNA, 14 bp, D. melanogaster
gtccaaaatgcaga

SEQ ID NO: 634774 - DNA, 13 bp, D. melanogaster
gtccaaagtccaa

SEQ ID NO: 634775 - DNA, 14 bp, D. melanogaster
gtccaaatatggaa

SEQ ID NO: 634776 - DNA, 13 bp, D. melanogaster
gtccaaatgtgga

SEQ ID NO: 634777 - DNA, 13 bp, D. melanogaster
gtccaaattctca

SEQ ID NO: 634778 - DNA, 13 bp, D. melanogaster
gtccaagtccaag

SEQ ID NO: 634779 - DNA, 14 bp, D. melanogaster
gtccaagtccaagt

SEQ ID NO: 634780 - DNA, 13 bp, D. melanogaster
gtccaagtccgag

SEQ ID NO: 634781 - DNA, 13 bp, D. melanogaster
gtccaagtgtttt

SEQ ID NO: 634782 - DNA, 14 bp, D. melanogaster
gtccaatgaaaaca

SEQ ID NO: 634783 - DNA, 13 bp, D. melanogaster
gtccaatgaagac

SEQ ID NO: 634784 - DNA, 13 bp, D. melanogaster
gtccaattaaaat

SEQ ID NO: 634785 - DNA, 14 bp, D. melanogaster
gtccacaacaactc

SEQ ID NO: 634786 - DNA, 13 bp, D. melanogaster
gtccacatccaca

SEQ ID NO: 634787 - DNA, 14 bp, D. melanogaster
gtccacatccacat

SEQ ID NO: 634788 - DNA, 13 bp, D. melanogaster
gtccacatccacg

SEQ ID NO: 634789 - DNA, 13 bp, D. melanogaster
gtccaccatttgc

SEQ ID NO: 634790 - DNA, 13 bp, D. melanogaster
gtccacgtccacg

SEQ ID NO: 634791 - DNA, 13 bp, D. melanogaster
gtccactcaccca

SEQ ID NO: 634792 - DNA, 13 bp, D. melanogaster
gtccactcgaatg

SEQ ID NO: 634793 - DNA, 14 bp, D. melanogaster
gtccactctaacgc

SEQ ID NO: 634794 - DNA, 13 bp, D. melanogaster
gtccactttgttg

SEQ ID NO: 634795 - DNA, 13 bp, D. melanogaster
gtccagagatatt

SEQ ID NO: 634796 - DNA, 13 bp, D. melanogaster
gtccagatatgcg

SEQ ID NO: 634797 - DNA, 13 bp, D. melanogaster
gtccagcaccagc

SEQ ID NO: 634798 - DNA, 13 bp, D. melanogaster
gtccagtgtccag

SEQ ID NO: 634799 - DNA, 13 bp, D. melanogaster
gtccagttaaaaa

SEQ ID NO: 634800 - DNA, 13 bp, D. melanogaster
gtccagtttttga

SEQ ID NO: 634801 - DNA, 13 bp, D. melanogaster
gtccatatgaact

SEQ ID NO: 634802 - DNA, 13 bp, D. melanogaster
gtccatcaaagag

SEQ ID NO: 634803 - DNA, 13 bp, D. melanogaster
gtccatctgtccg

SEQ ID NO: 634804 - DNA, 14 bp, D. melanogaster
gtccatctgtccgt

SEQ ID NO: 634805 - DNA, 13 bp, D. melanogaster
gtccatgctgtgg

SEQ ID NO: 634806 - DNA, 13 bp, D. melanogaster
gtccatgtgtgtg

SEQ ID NO: 634807 - DNA, 13 bp, D. melanogaster
gtccattcgaatt

SEQ ID NO: 634808 - DNA, 13 bp, D. melanogaster
gtccatttaatag

SEQ ID NO: 634809 - DNA, 13 bp, D. melanogaster
gtcccaaaaatgt

SEQ ID NO: 634810 - DNA, 14 bp, D. melanogaster
gtcccaaaaatgtg

SEQ ID NO: 634811 - DNA, 14 bp, D. melanogaster
gtcccaaagaaaat

SEQ ID NO: 634812 - DNA, 13 bp, D. melanogaster
gtcccaaattcat

SEQ ID NO: 634813 - DNA, 13 bp, D. melanogaster
gtcccacggccac

SEQ ID NO: 634814 - DNA, 20 bp, D. melanogaster
gtcccagtcccagtcccagt

SEQ ID NO: 634815 - DNA, 13 bp, D. melanogaster
gtcccagtcgcag

SEQ ID NO: 634816 - DNA, 13 bp, D. melanogaster
gtccctctccagc

SEQ ID NO: 634817 - DNA, 13 bp, D. melanogaster
gtccgaatattta

SEQ ID NO: 634818 - DNA, 13 bp, D. melanogaster
gtccgagtccgag

SEQ ID NO: 634819 - DNA, 13 bp, D. melanogaster
gtccgcattcgca

SEQ ID NO: 634820 - DNA, 13 bp, D. melanogaster
gtccgcctgtccg

SEQ ID NO: 634821 - DNA, 13 bp, D. melanogaster
gtccggaaatatg

SEQ ID NO: 634822 - DNA, 13 bp, D. melanogaster
gtccggatttcag

SEQ ID NO: 634823 - DNA, 13 bp, D. melanogaster
gtccgtatgaacg

SEQ ID NO: 634824 - DNA, 14 bp, D. melanogaster
gtccgtatgaacgt

SEQ ID NO: 634825 - DNA, 13 bp, D. melanogaster
gtccgtatgtctg

SEQ ID NO: 634826 - DNA, 13 bp, D. melanogaster
gtccgtccgcctg

SEQ ID NO: 634827 - DNA, 13 bp, D. melanogaster
gtccgtccgtccg

SEQ ID NO: 634828 - DNA, 13 bp, D. melanogaster
gtccgtccgtttg

SEQ ID NO: 634829 - DNA, 14 bp, D. melanogaster
gtccgtctgtccat

SEQ ID NO: 634830 - DNA, 13 bp, D. melanogaster
gtccgtctgtctg

SEQ ID NO: 634831 - DNA, 13 bp, D. melanogaster
gtccgttcgtatg

SEQ ID NO: 634832 - DNA, 13 bp, D. melanogaster
gtcctaaagaaat

SEQ ID NO: 634833 - DNA, 13 bp, D. melanogaster
gtcctcatcccca

SEQ ID NO: 634834 - DNA, 14 bp, D. melanogaster
gtcctccgttttcg

SEQ ID NO: 634835 - DNA, 13 bp, D. melanogaster
gtcctcgccgctc

SEQ ID NO: 634836 - DNA, 13 bp, D. melanogaster
gtcctgaaaagga

SEQ ID NO: 634837 - DNA, 13 bp, D. melanogaster
gtcctgagtcctg

SEQ ID NO: 634838 - DNA, 13 bp, D. melanogaster
gtcctgatgtcct

SEQ ID NO: 634839 - DNA, 13 bp, D. melanogaster
gtcctgcatcctg

SEQ ID NO: 634840 - DNA, 13 bp, D. melanogaster
gtcctgcatgtcc

SEQ ID NO: 634841 - DNA, 13 bp, D. melanogaster
gtcctgccacgcc

SEQ ID NO: 634842 - DNA, 13 bp, D. melanogaster
gtcctgccattca

SEQ ID NO: 634843 - DNA, 14 bp, D. melanogaster
gtcctgccattcag

SEQ ID NO: 634844 - DNA, 13 bp, D. melanogaster
gtcctgcgagtcc

SEQ ID NO: 634845 - DNA, 13 bp, D. melanogaster
gtcctgctcctgc

SEQ ID NO: 634846 - DNA, 13 bp, D. melanogaster
gtcctgctcctgg

SEQ ID NO: 634847 - DNA, 13 bp, D. melanogaster
gtcctggcaggac

SEQ ID NO: 634848 - DNA, 13 bp, D. melanogaster
gtcctggccaagt

SEQ ID NO: 634849 - DNA, 13 bp, D. melanogaster
gtcctggccagga

SEQ ID NO: 634850 - DNA, 13 bp, D. melanogaster
gtcctggccattt

SEQ ID NO: 634851 - DNA, 13 bp, D. melanogaster
gtcctggctgctg

SEQ ID NO: 634852 - DNA, 13 bp, D. melanogaster
gtcctgggtcctg

SEQ ID NO: 634853 - DNA, 13 bp, D. melanogaster
gtcctggtcctgg

SEQ ID NO: 634854 - DNA, 14 bp, D. melanogaster
gtcctgtcctgtcc

SEQ ID NO: 634855 - DNA, 13 bp, D. melanogaster
gtcctgtcgtcct

SEQ ID NO: 634856 - DNA, 13 bp, D. melanogaster
gtcctgtgtcctg

SEQ ID NO: 634857 - DNA, 13 bp, D. melanogaster
gtcctgtgtcctt

SEQ ID NO: 634858 - DNA, 14 bp, D. melanogaster
gtcctgttcgtcct

SEQ ID NO: 634859 - DNA, 13 bp, D. melanogaster
gtcctgttgccga

SEQ ID NO: 634860 - DNA, 13 bp, D. melanogaster
gtccttcatcctt

SEQ ID NO: 634861 - DNA, 13 bp, D. melanogaster
gtccttcgtcctg

SEQ ID NO: 634862 - DNA, 14 bp, D. melanogaster
gtccttcgtcctgc

SEQ ID NO: 634863 - DNA, 13 bp, D. melanogaster
gtccttcgtcctt

SEQ ID NO: 634864 - DNA, 14 bp, D. melanogaster
gtccttcgtccttc

SEQ ID NO: 634865 - DNA, 13 bp, D. melanogaster
gtccttgctcctt

SEQ ID NO: 634866 - DNA, 13 bp, D. melanogaster
gtccttggtcctt

SEQ ID NO: 634867 - DNA, 14 bp, D. melanogaster
gtccttggtccttg

SEQ ID NO: 634868 - DNA, 14 bp, D. melanogaster
gtccttgttgtcct

SEQ ID NO: 634869 - DNA, 13 bp, D. melanogaster
gtcctttggcatt

SEQ ID NO: 634870 - DNA, 13 bp, D. melanogaster
gtcctttggtcct

SEQ ID NO: 634871 - DNA, 13 bp, D. melanogaster
gtcctttgtcctt

SEQ ID NO: 634872 - DNA, 14 bp, D. melanogaster
gtccttttcaggac

SEQ ID NO: 634873 - DNA, 13 bp, D. melanogaster
gtccttttcgtcc

SEQ ID NO: 634874 - DNA, 13 bp, D. melanogaster
gtccttttggcca

SEQ ID NO: 634875 - DNA, 14 bp, D. melanogaster
gtccttttggtcct

SEQ ID NO: 634876 - DNA, 13 bp, D. melanogaster
gtcgaaaaaagct

SEQ ID NO: 634877 - DNA, 13 bp, D. melanogaster
gtcgaaaatgatt

SEQ ID NO: 634878 - DNA, 13 bp, D. melanogaster
gtcgaaaattaaa

SEQ ID NO: 634879 - DNA, 13 bp, D. melanogaster
gtcgaaagttttc

SEQ ID NO: 634880 - DNA, 13 bp, D. melanogaster
gtcgaacgtcaaa

SEQ ID NO: 634881 - DNA, 13 bp, D. melanogaster
gtcgaactggcca

SEQ ID NO: 634882 - DNA, 13 bp, D. melanogaster
gtcgaagagaaat

SEQ ID NO: 634883 - DNA, 13 bp, D. melanogaster
gtcgaaggatatt

SEQ ID NO: 634884 - DNA, 13 bp, D. melanogaster
gtcgaatcgaatc

SEQ ID NO: 634885 - DNA, 13 bp, D. melanogaster
gtcgaattacagc

SEQ ID NO: 634886 - DNA, 13 bp, D. melanogaster
gtcgacagcggca

SEQ ID NO: 634887 - DNA, 13 bp, D. melanogaster
gtcgacatataca

SEQ ID NO: 634888 - DNA, 13 bp, D. melanogaster
gtcgacatatttt

SEQ ID NO: 634889 - DNA, 13 bp, D. melanogaster
gtcgacggcgacg

SEQ ID NO: 634890 - DNA, 13 bp, D. melanogaster
gtcgacggcggcg

SEQ ID NO: 634891 - DNA, 14 bp, D. melanogaster
gtcgacggcggcgc

SEQ ID NO: 634892 - DNA, 13 bp, D. melanogaster
gtcgacgtcgcag

SEQ ID NO: 634893 - DNA, 14 bp, D. melanogaster
gtcgacgtcgctgc

SEQ ID NO: 634894 - DNA, 13 bp, D. melanogaster
gtcgacgtcggcg

SEQ ID NO: 634895 - DNA, 13 bp, D. melanogaster
gtcgacgtcgtcg

SEQ ID NO: 634896 - DNA, 13 bp, D. melanogaster
gtcgactgcgctg

SEQ ID NO: 634897 - DNA, 14 bp, D. melanogaster
gtcgacttccccga

SEQ ID NO: 634898 - DNA, 13 bp, D. melanogaster
gtcgagaaaaaac

SEQ ID NO: 634899 - DNA, 13 bp, D. melanogaster
gtcgagatctcag

SEQ ID NO: 634900 - DNA, 13 bp, D. melanogaster
gtcgagcaaaata

SEQ ID NO: 634901 - DNA, 13 bp, D. melanogaster
gtcgagcggaagg

SEQ ID NO: 634902 - DNA, 13 bp, D. melanogaster
gtcgagtcgagtc

SEQ ID NO: 634903 - DNA, 13 bp, D. melanogaster
gtcgagtgcattt

SEQ ID NO: 634904 - DNA, 13 bp, D. melanogaster
gtcgagtggagtg

SEQ ID NO: 634905 - DNA, 13 bp, D. melanogaster
gtcgagtggcaaa

SEQ ID NO: 634906 - DNA, 13 bp, D. melanogaster
gtcgagttcctcg

SEQ ID NO: 634907 - DNA, 13 bp, D. melanogaster
gtcgagttgagtt

SEQ ID NO: 634908 - DNA, 13 bp, D. melanogaster
gtcgatcatgaat

SEQ ID NO: 634909 - DNA, 13 bp, D. melanogaster
gtcgatgaaacca

SEQ ID NO: 634910 - DNA, 13 bp, D. melanogaster
gtcgatgaaggag

SEQ ID NO: 634911 - DNA, 13 bp, D. melanogaster
gtcgatgatgatg

SEQ ID NO: 634912 - DNA, 13 bp, D. melanogaster
gtcgatggcgatg

SEQ ID NO: 634913 - DNA, 14 bp, D. melanogaster
gtcgatggtcgatg

SEQ ID NO: 634914 - DNA, 13 bp, D. melanogaster
gtcgatgtcgatg

SEQ ID NO: 634915 - DNA, 13 bp, D. melanogaster
gtcgatgtttttt

SEQ ID NO: 634916 - DNA, 13 bp, D. melanogaster
gtcgattttggaa

SEQ ID NO: 634917 - DNA, 13 bp, D. melanogaster
gtcgcaaaaaaaa

SEQ ID NO: 634918 - DNA, 13 bp, D. melanogaster
gtcgcaaaagcaa

SEQ ID NO: 634919 - DNA, 13 bp, D. melanogaster
gtcgcaactggcg

SEQ ID NO: 634920 - DNA, 14 bp, D. melanogaster
gtcgcacacacaca

SEQ ID NO: 634921 - DNA, 13 bp, D. melanogaster
gtcgcagaatcag

SEQ ID NO: 634922 - DNA, 14 bp, D. melanogaster
gtcgcagtcgcagc

SEQ ID NO: 634923 - DNA, 13 bp, D. melanogaster
gtcgcattcctta

SEQ ID NO: 634924 - DNA, 13 bp, D. melanogaster
gtcgcatttttta

SEQ ID NO: 634925 - DNA, 13 bp, D. melanogaster
gtcgccattttgt

SEQ ID NO: 634926 - DNA, 13 bp, D. melanogaster
gtcgcccatgccg

SEQ ID NO: 634927 - DNA, 13 bp, D. melanogaster
gtcgccgattata

SEQ ID NO: 634928 - DNA, 13 bp, D. melanogaster
gtcgccgtcgccg

SEQ ID NO: 634929 - DNA, 13 bp, D. melanogaster
gtcgccgtcgctg

SEQ ID NO: 634930 - DNA, 13 bp, D. melanogaster
gtcgccgtcgtcg

SEQ ID NO: 634931 - DNA, 13 bp, D. melanogaster
gtcgccttttacg

SEQ ID NO: 634932 - DNA, 13 bp, D. melanogaster
gtcgcgcatgcgc

SEQ ID NO: 634933 - DNA, 13 bp, D. melanogaster
gtcgctgccagcg

SEQ ID NO: 634934 - DNA, 13 bp, D. melanogaster
gtcgctgccgacg

SEQ ID NO: 634935 - DNA, 13 bp, D. melanogaster
gtcgctgccgcag

SEQ ID NO: 634936 - DNA, 13 bp, D. melanogaster
gtcgctgccgctg

SEQ ID NO: 634937 - DNA, 14 bp, D. melanogaster
gtcgctgccgctgc

SEQ ID NO: 634938 - DNA, 14 bp, D. melanogaster
gtcgctgctgctgc

SEQ ID NO: 634939 - DNA, 15 bp, D. melanogaster
gtcgctgctgctgct

SEQ ID NO: 634940 - DNA, 13 bp, D. melanogaster
gtcgctggctttt

SEQ ID NO: 634941 - DNA, 14 bp, D. melanogaster
gtcgctggtggggc

SEQ ID NO: 634942 - DNA, 13 bp, D. melanogaster
gtcgctgtcgccg

SEQ ID NO: 634943 - DNA, 13 bp, D. melanogaster
gtcgcttcatctt

SEQ ID NO: 634944 - DNA, 13 bp, D. melanogaster
gtcggaaaaatcg

SEQ ID NO: 634945 - DNA, 13 bp, D. melanogaster
gtcggaaaagctt

SEQ ID NO: 634946 - DNA, 13 bp, D. melanogaster
gtcggaaacgctt

SEQ ID NO: 634947 - DNA, 13 bp, D. melanogaster
gtcggaaatcgaa

SEQ ID NO: 634948 - DNA, 13 bp, D. melanogaster
gtcggatcagcag

SEQ ID NO: 634949 - DNA, 14 bp, D. melanogaster
gtcggatgatgatg

SEQ ID NO: 634950 - DNA, 14 bp, D. melanogaster
gtcggcagcttaaa

SEQ ID NO: 634951 - DNA, 13 bp, D. melanogaster
gtcggccattttg

SEQ ID NO: 634952 - DNA, 13 bp, D. melanogaster
gtcggcgatcgaa

SEQ ID NO: 634953 - DNA, 13 bp, D. melanogaster
gtcggcgtcgctg

SEQ ID NO: 634954 - DNA, 13 bp, D. melanogaster
gtcgggaaactcg

SEQ ID NO: 634955 - DNA, 13 bp, D. melanogaster
gtcgggattcatt

SEQ ID NO: 634956 - DNA, 13 bp, D. melanogaster
gtcggggtcacca

SEQ ID NO: 634957 - DNA, 13 bp, D. melanogaster
gtcggtcggtcgg

SEQ ID NO: 634958 - DNA, 14 bp, D. melanogaster
gtcggtcggtcggt

SEQ ID NO: 634959 - DNA, 13 bp, D. melanogaster
gtcggtcggttgg

SEQ ID NO: 634960 - DNA, 14 bp, D. melanogaster
gtcggtcggttggt

SEQ ID NO: 634961 - DNA, 13 bp, D. melanogaster
gtcggtgggcgaa

SEQ ID NO: 634962 - DNA, 13 bp, D. melanogaster
gtcggttataatt

SEQ ID NO: 634963 - DNA, 13 bp, D. melanogaster
gtcgtaatcgata

SEQ ID NO: 634964 - DNA, 13 bp, D. melanogaster
gtcgtaattaaaa

SEQ ID NO: 634965 - DNA, 13 bp, D. melanogaster
gtcgtagtcgtag

SEQ ID NO: 634966 - DNA, 14 bp, D. melanogaster
gtcgtatacgtaat

SEQ ID NO: 634967 - DNA, 13 bp, D. melanogaster
gtcgtatacttaa

SEQ ID NO: 634968 - DNA, 14 bp, D. melanogaster
gtcgtcatcatcat

SEQ ID NO: 634969 - DNA, 13 bp, D. melanogaster
gtcgtcatcgtca

SEQ ID NO: 634970 - DNA, 14 bp, D. melanogaster
gtcgtcatcgtcat

SEQ ID NO: 634971 - DNA, 13 bp, D. melanogaster
gtcgtccaacgct

SEQ ID NO: 634972 - DNA, 13 bp, D. melanogaster
gtcgtcggcagcg

SEQ ID NO: 634973 - DNA, 14 bp, D. melanogaster
gtcgtcgtcatcat

SEQ ID NO: 634974 - DNA, 14 bp, D. melanogaster
gtcgtcgtcatcgc

SEQ ID NO: 634975 - DNA, 13 bp, D. melanogaster
gtcgtcgtcgatg

SEQ ID NO: 634976 - DNA, 13 bp, D. melanogaster
gtcgtcgtcgcag

SEQ ID NO: 634977 - DNA, 14 bp, D. melanogaster
gtcgtcgtcgccgt

SEQ ID NO: 634978 - DNA, 13 bp, D. melanogaster
gtcgtcgtcgctg

SEQ ID NO: 634979 - DNA, 13 bp, D. melanogaster
gtcgtcgtcgtcg

SEQ ID NO: 634980 - DNA, 14 bp, D. melanogaster
gtcgtcgtcgtcgc

SEQ ID NO: 634981 - DNA, 14 bp, D. melanogaster
gtcgtcgtcgtcgg

SEQ ID NO: 634982 - DNA, 13 bp, D. melanogaster
gtcgtcgtcgtct

SEQ ID NO: 634983 - DNA, 13 bp, D. melanogaster
gtcgtcgttgtcg

SEQ ID NO: 634984 - DNA, 14 bp, D. melanogaster
gtcgtcgttgtcgt

SEQ ID NO: 634985 - DNA, 13 bp, D. melanogaster
gtcgtcgttgttg

SEQ ID NO: 634986 - DNA, 14 bp, D. melanogaster
gtcgtggagatctc

SEQ ID NO: 634987 - DNA, 13 bp, D. melanogaster
gtcgtggtaaagg

SEQ ID NO: 634988 - DNA, 13 bp, D. melanogaster
gtcgtggtcgtgg

SEQ ID NO: 634989 - DNA, 13 bp, D. melanogaster
gtcgtggtgctgg

SEQ ID NO: 634990 - DNA, 13 bp, D. melanogaster
gtcgtgtgcgtgg

SEQ ID NO: 634991 - DNA, 13 bp, D. melanogaster
gtcgttgaaccat

SEQ ID NO: 634992 - DNA, 13 bp, D. melanogaster
gtcgttgcggatg

SEQ ID NO: 634993 - DNA, 13 bp, D. melanogaster
gtcgttgtcgctg

SEQ ID NO: 634994 - DNA, 14 bp, D. melanogaster
gtcgttgtcgtcgt

SEQ ID NO: 634995 - DNA, 13 bp, D. melanogaster
gtcgttgtcgttg

SEQ ID NO: 634996 - DNA, 14 bp, D. melanogaster
gtcgttgtcgttgt

SEQ ID NO: 634997 - DNA, 13 bp, D. melanogaster
gtcgttgttgctg

SEQ ID NO: 634998 - DNA, 13 bp, D. melanogaster
gtcgttgttgtcg

SEQ ID NO: 634999 - DNA, 14 bp, D. melanogaster
gtcgttgttgttgc

SEQ ID NO: 635000 - DNA, 13 bp, D. melanogaster
gtctaaaaataat

SEQ ID NO: 635001 - DNA, 13 bp, D. melanogaster
gtctaaaaatatg

SEQ ID NO: 635002 - DNA, 13 bp, D. melanogaster
gtctaaaaatatt

SEQ ID NO: 635003 - DNA, 14 bp, D. melanogaster
gtctaaaagtatgc

SEQ ID NO: 635004 - DNA, 13 bp, D. melanogaster
gtctaaactaata

SEQ ID NO: 635005 - DNA, 13 bp, D. melanogaster
gtctaacatattt

SEQ ID NO: 635006 - DNA, 13 bp, D. melanogaster
gtctaatagatca

SEQ ID NO: 635007 - DNA, 13 bp, D. melanogaster
gtctaattgaaaa

SEQ ID NO: 635008 - DNA, 14 bp, D. melanogaster
gtctacaacgaggt

SEQ ID NO: 635009 - DNA, 13 bp, D. melanogaster
gtctaccaatttg

SEQ ID NO: 635010 - DNA, 14 bp, D. melanogaster
gtctaccaatttga

SEQ ID NO: 635011 - DNA, 14 bp, D. melanogaster
gtctactgcccacc

SEQ ID NO: 635012 - DNA, 13 bp, D. melanogaster
gtctagaaaaatg

SEQ ID NO: 635013 - DNA, 14 bp, D. melanogaster
gtctagatctagaa

SEQ ID NO: 635014 - DNA, 14 bp, D. melanogaster
gtctagttgcaatt

SEQ ID NO: 635015 - DNA, 13 bp, D. melanogaster
gtctataaatata

SEQ ID NO: 635016 - DNA, 13 bp, D. melanogaster
gtctatatataaa

SEQ ID NO: 635017 - DNA, 13 bp, D. melanogaster
gtctatatatatg

SEQ ID NO: 635018 - DNA, 13 bp, D. melanogaster
gtctatatatttt

SEQ ID NO: 635019 - DNA, 13 bp, D. melanogaster
gtctatggggaaa

SEQ ID NO: 635020 - DNA, 13 bp, D. melanogaster
gtctatggtctgt

SEQ ID NO: 635021 - DNA, 13 bp, D. melanogaster
gtctatgtagtca

SEQ ID NO: 635022 - DNA, 13 bp, D. melanogaster
gtctatttggtat

SEQ ID NO: 635023 - DNA, 13 bp, D. melanogaster
gtctatttgttgg

SEQ ID NO: 635024 - DNA, 13 bp, D. melanogaster
gtctatttttata

SEQ ID NO: 635025 - DNA, 13 bp, D. melanogaster
gtctcagtctcag

SEQ ID NO: 635026 - DNA, 13 bp, D. melanogaster
gtctcccgcactg

SEQ ID NO: 635027 - DNA, 13 bp, D. melanogaster
gtctcgaaatcaa

SEQ ID NO: 635028 - DNA, 13 bp, D. melanogaster
gtctcgaacggac

SEQ ID NO: 635029 - DNA, 13 bp, D. melanogaster
gtctcgatctcag

SEQ ID NO: 635030 - DNA, 13 bp, D. melanogaster
gtctcgctcgcac

SEQ ID NO: 635031 - DNA, 13 bp, D. melanogaster
gtctctgtcgctc

SEQ ID NO: 635032 - DNA, 13 bp, D. melanogaster
gtctctgtgtgtg

SEQ ID NO: 635033 - DNA, 14 bp, D. melanogaster
gtctcttgttttta

SEQ ID NO: 635034 - DNA, 13 bp, D. melanogaster
gtctctttcgctc

SEQ ID NO: 635035 - DNA, 13 bp, D. melanogaster
gtctgaagtttga

SEQ ID NO: 635036 - DNA, 13 bp, D. melanogaster
gtctgaatataat

SEQ ID NO: 635037 - DNA, 15 bp, D. melanogaster
gtctgaatatggaat

SEQ ID NO: 635038 - DNA, 13 bp, D. melanogaster
gtctgaatctgaa

SEQ ID NO: 635039 - DNA, 13 bp, D. melanogaster
gtctgagtctgag

SEQ ID NO: 635040 - DNA, 13 bp, D. melanogaster
gtctgagtctggg

SEQ ID NO: 635041 - DNA, 13 bp, D. melanogaster
gtctgatggccag

SEQ ID NO: 635042 - DNA, 13 bp, D. melanogaster
gtctgcaaaatcg

SEQ ID NO: 635043 - DNA, 13 bp, D. melanogaster
gtctgcaatgtac

SEQ ID NO: 635044 - DNA, 13 bp, D. melanogaster
gtctgcattttgg

SEQ ID NO: 635045 - DNA, 13 bp, D. melanogaster
gtctgcctgctct

SEQ ID NO: 635046 - DNA, 13 bp, D. melanogaster
gtctgcctttaat

SEQ ID NO: 635047 - DNA, 13 bp, D. melanogaster
gtctgcggctttc

SEQ ID NO: 635048 - DNA, 13 bp, D. melanogaster
gtctgcgtgtgtg

SEQ ID NO: 635049 - DNA, 13 bp, D. melanogaster
gtctgcgtttggg

SEQ ID NO: 635050 - DNA, 13 bp, D. melanogaster
gtctgctccaatg

SEQ ID NO: 635051 - DNA, 13 bp, D. melanogaster
gtctgctgctggc

SEQ ID NO: 635052 - DNA, 13 bp, D. melanogaster
gtctgctgctgtt

SEQ ID NO: 635053 - DNA, 13 bp, D. melanogaster
gtctgctgtctgc

SEQ ID NO: 635054 - DNA, 13 bp, D. melanogaster
gtctgctttcggg

SEQ ID NO: 635055 - DNA, 13 bp, D. melanogaster
gtctggaaagctg

SEQ ID NO: 635056 - DNA, 13 bp, D. melanogaster
gtctggcaacgcc

SEQ ID NO: 635057 - DNA, 13 bp, D. melanogaster
gtctggcgatttt

SEQ ID NO: 635058 - DNA, 13 bp, D. melanogaster
gtctggtctggtc

SEQ ID NO: 635059 - DNA, 14 bp, D. melanogaster
gtctggtctggtct

SEQ ID NO: 635060 - DNA, 14 bp, D. melanogaster
gtctgtccgtccgt

SEQ ID NO: 635061 - DNA, 13 bp, D. melanogaster
gtctgtctccgtt

SEQ ID NO: 635062 - DNA, 13 bp, D. melanogaster
gtctgtctgactg

SEQ ID NO: 635063 - DNA, 13 bp, D. melanogaster
gtctgtctgtccg

SEQ ID NO: 635064 - DNA, 13 bp, D. melanogaster
gtctgtctgtctg

SEQ ID NO: 635065 - DNA, 13 bp, D. melanogaster
gtctgtctttggc

SEQ ID NO: 635066 - DNA, 13 bp, D. melanogaster
gtctgtgggccta

SEQ ID NO: 635067 - DNA, 13 bp, D. melanogaster
gtctgtgtctgtg

SEQ ID NO: 635068 - DNA, 13 bp, D. melanogaster
gtctgtgtgagtg

SEQ ID NO: 635069 - DNA, 13 bp, D. melanogaster
gtctgtgtgtgca

SEQ ID NO: 635070 - DNA, 13 bp, D. melanogaster
gtctgtttgccat

SEQ ID NO: 635071 - DNA, 13 bp, D. melanogaster
gtctgtttgtctg

SEQ ID NO: 635072 - DNA, 13 bp, D. melanogaster
gtcttagataata

SEQ ID NO: 635073 - DNA, 13 bp, D. melanogaster
gtcttcaatgtca

SEQ ID NO: 635074 - DNA, 14 bp, D. melanogaster
gtcttcacaaaaga

SEQ ID NO: 635075 - DNA, 13 bp, D. melanogaster
gtcttcagcggcg

SEQ ID NO: 635076 - DNA, 13 bp, D. melanogaster
gtcttcagtcttc

SEQ ID NO: 635077 - DNA, 14 bp, D. melanogaster
gtcttcatcactac

SEQ ID NO: 635078 - DNA, 13 bp, D. melanogaster
gtcttcattcaaa

SEQ ID NO: 635079 - DNA, 14 bp, D. melanogaster
gtcttccaaaaata

SEQ ID NO: 635080 - DNA, 13 bp, D. melanogaster
gtcttcggtcttc

SEQ ID NO: 635081 - DNA, 13 bp, D. melanogaster
gtcttctaaacaa

SEQ ID NO: 635082 - DNA, 13 bp, D. melanogaster
gtcttctcatttg

SEQ ID NO: 635083 - DNA, 13 bp, D. melanogaster
gtcttctgtcttc

SEQ ID NO: 635084 - DNA, 13 bp, D. melanogaster
gtcttcttccagt

SEQ ID NO: 635085 - DNA, 13 bp, D. melanogaster
gtcttgccaattt

SEQ ID NO: 635086 - DNA, 13 bp, D. melanogaster
gtcttggccaaat

SEQ ID NO: 635087 - DNA, 13 bp, D. melanogaster
gtcttggtcttgg

SEQ ID NO: 635088 - DNA, 13 bp, D. melanogaster
gtctttaaaatat

SEQ ID NO: 635089 - DNA, 14 bp, D. melanogaster
gtctttaaatatat

SEQ ID NO: 635090 - DNA, 14 bp, D. melanogaster
gtctttaagctgcc

SEQ ID NO: 635091 - DNA, 13 bp, D. melanogaster
gtctttgcagaaa

SEQ ID NO: 635092 - DNA, 14 bp, D. melanogaster
gtctttggtccagt

SEQ ID NO: 635093 - DNA, 13 bp, D. melanogaster
gtcttttaatatg

SEQ ID NO: 635094 - DNA, 13 bp, D. melanogaster
gtcttttggccaa

SEQ ID NO: 635095 - DNA, 13 bp, D. melanogaster
gtcttttggccag

SEQ ID NO: 635096 - DNA, 13 bp, D. melanogaster
gtgaaaaaatcaa

SEQ ID NO: 635097 - DNA, 13 bp, D. melanogaster
gtgaaaaaatgtg

SEQ ID NO: 635098 - DNA, 13 bp, D. melanogaster
gtgaaaaactgaa

SEQ ID NO: 635099 - DNA, 13 bp, D. melanogaster
gtgaaaaatatat

SEQ ID NO: 635100 - DNA, 13 bp, D. melanogaster
gtgaaaaatcaat

SEQ ID NO: 635101 - DNA, 13 bp, D. melanogaster
gtgaaaaatggaa

SEQ ID NO: 635102 - DNA, 13 bp, D. melanogaster
gtgaaaaattatt

SEQ ID NO: 635103 - DNA, 13 bp, D. melanogaster
gtgaaaaatttgt

SEQ ID NO: 635104 - DNA, 13 bp, D. melanogaster
gtgaaaactattt

SEQ ID NO: 635105 - DNA, 13 bp, D. melanogaster
gtgaaaagaaatt

SEQ ID NO: 635106 - DNA, 13 bp, D. melanogaster
gtgaaaagcaaat

SEQ ID NO: 635107 - DNA, 13 bp, D. melanogaster
gtgaaaagcgaaa

SEQ ID NO: 635108 - DNA, 13 bp, D. melanogaster
gtgaaaagtgaaa

SEQ ID NO: 635109 - DNA, 13 bp, D. melanogaster
gtgaaaagtgtaa

SEQ ID NO: 635110 - DNA, 13 bp, D. melanogaster
gtgaaaagttttg

SEQ ID NO: 635111 - DNA, 13 bp, D. melanogaster
gtgaaaataaaca

SEQ ID NO: 635112 - DNA, 13 bp, D. melanogaster
gtgaaaataaatt

SEQ ID NO: 635113 - DNA, 13 bp, D. melanogaster
gtgaaaataatga

SEQ ID NO: 635114 - DNA, 13 bp, D. melanogaster
gtgaaaataattg

SEQ ID NO: 635115 - DNA, 13 bp, D. melanogaster
gtgaaaatatata

SEQ ID NO: 635116 - DNA, 13 bp, D. melanogaster
gtgaaaatattaa

SEQ ID NO: 635117 - DNA, 14 bp, D. melanogaster
gtgaaaatatttat

SEQ ID NO: 635118 - DNA, 13 bp, D. melanogaster
gtgaaaatatttc

SEQ ID NO: 635119 - DNA, 13 bp, D. melanogaster
gtgaaaatgaatt

SEQ ID NO: 635120 - DNA, 13 bp, D. melanogaster
gtgaaaatgtgaa

SEQ ID NO: 635121 - DNA, 13 bp, D. melanogaster
gtgaaaatttaat

SEQ ID NO: 635122 - DNA, 13 bp, D. melanogaster
gtgaaaatttcat

SEQ ID NO: 635123 - DNA, 13 bp, D. melanogaster
gtgaaaatttcga

SEQ ID NO: 635124 - DNA, 13 bp, D. melanogaster
gtgaaaatttcta

SEQ ID NO: 635125 - DNA, 13 bp, D. melanogaster
gtgaaaattttca

SEQ ID NO: 635126 - DNA, 13 bp, D. melanogaster
gtgaaacatttgt

SEQ ID NO: 635127 - DNA, 13 bp, D. melanogaster
gtgaaaccaccaa

SEQ ID NO: 635128 - DNA, 13 bp, D. melanogaster
gtgaaacggaaat

SEQ ID NO: 635129 - DNA, 15 bp, D. melanogaster
gtgaaactatttctc

SEQ ID NO: 635130 - DNA, 13 bp, D. melanogaster
gtgaaactgataa

SEQ ID NO: 635131 - DNA, 13 bp, D. melanogaster
gtgaaactgatgg

SEQ ID NO: 635132 - DNA, 13 bp, D. melanogaster
gtgaaagacaaaa

SEQ ID NO: 635133 - DNA, 13 bp, D. melanogaster
gtgaaagcgaaaa

SEQ ID NO: 635134 - DNA, 14 bp, D. melanogaster
gtgaaaggtgaaag

SEQ ID NO: 635135 - DNA, 13 bp, D. melanogaster
gtgaaagtaataa

SEQ ID NO: 635136 - DNA, 14 bp, D. melanogaster
gtgaaagtgaaagt

SEQ ID NO: 635137 - DNA, 13 bp, D. melanogaster
gtgaaagtgaaat

SEQ ID NO: 635138 - DNA, 13 bp, D. melanogaster
gtgaaagttttcc

SEQ ID NO: 635139 - DNA, 13 bp, D. melanogaster
gtgaaagtttttt

SEQ ID NO: 635140 - DNA, 13 bp, D. melanogaster
gtgaaataaaact

SEQ ID NO: 635141 - DNA, 13 bp, D. melanogaster
gtgaaatacttca

SEQ ID NO: 635142 - DNA, 13 bp, D. melanogaster
gtgaaatatattt

SEQ ID NO: 635143 - DNA, 13 bp, D. melanogaster
gtgaaatatttaa

SEQ ID NO: 635144 - DNA, 13 bp, D. melanogaster
gtgaaatattttg

SEQ ID NO: 635145 - DNA, 13 bp, D. melanogaster
gtgaaatcaattt

SEQ ID NO: 635146 - DNA, 13 bp, D. melanogaster
gtgaaatcatttc

SEQ ID NO: 635147 - DNA, 13 bp, D. melanogaster
gtgaaattatgaa

SEQ ID NO: 635148 - DNA, 13 bp, D. melanogaster
gtgaaattcaaat

SEQ ID NO: 635149 - DNA, 13 bp, D. melanogaster
gtgaaatttaaat

SEQ ID NO: 635150 - DNA, 13 bp, D. melanogaster
gtgaaatttacat

SEQ ID NO: 635151 - DNA, 13 bp, D. melanogaster
gtgaaatttcata

SEQ ID NO: 635152 - DNA, 13 bp, D. melanogaster
gtgaaattttatt

SEQ ID NO: 635153 - DNA, 13 bp, D. melanogaster
gtgaacaaaaaac

SEQ ID NO: 635154 - DNA, 13 bp, D. melanogaster
gtgaacaaatctt

SEQ ID NO: 635155 - DNA, 13 bp, D. melanogaster
gtgaacaagacga

SEQ ID NO: 635156 - DNA, 13 bp, D. melanogaster
gtgaacaatgcct

SEQ ID NO: 635157 - DNA, 13 bp, D. melanogaster
gtgaacgtgaact

SEQ ID NO: 635158 - DNA, 15 bp, D. melanogaster
gtgaacgtgaacttt

SEQ ID NO: 635159 - DNA, 13 bp, D. melanogaster
gtgaactttagtg

SEQ ID NO: 635160 - DNA, 13 bp, D. melanogaster
gtgaagaaagcat

SEQ ID NO: 635161 - DNA, 13 bp, D. melanogaster
gtgaagaaatgca

SEQ ID NO: 635162 - DNA, 13 bp, D. melanogaster
gtgaagattatga

SEQ ID NO: 635163 - DNA, 18 bp, D. melanogaster
gtgaagggcatattttgt

SEQ ID NO: 635164 - DNA, 13 bp, D. melanogaster
gtgaagtgaagtg

SEQ ID NO: 635165 - DNA, 13 bp, D. melanogaster
gtgaagtggagtg

SEQ ID NO: 635166 - DNA, 13 bp, D. melanogaster
gtgaagttgaaac

SEQ ID NO: 635167 - DNA, 14 bp, D. melanogaster
gtgaagttttaaca

SEQ ID NO: 635168 - DNA, 13 bp, D. melanogaster
gtgaatagaaaat

SEQ ID NO: 635169 - DNA, 13 bp, D. melanogaster
gtgaatatatatg

SEQ ID NO: 635170 - DNA, 13 bp, D. melanogaster
gtgaatatattta

SEQ ID NO: 635171 - DNA, 13 bp, D. melanogaster
gtgaatctcctgc

SEQ ID NO: 635172 - DNA, 13 bp, D. melanogaster
gtgaatgaaaaac

SEQ ID NO: 635173 - DNA, 13 bp, D. melanogaster
gtgaatgaaatga

SEQ ID NO: 635174 - DNA, 14 bp, D. melanogaster
gtgaatgcgaatgc

SEQ ID NO: 635175 - DNA, 13 bp, D. melanogaster
gtgaatggtgaat

SEQ ID NO: 635176 - DNA, 13 bp, D. melanogaster
gtgaatgtgaatg

SEQ ID NO: 635177 - DNA, 13 bp, D. melanogaster
gtgaatgtgagtg

SEQ ID NO: 635178 - DNA, 14 bp, D. melanogaster
gtgaatgtgtgtgt

SEQ ID NO: 635179 - DNA, 13 bp, D. melanogaster
gtgaattgcattt

SEQ ID NO: 635180 - DNA, 13 bp, D. melanogaster
gtgaattgtgaat

SEQ ID NO: 635181 - DNA, 13 bp, D. melanogaster
gtgaattgttggc

SEQ ID NO: 635182 - DNA, 13 bp, D. melanogaster
gtgaatttattgc

SEQ ID NO: 635183 - DNA, 13 bp, D. melanogaster
gtgaatttgttta

SEQ ID NO: 635184 - DNA, 13 bp, D. melanogaster
gtgacaaaaagtt

SEQ ID NO: 635185 - DNA, 14 bp, D. melanogaster
gtgacaaattcgaa

SEQ ID NO: 635186 - DNA, 13 bp, D. melanogaster
gtgacaacaacaa

SEQ ID NO: 635187 - DNA, 13 bp, D. melanogaster
gtgacaattgtgt

SEQ ID NO: 635188 - DNA, 13 bp, D. melanogaster
gtgacactttgtc

SEQ ID NO: 635189 - DNA, 13 bp, D. melanogaster
gtgacagttttgt

SEQ ID NO: 635190 - DNA, 13 bp, D. melanogaster
gtgacatcagcag

SEQ ID NO: 635191 - DNA, 13 bp, D. melanogaster
gtgacattgcaat

SEQ ID NO: 635192 - DNA, 13 bp, D. melanogaster
gtgacatttttcc

SEQ ID NO: 635193 - DNA, 13 bp, D. melanogaster
gtgaccatcgcca

SEQ ID NO: 635194 - DNA, 13 bp, D. melanogaster
gtgaccatgttgc

SEQ ID NO: 635195 - DNA, 13 bp, D. melanogaster
gtgacccaaataa

SEQ ID NO: 635196 - DNA, 13 bp, D. melanogaster
gtgaccggtttgg

SEQ ID NO: 635197 - DNA, 14 bp, D. melanogaster
gtgacgaagcgcac

SEQ ID NO: 635198 - DNA, 13 bp, D. melanogaster
gtgacgccggaga

SEQ ID NO: 635199 - DNA, 15 bp, D. melanogaster
gtgacggccaaaatt

SEQ ID NO: 635200 - DNA, 13 bp, D. melanogaster
gtgacggcgtcgc

SEQ ID NO: 635201 - DNA, 13 bp, D. melanogaster
gtgacgtatttgg

SEQ ID NO: 635202 - DNA, 13 bp, D. melanogaster
gtgacttcatgca

SEQ ID NO: 635203 - DNA, 13 bp, D. melanogaster
gtgacttccggcg

SEQ ID NO: 635204 - DNA, 13 bp, D. melanogaster
gtgacttttgttt

SEQ ID NO: 635205 - DNA, 13 bp, D. melanogaster
gtgagaaaaacac

SEQ ID NO: 635206 - DNA, 13 bp, D. melanogaster
gtgagaaaattaa

SEQ ID NO: 635207 - DNA, 13 bp, D. melanogaster
gtgagaaatcaaa

SEQ ID NO: 635208 - DNA, 13 bp, D. melanogaster
gtgagaatgatga

SEQ ID NO: 635209 - DNA, 13 bp, D. melanogaster
gtgagagcgagag

SEQ ID NO: 635210 - DNA, 13 bp, D. melanogaster
gtgagagtgtgtg

SEQ ID NO: 635211 - DNA, 14 bp, D. melanogaster
gtgagataagcaca

SEQ ID NO: 635212 - DNA, 13 bp, D. melanogaster
gtgagcaaaaaaa

SEQ ID NO: 635213 - DNA, 13 bp, D. melanogaster
gtgagccataaaa

SEQ ID NO: 635214 - DNA, 13 bp, D. melanogaster
gtgagcgagacgg

SEQ ID NO: 635215 - DNA, 13 bp, D. melanogaster
gtgagcgagaggg

SEQ ID NO: 635216 - DNA, 14 bp, D. melanogaster
gtgagcgagcggaa

SEQ ID NO: 635217 - DNA, 13 bp, D. melanogaster
gtgagcggcaaat

SEQ ID NO: 635218 - DNA, 13 bp, D. melanogaster
gtgagctctccaa

SEQ ID NO: 635219 - DNA, 13 bp, D. melanogaster
gtgagtaaataaa

SEQ ID NO: 635220 - DNA, 13 bp, D. melanogaster
gtgagtgagagtg

SEQ ID NO: 635221 - DNA, 13 bp, D. melanogaster
gtgagtgagtgaa

SEQ ID NO: 635222 - DNA, 14 bp, D. melanogaster
gtgagtgagtgaat

SEQ ID NO: 635223 - DNA, 13 bp, D. melanogaster
gtgagtgagtgac

SEQ ID NO: 635224 - DNA, 13 bp, D. melanogaster
gtgagtgagtgct

SEQ ID NO: 635225 - DNA, 13 bp, D. melanogaster
gtgagtgatctga

SEQ ID NO: 635226 - DNA, 13 bp, D. melanogaster
gtgagtgcgagtg

SEQ ID NO: 635227 - DNA, 13 bp, D. melanogaster
gtgagtgcgtgcg

SEQ ID NO: 635228 - DNA, 13 bp, D. melanogaster
gtgagtggacgca

SEQ ID NO: 635229 - DNA, 13 bp, D. melanogaster
gtgagtgtgagtg

SEQ ID NO: 635230 - DNA, 13 bp, D. melanogaster
gtgagtgtgcgtg

SEQ ID NO: 635231 - DNA, 14 bp, D. melanogaster
gtgagtgtgcgtgt

SEQ ID NO: 635232 - DNA, 14 bp, D. melanogaster
gtgagtgtgtgcga

SEQ ID NO: 635233 - DNA, 13 bp, D. melanogaster
gtgagtgtgtgct

SEQ ID NO: 635234 - DNA, 16 bp, D. melanogaster
gtgagtgtgtgtgcgt

SEQ ID NO: 635235 - DNA, 13 bp, D. melanogaster
gtgagttggactt

SEQ ID NO: 635236 - DNA, 13 bp, D. melanogaster
gtgatacaaattg

SEQ ID NO: 635237 - DNA, 13 bp, D. melanogaster
gtgatacgaaaaa

SEQ ID NO: 635238 - DNA, 14 bp, D. melanogaster
gtgatacgaaaaaa

SEQ ID NO: 635239 - DNA, 13 bp, D. melanogaster
gtgatattttcga

SEQ ID NO: 635240 - DNA, 13 bp, D. melanogaster
gtgatcaaagtct

SEQ ID NO: 635241 - DNA, 13 bp, D. melanogaster
gtgatcagtagat

SEQ ID NO: 635242 - DNA, 13 bp, D. melanogaster
gtgatcatctcgc

SEQ ID NO: 635243 - DNA, 13 bp, D. melanogaster
gtgatgaaggcaa

SEQ ID NO: 635244 - DNA, 13 bp, D. melanogaster
gtgatgatcagcg

SEQ ID NO: 635245 - DNA, 13 bp, D. melanogaster
gtgatgatgatga

SEQ ID NO: 635246 - DNA, 13 bp, D. melanogaster
gtgatgatgatgg

SEQ ID NO: 635247 - DNA, 13 bp, D. melanogaster
gtgatggaataat

SEQ ID NO: 635248 - DNA, 13 bp, D. melanogaster
gtgatggacaact

SEQ ID NO: 635249 - DNA, 13 bp, D. melanogaster
gtgatggcaaatc

SEQ ID NO: 635250 - DNA, 13 bp, D. melanogaster
gtgatggtgatga

SEQ ID NO: 635251 - DNA, 13 bp, D. melanogaster
gtgatggtgatgg

SEQ ID NO: 635252 - DNA, 13 bp, D. melanogaster
gtgatgttcaaag

SEQ ID NO: 635253 - DNA, 13 bp, D. melanogaster
gtgatgttgctgc

SEQ ID NO: 635254 - DNA, 14 bp, D. melanogaster
gtgattacaatgcc

SEQ ID NO: 635255 - DNA, 13 bp, D. melanogaster
gtgattccaaaga

SEQ ID NO: 635256 - DNA, 13 bp, D. melanogaster
gtgattgaaaaat

SEQ ID NO: 635257 - DNA, 13 bp, D. melanogaster
gtgattgaagtat

SEQ ID NO: 635258 - DNA, 13 bp, D. melanogaster
gtgattgtgattg

SEQ ID NO: 635259 - DNA, 13 bp, D. melanogaster
gtgattgtgttaa

SEQ ID NO: 635260 - DNA, 13 bp, D. melanogaster
gtgatttaaaaat

SEQ ID NO: 635261 - DNA, 14 bp, D. melanogaster
gtgatttattgccc

SEQ ID NO: 635262 - DNA, 13 bp, D. melanogaster
gtgatttatttaa

SEQ ID NO: 635263 - DNA, 13 bp, D. melanogaster
gtgatttcatatt

SEQ ID NO: 635264 - DNA, 13 bp, D. melanogaster
gtgatttgcataa

SEQ ID NO: 635265 - DNA, 13 bp, D. melanogaster
gtgatttgcattt

SEQ ID NO: 635266 - DNA, 13 bp, D. melanogaster
gtgatttggaatt

SEQ ID NO: 635267 - DNA, 13 bp, D. melanogaster
gtgattttcaatt

SEQ ID NO: 635268 - DNA, 13 bp, D. melanogaster
gtgattttctttg

SEQ ID NO: 635269 - DNA, 14 bp, D. melanogaster
gtgattttctttgg

SEQ ID NO: 635270 - DNA, 14 bp, D. melanogaster
gtgatttttgtata

SEQ ID NO: 635271 - DNA, 13 bp, D. melanogaster
gtgcaaaaaaaat

SEQ ID NO: 635272 - DNA, 13 bp, D. melanogaster
gtgcaaaaaactt

SEQ ID NO: 635273 - DNA, 13 bp, D. melanogaster
gtgcaaaaaataa

SEQ ID NO: 635274 - DNA, 14 bp, D. melanogaster
gtgcaaaaaataaa

SEQ ID NO: 635275 - DNA, 13 bp, D. melanogaster
gtgcaaaaacaaa

SEQ ID NO: 635276 - DNA, 13 bp, D. melanogaster
gtgcaaaaagaaa

SEQ ID NO: 635277 - DNA, 13 bp, D. melanogaster
gtgcaaaaagtat

SEQ ID NO: 635278 - DNA, 13 bp, D. melanogaster
gtgcaaaaagttg

SEQ ID NO: 635279 - DNA, 13 bp, D. melanogaster
gtgcaaaaattta

SEQ ID NO: 635280 - DNA, 13 bp, D. melanogaster
gtgcaaaacaaaa

SEQ ID NO: 635281 - DNA, 14 bp, D. melanogaster
gtgcaaaaggagct

SEQ ID NO: 635282 - DNA, 13 bp, D. melanogaster
gtgcaaaagtgcc

SEQ ID NO: 635283 - DNA, 14 bp, D. melanogaster
gtgcaaaagtgcct

SEQ ID NO: 635284 - DNA, 13 bp, D. melanogaster
gtgcaaaagtttt

SEQ ID NO: 635285 - DNA, 13 bp, D. melanogaster
gtgcaaaataatt

SEQ ID NO: 635286 - DNA, 13 bp, D. melanogaster
gtgcaaaatattt

SEQ ID NO: 635287 - DNA, 13 bp, D. melanogaster
gtgcaaaatgctt

SEQ ID NO: 635288 - DNA, 13 bp, D. melanogaster
gtgcaaaattatt

SEQ ID NO: 635289 - DNA, 13 bp, D. melanogaster
gtgcaaacaacaa

SEQ ID NO: 635290 - DNA, 13 bp, D. melanogaster
gtgcaaacaattc

SEQ ID NO: 635291 - DNA, 13 bp, D. melanogaster
gtgcaaacaattt

SEQ ID NO: 635292 - DNA, 13 bp, D. melanogaster
gtgcaaacacaca

SEQ ID NO: 635293 - DNA, 14 bp, D. melanogaster
gtgcaaacacacac

SEQ ID NO: 635294 - DNA, 13 bp, D. melanogaster
gtgcaaacatttt

SEQ ID NO: 635295 - DNA, 13 bp, D. melanogaster
gtgcaaagtgaaa

SEQ ID NO: 635296 - DNA, 13 bp, D. melanogaster
gtgcaaagtgcaa

SEQ ID NO: 635297 - DNA, 13 bp, D. melanogaster
gtgcaaagttttc

SEQ ID NO: 635298 - DNA, 13 bp, D. melanogaster
gtgcaaataaaaa

SEQ ID NO: 635299 - DNA, 13 bp, D. melanogaster
gtgcaaataaata

SEQ ID NO: 635300 - DNA, 13 bp, D. melanogaster
gtgcaaataacaa

SEQ ID NO: 635301 - DNA, 13 bp, D. melanogaster
gtgcaaataattt

SEQ ID NO: 635302 - DNA, 14 bp, D. melanogaster
gtgcaaataatttt

SEQ ID NO: 635303 - DNA, 13 bp, D. melanogaster
gtgcaaatacaaa

SEQ ID NO: 635304 - DNA, 14 bp, D. melanogaster
gtgcaaatatttta

SEQ ID NO: 635305 - DNA, 13 bp, D. melanogaster
gtgcaaatgcaaa

SEQ ID NO: 635306 - DNA, 13 bp, D. melanogaster
gtgcaaatgttta

SEQ ID NO: 635307 - DNA, 13 bp, D. melanogaster
gtgcaaattgaaa

SEQ ID NO: 635308 - DNA, 13 bp, D. melanogaster
gtgcaaattgcag

SEQ ID NO: 635309 - DNA, 13 bp, D. melanogaster
gtgcaaatttatt

SEQ ID NO: 635310 - DNA, 13 bp, D. melanogaster
gtgcaacaaaaag

SEQ ID NO: 635311 - DNA, 13 bp, D. melanogaster
gtgcaacaaagaa

SEQ ID NO: 635312 - DNA, 13 bp, D. melanogaster
gtgcaacaacaat

SEQ ID NO: 635313 - DNA, 13 bp, D. melanogaster
gtgcaacaacttt

SEQ ID NO: 635314 - DNA, 13 bp, D. melanogaster
gtgcaacagttgc

SEQ ID NO: 635315 - DNA, 13 bp, D. melanogaster
gtgcaacataaat

SEQ ID NO: 635316 - DNA, 13 bp, D. melanogaster
gtgcaacatcaga

SEQ ID NO: 635317 - DNA, 13 bp, D. melanogaster
gtgcaacatgttg

SEQ ID NO: 635318 - DNA, 13 bp, D. melanogaster
gtgcaacattttg

SEQ ID NO: 635319 - DNA, 13 bp, D. melanogaster
gtgcaaccaatct

SEQ ID NO: 635320 - DNA, 13 bp, D. melanogaster
gtgcaacgtggcg

SEQ ID NO: 635321 - DNA, 13 bp, D. melanogaster
gtgcaactttttg

SEQ ID NO: 635322 - DNA, 13 bp, D. melanogaster
gtgcaagtgcaaa

SEQ ID NO: 635323 - DNA, 13 bp, D. melanogaster
gtgcaagtgcaat

SEQ ID NO: 635324 - DNA, 13 bp, D. melanogaster
gtgcaataaaaat

SEQ ID NO: 635325 - DNA, 13 bp, D. melanogaster
gtgcaataacaaa

SEQ ID NO: 635326 - DNA, 13 bp, D. melanogaster
gtgcaatatttgt

SEQ ID NO: 635327 - DNA, 13 bp, D. melanogaster
gtgcaatcaaaat

SEQ ID NO: 635328 - DNA, 13 bp, D. melanogaster
gtgcaatgaaatg

SEQ ID NO: 635329 - DNA, 13 bp, D. melanogaster
gtgcaatgacttc

SEQ ID NO: 635330 - DNA, 13 bp, D. melanogaster
gtgcaatggtaat

SEQ ID NO: 635331 - DNA, 13 bp, D. melanogaster
gtgcaattaaatt

SEQ ID NO: 635332 - DNA, 13 bp, D. melanogaster
gtgcaattaatta

SEQ ID NO: 635333 - DNA, 13 bp, D. melanogaster
gtgcaattgtttt

SEQ ID NO: 635334 - DNA, 13 bp, D. melanogaster
gtgcaatttgcag

SEQ ID NO: 635335 - DNA, 13 bp, D. melanogaster
gtgcaattttcac

SEQ ID NO: 635336 - DNA, 13 bp, D. melanogaster
gtgcaatttttat

SEQ ID NO: 635337 - DNA, 14 bp, D. melanogaster
gtgcaatttttttt

SEQ ID NO: 635338 - DNA, 13 bp, D. melanogaster
gtgcacaacaata

SEQ ID NO: 635339 - DNA, 14 bp, D. melanogaster
gtgcacacaaaatt

SEQ ID NO: 635340 - DNA, 13 bp, D. melanogaster
gtgcacacacaca

SEQ ID NO: 635341 - DNA, 13 bp, D. melanogaster
gtgcacacacgca

SEQ ID NO: 635342 - DNA, 13 bp, D. melanogaster
gtgcacacgtatg

SEQ ID NO: 635343 - DNA, 13 bp, D. melanogaster
gtgcacagaaaaa

SEQ ID NO: 635344 - DNA, 13 bp, D. melanogaster
gtgcacagaaaga

SEQ ID NO: 635345 - DNA, 13 bp, D. melanogaster
gtgcacagcgaaa

SEQ ID NO: 635346 - DNA, 14 bp, D. melanogaster
gtgcacaggaaaaa

SEQ ID NO: 635347 - DNA, 13 bp, D. melanogaster
gtgcacagtgggc

SEQ ID NO: 635348 - DNA, 13 bp, D. melanogaster
gtgcacatatata

SEQ ID NO: 635349 - DNA, 13 bp, D. melanogaster
gtgcacctgcaaa

SEQ ID NO: 635350 - DNA, 13 bp, D. melanogaster
gtgcactcagaaa

SEQ ID NO: 635351 - DNA, 13 bp, D. melanogaster
gtgcactcgaaaa

SEQ ID NO: 635352 - DNA, 14 bp, D. melanogaster
gtgcactcgaaaaa

SEQ ID NO: 635353 - DNA, 13 bp, D. melanogaster
gtgcactgaaaaa

SEQ ID NO: 635354 - DNA, 14 bp, D. melanogaster
gtgcactgaaaaaa

SEQ ID NO: 635355 - DNA, 13 bp, D. melanogaster
gtgcactgagaga

SEQ ID NO: 635356 - DNA, 13 bp, D. melanogaster
gtgcactgagcaa

SEQ ID NO: 635357 - DNA, 14 bp, D. melanogaster
gtgcactgcaagaa

SEQ ID NO: 635358 - DNA, 13 bp, D. melanogaster
gtgcactgtgaaa

SEQ ID NO: 635359 - DNA, 14 bp, D. melanogaster
gtgcacttaaaaaa

SEQ ID NO: 635360 - DNA, 13 bp, D. melanogaster
gtgcacttaaatt

SEQ ID NO: 635361 - DNA, 13 bp, D. melanogaster
gtgcacttcgttt

SEQ ID NO: 635362 - DNA, 14 bp, D. melanogaster
gtgcacttcgtttt

SEQ ID NO: 635363 - DNA, 14 bp, D. melanogaster
gtgcacttggaaaa

SEQ ID NO: 635364 - DNA, 13 bp, D. melanogaster
gtgcacttggcca

SEQ ID NO: 635365 - DNA, 13 bp, D. melanogaster
gtgcagaaagttt

SEQ ID NO: 635366 - DNA, 13 bp, D. melanogaster
gtgcagaaatttc

SEQ ID NO: 635367 - DNA, 14 bp, D. melanogaster
gtgcagaaatttcc

SEQ ID NO: 635368 - DNA, 13 bp, D. melanogaster
gtgcagagaaaaa

SEQ ID NO: 635369 - DNA, 13 bp, D. melanogaster
gtgcagatacaaa

SEQ ID NO: 635370 - DNA, 13 bp, D. melanogaster
gtgcagatgaaaa

SEQ ID NO: 635371 - DNA, 13 bp, D. melanogaster
gtgcagatgcagt

SEQ ID NO: 635372 - DNA, 13 bp, D. melanogaster
gtgcagcaacaac

SEQ ID NO: 635373 - DNA, 13 bp, D. melanogaster
gtgcagcaacagc

SEQ ID NO: 635374 - DNA, 13 bp, D. melanogaster
gtgcagcaagctg

SEQ ID NO: 635375 - DNA, 13 bp, D. melanogaster
gtgcagcagcagc

SEQ ID NO: 635376 - DNA, 14 bp, D. melanogaster
gtgcagcagcagca

SEQ ID NO: 635377 - DNA, 13 bp, D. melanogaster
gtgcagcagccac

SEQ ID NO: 635378 - DNA, 13 bp, D. melanogaster
gtgcagcagtacc

SEQ ID NO: 635379 - DNA, 13 bp, D. melanogaster
gtgcagcataaaa

SEQ ID NO: 635380 - DNA, 13 bp, D. melanogaster
gtgcagctaatta

SEQ ID NO: 635381 - DNA, 13 bp, D. melanogaster
gtgcagtgaaaaa

SEQ ID NO: 635382 - DNA, 13 bp, D. melanogaster
gtgcagtgcaaat

SEQ ID NO: 635383 - DNA, 13 bp, D. melanogaster
gtgcagtgcagtg

SEQ ID NO: 635384 - DNA, 13 bp, D. melanogaster
gtgcagtggaaaa

SEQ ID NO: 635385 - DNA, 13 bp, D. melanogaster
gtgcagtttttct

SEQ ID NO: 635386 - DNA, 13 bp, D. melanogaster
gtgcataaaatat

SEQ ID NO: 635387 - DNA, 13 bp, D. melanogaster
gtgcataaacatt

SEQ ID NO: 635388 - DNA, 13 bp, D. melanogaster
gtgcataaataaa

SEQ ID NO: 635389 - DNA, 13 bp, D. melanogaster
gtgcataaattaa

SEQ ID NO: 635390 - DNA, 13 bp, D. melanogaster
gtgcataaattac

SEQ ID NO: 635391 - DNA, 13 bp, D. melanogaster
gtgcatacaacgt

SEQ ID NO: 635392 - DNA, 13 bp, D. melanogaster
gtgcatacataca

SEQ ID NO: 635393 - DNA, 14 bp, D. melanogaster
gtgcatacatacat

SEQ ID NO: 635394 - DNA, 14 bp, D. melanogaster
gtgcatacatatat

SEQ ID NO: 635395 - DNA, 13 bp, D. melanogaster
gtgcatacatatg

SEQ ID NO: 635396 - DNA, 13 bp, D. melanogaster
gtgcatataaatt

SEQ ID NO: 635397 - DNA, 13 bp, D. melanogaster
gtgcatatatcga

SEQ ID NO: 635398 - DNA, 13 bp, D. melanogaster
gtgcatatgtatt

SEQ ID NO: 635399 - DNA, 13 bp, D. melanogaster
gtgcatctgtatc

SEQ ID NO: 635400 - DNA, 13 bp, D. melanogaster
gtgcatctgtgtg

SEQ ID NO: 635401 - DNA, 13 bp, D. melanogaster
gtgcatgaataat

SEQ ID NO: 635402 - DNA, 13 bp, D. melanogaster
gtgcatgcaaaac

SEQ ID NO: 635403 - DNA, 13 bp, D. melanogaster
gtgcatgcaacaa

SEQ ID NO: 635404 - DNA, 13 bp, D. melanogaster
gtgcatgccacct

SEQ ID NO: 635405 - DNA, 13 bp, D. melanogaster
gtgcatgcgtgtg

SEQ ID NO: 635406 - DNA, 13 bp, D. melanogaster
gtgcatggtgcat

SEQ ID NO: 635407 - DNA, 14 bp, D. melanogaster
gtgcatgtgtttat

SEQ ID NO: 635408 - DNA, 14 bp, D. melanogaster
gtgcattattgttg

SEQ ID NO: 635409 - DNA, 13 bp, D. melanogaster
gtgcattgaactg

SEQ ID NO: 635410 - DNA, 13 bp, D. melanogaster
gtgcattgaactt

SEQ ID NO: 635411 - DNA, 13 bp, D. melanogaster
gtgcattgctcaa

SEQ ID NO: 635412 - DNA, 13 bp, D. melanogaster
gtgcatttcgatt

SEQ ID NO: 635413 - DNA, 13 bp, D. melanogaster
gtgcatttgcatt

SEQ ID NO: 635414 - DNA, 13 bp, D. melanogaster
gtgcatttgcgag

SEQ ID NO: 635415 - DNA, 14 bp, D. melanogaster
gtgcatttgtgtgt

SEQ ID NO: 635416 - DNA, 13 bp, D. melanogaster
gtgcattttaatt

SEQ ID NO: 635417 - DNA, 13 bp, D. melanogaster
gtgcattttcaaa

SEQ ID NO: 635418 - DNA, 13 bp, D. melanogaster
gtgcattttgcaa

SEQ ID NO: 635419 - DNA, 14 bp, D. melanogaster
gtgcatttttaatt

SEQ ID NO: 635420 - DNA, 13 bp, D. melanogaster
gtgcatttttctc

SEQ ID NO: 635421 - DNA, 13 bp, D. melanogaster
gtgccaaaaaata

SEQ ID NO: 635422 - DNA, 13 bp, D. melanogaster
gtgccaaaaaatc

SEQ ID NO: 635423 - DNA, 13 bp, D. melanogaster
gtgccaaaaacta

SEQ ID NO: 635424 - DNA, 13 bp, D. melanogaster
gtgccaaaccaat

SEQ ID NO: 635425 - DNA, 13 bp, D. melanogaster
gtgccaaatcaaa

SEQ ID NO: 635426 - DNA, 13 bp, D. melanogaster
gtgccaactcagg

SEQ ID NO: 635427 - DNA, 13 bp, D. melanogaster
gtgccaagtgcaa

SEQ ID NO: 635428 - DNA, 13 bp, D. melanogaster
gtgccaagttcaa

SEQ ID NO: 635429 - DNA, 14 bp, D. melanogaster
gtgccaagttcaaa

SEQ ID NO: 635430 - DNA, 13 bp, D. melanogaster
gtgccaatgtgac

SEQ ID NO: 635431 - DNA, 13 bp, D. melanogaster
gtgccacaaaatg

SEQ ID NO: 635432 - DNA, 13 bp, D. melanogaster
gtgccacaattaa

SEQ ID NO: 635433 - DNA, 13 bp, D. melanogaster
gtgccacacacac

SEQ ID NO: 635434 - DNA, 13 bp, D. melanogaster
gtgccacatctca

SEQ ID NO: 635435 - DNA, 13 bp, D. melanogaster
gtgccaccaaaaa

SEQ ID NO: 635436 - DNA, 13 bp, D. melanogaster
gtgccacccactt

SEQ ID NO: 635437 - DNA, 13 bp, D. melanogaster
gtgccacccccgg

SEQ ID NO: 635438 - DNA, 14 bp, D. melanogaster
gtgccacgcccaca

SEQ ID NO: 635439 - DNA, 14 bp, D. melanogaster
gtgccacgcccact

SEQ ID NO: 635440 - DNA, 13 bp, D. melanogaster
gtgccacgcccca

SEQ ID NO: 635441 - DNA, 13 bp, D. melanogaster
gtgccacgccccc

SEQ ID NO: 635442 - DNA, 14 bp, D. melanogaster
gtgccacgccccca

SEQ ID NO: 635443 - DNA, 14 bp, D. melanogaster
gtgccacgcccccg

SEQ ID NO: 635444 - DNA, 13 bp, D. melanogaster
gtgccacgcccct

SEQ ID NO: 635445 - DNA, 14 bp, D. melanogaster
gtgccacgcccctc

SEQ ID NO: 635446 - DNA, 13 bp, D. melanogaster
gtgccactgagtc

SEQ ID NO: 635447 - DNA, 13 bp, D. melanogaster
gtgccactgccac

SEQ ID NO: 635448 - DNA, 13 bp, D. melanogaster
gtgccactgtgtg

SEQ ID NO: 635449 - DNA, 13 bp, D. melanogaster
gtgccagtgtgtg

SEQ ID NO: 635450 - DNA, 13 bp, D. melanogaster
gtgccatttgcca

SEQ ID NO: 635451 - DNA, 13 bp, D. melanogaster
gtgcccaaattag

SEQ ID NO: 635452 - DNA, 13 bp, D. melanogaster
gtgcccacagttc

SEQ ID NO: 635453 - DNA, 13 bp, D. melanogaster
gtgccccaaaatg

SEQ ID NO: 635454 - DNA, 13 bp, D. melanogaster
gtgccccagtgat

SEQ ID NO: 635455 - DNA, 13 bp, D. melanogaster
gtgccccgcccac

SEQ ID NO: 635456 - DNA, 14 bp, D. melanogaster
gtgccgaaataaat

SEQ ID NO: 635457 - DNA, 13 bp, D. melanogaster
gtgccgagaaccc

SEQ ID NO: 635458 - DNA, 14 bp, D. melanogaster
gtgccgctgggatc

SEQ ID NO: 635459 - DNA, 13 bp, D. melanogaster
gtgccgctgtcaa

SEQ ID NO: 635460 - DNA, 13 bp, D. melanogaster
gtgccggattggg

SEQ ID NO: 635461 - DNA, 13 bp, D. melanogaster
gtgccgtggcttt

SEQ ID NO: 635462 - DNA, 13 bp, D. melanogaster
gtgccgttgccca

SEQ ID NO: 635463 - DNA, 13 bp, D. melanogaster
gtgcctcaagata

SEQ ID NO: 635464 - DNA, 13 bp, D. melanogaster
gtgcctcgttggc

SEQ ID NO: 635465 - DNA, 13 bp, D. melanogaster
gtgcctgcaattt

SEQ ID NO: 635466 - DNA, 13 bp, D. melanogaster
gtgcctgtgaaat

SEQ ID NO: 635467 - DNA, 13 bp, D. melanogaster
gtgcgaaaaaaaa

SEQ ID NO: 635468 - DNA, 13 bp, D. melanogaster
gtgcgaaaagttt

SEQ ID NO: 635469 - DNA, 13 bp, D. melanogaster
gtgcgaaaattgc

SEQ ID NO: 635470 - DNA, 14 bp, D. melanogaster
gtgcgaaagagagg

SEQ ID NO: 635471 - DNA, 13 bp, D. melanogaster
gtgcgacaaattt

SEQ ID NO: 635472 - DNA, 13 bp, D. melanogaster
gtgcgacaccagc

SEQ ID NO: 635473 - DNA, 13 bp, D. melanogaster
gtgcgacagagag

SEQ ID NO: 635474 - DNA, 13 bp, D. melanogaster
gtgcgacctggcc

SEQ ID NO: 635475 - DNA, 13 bp, D. melanogaster
gtgcgactgtgtg

SEQ ID NO: 635476 - DNA, 13 bp, D. melanogaster
gtgcgagagagag

SEQ ID NO: 635477 - DNA, 13 bp, D. melanogaster
gtgcgagcgagac

SEQ ID NO: 635478 - DNA, 14 bp, D. melanogaster
gtgcgagcgagacg

SEQ ID NO: 635479 - DNA, 14 bp, D. melanogaster
gtgcgagcgagaga

SEQ ID NO: 635480 - DNA, 14 bp, D. melanogaster
gtgcgagcgagagc

SEQ ID NO: 635481 - DNA, 14 bp, D. melanogaster
gtgcgagcgagagg

SEQ ID NO: 635482 - DNA, 13 bp, D. melanogaster
gtgcgagcgagat

SEQ ID NO: 635483 - DNA, 14 bp, D. melanogaster
gtgcgagcgagatg

SEQ ID NO: 635484 - DNA, 13 bp, D. melanogaster
gtgcgagcgggac

SEQ ID NO: 635485 - DNA, 14 bp, D. melanogaster
gtgcgagcgggatg

SEQ ID NO: 635486 - DNA, 13 bp, D. melanogaster
gtgcgagggagag

SEQ ID NO: 635487 - DNA, 13 bp, D. melanogaster
gtgcgagtgcgag

SEQ ID NO: 635488 - DNA, 13 bp, D. melanogaster
gtgcgagtgggtg

SEQ ID NO: 635489 - DNA, 13 bp, D. melanogaster
gtgcgagtgtatg

SEQ ID NO: 635490 - DNA, 13 bp, D. melanogaster
gtgcgagtgtgag

SEQ ID NO: 635491 - DNA, 13 bp, D. melanogaster
gtgcgagtgtgtg

SEQ ID NO: 635492 - DNA, 13 bp, D. melanogaster
gtgcgattgtgtg

SEQ ID NO: 635493 - DNA, 13 bp, D. melanogaster
gtgcgcatcaacg

SEQ ID NO: 635494 - DNA, 13 bp, D. melanogaster
gtgcgccagtgtg

SEQ ID NO: 635495 - DNA, 13 bp, D. melanogaster
gtgcgcctgtgtg

SEQ ID NO: 635496 - DNA, 13 bp, D. melanogaster
gtgcgcgagtgtg

SEQ ID NO: 635497 - DNA, 13 bp, D. melanogaster
gtgcggaaaatgc

SEQ ID NO: 635498 - DNA, 13 bp, D. melanogaster
gtgcggaaaatgg

SEQ ID NO: 635499 - DNA, 13 bp, D. melanogaster
gtgcggaaaatgt

SEQ ID NO: 635500 - DNA, 14 bp, D. melanogaster
gtgcggatgcggat

SEQ ID NO: 635501 - DNA, 14 bp, D. melanogaster
gtgcgtatctgtgt

SEQ ID NO: 635502 - DNA, 13 bp, D. melanogaster
gtgcgtatgatta

SEQ ID NO: 635503 - DNA, 13 bp, D. melanogaster
gtgcgtatgcgta

SEQ ID NO: 635504 - DNA, 13 bp, D. melanogaster
gtgcgtatgtgtg

SEQ ID NO: 635505 - DNA, 14 bp, D. melanogaster
gtgcgtatgtgtgt

SEQ ID NO: 635506 - DNA, 13 bp, D. melanogaster
gtgcgtctccttt

SEQ ID NO: 635507 - DNA, 13 bp, D. melanogaster
gtgcgtctgtgtg

SEQ ID NO: 635508 - DNA, 14 bp, D. melanogaster
gtgcgtctgtgtgt

SEQ ID NO: 635509 - DNA, 13 bp, D. melanogaster
gtgcgtgagtgcg

SEQ ID NO: 635510 - DNA, 13 bp, D. melanogaster
gtgcgtgcgcgca

SEQ ID NO: 635511 - DNA, 14 bp, D. melanogaster
gtgcgtgcgtgcgt

SEQ ID NO: 635512 - DNA, 13 bp, D. melanogaster
gtgcgtgcgtgtg

SEQ ID NO: 635513 - DNA, 14 bp, D. melanogaster
gtgcgtgcgtgtgc

SEQ ID NO: 635514 - DNA, 13 bp, D. melanogaster
gtgcgtgctgtta

SEQ ID NO: 635515 - DNA, 15 bp, D. melanogaster
gtgcgtgtgaagctt

SEQ ID NO: 635516 - DNA, 13 bp, D. melanogaster
gtgcgtgtgagtg

SEQ ID NO: 635517 - DNA, 13 bp, D. melanogaster
gtgcgtgtgcgtg

SEQ ID NO: 635518 - DNA, 13 bp, D. melanogaster
gtgcgtgtgcgtt

SEQ ID NO: 635519 - DNA, 13 bp, D. melanogaster
gtgcgtgtgtatt

SEQ ID NO: 635520 - DNA, 13 bp, D. melanogaster
gtgcgtgtgtctc

SEQ ID NO: 635521 - DNA, 13 bp, D. melanogaster
gtgcgtgtgtgcg

SEQ ID NO: 635522 - DNA, 14 bp, D. melanogaster
gtgcgtgtgtgcga

SEQ ID NO: 635523 - DNA, 13 bp, D. melanogaster
gtgcgtgtgtggc

SEQ ID NO: 635524 - DNA, 14 bp, D. melanogaster
gtgcgtgtgtgtaa

SEQ ID NO: 635525 - DNA, 13 bp, D. melanogaster
gtgcgtgtgtgtc

SEQ ID NO: 635526 - DNA, 14 bp, D. melanogaster
gtgcgtgtgtgtct

SEQ ID NO: 635527 - DNA, 13 bp, D. melanogaster
gtgctaacgaaat

SEQ ID NO: 635528 - DNA, 14 bp, D. melanogaster
gtgctagaagacga

SEQ ID NO: 635529 - DNA, 13 bp, D. melanogaster
gtgctatttttgt

SEQ ID NO: 635530 - DNA, 13 bp, D. melanogaster
gtgctcaaatttt

SEQ ID NO: 635531 - DNA, 13 bp, D. melanogaster
gtgctcagtgctc

SEQ ID NO: 635532 - DNA, 13 bp, D. melanogaster
gtgctcatgtctt

SEQ ID NO: 635533 - DNA, 13 bp, D. melanogaster
gtgctcattaaat

SEQ ID NO: 635534 - DNA, 13 bp, D. melanogaster
gtgctcattaatt

SEQ ID NO: 635535 - DNA, 13 bp, D. melanogaster
gtgctccagccac

SEQ ID NO: 635536 - DNA, 13 bp, D. melanogaster
gtgctccatttgc

SEQ ID NO: 635537 - DNA, 13 bp, D. melanogaster
gtgctcctgctcc

SEQ ID NO: 635538 - DNA, 14 bp, D. melanogaster
gtgctcctgctcct

SEQ ID NO: 635539 - DNA, 13 bp, D. melanogaster
gtgctctcctcct

SEQ ID NO: 635540 - DNA, 13 bp, D. melanogaster
gtgctctggtttt

SEQ ID NO: 635541 - DNA, 13 bp, D. melanogaster
gtgctcttctcgc

SEQ ID NO: 635542 - DNA, 14 bp, D. melanogaster
gtgctgaagttggg

SEQ ID NO: 635543 - DNA, 13 bp, D. melanogaster
gtgctgcaaatga

SEQ ID NO: 635544 - DNA, 14 bp, D. melanogaster
gtgctgcaaatgag

SEQ ID NO: 635545 - DNA, 13 bp, D. melanogaster
gtgctgcaaattt

SEQ ID NO: 635546 - DNA, 13 bp, D. melanogaster
gtgctgcataaat

SEQ ID NO: 635547 - DNA, 13 bp, D. melanogaster
gtgctgccaaaaa

SEQ ID NO: 635548 - DNA, 14 bp, D. melanogaster
gtgctgcgtgagct

SEQ ID NO: 635549 - DNA, 13 bp, D. melanogaster
gtgctgctcctgc

SEQ ID NO: 635550 - DNA, 13 bp, D. melanogaster
gtgctgctgattt

SEQ ID NO: 635551 - DNA, 14 bp, D. melanogaster
gtgctgctgctgca

SEQ ID NO: 635552 - DNA, 13 bp, D. melanogaster
gtgctggccaaca

SEQ ID NO: 635553 - DNA, 14 bp, D. melanogaster
gtgctggccataaa

SEQ ID NO: 635554 - DNA, 13 bp, D. melanogaster
gtgctggtgtgcg

SEQ ID NO: 635555 - DNA, 13 bp, D. melanogaster
gtgctgtatttaa

SEQ ID NO: 635556 - DNA, 13 bp, D. melanogaster
gtgctgtgcgtgt

SEQ ID NO: 635557 - DNA, 13 bp, D. melanogaster
gtgctgtgctgtg

SEQ ID NO: 635558 - DNA, 13 bp, D. melanogaster
gtgcttaaaagta

SEQ ID NO: 635559 - DNA, 13 bp, D. melanogaster
gtgcttaaaataa

SEQ ID NO: 635560 - DNA, 13 bp, D. melanogaster
gtgcttaaataaa

SEQ ID NO: 635561 - DNA, 14 bp, D. melanogaster
gtgcttaaatattt

SEQ ID NO: 635562 - DNA, 14 bp, D. melanogaster
gtgcttcaagaagt

SEQ ID NO: 635563 - DNA, 13 bp, D. melanogaster
gtgcttcagctgt

SEQ ID NO: 635564 - DNA, 14 bp, D. melanogaster
gtgcttgcattttt

SEQ ID NO: 635565 - DNA, 13 bp, D. melanogaster
gtgcttttcagaa

SEQ ID NO: 635566 - DNA, 13 bp, D. melanogaster
gtgcttttcccat

SEQ ID NO: 635567 - DNA, 13 bp, D. melanogaster
gtggaaaaaagtg

SEQ ID NO: 635568 - DNA, 14 bp, D. melanogaster
gtggaaaaacaaaa

SEQ ID NO: 635569 - DNA, 13 bp, D. melanogaster
gtggaaaaacaac

SEQ ID NO: 635570 - DNA, 13 bp, D. melanogaster
gtggaaaaaccac

SEQ ID NO: 635571 - DNA, 13 bp, D. melanogaster
gtggaaaaagtgg

SEQ ID NO: 635572 - DNA, 13 bp, D. melanogaster
gtggaaaaagttt

SEQ ID NO: 635573 - DNA, 13 bp, D. melanogaster
gtggaaaaatatg

SEQ ID NO: 635574 - DNA, 13 bp, D. melanogaster
gtggaaaaatcaa

SEQ ID NO: 635575 - DNA, 13 bp, D. melanogaster
gtggaaaaattta

SEQ ID NO: 635576 - DNA, 13 bp, D. melanogaster
gtggaaaacggga

SEQ ID NO: 635577 - DNA, 13 bp, D. melanogaster
gtggaaaagccag

SEQ ID NO: 635578 - DNA, 13 bp, D. melanogaster
gtggaaaagcgag

SEQ ID NO: 635579 - DNA, 14 bp, D. melanogaster
gtggaaaagcggaa

SEQ ID NO: 635580 - DNA, 13 bp, D. melanogaster
gtggaaaagcggg

SEQ ID NO: 635581 - DNA, 13 bp, D. melanogaster
gtggaaaagtgga

SEQ ID NO: 635582 - DNA, 14 bp, D. melanogaster
gtggaaaagtggaa

SEQ ID NO: 635583 - DNA, 13 bp, D. melanogaster
gtggaaaagttta

SEQ ID NO: 635584 - DNA, 13 bp, D. melanogaster
gtggaaaagtttg

SEQ ID NO: 635585 - DNA, 13 bp, D. melanogaster
gtggaaaagtttt

SEQ ID NO: 635586 - DNA, 13 bp, D. melanogaster
gtggaaaataagt

SEQ ID NO: 635587 - DNA, 13 bp, D. melanogaster
gtggaaaataatg

SEQ ID NO: 635588 - DNA, 13 bp, D. melanogaster
gtggaaaatatat

SEQ ID NO: 635589 - DNA, 13 bp, D. melanogaster
gtggaaaatcaag

SEQ ID NO: 635590 - DNA, 13 bp, D. melanogaster
gtggaaaatcgaa

SEQ ID NO: 635591 - DNA, 13 bp, D. melanogaster
gtggaaaatgaaa

SEQ ID NO: 635592 - DNA, 13 bp, D. melanogaster
gtggaaaatgcaa

SEQ ID NO: 635593 - DNA, 13 bp, D. melanogaster
gtggaaaatgcat

SEQ ID NO: 635594 - DNA, 13 bp, D. melanogaster
gtggaaaatggaa

SEQ ID NO: 635595 - DNA, 13 bp, D. melanogaster
gtggaaaatgtaa

SEQ ID NO: 635596 - DNA, 13 bp, D. melanogaster
gtggaaaatgtga

SEQ ID NO: 635597 - DNA, 13 bp, D. melanogaster
gtggaaaattgaa

SEQ ID NO: 635598 - DNA, 13 bp, D. melanogaster
gtggaaaattgtg

SEQ ID NO: 635599 - DNA, 13 bp, D. melanogaster
gtggaaaattttt

SEQ ID NO: 635600 - DNA, 13 bp, D. melanogaster
gtggaaacccttt

SEQ ID NO: 635601 - DNA, 13 bp, D. melanogaster
gtggaaagcaaaa

SEQ ID NO: 635602 - DNA, 13 bp, D. melanogaster
gtggaaagccaaa

SEQ ID NO: 635603 - DNA, 13 bp, D. melanogaster
gtggaaagcgaaa

SEQ ID NO: 635604 - DNA, 13 bp, D. melanogaster
gtggaaagcggaa

SEQ ID NO: 635605 - DNA, 13 bp, D. melanogaster
gtggaaagggggc

SEQ ID NO: 635606 - DNA, 13 bp, D. melanogaster
gtggaaagtgaaa

SEQ ID NO: 635607 - DNA, 14 bp, D. melanogaster
gtggaaagtggaaa

SEQ ID NO: 635608 - DNA, 13 bp, D. melanogaster
gtggaaagtggag

SEQ ID NO: 635609 - DNA, 13 bp, D. melanogaster
gtggaaagtggca

SEQ ID NO: 635610 - DNA, 13 bp, D. melanogaster
gtggaaagtgggc

SEQ ID NO: 635611 - DNA, 13 bp, D. melanogaster
gtggaaatatatt

SEQ ID NO: 635612 - DNA, 13 bp, D. melanogaster
gtggaaatgaaaa

SEQ ID NO: 635613 - DNA, 14 bp, D. melanogaster
gtggaaatgaaaat

SEQ ID NO: 635614 - DNA, 13 bp, D. melanogaster
gtggaaatgaaat

SEQ ID NO: 635615 - DNA, 13 bp, D. melanogaster
gtggaaatgcaaa

SEQ ID NO: 635616 - DNA, 13 bp, D. melanogaster
gtggaaatggaaa

SEQ ID NO: 635617 - DNA, 14 bp, D. melanogaster
gtggaaatggaaaa

SEQ ID NO: 635618 - DNA, 13 bp, D. melanogaster
gtggaaatgtgca

SEQ ID NO: 635619 - DNA, 13 bp, D. melanogaster
gtggaaattcaat

SEQ ID NO: 635620 - DNA, 13 bp, D. melanogaster
gtggaaattgctt

SEQ ID NO: 635621 - DNA, 13 bp, D. melanogaster
gtggaaattgttt

SEQ ID NO: 635622 - DNA, 13 bp, D. melanogaster
gtggaaatttgtc

SEQ ID NO: 635623 - DNA, 13 bp, D. melanogaster
gtggaaatttgtg

SEQ ID NO: 635624 - DNA, 13 bp, D. melanogaster
gtggaaatttgtt

SEQ ID NO: 635625 - DNA, 13 bp, D. melanogaster
gtggaacgcaaat

SEQ ID NO: 635626 - DNA, 13 bp, D. melanogaster
gtggaactccaac

SEQ ID NO: 635627 - DNA, 14 bp, D. melanogaster
gtggaagaaataca

SEQ ID NO: 635628 - DNA, 14 bp, D. melanogaster
gtggaaggaggagc

SEQ ID NO: 635629 - DNA, 13 bp, D. melanogaster
gtggaagtggaaa

SEQ ID NO: 635630 - DNA, 13 bp, D. melanogaster
gtggaagtgggaa

SEQ ID NO: 635631 - DNA, 13 bp, D. melanogaster
gtggaataatttg

SEQ ID NO: 635632 - DNA, 13 bp, D. melanogaster
gtggaatatttca

SEQ ID NO: 635633 - DNA, 13 bp, D. melanogaster
gtggaatgccata

SEQ ID NO: 635634 - DNA, 13 bp, D. melanogaster
gtggaatgccgaa

SEQ ID NO: 635635 - DNA, 13 bp, D. melanogaster
gtggaatggaatg

SEQ ID NO: 635636 - DNA, 13 bp, D. melanogaster
gtggaatggggca

SEQ ID NO: 635637 - DNA, 13 bp, D. melanogaster
gtggaattaaaaa

SEQ ID NO: 635638 - DNA, 13 bp, D. melanogaster
gtggacaaaaagg

SEQ ID NO: 635639 - DNA, 14 bp, D. melanogaster
gtggacaataatta

SEQ ID NO: 635640 - DNA, 13 bp, D. melanogaster
gtggacagatgaa

SEQ ID NO: 635641 - DNA, 13 bp, D. melanogaster
gtggaccttttct

SEQ ID NO: 635642 - DNA, 13 bp, D. melanogaster
gtggacgcacagt

SEQ ID NO: 635643 - DNA, 13 bp, D. melanogaster
gtggacgtggcaa

SEQ ID NO: 635644 - DNA, 14 bp, D. melanogaster
gtggactccaaaca

SEQ ID NO: 635645 - DNA, 13 bp, D. melanogaster
gtggactgtattt

SEQ ID NO: 635646 - DNA, 13 bp, D. melanogaster
gtggacttattac

SEQ ID NO: 635647 - DNA, 14 bp, D. melanogaster
gtggagaaacatcg

SEQ ID NO: 635648 - DNA, 13 bp, D. melanogaster
gtggagaaagtgg

SEQ ID NO: 635649 - DNA, 13 bp, D. melanogaster
gtggagagcgagc

SEQ ID NO: 635650 - DNA, 14 bp, D. melanogaster
gtggagagcgagca

SEQ ID NO: 635651 - DNA, 13 bp, D. melanogaster
gtggagatctcca

SEQ ID NO: 635652 - DNA, 13 bp, D. melanogaster
gtggagcagaaaa

SEQ ID NO: 635653 - DNA, 13 bp, D. melanogaster
gtggagcagcagg

SEQ ID NO: 635654 - DNA, 13 bp, D. melanogaster
gtggagcaggagg

SEQ ID NO: 635655 - DNA, 13 bp, D. melanogaster
gtggagcgaagag

SEQ ID NO: 635656 - DNA, 13 bp, D. melanogaster
gtggagcggagtg

SEQ ID NO: 635657 - DNA, 13 bp, D. melanogaster
gtggagctggagc

SEQ ID NO: 635658 - DNA, 13 bp, D. melanogaster
gtggagctggtgg

SEQ ID NO: 635659 - DNA, 13 bp, D. melanogaster
gtggagctgtgga

SEQ ID NO: 635660 - DNA, 13 bp, D. melanogaster
gtggaggacacag

SEQ ID NO: 635661 - DNA, 14 bp, D. melanogaster
gtggaggagaagcc

SEQ ID NO: 635662 - DNA, 14 bp, D. melanogaster
gtggaggagccgca

SEQ ID NO: 635663 - DNA, 13 bp, D. melanogaster
gtggaggcctggt

SEQ ID NO: 635664 - DNA, 14 bp, D. melanogaster
gtggagtcgagtgg

SEQ ID NO: 635665 - DNA, 13 bp, D. melanogaster
gtggagtgccgaa

SEQ ID NO: 635666 - DNA, 13 bp, D. melanogaster
gtggagtggaagt

SEQ ID NO: 635667 - DNA, 13 bp, D. melanogaster
gtggagtggaatg

SEQ ID NO: 635668 - DNA, 13 bp, D. melanogaster
gtggagtggagta

SEQ ID NO: 635669 - DNA, 13 bp, D. melanogaster
gtggagtggagtt

SEQ ID NO: 635670 - DNA, 14 bp, D. melanogaster
gtggagtgggaaaa

SEQ ID NO: 635671 - DNA, 13 bp, D. melanogaster
gtggataccgtta

SEQ ID NO: 635672 - DNA, 14 bp, D. melanogaster
gtggatatggatat

SEQ ID NO: 635673 - DNA, 13 bp, D. melanogaster
gtggatatttttg

SEQ ID NO: 635674 - DNA, 13 bp, D. melanogaster
gtggatgagcatc

SEQ ID NO: 635675 - DNA, 14 bp, D. melanogaster
gtggatgaggatga

SEQ ID NO: 635676 - DNA, 14 bp, D. melanogaster
gtggatgaggatgt

SEQ ID NO: 635677 - DNA, 13 bp, D. melanogaster
gtggatgatgatg

SEQ ID NO: 635678 - DNA, 13 bp, D. melanogaster
gtggatgcggatg

SEQ ID NO: 635679 - DNA, 13 bp, D. melanogaster
gtggatgtggacg

SEQ ID NO: 635680 - DNA, 14 bp, D. melanogaster
gtggatgtggatgc

SEQ ID NO: 635681 - DNA, 13 bp, D. melanogaster
gtggattcctggc

SEQ ID NO: 635682 - DNA, 13 bp, D. melanogaster
gtggattctgatt

SEQ ID NO: 635683 - DNA, 13 bp, D. melanogaster
gtggatttggatt

SEQ ID NO: 635684 - DNA, 13 bp, D. melanogaster
gtggattttaatt

SEQ ID NO: 635685 - DNA, 13 bp, D. melanogaster
gtggcaaaaaaac

SEQ ID NO: 635686 - DNA, 13 bp, D. melanogaster
gtggcaaaaacaa

SEQ ID NO: 635687 - DNA, 14 bp, D. melanogaster
gtggcaaaaacaaa

SEQ ID NO: 635688 - DNA, 13 bp, D. melanogaster
gtggcaaaaaggg

SEQ ID NO: 635689 - DNA, 14 bp, D. melanogaster
gtggcaaaaaggga

SEQ ID NO: 635690 - DNA, 13 bp, D. melanogaster
gtggcaaaaatgg

SEQ ID NO: 635691 - DNA, 13 bp, D. melanogaster
gtggcaaaagcaa

SEQ ID NO: 635692 - DNA, 13 bp, D. melanogaster
gtggcaaaagcag

SEQ ID NO: 635693 - DNA, 13 bp, D. melanogaster
gtggcaaaagttt

SEQ ID NO: 635694 - DNA, 13 bp, D. melanogaster
gtggcaaaatcaa

SEQ ID NO: 635695 - DNA, 13 bp, D. melanogaster
gtggcaaaggaaa

SEQ ID NO: 635696 - DNA, 13 bp, D. melanogaster
gtggcaaaggggg

SEQ ID NO: 635697 - DNA, 13 bp, D. melanogaster
gtggcaaataaaa

SEQ ID NO: 635698 - DNA, 13 bp, D. melanogaster
gtggcaaatgaaa

SEQ ID NO: 635699 - DNA, 13 bp, D. melanogaster
gtggcaaatggga

SEQ ID NO: 635700 - DNA, 13 bp, D. melanogaster
gtggcaaattgaa

SEQ ID NO: 635701 - DNA, 13 bp, D. melanogaster
gtggcaacaaaaa

SEQ ID NO: 635702 - DNA, 13 bp, D. melanogaster
gtggcaacaaagt

SEQ ID NO: 635703 - DNA, 14 bp, D. melanogaster
gtggcaacaacaat

SEQ ID NO: 635704 - DNA, 13 bp, D. melanogaster
gtggcaacaattg

SEQ ID NO: 635705 - DNA, 14 bp, D. melanogaster
gtggcaactctggc

SEQ ID NO: 635706 - DNA, 13 bp, D. melanogaster
gtggcaagcaaaa

SEQ ID NO: 635707 - DNA, 13 bp, D. melanogaster
gtggcaaggaaat

SEQ ID NO: 635708 - DNA, 13 bp, D. melanogaster
gtggcaagtgcaa

SEQ ID NO: 635709 - DNA, 13 bp, D. melanogaster
gtggcaagtggaa

SEQ ID NO: 635710 - DNA, 13 bp, D. melanogaster
gtggcaagtggca

SEQ ID NO: 635711 - DNA, 14 bp, D. melanogaster
gtggcaagtggcaa

SEQ ID NO: 635712 - DNA, 14 bp, D. melanogaster
gtggcaagtggcag

SEQ ID NO: 635713 - DNA, 13 bp, D. melanogaster
gtggcaagtgggc

SEQ ID NO: 635714 - DNA, 13 bp, D. melanogaster
gtggcaataaaaa

SEQ ID NO: 635715 - DNA, 13 bp, D. melanogaster
gtggcaatggcaa

SEQ ID NO: 635716 - DNA, 13 bp, D. melanogaster
gtggcaatggcag

SEQ ID NO: 635717 - DNA, 13 bp, D. melanogaster
gtggcaatgtggc

SEQ ID NO: 635718 - DNA, 13 bp, D. melanogaster
gtggcaattaaaa

SEQ ID NO: 635719 - DNA, 13 bp, D. melanogaster
gtggcacaaacaa

SEQ ID NO: 635720 - DNA, 13 bp, D. melanogaster
gtggcacaataaa

SEQ ID NO: 635721 - DNA, 13 bp, D. melanogaster
gtggcacacacac

SEQ ID NO: 635722 - DNA, 13 bp, D. melanogaster
gtggcactcgagt

SEQ ID NO: 635723 - DNA, 13 bp, D. melanogaster
gtggcagcaactt

SEQ ID NO: 635724 - DNA, 13 bp, D. melanogaster
gtggcagccaaaa

SEQ ID NO: 635725 - DNA, 13 bp, D. melanogaster
gtggcagccacaa

SEQ ID NO: 635726 - DNA, 13 bp, D. melanogaster
gtggcagccacac

SEQ ID NO: 635727 - DNA, 13 bp, D. melanogaster
gtggcagccagga

SEQ ID NO: 635728 - DNA, 13 bp, D. melanogaster
gtggcagcttggc

SEQ ID NO: 635729 - DNA, 13 bp, D. melanogaster
gtggcaggaaaaa

SEQ ID NO: 635730 - DNA, 13 bp, D. melanogaster
gtggcaggggcag

SEQ ID NO: 635731 - DNA, 13 bp, D. melanogaster
gtggcaggtggca

SEQ ID NO: 635732 - DNA, 13 bp, D. melanogaster
gtggcagtggcaa

SEQ ID NO: 635733 - DNA, 13 bp, D. melanogaster
gtggcagtggcag

SEQ ID NO: 635734 - DNA, 14 bp, D. melanogaster
gtggcagtggcagc

SEQ ID NO: 635735 - DNA, 13 bp, D. melanogaster
gtggcagtggcat

SEQ ID NO: 635736 - DNA, 13 bp, D. melanogaster
gtggcagtgggcg

SEQ ID NO: 635737 - DNA, 13 bp, D. melanogaster
gtggcagtgggtg

SEQ ID NO: 635738 - DNA, 13 bp, D. melanogaster
gtggcagtggtgg

SEQ ID NO: 635739 - DNA, 13 bp, D. melanogaster
gtggcagtgttgc

SEQ ID NO: 635740 - DNA, 14 bp, D. melanogaster
gtggcagttgcagt

SEQ ID NO: 635741 - DNA, 13 bp, D. melanogaster
gtggcagttttgt

SEQ ID NO: 635742 - DNA, 13 bp, D. melanogaster
gtggcatactgct

SEQ ID NO: 635743 - DNA, 13 bp, D. melanogaster
gtggcatcgaagc

SEQ ID NO: 635744 - DNA, 13 bp, D. melanogaster
gtggcatgcaaat

SEQ ID NO: 635745 - DNA, 13 bp, D. melanogaster
gtggcatgcaaca

SEQ ID NO: 635746 - DNA, 13 bp, D. melanogaster
gtggcatgccaca

SEQ ID NO: 635747 - DNA, 13 bp, D. melanogaster
gtggcatgcggca

SEQ ID NO: 635748 - DNA, 13 bp, D. melanogaster
gtggcatggggca

SEQ ID NO: 635749 - DNA, 13 bp, D. melanogaster
gtggcatgtggca

SEQ ID NO: 635750 - DNA, 14 bp, D. melanogaster
gtggcatgtggcat

SEQ ID NO: 635751 - DNA, 13 bp, D. melanogaster
gtggcatgttgca

SEQ ID NO: 635752 - DNA, 13 bp, D. melanogaster
gtggcattatcaa

SEQ ID NO: 635753 - DNA, 13 bp, D. melanogaster
gtggcattcccag

SEQ ID NO: 635754 - DNA, 14 bp, D. melanogaster
gtggcattcccagc

SEQ ID NO: 635755 - DNA, 13 bp, D. melanogaster
gtggcattttgca

SEQ ID NO: 635756 - DNA, 13 bp, D. melanogaster
gtggccaaaaaac

SEQ ID NO: 635757 - DNA, 14 bp, D. melanogaster
gtggccaaaaaact

SEQ ID NO: 635758 - DNA, 13 bp, D. melanogaster
gtggccaaaaagc

SEQ ID NO: 635759 - DNA, 13 bp, D. melanogaster
gtggccaaaagcc

SEQ ID NO: 635760 - DNA, 13 bp, D. melanogaster
gtggccaaaaggg

SEQ ID NO: 635761 - DNA, 13 bp, D. melanogaster
gtggccaaaagtg

SEQ ID NO: 635762 - DNA, 13 bp, D. melanogaster
gtggccaacaaaa

SEQ ID NO: 635763 - DNA, 13 bp, D. melanogaster
gtggccaacaagg

SEQ ID NO: 635764 - DNA, 13 bp, D. melanogaster
gtggccaactgaa

SEQ ID NO: 635765 - DNA, 13 bp, D. melanogaster
gtggccaagtggg

SEQ ID NO: 635766 - DNA, 13 bp, D. melanogaster
gtggccaataaat

SEQ ID NO: 635767 - DNA, 13 bp, D. melanogaster
gtggccacaacaa

SEQ ID NO: 635768 - DNA, 13 bp, D. melanogaster
gtggccacgccca

SEQ ID NO: 635769 - DNA, 14 bp, D. melanogaster
gtggccactggcca

SEQ ID NO: 635770 - DNA, 13 bp, D. melanogaster
gtggccagaaatt

SEQ ID NO: 635771 - DNA, 13 bp, D. melanogaster
gtggccaggaaaa

SEQ ID NO: 635772 - DNA, 14 bp, D. melanogaster
gtggccagtggcca

SEQ ID NO: 635773 - DNA, 13 bp, D. melanogaster
gtggccataaaaa

SEQ ID NO: 635774 - DNA, 13 bp, D. melanogaster
gtggccataacaa

SEQ ID NO: 635775 - DNA, 13 bp, D. melanogaster
gtggccatgcaaa

SEQ ID NO: 635776 - DNA, 13 bp, D. melanogaster
gtggccattatgg

SEQ ID NO: 635777 - DNA, 13 bp, D. melanogaster
gtggcccaaaaca

SEQ ID NO: 635778 - DNA, 13 bp, D. melanogaster
gtggcccaaacta

SEQ ID NO: 635779 - DNA, 13 bp, D. melanogaster
gtggcccataaaa

SEQ ID NO: 635780 - DNA, 13 bp, D. melanogaster
gtggccctgaaaa

SEQ ID NO: 635781 - DNA, 14 bp, D. melanogaster
gtggccctgaaaag

SEQ ID NO: 635782 - DNA, 14 bp, D. melanogaster
gtggccgccggatt

SEQ ID NO: 635783 - DNA, 14 bp, D. melanogaster
gtggcctgcctttt

SEQ ID NO: 635784 - DNA, 13 bp, D. melanogaster
gtggccttcgagt

SEQ ID NO: 635785 - DNA, 13 bp, D. melanogaster
gtggcgaaaaaaa

SEQ ID NO: 635786 - DNA, 13 bp, D. melanogaster
gtggcgaaaataa

SEQ ID NO: 635787 - DNA, 14 bp, D. melanogaster
gtggcgaaaataat

SEQ ID NO: 635788 - DNA, 13 bp, D. melanogaster
gtggcgccatcta

SEQ ID NO: 635789 - DNA, 13 bp, D. melanogaster
gtggcgccatctg

SEQ ID NO: 635790 - DNA, 13 bp, D. melanogaster
gtggcggggaaaa

SEQ ID NO: 635791 - DNA, 13 bp, D. melanogaster
gtggcggtggcag

SEQ ID NO: 635792 - DNA, 13 bp, D. melanogaster
gtggcgtatacgt

SEQ ID NO: 635793 - DNA, 14 bp, D. melanogaster
gtggcgtgatttct

SEQ ID NO: 635794 - DNA, 13 bp, D. melanogaster
gtggctaaaaaat

SEQ ID NO: 635795 - DNA, 13 bp, D. melanogaster
gtggctaatatac

SEQ ID NO: 635796 - DNA, 13 bp, D. melanogaster
gtggctatgtgtg

SEQ ID NO: 635797 - DNA, 15 bp, D. melanogaster
gtggctccaggctct

SEQ ID NO: 635798 - DNA, 13 bp, D. melanogaster
gtggctctctgac

SEQ ID NO: 635799 - DNA, 13 bp, D. melanogaster
gtggctctgtgtg

SEQ ID NO: 635800 - DNA, 13 bp, D. melanogaster
gtggctgagtggc

SEQ ID NO: 635801 - DNA, 13 bp, D. melanogaster
gtggctgccacac

SEQ ID NO: 635802 - DNA, 13 bp, D. melanogaster
gtggctgccactg

SEQ ID NO: 635803 - DNA, 13 bp, D. melanogaster
gtggctgccactt

SEQ ID NO: 635804 - DNA, 13 bp, D. melanogaster
gtggctgctgcac

SEQ ID NO: 635805 - DNA, 13 bp, D. melanogaster
gtggctgctgttg

SEQ ID NO: 635806 - DNA, 13 bp, D. melanogaster
gtggctgctgttt

SEQ ID NO: 635807 - DNA, 13 bp, D. melanogaster
gtggctggagcac

SEQ ID NO: 635808 - DNA, 13 bp, D. melanogaster
gtggctgggaaat

SEQ ID NO: 635809 - DNA, 13 bp, D. melanogaster
gtggctggggcat

SEQ ID NO: 635810 - DNA, 13 bp, D. melanogaster
gtggctggtggct

SEQ ID NO: 635811 - DNA, 13 bp, D. melanogaster
gtggctgtggcag

SEQ ID NO: 635812 - DNA, 13 bp, D. melanogaster
gtggctgtgtgcg

SEQ ID NO: 635813 - DNA, 13 bp, D. melanogaster
gtggctgttgctg

SEQ ID NO: 635814 - DNA, 13 bp, D. melanogaster
gtggctttcactt

SEQ ID NO: 635815 - DNA, 13 bp, D. melanogaster
gtggctttggcca

SEQ ID NO: 635816 - DNA, 13 bp, D. melanogaster
gtggcttttatta

SEQ ID NO: 635817 - DNA, 13 bp, D. melanogaster
gtgggaaaaaatt

SEQ ID NO: 635818 - DNA, 13 bp, D. melanogaster
gtgggaaaatatt

SEQ ID NO: 635819 - DNA, 13 bp, D. melanogaster
gtgggaaaatgtt

SEQ ID NO: 635820 - DNA, 13 bp, D. melanogaster
gtgggaaaattaa

SEQ ID NO: 635821 - DNA, 13 bp, D. melanogaster
gtgggaaatggaa

SEQ ID NO: 635822 - DNA, 13 bp, D. melanogaster
gtgggaatttatc

SEQ ID NO: 635823 - DNA, 13 bp, D. melanogaster
gtgggactcaaag

SEQ ID NO: 635824 - DNA, 13 bp, D. melanogaster
gtgggagcgagac

SEQ ID NO: 635825 - DNA, 13 bp, D. melanogaster
gtgggagcgagag

SEQ ID NO: 635826 - DNA, 13 bp, D. melanogaster
gtgggagtggcaa

SEQ ID NO: 635827 - DNA, 13 bp, D. melanogaster
gtgggagtggcag

SEQ ID NO: 635828 - DNA, 13 bp, D. melanogaster
gtgggatgctgta

SEQ ID NO: 635829 - DNA, 13 bp, D. melanogaster
gtgggcaaacaaa

SEQ ID NO: 635830 - DNA, 13 bp, D. melanogaster
gtgggcaaacgaa

SEQ ID NO: 635831 - DNA, 13 bp, D. melanogaster
gtgggcaaacgat

SEQ ID NO: 635832 - DNA, 14 bp, D. melanogaster
gtgggcaaacgtgg

SEQ ID NO: 635833 - DNA, 13 bp, D. melanogaster
gtgggcaagtggg

SEQ ID NO: 635834 - DNA, 14 bp, D. melanogaster
gtgggcaatcgaaa

SEQ ID NO: 635835 - DNA, 13 bp, D. melanogaster
gtgggcatgggca

SEQ ID NO: 635836 - DNA, 14 bp, D. melanogaster
gtgggcatgtttgt

SEQ ID NO: 635837 - DNA, 13 bp, D. melanogaster
gtgggccaaaagc

SEQ ID NO: 635838 - DNA, 13 bp, D. melanogaster
gtgggccaaaatg

SEQ ID NO: 635839 - DNA, 13 bp, D. melanogaster
gtgggcgaaagtg

SEQ ID NO: 635840 - DNA, 13 bp, D. melanogaster
gtgggcgaagagt

SEQ ID NO: 635841 - DNA, 13 bp, D. melanogaster
gtgggcgagtgtg

SEQ ID NO: 635842 - DNA, 13 bp, D. melanogaster
gtgggcggaaaag

SEQ ID NO: 635843 - DNA, 13 bp, D. melanogaster
gtgggcggaagtg

SEQ ID NO: 635844 - DNA, 13 bp, D. melanogaster
gtgggcggaatgg

SEQ ID NO: 635845 - DNA, 13 bp, D. melanogaster
gtgggcggggcaa

SEQ ID NO: 635846 - DNA, 13 bp, D. melanogaster
gtgggcggggcac

SEQ ID NO: 635847 - DNA, 13 bp, D. melanogaster
gtgggcgtgaccg

SEQ ID NO: 635848 - DNA, 13 bp, D. melanogaster
gtgggcgtgccaa

SEQ ID NO: 635849 - DNA, 13 bp, D. melanogaster
gtgggcgtgccag

SEQ ID NO: 635850 - DNA, 13 bp, D. melanogaster
gtgggcgtgcccc

SEQ ID NO: 635851 - DNA, 13 bp, D. melanogaster
gtgggcgtggaaa

SEQ ID NO: 635852 - DNA, 13 bp, D. melanogaster
gtgggcgtggaag

SEQ ID NO: 635853 - DNA, 13 bp, D. melanogaster
gtgggcgtggcaa

SEQ ID NO: 635854 - DNA, 14 bp, D. melanogaster
gtgggcgtggcaac

SEQ ID NO: 635855 - DNA, 14 bp, D. melanogaster
gtgggcgtggcaag

SEQ ID NO: 635856 - DNA, 14 bp, D. melanogaster
gtgggcgtggcaat

SEQ ID NO: 635857 - DNA, 13 bp, D. melanogaster
gtgggcgtggcac

SEQ ID NO: 635858 - DNA, 14 bp, D. melanogaster
gtgggcgtggcaca

SEQ ID NO: 635859 - DNA, 13 bp, D. melanogaster
gtgggcgtggcag

SEQ ID NO: 635860 - DNA, 14 bp, D. melanogaster
gtgggcgtggcagc

SEQ ID NO: 635861 - DNA, 14 bp, D. melanogaster
gtgggcgtggcagt

SEQ ID NO: 635862 - DNA, 14 bp, D. melanogaster
gtgggcgtggcatg

SEQ ID NO: 635863 - DNA, 13 bp, D. melanogaster
gtgggcgtggcca

SEQ ID NO: 635864 - DNA, 14 bp, D. melanogaster
gtgggcgtggccag

SEQ ID NO: 635865 - DNA, 13 bp, D. melanogaster
gtgggcgtggccc

SEQ ID NO: 635866 - DNA, 14 bp, D. melanogaster
gtgggcgtggccca

SEQ ID NO: 635867 - DNA, 14 bp, D. melanogaster
gtgggcgtggcgca

SEQ ID NO: 635868 - DNA, 14 bp, D. melanogaster
gtgggcgtggctgc

SEQ ID NO: 635869 - DNA, 13 bp, D. melanogaster
gtgggcgtggctt

SEQ ID NO: 635870 - DNA, 13 bp, D. melanogaster
gtgggcgtggtag

SEQ ID NO: 635871 - DNA, 13 bp, D. melanogaster
gtgggcgtggtcc

SEQ ID NO: 635872 - DNA, 14 bp, D. melanogaster
gtgggcgtggtcca

SEQ ID NO: 635873 - DNA, 13 bp, D. melanogaster
gtgggcgtgtcag

SEQ ID NO: 635874 - DNA, 13 bp, D. melanogaster
gtgggcgttagaa

SEQ ID NO: 635875 - DNA, 13 bp, D. melanogaster
gtgggcgttgcaa

SEQ ID NO: 635876 - DNA, 14 bp, D. melanogaster
gtgggctcgccaca

SEQ ID NO: 635877 - DNA, 13 bp, D. melanogaster
gtgggctggaaaa

SEQ ID NO: 635878 - DNA, 13 bp, D. melanogaster
gtggggaaaacaa

SEQ ID NO: 635879 - DNA, 13 bp, D. melanogaster
gtggggaaaagcg

SEQ ID NO: 635880 - DNA, 13 bp, D. melanogaster
gtggggaaatgaa

SEQ ID NO: 635881 - DNA, 13 bp, D. melanogaster
gtggggaatcaat

SEQ ID NO: 635882 - DNA, 13 bp, D. melanogaster
gtggggacatgga

SEQ ID NO: 635883 - DNA, 14 bp, D. melanogaster
gtgggggcgtggca

SEQ ID NO: 635884 - DNA, 13 bp, D. melanogaster
gtggggggaaaat

SEQ ID NO: 635885 - DNA, 13 bp, D. melanogaster
gtggggtgtttac

SEQ ID NO: 635886 - DNA, 13 bp, D. melanogaster
gtgggtatttata

SEQ ID NO: 635887 - DNA, 13 bp, D. melanogaster
gtgggtgaaaaaa

SEQ ID NO: 635888 - DNA, 13 bp, D. melanogaster
gtgggtgaaagtg

SEQ ID NO: 635889 - DNA, 13 bp, D. melanogaster
gtgggtggaaaaa

SEQ ID NO: 635890 - DNA, 14 bp, D. melanogaster
gtgggtggaaaagc

SEQ ID NO: 635891 - DNA, 13 bp, D. melanogaster
gtgggtggaaatg

SEQ ID NO: 635892 - DNA, 13 bp, D. melanogaster
gtgggtggcactg

SEQ ID NO: 635893 - DNA, 14 bp, D. melanogaster
gtgggtggcagtgg

SEQ ID NO: 635894 - DNA, 13 bp, D. melanogaster
gtgggtgggaaaa

SEQ ID NO: 635895 - DNA, 13 bp, D. melanogaster
gtgggtggtgcag

SEQ ID NO: 635896 - DNA, 13 bp, D. melanogaster
gtgggtggtgcca

SEQ ID NO: 635897 - DNA, 14 bp, D. melanogaster
gtgggtggtgtgca

SEQ ID NO: 635898 - DNA, 14 bp, D. melanogaster
gtgggtgtggcagt

SEQ ID NO: 635899 - DNA, 13 bp, D. melanogaster
gtgggttcgcccg

SEQ ID NO: 635900 - DNA, 13 bp, D. melanogaster
gtggtaaaataaa

SEQ ID NO: 635901 - DNA, 13 bp, D. melanogaster
gtggtaaacaaac

SEQ ID NO: 635902 - DNA, 13 bp, D. melanogaster
gtggtaaaggagg

SEQ ID NO: 635903 - DNA, 13 bp, D. melanogaster
gtggtatactcat

SEQ ID NO: 635904 - DNA, 13 bp, D. melanogaster
gtggtcggtggtc

SEQ ID NO: 635905 - DNA, 13 bp, D. melanogaster
gtggtcgtggtcg

SEQ ID NO: 635906 - DNA, 13 bp, D. melanogaster
gtggtgcaggtgg

SEQ ID NO: 635907 - DNA, 13 bp, D. melanogaster
gtggtgcagtggt

SEQ ID NO: 635908 - DNA, 13 bp, D. melanogaster
gtggtggagctgc

SEQ ID NO: 635909 - DNA, 13 bp, D. melanogaster
gtggtggcagtgg

SEQ ID NO: 635910 - DNA, 13 bp, D. melanogaster
gtggtgggcatgt

SEQ ID NO: 635911 - DNA, 13 bp, D. melanogaster
gtggtgggcggaa

SEQ ID NO: 635912 - DNA, 13 bp, D. melanogaster
gtggtggtgaaaa

SEQ ID NO: 635913 - DNA, 13 bp, D. melanogaster
gtggtggtgatga

SEQ ID NO: 635914 - DNA, 13 bp, D. melanogaster
gtggtggtggaaa

SEQ ID NO: 635915 - DNA, 13 bp, D. melanogaster
gtggtggtggctc

SEQ ID NO: 635916 - DNA, 14 bp, D. melanogaster
gtggtggtggtgca

SEQ ID NO: 635917 - DNA, 13 bp, D. melanogaster
gtggtgtggaatg

SEQ ID NO: 635918 - DNA, 13 bp, D. melanogaster
gtggtgttgtgca

SEQ ID NO: 635919 - DNA, 14 bp, D. melanogaster
gtggtgttttatgc

SEQ ID NO: 635920 - DNA, 13 bp, D. melanogaster
gtggttaagcaag

SEQ ID NO: 635921 - DNA, 13 bp, D. melanogaster
gtggttatgcaaa

SEQ ID NO: 635922 - DNA, 13 bp, D. melanogaster
gtggttgaaaaat

SEQ ID NO: 635923 - DNA, 14 bp, D. melanogaster
gtggttgaaaaatc

SEQ ID NO: 635924 - DNA, 13 bp, D. melanogaster
gtggttgttgatc

SEQ ID NO: 635925 - DNA, 13 bp, D. melanogaster
gtggtttttccac

SEQ ID NO: 635926 - DNA, 14 bp, D. melanogaster
gtgtaaaactataa

SEQ ID NO: 635927 - DNA, 14 bp, D. melanogaster
gtgtaaaagttttt

SEQ ID NO: 635928 - DNA, 13 bp, D. melanogaster
gtgtaaaattaat

SEQ ID NO: 635929 - DNA, 13 bp, D. melanogaster
gtgtaaacaaatg

SEQ ID NO: 635930 - DNA, 13 bp, D. melanogaster
gtgtaaacaaatt

SEQ ID NO: 635931 - DNA, 13 bp, D. melanogaster
gtgtaaataatat

SEQ ID NO: 635932 - DNA, 13 bp, D. melanogaster
gtgtaaatataaa

SEQ ID NO: 635933 - DNA, 13 bp, D. melanogaster
gtgtaaatatatt

SEQ ID NO: 635934 - DNA, 13 bp, D. melanogaster
gtgtaaatattat

SEQ ID NO: 635935 - DNA, 14 bp, D. melanogaster
gtgtaaatattatt

SEQ ID NO: 635936 - DNA, 13 bp, D. melanogaster
gtgtaaatatttg

SEQ ID NO: 635937 - DNA, 13 bp, D. melanogaster
gtgtaaatgcaaa

SEQ ID NO: 635938 - DNA, 13 bp, D. melanogaster
gtgtaaatgtatg

SEQ ID NO: 635939 - DNA, 13 bp, D. melanogaster
gtgtaaattgaat

SEQ ID NO: 635940 - DNA, 14 bp, D. melanogaster
gtgtaaattgaata

SEQ ID NO: 635941 - DNA, 13 bp, D. melanogaster
gtgtaaatttgtt

SEQ ID NO: 635942 - DNA, 13 bp, D. melanogaster
gtgtaatattgtt

SEQ ID NO: 635943 - DNA, 13 bp, D. melanogaster
gtgtaatcttatt

SEQ ID NO: 635944 - DNA, 13 bp, D. melanogaster
gtgtaatttataa

SEQ ID NO: 635945 - DNA, 13 bp, D. melanogaster
gtgtaatttgtat

SEQ ID NO: 635946 - DNA, 13 bp, D. melanogaster
gtgtaattttcat

SEQ ID NO: 635947 - DNA, 13 bp, D. melanogaster
gtgtaattttgta

SEQ ID NO: 635948 - DNA, 14 bp, D. melanogaster
gtgtaattttgtat

SEQ ID NO: 635949 - DNA, 13 bp, D. melanogaster
gtgtacaaagaat

SEQ ID NO: 635950 - DNA, 13 bp, D. melanogaster
gtgtacaaatatt

SEQ ID NO: 635951 - DNA, 13 bp, D. melanogaster
gtgtacaatgtat

SEQ ID NO: 635952 - DNA, 14 bp, D. melanogaster
gtgtacaatgtatt

SEQ ID NO: 635953 - DNA, 13 bp, D. melanogaster
gtgtacatataca

SEQ ID NO: 635954 - DNA, 14 bp, D. melanogaster
gtgtacatatgtat

SEQ ID NO: 635955 - DNA, 13 bp, D. melanogaster
gtgtacatcctgt

SEQ ID NO: 635956 - DNA, 13 bp, D. melanogaster
gtgtacattaaat

SEQ ID NO: 635957 - DNA, 13 bp, D. melanogaster
gtgtacattaagc

SEQ ID NO: 635958 - DNA, 13 bp, D. melanogaster
gtgtacgagtata

SEQ ID NO: 635959 - DNA, 13 bp, D. melanogaster
gtgtacgagtgtg

SEQ ID NO: 635960 - DNA, 13 bp, D. melanogaster
gtgtacgtgtgtg

SEQ ID NO: 635961 - DNA, 14 bp, D. melanogaster
gtgtacgtgtgtgt

SEQ ID NO: 635962 - DNA, 14 bp, D. melanogaster
gtgtactggcttaa

SEQ ID NO: 635963 - DNA, 13 bp, D. melanogaster
gtgtagaagggga

SEQ ID NO: 635964 - DNA, 13 bp, D. melanogaster
gtgtagcatactt

SEQ ID NO: 635965 - DNA, 13 bp, D. melanogaster
gtgtataaaatat

SEQ ID NO: 635966 - DNA, 13 bp, D. melanogaster
gtgtataaataaa

SEQ ID NO: 635967 - DNA, 13 bp, D. melanogaster
gtgtataaatatt

SEQ ID NO: 635968 - DNA, 13 bp, D. melanogaster
gtgtataagctta

SEQ ID NO: 635969 - DNA, 13 bp, D. melanogaster
gtgtataatttta

SEQ ID NO: 635970 - DNA, 13 bp, D. melanogaster
gtgtatatagtat

SEQ ID NO: 635971 - DNA, 13 bp, D. melanogaster
gtgtatatataaa

SEQ ID NO: 635972 - DNA, 13 bp, D. melanogaster
gtgtatatatata

SEQ ID NO: 635973 - DNA, 13 bp, D. melanogaster
gtgtatatatgat

SEQ ID NO: 635974 - DNA, 15 bp, D. melanogaster
gtgtatatatgtatg

SEQ ID NO: 635975 - DNA, 13 bp, D. melanogaster
gtgtatatgtatt

SEQ ID NO: 635976 - DNA, 13 bp, D. melanogaster
gtgtatattttaa

SEQ ID NO: 635977 - DNA, 13 bp, D. melanogaster
gtgtatctggatg

SEQ ID NO: 635978 - DNA, 13 bp, D. melanogaster
gtgtatctgtatc

SEQ ID NO: 635979 - DNA, 14 bp, D. melanogaster
gtgtatctgtgtat

SEQ ID NO: 635980 - DNA, 13 bp, D. melanogaster
gtgtatgcaaaaa

SEQ ID NO: 635981 - DNA, 16 bp, D. melanogaster
gtgtatgccgtgaaac

SEQ ID NO: 635982 - DNA, 14 bp, D. melanogaster
gtgtatgcgtgtgt

SEQ ID NO: 635983 - DNA, 13 bp, D. melanogaster
gtgtatggtgtat

SEQ ID NO: 635984 - DNA, 13 bp, D. melanogaster
gtgtatgtaaata

SEQ ID NO: 635985 - DNA, 13 bp, D. melanogaster
gtgtatgtacata

SEQ ID NO: 635986 - DNA, 13 bp, D. melanogaster
gtgtatgtatgtg

SEQ ID NO: 635987 - DNA, 13 bp, D. melanogaster
gtgtatgtggatg

SEQ ID NO: 635988 - DNA, 14 bp, D. melanogaster
gtgtatgtgtgagt

SEQ ID NO: 635989 - DNA, 14 bp, D. melanogaster
gtgtatgtgtgcat

SEQ ID NO: 635990 - DNA, 13 bp, D. melanogaster
gtgtatgtgtgcg

SEQ ID NO: 635991 - DNA, 14 bp, D. melanogaster
gtgtatgtgtgcga

SEQ ID NO: 635992 - DNA, 14 bp, D. melanogaster
gtgtatgtgtgtat

SEQ ID NO: 635993 - DNA, 13 bp, D. melanogaster
gtgtatgtgtgtc

SEQ ID NO: 635994 - DNA, 13 bp, D. melanogaster
gtgtatgttttcg

SEQ ID NO: 635995 - DNA, 13 bp, D. melanogaster
gtgtattaaattt

SEQ ID NO: 635996 - DNA, 13 bp, D. melanogaster
gtgtattcatttg

SEQ ID NO: 635997 - DNA, 13 bp, D. melanogaster
gtgtatttataga

SEQ ID NO: 635998 - DNA, 13 bp, D. melanogaster
gtgtatttattaa

SEQ ID NO: 635999 - DNA, 13 bp, D. melanogaster
gtgtatttgcatt

SEQ ID NO: 636000 - DNA, 13 bp, D. melanogaster
gtgtattttaaat

SEQ ID NO: 636001 - DNA, 13 bp, D. melanogaster
gtgtatttttgga

SEQ ID NO: 636002 - DNA, 13 bp, D. melanogaster
gtgtcaaaaatga

SEQ ID NO: 636003 - DNA, 13 bp, D. melanogaster
gtgtcaactcttt

SEQ ID NO: 636004 - DNA, 14 bp, D. melanogaster
gtgtcaactcttta

SEQ ID NO: 636005 - DNA, 13 bp, D. melanogaster
gtgtcaagtgcag

SEQ ID NO: 636006 - DNA, 13 bp, D. melanogaster
gtgtcagtctgaa

SEQ ID NO: 636007 - DNA, 13 bp, D. melanogaster
gtgtcagttttgg

SEQ ID NO: 636008 - DNA, 13 bp, D. melanogaster
gtgtcataatctt

SEQ ID NO: 636009 - DNA, 13 bp, D. melanogaster
gtgtccatgtcca

SEQ ID NO: 636010 - DNA, 13 bp, D. melanogaster
gtgtccgatgatt

SEQ ID NO: 636011 - DNA, 13 bp, D. melanogaster
gtgtcctgcgtcc

SEQ ID NO: 636012 - DNA, 13 bp, D. melanogaster
gtgtcctggcatt

SEQ ID NO: 636013 - DNA, 13 bp, D. melanogaster
gtgtcctggctgc

SEQ ID NO: 636014 - DNA, 13 bp, D. melanogaster
gtgtcctgtgtcc

SEQ ID NO: 636015 - DNA, 14 bp, D. melanogaster
gtgtccttcgtcct

SEQ ID NO: 636016 - DNA, 13 bp, D. melanogaster
gtgtctaaaaata

SEQ ID NO: 636017 - DNA, 13 bp, D. melanogaster
gtgtctatgtgtg

SEQ ID NO: 636018 - DNA, 13 bp, D. melanogaster
gtgtctccctgaa

SEQ ID NO: 636019 - DNA, 13 bp, D. melanogaster
gtgtctgtatctg

SEQ ID NO: 636020 - DNA, 13 bp, D. melanogaster
gtgtctgtatgtg

SEQ ID NO: 636021 - DNA, 13 bp, D. melanogaster
gtgtctgtccagt

SEQ ID NO: 636022 - DNA, 14 bp, D. melanogaster
gtgtctgtctgtgt

SEQ ID NO: 636023 - DNA, 13 bp, D. melanogaster
gtgtctgtgtaat

SEQ ID NO: 636024 - DNA, 13 bp, D. melanogaster
gtgtctgtgtatg

SEQ ID NO: 636025 - DNA, 13 bp, D. melanogaster
gtgtctgtgtctg

SEQ ID NO: 636026 - DNA, 13 bp, D. melanogaster
gtgtctgtgtgca

SEQ ID NO: 636027 - DNA, 13 bp, D. melanogaster
gtgtctgtgtgtc

SEQ ID NO: 636028 - DNA, 13 bp, D. melanogaster
gtgtgaaaaactt

SEQ ID NO: 636029 - DNA, 13 bp, D. melanogaster
gtgtgaaaaatta

SEQ ID NO: 636030 - DNA, 14 bp, D. melanogaster
gtgtgaaaaattaa

SEQ ID NO: 636031 - DNA, 13 bp, D. melanogaster
gtgtgaaaatcat

SEQ ID NO: 636032 - DNA, 13 bp, D. melanogaster
gtgtgaaaatgaa

SEQ ID NO: 636033 - DNA, 13 bp, D. melanogaster
gtgtgaatgtgaa

SEQ ID NO: 636034 - DNA, 13 bp, D. melanogaster
gtgtgaatgtgtg

SEQ ID NO: 636035 - DNA, 14 bp, D. melanogaster
gtgtgaatgtgtgt

SEQ ID NO: 636036 - DNA, 13 bp, D. melanogaster
gtgtgaccatttt

SEQ ID NO: 636037 - DNA, 14 bp, D. melanogaster
gtgtgagagagaga

SEQ ID NO: 636038 - DNA, 13 bp, D. melanogaster
gtgtgagtatctg

SEQ ID NO: 636039 - DNA, 13 bp, D. melanogaster
gtgtgagtcgagt

SEQ ID NO: 636040 - DNA, 14 bp, D. melanogaster
gtgtgagtcgagtg

SEQ ID NO: 636041 - DNA, 13 bp, D. melanogaster
gtgtgagtgagct

SEQ ID NO: 636042 - DNA, 14 bp, D. melanogaster
gtgtgagtgagtgc

SEQ ID NO: 636043 - DNA, 13 bp, D. melanogaster
gtgtgagtgcaaa

SEQ ID NO: 636044 - DNA, 13 bp, D. melanogaster
gtgtgagtgcgag

SEQ ID NO: 636045 - DNA, 13 bp, D. melanogaster
gtgtgagtgcgct

SEQ ID NO: 636046 - DNA, 13 bp, D. melanogaster
gtgtgagtgcggg

SEQ ID NO: 636047 - DNA, 14 bp, D. melanogaster
gtgtgagtgcgtgt

SEQ ID NO: 636048 - DNA, 15 bp, D. melanogaster
gtgtgagtgtgcgtg

SEQ ID NO: 636049 - DNA, 13 bp, D. melanogaster
gtgtgagtgtgct

SEQ ID NO: 636050 - DNA, 13 bp, D. melanogaster
gtgtgagtgtgga

SEQ ID NO: 636051 - DNA, 15 bp, D. melanogaster
gtgtgagtgtgtatg

SEQ ID NO: 636052 - DNA, 14 bp, D. melanogaster
gtgtgagtgtttgc

SEQ ID NO: 636053 - DNA, 13 bp, D. melanogaster
gtgtgatgggaaa

SEQ ID NO: 636054 - DNA, 13 bp, D. melanogaster
gtgtgatttcttt

SEQ ID NO: 636055 - DNA, 13 bp, D. melanogaster
gtgtgatttttaa

SEQ ID NO: 636056 - DNA, 13 bp, D. melanogaster
gtgtgcaaaaaaa

SEQ ID NO: 636057 - DNA, 13 bp, D. melanogaster
gtgtgcaaaaaat

SEQ ID NO: 636058 - DNA, 13 bp, D. melanogaster
gtgtgcaaaaagt

SEQ ID NO: 636059 - DNA, 13 bp, D. melanogaster
gtgtgcaaatatt

SEQ ID NO: 636060 - DNA, 13 bp, D. melanogaster
gtgtgcaaatttt

SEQ ID NO: 636061 - DNA, 13 bp, D. melanogaster
gtgtgcaagtgtg

SEQ ID NO: 636062 - DNA, 13 bp, D. melanogaster
gtgtgcaattaaa

SEQ ID NO: 636063 - DNA, 13 bp, D. melanogaster
gtgtgcacttcat

SEQ ID NO: 636064 - DNA, 13 bp, D. melanogaster
gtgtgcagtgtgt

SEQ ID NO: 636065 - DNA, 13 bp, D. melanogaster
gtgtgcatatgtg

SEQ ID NO: 636066 - DNA, 14 bp, D. melanogaster
gtgtgcatatgtgt

SEQ ID NO: 636067 - DNA, 13 bp, D. melanogaster
gtgtgcatctgtg

SEQ ID NO: 636068 - DNA, 13 bp, D. melanogaster
gtgtgcatgtgag

SEQ ID NO: 636069 - DNA, 13 bp, D. melanogaster
gtgtgcatgtgta

SEQ ID NO: 636070 - DNA, 13 bp, D. melanogaster
gtgtgcatgtgtg

SEQ ID NO: 636071 - DNA, 13 bp, D. melanogaster
gtgtgccaaaaaa

SEQ ID NO: 636072 - DNA, 13 bp, D. melanogaster
gtgtgccaaaaat

SEQ ID NO: 636073 - DNA, 13 bp, D. melanogaster
gtgtgccacgccc

SEQ ID NO: 636074 - DNA, 13 bp, D. melanogaster
gtgtgccataaat

SEQ ID NO: 636075 - DNA, 13 bp, D. melanogaster
gtgtgccattcat

SEQ ID NO: 636076 - DNA, 14 bp, D. melanogaster
gtgtgcccgcgccg

SEQ ID NO: 636077 - DNA, 13 bp, D. melanogaster
gtgtgcctgtgtg

SEQ ID NO: 636078 - DNA, 14 bp, D. melanogaster
gtgtgcctgtgtgc

SEQ ID NO: 636079 - DNA, 14 bp, D. melanogaster
gtgtgcctgtgttt

SEQ ID NO: 636080 - DNA, 13 bp, D. melanogaster
gtgtgcgagagtg

SEQ ID NO: 636081 - DNA, 13 bp, D. melanogaster
gtgtgcgagcgag

SEQ ID NO: 636082 - DNA, 14 bp, D. melanogaster
gtgtgcgagcgaga

SEQ ID NO: 636083 - DNA, 13 bp, D. melanogaster
gtgtgcgagtgca

SEQ ID NO: 636084 - DNA, 13 bp, D. melanogaster
gtgtgcgagtgcg

SEQ ID NO: 636085 - DNA, 13 bp, D. melanogaster
gtgtgcgagtgtg

SEQ ID NO: 636086 - DNA, 14 bp, D. melanogaster
gtgtgcgagtgtgc

SEQ ID NO: 636087 - DNA, 14 bp, D. melanogaster
gtgtgcgagtgtgg

SEQ ID NO: 636088 - DNA, 13 bp, D. melanogaster
gtgtgcgattttt

SEQ ID NO: 636089 - DNA, 13 bp, D. melanogaster
gtgtgcggaaaat

SEQ ID NO: 636090 - DNA, 13 bp, D. melanogaster
gtgtgcgtatgtg

SEQ ID NO: 636091 - DNA, 13 bp, D. melanogaster
gtgtgcgtgagtg

SEQ ID NO: 636092 - DNA, 14 bp, D. melanogaster
gtgtgcgtgagtgc

SEQ ID NO: 636093 - DNA, 13 bp, D. melanogaster
gtgtgcgtgcgag

SEQ ID NO: 636094 - DNA, 13 bp, D. melanogaster
gtgtgcgtgcgcc

SEQ ID NO: 636095 - DNA, 13 bp, D. melanogaster
gtgtgcgtgcgcg

SEQ ID NO: 636096 - DNA, 13 bp, D. melanogaster
gtgtgcgtgcgtg

SEQ ID NO: 636097 - DNA, 13 bp, D. melanogaster
gtgtgcgtgctgg

SEQ ID NO: 636098 - DNA, 13 bp, D. melanogaster
gtgtgcgtggatt

SEQ ID NO: 636099 - DNA, 13 bp, D. melanogaster
gtgtgcgtgtcct

SEQ ID NO: 636100 - DNA, 13 bp, D. melanogaster
gtgtgcgtgtgaa

SEQ ID NO: 636101 - DNA, 13 bp, D. melanogaster
gtgtgcgtgtgac

SEQ ID NO: 636102 - DNA, 13 bp, D. melanogaster
gtgtgcgtgtgag

SEQ ID NO: 636103 - DNA, 14 bp, D. melanogaster
gtgtgcgtgtgagt

SEQ ID NO: 636104 - DNA, 13 bp, D. melanogaster
gtgtgcgtgtgca

SEQ ID NO: 636105 - DNA, 14 bp, D. melanogaster
gtgtgcgtgtgcat

SEQ ID NO: 636106 - DNA, 14 bp, D. melanogaster
gtgtgcgtgtgcct

SEQ ID NO: 636107 - DNA, 13 bp, D. melanogaster
gtgtgcgtgtgcg

SEQ ID NO: 636108 - DNA, 14 bp, D. melanogaster
gtgtgcgtgtgcgt

SEQ ID NO: 636109 - DNA, 13 bp, D. melanogaster
gtgtgcgtgtgta

SEQ ID NO: 636110 - DNA, 14 bp, D. melanogaster
gtgtgcgtgtgtaa

SEQ ID NO: 636111 - DNA, 14 bp, D. melanogaster
gtgtgcgtgtgtat

SEQ ID NO: 636112 - DNA, 14 bp, D. melanogaster
gtgtgcgtgtgtga

SEQ ID NO: 636113 - DNA, 14 bp, D. melanogaster
gtgtgcgtgtgtgc

SEQ ID NO: 636114 - DNA, 13 bp, D. melanogaster
gtgtgctagtgtg

SEQ ID NO: 636115 - DNA, 13 bp, D. melanogaster
gtgtgctctttga

SEQ ID NO: 636116 - DNA, 13 bp, D. melanogaster
gtgtgctgctgtt

SEQ ID NO: 636117 - DNA, 13 bp, D. melanogaster
gtgtgctgttgaa

SEQ ID NO: 636118 - DNA, 14 bp, D. melanogaster
gtgtgcttgtgtgc

SEQ ID NO: 636119 - DNA, 13 bp, D. melanogaster
gtgtgctttaatt

SEQ ID NO: 636120 - DNA, 13 bp, D. melanogaster
gtgtggaaaaaag

SEQ ID NO: 636121 - DNA, 13 bp, D. melanogaster
gtgtggaaaatgg

SEQ ID NO: 636122 - DNA, 13 bp, D. melanogaster
gtgtggaaaatgt

SEQ ID NO: 636123 - DNA, 13 bp, D. melanogaster
gtgtggaaaattc

SEQ ID NO: 636124 - DNA, 13 bp, D. melanogaster
gtgtggatgtgga

SEQ ID NO: 636125 - DNA, 14 bp, D. melanogaster
gtgtggatgtggat

SEQ ID NO: 636126 - DNA, 13 bp, D. melanogaster
gtgtggcaagtgg

SEQ ID NO: 636127 - DNA, 13 bp, D. melanogaster
gtgtggcaagtgt

SEQ ID NO: 636128 - DNA, 13 bp, D. melanogaster
gtgtggcagccac

SEQ ID NO: 636129 - DNA, 13 bp, D. melanogaster
gtgtggcaggcag

SEQ ID NO: 636130 - DNA, 13 bp, D. melanogaster
gtgtggcagtgtg

SEQ ID NO: 636131 - DNA, 13 bp, D. melanogaster
gtgtggcagtttt

SEQ ID NO: 636132 - DNA, 13 bp, D. melanogaster
gtgtggcatgtgg

SEQ ID NO: 636133 - DNA, 13 bp, D. melanogaster
gtgtggccataaa

SEQ ID NO: 636134 - DNA, 13 bp, D. melanogaster
gtgtggccctagt

SEQ ID NO: 636135 - DNA, 13 bp, D. melanogaster
gtgtggcctcctt

SEQ ID NO: 636136 - DNA, 13 bp, D. melanogaster
gtgtggcgcagtt

SEQ ID NO: 636137 - DNA, 13 bp, D. melanogaster
gtgtggctacttt

SEQ ID NO: 636138 - DNA, 13 bp, D. melanogaster
gtgtgggccaaaa

SEQ ID NO: 636139 - DNA, 13 bp, D. melanogaster
gtgtgggcgagtg

SEQ ID NO: 636140 - DNA, 14 bp, D. melanogaster
gtgtgggcgtggcc

SEQ ID NO: 636141 - DNA, 13 bp, D. melanogaster
gtgtgggcgtgtc

SEQ ID NO: 636142 - DNA, 13 bp, D. melanogaster
gtgtgggtggaaa

SEQ ID NO: 636143 - DNA, 14 bp, D. melanogaster
gtgtgggtggaaaa

SEQ ID NO: 636144 - DNA, 13 bp, D. melanogaster
gtgtgggtgtgca

SEQ ID NO: 636145 - DNA, 13 bp, D. melanogaster
gtgtggtgtacaa

SEQ ID NO: 636146 - DNA, 13 bp, D. melanogaster
gtgtgtaaaaaat

SEQ ID NO: 636147 - DNA, 14 bp, D. melanogaster
gtgtgtaaatattt

SEQ ID NO: 636148 - DNA, 14 bp, D. melanogaster
gtgtgtaaattgaa

SEQ ID NO: 636149 - DNA, 13 bp, D. melanogaster
gtgtgtaaattgt

SEQ ID NO: 636150 - DNA, 13 bp, D. melanogaster
gtgtgtaatttat

SEQ ID NO: 636151 - DNA, 14 bp, D. melanogaster
gtgtgtacatacat

SEQ ID NO: 636152 - DNA, 14 bp, D. melanogaster
gtgtgtacatatat

SEQ ID NO: 636153 - DNA, 13 bp, D. melanogaster
gtgtgtacatatg

SEQ ID NO: 636154 - DNA, 14 bp, D. melanogaster
gtgtgtacatatgt

SEQ ID NO: 636155 - DNA, 13 bp, D. melanogaster
gtgtgtataaaaa

SEQ ID NO: 636156 - DNA, 13 bp, D. melanogaster
gtgtgtatatatg

SEQ ID NO: 636157 - DNA, 13 bp, D. melanogaster
gtgtgtatattta

SEQ ID NO: 636158 - DNA, 13 bp, D. melanogaster
gtgtgtatctgtg

SEQ ID NO: 636159 - DNA, 14 bp, D. melanogaster
gtgtgtatctgtgt

SEQ ID NO: 636160 - DNA, 13 bp, D. melanogaster
gtgtgtatgtaag

SEQ ID NO: 636161 - DNA, 14 bp, D. melanogaster
gtgtgtatgtatat

SEQ ID NO: 636162 - DNA, 13 bp, D. melanogaster
gtgtgtatgtatg

SEQ ID NO: 636163 - DNA, 13 bp, D. melanogaster
gtgtgtatgtgct

SEQ ID NO: 636164 - DNA, 14 bp, D. melanogaster
gtgtgtatgtgtga

SEQ ID NO: 636165 - DNA, 13 bp, D. melanogaster
gtgtgtatttata

SEQ ID NO: 636166 - DNA, 14 bp, D. melanogaster
gtgtgtcagtgtgt

SEQ ID NO: 636167 - DNA, 13 bp, D. melanogaster
gtgtgtccatgtg

SEQ ID NO: 636168 - DNA, 13 bp, D. melanogaster
gtgtgtccgtgtg

SEQ ID NO: 636169 - DNA, 14 bp, D. melanogaster
gtgtgtccgtgtgt

SEQ ID NO: 636170 - DNA, 13 bp, D. melanogaster
gtgtgtctatgtg

SEQ ID NO: 636171 - DNA, 14 bp, D. melanogaster
gtgtgtctatgtgt

SEQ ID NO: 636172 - DNA, 14 bp, D. melanogaster
gtgtgtctgtatgt

SEQ ID NO: 636173 - DNA, 13 bp, D. melanogaster
gtgtgtctgtgcg

SEQ ID NO: 636174 - DNA, 14 bp, D. melanogaster
gtgtgtctgtgtgc

SEQ ID NO: 636175 - DNA, 13 bp, D. melanogaster
gtgtgtgaaaatg

SEQ ID NO: 636176 - DNA, 13 bp, D. melanogaster
gtgtgtgaaagtg

SEQ ID NO: 636177 - DNA, 13 bp, D. melanogaster
gtgtgtgaatgtg

SEQ ID NO: 636178 - DNA, 13 bp, D. melanogaster
gtgtgtgagtgaa

SEQ ID NO: 636179 - DNA, 13 bp, D. melanogaster
gtgtgtgagtgcg

SEQ ID NO: 636180 - DNA, 14 bp, D. melanogaster
gtgtgtgagtgcgc

SEQ ID NO: 636181 - DNA, 14 bp, D. melanogaster
gtgtgtgagtgctt

SEQ ID NO: 636182 - DNA, 13 bp, D. melanogaster
gtgtgtgcaaaag

SEQ ID NO: 636183 - DNA, 13 bp, D. melanogaster
gtgtgtgcaaatg

SEQ ID NO: 636184 - DNA, 13 bp, D. melanogaster
gtgtgtgcaaatt

SEQ ID NO: 636185 - DNA, 13 bp, D. melanogaster
gtgtgtgcaacat

SEQ ID NO: 636186 - DNA, 13 bp, D. melanogaster
gtgtgtgcacttt

SEQ ID NO: 636187 - DNA, 13 bp, D. melanogaster
gtgtgtgcatctg

SEQ ID NO: 636188 - DNA, 13 bp, D. melanogaster
gtgtgtgcatgta

SEQ ID NO: 636189 - DNA, 14 bp, D. melanogaster
gtgtgtgcatgtgg

SEQ ID NO: 636190 - DNA, 14 bp, D. melanogaster
gtgtgtgcatgtgt

SEQ ID NO: 636191 - DNA, 13 bp, D. melanogaster
gtgtgtgccagtg

SEQ ID NO: 636192 - DNA, 13 bp, D. melanogaster
gtgtgtgcctgcg

SEQ ID NO: 636193 - DNA, 13 bp, D. melanogaster
gtgtgtgcgactg

SEQ ID NO: 636194 - DNA, 14 bp, D. melanogaster
gtgtgtgcgagtgt

SEQ ID NO: 636195 - DNA, 14 bp, D. melanogaster
gtgtgtgcgcgagt

SEQ ID NO: 636196 - DNA, 13 bp, D. melanogaster
gtgtgtgcgcttt

SEQ ID NO: 636197 - DNA, 13 bp, D. melanogaster
gtgtgtgcggatg

SEQ ID NO: 636198 - DNA, 13 bp, D. melanogaster
gtgtgtgcggcaa

SEQ ID NO: 636199 - DNA, 13 bp, D. melanogaster
gtgtgtgcgtctg

SEQ ID NO: 636200 - DNA, 13 bp, D. melanogaster
gtgtgtgcgtgcc

SEQ ID NO: 636201 - DNA, 14 bp, D. melanogaster
gtgtgtgcgtgcga

SEQ ID NO: 636202 - DNA, 13 bp, D. melanogaster
gtgtgtgcgtgct

SEQ ID NO: 636203 - DNA, 13 bp, D. melanogaster
gtgtgtgcgtggc

SEQ ID NO: 636204 - DNA, 13 bp, D. melanogaster
gtgtgtgcgtgta

SEQ ID NO: 636205 - DNA, 13 bp, D. melanogaster
gtgtgtgcgtgtc

SEQ ID NO: 636206 - DNA, 14 bp, D. melanogaster
gtgtgtgcgtgtgc

SEQ ID NO: 636207 - DNA, 13 bp, D. melanogaster
gtgtgtgcgttgc

SEQ ID NO: 636208 - DNA, 13 bp, D. melanogaster
gtgtgtgcgttta

SEQ ID NO: 636209 - DNA, 13 bp, D. melanogaster
gtgtgtgctctgc

SEQ ID NO: 636210 - DNA, 13 bp, D. melanogaster
gtgtgtgctgctg

SEQ ID NO: 636211 - DNA, 13 bp, D. melanogaster
gtgtgtgctgctt

SEQ ID NO: 636212 - DNA, 13 bp, D. melanogaster
gtgtgtgctgtgc

SEQ ID NO: 636213 - DNA, 13 bp, D. melanogaster
gtgtgtgctttcg

SEQ ID NO: 636214 - DNA, 13 bp, D. melanogaster
gtgtgtggaaaaa

SEQ ID NO: 636215 - DNA, 13 bp, D. melanogaster
gtgtgtggaaaat

SEQ ID NO: 636216 - DNA, 13 bp, D. melanogaster
gtgtgtggaaatt

SEQ ID NO: 636217 - DNA, 13 bp, D. melanogaster
gtgtgtggaagtg

SEQ ID NO: 636218 - DNA, 13 bp, D. melanogaster
gtgtgtggcaaaa

SEQ ID NO: 636219 - DNA, 13 bp, D. melanogaster
gtgtgtggcagct

SEQ ID NO: 636220 - DNA, 13 bp, D. melanogaster
gtgtgtgggaaat

SEQ ID NO: 636221 - DNA, 14 bp, D. melanogaster
gtgtgtgtatatat

SEQ ID NO: 636222 - DNA, 13 bp, D. melanogaster
gtgtgtgtatatg

SEQ ID NO: 636223 - DNA, 14 bp, D. melanogaster
gtgtgtgtatatgt

SEQ ID NO: 636224 - DNA, 13 bp, D. melanogaster
gtgtgtgtatgag

SEQ ID NO: 636225 - DNA, 13 bp, D. melanogaster
gtgtgtgtatgca

SEQ ID NO: 636226 - DNA, 13 bp, D. melanogaster
gtgtgtgtatgcc

SEQ ID NO: 636227 - DNA, 13 bp, D. melanogaster
gtgtgtgtatgta

SEQ ID NO: 636228 - DNA, 13 bp, D. melanogaster
gtgtgtgtcataa

SEQ ID NO: 636229 - DNA, 14 bp, D. melanogaster
gtgtgtgtccgtgt

SEQ ID NO: 636230 - DNA, 13 bp, D. melanogaster
gtgtgtgtcctgg

SEQ ID NO: 636231 - DNA, 13 bp, D. melanogaster
gtgtgtgtcctgt

SEQ ID NO: 636232 - DNA, 13 bp, D. melanogaster
gtgtgtgtccttt

SEQ ID NO: 636233 - DNA, 14 bp, D. melanogaster
gtgtgtgtctatgt

SEQ ID NO: 636234 - DNA, 13 bp, D. melanogaster
gtgtgtgtctgcg

SEQ ID NO: 636235 - DNA, 14 bp, D. melanogaster
gtgtgtgtctgcgt

SEQ ID NO: 636236 - DNA, 14 bp, D. melanogaster
gtgtgtgtctgtgc

SEQ ID NO: 636237 - DNA, 13 bp, D. melanogaster
gtgtgtgtgaaag

SEQ ID NO: 636238 - DNA, 13 bp, D. melanogaster
gtgtgtgtgaaat

SEQ ID NO: 636239 - DNA, 13 bp, D. melanogaster
gtgtgtgtgaagt

SEQ ID NO: 636240 - DNA, 13 bp, D. melanogaster
gtgtgtgtgaatg

SEQ ID NO: 636241 - DNA, 13 bp, D. melanogaster
gtgtgtgtgactg

SEQ ID NO: 636242 - DNA, 13 bp, D. melanogaster
gtgtgtgtgagaa

SEQ ID NO: 636243 - DNA, 13 bp, D. melanogaster
gtgtgtgtgagcc

SEQ ID NO: 636244 - DNA, 14 bp, D. melanogaster
gtgtgtgtgagcca

SEQ ID NO: 636245 - DNA, 13 bp, D. melanogaster
gtgtgtgtgagta

SEQ ID NO: 636246 - DNA, 13 bp, D. melanogaster
gtgtgtgtgcaac

SEQ ID NO: 636247 - DNA, 14 bp, D. melanogaster
gtgtgtgtgcaaca

SEQ ID NO: 636248 - DNA, 13 bp, D. melanogaster
gtgtgtgtgcaag

SEQ ID NO: 636249 - DNA, 13 bp, D. melanogaster
gtgtgtgtgcaca

SEQ ID NO: 636250 - DNA, 14 bp, D. melanogaster
gtgtgtgtgcactt

SEQ ID NO: 636251 - DNA, 13 bp, D. melanogaster
gtgtgtgtgcaga

SEQ ID NO: 636252 - DNA, 14 bp, D. melanogaster
gtgtgtgtgcagaa

SEQ ID NO: 636253 - DNA, 13 bp, D. melanogaster
gtgtgtgtgcata

SEQ ID NO: 636254 - DNA, 14 bp, D. melanogaster
gtgtgtgtgcattg

SEQ ID NO: 636255 - DNA, 14 bp, D. melanogaster
gtgtgtgtgcattt

SEQ ID NO: 636256 - DNA, 13 bp, D. melanogaster
gtgtgtgtgccaa

SEQ ID NO: 636257 - DNA, 13 bp, D. melanogaster
gtgtgtgtgccat

SEQ ID NO: 636258 - DNA, 13 bp, D. melanogaster
gtgtgtgtgccga

SEQ ID NO: 636259 - DNA, 13 bp, D. melanogaster
gtgtgtgtgccta

SEQ ID NO: 636260 - DNA, 13 bp, D. melanogaster
gtgtgtgtgcgaa

SEQ ID NO: 636261 - DNA, 14 bp, D. melanogaster
gtgtgtgtgcgaaa

SEQ ID NO: 636262 - DNA, 13 bp, D. melanogaster
gtgtgtgtgcgca

SEQ ID NO: 636263 - DNA, 14 bp, D. melanogaster
gtgtgtgtgcgcct

SEQ ID NO: 636264 - DNA, 13 bp, D. melanogaster
gtgtgtgtgcgcg

SEQ ID NO: 636265 - DNA, 15 bp, D. melanogaster
gtgtgtgtgcgcgcg

SEQ ID NO: 636266 - DNA, 14 bp, D. melanogaster
gtgtgtgtgcgctg

SEQ ID NO: 636267 - DNA, 13 bp, D. melanogaster
gtgtgtgtgctag

SEQ ID NO: 636268 - DNA, 13 bp, D. melanogaster
gtgtgtgtgctca

SEQ ID NO: 636269 - DNA, 13 bp, D. melanogaster
gtgtgtgtgctcc

SEQ ID NO: 636270 - DNA, 13 bp, D. melanogaster
gtgtgtgtgctgc

SEQ ID NO: 636271 - DNA, 14 bp, D. melanogaster
gtgtgtgtgctgca

SEQ ID NO: 636272 - DNA, 14 bp, D. melanogaster
gtgtgtgtgctggc

SEQ ID NO: 636273 - DNA, 13 bp, D. melanogaster
gtgtgtgtgcttc

SEQ ID NO: 636274 - DNA, 13 bp, D. melanogaster
gtgtgtgtggaaa

SEQ ID NO: 636275 - DNA, 14 bp, D. melanogaster
gtgtgtgtggaaaa

SEQ ID NO: 636276 - DNA, 13 bp, D. melanogaster
gtgtgtgtggaag

SEQ ID NO: 636277 - DNA, 13 bp, D. melanogaster
gtgtgtgtggata

SEQ ID NO: 636278 - DNA, 14 bp, D. melanogaster
gtgtgtgtggcagg

SEQ ID NO: 636279 - DNA, 14 bp, D. melanogaster
gtgtgtgtgggaaa

SEQ ID NO: 636280 - DNA, 13 bp, D. melanogaster
gtgtgtgtgggca

SEQ ID NO: 636281 - DNA, 13 bp, D. melanogaster
gtgtgtgtgggcc

SEQ ID NO: 636282 - DNA, 14 bp, D. melanogaster
gtgtgtgtgggcca

SEQ ID NO: 636283 - DNA, 14 bp, D. melanogaster
gtgtgtgtgggcga

SEQ ID NO: 636284 - DNA, 14 bp, D. melanogaster
gtgtgtgtgtaaat

SEQ ID NO: 636285 - DNA, 13 bp, D. melanogaster
gtgtgtgtgtaag

SEQ ID NO: 636286 - DNA, 13 bp, D. melanogaster
gtgtgtgtgtaat

SEQ ID NO: 636287 - DNA, 14 bp, D. melanogaster
gtgtgtgtgtaatt

SEQ ID NO: 636288 - DNA, 13 bp, D. melanogaster
gtgtgtgtgtaca

SEQ ID NO: 636289 - DNA, 13 bp, D. melanogaster
gtgtgtgtgtacc

SEQ ID NO: 636290 - DNA, 14 bp, D. melanogaster
gtgtgtgtgtagat

SEQ ID NO: 636291 - DNA, 14 bp, D. melanogaster
gtgtgtgtgtatag

SEQ ID NO: 636292 - DNA, 14 bp, D. melanogaster
gtgtgtgtgtatat

SEQ ID NO: 636293 - DNA, 13 bp, D. melanogaster
gtgtgtgtgtatc

SEQ ID NO: 636294 - DNA, 14 bp, D. melanogaster
gtgtgtgtgtatgc

SEQ ID NO: 636295 - DNA, 14 bp, D. melanogaster
gtgtgtgtgtattc

SEQ ID NO: 636296 - DNA, 14 bp, D. melanogaster
gtgtgtgtgtcagc

SEQ ID NO: 636297 - DNA, 13 bp, D. melanogaster
gtgtgtgtgtcta

SEQ ID NO: 636298 - DNA, 14 bp, D. melanogaster
gtgtgtgtgtgtcc

SEQ ID NO: 636299 - DNA, 14 bp, D. melanogaster
gtgtgtgtgttagc

SEQ ID NO: 636300 - DNA, 14 bp, D. melanogaster
gtgtgtgtgttcga

SEQ ID NO: 636301 - DNA, 13 bp, D. melanogaster
gtgtgtgttagct

SEQ ID NO: 636302 - DNA, 13 bp, D. melanogaster
gtgtgtgttccat

SEQ ID NO: 636303 - DNA, 13 bp, D. melanogaster
gtgtgtgttgcag

SEQ ID NO: 636304 - DNA, 14 bp, D. melanogaster
gtgtgtgttggcca

SEQ ID NO: 636305 - DNA, 13 bp, D. melanogaster
gtgtgtgtttaag

SEQ ID NO: 636306 - DNA, 13 bp, D. melanogaster
gtgtgtgtttgcc

SEQ ID NO: 636307 - DNA, 14 bp, D. melanogaster
gtgtgtgtttgcca

SEQ ID NO: 636308 - DNA, 14 bp, D. melanogaster
gtgtgtgtttgcct

SEQ ID NO: 636309 - DNA, 13 bp, D. melanogaster
gtgtgtgttttca

SEQ ID NO: 636310 - DNA, 14 bp, D. melanogaster
gtgtgttcgagtgt

SEQ ID NO: 636311 - DNA, 13 bp, D. melanogaster
gtgtgttggccaa

SEQ ID NO: 636312 - DNA, 13 bp, D. melanogaster
gtgtgtttaatta

SEQ ID NO: 636313 - DNA, 13 bp, D. melanogaster
gtgtgtttgcata

SEQ ID NO: 636314 - DNA, 13 bp, D. melanogaster
gtgtgtttgccaa

SEQ ID NO: 636315 - DNA, 13 bp, D. melanogaster
gtgtgtttgtatc

SEQ ID NO: 636316 - DNA, 13 bp, D. melanogaster
gtgtgtttgtcta

SEQ ID NO: 636317 - DNA, 14 bp, D. melanogaster
gtgtgtttgtgtaa

SEQ ID NO: 636318 - DNA, 13 bp, D. melanogaster
gtgttaaaaattg

SEQ ID NO: 636319 - DNA, 13 bp, D. melanogaster
gtgttaaatgcaa

SEQ ID NO: 636320 - DNA, 14 bp, D. melanogaster
gtgttataatttgt

SEQ ID NO: 636321 - DNA, 13 bp, D. melanogaster
gtgttataccaaa

SEQ ID NO: 636322 - DNA, 13 bp, D. melanogaster
gtgttcaaacaaa

SEQ ID NO: 636323 - DNA, 13 bp, D. melanogaster
gtgttcactgtac

SEQ ID NO: 636324 - DNA, 13 bp, D. melanogaster
gtgttcagaaaaa

SEQ ID NO: 636325 - DNA, 13 bp, D. melanogaster
gtgttcataaaaa

SEQ ID NO: 636326 - DNA, 13 bp, D. melanogaster
gtgttcataaata

SEQ ID NO: 636327 - DNA, 13 bp, D. melanogaster
gtgttcattcttt

SEQ ID NO: 636328 - DNA, 14 bp, D. melanogaster
gtgttccagttgcc

SEQ ID NO: 636329 - DNA, 13 bp, D. melanogaster
gtgttccccaagg

SEQ ID NO: 636330 - DNA, 14 bp, D. melanogaster
gtgttcctatttat

SEQ ID NO: 636331 - DNA, 13 bp, D. melanogaster
gtgttgaaaagtg

SEQ ID NO: 636332 - DNA, 14 bp, D. melanogaster
gtgttgaaacaata

SEQ ID NO: 636333 - DNA, 13 bp, D. melanogaster
gtgttgaaatttc

SEQ ID NO: 636334 - DNA, 13 bp, D. melanogaster
gtgttgactggaa

SEQ ID NO: 636335 - DNA, 13 bp, D. melanogaster
gtgttgataataa

SEQ ID NO: 636336 - DNA, 13 bp, D. melanogaster
gtgttgcagttgc

SEQ ID NO: 636337 - DNA, 14 bp, D. melanogaster
gtgttgcatgttgc

SEQ ID NO: 636338 - DNA, 13 bp, D. melanogaster
gtgttgccaaaat

SEQ ID NO: 636339 - DNA, 13 bp, D. melanogaster
gtgttgctgctgc

SEQ ID NO: 636340 - DNA, 13 bp, D. melanogaster
gtgttggcatttg

SEQ ID NO: 636341 - DNA, 13 bp, D. melanogaster
gtgttggcatttt

SEQ ID NO: 636342 - DNA, 13 bp, D. melanogaster
gtgttggccaaat

SEQ ID NO: 636343 - DNA, 13 bp, D. melanogaster
gtgttggccaaca

SEQ ID NO: 636344 - DNA, 13 bp, D. melanogaster
gtgttggccaaga

SEQ ID NO: 636345 - DNA, 14 bp, D. melanogaster
gtgttgtgcatgtg

SEQ ID NO: 636346 - DNA, 14 bp, D. melanogaster
gtgttgttgctgct

SEQ ID NO: 636347 - DNA, 13 bp, D. melanogaster
gtgtttaaaaaag

SEQ ID NO: 636348 - DNA, 13 bp, D. melanogaster
gtgtttaactttc

SEQ ID NO: 636349 - DNA, 13 bp, D. melanogaster
gtgtttactatgg

SEQ ID NO: 636350 - DNA, 13 bp, D. melanogaster
gtgtttatctatt

SEQ ID NO: 636351 - DNA, 13 bp, D. melanogaster
gtgtttcagtttc

SEQ ID NO: 636352 - DNA, 13 bp, D. melanogaster
gtgtttccaaaaa

SEQ ID NO: 636353 - DNA, 14 bp, D. melanogaster
gtgtttccaaaaat

SEQ ID NO: 636354 - DNA, 13 bp, D. melanogaster
gtgtttgaaatgg

SEQ ID NO: 636355 - DNA, 13 bp, D. melanogaster
gtgtttgcaataa

SEQ ID NO: 636356 - DNA, 13 bp, D. melanogaster
gtgtttgcatttg

SEQ ID NO: 636357 - DNA, 13 bp, D. melanogaster
gtgtttgccattt

SEQ ID NO: 636358 - DNA, 13 bp, D. melanogaster
gtgtttgcctttg

SEQ ID NO: 636359 - DNA, 13 bp, D. melanogaster
gtgtttgcgcaag

SEQ ID NO: 636360 - DNA, 13 bp, D. melanogaster
gtgtttggataaa

SEQ ID NO: 636361 - DNA, 13 bp, D. melanogaster
gtgtttggccaaa

SEQ ID NO: 636362 - DNA, 13 bp, D. melanogaster
gtgtttggtgcaa

SEQ ID NO: 636363 - DNA, 13 bp, D. melanogaster
gtgtttgtgcatt

SEQ ID NO: 636364 - DNA, 13 bp, D. melanogaster
gtgtttgtgtgcc

SEQ ID NO: 636365 - DNA, 14 bp, D. melanogaster
gtgttttatgcgat

SEQ ID NO: 636366 - DNA, 13 bp, D. melanogaster
gtgttttatggcc

SEQ ID NO: 636367 - DNA, 13 bp, D. melanogaster
gtgttttcaatta

SEQ ID NO: 636368 - DNA, 13 bp, D. melanogaster
gtgttttccttgc

SEQ ID NO: 636369 - DNA, 13 bp, D. melanogaster
gtgttttcgaatt

SEQ ID NO: 636370 - DNA, 13 bp, D. melanogaster
gtgtttttcggaa

SEQ ID NO: 636371 - DNA, 13 bp, D. melanogaster
gtgtttttgaata

SEQ ID NO: 636372 - DNA, 13 bp, D. melanogaster
gtgttttttccaa

SEQ ID NO: 636373 - DNA, 13 bp, D. melanogaster
gttaaaaactaaa

SEQ ID NO: 636374 - DNA, 13 bp, D. melanogaster
gttaaaaatgaat

SEQ ID NO: 636375 - DNA, 14 bp, D. melanogaster
gttaaaaatgaatt

SEQ ID NO: 636376 - DNA, 13 bp, D. melanogaster
gttaaaacaaatt

SEQ ID NO: 636377 - DNA, 13 bp, D. melanogaster
gttaaaacattta

SEQ ID NO: 636378 - DNA, 13 bp, D. melanogaster
gttaaaaccaaac

SEQ ID NO: 636379 - DNA, 13 bp, D. melanogaster
gttaaaacgaaaa

SEQ ID NO: 636380 - DNA, 13 bp, D. melanogaster
gttaaaagaaaac

SEQ ID NO: 636381 - DNA, 13 bp, D. melanogaster
gttaaaagtgaaa

SEQ ID NO: 636382 - DNA, 13 bp, D. melanogaster
gttaaaagttaat

SEQ ID NO: 636383 - DNA, 14 bp, D. melanogaster
gttaaaataaagtt

SEQ ID NO: 636384 - DNA, 13 bp, D. melanogaster
gttaaaatattca

SEQ ID NO: 636385 - DNA, 14 bp, D. melanogaster
gttaaaatattcat

SEQ ID NO: 636386 - DNA, 13 bp, D. melanogaster
gttaaaatgaatt

SEQ ID NO: 636387 - DNA, 13 bp, D. melanogaster
gttaaaatgtata

SEQ ID NO: 636388 - DNA, 13 bp, D. melanogaster
gttaaaattacaa

SEQ ID NO: 636389 - DNA, 13 bp, D. melanogaster
gttaaacaaaaat

SEQ ID NO: 636390 - DNA, 13 bp, D. melanogaster
gttaaacaaatat

SEQ ID NO: 636391 - DNA, 13 bp, D. melanogaster
gttaaacaaatta

SEQ ID NO: 636392 - DNA, 13 bp, D. melanogaster
gttaaacaaattt

SEQ ID NO: 636393 - DNA, 13 bp, D. melanogaster
gttaaacaagctg

SEQ ID NO: 636394 - DNA, 13 bp, D. melanogaster
gttaaacaggtat

SEQ ID NO: 636395 - DNA, 13 bp, D. melanogaster
gttaaacataaaa

SEQ ID NO: 636396 - DNA, 13 bp, D. melanogaster
gttaaacatttta

SEQ ID NO: 636397 - DNA, 13 bp, D. melanogaster
gttaaagaaacca

SEQ ID NO: 636398 - DNA, 13 bp, D. melanogaster
gttaaaggttttt

SEQ ID NO: 636399 - DNA, 14 bp, D. melanogaster
gttaaagttaaagt

SEQ ID NO: 636400 - DNA, 13 bp, D. melanogaster
gttaaataaacat

SEQ ID NO: 636401 - DNA, 13 bp, D. melanogaster
gttaaataaagtt

SEQ ID NO: 636402 - DNA, 13 bp, D. melanogaster
gttaaatacagca

SEQ ID NO: 636403 - DNA, 14 bp, D. melanogaster
gttaaatacatttt

SEQ ID NO: 636404 - DNA, 13 bp, D. melanogaster
gttaaatatatct

SEQ ID NO: 636405 - DNA, 13 bp, D. melanogaster
gttaaatatatgt

SEQ ID NO: 636406 - DNA, 14 bp, D. melanogaster
gttaaatcacatat

SEQ ID NO: 636407 - DNA, 13 bp, D. melanogaster
gttaaatgaataa

SEQ ID NO: 636408 - DNA, 13 bp, D. melanogaster
gttaaatggaaaa

SEQ ID NO: 636409 - DNA, 13 bp, D. melanogaster
gttaaatggcaaa

SEQ ID NO: 636410 - DNA, 14 bp, D. melanogaster
gttaaatgtattta

SEQ ID NO: 636411 - DNA, 13 bp, D. melanogaster
gttaaattaactt

SEQ ID NO: 636412 - DNA, 13 bp, D. melanogaster
gttaaattgaaat

SEQ ID NO: 636413 - DNA, 13 bp, D. melanogaster
gttaaatttactt

SEQ ID NO: 636414 - DNA, 13 bp, D. melanogaster
gttaaatttgaaa

SEQ ID NO: 636415 - DNA, 13 bp, D. melanogaster
gttaaatttgttg

SEQ ID NO: 636416 - DNA, 13 bp, D. melanogaster
gttaacaaacaaa

SEQ ID NO: 636417 - DNA, 13 bp, D. melanogaster
gttaacgtttatt

SEQ ID NO: 636418 - DNA, 14 bp, D. melanogaster
gttaactaagttaa

SEQ ID NO: 636419 - DNA, 13 bp, D. melanogaster
gttaactccaatt

SEQ ID NO: 636420 - DNA, 14 bp, D. melanogaster
gttaactccaattt

SEQ ID NO: 636421 - DNA, 13 bp, D. melanogaster
gttaactgaagaa

SEQ ID NO: 636422 - DNA, 13 bp, D. melanogaster
gttaacttatata

SEQ ID NO: 636423 - DNA, 13 bp, D. melanogaster
gttaagaattgtt

SEQ ID NO: 636424 - DNA, 13 bp, D. melanogaster
gttaagatcattt

SEQ ID NO: 636425 - DNA, 14 bp, D. melanogaster
gttaagatcatttt

SEQ ID NO: 636426 - DNA, 13 bp, D. melanogaster
gttaagattttcc

SEQ ID NO: 636427 - DNA, 13 bp, D. melanogaster
gttaagattttta

SEQ ID NO: 636428 - DNA, 14 bp, D. melanogaster
gttaagcataacaa

SEQ ID NO: 636429 - DNA, 13 bp, D. melanogaster
gttaagcttaaat

SEQ ID NO: 636430 - DNA, 13 bp, D. melanogaster
gttaaggagttaa

SEQ ID NO: 636431 - DNA, 13 bp, D. melanogaster
gttaagttaaata

SEQ ID NO: 636432 - DNA, 13 bp, D. melanogaster
gttaataattctt

SEQ ID NO: 636433 - DNA, 13 bp, D. melanogaster
gttaatcaaaatg

SEQ ID NO: 636434 - DNA, 13 bp, D. melanogaster
gttaatgaatttc

SEQ ID NO: 636435 - DNA, 13 bp, D. melanogaster
gttaatggttaat

SEQ ID NO: 636436 - DNA, 13 bp, D. melanogaster
gttaatgtaataa

SEQ ID NO: 636437 - DNA, 13 bp, D. melanogaster
gttaatgttaatg

SEQ ID NO: 636438 - DNA, 13 bp, D. melanogaster
gttaatgtttaca

SEQ ID NO: 636439 - DNA, 13 bp, D. melanogaster
gttaattaattac

SEQ ID NO: 636440 - DNA, 13 bp, D. melanogaster
gttaattactttt

SEQ ID NO: 636441 - DNA, 13 bp, D. melanogaster
gttaattagaatt

SEQ ID NO: 636442 - DNA, 13 bp, D. melanogaster
gttaattagctga

SEQ ID NO: 636443 - DNA, 13 bp, D. melanogaster
gttaattatgtac

SEQ ID NO: 636444 - DNA, 13 bp, D. melanogaster
gttaattatgtat

SEQ ID NO: 636445 - DNA, 13 bp, D. melanogaster
gttaattgtaatt

SEQ ID NO: 636446 - DNA, 13 bp, D. melanogaster
gttaatttaacaa

SEQ ID NO: 636447 - DNA, 13 bp, D. melanogaster
gttaatttatgca

SEQ ID NO: 636448 - DNA, 13 bp, D. melanogaster
gttaatttcaatt

SEQ ID NO: 636449 - DNA, 13 bp, D. melanogaster
gttaatttcgatt

SEQ ID NO: 636450 - DNA, 14 bp, D. melanogaster
gttaatttctctcc

SEQ ID NO: 636451 - DNA, 13 bp, D. melanogaster
gttaatttgccaa

SEQ ID NO: 636452 - DNA, 13 bp, D. melanogaster
gttaattttcaat

SEQ ID NO: 636453 - DNA, 13 bp, D. melanogaster
gttacaaaataaa

SEQ ID NO: 636454 - DNA, 13 bp, D. melanogaster
gttacaaatgaag

SEQ ID NO: 636455 - DNA, 13 bp, D. melanogaster
gttacaattgtgt

SEQ ID NO: 636456 - DNA, 13 bp, D. melanogaster
gttacaatttacc

SEQ ID NO: 636457 - DNA, 13 bp, D. melanogaster
gttacagaaatag

SEQ ID NO: 636458 - DNA, 14 bp, D. melanogaster
gttacagcttgtgt

SEQ ID NO: 636459 - DNA, 13 bp, D. melanogaster
gttacatttaaaa

SEQ ID NO: 636460 - DNA, 13 bp, D. melanogaster
gttaccaaaataa

SEQ ID NO: 636461 - DNA, 13 bp, D. melanogaster
gttacccatgaat

SEQ ID NO: 636462 - DNA, 13 bp, D. melanogaster
gttaccccttacc

SEQ ID NO: 636463 - DNA, 14 bp, D. melanogaster
gttaccccttacca

SEQ ID NO: 636464 - DNA, 13 bp, D. melanogaster
gttacccgatttt

SEQ ID NO: 636465 - DNA, 13 bp, D. melanogaster
gttaccctttttg

SEQ ID NO: 636466 - DNA, 13 bp, D. melanogaster
gttacgcatcttg

SEQ ID NO: 636467 - DNA, 14 bp, D. melanogaster
gttacgtatacgcc

SEQ ID NO: 636468 - DNA, 13 bp, D. melanogaster
gttacgttacgtt

SEQ ID NO: 636469 - DNA, 13 bp, D. melanogaster
gttactaaaaact

SEQ ID NO: 636470 - DNA, 13 bp, D. melanogaster
gttactaatgaat

SEQ ID NO: 636471 - DNA, 13 bp, D. melanogaster
gttactccttttg

SEQ ID NO: 636472 - DNA, 14 bp, D. melanogaster
gttacttatatttt

SEQ ID NO: 636473 - DNA, 14 bp, D. melanogaster
gttagatttttgcc

SEQ ID NO: 636474 - DNA, 13 bp, D. melanogaster
gttagcaacaaca

SEQ ID NO: 636475 - DNA, 13 bp, D. melanogaster
gttagcagcaatt

SEQ ID NO: 636476 - DNA, 13 bp, D. melanogaster
gttagccagcaca

SEQ ID NO: 636477 - DNA, 13 bp, D. melanogaster
gttagtgaaacag

SEQ ID NO: 636478 - DNA, 13 bp, D. melanogaster
gttagtggagtgc

SEQ ID NO: 636479 - DNA, 13 bp, D. melanogaster
gttagttagttat

SEQ ID NO: 636480 - DNA, 13 bp, D. melanogaster
gttagttcttata

SEQ ID NO: 636481 - DNA, 13 bp, D. melanogaster
gttagttgaatct

SEQ ID NO: 636482 - DNA, 13 bp, D. melanogaster
gttagtttaggtc

SEQ ID NO: 636483 - DNA, 13 bp, D. melanogaster
gttataaaaatag

SEQ ID NO: 636484 - DNA, 13 bp, D. melanogaster
gttataaagaaat

SEQ ID NO: 636485 - DNA, 13 bp, D. melanogaster
gttataaagttat

SEQ ID NO: 636486 - DNA, 13 bp, D. melanogaster
gttataaatgcaa

SEQ ID NO: 636487 - DNA, 13 bp, D. melanogaster
gttataagttata

SEQ ID NO: 636488 - DNA, 13 bp, D. melanogaster
gttataatgcaaa

SEQ ID NO: 636489 - DNA, 13 bp, D. melanogaster
gttatacaaaaaa

SEQ ID NO: 636490 - DNA, 13 bp, D. melanogaster
gttatactcaaaa

SEQ ID NO: 636491 - DNA, 14 bp, D. melanogaster
gttatagttatagt

SEQ ID NO: 636492 - DNA, 13 bp, D. melanogaster
gttatatactttt

SEQ ID NO: 636493 - DNA, 14 bp, D. melanogaster
gttatataggcaaa

SEQ ID NO: 636494 - DNA, 13 bp, D. melanogaster
gttatatatgtac

SEQ ID NO: 636495 - DNA, 13 bp, D. melanogaster
gttatatgtatat

SEQ ID NO: 636496 - DNA, 13 bp, D. melanogaster
gttatatgtggac

SEQ ID NO: 636497 - DNA, 13 bp, D. melanogaster
gttatatttcaaa

SEQ ID NO: 636498 - DNA, 13 bp, D. melanogaster
gttatcaatcaaa

SEQ ID NO: 636499 - DNA, 13 bp, D. melanogaster
gttatcgggtacc

SEQ ID NO: 636500 - DNA, 14 bp, D. melanogaster
gttatcgtcattgg

SEQ ID NO: 636501 - DNA, 13 bp, D. melanogaster
gttatcgttatcg

SEQ ID NO: 636502 - DNA, 13 bp, D. melanogaster
gttatctttcccc

SEQ ID NO: 636503 - DNA, 14 bp, D. melanogaster
gttatgaacgcgat

SEQ ID NO: 636504 - DNA, 13 bp, D. melanogaster
gttatgattatta

SEQ ID NO: 636505 - DNA, 13 bp, D. melanogaster
gttatgcagtttg

SEQ ID NO: 636506 - DNA, 13 bp, D. melanogaster
gttatgcgaaaaa

SEQ ID NO: 636507 - DNA, 13 bp, D. melanogaster
gttatggagaaaa

SEQ ID NO: 636508 - DNA, 13 bp, D. melanogaster
gttatgttactgt

SEQ ID NO: 636509 - DNA, 13 bp, D. melanogaster
gttatgttctctt

SEQ ID NO: 636510 - DNA, 13 bp, D. melanogaster
gttattaaaagtt

SEQ ID NO: 636511 - DNA, 13 bp, D. melanogaster
gttattaaacaaa

SEQ ID NO: 636512 - DNA, 13 bp, D. melanogaster
gttattaagttat

SEQ ID NO: 636513 - DNA, 13 bp, D. melanogaster
gttattaatttct

SEQ ID NO: 636514 - DNA, 13 bp, D. melanogaster
gttattacgttat

SEQ ID NO: 636515 - DNA, 13 bp, D. melanogaster
gttattactttta

SEQ ID NO: 636516 - DNA, 14 bp, D. melanogaster
gttattagtgcaat

SEQ ID NO: 636517 - DNA, 14 bp, D. melanogaster
gttattatcgcaaa

SEQ ID NO: 636518 - DNA, 13 bp, D. melanogaster
gttattcggaaaa

SEQ ID NO: 636519 - DNA, 13 bp, D. melanogaster
gttattgaaataa

SEQ ID NO: 636520 - DNA, 13 bp, D. melanogaster
gttattgaactgg

SEQ ID NO: 636521 - DNA, 13 bp, D. melanogaster
gttattgccctgc

SEQ ID NO: 636522 - DNA, 13 bp, D. melanogaster
gttattgttatga

SEQ ID NO: 636523 - DNA, 13 bp, D. melanogaster
gttattgttgatg

SEQ ID NO: 636524 - DNA, 13 bp, D. melanogaster
gttattgttgcta

SEQ ID NO: 636525 - DNA, 13 bp, D. melanogaster
gttattgttgctc

SEQ ID NO: 636526 - DNA, 13 bp, D. melanogaster
gttattgttgtcg

SEQ ID NO: 636527 - DNA, 13 bp, D. melanogaster
gttattgttttcg

SEQ ID NO: 636528 - DNA, 14 bp, D. melanogaster
gttatttaatgcaa

SEQ ID NO: 636529 - DNA, 13 bp, D. melanogaster
gttatttacaaaa

SEQ ID NO: 636530 - DNA, 13 bp, D. melanogaster
gttatttatacat

SEQ ID NO: 636531 - DNA, 13 bp, D. melanogaster
gttatttcaattt

SEQ ID NO: 636532 - DNA, 13 bp, D. melanogaster
gttatttcgataa

SEQ ID NO: 636533 - DNA, 13 bp, D. melanogaster
gttatttgacttt

SEQ ID NO: 636534 - DNA, 13 bp, D. melanogaster
gttatttgtttac

SEQ ID NO: 636535 - DNA, 13 bp, D. melanogaster
gttattttaaaga

SEQ ID NO: 636536 - DNA, 13 bp, D. melanogaster
gttattttacatt

SEQ ID NO: 636537 - DNA, 13 bp, D. melanogaster
gttattttcataa

SEQ ID NO: 636538 - DNA, 13 bp, D. melanogaster
gttattttgaaac

SEQ ID NO: 636539 - DNA, 13 bp, D. melanogaster
gttcaaaaaatac

SEQ ID NO: 636540 - DNA, 13 bp, D. melanogaster
gttcaaaaataaa

SEQ ID NO: 636541 - DNA, 13 bp, D. melanogaster
gttcaaaaatata

SEQ ID NO: 636542 - DNA, 13 bp, D. melanogaster
gttcaaaacataa

SEQ ID NO: 636543 - DNA, 13 bp, D. melanogaster
gttcaaaataaaa

SEQ ID NO: 636544 - DNA, 13 bp, D. melanogaster
gttcaaaatcaaa

SEQ ID NO: 636545 - DNA, 13 bp, D. melanogaster
gttcaaaatcagt

SEQ ID NO: 636546 - DNA, 13 bp, D. melanogaster
gttcaaaattgtg

SEQ ID NO: 636547 - DNA, 13 bp, D. melanogaster
gttcaaacaaaaa

SEQ ID NO: 636548 - DNA, 13 bp, D. melanogaster
gttcaaagctcag

SEQ ID NO: 636549 - DNA, 13 bp, D. melanogaster
gttcaaaggagga

SEQ ID NO: 636550 - DNA, 13 bp, D. melanogaster
gttcaaataaaag

SEQ ID NO: 636551 - DNA, 14 bp, D. melanogaster
gttcaaatgtggaa

SEQ ID NO: 636552 - DNA, 13 bp, D. melanogaster
gttcaaattcaaa

SEQ ID NO: 636553 - DNA, 13 bp, D. melanogaster
gttcaaatttgga

SEQ ID NO: 636554 - DNA, 13 bp, D. melanogaster
gttcaaatttgtt

SEQ ID NO: 636555 - DNA, 13 bp, D. melanogaster
gttcaacaagagc

SEQ ID NO: 636556 - DNA, 13 bp, D. melanogaster
gttcaaggaccac

SEQ ID NO: 636557 - DNA, 13 bp, D. melanogaster
gttcaagttcaaa

SEQ ID NO: 636558 - DNA, 13 bp, D. melanogaster
gttcaataaatat

SEQ ID NO: 636559 - DNA, 13 bp, D. melanogaster
gttcaatatagtt

SEQ ID NO: 636560 - DNA, 13 bp, D. melanogaster
gttcaattcaatt

SEQ ID NO: 636561 - DNA, 13 bp, D. melanogaster
gttcaattcgaat

SEQ ID NO: 636562 - DNA, 13 bp, D. melanogaster
gttcaatttcaat

SEQ ID NO: 636563 - DNA, 13 bp, D. melanogaster
gttcaatttgaat

SEQ ID NO: 636564 - DNA, 13 bp, D. melanogaster
gttcacaatgcgg

SEQ ID NO: 636565 - DNA, 13 bp, D. melanogaster
gttcacggcggag

SEQ ID NO: 636566 - DNA, 13 bp, D. melanogaster
gttcacttcactc

SEQ ID NO: 636567 - DNA, 13 bp, D. melanogaster
gttcaggaccaag

SEQ ID NO: 636568 - DNA, 13 bp, D. melanogaster
gttcaggttcagg

SEQ ID NO: 636569 - DNA, 13 bp, D. melanogaster
gttcaggttttaa

SEQ ID NO: 636570 - DNA, 14 bp, D. melanogaster
gttcaggttttaaa

SEQ ID NO: 636571 - DNA, 13 bp, D. melanogaster
gttcagtgggtgg

SEQ ID NO: 636572 - DNA, 13 bp, D. melanogaster
gttcagttcagtt

SEQ ID NO: 636573 - DNA, 14 bp, D. melanogaster
gttcagttcagttt

SEQ ID NO: 636574 - DNA, 13 bp, D. melanogaster
gttcagttctgtt

SEQ ID NO: 636575 - DNA, 13 bp, D. melanogaster
gttcagttgagtt

SEQ ID NO: 636576 - DNA, 13 bp, D. melanogaster
gttcagtttcagt

SEQ ID NO: 636577 - DNA, 13 bp, D. melanogaster
gttcagtttggct

SEQ ID NO: 636578 - DNA, 13 bp, D. melanogaster
gttcataaacggc

SEQ ID NO: 636579 - DNA, 13 bp, D. melanogaster
gttcataaataaa

SEQ ID NO: 636580 - DNA, 13 bp, D. melanogaster
gttcataaatatt

SEQ ID NO: 636581 - DNA, 13 bp, D. melanogaster
gttcataatattt

SEQ ID NO: 636582 - DNA, 13 bp, D. melanogaster
gttcatacggaca

SEQ ID NO: 636583 - DNA, 14 bp, D. melanogaster
gttcatacggacag

SEQ ID NO: 636584 - DNA, 14 bp, D. melanogaster
gttcatacggacat

SEQ ID NO: 636585 - DNA, 13 bp, D. melanogaster
gttcatagatttt

SEQ ID NO: 636586 - DNA, 13 bp, D. melanogaster
gttcatatacata

SEQ ID NO: 636587 - DNA, 13 bp, D. melanogaster
gttcatattttca

SEQ ID NO: 636588 - DNA, 13 bp, D. melanogaster
gttcatcatcatc

SEQ ID NO: 636589 - DNA, 14 bp, D. melanogaster
gttcatccgccacc

SEQ ID NO: 636590 - DNA, 13 bp, D. melanogaster
gttcatcgcagcg

SEQ ID NO: 636591 - DNA, 13 bp, D. melanogaster
gttcatgcaaaat

SEQ ID NO: 636592 - DNA, 13 bp, D. melanogaster
gttcattaaataa

SEQ ID NO: 636593 - DNA, 13 bp, D. melanogaster
gttcattaaatat

SEQ ID NO: 636594 - DNA, 13 bp, D. melanogaster
gttcattaataaa

SEQ ID NO: 636595 - DNA, 13 bp, D. melanogaster
gttcattcataaa

SEQ ID NO: 636596 - DNA, 13 bp, D. melanogaster
gttcattgatttt

SEQ ID NO: 636597 - DNA, 13 bp, D. melanogaster
gttcattgttgtt

SEQ ID NO: 636598 - DNA, 13 bp, D. melanogaster
gttcatttcggac

SEQ ID NO: 636599 - DNA, 13 bp, D. melanogaster
gttcatttcgttt

SEQ ID NO: 636600 - DNA, 13 bp, D. melanogaster
gttcattttggca

SEQ ID NO: 636601 - DNA, 13 bp, D. melanogaster
gttcatttttcat

SEQ ID NO: 636602 - DNA, 13 bp, D. melanogaster
gttccaaaaataa

SEQ ID NO: 636603 - DNA, 13 bp, D. melanogaster
gttccaaattctt

SEQ ID NO: 636604 - DNA, 13 bp, D. melanogaster
gttccacatgatg

SEQ ID NO: 636605 - DNA, 13 bp, D. melanogaster
gttccacattttc

SEQ ID NO: 636606 - DNA, 13 bp, D. melanogaster
gttccagttgccg

SEQ ID NO: 636607 - DNA, 13 bp, D. melanogaster
gttccattccgtt

SEQ ID NO: 636608 - DNA, 13 bp, D. melanogaster
gttccatttttta

SEQ ID NO: 636609 - DNA, 13 bp, D. melanogaster
gttccccaaggat

SEQ ID NO: 636610 - DNA, 13 bp, D. melanogaster
gttccccattggc

SEQ ID NO: 636611 - DNA, 13 bp, D. melanogaster
gttccctgaacag

SEQ ID NO: 636612 - DNA, 13 bp, D. melanogaster
gttccctttgcga

SEQ ID NO: 636613 - DNA, 14 bp, D. melanogaster
gttccctttgcgag

SEQ ID NO: 636614 - DNA, 13 bp, D. melanogaster
gttccgggttggg

SEQ ID NO: 636615 - DNA, 13 bp, D. melanogaster
gttccgttccgtt

SEQ ID NO: 636616 - DNA, 14 bp, D. melanogaster
gttccgttccgttc

SEQ ID NO: 636617 - DNA, 13 bp, D. melanogaster
gttccgtttcgtt

SEQ ID NO: 636618 - DNA, 13 bp, D. melanogaster
gttcctaaagttt

SEQ ID NO: 636619 - DNA, 13 bp, D. melanogaster
gttcctagaaatt

SEQ ID NO: 636620 - DNA, 13 bp, D. melanogaster
gttcctgctgctg

SEQ ID NO: 636621 - DNA, 13 bp, D. melanogaster
gttcctgtggaag

SEQ ID NO: 636622 - DNA, 13 bp, D. melanogaster
gttcctgttctct

SEQ ID NO: 636623 - DNA, 13 bp, D. melanogaster
gttcctgttgttg

SEQ ID NO: 636624 - DNA, 13 bp, D. melanogaster
gttcctttaagtt

SEQ ID NO: 636625 - DNA, 13 bp, D. melanogaster
gttcgaacgtctg

SEQ ID NO: 636626 - DNA, 13 bp, D. melanogaster
gttcgagtgtgtg

SEQ ID NO: 636627 - DNA, 14 bp, D. melanogaster
gttcgagtgtgtgt

SEQ ID NO: 636628 - DNA, 13 bp, D. melanogaster
gttcgagttcgag

SEQ ID NO: 636629 - DNA, 13 bp, D. melanogaster
gttcgattcgatt

SEQ ID NO: 636630 - DNA, 13 bp, D. melanogaster
gttcgattcggtt

SEQ ID NO: 636631 - DNA, 13 bp, D. melanogaster
gttcgatttcgat

SEQ ID NO: 636632 - DNA, 13 bp, D. melanogaster
gttcgatttgatt

SEQ ID NO: 636633 - DNA, 13 bp, D. melanogaster
gttcgcagataga

SEQ ID NO: 636634 - DNA, 14 bp, D. melanogaster
gttcgcagcaacaa

SEQ ID NO: 636635 - DNA, 13 bp, D. melanogaster
gttcgccaaccga

SEQ ID NO: 636636 - DNA, 13 bp, D. melanogaster
gttcgcctgcttt

SEQ ID NO: 636637 - DNA, 13 bp, D. melanogaster
gttcgctattcga

SEQ ID NO: 636638 - DNA, 13 bp, D. melanogaster
gttcgctgtagcg

SEQ ID NO: 636639 - DNA, 13 bp, D. melanogaster
gttcgctttattt

SEQ ID NO: 636640 - DNA, 13 bp, D. melanogaster
gttcggaatgagg

SEQ ID NO: 636641 - DNA, 13 bp, D. melanogaster
gttcggcagaaac

SEQ ID NO: 636642 - DNA, 13 bp, D. melanogaster
gttcgggtttcat

SEQ ID NO: 636643 - DNA, 13 bp, D. melanogaster
gttcggtggcttc

SEQ ID NO: 636644 - DNA, 13 bp, D. melanogaster
gttcggttcagtt

SEQ ID NO: 636645 - DNA, 14 bp, D. melanogaster
gttcggttcagttc

SEQ ID NO: 636646 - DNA, 13 bp, D. melanogaster
gttcggttcgctt

SEQ ID NO: 636647 - DNA, 13 bp, D. melanogaster
gttcggttcggtt

SEQ ID NO: 636648 - DNA, 13 bp, D. melanogaster
gttcggtttcagt

SEQ ID NO: 636649 - DNA, 14 bp, D. melanogaster
gttcggtttctgct

SEQ ID NO: 636650 - DNA, 13 bp, D. melanogaster
gttcggttttatt

SEQ ID NO: 636651 - DNA, 13 bp, D. melanogaster
gttcgtactcttt

SEQ ID NO: 636652 - DNA, 13 bp, D. melanogaster
gttcgtctgtccg

SEQ ID NO: 636653 - DNA, 13 bp, D. melanogaster
gttcgtgcctctg

SEQ ID NO: 636654 - DNA, 14 bp, D. melanogaster
gttcgttggcgttg

SEQ ID NO: 636655 - DNA, 13 bp, D. melanogaster
gttcgtttcgctt

SEQ ID NO: 636656 - DNA, 13 bp, D. melanogaster
gttctaagaaaaa

SEQ ID NO: 636657 - DNA, 13 bp, D. melanogaster
gttctacattttt

SEQ ID NO: 636658 - DNA, 13 bp, D. melanogaster
gttctactaataa

SEQ ID NO: 636659 - DNA, 13 bp, D. melanogaster
gttctactttttc

SEQ ID NO: 636660 - DNA, 13 bp, D. melanogaster
gttctagaaattc

SEQ ID NO: 636661 - DNA, 13 bp, D. melanogaster
gttctatactatt

SEQ ID NO: 636662 - DNA, 14 bp, D. melanogaster
gttctatgtttaaa

SEQ ID NO: 636663 - DNA, 13 bp, D. melanogaster
gttctcgattctc

SEQ ID NO: 636664 - DNA, 13 bp, D. melanogaster
gttctcgttctcg

SEQ ID NO: 636665 - DNA, 13 bp, D. melanogaster
gttctcgttttcg

SEQ ID NO: 636666 - DNA, 13 bp, D. melanogaster
gttctctgcagcc

SEQ ID NO: 636667 - DNA, 13 bp, D. melanogaster
gttctctttgaga

SEQ ID NO: 636668 - DNA, 13 bp, D. melanogaster
gttctgaaatcaa

SEQ ID NO: 636669 - DNA, 13 bp, D. melanogaster
gttctgattctaa

SEQ ID NO: 636670 - DNA, 13 bp, D. melanogaster
gttctgcaggcaa

SEQ ID NO: 636671 - DNA, 13 bp, D. melanogaster
gttctgctgctgc

SEQ ID NO: 636672 - DNA, 13 bp, D. melanogaster
gttctgcttttgg

SEQ ID NO: 636673 - DNA, 13 bp, D. melanogaster
gttctggacggat

SEQ ID NO: 636674 - DNA, 13 bp, D. melanogaster
gttctggccaaaa

SEQ ID NO: 636675 - DNA, 13 bp, D. melanogaster
gttctgtgttctg

SEQ ID NO: 636676 - DNA, 14 bp, D. melanogaster
gttctgttctgttc

SEQ ID NO: 636677 - DNA, 13 bp, D. melanogaster
gttctgtttctag

SEQ ID NO: 636678 - DNA, 13 bp, D. melanogaster
gttcttaaaaaag

SEQ ID NO: 636679 - DNA, 14 bp, D. melanogaster
gttcttaaaaaagg

SEQ ID NO: 636680 - DNA, 13 bp, D. melanogaster
gttcttaaagaaa

SEQ ID NO: 636681 - DNA, 13 bp, D. melanogaster
gttcttaattgta

SEQ ID NO: 636682 - DNA, 14 bp, D. melanogaster
gttcttatacaaga

SEQ ID NO: 636683 - DNA, 13 bp, D. melanogaster
gttcttatcattc

SEQ ID NO: 636684 - DNA, 13 bp, D. melanogaster
gttcttattttga

SEQ ID NO: 636685 - DNA, 13 bp, D. melanogaster
gttcttcaagcgg

SEQ ID NO: 636686 - DNA, 14 bp, D. melanogaster
gttcttcagcatta

SEQ ID NO: 636687 - DNA, 13 bp, D. melanogaster
gttcttctggacc

SEQ ID NO: 636688 - DNA, 13 bp, D. melanogaster
gttcttggcccaa

SEQ ID NO: 636689 - DNA, 13 bp, D. melanogaster
gttctttgacttt

SEQ ID NO: 636690 - DNA, 13 bp, D. melanogaster
gttctttgtgcac

SEQ ID NO: 636691 - DNA, 13 bp, D. melanogaster
gttcttttctacg

SEQ ID NO: 636692 - DNA, 13 bp, D. melanogaster
gttgaaaaaatcg

SEQ ID NO: 636693 - DNA, 13 bp, D. melanogaster
gttgaaaaacaaa

SEQ ID NO: 636694 - DNA, 13 bp, D. melanogaster
gttgaaaaatcgg

SEQ ID NO: 636695 - DNA, 13 bp, D. melanogaster
gttgaaaaatgtt

SEQ ID NO: 636696 - DNA, 13 bp, D. melanogaster
gttgaaaaattcg

SEQ ID NO: 636697 - DNA, 13 bp, D. melanogaster
gttgaaaacaaat

SEQ ID NO: 636698 - DNA, 13 bp, D. melanogaster
gttgaaaactatg

SEQ ID NO: 636699 - DNA, 14 bp, D. melanogaster
gttgaaaagtatat

SEQ ID NO: 636700 - DNA, 14 bp, D. melanogaster
gttgaaaagtatgt

SEQ ID NO: 636701 - DNA, 13 bp, D. melanogaster
gttgaaaagtgaa

SEQ ID NO: 636702 - DNA, 13 bp, D. melanogaster
gttgaaaagtgtg

SEQ ID NO: 636703 - DNA, 14 bp, D. melanogaster
gttgaaaagtgtgt

SEQ ID NO: 636704 - DNA, 13 bp, D. melanogaster
gttgaaaagtttg

SEQ ID NO: 636705 - DNA, 13 bp, D. melanogaster
gttgaaaataaac

SEQ ID NO: 636706 - DNA, 13 bp, D. melanogaster
gttgaaaatgaaa

SEQ ID NO: 636707 - DNA, 13 bp, D. melanogaster
gttgaaaatgctt

SEQ ID NO: 636708 - DNA, 13 bp, D. melanogaster
gttgaaaattaaa

SEQ ID NO: 636709 - DNA, 13 bp, D. melanogaster
gttgaaaattatc

SEQ ID NO: 636710 - DNA, 13 bp, D. melanogaster
gttgaaaattgaa

SEQ ID NO: 636711 - DNA, 13 bp, D. melanogaster
gttgaaacaaaaa

SEQ ID NO: 636712 - DNA, 13 bp, D. melanogaster
gttgaaacaataa

SEQ ID NO: 636713 - DNA, 13 bp, D. melanogaster
gttgaaacagttg

SEQ ID NO: 636714 - DNA, 13 bp, D. melanogaster
gttgaaacattta

SEQ ID NO: 636715 - DNA, 13 bp, D. melanogaster
gttgaaaggtggc

SEQ ID NO: 636716 - DNA, 13 bp, D. melanogaster
gttgaaataatat

SEQ ID NO: 636717 - DNA, 14 bp, D. melanogaster
gttgaaatatattt

SEQ ID NO: 636718 - DNA, 13 bp, D. melanogaster
gttgaaatcgaaa

SEQ ID NO: 636719 - DNA, 13 bp, D. melanogaster
gttgaaattgtta

SEQ ID NO: 636720 - DNA, 13 bp, D. melanogaster
gttgaaattttat

SEQ ID NO: 636721 - DNA, 13 bp, D. melanogaster
gttgaacattttt

SEQ ID NO: 636722 - DNA, 14 bp, D. melanogaster
gttgaaccattgtt

SEQ ID NO: 636723 - DNA, 13 bp, D. melanogaster
gttgaagagtttt

SEQ ID NO: 636724 - DNA, 13 bp, D. melanogaster
gttgaagttgaag

SEQ ID NO: 636725 - DNA, 14 bp, D. melanogaster
gttgaagttgaagt

SEQ ID NO: 636726 - DNA, 13 bp, D. melanogaster
gttgaatatcaag

SEQ ID NO: 636727 - DNA, 13 bp, D. melanogaster
gttgaatcaacca

SEQ ID NO: 636728 - DNA, 13 bp, D. melanogaster
gttgaatccaact

SEQ ID NO: 636729 - DNA, 13 bp, D. melanogaster
gttgaatttgaat

SEQ ID NO: 636730 - DNA, 14 bp, D. melanogaster
gttgaattttgtta

SEQ ID NO: 636731 - DNA, 13 bp, D. melanogaster
gttgacaaaaata

SEQ ID NO: 636732 - DNA, 13 bp, D. melanogaster
gttgacaaaaatg

SEQ ID NO: 636733 - DNA, 13 bp, D. melanogaster
gttgacaaaaccg

SEQ ID NO: 636734 - DNA, 13 bp, D. melanogaster
gttgacaatgaaa

SEQ ID NO: 636735 - DNA, 13 bp, D. melanogaster
gttgacaattttt

SEQ ID NO: 636736 - DNA, 13 bp, D. melanogaster
gttgacagaggcc

SEQ ID NO: 636737 - DNA, 13 bp, D. melanogaster
gttgaccaaaaaa

SEQ ID NO: 636738 - DNA, 13 bp, D. melanogaster
gttgaccataaaa

SEQ ID NO: 636739 - DNA, 13 bp, D. melanogaster
gttgacccctcac

SEQ ID NO: 636740 - DNA, 13 bp, D. melanogaster
gttgacgttgatg

SEQ ID NO: 636741 - DNA, 13 bp, D. melanogaster
gttgactacacta

SEQ ID NO: 636742 - DNA, 13 bp, D. melanogaster
gttgactggaagt

SEQ ID NO: 636743 - DNA, 14 bp, D. melanogaster
gttgactggaagtg

SEQ ID NO: 636744 - DNA, 14 bp, D. melanogaster
gttgagattcagca

SEQ ID NO: 636745 - DNA, 13 bp, D. melanogaster
gttgagattgtga

SEQ ID NO: 636746 - DNA, 14 bp, D. melanogaster
gttgagcagcaaca

SEQ ID NO: 636747 - DNA, 13 bp, D. melanogaster
gttgagccaaaaa

SEQ ID NO: 636748 - DNA, 14 bp, D. melanogaster
gttgaggtcattaa

SEQ ID NO: 636749 - DNA, 13 bp, D. melanogaster
gttgagtcgagtc

SEQ ID NO: 636750 - DNA, 14 bp, D. melanogaster
gttgagtcgagtcg

SEQ ID NO: 636751 - DNA, 13 bp, D. melanogaster
gttgagttgagct

SEQ ID NO: 636752 - DNA, 13 bp, D. melanogaster
gttgagttgagtg

SEQ ID NO: 636753 - DNA, 13 bp, D. melanogaster
gttgataaataaa

SEQ ID NO: 636754 - DNA, 13 bp, D. melanogaster
gttgataatattt

SEQ ID NO: 636755 - DNA, 14 bp, D. melanogaster
gttgataatatttg

SEQ ID NO: 636756 - DNA, 13 bp, D. melanogaster
gttgatcgtgttt

SEQ ID NO: 636757 - DNA, 13 bp, D. melanogaster
gttgatctgtttt

SEQ ID NO: 636758 - DNA, 14 bp, D. melanogaster
gttgatgatgatgg

SEQ ID NO: 636759 - DNA, 13 bp, D. melanogaster
gttgatgatgatt

SEQ ID NO: 636760 - DNA, 13 bp, D. melanogaster
gttgatgctgatg

SEQ ID NO: 636761 - DNA, 14 bp, D. melanogaster
gttgatgctgctgc

SEQ ID NO: 636762 - DNA, 14 bp, D. melanogaster
gttgatggcagcgg

SEQ ID NO: 636763 - DNA, 13 bp, D. melanogaster
gttgatggtttaa

SEQ ID NO: 636764 - DNA, 13 bp, D. melanogaster
gttgatgtggatg

SEQ ID NO: 636765 - DNA, 13 bp, D. melanogaster
gttgatgtggctg

SEQ ID NO: 636766 - DNA, 13 bp, D. melanogaster
gttgatgttgctg

SEQ ID NO: 636767 - DNA, 13 bp, D. melanogaster
gttgatgttgctt

SEQ ID NO: 636768 - DNA, 14 bp, D. melanogaster
gttgatgttgttgc

SEQ ID NO: 636769 - DNA, 13 bp, D. melanogaster
gttgattaaaaaa

SEQ ID NO: 636770 - DNA, 13 bp, D. melanogaster
gttgattcaactt

SEQ ID NO: 636771 - DNA, 13 bp, D. melanogaster
gttgattgatatt

SEQ ID NO: 636772 - DNA, 13 bp, D. melanogaster
gttgattgcattt

SEQ ID NO: 636773 - DNA, 13 bp, D. melanogaster
gttgatttaaacc

SEQ ID NO: 636774 - DNA, 14 bp, D. melanogaster
gttgatttcaattt

SEQ ID NO: 636775 - DNA, 13 bp, D. melanogaster
gttgatttgttga

SEQ ID NO: 636776 - DNA, 13 bp, D. melanogaster
gttgattttaaag

SEQ ID NO: 636777 - DNA, 13 bp, D. melanogaster
gttgattttgaaa

SEQ ID NO: 636778 - DNA, 13 bp, D. melanogaster
gttgcaaaaaaaa

SEQ ID NO: 636779 - DNA, 14 bp, D. melanogaster
gttgcaaaaaaaaa

SEQ ID NO: 636780 - DNA, 13 bp, D. melanogaster
gttgcaaaaattt

SEQ ID NO: 636781 - DNA, 13 bp, D. melanogaster
gttgcaaaacaaa

SEQ ID NO: 636782 - DNA, 13 bp, D. melanogaster
gttgcaaaagttt

SEQ ID NO: 636783 - DNA, 13 bp, D. melanogaster
gttgcaaactcta

SEQ ID NO: 636784 - DNA, 13 bp, D. melanogaster
gttgcaaataaaa

SEQ ID NO: 636785 - DNA, 13 bp, D. melanogaster
gttgcaaatcaaa

SEQ ID NO: 636786 - DNA, 13 bp, D. melanogaster
gttgcaaatgcaa

SEQ ID NO: 636787 - DNA, 13 bp, D. melanogaster
gttgcaaatgtgc

SEQ ID NO: 636788 - DNA, 13 bp, D. melanogaster
gttgcaaattaaa

SEQ ID NO: 636789 - DNA, 14 bp, D. melanogaster
gttgcaaattaaat

SEQ ID NO: 636790 - DNA, 13 bp, D. melanogaster
gttgcaacaacaa

SEQ ID NO: 636791 - DNA, 14 bp, D. melanogaster
gttgcaactgcaga

SEQ ID NO: 636792 - DNA, 13 bp, D. melanogaster
gttgcaactgctg

SEQ ID NO: 636793 - DNA, 13 bp, D. melanogaster
gttgcaacttttg

SEQ ID NO: 636794 - DNA, 14 bp, D. melanogaster
gttgcaagagaaaa

SEQ ID NO: 636795 - DNA, 13 bp, D. melanogaster
gttgcaagtgcaa

SEQ ID NO: 636796 - DNA, 14 bp, D. melanogaster
gttgcaagtgcaac

SEQ ID NO: 636797 - DNA, 13 bp, D. melanogaster
gttgcaagtgcag

SEQ ID NO: 636798 - DNA, 13 bp, D. melanogaster
gttgcaagtggaa

SEQ ID NO: 636799 - DNA, 13 bp, D. melanogaster
gttgcaagtggca

SEQ ID NO: 636800 - DNA, 13 bp, D. melanogaster
gttgcaagttgct

SEQ ID NO: 636801 - DNA, 13 bp, D. melanogaster
gttgcaatatttt

SEQ ID NO: 636802 - DNA, 13 bp, D. melanogaster
gttgcaattgctg

SEQ ID NO: 636803 - DNA, 14 bp, D. melanogaster
gttgcaattgttgc

SEQ ID NO: 636804 - DNA, 13 bp, D. melanogaster
gttgcacagcaca

SEQ ID NO: 636805 - DNA, 13 bp, D. melanogaster
gttgcaccgcact

SEQ ID NO: 636806 - DNA, 14 bp, D. melanogaster
gttgcacttgcaac

SEQ ID NO: 636807 - DNA, 13 bp, D. melanogaster
gttgcagattttc

SEQ ID NO: 636808 - DNA, 13 bp, D. melanogaster
gttgcagcaacat

SEQ ID NO: 636809 - DNA, 13 bp, D. melanogaster
gttgcagcagctg

SEQ ID NO: 636810 - DNA, 13 bp, D. melanogaster
gttgcagcagttg

SEQ ID NO: 636811 - DNA, 14 bp, D. melanogaster
gttgcagcagttgc

SEQ ID NO: 636812 - DNA, 13 bp, D. melanogaster
gttgcagccacaa

SEQ ID NO: 636813 - DNA, 13 bp, D. melanogaster
gttgcagccattt

SEQ ID NO: 636814 - DNA, 13 bp, D. melanogaster
gttgcagcggaaa

SEQ ID NO: 636815 - DNA, 13 bp, D. melanogaster
gttgcagctaatt

SEQ ID NO: 636816 - DNA, 13 bp, D. melanogaster
gttgcagctcctg

SEQ ID NO: 636817 - DNA, 14 bp, D. melanogaster
gttgcagctgctgc

SEQ ID NO: 636818 - DNA, 13 bp, D. melanogaster
gttgcagtcagtc

SEQ ID NO: 636819 - DNA, 13 bp, D. melanogaster
gttgcagtgcgac

SEQ ID NO: 636820 - DNA, 14 bp, D. melanogaster
gttgcagttgcaat

SEQ ID NO: 636821 - DNA, 14 bp, D. melanogaster
gttgcagttgcact

SEQ ID NO: 636822 - DNA, 13 bp, D. melanogaster
gttgcagttgcat

SEQ ID NO: 636823 - DNA, 13 bp, D. melanogaster
gttgcagttgcca

SEQ ID NO: 636824 - DNA, 13 bp, D. melanogaster
gttgcagttgcga

SEQ ID NO: 636825 - DNA, 13 bp, D. melanogaster
gttgcagttgctg

SEQ ID NO: 636826 - DNA, 13 bp, D. melanogaster
gttgcagttgttg

SEQ ID NO: 636827 - DNA, 14 bp, D. melanogaster
gttgcagttgttgc

SEQ ID NO: 636828 - DNA, 13 bp, D. melanogaster
gttgcagtttgaa

SEQ ID NO: 636829 - DNA, 13 bp, D. melanogaster
gttgcagttttac

SEQ ID NO: 636830 - DNA, 13 bp, D. melanogaster
gttgcagtttttt

SEQ ID NO: 636831 - DNA, 13 bp, D. melanogaster
gttgcataaatta

SEQ ID NO: 636832 - DNA, 13 bp, D. melanogaster
gttgcatactttt

SEQ ID NO: 636833 - DNA, 14 bp, D. melanogaster
gttgcatacttttg

SEQ ID NO: 636834 - DNA, 13 bp, D. melanogaster
gttgcatatgcaa

SEQ ID NO: 636835 - DNA, 13 bp, D. melanogaster
gttgcatatttat

SEQ ID NO: 636836 - DNA, 13 bp, D. melanogaster
gttgcatgcaaca

SEQ ID NO: 636837 - DNA, 13 bp, D. melanogaster
gttgcatgccaca

SEQ ID NO: 636838 - DNA, 13 bp, D. melanogaster
gttgcatgccgca

SEQ ID NO: 636839 - DNA, 13 bp, D. melanogaster
gttgcatgttgtt

SEQ ID NO: 636840 - DNA, 13 bp, D. melanogaster
gttgcattcgttt

SEQ ID NO: 636841 - DNA, 13 bp, D. melanogaster
gttgcattgcata

SEQ ID NO: 636842 - DNA, 13 bp, D. melanogaster
gttgcatttataa

SEQ ID NO: 636843 - DNA, 13 bp, D. melanogaster
gttgcatttatat

SEQ ID NO: 636844 - DNA, 13 bp, D. melanogaster
gttgcatttgctg

SEQ ID NO: 636845 - DNA, 13 bp, D. melanogaster
gttgcattttcct

SEQ ID NO: 636846 - DNA, 13 bp, D. melanogaster
gttgccaaacaaa

SEQ ID NO: 636847 - DNA, 13 bp, D. melanogaster
gttgccaaagaaa

SEQ ID NO: 636848 - DNA, 13 bp, D. melanogaster
gttgccaaatatt

SEQ ID NO: 636849 - DNA, 13 bp, D. melanogaster
gttgccaaattaa

SEQ ID NO: 636850 - DNA, 13 bp, D. melanogaster
gttgccaactgcc

SEQ ID NO: 636851 - DNA, 13 bp, D. melanogaster
gttgccaactttg

SEQ ID NO: 636852 - DNA, 13 bp, D. melanogaster
gttgccaatgttg

SEQ ID NO: 636853 - DNA, 13 bp, D. melanogaster
gttgccaattaaa

SEQ ID NO: 636854 - DNA, 13 bp, D. melanogaster
gttgccacaacaa

SEQ ID NO: 636855 - DNA, 14 bp, D. melanogaster
gttgccacgcccac

SEQ ID NO: 636856 - DNA, 14 bp, D. melanogaster
gttgccacgccccc

SEQ ID NO: 636857 - DNA, 13 bp, D. melanogaster
gttgccactgcaa

SEQ ID NO: 636858 - DNA, 13 bp, D. melanogaster
gttgccacttggc

SEQ ID NO: 636859 - DNA, 13 bp, D. melanogaster
gttgccagaatgt

SEQ ID NO: 636860 - DNA, 13 bp, D. melanogaster
gttgccagcaaca

SEQ ID NO: 636861 - DNA, 13 bp, D. melanogaster
gttgccagccaaa

SEQ ID NO: 636862 - DNA, 13 bp, D. melanogaster
gttgccaggacct

SEQ ID NO: 636863 - DNA, 13 bp, D. melanogaster
gttgccagttgca

SEQ ID NO: 636864 - DNA, 13 bp, D. melanogaster
gttgccagttggc

SEQ ID NO: 636865 - DNA, 13 bp, D. melanogaster
gttgccataccaa

SEQ ID NO: 636866 - DNA, 13 bp, D. melanogaster
gttgccatcaaaa

SEQ ID NO: 636867 - DNA, 13 bp, D. melanogaster
gttgccatgcaaa

SEQ ID NO: 636868 - DNA, 13 bp, D. melanogaster
gttgccatggcaa

SEQ ID NO: 636869 - DNA, 13 bp, D. melanogaster
gttgccattattt

SEQ ID NO: 636870 - DNA, 13 bp, D. melanogaster
gttgccattgcaa

SEQ ID NO: 636871 - DNA, 13 bp, D. melanogaster
gttgccattgccg

SEQ ID NO: 636872 - DNA, 13 bp, D. melanogaster
gttgccattgctg

SEQ ID NO: 636873 - DNA, 13 bp, D. melanogaster
gttgccattggca

SEQ ID NO: 636874 - DNA, 13 bp, D. melanogaster
gttgccatttatt

SEQ ID NO: 636875 - DNA, 13 bp, D. melanogaster
gttgccattttat

SEQ ID NO: 636876 - DNA, 13 bp, D. melanogaster
gttgccatttttg

SEQ ID NO: 636877 - DNA, 13 bp, D. melanogaster
gttgccccacagc

SEQ ID NO: 636878 - DNA, 13 bp, D. melanogaster
gttgcccttcatt

SEQ ID NO: 636879 - DNA, 13 bp, D. melanogaster
gttgccgccgctg

SEQ ID NO: 636880 - DNA, 14 bp, D. melanogaster
gttgccgccgctgc

SEQ ID NO: 636881 - DNA, 13 bp, D. melanogaster
gttgccgctgcaa

SEQ ID NO: 636882 - DNA, 13 bp, D. melanogaster
gttgccgctgcca

SEQ ID NO: 636883 - DNA, 13 bp, D. melanogaster
gttgccgctgccg

SEQ ID NO: 636884 - DNA, 14 bp, D. melanogaster
gttgccgctgccgc

SEQ ID NO: 636885 - DNA, 13 bp, D. melanogaster
gttgccgctgctc

SEQ ID NO: 636886 - DNA, 13 bp, D. melanogaster
gttgccgctgctt

SEQ ID NO: 636887 - DNA, 13 bp, D. melanogaster
gttgccgcttttc

SEQ ID NO: 636888 - DNA, 13 bp, D. melanogaster
gttgccgttgcca

SEQ ID NO: 636889 - DNA, 13 bp, D. melanogaster
gttgccgttgccg

SEQ ID NO: 636890 - DNA, 13 bp, D. melanogaster
gttgccgttgctg

SEQ ID NO: 636891 - DNA, 13 bp, D. melanogaster
gttgccgttgtcg

SEQ ID NO: 636892 - DNA, 15 bp, D. melanogaster
gttgcctaagtcttt

SEQ ID NO: 636893 - DNA, 13 bp, D. melanogaster
gttgcctactttt

SEQ ID NO: 636894 - DNA, 13 bp, D. melanogaster
gttgcctttgccg

SEQ ID NO: 636895 - DNA, 13 bp, D. melanogaster
gttgccttttgtg

SEQ ID NO: 636896 - DNA, 13 bp, D. melanogaster
gttgcgaaaaaaa

SEQ ID NO: 636897 - DNA, 13 bp, D. melanogaster
gttgcgcctgcgc

SEQ ID NO: 636898 - DNA, 13 bp, D. melanogaster
gttgcggctgctg

SEQ ID NO: 636899 - DNA, 14 bp, D. melanogaster
gttgcggctgctgc

SEQ ID NO: 636900 - DNA, 13 bp, D. melanogaster
gttgcgtcgagca

SEQ ID NO: 636901 - DNA, 13 bp, D. melanogaster
gttgctaaaaata

SEQ ID NO: 636902 - DNA, 13 bp, D. melanogaster
gttgctactgttg

SEQ ID NO: 636903 - DNA, 13 bp, D. melanogaster
gttgctattgcca

SEQ ID NO: 636904 - DNA, 13 bp, D. melanogaster
gttgctattgttg

SEQ ID NO: 636905 - DNA, 14 bp, D. melanogaster
gttgctattgttgc

SEQ ID NO: 636906 - DNA, 13 bp, D. melanogaster
gttgctatttttg

SEQ ID NO: 636907 - DNA, 13 bp, D. melanogaster
gttgctcagcgcc

SEQ ID NO: 636908 - DNA, 13 bp, D. melanogaster
gttgctcgaagca

SEQ ID NO: 636909 - DNA, 13 bp, D. melanogaster
gttgctcgatata

SEQ ID NO: 636910 - DNA, 13 bp, D. melanogaster
gttgctcgctttt

SEQ ID NO: 636911 - DNA, 13 bp, D. melanogaster
gttgctgatgctg

SEQ ID NO: 636912 - DNA, 14 bp, D. melanogaster
gttgctgatgctgc

SEQ ID NO: 636913 - DNA, 13 bp, D. melanogaster
gttgctgattttg

SEQ ID NO: 636914 - DNA, 13 bp, D. melanogaster
gttgctgcaacat

SEQ ID NO: 636915 - DNA, 14 bp, D. melanogaster
gttgctgcagctgc

SEQ ID NO: 636916 - DNA, 13 bp, D. melanogaster
gttgctgcagttg

SEQ ID NO: 636917 - DNA, 13 bp, D. melanogaster
gttgctgccgcag

SEQ ID NO: 636918 - DNA, 13 bp, D. melanogaster
gttgctgccgccg

SEQ ID NO: 636919 - DNA, 13 bp, D. melanogaster
gttgctgccgctg

SEQ ID NO: 636920 - DNA, 14 bp, D. melanogaster
gttgctgccgctgc

SEQ ID NO: 636921 - DNA, 14 bp, D. melanogaster
gttgctgccgctgt

SEQ ID NO: 636922 - DNA, 13 bp, D. melanogaster
gttgctgccgtgc

SEQ ID NO: 636923 - DNA, 13 bp, D. melanogaster
gttgctgccgttg

SEQ ID NO: 636924 - DNA, 14 bp, D. melanogaster
gttgctgccgttgc

SEQ ID NO: 636925 - DNA, 13 bp, D. melanogaster
gttgctgctattg

SEQ ID NO: 636926 - DNA, 13 bp, D. melanogaster
gttgctgctgatt

SEQ ID NO: 636927 - DNA, 14 bp, D. melanogaster
gttgctgctgattg

SEQ ID NO: 636928 - DNA, 13 bp, D. melanogaster
gttgctgctgcaa

SEQ ID NO: 636929 - DNA, 14 bp, D. melanogaster
gttgctgctgcaag

SEQ ID NO: 636930 - DNA, 14 bp, D. melanogaster
gttgctgctgcagc

SEQ ID NO: 636931 - DNA, 14 bp, D. melanogaster
gttgctgctgcagt

SEQ ID NO: 636932 - DNA, 13 bp, D. melanogaster
gttgctgctgccc

SEQ ID NO: 636933 - DNA, 13 bp, D. melanogaster
gttgctgctgccg

SEQ ID NO: 636934 - DNA, 14 bp, D. melanogaster
gttgctgctgccgc

SEQ ID NO: 636935 - DNA, 13 bp, D. melanogaster
gttgctgctgcgc

SEQ ID NO: 636936 - DNA, 13 bp, D. melanogaster
gttgctgctgcgt

SEQ ID NO: 636937 - DNA, 14 bp, D. melanogaster
gttgctgctgctgg

SEQ ID NO: 636938 - DNA, 14 bp, D. melanogaster
gttgctgctgctgt

SEQ ID NO: 636939 - DNA, 13 bp, D. melanogaster
gttgctgctgctt

SEQ ID NO: 636940 - DNA, 13 bp, D. melanogaster
gttgctgctggct

SEQ ID NO: 636941 - DNA, 14 bp, D. melanogaster
gttgctgctggctg

SEQ ID NO: 636942 - DNA, 13 bp, D. melanogaster
gttgctgctgggc

SEQ ID NO: 636943 - DNA, 13 bp, D. melanogaster
gttgctgctgtcg

SEQ ID NO: 636944 - DNA, 13 bp, D. melanogaster
gttgctgctgtgc

SEQ ID NO: 636945 - DNA, 14 bp, D. melanogaster
gttgctgctgtgct

SEQ ID NO: 636946 - DNA, 14 bp, D. melanogaster
gttgctgctgtggc

SEQ ID NO: 636947 - DNA, 13 bp, D. melanogaster
gttgctgctgtta

SEQ ID NO: 636948 - DNA, 15 bp, D. melanogaster
gttgctgcttctgct

SEQ ID NO: 636949 - DNA, 13 bp, D. melanogaster
gttgctgcttctt

SEQ ID NO: 636950 - DNA, 13 bp, D. melanogaster
gttgctgctttgc

SEQ ID NO: 636951 - DNA, 13 bp, D. melanogaster
gttgctggcgttg

SEQ ID NO: 636952 - DNA, 13 bp, D. melanogaster
gttgctggttgct

SEQ ID NO: 636953 - DNA, 14 bp, D. melanogaster
gttgctggttgctg

SEQ ID NO: 636954 - DNA, 13 bp, D. melanogaster
gttgctgttactg

SEQ ID NO: 636955 - DNA, 13 bp, D. melanogaster
gttgctgttgcaa

SEQ ID NO: 636956 - DNA, 13 bp, D. melanogaster
gttgctgttgcag

SEQ ID NO: 636957 - DNA, 13 bp, D. melanogaster
gttgctgttgcca

SEQ ID NO: 636958 - DNA, 13 bp, D. melanogaster
gttgctgttgctc

SEQ ID NO: 636959 - DNA, 14 bp, D. melanogaster
gttgctgttgctgg

SEQ ID NO: 636960 - DNA, 13 bp, D. melanogaster
gttgctgttgtca

SEQ ID NO: 636961 - DNA, 13 bp, D. melanogaster
gttgctgtttatt

SEQ ID NO: 636962 - DNA, 13 bp, D. melanogaster
gttgctgtttgct

SEQ ID NO: 636963 - DNA, 13 bp, D. melanogaster
gttgctttcgctg

SEQ ID NO: 636964 - DNA, 13 bp, D. melanogaster
gttgcttttattg

SEQ ID NO: 636965 - DNA, 13 bp, D. melanogaster
gttgcttttgccg

SEQ ID NO: 636966 - DNA, 13 bp, D. melanogaster
gttgcttttgctg

SEQ ID NO: 636967 - DNA, 14 bp, D. melanogaster
gttgcttttgctgc

SEQ ID NO: 636968 - DNA, 13 bp, D. melanogaster
gttggaaaaacaa

SEQ ID NO: 636969 - DNA, 13 bp, D. melanogaster
gttggaaaaactt

SEQ ID NO: 636970 - DNA, 14 bp, D. melanogaster
gttggaaaaataat

SEQ ID NO: 636971 - DNA, 13 bp, D. melanogaster
gttggaaaaatca

SEQ ID NO: 636972 - DNA, 13 bp, D. melanogaster
gttggaaaacatt

SEQ ID NO: 636973 - DNA, 13 bp, D. melanogaster
gttggaaaataaa

SEQ ID NO: 636974 - DNA, 13 bp, D. melanogaster
gttggaaaattat

SEQ ID NO: 636975 - DNA, 13 bp, D. melanogaster
gttggaaaatttg

SEQ ID NO: 636976 - DNA, 13 bp, D. melanogaster
gttggaaataaat

SEQ ID NO: 636977 - DNA, 13 bp, D. melanogaster
gttggaaatataa

SEQ ID NO: 636978 - DNA, 13 bp, D. melanogaster
gttggaaatgaaa

SEQ ID NO: 636979 - DNA, 13 bp, D. melanogaster
gttggaaattaaa

SEQ ID NO: 636980 - DNA, 14 bp, D. melanogaster
gttggacatctttt

SEQ ID NO: 636981 - DNA, 13 bp, D. melanogaster
gttggagatggag

SEQ ID NO: 636982 - DNA, 13 bp, D. melanogaster
gttggagctgaag

SEQ ID NO: 636983 - DNA, 13 bp, D. melanogaster
gttggagttccac

SEQ ID NO: 636984 - DNA, 13 bp, D. melanogaster
gttggagttgaag

SEQ ID NO: 636985 - DNA, 13 bp, D. melanogaster
gttggagttggag

SEQ ID NO: 636986 - DNA, 13 bp, D. melanogaster
gttggataatttg

SEQ ID NO: 636987 - DNA, 13 bp, D. melanogaster
gttggcaaaaagt

SEQ ID NO: 636988 - DNA, 13 bp, D. melanogaster
gttggcaaaaatg

SEQ ID NO: 636989 - DNA, 13 bp, D. melanogaster
gttggcaaaagtt

SEQ ID NO: 636990 - DNA, 13 bp, D. melanogaster
gttggcaaaatct

SEQ ID NO: 636991 - DNA, 13 bp, D. melanogaster
gttggcaaacttt

SEQ ID NO: 636992 - DNA, 13 bp, D. melanogaster
gttggcaaatgca

SEQ ID NO: 636993 - DNA, 13 bp, D. melanogaster
gttggcaaatgct

SEQ ID NO: 636994 - DNA, 13 bp, D. melanogaster
gttggcaaccctg

SEQ ID NO: 636995 - DNA, 13 bp, D. melanogaster
gttggcaataaaa

SEQ ID NO: 636996 - DNA, 13 bp, D. melanogaster
gttggcaatttgc

SEQ ID NO: 636997 - DNA, 13 bp, D. melanogaster
gttggcaatttgt

SEQ ID NO: 636998 - DNA, 13 bp, D. melanogaster
gttggcactactc

SEQ ID NO: 636999 - DNA, 13 bp, D. melanogaster
gttggcagcgctg

SEQ ID NO: 637000 - DNA, 13 bp, D. melanogaster
gttggcagctgca

SEQ ID NO: 637001 - DNA, 14 bp, D. melanogaster
gttggcagctggtg

SEQ ID NO: 637002 - DNA, 13 bp, D. melanogaster
gttggcagttgca

SEQ ID NO: 637003 - DNA, 13 bp, D. melanogaster
gttggcagttgcc

SEQ ID NO: 637004 - DNA, 13 bp, D. melanogaster
gttggcattaaaa

SEQ ID NO: 637005 - DNA, 13 bp, D. melanogaster
gttggcattcttg

SEQ ID NO: 637006 - DNA, 13 bp, D. melanogaster
gttggcattgttg

SEQ ID NO: 637007 - DNA, 13 bp, D. melanogaster
gttggcatttcat

SEQ ID NO: 637008 - DNA, 13 bp, D. melanogaster
gttggcatttttt

SEQ ID NO: 637009 - DNA, 13 bp, D. melanogaster
gttggccaaaaaa

SEQ ID NO: 637010 - DNA, 13 bp, D. melanogaster
gttggccaaaaag

SEQ ID NO: 637011 - DNA, 14 bp, D. melanogaster
gttggccaaaaagt

SEQ ID NO: 637012 - DNA, 14 bp, D. melanogaster
gttggccaaaaggg

SEQ ID NO: 637013 - DNA, 14 bp, D. melanogaster
gttggccaaaagtt

SEQ ID NO: 637014 - DNA, 13 bp, D. melanogaster
gttggccaaacaa

SEQ ID NO: 637015 - DNA, 14 bp, D. melanogaster
gttggccaaacaaa

SEQ ID NO: 637016 - DNA, 13 bp, D. melanogaster
gttggccaaaggg

SEQ ID NO: 637017 - DNA, 13 bp, D. melanogaster
gttggccaaataa

SEQ ID NO: 637018 - DNA, 13 bp, D. melanogaster
gttggccaaatgc

SEQ ID NO: 637019 - DNA, 13 bp, D. melanogaster
gttggccaaatgt

SEQ ID NO: 637020 - DNA, 13 bp, D. melanogaster
gttggccaacaaa

SEQ ID NO: 637021 - DNA, 13 bp, D. melanogaster
gttggccaacaac

SEQ ID NO: 637022 - DNA, 13 bp, D. melanogaster
gttggccaaccaa

SEQ ID NO: 637023 - DNA, 13 bp, D. melanogaster
gttggccaactgg

SEQ ID NO: 637024 - DNA, 13 bp, D. melanogaster
gttggccaagaaa

SEQ ID NO: 637025 - DNA, 13 bp, D. melanogaster
gttggccaagtga

SEQ ID NO: 637026 - DNA, 13 bp, D. melanogaster
gttggccaagtgg

SEQ ID NO: 637027 - DNA, 13 bp, D. melanogaster
gttggccaagtgt

SEQ ID NO: 637028 - DNA, 13 bp, D. melanogaster
gttggccacggcc

SEQ ID NO: 637029 - DNA, 13 bp, D. melanogaster
gttggccactttt

SEQ ID NO: 637030 - DNA, 13 bp, D. melanogaster
gttggccagctgg

SEQ ID NO: 637031 - DNA, 13 bp, D. melanogaster
gttggccaggaaa

SEQ ID NO: 637032 - DNA, 13 bp, D. melanogaster
gttggccaggcca

SEQ ID NO: 637033 - DNA, 14 bp, D. melanogaster
gttggccagtttcc

SEQ ID NO: 637034 - DNA, 13 bp, D. melanogaster
gttggccatcaaa

SEQ ID NO: 637035 - DNA, 13 bp, D. melanogaster
gttggccattggc

SEQ ID NO: 637036 - DNA, 13 bp, D. melanogaster
gttggccatttgg

SEQ ID NO: 637037 - DNA, 13 bp, D. melanogaster
gttggccatttgt

SEQ ID NO: 637038 - DNA, 13 bp, D. melanogaster
gttggcccaaaac

SEQ ID NO: 637039 - DNA, 13 bp, D. melanogaster
gttggcccatgga

SEQ ID NO: 637040 - DNA, 13 bp, D. melanogaster
gttggccctggaa

SEQ ID NO: 637041 - DNA, 13 bp, D. melanogaster
gttggccgtggag

SEQ ID NO: 637042 - DNA, 13 bp, D. melanogaster
gttggcctcgctt

SEQ ID NO: 637043 - DNA, 13 bp, D. melanogaster
gttggcctggcca

SEQ ID NO: 637044 - DNA, 13 bp, D. melanogaster
gttggcgaaaaaa

SEQ ID NO: 637045 - DNA, 13 bp, D. melanogaster
gttggctaattaa

SEQ ID NO: 637046 - DNA, 13 bp, D. melanogaster
gttggctactttc

SEQ ID NO: 637047 - DNA, 13 bp, D. melanogaster
gttggctataaaa

SEQ ID NO: 637048 - DNA, 13 bp, D. melanogaster
gttggctgctgct

SEQ ID NO: 637049 - DNA, 13 bp, D. melanogaster
gttggctgctggc

SEQ ID NO: 637050 - DNA, 13 bp, D. melanogaster
gttggctgggaaa

SEQ ID NO: 637051 - DNA, 13 bp, D. melanogaster
gttggcttaaaag

SEQ ID NO: 637052 - DNA, 13 bp, D. melanogaster
gttggcttggctg

SEQ ID NO: 637053 - DNA, 13 bp, D. melanogaster
gttggctttaatt

SEQ ID NO: 637054 - DNA, 13 bp, D. melanogaster
gttggctttgagt

SEQ ID NO: 637055 - DNA, 13 bp, D. melanogaster
gttggctttgggc

SEQ ID NO: 637056 - DNA, 13 bp, D. melanogaster
gttggcttttatg

SEQ ID NO: 637057 - DNA, 13 bp, D. melanogaster
gttgggaaaatct

SEQ ID NO: 637058 - DNA, 13 bp, D. melanogaster
gttgggaaaatgc

SEQ ID NO: 637059 - DNA, 13 bp, D. melanogaster
gttgggattgtaa

SEQ ID NO: 637060 - DNA, 14 bp, D. melanogaster
gttgggcaaacaaa

SEQ ID NO: 637061 - DNA, 13 bp, D. melanogaster
gttgggcaaacgt

SEQ ID NO: 637062 - DNA, 13 bp, D. melanogaster
gttgggccaaaaa

SEQ ID NO: 637063 - DNA, 13 bp, D. melanogaster
gttgggccaagaa

SEQ ID NO: 637064 - DNA, 13 bp, D. melanogaster
gttgggcgccaca

SEQ ID NO: 637065 - DNA, 13 bp, D. melanogaster
gttgggctctgaa

SEQ ID NO: 637066 - DNA, 13 bp, D. melanogaster
gttggggatctgg

SEQ ID NO: 637067 - DNA, 13 bp, D. melanogaster
gttgggtaaacaa

SEQ ID NO: 637068 - DNA, 13 bp, D. melanogaster
gttgggtggaaaa

SEQ ID NO: 637069 - DNA, 14 bp, D. melanogaster
gttggtaaaaaaaa

SEQ ID NO: 637070 - DNA, 13 bp, D. melanogaster
gttggtaaacaaa

SEQ ID NO: 637071 - DNA, 13 bp, D. melanogaster
gttggtgaaggtc

SEQ ID NO: 637072 - DNA, 14 bp, D. melanogaster
gttggtgctgctgc

SEQ ID NO: 637073 - DNA, 13 bp, D. melanogaster
gttggttacttca

SEQ ID NO: 637074 - DNA, 13 bp, D. melanogaster
gttggtttataaa

SEQ ID NO: 637075 - DNA, 14 bp, D. melanogaster
gttggtttcattaa

SEQ ID NO: 637076 - DNA, 13 bp, D. melanogaster
gttgtaaaaagca

SEQ ID NO: 637077 - DNA, 13 bp, D. melanogaster
gttgtaaaaatgt

SEQ ID NO: 637078 - DNA, 13 bp, D. melanogaster
gttgtaaaataaa

SEQ ID NO: 637079 - DNA, 13 bp, D. melanogaster
gttgtaaaatatt

SEQ ID NO: 637080 - DNA, 13 bp, D. melanogaster
gttgtaaatgttt

SEQ ID NO: 637081 - DNA, 13 bp, D. melanogaster
gttgtaaattaaa

SEQ ID NO: 637082 - DNA, 13 bp, D. melanogaster
gttgtacaattat

SEQ ID NO: 637083 - DNA, 13 bp, D. melanogaster
gttgtacatatgt

SEQ ID NO: 637084 - DNA, 13 bp, D. melanogaster
gttgtaccttttt

SEQ ID NO: 637085 - DNA, 13 bp, D. melanogaster
gttgtactcatat

SEQ ID NO: 637086 - DNA, 13 bp, D. melanogaster
gttgtagttgcag

SEQ ID NO: 637087 - DNA, 13 bp, D. melanogaster
gttgtagttgctt

SEQ ID NO: 637088 - DNA, 13 bp, D. melanogaster
gttgtagttgtag

SEQ ID NO: 637089 - DNA, 14 bp, D. melanogaster
gttgtagttgtagt

SEQ ID NO: 637090 - DNA, 13 bp, D. melanogaster
gttgtataattta

SEQ ID NO: 637091 - DNA, 13 bp, D. melanogaster
gttgtatacatca

SEQ ID NO: 637092 - DNA, 13 bp, D. melanogaster
gttgtatgtatgt

SEQ ID NO: 637093 - DNA, 14 bp, D. melanogaster
gttgtatgtatgta

SEQ ID NO: 637094 - DNA, 13 bp, D. melanogaster
gttgtcaaaaatt

SEQ ID NO: 637095 - DNA, 13 bp, D. melanogaster
gttgtcaagaaaa

SEQ ID NO: 637096 - DNA, 13 bp, D. melanogaster
gttgtcaagtttc

SEQ ID NO: 637097 - DNA, 14 bp, D. melanogaster
gttgtcaagtttct

SEQ ID NO: 637098 - DNA, 13 bp, D. melanogaster
gttgtcatttgtt

SEQ ID NO: 637099 - DNA, 13 bp, D. melanogaster
gttgtccaagatt

SEQ ID NO: 637100 - DNA, 13 bp, D. melanogaster
gttgtcgatgcgg

SEQ ID NO: 637101 - DNA, 13 bp, D. melanogaster
gttgtcgctgctg

SEQ ID NO: 637102 - DNA, 13 bp, D. melanogaster
gttgtcgctgtcg

SEQ ID NO: 637103 - DNA, 13 bp, D. melanogaster
gttgtcgctgttt

SEQ ID NO: 637104 - DNA, 13 bp, D. melanogaster
gttgtcgtcatcg

SEQ ID NO: 637105 - DNA, 13 bp, D. melanogaster
gttgtcgtcgtcg

SEQ ID NO: 637106 - DNA, 14 bp, D. melanogaster
gttgtcgtcgtcgt

SEQ ID NO: 637107 - DNA, 13 bp, D. melanogaster
gttgtcgtcgttg

SEQ ID NO: 637108 - DNA, 13 bp, D. melanogaster
gttgtcgttgctg

SEQ ID NO: 637109 - DNA, 13 bp, D. melanogaster
gttgtcgttgtcg

SEQ ID NO: 637110 - DNA, 14 bp, D. melanogaster
gttgtcgttgtcgc

SEQ ID NO: 637111 - DNA, 14 bp, D. melanogaster
gttgtgacattttt

SEQ ID NO: 637112 - DNA, 13 bp, D. melanogaster
gttgtgcaaactg

SEQ ID NO: 637113 - DNA, 13 bp, D. melanogaster
gttgtgcaatttt

SEQ ID NO: 637114 - DNA, 13 bp, D. melanogaster
gttgtgcatattt

SEQ ID NO: 637115 - DNA, 13 bp, D. melanogaster
gttgtgcgtggct

SEQ ID NO: 637116 - DNA, 13 bp, D. melanogaster
gttgtgcttaatt

SEQ ID NO: 637117 - DNA, 13 bp, D. melanogaster
gttgtggaaaacg

SEQ ID NO: 637118 - DNA, 13 bp, D. melanogaster
gttgtggataaaa

SEQ ID NO: 637119 - DNA, 13 bp, D. melanogaster
gttgtggcaaaaa

SEQ ID NO: 637120 - DNA, 13 bp, D. melanogaster
gttgtggctgcca

SEQ ID NO: 637121 - DNA, 13 bp, D. melanogaster
gttgtggctgctg

SEQ ID NO: 637122 - DNA, 13 bp, D. melanogaster
gttgtgtgcgcac

SEQ ID NO: 637123 - DNA, 13 bp, D. melanogaster
gttgtgtgtctaa

SEQ ID NO: 637124 - DNA, 13 bp, D. melanogaster
gttgttaaaaaaa

SEQ ID NO: 637125 - DNA, 14 bp, D. melanogaster
gttgttaaatatat

SEQ ID NO: 637126 - DNA, 13 bp, D. melanogaster
gttgttaaatatt

SEQ ID NO: 637127 - DNA, 13 bp, D. melanogaster
gttgttaacaaaa

SEQ ID NO: 637128 - DNA, 13 bp, D. melanogaster
gttgttaacattt

SEQ ID NO: 637129 - DNA, 13 bp, D. melanogaster
gttgttaactttt

SEQ ID NO: 637130 - DNA, 13 bp, D. melanogaster
gttgttaataaat

SEQ ID NO: 637131 - DNA, 13 bp, D. melanogaster
gttgttatgcaaa

SEQ ID NO: 637132 - DNA, 13 bp, D. melanogaster
gttgttattgctg

SEQ ID NO: 637133 - DNA, 14 bp, D. melanogaster
gttgttattgctgc

SEQ ID NO: 637134 - DNA, 13 bp, D. melanogaster
gttgttattgtcg

SEQ ID NO: 637135 - DNA, 14 bp, D. melanogaster
gttgttattgttgc

SEQ ID NO: 637136 - DNA, 13 bp, D. melanogaster
gttgttcatttgt

SEQ ID NO: 637137 - DNA, 13 bp, D. melanogaster
gttgttcctgctg

SEQ ID NO: 637138 - DNA, 13 bp, D. melanogaster
gttgttccttgag

SEQ ID NO: 637139 - DNA, 13 bp, D. melanogaster
gttgttctcttta

SEQ ID NO: 637140 - DNA, 13 bp, D. melanogaster
gttgttgaccatt

SEQ ID NO: 637141 - DNA, 13 bp, D. melanogaster
gttgttgatgatg

SEQ ID NO: 637142 - DNA, 13 bp, D. melanogaster
gttgttgattgat

SEQ ID NO: 637143 - DNA, 13 bp, D. melanogaster
gttgttgcaacaa

SEQ ID NO: 637144 - DNA, 13 bp, D. melanogaster
gttgttgcattgt

SEQ ID NO: 637145 - DNA, 13 bp, D. melanogaster
gttgttgccactt

SEQ ID NO: 637146 - DNA, 13 bp, D. melanogaster
gttgttgccagcc

SEQ ID NO: 637147 - DNA, 13 bp, D. melanogaster
gttgttgccgttg

SEQ ID NO: 637148 - DNA, 13 bp, D. melanogaster
gttgttgcctttg

SEQ ID NO: 637149 - DNA, 13 bp, D. melanogaster
gttgttgctatta

SEQ ID NO: 637150 - DNA, 13 bp, D. melanogaster
gttgttgctcttc

SEQ ID NO: 637151 - DNA, 13 bp, D. melanogaster
gttgttgctgcca

SEQ ID NO: 637152 - DNA, 14 bp, D. melanogaster
gttgttgctgccac

SEQ ID NO: 637153 - DNA, 13 bp, D. melanogaster
gttgttgctgcct

SEQ ID NO: 637154 - DNA, 13 bp, D. melanogaster
gttgttgctgcta

SEQ ID NO: 637155 - DNA, 13 bp, D. melanogaster
gttgttgctgctc

SEQ ID NO: 637156 - DNA, 13 bp, D. melanogaster
gttgttgctgctt

SEQ ID NO: 637157 - DNA, 13 bp, D. melanogaster
gttgttgctggcg

SEQ ID NO: 637158 - DNA, 13 bp, D. melanogaster
gttgttgctgtcg

SEQ ID NO: 637159 - DNA, 14 bp, D. melanogaster
gttgttgctgtcgt

SEQ ID NO: 637160 - DNA, 13 bp, D. melanogaster
gttgttggcattg

SEQ ID NO: 637161 - DNA, 13 bp, D. melanogaster
gttgttggccaaa

SEQ ID NO: 637162 - DNA, 13 bp, D. melanogaster
gttgttggccagg

SEQ ID NO: 637163 - DNA, 14 bp, D. melanogaster
gttgttggctttga

SEQ ID NO: 637164 - DNA, 13 bp, D. melanogaster
gttgttgtaattg

SEQ ID NO: 637165 - DNA, 13 bp, D. melanogaster
gttgttgtagctg

SEQ ID NO: 637166 - DNA, 13 bp, D. melanogaster
gttgttgtcgatg

SEQ ID NO: 637167 - DNA, 13 bp, D. melanogaster
gttgttgtgctgc

SEQ ID NO: 637168 - DNA, 13 bp, D. melanogaster
gttgttgttactg

SEQ ID NO: 637169 - DNA, 13 bp, D. melanogaster
gttgttgttgaaa

SEQ ID NO: 637170 - DNA, 13 bp, D. melanogaster
gttgttgttgata

SEQ ID NO: 637171 - DNA, 13 bp, D. melanogaster
gttgttgttgcca

SEQ ID NO: 637172 - DNA, 14 bp, D. melanogaster
gttgttgttgccgc

SEQ ID NO: 637173 - DNA, 14 bp, D. melanogaster
gttgttgttgcctg

SEQ ID NO: 637174 - DNA, 13 bp, D. melanogaster
gttgttgttgcgc

SEQ ID NO: 637175 - DNA, 14 bp, D. melanogaster
gttgttgttgctat

SEQ ID NO: 637176 - DNA, 14 bp, D. melanogaster
gttgttgttgctga

SEQ ID NO: 637177 - DNA, 13 bp, D. melanogaster
gttgttgttggcc

SEQ ID NO: 637178 - DNA, 13 bp, D. melanogaster
gttgttgttgtca

SEQ ID NO: 637179 - DNA, 13 bp, D. melanogaster
gttgttgtttcgc

SEQ ID NO: 637180 - DNA, 13 bp, D. melanogaster
gttgttgtttgcc

SEQ ID NO: 637181 - DNA, 14 bp, D. melanogaster
gttgtttaaaaatt

SEQ ID NO: 637182 - DNA, 13 bp, D. melanogaster
gttgtttcagttg

SEQ ID NO: 637183 - DNA, 13 bp, D. melanogaster
gttgtttcggcag

SEQ ID NO: 637184 - DNA, 13 bp, D. melanogaster
gttgtttctgctg

SEQ ID NO: 637185 - DNA, 13 bp, D. melanogaster
gttgtttggccag

SEQ ID NO: 637186 - DNA, 13 bp, D. melanogaster
gttgtttgtggcc

SEQ ID NO: 637187 - DNA, 13 bp, D. melanogaster
gttgttttaaaaa

SEQ ID NO: 637188 - DNA, 13 bp, D. melanogaster
gttgttttcaaat

SEQ ID NO: 637189 - DNA, 13 bp, D. melanogaster
gttgttttcagtt

SEQ ID NO: 637190 - DNA, 13 bp, D. melanogaster
gttgttttgctgc

SEQ ID NO: 637191 - DNA, 13 bp, D. melanogaster
gttgtttttggcc

SEQ ID NO: 637192 - DNA, 13 bp, D. melanogaster
gtttaaaaaacat

SEQ ID NO: 637193 - DNA, 14 bp, D. melanogaster
gtttaaaaaacatt

SEQ ID NO: 637194 - DNA, 13 bp, D. melanogaster
gtttaaaaacaaa

SEQ ID NO: 637195 - DNA, 13 bp, D. melanogaster
gtttaaaaatagc

SEQ ID NO: 637196 - DNA, 14 bp, D. melanogaster
gtttaaaaatagcc

SEQ ID NO: 637197 - DNA, 13 bp, D. melanogaster
gtttaaaaatgta

SEQ ID NO: 637198 - DNA, 13 bp, D. melanogaster
gtttaaaagtatg

SEQ ID NO: 637199 - DNA, 13 bp, D. melanogaster
gtttaaaagtgaa

SEQ ID NO: 637200 - DNA, 13 bp, D. melanogaster
gtttaaaagtgtg

SEQ ID NO: 637201 - DNA, 14 bp, D. melanogaster
gtttaaaataagtt

SEQ ID NO: 637202 - DNA, 13 bp, D. melanogaster
gtttaaaataatc

SEQ ID NO: 637203 - DNA, 13 bp, D. melanogaster
gtttaaaatcaaa

SEQ ID NO: 637204 - DNA, 13 bp, D. melanogaster
gtttaaaatgcaa

SEQ ID NO: 637205 - DNA, 13 bp, D. melanogaster
gtttaaaatgctt

SEQ ID NO: 637206 - DNA, 13 bp, D. melanogaster
gtttaaaatgtgt

SEQ ID NO: 637207 - DNA, 13 bp, D. melanogaster
gtttaaaatgttt

SEQ ID NO: 637208 - DNA, 13 bp, D. melanogaster
gtttaaaattcat

SEQ ID NO: 637209 - DNA, 13 bp, D. melanogaster
gtttaaacaaaaa

SEQ ID NO: 637210 - DNA, 13 bp, D. melanogaster
gtttaaacaaatg

SEQ ID NO: 637211 - DNA, 13 bp, D. melanogaster
gtttaaacaagtc

SEQ ID NO: 637212 - DNA, 13 bp, D. melanogaster
gtttaaacttaaa

SEQ ID NO: 637213 - DNA, 13 bp, D. melanogaster
gtttaaagaaata

SEQ ID NO: 637214 - DNA, 13 bp, D. melanogaster
gtttaaagattaa

SEQ ID NO: 637215 - DNA, 13 bp, D. melanogaster
gtttaaagtaaac

SEQ ID NO: 637216 - DNA, 13 bp, D. melanogaster
gtttaaagttcta

SEQ ID NO: 637217 - DNA, 13 bp, D. melanogaster
gtttaaagtttaa

SEQ ID NO: 637218 - DNA, 13 bp, D. melanogaster
gtttaaataatag

SEQ ID NO: 637219 - DNA, 13 bp, D. melanogaster
gtttaaataattc

SEQ ID NO: 637220 - DNA, 13 bp, D. melanogaster
gtttaaatataga

SEQ ID NO: 637221 - DNA, 13 bp, D. melanogaster
gtttaaatattca

SEQ ID NO: 637222 - DNA, 13 bp, D. melanogaster
gtttaaatgattt

SEQ ID NO: 637223 - DNA, 13 bp, D. melanogaster
gtttaaattaaac

SEQ ID NO: 637224 - DNA, 13 bp, D. melanogaster
gtttaaattgata

SEQ ID NO: 637225 - DNA, 13 bp, D. melanogaster
gtttaaatttcaa

SEQ ID NO: 637226 - DNA, 13 bp, D. melanogaster
gtttaaatttgta

SEQ ID NO: 637227 - DNA, 13 bp, D. melanogaster
gtttaacaacgaa

SEQ ID NO: 637228 - DNA, 13 bp, D. melanogaster
gtttaacaagttc

SEQ ID NO: 637229 - DNA, 13 bp, D. melanogaster
gtttaacattgtt

SEQ ID NO: 637230 - DNA, 13 bp, D. melanogaster
gtttaactttcac

SEQ ID NO: 637231 - DNA, 13 bp, D. melanogaster
gtttaactttctt

SEQ ID NO: 637232 - DNA, 13 bp, D. melanogaster
gtttaactttttg

SEQ ID NO: 637233 - DNA, 13 bp, D. melanogaster
gtttaagatttta

SEQ ID NO: 637234 - DNA, 13 bp, D. melanogaster
gtttaagcaaata

SEQ ID NO: 637235 - DNA, 13 bp, D. melanogaster
gtttaagcaattt

SEQ ID NO: 637236 - DNA, 13 bp, D. melanogaster
gtttaagccaaaa

SEQ ID NO: 637237 - DNA, 13 bp, D. melanogaster
gtttaagctttaa

SEQ ID NO: 637238 - DNA, 13 bp, D. melanogaster
gtttaaggttcag

SEQ ID NO: 637239 - DNA, 13 bp, D. melanogaster
gtttaagtttaag

SEQ ID NO: 637240 - DNA, 13 bp, D. melanogaster
gtttaataacaat

SEQ ID NO: 637241 - DNA, 13 bp, D. melanogaster
gtttaatatgcaa

SEQ ID NO: 637242 - DNA, 13 bp, D. melanogaster
gtttaatatgcat

SEQ ID NO: 637243 - DNA, 13 bp, D. melanogaster
gtttaatgaaata

SEQ ID NO: 637244 - DNA, 13 bp, D. melanogaster
gtttaatgcaaaa

SEQ ID NO: 637245 - DNA, 13 bp, D. melanogaster
gtttaatgtacat

SEQ ID NO: 637246 - DNA, 14 bp, D. melanogaster
gtttaattaaaaac

SEQ ID NO: 637247 - DNA, 13 bp, D. melanogaster
gtttaattaaaac

SEQ ID NO: 637248 - DNA, 13 bp, D. melanogaster
gtttaattaaagt

SEQ ID NO: 637249 - DNA, 13 bp, D. melanogaster
gtttaatttcatt

SEQ ID NO: 637250 - DNA, 13 bp, D. melanogaster
gtttaatttgaaa

SEQ ID NO: 637251 - DNA, 13 bp, D. melanogaster
gtttaatttgctg

SEQ ID NO: 637252 - DNA, 14 bp, D. melanogaster
gtttaattttatgg

SEQ ID NO: 637253 - DNA, 13 bp, D. melanogaster
gtttacaaaaaaa

SEQ ID NO: 637254 - DNA, 13 bp, D. melanogaster
gtttacaaaacaa

SEQ ID NO: 637255 - DNA, 13 bp, D. melanogaster
gtttacaaaacta

SEQ ID NO: 637256 - DNA, 13 bp, D. melanogaster
gtttacaaaattt

SEQ ID NO: 637257 - DNA, 13 bp, D. melanogaster
gtttacaaacaaa

SEQ ID NO: 637258 - DNA, 13 bp, D. melanogaster
gtttacaactttt

SEQ ID NO: 637259 - DNA, 13 bp, D. melanogaster
gtttacaattaaa

SEQ ID NO: 637260 - DNA, 13 bp, D. melanogaster
gtttacacactgt

SEQ ID NO: 637261 - DNA, 13 bp, D. melanogaster
gtttacagaagtt

SEQ ID NO: 637262 - DNA, 13 bp, D. melanogaster
gtttacagaattc

SEQ ID NO: 637263 - DNA, 13 bp, D. melanogaster
gtttacatatttt

SEQ ID NO: 637264 - DNA, 13 bp, D. melanogaster
gtttacattattt

SEQ ID NO: 637265 - DNA, 13 bp, D. melanogaster
gtttacatttaaa

SEQ ID NO: 637266 - DNA, 13 bp, D. melanogaster
gtttacattttga

SEQ ID NO: 637267 - DNA, 13 bp, D. melanogaster
gtttacattttta

SEQ ID NO: 637268 - DNA, 13 bp, D. melanogaster
gtttaccaaaaat

SEQ ID NO: 637269 - DNA, 14 bp, D. melanogaster
gtttaccaaatgaa

SEQ ID NO: 637270 - DNA, 13 bp, D. melanogaster
gtttaccatttaa

SEQ ID NO: 637271 - DNA, 13 bp, D. melanogaster
gtttacctgaatg

SEQ ID NO: 637272 - DNA, 13 bp, D. melanogaster
gtttacctgcggc

SEQ ID NO: 637273 - DNA, 13 bp, D. melanogaster
gtttaccttttgc

SEQ ID NO: 637274 - DNA, 13 bp, D. melanogaster
gtttacgacaagt

SEQ ID NO: 637275 - DNA, 13 bp, D. melanogaster
gtttacgatatga

SEQ ID NO: 637276 - DNA, 13 bp, D. melanogaster
gtttacttaatta

SEQ ID NO: 637277 - DNA, 14 bp, D. melanogaster
gtttacttacaggt

SEQ ID NO: 637278 - DNA, 13 bp, D. melanogaster
gtttacttcttct

SEQ ID NO: 637279 - DNA, 13 bp, D. melanogaster
gtttactttaaaa

SEQ ID NO: 637280 - DNA, 13 bp, D. melanogaster
gtttactttaaat

SEQ ID NO: 637281 - DNA, 13 bp, D. melanogaster
gtttactttgctg

SEQ ID NO: 637282 - DNA, 13 bp, D. melanogaster
gtttacttttagt

SEQ ID NO: 637283 - DNA, 14 bp, D. melanogaster
gtttacttttattc

SEQ ID NO: 637284 - DNA, 13 bp, D. melanogaster
gtttacttttcac

SEQ ID NO: 637285 - DNA, 13 bp, D. melanogaster
gtttactttttac

SEQ ID NO: 637286 - DNA, 14 bp, D. melanogaster
gtttagccttgtcc

SEQ ID NO: 637287 - DNA, 13 bp, D. melanogaster
gtttagcgatatt

SEQ ID NO: 637288 - DNA, 13 bp, D. melanogaster
gtttagtaaatat

SEQ ID NO: 637289 - DNA, 13 bp, D. melanogaster
gtttagtgaaaca

SEQ ID NO: 637290 - DNA, 13 bp, D. melanogaster
gtttagtttgagg

SEQ ID NO: 637291 - DNA, 13 bp, D. melanogaster
gtttagttttccc

SEQ ID NO: 637292 - DNA, 13 bp, D. melanogaster
gtttagttttgaa

SEQ ID NO: 637293 - DNA, 13 bp, D. melanogaster
gtttataaaacaa

SEQ ID NO: 637294 - DNA, 13 bp, D. melanogaster
gtttataaaagaa

SEQ ID NO: 637295 - DNA, 13 bp, D. melanogaster
gtttataaacatt

SEQ ID NO: 637296 - DNA, 13 bp, D. melanogaster
gtttataaactgt

SEQ ID NO: 637297 - DNA, 13 bp, D. melanogaster
gtttataaatatg

SEQ ID NO: 637298 - DNA, 13 bp, D. melanogaster
gtttataattcaa

SEQ ID NO: 637299 - DNA, 13 bp, D. melanogaster
gtttatacaattt

SEQ ID NO: 637300 - DNA, 13 bp, D. melanogaster
gtttatataccct

SEQ ID NO: 637301 - DNA, 13 bp, D. melanogaster
gtttatatataga

SEQ ID NO: 637302 - DNA, 13 bp, D. melanogaster
gtttatatattct

SEQ ID NO: 637303 - DNA, 13 bp, D. melanogaster
gtttatatttcaa

SEQ ID NO: 637304 - DNA, 13 bp, D. melanogaster
gtttatctacctc

SEQ ID NO: 637305 - DNA, 13 bp, D. melanogaster
gtttatctattta

SEQ ID NO: 637306 - DNA, 13 bp, D. melanogaster
gtttatgattttc

SEQ ID NO: 637307 - DNA, 13 bp, D. melanogaster
gtttatgcaaatt

SEQ ID NO: 637308 - DNA, 13 bp, D. melanogaster
gtttatggtaaaa

SEQ ID NO: 637309 - DNA, 13 bp, D. melanogaster
gtttatgtttgcc

SEQ ID NO: 637310 - DNA, 13 bp, D. melanogaster
gtttattaaaatc

SEQ ID NO: 637311 - DNA, 13 bp, D. melanogaster
gtttattaaaatg

SEQ ID NO: 637312 - DNA, 14 bp, D. melanogaster
gtttattaaacatt

SEQ ID NO: 637313 - DNA, 14 bp, D. melanogaster
gtttattaattaca

SEQ ID NO: 637314 - DNA, 13 bp, D. melanogaster
gtttattacaaaa

SEQ ID NO: 637315 - DNA, 13 bp, D. melanogaster
gtttattatgcaa

SEQ ID NO: 637316 - DNA, 13 bp, D. melanogaster
gtttattcattta

SEQ ID NO: 637317 - DNA, 13 bp, D. melanogaster
gtttattgaagct

SEQ ID NO: 637318 - DNA, 13 bp, D. melanogaster
gtttattgaattc

SEQ ID NO: 637319 - DNA, 13 bp, D. melanogaster
gtttattgcaaaa

SEQ ID NO: 637320 - DNA, 13 bp, D. melanogaster
gtttattgcaaat

SEQ ID NO: 637321 - DNA, 14 bp, D. melanogaster
gtttattgcaattt

SEQ ID NO: 637322 - DNA, 14 bp, D. melanogaster
gtttattgctgggc

SEQ ID NO: 637323 - DNA, 13 bp, D. melanogaster
gtttattggcagt

SEQ ID NO: 637324 - DNA, 13 bp, D. melanogaster
gtttattgtaaat

SEQ ID NO: 637325 - DNA, 13 bp, D. melanogaster
gtttatttaaatg

SEQ ID NO: 637326 - DNA, 13 bp, D. melanogaster
gtttatttaactt

SEQ ID NO: 637327 - DNA, 14 bp, D. melanogaster
gtttatttactatt

SEQ ID NO: 637328 - DNA, 13 bp, D. melanogaster
gtttatttataga

SEQ ID NO: 637329 - DNA, 13 bp, D. melanogaster
gtttatttcccaa

SEQ ID NO: 637330 - DNA, 13 bp, D. melanogaster
gtttatttcgatt

SEQ ID NO: 637331 - DNA, 13 bp, D. melanogaster
gtttatttgctta

SEQ ID NO: 637332 - DNA, 13 bp, D. melanogaster
gtttatttggaat

SEQ ID NO: 637333 - DNA, 13 bp, D. melanogaster
gtttattttaaac

SEQ ID NO: 637334 - DNA, 13 bp, D. melanogaster
gtttattttcaaa

SEQ ID NO: 637335 - DNA, 13 bp, D. melanogaster
gtttattttgcaa

SEQ ID NO: 637336 - DNA, 13 bp, D. melanogaster
gtttattttgcca

SEQ ID NO: 637337 - DNA, 13 bp, D. melanogaster
gtttattttggca

SEQ ID NO: 637338 - DNA, 13 bp, D. melanogaster
gtttattttggct

SEQ ID NO: 637339 - DNA, 13 bp, D. melanogaster
gtttcaaaaacaa

SEQ ID NO: 637340 - DNA, 13 bp, D. melanogaster
gtttcaaaaactt

SEQ ID NO: 637341 - DNA, 13 bp, D. melanogaster
gtttcaaaaataa

SEQ ID NO: 637342 - DNA, 13 bp, D. melanogaster
gtttcaaagattt

SEQ ID NO: 637343 - DNA, 19 bp, D. melanogaster
gtttcaaaggctaagctaa

SEQ ID NO: 637344 - DNA, 13 bp, D. melanogaster
gtttcaaatattt

SEQ ID NO: 637345 - DNA, 13 bp, D. melanogaster
gtttcaaattaaa

SEQ ID NO: 637346 - DNA, 13 bp, D. melanogaster
gtttcaaattcaa

SEQ ID NO: 637347 - DNA, 13 bp, D. melanogaster
gtttcaaattgaa

SEQ ID NO: 637348 - DNA, 13 bp, D. melanogaster
gtttcaagatttt

SEQ ID NO: 637349 - DNA, 13 bp, D. melanogaster
gtttcaagtattt

SEQ ID NO: 637350 - DNA, 13 bp, D. melanogaster
gtttcaagtttca

SEQ ID NO: 637351 - DNA, 14 bp, D. melanogaster
gtttcaattgcctc

SEQ ID NO: 637352 - DNA, 13 bp, D. melanogaster
gtttcaatttaaa

SEQ ID NO: 637353 - DNA, 13 bp, D. melanogaster
gtttcaatttaat

SEQ ID NO: 637354 - DNA, 13 bp, D. melanogaster
gtttcaatttcaa

SEQ ID NO: 637355 - DNA, 14 bp, D. melanogaster
gtttcaatttcaat

SEQ ID NO: 637356 - DNA, 13 bp, D. melanogaster
gtttcaatttcga

SEQ ID NO: 637357 - DNA, 13 bp, D. melanogaster
gtttcaatttctc

SEQ ID NO: 637358 - DNA, 13 bp, D. melanogaster
gtttcaatttgtt

SEQ ID NO: 637359 - DNA, 13 bp, D. melanogaster
gtttcacaagaag

SEQ ID NO: 637360 - DNA, 13 bp, D. melanogaster
gtttcacaatgca

SEQ ID NO: 637361 - DNA, 13 bp, D. melanogaster
gtttcactaaagt

SEQ ID NO: 637362 - DNA, 13 bp, D. melanogaster
gtttcagattcag

SEQ ID NO: 637363 - DNA, 13 bp, D. melanogaster
gtttcagccattt

SEQ ID NO: 637364 - DNA, 14 bp, D. melanogaster
gtttcaggaaaact

SEQ ID NO: 637365 - DNA, 13 bp, D. melanogaster
gtttcagtatctg

SEQ ID NO: 637366 - DNA, 14 bp, D. melanogaster
gtttcagttcagtt

SEQ ID NO: 637367 - DNA, 13 bp, D. melanogaster
gtttcagttgcat

SEQ ID NO: 637368 - DNA, 13 bp, D. melanogaster
gtttcagttgttt

SEQ ID NO: 637369 - DNA, 13 bp, D. melanogaster
gtttcagtttaat

SEQ ID NO: 637370 - DNA, 13 bp, D. melanogaster
gtttcagtttcgg

SEQ ID NO: 637371 - DNA, 13 bp, D. melanogaster
gtttcagtttctg

SEQ ID NO: 637372 - DNA, 14 bp, D. melanogaster
gtttcagtttctgt

SEQ ID NO: 637373 - DNA, 13 bp, D. melanogaster
gtttcagttttgt

SEQ ID NO: 637374 - DNA, 13 bp, D. melanogaster
gtttcataaacaa

SEQ ID NO: 637375 - DNA, 13 bp, D. melanogaster
gtttcatactttt

SEQ ID NO: 637376 - DNA, 13 bp, D. melanogaster
gtttcattaaaaa

SEQ ID NO: 637377 - DNA, 13 bp, D. melanogaster
gtttcattgtcaa

SEQ ID NO: 637378 - DNA, 13 bp, D. melanogaster
gtttcatttcaat

SEQ ID NO: 637379 - DNA, 13 bp, D. melanogaster
gtttcatttcact

SEQ ID NO: 637380 - DNA, 13 bp, D. melanogaster
gtttcatttcgtt

SEQ ID NO: 637381 - DNA, 13 bp, D. melanogaster
gtttcatttgaaa

SEQ ID NO: 637382 - DNA, 13 bp, D. melanogaster
gtttcatttggtt

SEQ ID NO: 637383 - DNA, 13 bp, D. melanogaster
gtttcattttaat

SEQ ID NO: 637384 - DNA, 14 bp, D. melanogaster
gtttcattttcatt

SEQ ID NO: 637385 - DNA, 13 bp, D. melanogaster
gtttcattttgct

SEQ ID NO: 637386 - DNA, 13 bp, D. melanogaster
gtttcatttttgg

SEQ ID NO: 637387 - DNA, 13 bp, D. melanogaster
gtttccaaaatat

SEQ ID NO: 637388 - DNA, 13 bp, D. melanogaster
gtttccaaattta

SEQ ID NO: 637389 - DNA, 13 bp, D. melanogaster
gtttccaattgga

SEQ ID NO: 637390 - DNA, 13 bp, D. melanogaster
gtttccactgcgt

SEQ ID NO: 637391 - DNA, 13 bp, D. melanogaster
gtttccactggta

SEQ ID NO: 637392 - DNA, 13 bp, D. melanogaster
gtttccagtccga

SEQ ID NO: 637393 - DNA, 13 bp, D. melanogaster
gtttccagttccc

SEQ ID NO: 637394 - DNA, 13 bp, D. melanogaster
gtttccagttttc

SEQ ID NO: 637395 - DNA, 13 bp, D. melanogaster
gtttccattgcca

SEQ ID NO: 637396 - DNA, 14 bp, D. melanogaster
gtttccatttccat

SEQ ID NO: 637397 - DNA, 13 bp, D. melanogaster
gtttcccagtttc

SEQ ID NO: 637398 - DNA, 14 bp, D. melanogaster
gtttcccatttttt

SEQ ID NO: 637399 - DNA, 13 bp, D. melanogaster
gtttccccatttc

SEQ ID NO: 637400 - DNA, 13 bp, D. melanogaster
gtttccccttaat

SEQ ID NO: 637401 - DNA, 13 bp, D. melanogaster
gtttcccttttgg

SEQ ID NO: 637402 - DNA, 13 bp, D. melanogaster
gtttccgaaagaa

SEQ ID NO: 637403 - DNA, 13 bp, D. melanogaster
gtttccgctgcaa

SEQ ID NO: 637404 - DNA, 13 bp, D. melanogaster
gtttccgcttccg

SEQ ID NO: 637405 - DNA, 13 bp, D. melanogaster
gtttccggttccg

SEQ ID NO: 637406 - DNA, 13 bp, D. melanogaster
gtttccgtttccg

SEQ ID NO: 637407 - DNA, 14 bp, D. melanogaster
gtttccgtttccgc

SEQ ID NO: 637408 - DNA, 13 bp, D. melanogaster
gtttcctggaaga

SEQ ID NO: 637409 - DNA, 13 bp, D. melanogaster
gtttcgaatattt

SEQ ID NO: 637410 - DNA, 13 bp, D. melanogaster
gtttcgagcactg

SEQ ID NO: 637411 - DNA, 13 bp, D. melanogaster
gtttcgagtgttt

SEQ ID NO: 637412 - DNA, 13 bp, D. melanogaster
gtttcgatatttt

SEQ ID NO: 637413 - DNA, 13 bp, D. melanogaster
gtttcgattagat

SEQ ID NO: 637414 - DNA, 13 bp, D. melanogaster
gtttcgattcgat

SEQ ID NO: 637415 - DNA, 14 bp, D. melanogaster
gtttcgattcgatt

SEQ ID NO: 637416 - DNA, 13 bp, D. melanogaster
gtttcgattttaa

SEQ ID NO: 637417 - DNA, 13 bp, D. melanogaster
gtttcggaaaacg

SEQ ID NO: 637418 - DNA, 13 bp, D. melanogaster
gtttcggtttcaa

SEQ ID NO: 637419 - DNA, 13 bp, D. melanogaster
gtttcggtttcgt

SEQ ID NO: 637420 - DNA, 13 bp, D. melanogaster
gtttcggtttcta

SEQ ID NO: 637421 - DNA, 13 bp, D. melanogaster
gtttcggttttca

SEQ ID NO: 637422 - DNA, 13 bp, D. melanogaster
gtttcggttttcg

SEQ ID NO: 637423 - DNA, 14 bp, D. melanogaster
gtttcggttttcgg

SEQ ID NO: 637424 - DNA, 13 bp, D. melanogaster
gtttcgtatttca

SEQ ID NO: 637425 - DNA, 13 bp, D. melanogaster
gtttcgtgtgaca

SEQ ID NO: 637426 - DNA, 14 bp, D. melanogaster
gtttcgtttcgatt

SEQ ID NO: 637427 - DNA, 13 bp, D. melanogaster
gtttcgtttcgct

SEQ ID NO: 637428 - DNA, 13 bp, D. melanogaster
gtttcgtttcggt

SEQ ID NO: 637429 - DNA, 13 bp, D. melanogaster
gtttcgtttcgta

SEQ ID NO: 637430 - DNA, 13 bp, D. melanogaster
gtttcgtttcgtc

SEQ ID NO: 637431 - DNA, 13 bp, D. melanogaster
gtttcgttttcat

SEQ ID NO: 637432 - DNA, 13 bp, D. melanogaster
gtttcgtttttaa

SEQ ID NO: 637433 - DNA, 14 bp, D. melanogaster
gtttcgtttttaag

SEQ ID NO: 637434 - DNA, 13 bp, D. melanogaster
gtttctaatattt

SEQ ID NO: 637435 - DNA, 13 bp, D. melanogaster
gtttctaatttat

SEQ ID NO: 637436 - DNA, 13 bp, D. melanogaster
gtttctagaccaa

SEQ ID NO: 637437 - DNA, 13 bp, D. melanogaster
gtttctattagat

SEQ ID NO: 637438 - DNA, 13 bp, D. melanogaster
gtttctcagtttt

SEQ ID NO: 637439 - DNA, 13 bp, D. melanogaster
gtttctccacctc

SEQ ID NO: 637440 - DNA, 14 bp, D. melanogaster
gtttctccacctct

SEQ ID NO: 637441 - DNA, 14 bp, D. melanogaster
gtttctggatcacc

SEQ ID NO: 637442 - DNA, 14 bp, D. melanogaster
gtttctggccaaaa

SEQ ID NO: 637443 - DNA, 13 bp, D. melanogaster
gtttctgtatctg

SEQ ID NO: 637444 - DNA, 14 bp, D. melanogaster
gtttctgtgtgccc

SEQ ID NO: 637445 - DNA, 14 bp, D. melanogaster
gtttctgttgctgc

SEQ ID NO: 637446 - DNA, 13 bp, D. melanogaster
gtttctgtttcgc

SEQ ID NO: 637447 - DNA, 14 bp, D. melanogaster
gtttctgtttctgc

SEQ ID NO: 637448 - DNA, 13 bp, D. melanogaster
gtttctgtttgcc

SEQ ID NO: 637449 - DNA, 14 bp, D. melanogaster
gtttctgtttttga

SEQ ID NO: 637450 - DNA, 13 bp, D. melanogaster
gtttcttaaaata

SEQ ID NO: 637451 - DNA, 13 bp, D. melanogaster
gtttcttaagaca

SEQ ID NO: 637452 - DNA, 13 bp, D. melanogaster
gtttcttaatact

SEQ ID NO: 637453 - DNA, 13 bp, D. melanogaster
gtttcttgacaaa

SEQ ID NO: 637454 - DNA, 13 bp, D. melanogaster
gtttctttcaagc

SEQ ID NO: 637455 - DNA, 13 bp, D. melanogaster
gtttctttggtac

SEQ ID NO: 637456 - DNA, 13 bp, D. melanogaster
gtttcttttaaat

SEQ ID NO: 637457 - DNA, 13 bp, D. melanogaster
gtttcttttcagt

SEQ ID NO: 637458 - DNA, 13 bp, D. melanogaster
gtttcttttctaa

SEQ ID NO: 637459 - DNA, 13 bp, D. melanogaster
gtttgaaaaaatt

SEQ ID NO: 637460 - DNA, 13 bp, D. melanogaster
gtttgaaaaatat

SEQ ID NO: 637461 - DNA, 13 bp, D. melanogaster
gtttgaaaacatt

SEQ ID NO: 637462 - DNA, 13 bp, D. melanogaster
gtttgaaaagaaa

SEQ ID NO: 637463 - DNA, 13 bp, D. melanogaster
gtttgaaaagctt

SEQ ID NO: 637464 - DNA, 13 bp, D. melanogaster
gtttgaaaatatt

SEQ ID NO: 637465 - DNA, 13 bp, D. melanogaster
gtttgaaaattta

SEQ ID NO: 637466 - DNA, 13 bp, D. melanogaster
gtttgaaagatcc

SEQ ID NO: 637467 - DNA, 14 bp, D. melanogaster
gtttgaaagatcca

SEQ ID NO: 637468 - DNA, 13 bp, D. melanogaster
gtttgaaattaat

SEQ ID NO: 637469 - DNA, 13 bp, D. melanogaster
gtttgaaattatt

SEQ ID NO: 637470 - DNA, 13 bp, D. melanogaster
gtttgaaattcaa

SEQ ID NO: 637471 - DNA, 13 bp, D. melanogaster
gtttgaacttgtt

SEQ ID NO: 637472 - DNA, 13 bp, D. melanogaster
gtttgaagaattt

SEQ ID NO: 637473 - DNA, 13 bp, D. melanogaster
gtttgaagtattt

SEQ ID NO: 637474 - DNA, 14 bp, D. melanogaster
gtttgaataattta

SEQ ID NO: 637475 - DNA, 13 bp, D. melanogaster
gtttgaatttcaa

SEQ ID NO: 637476 - DNA, 13 bp, D. melanogaster
gtttgaatttgaa

SEQ ID NO: 637477 - DNA, 13 bp, D. melanogaster
gtttgaatttgca

SEQ ID NO: 637478 - DNA, 13 bp, D. melanogaster
gtttgacggcaaa

SEQ ID NO: 637479 - DNA, 13 bp, D. melanogaster
gtttgagtgtggc

SEQ ID NO: 637480 - DNA, 14 bp, D. melanogaster
gtttgagtgtggca

SEQ ID NO: 637481 - DNA, 13 bp, D. melanogaster
gtttgagttcgag

SEQ ID NO: 637482 - DNA, 13 bp, D. melanogaster
gtttgataattta

SEQ ID NO: 637483 - DNA, 13 bp, D. melanogaster
gtttgatcaaaaa

SEQ ID NO: 637484 - DNA, 13 bp, D. melanogaster
gtttgatggcgag

SEQ ID NO: 637485 - DNA, 13 bp, D. melanogaster
gtttgatttaaat

SEQ ID NO: 637486 - DNA, 13 bp, D. melanogaster
gtttgatttcgtt

SEQ ID NO: 637487 - DNA, 13 bp, D. melanogaster
gtttgattttcaa

SEQ ID NO: 637488 - DNA, 13 bp, D. melanogaster
gtttgattttggc

SEQ ID NO: 637489 - DNA, 13 bp, D. melanogaster
gtttgcaaacaaa

SEQ ID NO: 637490 - DNA, 13 bp, D. melanogaster
gtttgcaaacatt

SEQ ID NO: 637491 - DNA, 14 bp, D. melanogaster
gtttgcaaacattt

SEQ ID NO: 637492 - DNA, 13 bp, D. melanogaster
gtttgcaaacttt

SEQ ID NO: 637493 - DNA, 13 bp, D. melanogaster
gtttgcaaatatt

SEQ ID NO: 637494 - DNA, 13 bp, D. melanogaster
gtttgcaaattaa

SEQ ID NO: 637495 - DNA, 13 bp, D. melanogaster
gtttgcaactttt

SEQ ID NO: 637496 - DNA, 13 bp, D. melanogaster
gtttgcaatgcca

SEQ ID NO: 637497 - DNA, 13 bp, D. melanogaster
gtttgcaattttt

SEQ ID NO: 637498 - DNA, 13 bp, D. melanogaster
gtttgcaggtgca

SEQ ID NO: 637499 - DNA, 13 bp, D. melanogaster
gtttgcagtgcgg

SEQ ID NO: 637500 - DNA, 13 bp, D. melanogaster
gtttgcatattta

SEQ ID NO: 637501 - DNA, 13 bp, D. melanogaster
gtttgcatcccaa

SEQ ID NO: 637502 - DNA, 13 bp, D. melanogaster
gtttgcatgtgtg

SEQ ID NO: 637503 - DNA, 13 bp, D. melanogaster
gtttgcattgcat

SEQ ID NO: 637504 - DNA, 13 bp, D. melanogaster
gtttgcatttatt

SEQ ID NO: 637505 - DNA, 13 bp, D. melanogaster
gtttgcatttcat

SEQ ID NO: 637506 - DNA, 13 bp, D. melanogaster
gtttgcattttcc

SEQ ID NO: 637507 - DNA, 13 bp, D. melanogaster
gtttgccaaaatt

SEQ ID NO: 637508 - DNA, 13 bp, D. melanogaster
gtttgccaaattg

SEQ ID NO: 637509 - DNA, 13 bp, D. melanogaster
gtttgccaattgc

SEQ ID NO: 637510 - DNA, 13 bp, D. melanogaster
gtttgccaatttg

SEQ ID NO: 637511 - DNA, 13 bp, D. melanogaster
gtttgccacgccc

SEQ ID NO: 637512 - DNA, 13 bp, D. melanogaster
gtttgccagcagc

SEQ ID NO: 637513 - DNA, 13 bp, D. melanogaster
gtttgccagcttt

SEQ ID NO: 637514 - DNA, 13 bp, D. melanogaster
gtttgccataaat

SEQ ID NO: 637515 - DNA, 13 bp, D. melanogaster
gtttgccattaaa

SEQ ID NO: 637516 - DNA, 13 bp, D. melanogaster
gtttgccatttgc

SEQ ID NO: 637517 - DNA, 13 bp, D. melanogaster
gtttgccatttgt

SEQ ID NO: 637518 - DNA, 14 bp, D. melanogaster
gtttgccatttgtt

SEQ ID NO: 637519 - DNA, 13 bp, D. melanogaster
gtttgcccaccaa

SEQ ID NO: 637520 - DNA, 13 bp, D. melanogaster
gtttgcccatttc

SEQ ID NO: 637521 - DNA, 13 bp, D. melanogaster
gtttgcccatttt

SEQ ID NO: 637522 - DNA, 13 bp, D. melanogaster
gtttgccctaggc

SEQ ID NO: 637523 - DNA, 13 bp, D. melanogaster
gtttgccggcaaa

SEQ ID NO: 637524 - DNA, 13 bp, D. melanogaster
gtttgccgtttgc

SEQ ID NO: 637525 - DNA, 13 bp, D. melanogaster
gtttgcctgcaat

SEQ ID NO: 637526 - DNA, 13 bp, D. melanogaster
gtttgcctgcctg

SEQ ID NO: 637527 - DNA, 13 bp, D. melanogaster
gtttgcctgtttg

SEQ ID NO: 637528 - DNA, 13 bp, D. melanogaster
gtttgcctttgcc

SEQ ID NO: 637529 - DNA, 13 bp, D. melanogaster
gtttgcgccaagt

SEQ ID NO: 637530 - DNA, 14 bp, D. melanogaster
gtttgcgccaagtg

SEQ ID NO: 637531 - DNA, 14 bp, D. melanogaster
gtttgcgccataaa

SEQ ID NO: 637532 - DNA, 13 bp, D. melanogaster
gtttgcggtaata

SEQ ID NO: 637533 - DNA, 14 bp, D. melanogaster
gtttgctaagcgtt

SEQ ID NO: 637534 - DNA, 13 bp, D. melanogaster
gtttgctattttc

SEQ ID NO: 637535 - DNA, 13 bp, D. melanogaster
gtttgctgaaaat

SEQ ID NO: 637536 - DNA, 13 bp, D. melanogaster
gtttgctgattgc

SEQ ID NO: 637537 - DNA, 13 bp, D. melanogaster
gtttgctgcactt

SEQ ID NO: 637538 - DNA, 13 bp, D. melanogaster
gtttgctgcatcg

SEQ ID NO: 637539 - DNA, 14 bp, D. melanogaster
gtttgctgcatcgc

SEQ ID NO: 637540 - DNA, 13 bp, D. melanogaster
gtttgctgccaaa

SEQ ID NO: 637541 - DNA, 13 bp, D. melanogaster
gtttgctgccttt

SEQ ID NO: 637542 - DNA, 13 bp, D. melanogaster
gtttgctggcttt

SEQ ID NO: 637543 - DNA, 13 bp, D. melanogaster
gtttgctgtttgc

SEQ ID NO: 637544 - DNA, 13 bp, D. melanogaster
gtttgcttagttt

SEQ ID NO: 637545 - DNA, 13 bp, D. melanogaster
gtttgctttggca

SEQ ID NO: 637546 - DNA, 13 bp, D. melanogaster
gtttgctttggct

SEQ ID NO: 637547 - DNA, 13 bp, D. melanogaster
gtttgcttttcgc

SEQ ID NO: 637548 - DNA, 14 bp, D. melanogaster
gtttgcttttgcaa

SEQ ID NO: 637549 - DNA, 13 bp, D. melanogaster
gtttggaaaatat

SEQ ID NO: 637550 - DNA, 13 bp, D. melanogaster
gtttggaatataa

SEQ ID NO: 637551 - DNA, 14 bp, D. melanogaster
gtttggaattaaaa

SEQ ID NO: 637552 - DNA, 13 bp, D. melanogaster
gtttggaccaccc

SEQ ID NO: 637553 - DNA, 13 bp, D. melanogaster
gtttggagtccac

SEQ ID NO: 637554 - DNA, 13 bp, D. melanogaster
gtttggataaaat

SEQ ID NO: 637555 - DNA, 14 bp, D. melanogaster
gtttggataaacag

SEQ ID NO: 637556 - DNA, 13 bp, D. melanogaster
gtttggatttgga

SEQ ID NO: 637557 - DNA, 13 bp, D. melanogaster
gtttggcaacaaa

SEQ ID NO: 637558 - DNA, 13 bp, D. melanogaster
gtttggcaattaa

SEQ ID NO: 637559 - DNA, 14 bp, D. melanogaster
gtttggcattgatt

SEQ ID NO: 637560 - DNA, 13 bp, D. melanogaster
gtttggcatttgt

SEQ ID NO: 637561 - DNA, 13 bp, D. melanogaster
gtttggccaatta

SEQ ID NO: 637562 - DNA, 13 bp, D. melanogaster
gtttggcgctgcg

SEQ ID NO: 637563 - DNA, 13 bp, D. melanogaster
gtttggcggcttt

SEQ ID NO: 637564 - DNA, 13 bp, D. melanogaster
gtttggctgccaa

SEQ ID NO: 637565 - DNA, 13 bp, D. melanogaster
gtttggctgcctg

SEQ ID NO: 637566 - DNA, 13 bp, D. melanogaster
gtttggctggctg

SEQ ID NO: 637567 - DNA, 13 bp, D. melanogaster
gtttggctttcgt

SEQ ID NO: 637568 - DNA, 13 bp, D. melanogaster
gtttgggcatttt

SEQ ID NO: 637569 - DNA, 13 bp, D. melanogaster
gtttgggccaagt

SEQ ID NO: 637570 - DNA, 13 bp, D. melanogaster
gtttgggccacaa

SEQ ID NO: 637571 - DNA, 13 bp, D. melanogaster
gtttgggccatgt

SEQ ID NO: 637572 - DNA, 13 bp, D. melanogaster
gtttggggcattt

SEQ ID NO: 637573 - DNA, 13 bp, D. melanogaster
gtttggtaaaaaa

SEQ ID NO: 637574 - DNA, 13 bp, D. melanogaster
gtttggtggaact

SEQ ID NO: 637575 - DNA, 14 bp, D. melanogaster
gtttggtgtatctg

SEQ ID NO: 637576 - DNA, 13 bp, D. melanogaster
gtttggttttatc

SEQ ID NO: 637577 - DNA, 13 bp, D. melanogaster
gtttggttttgaa

SEQ ID NO: 637578 - DNA, 13 bp, D. melanogaster
gtttgtaaaatat

SEQ ID NO: 637579 - DNA, 13 bp, D. melanogaster
gtttgtaaataaa

SEQ ID NO: 637580 - DNA, 13 bp, D. melanogaster
gtttgtaaatata

SEQ ID NO: 637581 - DNA, 13 bp, D. melanogaster
gtttgtaaatatc

SEQ ID NO: 637582 - DNA, 13 bp, D. melanogaster
gtttgtaaatatt

SEQ ID NO: 637583 - DNA, 13 bp, D. melanogaster
gtttgtataatta

SEQ ID NO: 637584 - DNA, 13 bp, D. melanogaster
gtttgtatataat

SEQ ID NO: 637585 - DNA, 13 bp, D. melanogaster
gtttgtatatatg

SEQ ID NO: 637586 - DNA, 14 bp, D. melanogaster
gtttgtatctgtat

SEQ ID NO: 637587 - DNA, 13 bp, D. melanogaster
gtttgtcaacaaa

SEQ ID NO: 637588 - DNA, 13 bp, D. melanogaster
gtttgtccgtatg

SEQ ID NO: 637589 - DNA, 13 bp, D. melanogaster
gtttgtccgtgat

SEQ ID NO: 637590 - DNA, 13 bp, D. melanogaster
gtttgtccgtttg

SEQ ID NO: 637591 - DNA, 13 bp, D. melanogaster
gtttgtctgggat

SEQ ID NO: 637592 - DNA, 13 bp, D. melanogaster
gtttgtgaaaaat

SEQ ID NO: 637593 - DNA, 13 bp, D. melanogaster
gtttgtgaaaata

SEQ ID NO: 637594 - DNA, 14 bp, D. melanogaster
gtttgtgaaaatat

SEQ ID NO: 637595 - DNA, 13 bp, D. melanogaster
gtttgtggaaaat

SEQ ID NO: 637596 - DNA, 14 bp, D. melanogaster
gtttgtgtatatat

SEQ ID NO: 637597 - DNA, 13 bp, D. melanogaster
gtttgtgtgccaa

SEQ ID NO: 637598 - DNA, 13 bp, D. melanogaster
gtttgtgtggcaa

SEQ ID NO: 637599 - DNA, 13 bp, D. melanogaster
gtttgtgttgcca

SEQ ID NO: 637600 - DNA, 13 bp, D. melanogaster
gtttgtgtttaaa

SEQ ID NO: 637601 - DNA, 13 bp, D. melanogaster
gtttgtgtttgca

SEQ ID NO: 637602 - DNA, 13 bp, D. melanogaster
gtttgtgtttgcc

SEQ ID NO: 637603 - DNA, 13 bp, D. melanogaster
gtttgttaaaatc

SEQ ID NO: 637604 - DNA, 13 bp, D. melanogaster
gtttgttaaaatt

SEQ ID NO: 637605 - DNA, 13 bp, D. melanogaster
gtttgttgacttt

SEQ ID NO: 637606 - DNA, 13 bp, D. melanogaster
gtttgttgccatt

SEQ ID NO: 637607 - DNA, 13 bp, D. melanogaster
gtttgttgtcatt

SEQ ID NO: 637608 - DNA, 13 bp, D. melanogaster
gtttgtttaaata

SEQ ID NO: 637609 - DNA, 13 bp, D. melanogaster
gtttgtttaacaa

SEQ ID NO: 637610 - DNA, 13 bp, D. melanogaster
gtttgtttacaaa

SEQ ID NO: 637611 - DNA, 13 bp, D. melanogaster
gtttgtttacatt

SEQ ID NO: 637612 - DNA, 13 bp, D. melanogaster
gtttgtttaggcg

SEQ ID NO: 637613 - DNA, 13 bp, D. melanogaster
gtttgtttgccca

SEQ ID NO: 637614 - DNA, 13 bp, D. melanogaster
gtttgtttgctgc

SEQ ID NO: 637615 - DNA, 13 bp, D. melanogaster
gtttgtttgtcat

SEQ ID NO: 637616 - DNA, 13 bp, D. melanogaster
gtttgtttgtccg

SEQ ID NO: 637617 - DNA, 13 bp, D. melanogaster
gtttgttttacaa

SEQ ID NO: 637618 - DNA, 13 bp, D. melanogaster
gtttgttttcact

SEQ ID NO: 637619 - DNA, 13 bp, D. melanogaster
gtttgttttccat

SEQ ID NO: 637620 - DNA, 14 bp, D. melanogaster
gtttgttttgcatt

SEQ ID NO: 637621 - DNA, 14 bp, D. melanogaster
gttttaaaaacaaa

SEQ ID NO: 637622 - DNA, 13 bp, D. melanogaster
gttttaaaaatac

SEQ ID NO: 637623 - DNA, 13 bp, D. melanogaster
gttttaaaacaaa

SEQ ID NO: 637624 - DNA, 13 bp, D. melanogaster
gttttaaaacaag

SEQ ID NO: 637625 - DNA, 14 bp, D. melanogaster
gttttaaaacattt

SEQ ID NO: 637626 - DNA, 13 bp, D. melanogaster
gttttaaaaccaa

SEQ ID NO: 637627 - DNA, 13 bp, D. melanogaster
gttttaaaactga

SEQ ID NO: 637628 - DNA, 13 bp, D. melanogaster
gttttaaaattca

SEQ ID NO: 637629 - DNA, 13 bp, D. melanogaster
gttttaaaatttc

SEQ ID NO: 637630 - DNA, 13 bp, D. melanogaster
gttttaaaatttg

SEQ ID NO: 637631 - DNA, 13 bp, D. melanogaster
gttttaaacaaat

SEQ ID NO: 637632 - DNA, 13 bp, D. melanogaster
gttttaaacattt

SEQ ID NO: 637633 - DNA, 13 bp, D. melanogaster
gttttaaactaaa

SEQ ID NO: 637634 - DNA, 13 bp, D. melanogaster
gttttaaagtgat

SEQ ID NO: 637635 - DNA, 13 bp, D. melanogaster
gttttaaagtttc

SEQ ID NO: 637636 - DNA, 13 bp, D. melanogaster
gttttaaatacat

SEQ ID NO: 637637 - DNA, 13 bp, D. melanogaster
gttttaaatatac

SEQ ID NO: 637638 - DNA, 13 bp, D. melanogaster
gttttaaatcaaa

SEQ ID NO: 637639 - DNA, 13 bp, D. melanogaster
gttttaaatgaaa

SEQ ID NO: 637640 - DNA, 13 bp, D. melanogaster
gttttaaatgaat

SEQ ID NO: 637641 - DNA, 13 bp, D. melanogaster
gttttaaatttgc

SEQ ID NO: 637642 - DNA, 13 bp, D. melanogaster
gttttaagaattt

SEQ ID NO: 637643 - DNA, 13 bp, D. melanogaster
gttttaagacgga

SEQ ID NO: 637644 - DNA, 13 bp, D. melanogaster
gttttaagccaaa

SEQ ID NO: 637645 - DNA, 13 bp, D. melanogaster
gttttaagtatgg

SEQ ID NO: 637646 - DNA, 13 bp, D. melanogaster
gttttaagttgaa

SEQ ID NO: 637647 - DNA, 13 bp, D. melanogaster
gttttaataaagt

SEQ ID NO: 637648 - DNA, 13 bp, D. melanogaster
gttttaataagaa

SEQ ID NO: 637649 - DNA, 13 bp, D. melanogaster
gttttaatacttt

SEQ ID NO: 637650 - DNA, 13 bp, D. melanogaster
gttttaatcattt

SEQ ID NO: 637651 - DNA, 13 bp, D. melanogaster
gttttaatggccg

SEQ ID NO: 637652 - DNA, 13 bp, D. melanogaster
gttttaattattc

SEQ ID NO: 637653 - DNA, 13 bp, D. melanogaster
gttttaattcaat

SEQ ID NO: 637654 - DNA, 13 bp, D. melanogaster
gttttaattgagt

SEQ ID NO: 637655 - DNA, 13 bp, D. melanogaster
gttttaattgcca

SEQ ID NO: 637656 - DNA, 13 bp, D. melanogaster
gttttaattgctg

SEQ ID NO: 637657 - DNA, 13 bp, D. melanogaster
gttttaatttaca

SEQ ID NO: 637658 - DNA, 13 bp, D. melanogaster
gttttacaaaaaa

SEQ ID NO: 637659 - DNA, 13 bp, D. melanogaster
gttttacaaaaat

SEQ ID NO: 637660 - DNA, 14 bp, D. melanogaster
gttttacaattttt

SEQ ID NO: 637661 - DNA, 13 bp, D. melanogaster
gttttacataatt

SEQ ID NO: 637662 - DNA, 13 bp, D. melanogaster
gttttacctataa

SEQ ID NO: 637663 - DNA, 13 bp, D. melanogaster
gttttacttttac

SEQ ID NO: 637664 - DNA, 13 bp, D. melanogaster
gttttagccaaaa

SEQ ID NO: 637665 - DNA, 13 bp, D. melanogaster
gttttagccaagt

SEQ ID NO: 637666 - DNA, 13 bp, D. melanogaster
gttttagtcaagt

SEQ ID NO: 637667 - DNA, 13 bp, D. melanogaster
gttttataaaaag

SEQ ID NO: 637668 - DNA, 13 bp, D. melanogaster
gttttataaacaa

SEQ ID NO: 637669 - DNA, 13 bp, D. melanogaster
gttttataaatag

SEQ ID NO: 637670 - DNA, 13 bp, D. melanogaster
gttttataatttc

SEQ ID NO: 637671 - DNA, 13 bp, D. melanogaster
gttttatacaaat

SEQ ID NO: 637672 - DNA, 13 bp, D. melanogaster
gttttatacattt

SEQ ID NO: 637673 - DNA, 13 bp, D. melanogaster
gttttatattcaa

SEQ ID NO: 637674 - DNA, 13 bp, D. melanogaster
gttttatcaaaaa

SEQ ID NO: 637675 - DNA, 14 bp, D. melanogaster
gttttatgcaaatt

SEQ ID NO: 637676 - DNA, 13 bp, D. melanogaster
gttttatggccca

SEQ ID NO: 637677 - DNA, 14 bp, D. melanogaster
gttttatgtgtaaa

SEQ ID NO: 637678 - DNA, 13 bp, D. melanogaster
gttttattaatac

SEQ ID NO: 637679 - DNA, 14 bp, D. melanogaster
gttttattatgaaa

SEQ ID NO: 637680 - DNA, 13 bp, D. melanogaster
gttttattgcctt

SEQ ID NO: 637681 - DNA, 13 bp, D. melanogaster
gttttattgctaa

SEQ ID NO: 637682 - DNA, 13 bp, D. melanogaster
gttttattgttgc

SEQ ID NO: 637683 - DNA, 14 bp, D. melanogaster
gttttattgttgct

SEQ ID NO: 637684 - DNA, 13 bp, D. melanogaster
gttttatttcatg

SEQ ID NO: 637685 - DNA, 13 bp, D. melanogaster
gttttatttccat

SEQ ID NO: 637686 - DNA, 13 bp, D. melanogaster
gttttatttcgca

SEQ ID NO: 637687 - DNA, 13 bp, D. melanogaster
gttttatttcgct

SEQ ID NO: 637688 - DNA, 13 bp, D. melanogaster
gttttatttctgc

SEQ ID NO: 637689 - DNA, 13 bp, D. melanogaster
gttttatttgctg

SEQ ID NO: 637690 - DNA, 13 bp, D. melanogaster
gttttatttgtca

SEQ ID NO: 637691 - DNA, 13 bp, D. melanogaster
gttttcaaaaaat

SEQ ID NO: 637692 - DNA, 13 bp, D. melanogaster
gttttcaaaatgt

SEQ ID NO: 637693 - DNA, 13 bp, D. melanogaster
gttttcaaaccgc

SEQ ID NO: 637694 - DNA, 13 bp, D. melanogaster
gttttcaaagatt

SEQ ID NO: 637695 - DNA, 13 bp, D. melanogaster
gttttcaaatatt

SEQ ID NO: 637696 - DNA, 13 bp, D. melanogaster
gttttcaaattat

SEQ ID NO: 637697 - DNA, 13 bp, D. melanogaster
gttttcaaatttc

SEQ ID NO: 637698 - DNA, 13 bp, D. melanogaster
gttttcaaatttg

SEQ ID NO: 637699 - DNA, 13 bp, D. melanogaster
gttttcaaatttt

SEQ ID NO: 637700 - DNA, 13 bp, D. melanogaster
gttttcaacattt

SEQ ID NO: 637701 - DNA, 13 bp, D. melanogaster
gttttcaagttca

SEQ ID NO: 637702 - DNA, 13 bp, D. melanogaster
gttttcaataaat

SEQ ID NO: 637703 - DNA, 13 bp, D. melanogaster
gttttcaatcaaa

SEQ ID NO: 637704 - DNA, 13 bp, D. melanogaster
gttttcaattgaa

SEQ ID NO: 637705 - DNA, 13 bp, D. melanogaster
gttttcaatttca

SEQ ID NO: 637706 - DNA, 14 bp, D. melanogaster
gttttcaatttgtt

SEQ ID NO: 637707 - DNA, 13 bp, D. melanogaster
gttttcacttctt

SEQ ID NO: 637708 - DNA, 13 bp, D. melanogaster
gttttcactttgt

SEQ ID NO: 637709 - DNA, 13 bp, D. melanogaster
gttttcagatctt

SEQ ID NO: 637710 - DNA, 13 bp, D. melanogaster
gttttcagtgttt

SEQ ID NO: 637711 - DNA, 13 bp, D. melanogaster
gttttcagttcga

SEQ ID NO: 637712 - DNA, 13 bp, D. melanogaster
gttttcagtttca

SEQ ID NO: 637713 - DNA, 13 bp, D. melanogaster
gttttcagtttgc

SEQ ID NO: 637714 - DNA, 13 bp, D. melanogaster
gttttcagttttc

SEQ ID NO: 637715 - DNA, 14 bp, D. melanogaster
gttttcagttttcg

SEQ ID NO: 637716 - DNA, 13 bp, D. melanogaster
gttttcataaaaa

SEQ ID NO: 637717 - DNA, 13 bp, D. melanogaster
gttttcatctgca

SEQ ID NO: 637718 - DNA, 13 bp, D. melanogaster
gttttcattactt

SEQ ID NO: 637719 - DNA, 14 bp, D. melanogaster
gttttcattctgat

SEQ ID NO: 637720 - DNA, 13 bp, D. melanogaster
gttttcattgaaa

SEQ ID NO: 637721 - DNA, 13 bp, D. melanogaster
gttttcattgccg

SEQ ID NO: 637722 - DNA, 13 bp, D. melanogaster
gttttcatttaaa

SEQ ID NO: 637723 - DNA, 13 bp, D. melanogaster
gttttcatttaat

SEQ ID NO: 637724 - DNA, 14 bp, D. melanogaster
gttttcatttcatt

SEQ ID NO: 637725 - DNA, 14 bp, D. melanogaster
gttttcatttccat

SEQ ID NO: 637726 - DNA, 13 bp, D. melanogaster
gttttcatttgtg

SEQ ID NO: 637727 - DNA, 13 bp, D. melanogaster
gttttcattttcg

SEQ ID NO: 637728 - DNA, 14 bp, D. melanogaster
gttttcattttcgt

SEQ ID NO: 637729 - DNA, 13 bp, D. melanogaster
gttttcattttga

SEQ ID NO: 637730 - DNA, 13 bp, D. melanogaster
gttttcattttgc

SEQ ID NO: 637731 - DNA, 14 bp, D. melanogaster
gttttcattttgca

SEQ ID NO: 637732 - DNA, 13 bp, D. melanogaster
gttttccaaaata

SEQ ID NO: 637733 - DNA, 13 bp, D. melanogaster
gttttccaaatat

SEQ ID NO: 637734 - DNA, 13 bp, D. melanogaster
gttttccaagaaa

SEQ ID NO: 637735 - DNA, 13 bp, D. melanogaster
gttttccaagttt

SEQ ID NO: 637736 - DNA, 13 bp, D. melanogaster
gttttccacaaaa

SEQ ID NO: 637737 - DNA, 13 bp, D. melanogaster
gttttccacacac

SEQ ID NO: 637738 - DNA, 13 bp, D. melanogaster
gttttccacattt

SEQ ID NO: 637739 - DNA, 13 bp, D. melanogaster
gttttccactttt

SEQ ID NO: 637740 - DNA, 13 bp, D. melanogaster
gttttccattcaa

SEQ ID NO: 637741 - DNA, 13 bp, D. melanogaster
gttttccattcca

SEQ ID NO: 637742 - DNA, 13 bp, D. melanogaster
gttttccatttgc

SEQ ID NO: 637743 - DNA, 13 bp, D. melanogaster
gttttccatttgt

SEQ ID NO: 637744 - DNA, 14 bp, D. melanogaster
gttttccatttttg

SEQ ID NO: 637745 - DNA, 13 bp, D. melanogaster
gttttcccaacca

SEQ ID NO: 637746 - DNA, 13 bp, D. melanogaster
gttttcccaactt

SEQ ID NO: 637747 - DNA, 13 bp, D. melanogaster
gttttcccacttt

SEQ ID NO: 637748 - DNA, 14 bp, D. melanogaster
gttttcccattttc

SEQ ID NO: 637749 - DNA, 14 bp, D. melanogaster
gttttccccacttt

SEQ ID NO: 637750 - DNA, 13 bp, D. melanogaster
gttttcccccatt

SEQ ID NO: 637751 - DNA, 13 bp, D. melanogaster
gttttccctattt

SEQ ID NO: 637752 - DNA, 14 bp, D. melanogaster
gttttccctcagat

SEQ ID NO: 637753 - DNA, 13 bp, D. melanogaster
gttttccctcgct

SEQ ID NO: 637754 - DNA, 13 bp, D. melanogaster
gttttccgaaaca

SEQ ID NO: 637755 - DNA, 13 bp, D. melanogaster
gttttccgacttt

SEQ ID NO: 637756 - DNA, 13 bp, D. melanogaster
gttttccgattgt

SEQ ID NO: 637757 - DNA, 14 bp, D. melanogaster
gttttccgattttc

SEQ ID NO: 637758 - DNA, 13 bp, D. melanogaster
gttttccgctggc

SEQ ID NO: 637759 - DNA, 13 bp, D. melanogaster
gttttccggcttt

SEQ ID NO: 637760 - DNA, 13 bp, D. melanogaster
gttttcctcgctt

SEQ ID NO: 637761 - DNA, 13 bp, D. melanogaster
gttttcctgaaac

SEQ ID NO: 637762 - DNA, 13 bp, D. melanogaster
gttttccttccta

SEQ ID NO: 637763 - DNA, 13 bp, D. melanogaster
gttttcctttggc

SEQ ID NO: 637764 - DNA, 13 bp, D. melanogaster
gttttccttttca

SEQ ID NO: 637765 - DNA, 13 bp, D. melanogaster
gttttcgaaaaat

SEQ ID NO: 637766 - DNA, 14 bp, D. melanogaster
gttttcgaaaaatt

SEQ ID NO: 637767 - DNA, 13 bp, D. melanogaster
gttttcgaaaatt

SEQ ID NO: 637768 - DNA, 13 bp, D. melanogaster
gttttcgaattaa

SEQ ID NO: 637769 - DNA, 13 bp, D. melanogaster
gttttcgaattct

SEQ ID NO: 637770 - DNA, 13 bp, D. melanogaster
gttttcgaatttt

SEQ ID NO: 637771 - DNA, 13 bp, D. melanogaster
gttttcgatcgtt

SEQ ID NO: 637772 - DNA, 13 bp, D. melanogaster
gttttcgattcgt

SEQ ID NO: 637773 - DNA, 13 bp, D. melanogaster
gttttcgatttcg

SEQ ID NO: 637774 - DNA, 13 bp, D. melanogaster
gttttcgatttgc

SEQ ID NO: 637775 - DNA, 13 bp, D. melanogaster
gttttcgattttc

SEQ ID NO: 637776 - DNA, 13 bp, D. melanogaster
gttttcgcatttc

SEQ ID NO: 637777 - DNA, 13 bp, D. melanogaster
gttttcgcctctt

SEQ ID NO: 637778 - DNA, 13 bp, D. melanogaster
gttttcggaattt

SEQ ID NO: 637779 - DNA, 13 bp, D. melanogaster
gttttcggaggca

SEQ ID NO: 637780 - DNA, 13 bp, D. melanogaster
gttttcgtctgaa

SEQ ID NO: 637781 - DNA, 13 bp, D. melanogaster
gttttcgttccga

SEQ ID NO: 637782 - DNA, 13 bp, D. melanogaster
gttttcgtttcga

SEQ ID NO: 637783 - DNA, 14 bp, D. melanogaster
gttttcgtttcgaa

SEQ ID NO: 637784 - DNA, 13 bp, D. melanogaster
gttttctaaattt

SEQ ID NO: 637785 - DNA, 13 bp, D. melanogaster
gttttctagttta

SEQ ID NO: 637786 - DNA, 13 bp, D. melanogaster
gttttctgcgtat

SEQ ID NO: 637787 - DNA, 13 bp, D. melanogaster
gttttcttaatta

SEQ ID NO: 637788 - DNA, 14 bp, D. melanogaster
gttttcttcaagtt

SEQ ID NO: 637789 - DNA, 15 bp, D. melanogaster
gttttcttcaagttc

SEQ ID NO: 637790 - DNA, 13 bp, D. melanogaster
gttttcttcaatt

SEQ ID NO: 637791 - DNA, 13 bp, D. melanogaster
gttttctttacca

SEQ ID NO: 637792 - DNA, 13 bp, D. melanogaster
gttttgaaaaata

SEQ ID NO: 637793 - DNA, 13 bp, D. melanogaster
gttttgaaaaatg

SEQ ID NO: 637794 - DNA, 13 bp, D. melanogaster
gttttgaaaataa

SEQ ID NO: 637795 - DNA, 13 bp, D. melanogaster
gttttgaaaatat

SEQ ID NO: 637796 - DNA, 13 bp, D. melanogaster
gttttgaaagttg

SEQ ID NO: 637797 - DNA, 13 bp, D. melanogaster
gttttgaaattat

SEQ ID NO: 637798 - DNA, 13 bp, D. melanogaster
gttttgaaggtag

SEQ ID NO: 637799 - DNA, 13 bp, D. melanogaster
gttttgaataatt

SEQ ID NO: 637800 - DNA, 13 bp, D. melanogaster
gttttgaatgaaa

SEQ ID NO: 637801 - DNA, 13 bp, D. melanogaster
gttttgaatgaat

SEQ ID NO: 637802 - DNA, 14 bp, D. melanogaster
gttttgaattgaat

SEQ ID NO: 637803 - DNA, 13 bp, D. melanogaster
gttttgagaaagg

SEQ ID NO: 637804 - DNA, 14 bp, D. melanogaster
gttttgagttaaaa

SEQ ID NO: 637805 - DNA, 13 bp, D. melanogaster
gttttgataaatt

SEQ ID NO: 637806 - DNA, 13 bp, D. melanogaster
gttttgataaccg

SEQ ID NO: 637807 - DNA, 13 bp, D. melanogaster
gttttgatcaaaa

SEQ ID NO: 637808 - DNA, 13 bp, D. melanogaster
gttttgattaaaa

SEQ ID NO: 637809 - DNA, 13 bp, D. melanogaster
gttttgatttcca

SEQ ID NO: 637810 - DNA, 13 bp, D. melanogaster
gttttgatttcga

SEQ ID NO: 637811 - DNA, 13 bp, D. melanogaster
gttttgattttca

SEQ ID NO: 637812 - DNA, 13 bp, D. melanogaster
gttttgcaaaaaa

SEQ ID NO: 637813 - DNA, 13 bp, D. melanogaster
gttttgcaaaaac

SEQ ID NO: 637814 - DNA, 13 bp, D. melanogaster
gttttgcaaacaa

SEQ ID NO: 637815 - DNA, 13 bp, D. melanogaster
gttttgcaaatat

SEQ ID NO: 637816 - DNA, 13 bp, D. melanogaster
gttttgcaaattt

SEQ ID NO: 637817 - DNA, 13 bp, D. melanogaster
gttttgcaattaa

SEQ ID NO: 637818 - DNA, 13 bp, D. melanogaster
gttttgcacattt

SEQ ID NO: 637819 - DNA, 13 bp, D. melanogaster
gttttgcattatt

SEQ ID NO: 637820 - DNA, 13 bp, D. melanogaster
gttttgcatttgc

SEQ ID NO: 637821 - DNA, 13 bp, D. melanogaster
gttttgcattttg

SEQ ID NO: 637822 - DNA, 13 bp, D. melanogaster
gttttgccattgc

SEQ ID NO: 637823 - DNA, 13 bp, D. melanogaster
gttttgcccattt

SEQ ID NO: 637824 - DNA, 13 bp, D. melanogaster
gttttgctggcag

SEQ ID NO: 637825 - DNA, 13 bp, D. melanogaster
gttttgcttaaaa

SEQ ID NO: 637826 - DNA, 13 bp, D. melanogaster
gttttgcttggct

SEQ ID NO: 637827 - DNA, 13 bp, D. melanogaster
gttttgctttggc

SEQ ID NO: 637828 - DNA, 13 bp, D. melanogaster
gttttggaaaaat

SEQ ID NO: 637829 - DNA, 13 bp, D. melanogaster
gttttggcattcg

SEQ ID NO: 637830 - DNA, 13 bp, D. melanogaster
gttttggccaacg

SEQ ID NO: 637831 - DNA, 14 bp, D. melanogaster
gttttggccaactt

SEQ ID NO: 637832 - DNA, 13 bp, D. melanogaster
gttttggccaagt

SEQ ID NO: 637833 - DNA, 14 bp, D. melanogaster
gttttggccaagtt

SEQ ID NO: 637834 - DNA, 13 bp, D. melanogaster
gttttggccaatt

SEQ ID NO: 637835 - DNA, 13 bp, D. melanogaster
gttttggccagaa

SEQ ID NO: 637836 - DNA, 13 bp, D. melanogaster
gttttggccagca

SEQ ID NO: 637837 - DNA, 13 bp, D. melanogaster
gttttggccaggc

SEQ ID NO: 637838 - DNA, 14 bp, D. melanogaster
gttttggccaggcc

SEQ ID NO: 637839 - DNA, 13 bp, D. melanogaster
gttttggccagtt

SEQ ID NO: 637840 - DNA, 13 bp, D. melanogaster
gttttggccatgt

SEQ ID NO: 637841 - DNA, 13 bp, D. melanogaster
gttttggcccaaa

SEQ ID NO: 637842 - DNA, 13 bp, D. melanogaster
gttttggcccggc

SEQ ID NO: 637843 - DNA, 14 bp, D. melanogaster
gttttggcctggcc

SEQ ID NO: 637844 - DNA, 13 bp, D. melanogaster
gttttggcctggt

SEQ ID NO: 637845 - DNA, 13 bp, D. melanogaster
gttttggctattt

SEQ ID NO: 637846 - DNA, 14 bp, D. melanogaster
gttttggctttggc

SEQ ID NO: 637847 - DNA, 14 bp, D. melanogaster
gttttgggccaaaa

SEQ ID NO: 637848 - DNA, 13 bp, D. melanogaster
gttttgggccaac

SEQ ID NO: 637849 - DNA, 13 bp, D. melanogaster
gttttggtaaatt

SEQ ID NO: 637850 - DNA, 13 bp, D. melanogaster
gttttggtcaaaa

SEQ ID NO: 637851 - DNA, 13 bp, D. melanogaster
gttttggttttca

SEQ ID NO: 637852 - DNA, 13 bp, D. melanogaster
gttttgtaaatat

SEQ ID NO: 637853 - DNA, 13 bp, D. melanogaster
gttttgtaaattg

SEQ ID NO: 637854 - DNA, 13 bp, D. melanogaster
gttttgtacattt

SEQ ID NO: 637855 - DNA, 13 bp, D. melanogaster
gttttgtatctct

SEQ ID NO: 637856 - DNA, 13 bp, D. melanogaster
gttttgtatttca

SEQ ID NO: 637857 - DNA, 14 bp, D. melanogaster
gttttgtcaacaga

SEQ ID NO: 637858 - DNA, 13 bp, D. melanogaster
gttttgtgaaatt

SEQ ID NO: 637859 - DNA, 13 bp, D. melanogaster
gttttgtgaatga

SEQ ID NO: 637860 - DNA, 13 bp, D. melanogaster
gttttgtgcaatt

SEQ ID NO: 637861 - DNA, 13 bp, D. melanogaster
gttttgtgcagct

SEQ ID NO: 637862 - DNA, 13 bp, D. melanogaster
gttttgtgcgatt

SEQ ID NO: 637863 - DNA, 13 bp, D. melanogaster
gttttgtgcggct

SEQ ID NO: 637864 - DNA, 13 bp, D. melanogaster
gttttgtggaaaa

SEQ ID NO: 637865 - DNA, 13 bp, D. melanogaster
gttttgtggcaaa

SEQ ID NO: 637866 - DNA, 13 bp, D. melanogaster
gttttgtggctgc

SEQ ID NO: 637867 - DNA, 13 bp, D. melanogaster
gttttgtgtaatc

SEQ ID NO: 637868 - DNA, 13 bp, D. melanogaster
gttttgtgtgcaa

SEQ ID NO: 637869 - DNA, 13 bp, D. melanogaster
gttttgtgtgcat

SEQ ID NO: 637870 - DNA, 13 bp, D. melanogaster
gttttgtgtgcca

SEQ ID NO: 637871 - DNA, 13 bp, D. melanogaster
gttttgtttgact

SEQ ID NO: 637872 - DNA, 13 bp, D. melanogaster
gttttgtttgcca

SEQ ID NO: 637873 - DNA, 13 bp, D. melanogaster
gttttgttttgac

SEQ ID NO: 637874 - DNA, 13 bp, D. melanogaster
gtttttaaaaaag

SEQ ID NO: 637875 - DNA, 13 bp, D. melanogaster
gtttttaaaaaca

SEQ ID NO: 637876 - DNA, 13 bp, D. melanogaster
gtttttaaaacaa

SEQ ID NO: 637877 - DNA, 13 bp, D. melanogaster
gtttttaaacaaa

SEQ ID NO: 637878 - DNA, 13 bp, D. melanogaster
gtttttaaagaaa

SEQ ID NO: 637879 - DNA, 13 bp, D. melanogaster
gtttttaaagctt

SEQ ID NO: 637880 - DNA, 13 bp, D. melanogaster
gtttttaaagttg

SEQ ID NO: 637881 - DNA, 13 bp, D. melanogaster
gtttttaaatcaa

SEQ ID NO: 637882 - DNA, 13 bp, D. melanogaster
gtttttaaattct

SEQ ID NO: 637883 - DNA, 13 bp, D. melanogaster
gtttttaagtttc

SEQ ID NO: 637884 - DNA, 14 bp, D. melanogaster
gtttttaagtttca

SEQ ID NO: 637885 - DNA, 14 bp, D. melanogaster
gtttttaatgaaat

SEQ ID NO: 637886 - DNA, 13 bp, D. melanogaster
gtttttaattgaa

SEQ ID NO: 637887 - DNA, 13 bp, D. melanogaster
gtttttacaaagc

SEQ ID NO: 637888 - DNA, 13 bp, D. melanogaster
gtttttacattta

SEQ ID NO: 637889 - DNA, 14 bp, D. melanogaster
gtttttactcacac

SEQ ID NO: 637890 - DNA, 13 bp, D. melanogaster
gtttttactttca

SEQ ID NO: 637891 - DNA, 13 bp, D. melanogaster
gtttttagaactt

SEQ ID NO: 637892 - DNA, 13 bp, D. melanogaster
gtttttagcattt

SEQ ID NO: 637893 - DNA, 13 bp, D. melanogaster
gtttttagttcat

SEQ ID NO: 637894 - DNA, 13 bp, D. melanogaster
gtttttataaaca

SEQ ID NO: 637895 - DNA, 13 bp, D. melanogaster
gtttttataactt

SEQ ID NO: 637896 - DNA, 13 bp, D. melanogaster
gtttttatacata

SEQ ID NO: 637897 - DNA, 13 bp, D. melanogaster
gtttttatacccg

SEQ ID NO: 637898 - DNA, 14 bp, D. melanogaster
gtttttatacccgt

SEQ ID NO: 637899 - DNA, 14 bp, D. melanogaster
gtttttatcgtgct

SEQ ID NO: 637900 - DNA, 13 bp, D. melanogaster
gtttttatgctgc

SEQ ID NO: 637901 - DNA, 13 bp, D. melanogaster
gtttttatggagt

SEQ ID NO: 637902 - DNA, 13 bp, D. melanogaster
gtttttattaagc

SEQ ID NO: 637903 - DNA, 13 bp, D. melanogaster
gtttttattgtgc

SEQ ID NO: 637904 - DNA, 13 bp, D. melanogaster
gtttttatttgca

SEQ ID NO: 637905 - DNA, 13 bp, D. melanogaster
gtttttcaaccaa

SEQ ID NO: 637906 - DNA, 13 bp, D. melanogaster
gtttttcaagaaa

SEQ ID NO: 637907 - DNA, 13 bp, D. melanogaster
gtttttcaataaa

SEQ ID NO: 637908 - DNA, 13 bp, D. melanogaster
gtttttcaatatt

SEQ ID NO: 637909 - DNA, 13 bp, D. melanogaster
gtttttcaatttc

SEQ ID NO: 637910 - DNA, 14 bp, D. melanogaster
gtttttcacatttt

SEQ ID NO: 637911 - DNA, 13 bp, D. melanogaster
gtttttcagttgc

SEQ ID NO: 637912 - DNA, 13 bp, D. melanogaster
gtttttcataatt

SEQ ID NO: 637913 - DNA, 13 bp, D. melanogaster
gtttttcattcat

SEQ ID NO: 637914 - DNA, 13 bp, D. melanogaster
gtttttcatttaa

SEQ ID NO: 637915 - DNA, 13 bp, D. melanogaster
gtttttccaacaa

SEQ ID NO: 637916 - DNA, 13 bp, D. melanogaster
gtttttccaattg

SEQ ID NO: 637917 - DNA, 13 bp, D. melanogaster
gtttttccaattt

SEQ ID NO: 637918 - DNA, 13 bp, D. melanogaster
gtttttccactgc

SEQ ID NO: 637919 - DNA, 13 bp, D. melanogaster
gtttttccagccc

SEQ ID NO: 637920 - DNA, 13 bp, D. melanogaster
gtttttccagctc

SEQ ID NO: 637921 - DNA, 13 bp, D. melanogaster
gtttttccagctg

SEQ ID NO: 637922 - DNA, 13 bp, D. melanogaster
gtttttccagctt

SEQ ID NO: 637923 - DNA, 13 bp, D. melanogaster
gtttttcccaaaa

SEQ ID NO: 637924 - DNA, 13 bp, D. melanogaster
gtttttcccaaag

SEQ ID NO: 637925 - DNA, 14 bp, D. melanogaster
gtttttcccatttt

SEQ ID NO: 637926 - DNA, 13 bp, D. melanogaster
gtttttccgattt

SEQ ID NO: 637927 - DNA, 14 bp, D. melanogaster
gtttttcctacaaa

SEQ ID NO: 637928 - DNA, 13 bp, D. melanogaster
gtttttcctgccc

SEQ ID NO: 637929 - DNA, 13 bp, D. melanogaster
gtttttcctgctg

SEQ ID NO: 637930 - DNA, 13 bp, D. melanogaster
gtttttcgaatgc

SEQ ID NO: 637931 - DNA, 13 bp, D. melanogaster
gtttttcgaattt

SEQ ID NO: 637932 - DNA, 14 bp, D. melanogaster
gtttttcgaatttt

SEQ ID NO: 637933 - DNA, 13 bp, D. melanogaster
gtttttctaaata

SEQ ID NO: 637934 - DNA, 13 bp, D. melanogaster
gtttttctagcgc

SEQ ID NO: 637935 - DNA, 13 bp, D. melanogaster
gtttttctcatgt

SEQ ID NO: 637936 - DNA, 13 bp, D. melanogaster
gtttttctccatt

SEQ ID NO: 637937 - DNA, 13 bp, D. melanogaster
gtttttctcgctg

SEQ ID NO: 637938 - DNA, 13 bp, D. melanogaster
gtttttctgcagc

SEQ ID NO: 637939 - DNA, 13 bp, D. melanogaster
gtttttcttcaaa

SEQ ID NO: 637940 - DNA, 13 bp, D. melanogaster
gtttttgaaaaaa

SEQ ID NO: 637941 - DNA, 14 bp, D. melanogaster
gtttttgaaaaaaa

SEQ ID NO: 637942 - DNA, 13 bp, D. melanogaster
gtttttgaaaatt

SEQ ID NO: 637943 - DNA, 13 bp, D. melanogaster
gtttttgaataaa

SEQ ID NO: 637944 - DNA, 14 bp, D. melanogaster
gtttttgaataaaa

SEQ ID NO: 637945 - DNA, 14 bp, D. melanogaster
gtttttgatataga

SEQ ID NO: 637946 - DNA, 14 bp, D. melanogaster
gtttttgatattga

SEQ ID NO: 637947 - DNA, 13 bp, D. melanogaster
gtttttgattgaa

SEQ ID NO: 637948 - DNA, 13 bp, D. melanogaster
gtttttgcaaaac

SEQ ID NO: 637949 - DNA, 13 bp, D. melanogaster
gtttttgcagtgc

SEQ ID NO: 637950 - DNA, 13 bp, D. melanogaster
gtttttgcatttc

SEQ ID NO: 637951 - DNA, 13 bp, D. melanogaster
gtttttgcatttg

SEQ ID NO: 637952 - DNA, 14 bp, D. melanogaster
gtttttgcatttgc

SEQ ID NO: 637953 - DNA, 13 bp, D. melanogaster
gtttttgccaatt

SEQ ID NO: 637954 - DNA, 13 bp, D. melanogaster
gtttttgccactg

SEQ ID NO: 637955 - DNA, 13 bp, D. melanogaster
gtttttgcggctg

SEQ ID NO: 637956 - DNA, 13 bp, D. melanogaster
gtttttgctaatt

SEQ ID NO: 637957 - DNA, 14 bp, D. melanogaster
gtttttgctaattt

SEQ ID NO: 637958 - DNA, 13 bp, D. melanogaster
gtttttgctgctg

SEQ ID NO: 637959 - DNA, 13 bp, D. melanogaster
gtttttgctggca

SEQ ID NO: 637960 - DNA, 13 bp, D. melanogaster
gtttttggagatt

SEQ ID NO: 637961 - DNA, 13 bp, D. melanogaster
gtttttggcaatt

SEQ ID NO: 637962 - DNA, 13 bp, D. melanogaster
gtttttggcagca

SEQ ID NO: 637963 - DNA, 13 bp, D. melanogaster
gtttttggcattt

SEQ ID NO: 637964 - DNA, 13 bp, D. melanogaster
gtttttggccaaa

SEQ ID NO: 637965 - DNA, 13 bp, D. melanogaster
gtttttggccaac

SEQ ID NO: 637966 - DNA, 13 bp, D. melanogaster
gtttttggcccaa

SEQ ID NO: 637967 - DNA, 13 bp, D. melanogaster
gtttttggcctgg

SEQ ID NO: 637968 - DNA, 13 bp, D. melanogaster
gtttttggccttc

SEQ ID NO: 637969 - DNA, 13 bp, D. melanogaster
gtttttggcgaaa

SEQ ID NO: 637970 - DNA, 13 bp, D. melanogaster
gtttttggctctg

SEQ ID NO: 637971 - DNA, 13 bp, D. melanogaster
gtttttgggagag

SEQ ID NO: 637972 - DNA, 13 bp, D. melanogaster
gtttttgggcaaa

SEQ ID NO: 637973 - DNA, 13 bp, D. melanogaster
gtttttgggcaat

SEQ ID NO: 637974 - DNA, 13 bp, D. melanogaster
gtttttgggcact

SEQ ID NO: 637975 - DNA, 13 bp, D. melanogaster
gtttttgggcatt

SEQ ID NO: 637976 - DNA, 14 bp, D. melanogaster
gtttttggggccaa

SEQ ID NO: 637977 - DNA, 13 bp, D. melanogaster
gtttttgtcattg

SEQ ID NO: 637978 - DNA, 13 bp, D. melanogaster
gtttttgtgcatt

SEQ ID NO: 637979 - DNA, 13 bp, D. melanogaster
gtttttgtggccc

SEQ ID NO: 637980 - DNA, 14 bp, D. melanogaster
gtttttgtggccca

SEQ ID NO: 637981 - DNA, 13 bp, D. melanogaster
gtttttgttgccc

SEQ ID NO: 637982 - DNA, 13 bp, D. melanogaster
gtttttgttgccg

SEQ ID NO: 637983 - DNA, 13 bp, D. melanogaster
gtttttgtttaca

SEQ ID NO: 637984 - DNA, 13 bp, D. melanogaster
gtttttgtttacc

SEQ ID NO: 637985 - DNA, 13 bp, D. melanogaster
gtttttgtttgca

SEQ ID NO: 637986 - DNA, 13 bp, D. melanogaster
gttttttaaaaac

SEQ ID NO: 637987 - DNA, 13 bp, D. melanogaster
gttttttaaacca

SEQ ID NO: 637988 - DNA, 14 bp, D. melanogaster
gttttttaacattt

SEQ ID NO: 637989 - DNA, 13 bp, D. melanogaster
gttttttccagtg

SEQ ID NO: 637990 - DNA, 13 bp, D. melanogaster
gttttttgaaata

SEQ ID NO: 637991 - DNA, 13 bp, D. melanogaster
gttttttgacaaa

SEQ ID NO: 637992 - DNA, 13 bp, D. melanogaster
gttttttgagaaa

SEQ ID NO: 637993 - DNA, 13 bp, D. melanogaster
gttttttgcaaat

SEQ ID NO: 637994 - DNA, 13 bp, D. melanogaster
gttttttgcagtg

SEQ ID NO: 637995 - DNA, 13 bp, D. melanogaster
gttttttgccaaa

SEQ ID NO: 637996 - DNA, 14 bp, D. melanogaster
gttttttgccaaaa

SEQ ID NO: 637997 - DNA, 13 bp, D. melanogaster
gttttttgcccaa

SEQ ID NO: 637998 - DNA, 13 bp, D. melanogaster
gttttttgcttaa

SEQ ID NO: 637999 - DNA, 13 bp, D. melanogaster
gttttttggccaa

SEQ ID NO: 638000 - DNA, 13 bp, D. melanogaster
gttttttgttcca

SEQ ID NO: 638001 - DNA, 13 bp, D. melanogaster
gtttttttgccac

SEQ ID NO: 638002 - DNA, 13 bp, D. melanogaster
gttttttttacaa

SEQ ID NO: 638003 - DNA, 13 bp, D. melanogaster
gttttttttcgaa

SEQ ID NO: 638004 - DNA, 13 bp, D. melanogaster
gttttttttgaca

SEQ ID NO: 638005 - DNA, 13 bp, D. melanogaster
taaaaaaaatcgt

SEQ ID NO: 638006 - DNA, 14 bp, D. melanogaster
taaaaaaaatgcat

SEQ ID NO: 638007 - DNA, 13 bp, D. melanogaster
taaaaaaaggagc

SEQ ID NO: 638008 - DNA, 13 bp, D. melanogaster
taaaaaacaatgc

SEQ ID NO: 638009 - DNA, 13 bp, D. melanogaster
taaaaaacagttt

SEQ ID NO: 638010 - DNA, 14 bp, D. melanogaster
taaaaaaccaaatg

SEQ ID NO: 638011 - DNA, 13 bp, D. melanogaster
taaaaaacgtata

SEQ ID NO: 638012 - DNA, 14 bp, D. melanogaster
taaaaaagaaacgc

SEQ ID NO: 638013 - DNA, 13 bp, D. melanogaster
taaaaaagatttg

SEQ ID NO: 638014 - DNA, 13 bp, D. melanogaster
taaaaaagctaat

SEQ ID NO: 638015 - DNA, 13 bp, D. melanogaster
taaaaaaggaagc

SEQ ID NO: 638016 - DNA, 14 bp, D. melanogaster
taaaaaaggaagct

SEQ ID NO: 638017 - DNA, 14 bp, D. melanogaster
taaaaaaggtagca

SEQ ID NO: 638018 - DNA, 13 bp, D. melanogaster
taaaaaaggttta

SEQ ID NO: 638019 - DNA, 13 bp, D. melanogaster
taaaaaagtgcaa

SEQ ID NO: 638020 - DNA, 13 bp, D. melanogaster
taaaaaagtgcat

SEQ ID NO: 638021 - DNA, 13 bp, D. melanogaster
taaaaaagttgtg

SEQ ID NO: 638022 - DNA, 13 bp, D. melanogaster
taaaaaagtttac

SEQ ID NO: 638023 - DNA, 14 bp, D. melanogaster
taaaaaatactgaa

SEQ ID NO: 638024 - DNA, 13 bp, D. melanogaster
taaaaaatagttg

SEQ ID NO: 638025 - DNA, 13 bp, D. melanogaster
taaaaaatatgtg

SEQ ID NO: 638026 - DNA, 13 bp, D. melanogaster
taaaaaatattgc

SEQ ID NO: 638027 - DNA, 14 bp, D. melanogaster
taaaaaatatttgc

SEQ ID NO: 638028 - DNA, 13 bp, D. melanogaster
taaaaaatcaacg

SEQ ID NO: 638029 - DNA, 14 bp, D. melanogaster
taaaaaatccaaag

SEQ ID NO: 638030 - DNA, 13 bp, D. melanogaster
taaaaaatccatt

SEQ ID NO: 638031 - DNA, 13 bp, D. melanogaster
taaaaaatcgaat

SEQ ID NO: 638032 - DNA, 13 bp, D. melanogaster
taaaaaatgatgt

SEQ ID NO: 638033 - DNA, 13 bp, D. melanogaster
taaaaaatgcaac

SEQ ID NO: 638034 - DNA, 13 bp, D. melanogaster
taaaaaatgcatt

SEQ ID NO: 638035 - DNA, 13 bp, D. melanogaster
taaaaaatgctca

SEQ ID NO: 638036 - DNA, 13 bp, D. melanogaster
taaaaaatgttga

SEQ ID NO: 638037 - DNA, 13 bp, D. melanogaster
taaaaaatgttgt

SEQ ID NO: 638038 - DNA, 13 bp, D. melanogaster
taaaaaattgcaa

SEQ ID NO: 638039 - DNA, 14 bp, D. melanogaster
taaaaaattgcaaa

SEQ ID NO: 638040 - DNA, 13 bp, D. melanogaster
taaaaaattgtac

SEQ ID NO: 638041 - DNA, 14 bp, D. melanogaster
taaaaaattgtcag

SEQ ID NO: 638042 - DNA, 13 bp, D. melanogaster
taaaaaatttcca

SEQ ID NO: 638043 - DNA, 13 bp, D. melanogaster
taaaaacaaatcg

SEQ ID NO: 638044 - DNA, 13 bp, D. melanogaster
taaaaacaaattg

SEQ ID NO: 638045 - DNA, 14 bp, D. melanogaster
taaaaacaagagac

SEQ ID NO: 638046 - DNA, 14 bp, D. melanogaster
taaaaacaatgtaa

SEQ ID NO: 638047 - DNA, 13 bp, D. melanogaster
taaaaacaattct

SEQ ID NO: 638048 - DNA, 13 bp, D. melanogaster
taaaaacagcagc

SEQ ID NO: 638049 - DNA, 14 bp, D. melanogaster
taaaaacagctttc

SEQ ID NO: 638050 - DNA, 13 bp, D. melanogaster
taaaaacatatgt

SEQ ID NO: 638051 - DNA, 13 bp, D. melanogaster
taaaaacatcatc

SEQ ID NO: 638052 - DNA, 13 bp, D. melanogaster
taaaaacattaag

SEQ ID NO: 638053 - DNA, 13 bp, D. melanogaster
taaaaacattgtt

SEQ ID NO: 638054 - DNA, 13 bp, D. melanogaster
taaaaacatttcc

SEQ ID NO: 638055 - DNA, 13 bp, D. melanogaster
taaaaacatttga

SEQ ID NO: 638056 - DNA, 13 bp, D. melanogaster
taaaaaccaagtt

SEQ ID NO: 638057 - DNA, 15 bp, D. melanogaster
taaaaaccaagttat

SEQ ID NO: 638058 - DNA, 13 bp, D. melanogaster
taaaaaccaattt

SEQ ID NO: 638059 - DNA, 13 bp, D. melanogaster
taaaaaccatttt

SEQ ID NO: 638060 - DNA, 13 bp, D. melanogaster
taaaaacccattt

SEQ ID NO: 638061 - DNA, 13 bp, D. melanogaster
taaaaaccctttt

SEQ ID NO: 638062 - DNA, 13 bp, D. melanogaster
taaaaaccgaaat

SEQ ID NO: 638063 - DNA, 13 bp, D. melanogaster
taaaaaccgaaga

SEQ ID NO: 638064 - DNA, 13 bp, D. melanogaster
taaaaaccgcaaa

SEQ ID NO: 638065 - DNA, 13 bp, D. melanogaster
taaaaacctacga

SEQ ID NO: 638066 - DNA, 13 bp, D. melanogaster
taaaaacctatat

SEQ ID NO: 638067 - DNA, 13 bp, D. melanogaster
taaaaacctattt

SEQ ID NO: 638068 - DNA, 13 bp, D. melanogaster
taaaaacctttaa

SEQ ID NO: 638069 - DNA, 13 bp, D. melanogaster
taaaaacgaaatg

SEQ ID NO: 638070 - DNA, 13 bp, D. melanogaster
taaaaacgaattt

SEQ ID NO: 638071 - DNA, 13 bp, D. melanogaster
taaaaacgatttt

SEQ ID NO: 638072 - DNA, 13 bp, D. melanogaster
taaaaacgcaaac

SEQ ID NO: 638073 - DNA, 13 bp, D. melanogaster
taaaaacgccaaa

SEQ ID NO: 638074 - DNA, 13 bp, D. melanogaster
taaaaacgttaaa

SEQ ID NO: 638075 - DNA, 14 bp, D. melanogaster
taaaaactaagaag

SEQ ID NO: 638076 - DNA, 13 bp, D. melanogaster
taaaaactaagac

SEQ ID NO: 638077 - DNA, 13 bp, D. melanogaster
taaaaactactac

SEQ ID NO: 638078 - DNA, 13 bp, D. melanogaster
taaaaactacttt

SEQ ID NO: 638079 - DNA, 13 bp, D. melanogaster
taaaaactagttt

SEQ ID NO: 638080 - DNA, 13 bp, D. melanogaster
taaaaactatgaa

SEQ ID NO: 638081 - DNA, 13 bp, D. melanogaster
taaaaactcaatt

SEQ ID NO: 638082 - DNA, 13 bp, D. melanogaster
taaaaactcattt

SEQ ID NO: 638083 - DNA, 14 bp, D. melanogaster
taaaaactgaatgg

SEQ ID NO: 638084 - DNA, 13 bp, D. melanogaster
taaaaactgcaaa

SEQ ID NO: 638085 - DNA, 13 bp, D. melanogaster
taaaaactgtaaa

SEQ ID NO: 638086 - DNA, 13 bp, D. melanogaster
taaaaactgtttt

SEQ ID NO: 638087 - DNA, 13 bp, D. melanogaster
taaaaacttgtat

SEQ ID NO: 638088 - DNA, 13 bp, D. melanogaster
taaaaactttgaa

SEQ ID NO: 638089 - DNA, 14 bp, D. melanogaster
taaaaacttttctt

SEQ ID NO: 638090 - DNA, 13 bp, D. melanogaster
taaaaagaaagcg

SEQ ID NO: 638091 - DNA, 13 bp, D. melanogaster
taaaaagaaatct

SEQ ID NO: 638092 - DNA, 13 bp, D. melanogaster
taaaaagaacttg

SEQ ID NO: 638093 - DNA, 13 bp, D. melanogaster
taaaaagaatgtt

SEQ ID NO: 638094 - DNA, 13 bp, D. melanogaster
taaaaagagaact

SEQ ID NO: 638095 - DNA, 14 bp, D. melanogaster
taaaaagagaacta

SEQ ID NO: 638096 - DNA, 13 bp, D. melanogaster
taaaaagagttct

SEQ ID NO: 638097 - DNA, 13 bp, D. melanogaster
taaaaagcaagca

SEQ ID NO: 638098 - DNA, 13 bp, D. melanogaster
taaaaagcaatca

SEQ ID NO: 638099 - DNA, 13 bp, D. melanogaster
taaaaagcaatgg

SEQ ID NO: 638100 - DNA, 14 bp, D. melanogaster
taaaaagcaatgga

SEQ ID NO: 638101 - DNA, 13 bp, D. melanogaster
taaaaagcacaca

SEQ ID NO: 638102 - DNA, 13 bp, D. melanogaster
taaaaagcagcag

SEQ ID NO: 638103 - DNA, 13 bp, D. melanogaster
taaaaagccaata

SEQ ID NO: 638104 - DNA, 13 bp, D. melanogaster
taaaaagccacaa

SEQ ID NO: 638105 - DNA, 13 bp, D. melanogaster
taaaaagccagca

SEQ ID NO: 638106 - DNA, 13 bp, D. melanogaster
taaaaagcgatca

SEQ ID NO: 638107 - DNA, 13 bp, D. melanogaster
taaaaagctttaa

SEQ ID NO: 638108 - DNA, 14 bp, D. melanogaster
taaaaagctttaaa

SEQ ID NO: 638109 - DNA, 13 bp, D. melanogaster
taaaaagctttga

SEQ ID NO: 638110 - DNA, 13 bp, D. melanogaster
taaaaaggcaaac

SEQ ID NO: 638111 - DNA, 13 bp, D. melanogaster
taaaaaggcttaa

SEQ ID NO: 638112 - DNA, 13 bp, D. melanogaster
taaaaaggtaatt

SEQ ID NO: 638113 - DNA, 13 bp, D. melanogaster
taaaaaggtggcc

SEQ ID NO: 638114 - DNA, 13 bp, D. melanogaster
taaaaaggttttt

SEQ ID NO: 638115 - DNA, 13 bp, D. melanogaster
taaaaagtaagca

SEQ ID NO: 638116 - DNA, 13 bp, D. melanogaster
taaaaagtcaaac

SEQ ID NO: 638117 - DNA, 13 bp, D. melanogaster
taaaaagtcaatt

SEQ ID NO: 638118 - DNA, 14 bp, D. melanogaster
taaaaagtcaatta

SEQ ID NO: 638119 - DNA, 13 bp, D. melanogaster
taaaaagtccatg

SEQ ID NO: 638120 - DNA, 14 bp, D. melanogaster
taaaaagtgcataa

SEQ ID NO: 638121 - DNA, 13 bp, D. melanogaster
taaaaagttacga

SEQ ID NO: 638122 - DNA, 13 bp, D. melanogaster
taaaaagttattc

SEQ ID NO: 638123 - DNA, 13 bp, D. melanogaster
taaaaagttcatt

SEQ ID NO: 638124 - DNA, 13 bp, D. melanogaster
taaaaagttcttt

SEQ ID NO: 638125 - DNA, 13 bp, D. melanogaster
taaaaagttgata

SEQ ID NO: 638126 - DNA, 13 bp, D. melanogaster
taaaaagttgtta

SEQ ID NO: 638127 - DNA, 13 bp, D. melanogaster
taaaaagttgttt

SEQ ID NO: 638128 - DNA, 13 bp, D. melanogaster
taaaaagtttcaa

SEQ ID NO: 638129 - DNA, 13 bp, D. melanogaster
taaaaagttttct

SEQ ID NO: 638130 - DNA, 13 bp, D. melanogaster
taaaaataaagct

SEQ ID NO: 638131 - DNA, 14 bp, D. melanogaster
taaaaataaatgtc

SEQ ID NO: 638132 - DNA, 13 bp, D. melanogaster
taaaaataacttg

SEQ ID NO: 638133 - DNA, 13 bp, D. melanogaster
taaaaataaggtt

SEQ ID NO: 638134 - DNA, 13 bp, D. melanogaster
taaaaataatacg

SEQ ID NO: 638135 - DNA, 14 bp, D. melanogaster
taaaaataatacga

SEQ ID NO: 638136 - DNA, 13 bp, D. melanogaster
taaaaataatcga

SEQ ID NO: 638137 - DNA, 13 bp, D. melanogaster
taaaaataatgcc

SEQ ID NO: 638138 - DNA, 13 bp, D. melanogaster
taaaaataattgc

SEQ ID NO: 638139 - DNA, 14 bp, D. melanogaster
taaaaataattgcc

SEQ ID NO: 638140 - DNA, 13 bp, D. melanogaster
taaaaataccatt

SEQ ID NO: 638141 - DNA, 13 bp, D. melanogaster
taaaaatacgaat

SEQ ID NO: 638142 - DNA, 13 bp, D. melanogaster
taaaaatactgct

SEQ ID NO: 638143 - DNA, 13 bp, D. melanogaster
taaaaatagcaat

SEQ ID NO: 638144 - DNA, 13 bp, D. melanogaster
taaaaatagcatt

SEQ ID NO: 638145 - DNA, 13 bp, D. melanogaster
taaaaatagtgac

SEQ ID NO: 638146 - DNA, 13 bp, D. melanogaster
taaaaatagtttg

SEQ ID NO: 638147 - DNA, 13 bp, D. melanogaster
taaaaatatacag

SEQ ID NO: 638148 - DNA, 13 bp, D. melanogaster
taaaaatatcttc

SEQ ID NO: 638149 - DNA, 13 bp, D. melanogaster
taaaaatatgtgt

SEQ ID NO: 638150 - DNA, 13 bp, D. melanogaster
taaaaatcaacag

SEQ ID NO: 638151 - DNA, 13 bp, D. melanogaster
taaaaatcaatag

SEQ ID NO: 638152 - DNA, 13 bp, D. melanogaster
taaaaatcaattg

SEQ ID NO: 638153 - DNA, 14 bp, D. melanogaster
taaaaatcagccaa

SEQ ID NO: 638154 - DNA, 13 bp, D. melanogaster
taaaaatcatttg

SEQ ID NO: 638155 - DNA, 13 bp, D. melanogaster
taaaaatccatta

SEQ ID NO: 638156 - DNA, 13 bp, D. melanogaster
taaaaatccattt

SEQ ID NO: 638157 - DNA, 13 bp, D. melanogaster
taaaaatcgattt

SEQ ID NO: 638158 - DNA, 13 bp, D. melanogaster
taaaaatcggatt

SEQ ID NO: 638159 - DNA, 13 bp, D. melanogaster
taaaaatctaacc

SEQ ID NO: 638160 - DNA, 13 bp, D. melanogaster
taaaaatctagtt

SEQ ID NO: 638161 - DNA, 14 bp, D. melanogaster
taaaaatcttaact

SEQ ID NO: 638162 - DNA, 13 bp, D. melanogaster
taaaaatgaatgc

SEQ ID NO: 638163 - DNA, 13 bp, D. melanogaster
taaaaatgagttt

SEQ ID NO: 638164 - DNA, 13 bp, D. melanogaster
taaaaatgatggc

SEQ ID NO: 638165 - DNA, 14 bp, D. melanogaster
taaaaatgcaaaat

SEQ ID NO: 638166 - DNA, 14 bp, D. melanogaster
taaaaatgcaaatt

SEQ ID NO: 638167 - DNA, 13 bp, D. melanogaster
taaaaatgcaata

SEQ ID NO: 638168 - DNA, 14 bp, D. melanogaster
taaaaatgcaataa

SEQ ID NO: 638169 - DNA, 13 bp, D. melanogaster
taaaaatgcaatc

SEQ ID NO: 638170 - DNA, 13 bp, D. melanogaster
taaaaatgcaatt

SEQ ID NO: 638171 - DNA, 13 bp, D. melanogaster
taaaaatgcatat

SEQ ID NO: 638172 - DNA, 13 bp, D. melanogaster
taaaaatgcattt

SEQ ID NO: 638173 - DNA, 13 bp, D. melanogaster
taaaaatgccagc

SEQ ID NO: 638174 - DNA, 13 bp, D. melanogaster
taaaaatgcccaa

SEQ ID NO: 638175 - DNA, 14 bp, D. melanogaster
taaaaatgcccaat

SEQ ID NO: 638176 - DNA, 13 bp, D. melanogaster
taaaaatgcgtct

SEQ ID NO: 638177 - DNA, 13 bp, D. melanogaster
taaaaatgctata

SEQ ID NO: 638178 - DNA, 13 bp, D. melanogaster
taaaaatgctatt

SEQ ID NO: 638179 - DNA, 13 bp, D. melanogaster
taaaaatgctcat

SEQ ID NO: 638180 - DNA, 14 bp, D. melanogaster
taaaaatgctcata

SEQ ID NO: 638181 - DNA, 14 bp, D. melanogaster
taaaaatgctttta

SEQ ID NO: 638182 - DNA, 13 bp, D. melanogaster
taaaaatggaatc

SEQ ID NO: 638183 - DNA, 14 bp, D. melanogaster
taaaaatggaatcc

SEQ ID NO: 638184 - DNA, 13 bp, D. melanogaster
taaaaatggaatt

SEQ ID NO: 638185 - DNA, 14 bp, D. melanogaster
taaaaatggaattt

SEQ ID NO: 638186 - DNA, 13 bp, D. melanogaster
taaaaatggattt

SEQ ID NO: 638187 - DNA, 13 bp, D. melanogaster
taaaaatggtatt

SEQ ID NO: 638188 - DNA, 13 bp, D. melanogaster
taaaaatggttaa

SEQ ID NO: 638189 - DNA, 13 bp, D. melanogaster
taaaaatggtttt

SEQ ID NO: 638190 - DNA, 13 bp, D. melanogaster
taaaaatgtaaac

SEQ ID NO: 638191 - DNA, 13 bp, D. melanogaster
taaaaatgtaagc

SEQ ID NO: 638192 - DNA, 13 bp, D. melanogaster
taaaaatgtaatg

SEQ ID NO: 638193 - DNA, 13 bp, D. melanogaster
taaaaatgtacac

SEQ ID NO: 638194 - DNA, 13 bp, D. melanogaster
taaaaatgtagta

SEQ ID NO: 638195 - DNA, 13 bp, D. melanogaster
taaaaatgtattg

SEQ ID NO: 638196 - DNA, 13 bp, D. melanogaster
taaaaatgtgaat

SEQ ID NO: 638197 - DNA, 13 bp, D. melanogaster
taaaaatgtgata

SEQ ID NO: 638198 - DNA, 13 bp, D. melanogaster
taaaaatgtggaa

SEQ ID NO: 638199 - DNA, 13 bp, D. melanogaster
taaaaatgtgtat

SEQ ID NO: 638200 - DNA, 13 bp, D. melanogaster
taaaaatgtgttt

SEQ ID NO: 638201 - DNA, 13 bp, D. melanogaster
taaaaatgttagt

SEQ ID NO: 638202 - DNA, 13 bp, D. melanogaster
taaaaatgttctt

SEQ ID NO: 638203 - DNA, 13 bp, D. melanogaster
taaaaatgttgtg

SEQ ID NO: 638204 - DNA, 14 bp, D. melanogaster
taaaaatgtttaag

SEQ ID NO: 638205 - DNA, 13 bp, D. melanogaster
taaaaatgtttct

SEQ ID NO: 638206 - DNA, 13 bp, D. melanogaster
taaaaattattgg

SEQ ID NO: 638207 - DNA, 13 bp, D. melanogaster
taaaaattccaca

SEQ ID NO: 638208 - DNA, 13 bp, D. melanogaster
taaaaattccact

SEQ ID NO: 638209 - DNA, 13 bp, D. melanogaster
taaaaattcgatt

SEQ ID NO: 638210 - DNA, 13 bp, D. melanogaster
taaaaattcttca

SEQ ID NO: 638211 - DNA, 13 bp, D. melanogaster
taaaaattgcaat

SEQ ID NO: 638212 - DNA, 13 bp, D. melanogaster
taaaaattgtttc

SEQ ID NO: 638213 - DNA, 14 bp, D. melanogaster
taaaaattgtttcg

SEQ ID NO: 638214 - DNA, 13 bp, D. melanogaster
taaaaatttcaac

SEQ ID NO: 638215 - DNA, 13 bp, D. melanogaster
taaaaatttcaca

SEQ ID NO: 638216 - DNA, 13 bp, D. melanogaster
taaaaatttccaa

SEQ ID NO: 638217 - DNA, 14 bp, D. melanogaster
taaaaatttccaat

SEQ ID NO: 638218 - DNA, 13 bp, D. melanogaster
taaaaatttgcaa

SEQ ID NO: 638219 - DNA, 14 bp, D. melanogaster
taaaaatttgcaaa

SEQ ID NO: 638220 - DNA, 13 bp, D. melanogaster
taaaaattttgac

SEQ ID NO: 638221 - DNA, 14 bp, D. melanogaster
taaaacaaaagttt

SEQ ID NO: 638222 - DNA, 13 bp, D. melanogaster
taaaacaaaattg

SEQ ID NO: 638223 - DNA, 14 bp, D. melanogaster
taaaacaaaattga

SEQ ID NO: 638224 - DNA, 13 bp, D. melanogaster
taaaacaaaggca

SEQ ID NO: 638225 - DNA, 13 bp, D. melanogaster
taaaacaaatcga

SEQ ID NO: 638226 - DNA, 13 bp, D. melanogaster
taaaacaaatgca

SEQ ID NO: 638227 - DNA, 13 bp, D. melanogaster
taaaacaaatgcc

SEQ ID NO: 638228 - DNA, 13 bp, D. melanogaster
taaaacaaatgta

SEQ ID NO: 638229 - DNA, 14 bp, D. melanogaster
taaaacaacatttt

SEQ ID NO: 638230 - DNA, 13 bp, D. melanogaster
taaaacaagaatt

SEQ ID NO: 638231 - DNA, 13 bp, D. melanogaster
taaaacaatgcaa

SEQ ID NO: 638232 - DNA, 13 bp, D. melanogaster
taaaacacatttt

SEQ ID NO: 638233 - DNA, 13 bp, D. melanogaster
taaaacacttgaa

SEQ ID NO: 638234 - DNA, 14 bp, D. melanogaster
taaaacacttttta

SEQ ID NO: 638235 - DNA, 13 bp, D. melanogaster
taaaacagctgtt

SEQ ID NO: 638236 - DNA, 13 bp, D. melanogaster
taaaacatatatg

SEQ ID NO: 638237 - DNA, 13 bp, D. melanogaster
taaaacatattgt

SEQ ID NO: 638238 - DNA, 13 bp, D. melanogaster
taaaacatatttc

SEQ ID NO: 638239 - DNA, 13 bp, D. melanogaster
taaaacatgaaac

SEQ ID NO: 638240 - DNA, 13 bp, D. melanogaster
taaaacatgcaaa

SEQ ID NO: 638241 - DNA, 13 bp, D. melanogaster
taaaacatttaac

SEQ ID NO: 638242 - DNA, 13 bp, D. melanogaster
taaaacatttact

SEQ ID NO: 638243 - DNA, 13 bp, D. melanogaster
taaaacattttca

SEQ ID NO: 638244 - DNA, 13 bp, D. melanogaster
taaaaccaaaagc

SEQ ID NO: 638245 - DNA, 13 bp, D. melanogaster
taaaaccaaacct

SEQ ID NO: 638246 - DNA, 15 bp, D. melanogaster
taaaaccaaacctct

SEQ ID NO: 638247 - DNA, 13 bp, D. melanogaster
taaaaccaaatga

SEQ ID NO: 638248 - DNA, 14 bp, D. melanogaster
taaaaccaacatat

SEQ ID NO: 638249 - DNA, 13 bp, D. melanogaster
taaaaccaacatt

SEQ ID NO: 638250 - DNA, 13 bp, D. melanogaster
taaaaccaagcac

SEQ ID NO: 638251 - DNA, 13 bp, D. melanogaster
taaaaccaaggtc

SEQ ID NO: 638252 - DNA, 13 bp, D. melanogaster
taaaaccaagttt

SEQ ID NO: 638253 - DNA, 14 bp, D. melanogaster
taaaaccaatttgt

SEQ ID NO: 638254 - DNA, 13 bp, D. melanogaster
taaaaccagtttc

SEQ ID NO: 638255 - DNA, 13 bp, D. melanogaster
taaaaccatttat

SEQ ID NO: 638256 - DNA, 13 bp, D. melanogaster
taaaaccattttg

SEQ ID NO: 638257 - DNA, 13 bp, D. melanogaster
taaaacccaattt

SEQ ID NO: 638258 - DNA, 13 bp, D. melanogaster
taaaaccgaaacg

SEQ ID NO: 638259 - DNA, 13 bp, D. melanogaster
taaaaccgaacaa

SEQ ID NO: 638260 - DNA, 13 bp, D. melanogaster
taaaaccgcaaaa

SEQ ID NO: 638261 - DNA, 13 bp, D. melanogaster
taaaaccgcccaa

SEQ ID NO: 638262 - DNA, 14 bp, D. melanogaster
taaaaccgcccaaa

SEQ ID NO: 638263 - DNA, 14 bp, D. melanogaster
taaaacctatgtaa

SEQ ID NO: 638264 - DNA, 13 bp, D. melanogaster
taaaacctatttt

SEQ ID NO: 638265 - DNA, 13 bp, D. melanogaster
taaaacctgaacc

SEQ ID NO: 638266 - DNA, 14 bp, D. melanogaster
taaaacctgtaaag

SEQ ID NO: 638267 - DNA, 13 bp, D. melanogaster
taaaaccttattt

SEQ ID NO: 638268 - DNA, 13 bp, D. melanogaster
taaaacctttaaa

SEQ ID NO: 638269 - DNA, 13 bp, D. melanogaster
taaaacctttaat

SEQ ID NO: 638270 - DNA, 13 bp, D. melanogaster
taaaacctttttt

SEQ ID NO: 638271 - DNA, 13 bp, D. melanogaster
taaaacgaaacca

SEQ ID NO: 638272 - DNA, 14 bp, D. melanogaster
taaaacgaaatgaa

SEQ ID NO: 638273 - DNA, 13 bp, D. melanogaster
taaaacgaattta

SEQ ID NO: 638274 - DNA, 13 bp, D. melanogaster
taaaacgaggaaa

SEQ ID NO: 638275 - DNA, 14 bp, D. melanogaster
taaaacgaggaaaa

SEQ ID NO: 638276 - DNA, 13 bp, D. melanogaster
taaaacgcaaata

SEQ ID NO: 638277 - DNA, 14 bp, D. melanogaster
taaaacgcaataaa

SEQ ID NO: 638278 - DNA, 13 bp, D. melanogaster
taaaacgcagcca

SEQ ID NO: 638279 - DNA, 13 bp, D. melanogaster
taaaacgcatttt

SEQ ID NO: 638280 - DNA, 13 bp, D. melanogaster
taaaacgcttttt

SEQ ID NO: 638281 - DNA, 13 bp, D. melanogaster
taaaacggaaata

SEQ ID NO: 638282 - DNA, 13 bp, D. melanogaster
taaaacggaaatt

SEQ ID NO: 638283 - DNA, 13 bp, D. melanogaster
taaaacggagcat

SEQ ID NO: 638284 - DNA, 13 bp, D. melanogaster
taaaacgtaattt

SEQ ID NO: 638285 - DNA, 13 bp, D. melanogaster
taaaacgtatttt

SEQ ID NO: 638286 - DNA, 13 bp, D. melanogaster
taaaacgtgccaa

SEQ ID NO: 638287 - DNA, 13 bp, D. melanogaster
taaaacgtttaaa

SEQ ID NO: 638288 - DNA, 13 bp, D. melanogaster
taaaacgttttaa

SEQ ID NO: 638289 - DNA, 13 bp, D. melanogaster
taaaacgtttttt

SEQ ID NO: 638290 - DNA, 13 bp, D. melanogaster
taaaactaaaagc

SEQ ID NO: 638291 - DNA, 13 bp, D. melanogaster
taaaactaaactt

SEQ ID NO: 638292 - DNA, 13 bp, D. melanogaster
taaaactaaattc

SEQ ID NO: 638293 - DNA, 13 bp, D. melanogaster
taaaactacatat

SEQ ID NO: 638294 - DNA, 13 bp, D. melanogaster
taaaactagctat

SEQ ID NO: 638295 - DNA, 13 bp, D. melanogaster
taaaactatgaaa

SEQ ID NO: 638296 - DNA, 14 bp, D. melanogaster
taaaactcaaacat

SEQ ID NO: 638297 - DNA, 13 bp, D. melanogaster
taaaactccataa

SEQ ID NO: 638298 - DNA, 13 bp, D. melanogaster
taaaactgaaaac

SEQ ID NO: 638299 - DNA, 13 bp, D. melanogaster
taaaactgaaaat

SEQ ID NO: 638300 - DNA, 14 bp, D. melanogaster
taaaactgaaaata

SEQ ID NO: 638301 - DNA, 14 bp, D. melanogaster
taaaactgaaactg

SEQ ID NO: 638302 - DNA, 13 bp, D. melanogaster
taaaactgaaaga

SEQ ID NO: 638303 - DNA, 13 bp, D. melanogaster
taaaactgaaata

SEQ ID NO: 638304 - DNA, 13 bp, D. melanogaster
taaaactgaataa

SEQ ID NO: 638305 - DNA, 13 bp, D. melanogaster
taaaactgaattt

SEQ ID NO: 638306 - DNA, 13 bp, D. melanogaster
taaaactgcattc

SEQ ID NO: 638307 - DNA, 13 bp, D. melanogaster
taaaactggaaaa

SEQ ID NO: 638308 - DNA, 13 bp, D. melanogaster
taaaactgtttat

SEQ ID NO: 638309 - DNA, 13 bp, D. melanogaster
taaaacttaaagt

SEQ ID NO: 638310 - DNA, 13 bp, D. melanogaster
taaaacttaagat

SEQ ID NO: 638311 - DNA, 13 bp, D. melanogaster
taaaacttaatca

SEQ ID NO: 638312 - DNA, 13 bp, D. melanogaster
taaaacttcacat

SEQ ID NO: 638313 - DNA, 13 bp, D. melanogaster
taaaacttgaaaa

SEQ ID NO: 638314 - DNA, 13 bp, D. melanogaster
taaaactttacaa

SEQ ID NO: 638315 - DNA, 13 bp, D. melanogaster
taaaacttttcta

SEQ ID NO: 638316 - DNA, 13 bp, D. melanogaster
taaaagaaaattc

SEQ ID NO: 638317 - DNA, 13 bp, D. melanogaster
taaaagaaatgtg

SEQ ID NO: 638318 - DNA, 14 bp, D. melanogaster
taaaagaaattgga

SEQ ID NO: 638319 - DNA, 14 bp, D. melanogaster
taaaagagttgaca

SEQ ID NO: 638320 - DNA, 14 bp, D. melanogaster
taaaagataaaacc

SEQ ID NO: 638321 - DNA, 14 bp, D. melanogaster
taaaagatgatgag

SEQ ID NO: 638322 - DNA, 13 bp, D. melanogaster
taaaagatggcaa

SEQ ID NO: 638323 - DNA, 13 bp, D. melanogaster
taaaagattaatg

SEQ ID NO: 638324 - DNA, 14 bp, D. melanogaster
taaaagcaaaagca

SEQ ID NO: 638325 - DNA, 13 bp, D. melanogaster
taaaagcaaacat

SEQ ID NO: 638326 - DNA, 13 bp, D. melanogaster
taaaagcagcagc

SEQ ID NO: 638327 - DNA, 13 bp, D. melanogaster
taaaagcatattt

SEQ ID NO: 638328 - DNA, 13 bp, D. melanogaster
taaaagcatttgc

SEQ ID NO: 638329 - DNA, 13 bp, D. melanogaster
taaaagccaaaca

SEQ ID NO: 638330 - DNA, 13 bp, D. melanogaster
taaaagccaaagc

SEQ ID NO: 638331 - DNA, 13 bp, D. melanogaster
taaaagccaacaa

SEQ ID NO: 638332 - DNA, 13 bp, D. melanogaster
taaaagccaactt

SEQ ID NO: 638333 - DNA, 13 bp, D. melanogaster
taaaagccaatta

SEQ ID NO: 638334 - DNA, 13 bp, D. melanogaster
taaaagccactaa

SEQ ID NO: 638335 - DNA, 13 bp, D. melanogaster
taaaagccattta

SEQ ID NO: 638336 - DNA, 13 bp, D. melanogaster
taaaagcctttaa

SEQ ID NO: 638337 - DNA, 13 bp, D. melanogaster
taaaagcgaaata

SEQ ID NO: 638338 - DNA, 13 bp, D. melanogaster
taaaagcgcaaaa

SEQ ID NO: 638339 - DNA, 14 bp, D. melanogaster
taaaagcgcaaaaa

SEQ ID NO: 638340 - DNA, 13 bp, D. melanogaster
taaaagctaaaag

SEQ ID NO: 638341 - DNA, 14 bp, D. melanogaster
taaaagctaaaagg

SEQ ID NO: 638342 - DNA, 13 bp, D. melanogaster
taaaagctaaagt

SEQ ID NO: 638343 - DNA, 13 bp, D. melanogaster
taaaagctagaaa

SEQ ID NO: 638344 - DNA, 13 bp, D. melanogaster
taaaagctctgga

SEQ ID NO: 638345 - DNA, 13 bp, D. melanogaster
taaaagcttaatt

SEQ ID NO: 638346 - DNA, 13 bp, D. melanogaster
taaaagctttgaa

SEQ ID NO: 638347 - DNA, 14 bp, D. melanogaster
taaaagcttttctt

SEQ ID NO: 638348 - DNA, 13 bp, D. melanogaster
taaaaggaaaagc

SEQ ID NO: 638349 - DNA, 13 bp, D. melanogaster
taaaaggcaaata

SEQ ID NO: 638350 - DNA, 13 bp, D. melanogaster
taaaaggcaattt

SEQ ID NO: 638351 - DNA, 13 bp, D. melanogaster
taaaaggcatttt

SEQ ID NO: 638352 - DNA, 13 bp, D. melanogaster
taaaaggcgaaaa

SEQ ID NO: 638353 - DNA, 13 bp, D. melanogaster
taaaaggcttgtt

SEQ ID NO: 638354 - DNA, 13 bp, D. melanogaster
taaaaggttttaa

SEQ ID NO: 638355 - DNA, 13 bp, D. melanogaster
taaaagtaaacca

SEQ ID NO: 638356 - DNA, 13 bp, D. melanogaster
taaaagtaaacga

SEQ ID NO: 638357 - DNA, 13 bp, D. melanogaster
taaaagtaaatac

SEQ ID NO: 638358 - DNA, 13 bp, D. melanogaster
taaaagtaaattc

SEQ ID NO: 638359 - DNA, 13 bp, D. melanogaster
taaaagtaattca

SEQ ID NO: 638360 - DNA, 13 bp, D. melanogaster
taaaagtaattgt

SEQ ID NO: 638361 - DNA, 13 bp, D. melanogaster
taaaagtacatat

SEQ ID NO: 638362 - DNA, 13 bp, D. melanogaster
taaaagtacgttg

SEQ ID NO: 638363 - DNA, 13 bp, D. melanogaster
taaaagtagagca

SEQ ID NO: 638364 - DNA, 13 bp, D. melanogaster
taaaagtatacaa

SEQ ID NO: 638365 - DNA, 13 bp, D. melanogaster
taaaagtatatac

SEQ ID NO: 638366 - DNA, 13 bp, D. melanogaster
taaaagtatcttt

SEQ ID NO: 638367 - DNA, 13 bp, D. melanogaster
taaaagtatgcaa

SEQ ID NO: 638368 - DNA, 13 bp, D. melanogaster
taaaagtatgtat

SEQ ID NO: 638369 - DNA, 13 bp, D. melanogaster
taaaagtattttg

SEQ ID NO: 638370 - DNA, 13 bp, D. melanogaster
taaaagtcaaaac

SEQ ID NO: 638371 - DNA, 13 bp, D. melanogaster
taaaagtcaaaat

SEQ ID NO: 638372 - DNA, 13 bp, D. melanogaster
taaaagtcaaatg

SEQ ID NO: 638373 - DNA, 14 bp, D. melanogaster
taaaagtcaattaa

SEQ ID NO: 638374 - DNA, 13 bp, D. melanogaster
taaaagtcattta

SEQ ID NO: 638375 - DNA, 13 bp, D. melanogaster
taaaagtctgtcc

SEQ ID NO: 638376 - DNA, 13 bp, D. melanogaster
taaaagtcttaaa

SEQ ID NO: 638377 - DNA, 13 bp, D. melanogaster
taaaagtgaaagg

SEQ ID NO: 638378 - DNA, 13 bp, D. melanogaster
taaaagtgaatta

SEQ ID NO: 638379 - DNA, 13 bp, D. melanogaster
taaaagtgcaaca

SEQ ID NO: 638380 - DNA, 13 bp, D. melanogaster
taaaagtgcaatt

SEQ ID NO: 638381 - DNA, 13 bp, D. melanogaster
taaaagtgcattt

SEQ ID NO: 638382 - DNA, 13 bp, D. melanogaster
taaaagtgtataa

SEQ ID NO: 638383 - DNA, 13 bp, D. melanogaster
taaaagtgttttt

SEQ ID NO: 638384 - DNA, 13 bp, D. melanogaster
taaaagttaacaa

SEQ ID NO: 638385 - DNA, 13 bp, D. melanogaster
taaaagttacaaa

SEQ ID NO: 638386 - DNA, 13 bp, D. melanogaster
taaaagttcaaag

SEQ ID NO: 638387 - DNA, 13 bp, D. melanogaster
taaaagttctctt

SEQ ID NO: 638388 - DNA, 13 bp, D. melanogaster
taaaagttgcaat

SEQ ID NO: 638389 - DNA, 13 bp, D. melanogaster
taaaagttggaga

SEQ ID NO: 638390 - DNA, 13 bp, D. melanogaster
taaaagttggcaa

SEQ ID NO: 638391 - DNA, 14 bp, D. melanogaster
taaaagttgtaaag

SEQ ID NO: 638392 - DNA, 13 bp, D. melanogaster
taaaagttgtttt

SEQ ID NO: 638393 - DNA, 13 bp, D. melanogaster
taaaagtttactt

SEQ ID NO: 638394 - DNA, 13 bp, D. melanogaster
taaaagtttagtt

SEQ ID NO: 638395 - DNA, 13 bp, D. melanogaster
taaaagtttcctc

SEQ ID NO: 638396 - DNA, 14 bp, D. melanogaster
taaaagtttcttat

SEQ ID NO: 638397 - DNA, 13 bp, D. melanogaster
taaaagtttgcca

SEQ ID NO: 638398 - DNA, 13 bp, D. melanogaster
taaaagttttcaa

SEQ ID NO: 638399 - DNA, 13 bp, D. melanogaster
taaaagttttccc

SEQ ID NO: 638400 - DNA, 13 bp, D. melanogaster
taaaagttttctc

SEQ ID NO: 638401 - DNA, 13 bp, D. melanogaster
taaaagttttgta

SEQ ID NO: 638402 - DNA, 14 bp, D. melanogaster
taaaagtttttcat

SEQ ID NO: 638403 - DNA, 13 bp, D. melanogaster
taaaataaaatgc

SEQ ID NO: 638404 - DNA, 13 bp, D. melanogaster
taaaataaacagc

SEQ ID NO: 638405 - DNA, 13 bp, D. melanogaster
taaaataaacatg

SEQ ID NO: 638406 - DNA, 13 bp, D. melanogaster
taaaataaatgca

SEQ ID NO: 638407 - DNA, 13 bp, D. melanogaster
taaaataaatgcc

SEQ ID NO: 638408 - DNA, 13 bp, D. melanogaster
taaaataagaatc

SEQ ID NO: 638409 - DNA, 13 bp, D. melanogaster
taaaataagacag

SEQ ID NO: 638410 - DNA, 13 bp, D. melanogaster
taaaataatcaag

SEQ ID NO: 638411 - DNA, 14 bp, D. melanogaster
taaaataatcaagc

SEQ ID NO: 638412 - DNA, 13 bp, D. melanogaster
taaaataatgtga

SEQ ID NO: 638413 - DNA, 13 bp, D. melanogaster
taaaataattgca

SEQ ID NO: 638414 - DNA, 14 bp, D. melanogaster
taaaataatttgca

SEQ ID NO: 638415 - DNA, 13 bp, D. melanogaster
taaaatacaagtt

SEQ ID NO: 638416 - DNA, 13 bp, D. melanogaster
taaaatacagatt

SEQ ID NO: 638417 - DNA, 13 bp, D. melanogaster
taaaatacataga

SEQ ID NO: 638418 - DNA, 13 bp, D. melanogaster
taaaatacgattt

SEQ ID NO: 638419 - DNA, 13 bp, D. melanogaster
taaaatacgtttt

SEQ ID NO: 638420 - DNA, 13 bp, D. melanogaster
taaaatagcaatt

SEQ ID NO: 638421 - DNA, 14 bp, D. melanogaster
taaaatagcaatta

SEQ ID NO: 638422 - DNA, 13 bp, D. melanogaster
taaaatagcattt

SEQ ID NO: 638423 - DNA, 13 bp, D. melanogaster
taaaatagccaac

SEQ ID NO: 638424 - DNA, 13 bp, D. melanogaster
taaaatagcttta

SEQ ID NO: 638425 - DNA, 13 bp, D. melanogaster
taaaatagttgaa

SEQ ID NO: 638426 - DNA, 13 bp, D. melanogaster
taaaatagtttgt

SEQ ID NO: 638427 - DNA, 13 bp, D. melanogaster
taaaatagttttc

SEQ ID NO: 638428 - DNA, 14 bp, D. melanogaster
taaaatatatatgc

SEQ ID NO: 638429 - DNA, 13 bp, D. melanogaster
taaaatatatgca

SEQ ID NO: 638430 - DNA, 13 bp, D. melanogaster
taaaatatatgtg

SEQ ID NO: 638431 - DNA, 13 bp, D. melanogaster
taaaatatcactt

SEQ ID NO: 638432 - DNA, 13 bp, D. melanogaster
taaaatatccttt

SEQ ID NO: 638433 - DNA, 14 bp, D. melanogaster
taaaatatgcaaaa

SEQ ID NO: 638434 - DNA, 13 bp, D. melanogaster
taaaatatgcaca

SEQ ID NO: 638435 - DNA, 13 bp, D. melanogaster
taaaatatgctta

SEQ ID NO: 638436 - DNA, 13 bp, D. melanogaster
taaaatatggatt

SEQ ID NO: 638437 - DNA, 13 bp, D. melanogaster
taaaatatgtact

SEQ ID NO: 638438 - DNA, 13 bp, D. melanogaster
taaaatattcatg

SEQ ID NO: 638439 - DNA, 13 bp, D. melanogaster
taaaatattctca

SEQ ID NO: 638440 - DNA, 13 bp, D. melanogaster
taaaatattggca

SEQ ID NO: 638441 - DNA, 14 bp, D. melanogaster
taaaatattgtcat

SEQ ID NO: 638442 - DNA, 14 bp, D. melanogaster
taaaatatttgctt

SEQ ID NO: 638443 - DNA, 14 bp, D. melanogaster
taaaatattttagc

SEQ ID NO: 638444 - DNA, 13 bp, D. melanogaster
taaaatcaaagca

SEQ ID NO: 638445 - DNA, 13 bp, D. melanogaster
taaaatcaaattg

SEQ ID NO: 638446 - DNA, 13 bp, D. melanogaster
taaaatcaacaag

SEQ ID NO: 638447 - DNA, 13 bp, D. melanogaster
taaaatcacaatt

SEQ ID NO: 638448 - DNA, 13 bp, D. melanogaster
taaaatcacattt

SEQ ID NO: 638449 - DNA, 14 bp, D. melanogaster
taaaatcacatttt

SEQ ID NO: 638450 - DNA, 14 bp, D. melanogaster
taaaatcagagaga

SEQ ID NO: 638451 - DNA, 13 bp, D. melanogaster
taaaatcagtttt

SEQ ID NO: 638452 - DNA, 13 bp, D. melanogaster
taaaatcatattc

SEQ ID NO: 638453 - DNA, 13 bp, D. melanogaster
taaaatcatgtat

SEQ ID NO: 638454 - DNA, 13 bp, D. melanogaster
taaaatcattaag

SEQ ID NO: 638455 - DNA, 13 bp, D. melanogaster
taaaatccatttt

SEQ ID NO: 638456 - DNA, 13 bp, D. melanogaster
taaaatcctctgg

SEQ ID NO: 638457 - DNA, 13 bp, D. melanogaster
taaaatcctggcc

SEQ ID NO: 638458 - DNA, 13 bp, D. melanogaster
taaaatccttaaa

SEQ ID NO: 638459 - DNA, 13 bp, D. melanogaster
taaaatcgaaaat

SEQ ID NO: 638460 - DNA, 13 bp, D. melanogaster
taaaatcgaatta

SEQ ID NO: 638461 - DNA, 13 bp, D. melanogaster
taaaatcgatttt

SEQ ID NO: 638462 - DNA, 13 bp, D. melanogaster
taaaatcgcaatt

SEQ ID NO: 638463 - DNA, 13 bp, D. melanogaster
taaaatcggagag

SEQ ID NO: 638464 - DNA, 13 bp, D. melanogaster
taaaatcgttttt

SEQ ID NO: 638465 - DNA, 14 bp, D. melanogaster
taaaatctaaatct

SEQ ID NO: 638466 - DNA, 13 bp, D. melanogaster
taaaatctatgaa

SEQ ID NO: 638467 - DNA, 13 bp, D. melanogaster
taaaatctcagct

SEQ ID NO: 638468 - DNA, 13 bp, D. melanogaster
taaaatctgaaaa

SEQ ID NO: 638469 - DNA, 13 bp, D. melanogaster
taaaatctgaaat

SEQ ID NO: 638470 - DNA, 13 bp, D. melanogaster
taaaatctgcaaa

SEQ ID NO: 638471 - DNA, 13 bp, D. melanogaster
taaaatctgtatg

SEQ ID NO: 638472 - DNA, 13 bp, D. melanogaster
taaaatcttgaaa

SEQ ID NO: 638473 - DNA, 13 bp, D. melanogaster
taaaatcttttga

SEQ ID NO: 638474 - DNA, 13 bp, D. melanogaster
taaaatgaaactt

SEQ ID NO: 638475 - DNA, 14 bp, D. melanogaster
taaaatgaaataca

SEQ ID NO: 638476 - DNA, 14 bp, D. melanogaster
taaaatgaaatcaa

SEQ ID NO: 638477 - DNA, 13 bp, D. melanogaster
taaaatgaaattc

SEQ ID NO: 638478 - DNA, 13 bp, D. melanogaster
taaaatgaacttg

SEQ ID NO: 638479 - DNA, 13 bp, D. melanogaster
taaaatgaagtat

SEQ ID NO: 638480 - DNA, 13 bp, D. melanogaster
taaaatgagtttt

SEQ ID NO: 638481 - DNA, 13 bp, D. melanogaster
taaaatgcaaaac

SEQ ID NO: 638482 - DNA, 13 bp, D. melanogaster
taaaatgcaaaga

SEQ ID NO: 638483 - DNA, 13 bp, D. melanogaster
taaaatgcaaatg

SEQ ID NO: 638484 - DNA, 14 bp, D. melanogaster
taaaatgcaaatga

SEQ ID NO: 638485 - DNA, 13 bp, D. melanogaster
taaaatgcaaatt

SEQ ID NO: 638486 - DNA, 14 bp, D. melanogaster
taaaatgcagaaaa

SEQ ID NO: 638487 - DNA, 13 bp, D. melanogaster
taaaatgcagcca

SEQ ID NO: 638488 - DNA, 13 bp, D. melanogaster
taaaatgcataaa

SEQ ID NO: 638489 - DNA, 13 bp, D. melanogaster
taaaatgcatgca

SEQ ID NO: 638490 - DNA, 13 bp, D. melanogaster
taaaatgcattga

SEQ ID NO: 638491 - DNA, 14 bp, D. melanogaster
taaaatgcatttca

SEQ ID NO: 638492 - DNA, 13 bp, D. melanogaster
taaaatgcatttg

SEQ ID NO: 638493 - DNA, 13 bp, D. melanogaster
taaaatgcatttt

SEQ ID NO: 638494 - DNA, 13 bp, D. melanogaster
taaaatgccaaag

SEQ ID NO: 638495 - DNA, 13 bp, D. melanogaster
taaaatgccacaa

SEQ ID NO: 638496 - DNA, 13 bp, D. melanogaster
taaaatgccattt

SEQ ID NO: 638497 - DNA, 13 bp, D. melanogaster
taaaatgccgcaa

SEQ ID NO: 638498 - DNA, 13 bp, D. melanogaster
taaaatgcctttt

SEQ ID NO: 638499 - DNA, 13 bp, D. melanogaster
taaaatgcgaaaa

SEQ ID NO: 638500 - DNA, 14 bp, D. melanogaster
taaaatgcgaaaat

SEQ ID NO: 638501 - DNA, 13 bp, D. melanogaster
taaaatgctaaat

SEQ ID NO: 638502 - DNA, 13 bp, D. melanogaster
taaaatgctaatt

SEQ ID NO: 638503 - DNA, 13 bp, D. melanogaster
taaaatgctgttt

SEQ ID NO: 638504 - DNA, 13 bp, D. melanogaster
taaaatgcttaaa

SEQ ID NO: 638505 - DNA, 13 bp, D. melanogaster
taaaatgctttaa

SEQ ID NO: 638506 - DNA, 14 bp, D. melanogaster
taaaatggaaatga

SEQ ID NO: 638507 - DNA, 13 bp, D. melanogaster
taaaatggcaaaa

SEQ ID NO: 638508 - DNA, 13 bp, D. melanogaster
taaaatggcacaa

SEQ ID NO: 638509 - DNA, 13 bp, D. melanogaster
taaaatggtttat

SEQ ID NO: 638510 - DNA, 13 bp, D. melanogaster
taaaatggttttg

SEQ ID NO: 638511 - DNA, 13 bp, D. melanogaster
taaaatgtaaagt

SEQ ID NO: 638512 - DNA, 14 bp, D. melanogaster
taaaatgtaaatgt

SEQ ID NO: 638513 - DNA, 14 bp, D. melanogaster
taaaatgtaatcaa

SEQ ID NO: 638514 - DNA, 13 bp, D. melanogaster
taaaatgtacaaa

SEQ ID NO: 638515 - DNA, 13 bp, D. melanogaster
taaaatgtacttg

SEQ ID NO: 638516 - DNA, 13 bp, D. melanogaster
taaaatgtagcaa

SEQ ID NO: 638517 - DNA, 13 bp, D. melanogaster
taaaatgtagttt

SEQ ID NO: 638518 - DNA, 13 bp, D. melanogaster
taaaatgtatcaa

SEQ ID NO: 638519 - DNA, 13 bp, D. melanogaster
taaaatgtcaaat

SEQ ID NO: 638520 - DNA, 13 bp, D. melanogaster
taaaatgtcaaca

SEQ ID NO: 638521 - DNA, 13 bp, D. melanogaster
taaaatgtcacat

SEQ ID NO: 638522 - DNA, 14 bp, D. melanogaster
taaaatgtcatcaa

SEQ ID NO: 638523 - DNA, 13 bp, D. melanogaster
taaaatgtgaata

SEQ ID NO: 638524 - DNA, 13 bp, D. melanogaster
taaaatgtgcatt

SEQ ID NO: 638525 - DNA, 13 bp, D. melanogaster
taaaatgtgccaa

SEQ ID NO: 638526 - DNA, 13 bp, D. melanogaster
taaaatgtgtgtg

SEQ ID NO: 638527 - DNA, 13 bp, D. melanogaster
taaaatgtgtttt

SEQ ID NO: 638528 - DNA, 13 bp, D. melanogaster
taaaatgttaagt

SEQ ID NO: 638529 - DNA, 13 bp, D. melanogaster
taaaatgttatac

SEQ ID NO: 638530 - DNA, 13 bp, D. melanogaster
taaaatgttcaat

SEQ ID NO: 638531 - DNA, 13 bp, D. melanogaster
taaaatgtttcaa

SEQ ID NO: 638532 - DNA, 13 bp, D. melanogaster
taaaatgtttcct

SEQ ID NO: 638533 - DNA, 13 bp, D. melanogaster
taaaatgtttgat

SEQ ID NO: 638534 - DNA, 13 bp, D. melanogaster
taaaatgtttgta

SEQ ID NO: 638535 - DNA, 13 bp, D. melanogaster
taaaatgttttgt

SEQ ID NO: 638536 - DNA, 13 bp, D. melanogaster
taaaattaaaagc

SEQ ID NO: 638537 - DNA, 14 bp, D. melanogaster
taaaattaaaagcc

SEQ ID NO: 638538 - DNA, 13 bp, D. melanogaster
taaaattaaactg

SEQ ID NO: 638539 - DNA, 13 bp, D. melanogaster
taaaattaaagtg

SEQ ID NO: 638540 - DNA, 13 bp, D. melanogaster
taaaattaacgaa

SEQ ID NO: 638541 - DNA, 13 bp, D. melanogaster
taaaattagttca

SEQ ID NO: 638542 - DNA, 13 bp, D. melanogaster
taaaattatgcaa

SEQ ID NO: 638543 - DNA, 14 bp, D. melanogaster
taaaattatgtttg

SEQ ID NO: 638544 - DNA, 13 bp, D. melanogaster
taaaattcacttt

SEQ ID NO: 638545 - DNA, 13 bp, D. melanogaster
taaaattcatgtt

SEQ ID NO: 638546 - DNA, 13 bp, D. melanogaster
taaaattccaaat

SEQ ID NO: 638547 - DNA, 13 bp, D. melanogaster
taaaattccaaca

SEQ ID NO: 638548 - DNA, 13 bp, D. melanogaster
taaaattccaata

SEQ ID NO: 638549 - DNA, 13 bp, D. melanogaster
taaaattctcttt

SEQ ID NO: 638550 - DNA, 13 bp, D. melanogaster
taaaattctgtaa

SEQ ID NO: 638551 - DNA, 14 bp, D. melanogaster
taaaattctgtcga

SEQ ID NO: 638552 - DNA, 14 bp, D. melanogaster
taaaattcttttgt

SEQ ID NO: 638553 - DNA, 13 bp, D. melanogaster
taaaattgacttt

SEQ ID NO: 638554 - DNA, 13 bp, D. melanogaster
taaaattgattag

SEQ ID NO: 638555 - DNA, 13 bp, D. melanogaster
taaaattgatttg

SEQ ID NO: 638556 - DNA, 13 bp, D. melanogaster
taaaattgcaaat

SEQ ID NO: 638557 - DNA, 13 bp, D. melanogaster
taaaattgccaag

SEQ ID NO: 638558 - DNA, 13 bp, D. melanogaster
taaaattggttta

SEQ ID NO: 638559 - DNA, 13 bp, D. melanogaster
taaaattgtattc

SEQ ID NO: 638560 - DNA, 13 bp, D. melanogaster
taaaattgtcttt

SEQ ID NO: 638561 - DNA, 13 bp, D. melanogaster
taaaattgtgaaa

SEQ ID NO: 638562 - DNA, 13 bp, D. melanogaster
taaaattgtttga

SEQ ID NO: 638563 - DNA, 13 bp, D. melanogaster
taaaattgttttc

SEQ ID NO: 638564 - DNA, 13 bp, D. melanogaster
taaaatttatgtg

SEQ ID NO: 638565 - DNA, 13 bp, D. melanogaster
taaaatttcaaac

SEQ ID NO: 638566 - DNA, 13 bp, D. melanogaster
taaaatttcaact

SEQ ID NO: 638567 - DNA, 13 bp, D. melanogaster
taaaatttcaatg

SEQ ID NO: 638568 - DNA, 13 bp, D. melanogaster
taaaatttccaat

SEQ ID NO: 638569 - DNA, 13 bp, D. melanogaster
taaaatttccatt

SEQ ID NO: 638570 - DNA, 13 bp, D. melanogaster
taaaatttcccaa

SEQ ID NO: 638571 - DNA, 13 bp, D. melanogaster
taaaatttcgttt

SEQ ID NO: 638572 - DNA, 13 bp, D. melanogaster
taaaatttctcat

SEQ ID NO: 638573 - DNA, 13 bp, D. melanogaster
taaaatttgcgaa

SEQ ID NO: 638574 - DNA, 13 bp, D. melanogaster
taaaatttggaaa

SEQ ID NO: 638575 - DNA, 13 bp, D. melanogaster
taaaatttgtatg

SEQ ID NO: 638576 - DNA, 13 bp, D. melanogaster
taaaatttgtgag

SEQ ID NO: 638577 - DNA, 13 bp, D. melanogaster
taaaatttgttga

SEQ ID NO: 638578 - DNA, 13 bp, D. melanogaster
taaaatttgtttg

SEQ ID NO: 638579 - DNA, 13 bp, D. melanogaster
taaaattttcaac

SEQ ID NO: 638580 - DNA, 13 bp, D. melanogaster
taaaattttgtct

SEQ ID NO: 638581 - DNA, 13 bp, D. melanogaster
taaaatttttcca

SEQ ID NO: 638582 - DNA, 13 bp, D. melanogaster
taaaatttttgcc

SEQ ID NO: 638583 - DNA, 13 bp, D. melanogaster
taaacaaaaacgc

SEQ ID NO: 638584 - DNA, 13 bp, D. melanogaster
taaacaaaaagcc

SEQ ID NO: 638585 - DNA, 13 bp, D. melanogaster
taaacaaaaagct

SEQ ID NO: 638586 - DNA, 13 bp, D. melanogaster
taaacaaaaatgg

SEQ ID NO: 638587 - DNA, 13 bp, D. melanogaster
taaacaaaaatgt

SEQ ID NO: 638588 - DNA, 13 bp, D. melanogaster
taaacaaaaattg

SEQ ID NO: 638589 - DNA, 13 bp, D. melanogaster
taaacaaaacgag

SEQ ID NO: 638590 - DNA, 13 bp, D. melanogaster
taaacaaaactct

SEQ ID NO: 638591 - DNA, 13 bp, D. melanogaster
taaacaaaagcca

SEQ ID NO: 638592 - DNA, 13 bp, D. melanogaster
taaacaaaatcag

SEQ ID NO: 638593 - DNA, 14 bp, D. melanogaster
taaacaaaatgaat

SEQ ID NO: 638594 - DNA, 13 bp, D. melanogaster
taaacaaaatgat

SEQ ID NO: 638595 - DNA, 13 bp, D. melanogaster
taaacaaaatgca

SEQ ID NO: 638596 - DNA, 13 bp, D. melanogaster
taaacaaaatgcg

SEQ ID NO: 638597 - DNA, 13 bp, D. melanogaster
taaacaaaatgtt

SEQ ID NO: 638598 - DNA, 13 bp, D. melanogaster
taaacaaaattcc

SEQ ID NO: 638599 - DNA, 13 bp, D. melanogaster
taaacaaacattt

SEQ ID NO: 638600 - DNA, 13 bp, D. melanogaster
taaacaaactgaa

SEQ ID NO: 638601 - DNA, 13 bp, D. melanogaster
taaacaaagcaat

SEQ ID NO: 638602 - DNA, 13 bp, D. melanogaster
taaacaaataagg

SEQ ID NO: 638603 - DNA, 13 bp, D. melanogaster
taaacaaatgcca

SEQ ID NO: 638604 - DNA, 14 bp, D. melanogaster
taaacaaatgcgaa

SEQ ID NO: 638605 - DNA, 13 bp, D. melanogaster
taaacaaatgctt

SEQ ID NO: 638606 - DNA, 13 bp, D. melanogaster
taaacaaatgtgc

SEQ ID NO: 638607 - DNA, 13 bp, D. melanogaster
taaacaaattatg

SEQ ID NO: 638608 - DNA, 14 bp, D. melanogaster
taaacaaattgaaa

SEQ ID NO: 638609 - DNA, 13 bp, D. melanogaster
taaacaaattgat

SEQ ID NO: 638610 - DNA, 13 bp, D. melanogaster
taaacaaattgcg

SEQ ID NO: 638611 - DNA, 13 bp, D. melanogaster
taaacaaattgtg

SEQ ID NO: 638612 - DNA, 13 bp, D. melanogaster
taaacaaattgtt

SEQ ID NO: 638613 - DNA, 13 bp, D. melanogaster
taaacaaatttac

SEQ ID NO: 638614 - DNA, 13 bp, D. melanogaster
taaacaaatttca

SEQ ID NO: 638615 - DNA, 14 bp, D. melanogaster
taaacaaatttgtt

SEQ ID NO: 638616 - DNA, 14 bp, D. melanogaster
taaacaaattttca

SEQ ID NO: 638617 - DNA, 14 bp, D. melanogaster
taaacaacaaattc

SEQ ID NO: 638618 - DNA, 13 bp, D. melanogaster
taaacaacattat

SEQ ID NO: 638619 - DNA, 13 bp, D. melanogaster
taaacaacattta

SEQ ID NO: 638620 - DNA, 13 bp, D. melanogaster
taaacaacctttt

SEQ ID NO: 638621 - DNA, 13 bp, D. melanogaster
taaacaactgcac

SEQ ID NO: 638622 - DNA, 13 bp, D. melanogaster
taaacaacttaat

SEQ ID NO: 638623 - DNA, 13 bp, D. melanogaster
taaacaactttta

SEQ ID NO: 638624 - DNA, 13 bp, D. melanogaster
taaacaagaaatt

SEQ ID NO: 638625 - DNA, 13 bp, D. melanogaster
taaacaagattaa

SEQ ID NO: 638626 - DNA, 13 bp, D. melanogaster
taaacaagcaaat

SEQ ID NO: 638627 - DNA, 13 bp, D. melanogaster
taaacaagctgaa

SEQ ID NO: 638628 - DNA, 13 bp, D. melanogaster
taaacaaggcaaa

SEQ ID NO: 638629 - DNA, 13 bp, D. melanogaster
taaacaagtgaaa

SEQ ID NO: 638630 - DNA, 13 bp, D. melanogaster
taaacaagttgaa

SEQ ID NO: 638631 - DNA, 13 bp, D. melanogaster
taaacaagtttct

SEQ ID NO: 638632 - DNA, 13 bp, D. melanogaster
taaacaataattg

SEQ ID NO: 638633 - DNA, 13 bp, D. melanogaster
taaacaatatgtg

SEQ ID NO: 638634 - DNA, 13 bp, D. melanogaster
taaacaatatttg

SEQ ID NO: 638635 - DNA, 13 bp, D. melanogaster
taaacaatcgcac

SEQ ID NO: 638636 - DNA, 13 bp, D. melanogaster
taaacaatgcaaa

SEQ ID NO: 638637 - DNA, 13 bp, D. melanogaster
taaacaatggaaa

SEQ ID NO: 638638 - DNA, 13 bp, D. melanogaster
taaacaatggcta

SEQ ID NO: 638639 - DNA, 13 bp, D. melanogaster
taaacaatgtacc

SEQ ID NO: 638640 - DNA, 13 bp, D. melanogaster
taaacaattaagt

SEQ ID NO: 638641 - DNA, 13 bp, D. melanogaster
taaacaattgctt

SEQ ID NO: 638642 - DNA, 13 bp, D. melanogaster
taaacaattgtaa

SEQ ID NO: 638643 - DNA, 13 bp, D. melanogaster
taaacaattgtgt

SEQ ID NO: 638644 - DNA, 13 bp, D. melanogaster
taaacaatttaca

SEQ ID NO: 638645 - DNA, 13 bp, D. melanogaster
taaacaatttact

SEQ ID NO: 638646 - DNA, 14 bp, D. melanogaster
taaacaatttattg

SEQ ID NO: 638647 - DNA, 13 bp, D. melanogaster
taaacaatttcac

SEQ ID NO: 638648 - DNA, 13 bp, D. melanogaster
taaacaattttcg

SEQ ID NO: 638649 - DNA, 13 bp, D. melanogaster
taaacaattttga

SEQ ID NO: 638650 - DNA, 14 bp, D. melanogaster
taaacaatttttga

SEQ ID NO: 638651 - DNA, 13 bp, D. melanogaster
taaacacaaaagt

SEQ ID NO: 638652 - DNA, 13 bp, D. melanogaster
taaacacaaattc

SEQ ID NO: 638653 - DNA, 13 bp, D. melanogaster
taaacacaaattt

SEQ ID NO: 638654 - DNA, 13 bp, D. melanogaster
taaacacaacttt

SEQ ID NO: 638655 - DNA, 13 bp, D. melanogaster
taaacacaatatt

SEQ ID NO: 638656 - DNA, 13 bp, D. melanogaster
taaacacacgcac

SEQ ID NO: 638657 - DNA, 14 bp, D. melanogaster
taaacacatgcaca

SEQ ID NO: 638658 - DNA, 13 bp, D. melanogaster
taaacacatttaa

SEQ ID NO: 638659 - DNA, 13 bp, D. melanogaster
taaacacatttgt

SEQ ID NO: 638660 - DNA, 13 bp, D. melanogaster
taaacaccgccgt

SEQ ID NO: 638661 - DNA, 13 bp, D. melanogaster
taaacacgaaaca

SEQ ID NO: 638662 - DNA, 13 bp, D. melanogaster
taaacacttttta

SEQ ID NO: 638663 - DNA, 13 bp, D. melanogaster
taaacagaaaatt

SEQ ID NO: 638664 - DNA, 13 bp, D. melanogaster
taaacagaaacag

SEQ ID NO: 638665 - DNA, 13 bp, D. melanogaster
taaacagaatttt

SEQ ID NO: 638666 - DNA, 13 bp, D. melanogaster
taaacagcaaata

SEQ ID NO: 638667 - DNA, 13 bp, D. melanogaster
taaacagcaaatt

SEQ ID NO: 638668 - DNA, 13 bp, D. melanogaster
taaacagcaacaa

SEQ ID NO: 638669 - DNA, 13 bp, D. melanogaster
taaacagcaataa

SEQ ID NO: 638670 - DNA, 13 bp, D. melanogaster
taaacagcagcag

SEQ ID NO: 638671 - DNA, 13 bp, D. melanogaster
taaacagcatttt

SEQ ID NO: 638672 - DNA, 13 bp, D. melanogaster
taaacagcgacaa

SEQ ID NO: 638673 - DNA, 13 bp, D. melanogaster
taaacagctgatt

SEQ ID NO: 638674 - DNA, 13 bp, D. melanogaster
taaacaggaaaat

SEQ ID NO: 638675 - DNA, 13 bp, D. melanogaster
taaacagggttca

SEQ ID NO: 638676 - DNA, 13 bp, D. melanogaster
taaacagtaaaca

SEQ ID NO: 638677 - DNA, 13 bp, D. melanogaster
taaacagtatttt

SEQ ID NO: 638678 - DNA, 13 bp, D. melanogaster
taaacagtttctt

SEQ ID NO: 638679 - DNA, 13 bp, D. melanogaster
taaacagttttaa

SEQ ID NO: 638680 - DNA, 13 bp, D. melanogaster
taaacataaaatg

SEQ ID NO: 638681 - DNA, 13 bp, D. melanogaster
taaacataaactg

SEQ ID NO: 638682 - DNA, 13 bp, D. melanogaster
taaacataaatga

SEQ ID NO: 638683 - DNA, 13 bp, D. melanogaster
taaacataagttt

SEQ ID NO: 638684 - DNA, 13 bp, D. melanogaster
taaacatagaaca

SEQ ID NO: 638685 - DNA, 14 bp, D. melanogaster
taaacatagcaaca

SEQ ID NO: 638686 - DNA, 13 bp, D. melanogaster
taaacatatgcat

SEQ ID NO: 638687 - DNA, 13 bp, D. melanogaster
taaacatatgtaa

SEQ ID NO: 638688 - DNA, 13 bp, D. melanogaster
taaacatattcaa

SEQ ID NO: 638689 - DNA, 13 bp, D. melanogaster
taaacatattctt

SEQ ID NO: 638690 - DNA, 13 bp, D. melanogaster
taaacatattgat

SEQ ID NO: 638691 - DNA, 13 bp, D. melanogaster
taaacatatttga

SEQ ID NO: 638692 - DNA, 13 bp, D. melanogaster
taaacatattttc

SEQ ID NO: 638693 - DNA, 13 bp, D. melanogaster
taaacatcctaaa

SEQ ID NO: 638694 - DNA, 13 bp, D. melanogaster
taaacatgacact

SEQ ID NO: 638695 - DNA, 13 bp, D. melanogaster
taaacatgtaaga

SEQ ID NO: 638696 - DNA, 13 bp, D. melanogaster
taaacatgtatgt

SEQ ID NO: 638697 - DNA, 14 bp, D. melanogaster
taaacatgttttaa

SEQ ID NO: 638698 - DNA, 13 bp, D. melanogaster
taaacattaagta

SEQ ID NO: 638699 - DNA, 13 bp, D. melanogaster
taaacattcaagg

SEQ ID NO: 638700 - DNA, 13 bp, D. melanogaster
taaacattccaaa

SEQ ID NO: 638701 - DNA, 13 bp, D. melanogaster
taaacattgattt

SEQ ID NO: 638702 - DNA, 13 bp, D. melanogaster
taaacattgcaaa

SEQ ID NO: 638703 - DNA, 13 bp, D. melanogaster
taaacatttagta

SEQ ID NO: 638704 - DNA, 13 bp, D. melanogaster
taaacatttcaat

SEQ ID NO: 638705 - DNA, 13 bp, D. melanogaster
taaacatttgatt

SEQ ID NO: 638706 - DNA, 13 bp, D. melanogaster
taaacatttgctt

SEQ ID NO: 638707 - DNA, 13 bp, D. melanogaster
taaacatttgtaa

SEQ ID NO: 638708 - DNA, 13 bp, D. melanogaster
taaacattttatc

SEQ ID NO: 638709 - DNA, 13 bp, D. melanogaster
taaacattttatg

SEQ ID NO: 638710 - DNA, 13 bp, D. melanogaster
taaacattttcta

SEQ ID NO: 638711 - DNA, 13 bp, D. melanogaster
taaacattttgaa

SEQ ID NO: 638712 - DNA, 14 bp, D. melanogaster
taaacattttgatt

SEQ ID NO: 638713 - DNA, 14 bp, D. melanogaster
taaacattttgtat

SEQ ID NO: 638714 - DNA, 13 bp, D. melanogaster
taaacattttgtg

SEQ ID NO: 638715 - DNA, 13 bp, D. melanogaster
taaacattttgtt

SEQ ID NO: 638716 - DNA, 13 bp, D. melanogaster
taaacatttttag

SEQ ID NO: 638717 - DNA, 13 bp, D. melanogaster
taaacatttttgt

SEQ ID NO: 638718 - DNA, 14 bp, D. melanogaster
taaacatttttgtg

SEQ ID NO: 638719 - DNA, 13 bp, D. melanogaster
taaaccaaaattt

SEQ ID NO: 638720 - DNA, 13 bp, D. melanogaster
taaaccaatatat

SEQ ID NO: 638721 - DNA, 13 bp, D. melanogaster
taaaccaatttaa

SEQ ID NO: 638722 - DNA, 13 bp, D. melanogaster
taaaccaatttgc

SEQ ID NO: 638723 - DNA, 13 bp, D. melanogaster
taaaccaatttgt

SEQ ID NO: 638724 - DNA, 13 bp, D. melanogaster
taaaccagaaaat

SEQ ID NO: 638725 - DNA, 13 bp, D. melanogaster
taaaccagaaata

SEQ ID NO: 638726 - DNA, 13 bp, D. melanogaster
taaacccaatttt

SEQ ID NO: 638727 - DNA, 14 bp, D. melanogaster
taaacccaattttc

SEQ ID NO: 638728 - DNA, 13 bp, D. melanogaster
taaaccgaaatga

SEQ ID NO: 638729 - DNA, 13 bp, D. melanogaster
taaaccgaagata

SEQ ID NO: 638730 - DNA, 13 bp, D. melanogaster
taaaccttttatt

SEQ ID NO: 638731 - DNA, 13 bp, D. melanogaster
taaacgaaaatat

SEQ ID NO: 638732 - DNA, 13 bp, D. melanogaster
taaacgaaaatgt

SEQ ID NO: 638733 - DNA, 13 bp, D. melanogaster
taaacgaaacgaa

SEQ ID NO: 638734 - DNA, 13 bp, D. melanogaster
taaacgaaattaa

SEQ ID NO: 638735 - DNA, 13 bp, D. melanogaster
taaacgaaattat

SEQ ID NO: 638736 - DNA, 13 bp, D. melanogaster
taaacgaaatttc

SEQ ID NO: 638737 - DNA, 13 bp, D. melanogaster
taaacgaaccagt

SEQ ID NO: 638738 - DNA, 13 bp, D. melanogaster
taaacgaactttt

SEQ ID NO: 638739 - DNA, 13 bp, D. melanogaster
taaacgaagatga

SEQ ID NO: 638740 - DNA, 13 bp, D. melanogaster
taaacgaagcaaa

SEQ ID NO: 638741 - DNA, 13 bp, D. melanogaster
taaacgaatattt

SEQ ID NO: 638742 - DNA, 13 bp, D. melanogaster
taaacgaatttaa

SEQ ID NO: 638743 - DNA, 13 bp, D. melanogaster
taaacgaattttt

SEQ ID NO: 638744 - DNA, 13 bp, D. melanogaster
taaacgacgaaaa

SEQ ID NO: 638745 - DNA, 13 bp, D. melanogaster
taaacgactaaga

SEQ ID NO: 638746 - DNA, 13 bp, D. melanogaster
taaacgagcaaaa

SEQ ID NO: 638747 - DNA, 14 bp, D. melanogaster
taaacgagcaaaaa

SEQ ID NO: 638748 - DNA, 13 bp, D. melanogaster
taaacgagctaaa

SEQ ID NO: 638749 - DNA, 13 bp, D. melanogaster
taaacgagttttt

SEQ ID NO: 638750 - DNA, 13 bp, D. melanogaster
taaacgatttcat

SEQ ID NO: 638751 - DNA, 13 bp, D. melanogaster
taaacgcaatttt

SEQ ID NO: 638752 - DNA, 13 bp, D. melanogaster
taaacgtaaacaa

SEQ ID NO: 638753 - DNA, 13 bp, D. melanogaster
taaacgtaaatat

SEQ ID NO: 638754 - DNA, 14 bp, D. melanogaster
taaacgtaatatta

SEQ ID NO: 638755 - DNA, 13 bp, D. melanogaster
taaacgtacatat

SEQ ID NO: 638756 - DNA, 13 bp, D. melanogaster
taaacgtatatat

SEQ ID NO: 638757 - DNA, 14 bp, D. melanogaster
taaacgtatatata

SEQ ID NO: 638758 - DNA, 13 bp, D. melanogaster
taaacgtttgttt

SEQ ID NO: 638759 - DNA, 13 bp, D. melanogaster
taaactaaacgaa

SEQ ID NO: 638760 - DNA, 13 bp, D. melanogaster
taaactaaatgtt

SEQ ID NO: 638761 - DNA, 13 bp, D. melanogaster
taaactaaattag

SEQ ID NO: 638762 - DNA, 13 bp, D. melanogaster
taaactacttaaa

SEQ ID NO: 638763 - DNA, 13 bp, D. melanogaster
taaactatataca

SEQ ID NO: 638764 - DNA, 13 bp, D. melanogaster
taaactatgtttt

SEQ ID NO: 638765 - DNA, 13 bp, D. melanogaster
taaactatttatg

SEQ ID NO: 638766 - DNA, 13 bp, D. melanogaster
taaactatttgta

SEQ ID NO: 638767 - DNA, 13 bp, D. melanogaster
taaactcaaaact

SEQ ID NO: 638768 - DNA, 13 bp, D. melanogaster
taaactcaaagaa

SEQ ID NO: 638769 - DNA, 13 bp, D. melanogaster
taaactcaaatta

SEQ ID NO: 638770 - DNA, 13 bp, D. melanogaster
taaactcaaattt

SEQ ID NO: 638771 - DNA, 13 bp, D. melanogaster
taaactcaacttt

SEQ ID NO: 638772 - DNA, 13 bp, D. melanogaster
taaactcaattta

SEQ ID NO: 638773 - DNA, 13 bp, D. melanogaster
taaactctttaaa

SEQ ID NO: 638774 - DNA, 13 bp, D. melanogaster
taaactgaaatta

SEQ ID NO: 638775 - DNA, 13 bp, D. melanogaster
taaactgaaattt

SEQ ID NO: 638776 - DNA, 13 bp, D. melanogaster
taaactgaatttt

SEQ ID NO: 638777 - DNA, 13 bp, D. melanogaster
taaactgatttaa

SEQ ID NO: 638778 - DNA, 13 bp, D. melanogaster
taaactgcaataa

SEQ ID NO: 638779 - DNA, 13 bp, D. melanogaster
taaactgcaattt

SEQ ID NO: 638780 - DNA, 13 bp, D. melanogaster
taaactgcagctg

SEQ ID NO: 638781 - DNA, 13 bp, D. melanogaster
taaactgcattag

SEQ ID NO: 638782 - DNA, 13 bp, D. melanogaster
taaactgctgcaa

SEQ ID NO: 638783 - DNA, 13 bp, D. melanogaster
taaactggaaaat

SEQ ID NO: 638784 - DNA, 13 bp, D. melanogaster
taaactggagaaa

SEQ ID NO: 638785 - DNA, 13 bp, D. melanogaster
taaactgtttttt

SEQ ID NO: 638786 - DNA, 14 bp, D. melanogaster
taaacttaaaagcc

SEQ ID NO: 638787 - DNA, 14 bp, D. melanogaster
taaacttaaagcaa

SEQ ID NO: 638788 - DNA, 13 bp, D. melanogaster
taaacttaaatgg

SEQ ID NO: 638789 - DNA, 13 bp, D. melanogaster
taaacttaaattg

SEQ ID NO: 638790 - DNA, 13 bp, D. melanogaster
taaacttaggacc

SEQ ID NO: 638791 - DNA, 13 bp, D. melanogaster
taaacttataaac

SEQ ID NO: 638792 - DNA, 13 bp, D. melanogaster
taaacttcaactt

SEQ ID NO: 638793 - DNA, 13 bp, D. melanogaster
taaacttgaaaac

SEQ ID NO: 638794 - DNA, 14 bp, D. melanogaster
taaacttgaaattt

SEQ ID NO: 638795 - DNA, 13 bp, D. melanogaster
taaacttgtaaaa

SEQ ID NO: 638796 - DNA, 13 bp, D. melanogaster
taaactttaaaca

SEQ ID NO: 638797 - DNA, 13 bp, D. melanogaster
taaactttaacaa

SEQ ID NO: 638798 - DNA, 13 bp, D. melanogaster
taaactttattgc

SEQ ID NO: 638799 - DNA, 14 bp, D. melanogaster
taaactttattgcc

SEQ ID NO: 638800 - DNA, 13 bp, D. melanogaster
taaactttatttc

SEQ ID NO: 638801 - DNA, 13 bp, D. melanogaster
taaactttcattt

SEQ ID NO: 638802 - DNA, 13 bp, D. melanogaster
taaactttgtaaa

SEQ ID NO: 638803 - DNA, 13 bp, D. melanogaster
taaacttttaaag

SEQ ID NO: 638804 - DNA, 13 bp, D. melanogaster
taaacttttcctt

SEQ ID NO: 638805 - DNA, 13 bp, D. melanogaster
taaacttttgcaa

SEQ ID NO: 638806 - DNA, 13 bp, D. melanogaster
taaacttttgcat

SEQ ID NO: 638807 - DNA, 13 bp, D. melanogaster
taaactttttgaa

SEQ ID NO: 638808 - DNA, 13 bp, D. melanogaster
taaactttttgct

SEQ ID NO: 638809 - DNA, 13 bp, D. melanogaster
taaagaaaaactt

SEQ ID NO: 638810 - DNA, 13 bp, D. melanogaster
taaagaaaatgtt

SEQ ID NO: 638811 - DNA, 13 bp, D. melanogaster
taaagaaacattt

SEQ ID NO: 638812 - DNA, 13 bp, D. melanogaster
taaagaaacttaa

SEQ ID NO: 638813 - DNA, 13 bp, D. melanogaster
taaagaaataact

SEQ ID NO: 638814 - DNA, 13 bp, D. melanogaster
taaagaaatgctt

SEQ ID NO: 638815 - DNA, 13 bp, D. melanogaster
taaagaaatgtat

SEQ ID NO: 638816 - DNA, 13 bp, D. melanogaster
taaagaaattcaa

SEQ ID NO: 638817 - DNA, 13 bp, D. melanogaster
taaagaaattgta

SEQ ID NO: 638818 - DNA, 13 bp, D. melanogaster
taaagaaatttgt

SEQ ID NO: 638819 - DNA, 13 bp, D. melanogaster
taaagaacaaatt

SEQ ID NO: 638820 - DNA, 13 bp, D. melanogaster
taaagaacgttgg

SEQ ID NO: 638821 - DNA, 13 bp, D. melanogaster
taaagaactaatt

SEQ ID NO: 638822 - DNA, 13 bp, D. melanogaster
taaagaagatttt

SEQ ID NO: 638823 - DNA, 13 bp, D. melanogaster
taaagaagcaaat

SEQ ID NO: 638824 - DNA, 13 bp, D. melanogaster
taaagaagctata

SEQ ID NO: 638825 - DNA, 13 bp, D. melanogaster
taaagaagttttt

SEQ ID NO: 638826 - DNA, 13 bp, D. melanogaster
taaagaatatgtt

SEQ ID NO: 638827 - DNA, 13 bp, D. melanogaster
taaagaattccat

SEQ ID NO: 638828 - DNA, 13 bp, D. melanogaster
taaagaattgaac

SEQ ID NO: 638829 - DNA, 13 bp, D. melanogaster
taaagaatttcaa

SEQ ID NO: 638830 - DNA, 13 bp, D. melanogaster
taaagacaattga

SEQ ID NO: 638831 - DNA, 14 bp, D. melanogaster
taaagacaattgat

SEQ ID NO: 638832 - DNA, 14 bp, D. melanogaster
taaagacatttatt

SEQ ID NO: 638833 - DNA, 13 bp, D. melanogaster
taaagacattttt

SEQ ID NO: 638834 - DNA, 13 bp, D. melanogaster
taaagacggcatt

SEQ ID NO: 638835 - DNA, 13 bp, D. melanogaster
taaagactaaatc

SEQ ID NO: 638836 - DNA, 13 bp, D. melanogaster
taaagactccaat

SEQ ID NO: 638837 - DNA, 13 bp, D. melanogaster
taaagacttacaa

SEQ ID NO: 638838 - DNA, 13 bp, D. melanogaster
taaagacttgttt

SEQ ID NO: 638839 - DNA, 13 bp, D. melanogaster
taaagactttaaa

SEQ ID NO: 638840 - DNA, 13 bp, D. melanogaster
taaagagatattt

SEQ ID NO: 638841 - DNA, 13 bp, D. melanogaster
taaagagcacgaa

SEQ ID NO: 638842 - DNA, 13 bp, D. melanogaster
taaagagctttaa

SEQ ID NO: 638843 - DNA, 13 bp, D. melanogaster
taaagaggaagat

SEQ ID NO: 638844 - DNA, 13 bp, D. melanogaster
taaagataacttt

SEQ ID NO: 638845 - DNA, 13 bp, D. melanogaster
taaagatacaaat

SEQ ID NO: 638846 - DNA, 13 bp, D. melanogaster
taaagatacaatt

SEQ ID NO: 638847 - DNA, 13 bp, D. melanogaster
taaagataccacc

SEQ ID NO: 638848 - DNA, 13 bp, D. melanogaster
taaagatatagat

SEQ ID NO: 638849 - DNA, 13 bp, D. melanogaster
taaagatatatgt

SEQ ID NO: 638850 - DNA, 13 bp, D. melanogaster
taaagatcttcct

SEQ ID NO: 638851 - DNA, 13 bp, D. melanogaster
taaagatgatttt

SEQ ID NO: 638852 - DNA, 13 bp, D. melanogaster
taaagattaagat

SEQ ID NO: 638853 - DNA, 13 bp, D. melanogaster
taaagatttcaaa

SEQ ID NO: 638854 - DNA, 13 bp, D. melanogaster
taaagatttcaat

SEQ ID NO: 638855 - DNA, 13 bp, D. melanogaster
taaagatttgaaa

SEQ ID NO: 638856 - DNA, 13 bp, D. melanogaster
taaagattttgaa

SEQ ID NO: 638857 - DNA, 13 bp, D. melanogaster
taaagcaaaatat

SEQ ID NO: 638858 - DNA, 13 bp, D. melanogaster
taaagcaaacaga

SEQ ID NO: 638859 - DNA, 13 bp, D. melanogaster
taaagcaaacatt

SEQ ID NO: 638860 - DNA, 13 bp, D. melanogaster
taaagcaaatata

SEQ ID NO: 638861 - DNA, 13 bp, D. melanogaster
taaagcaaatatt

SEQ ID NO: 638862 - DNA, 13 bp, D. melanogaster
taaagcaaattaa

SEQ ID NO: 638863 - DNA, 14 bp, D. melanogaster
taaagcaaattaaa

SEQ ID NO: 638864 - DNA, 13 bp, D. melanogaster
taaagcaaattga

SEQ ID NO: 638865 - DNA, 13 bp, D. melanogaster
taaagcaaattgc

SEQ ID NO: 638866 - DNA, 14 bp, D. melanogaster
taaagcaataaata

SEQ ID NO: 638867 - DNA, 13 bp, D. melanogaster
taaagcaatatat

SEQ ID NO: 638868 - DNA, 13 bp, D. melanogaster
taaagcaatcgat

SEQ ID NO: 638869 - DNA, 14 bp, D. melanogaster
taaagcaattaaaa

SEQ ID NO: 638870 - DNA, 13 bp, D. melanogaster
taaagcacacaca

SEQ ID NO: 638871 - DNA, 13 bp, D. melanogaster
taaagcacatttt

SEQ ID NO: 638872 - DNA, 13 bp, D. melanogaster
taaagcatacata

SEQ ID NO: 638873 - DNA, 13 bp, D. melanogaster
taaagcatataaa

SEQ ID NO: 638874 - DNA, 13 bp, D. melanogaster
taaagcatcaaaa

SEQ ID NO: 638875 - DNA, 13 bp, D. melanogaster
taaagcattaaaa

SEQ ID NO: 638876 - DNA, 13 bp, D. melanogaster
taaagcattcaaa

SEQ ID NO: 638877 - DNA, 13 bp, D. melanogaster
taaagcatttcaa

SEQ ID NO: 638878 - DNA, 13 bp, D. melanogaster
taaagcatttttt

SEQ ID NO: 638879 - DNA, 13 bp, D. melanogaster
taaagccaaaaat

SEQ ID NO: 638880 - DNA, 13 bp, D. melanogaster
taaagccaaagaa

SEQ ID NO: 638881 - DNA, 13 bp, D. melanogaster
taaagccaaagac

SEQ ID NO: 638882 - DNA, 13 bp, D. melanogaster
taaagccaaagcc

SEQ ID NO: 638883 - DNA, 13 bp, D. melanogaster
taaagccaattaa

SEQ ID NO: 638884 - DNA, 13 bp, D. melanogaster
taaagccacaaaa

SEQ ID NO: 638885 - DNA, 13 bp, D. melanogaster
taaagcccataaa

SEQ ID NO: 638886 - DNA, 13 bp, D. melanogaster
taaagccgccaaa

SEQ ID NO: 638887 - DNA, 13 bp, D. melanogaster
taaagcctaaaaa

SEQ ID NO: 638888 - DNA, 13 bp, D. melanogaster
taaagcctattca

SEQ ID NO: 638889 - DNA, 13 bp, D. melanogaster
taaagccttaaaa

SEQ ID NO: 638890 - DNA, 13 bp, D. melanogaster
taaagcgaaagct

SEQ ID NO: 638891 - DNA, 14 bp, D. melanogaster
taaagcgaattatt

SEQ ID NO: 638892 - DNA, 13 bp, D. melanogaster
taaagctaaatta

SEQ ID NO: 638893 - DNA, 13 bp, D. melanogaster
taaagctaacaaa

SEQ ID NO: 638894 - DNA, 13 bp, D. melanogaster
taaagctattaaa

SEQ ID NO: 638895 - DNA, 13 bp, D. melanogaster
taaagctcaaagc

SEQ ID NO: 638896 - DNA, 13 bp, D. melanogaster
taaagctcattaa

SEQ ID NO: 638897 - DNA, 13 bp, D. melanogaster
taaagctgaaatg

SEQ ID NO: 638898 - DNA, 13 bp, D. melanogaster
taaagctgaacac

SEQ ID NO: 638899 - DNA, 13 bp, D. melanogaster
taaagctgaatgt

SEQ ID NO: 638900 - DNA, 13 bp, D. melanogaster
taaagcttaattt

SEQ ID NO: 638901 - DNA, 13 bp, D. melanogaster
taaagcttatatt

SEQ ID NO: 638902 - DNA, 13 bp, D. melanogaster
taaaggaatgctt

SEQ ID NO: 638903 - DNA, 14 bp, D. melanogaster
taaaggacagatca

SEQ ID NO: 638904 - DNA, 13 bp, D. melanogaster
taaaggacatttt

SEQ ID NO: 638905 - DNA, 14 bp, D. melanogaster
taaaggagctggcc

SEQ ID NO: 638906 - DNA, 13 bp, D. melanogaster
taaaggatgagaa

SEQ ID NO: 638907 - DNA, 13 bp, D. melanogaster
taaaggattccac

SEQ ID NO: 638908 - DNA, 13 bp, D. melanogaster
taaaggattttcg

SEQ ID NO: 638909 - DNA, 14 bp, D. melanogaster
taaaggcaaacaaa

SEQ ID NO: 638910 - DNA, 13 bp, D. melanogaster
taaaggcaaattt

SEQ ID NO: 638911 - DNA, 13 bp, D. melanogaster
taaaggcattaaa

SEQ ID NO: 638912 - DNA, 13 bp, D. melanogaster
taaagggtttttt

SEQ ID NO: 638913 - DNA, 14 bp, D. melanogaster
taaagggttttttg

SEQ ID NO: 638914 - DNA, 13 bp, D. melanogaster
taaaggtaaattt

SEQ ID NO: 638915 - DNA, 13 bp, D. melanogaster
taaaggtagcaaa

SEQ ID NO: 638916 - DNA, 13 bp, D. melanogaster
taaaggtatatat

SEQ ID NO: 638917 - DNA, 13 bp, D. melanogaster
taaaggtattgat

SEQ ID NO: 638918 - DNA, 13 bp, D. melanogaster
taaaggtatttat

SEQ ID NO: 638919 - DNA, 13 bp, D. melanogaster
taaaggtttattt

SEQ ID NO: 638920 - DNA, 13 bp, D. melanogaster
taaaggtttttta

SEQ ID NO: 638921 - DNA, 13 bp, D. melanogaster
taaagtaaacaca

SEQ ID NO: 638922 - DNA, 13 bp, D. melanogaster
taaagtaaaccta

SEQ ID NO: 638923 - DNA, 13 bp, D. melanogaster
taaagtaaacttt

SEQ ID NO: 638924 - DNA, 13 bp, D. melanogaster
taaagtaaagtac

SEQ ID NO: 638925 - DNA, 13 bp, D. melanogaster
taaagtacaattt

SEQ ID NO: 638926 - DNA, 13 bp, D. melanogaster
taaagtacatata

SEQ ID NO: 638927 - DNA, 13 bp, D. melanogaster
taaagtacattta

SEQ ID NO: 638928 - DNA, 14 bp, D. melanogaster
taaagtacatttta

SEQ ID NO: 638929 - DNA, 13 bp, D. melanogaster
taaagtagaacat

SEQ ID NO: 638930 - DNA, 13 bp, D. melanogaster
taaagtatataca

SEQ ID NO: 638931 - DNA, 13 bp, D. melanogaster
taaagtattgtat

SEQ ID NO: 638932 - DNA, 13 bp, D. melanogaster
taaagtatttgaa

SEQ ID NO: 638933 - DNA, 13 bp, D. melanogaster
taaagtatttggc

SEQ ID NO: 638934 - DNA, 13 bp, D. melanogaster
taaagtatttgta

SEQ ID NO: 638935 - DNA, 13 bp, D. melanogaster
taaagtcaaattt

SEQ ID NO: 638936 - DNA, 13 bp, D. melanogaster
taaagtcatactc

SEQ ID NO: 638937 - DNA, 13 bp, D. melanogaster
taaagtcatttaa

SEQ ID NO: 638938 - DNA, 13 bp, D. melanogaster
taaagtcccaaat

SEQ ID NO: 638939 - DNA, 13 bp, D. melanogaster
taaagtccgggta

SEQ ID NO: 638940 - DNA, 13 bp, D. melanogaster
taaagtctaaaaa

SEQ ID NO: 638941 - DNA, 13 bp, D. melanogaster
taaagtctaagaa

SEQ ID NO: 638942 - DNA, 13 bp, D. melanogaster
taaagtctattat

SEQ ID NO: 638943 - DNA, 13 bp, D. melanogaster
taaagtctcaaaa

SEQ ID NO: 638944 - DNA, 13 bp, D. melanogaster
taaagtgaaatat

SEQ ID NO: 638945 - DNA, 13 bp, D. melanogaster
taaagtgaactaa

SEQ ID NO: 638946 - DNA, 13 bp, D. melanogaster
taaagtgaatttt

SEQ ID NO: 638947 - DNA, 13 bp, D. melanogaster
taaagtgatgtac

SEQ ID NO: 638948 - DNA, 13 bp, D. melanogaster
taaagtgcaaata

SEQ ID NO: 638949 - DNA, 13 bp, D. melanogaster
taaagtgcaaatt

SEQ ID NO: 638950 - DNA, 13 bp, D. melanogaster
taaagtgcaataa

SEQ ID NO: 638951 - DNA, 13 bp, D. melanogaster
taaagtgcacaaa

SEQ ID NO: 638952 - DNA, 13 bp, D. melanogaster
taaagtgcacttt

SEQ ID NO: 638953 - DNA, 13 bp, D. melanogaster
taaagtgcataaa

SEQ ID NO: 638954 - DNA, 13 bp, D. melanogaster
taaagtgcattta

SEQ ID NO: 638955 - DNA, 14 bp, D. melanogaster
taaagtgccttaaa

SEQ ID NO: 638956 - DNA, 13 bp, D. melanogaster
taaagtggaaaac

SEQ ID NO: 638957 - DNA, 13 bp, D. melanogaster
taaagtggaaaat

SEQ ID NO: 638958 - DNA, 13 bp, D. melanogaster
taaagtggatttt

SEQ ID NO: 638959 - DNA, 13 bp, D. melanogaster
taaagtggctatt

SEQ ID NO: 638960 - DNA, 13 bp, D. melanogaster
taaagtgtaaata

SEQ ID NO: 638961 - DNA, 14 bp, D. melanogaster
taaagtgtaatatt

SEQ ID NO: 638962 - DNA, 13 bp, D. melanogaster
taaagtgtaattt

SEQ ID NO: 638963 - DNA, 13 bp, D. melanogaster
taaagtgtatttt

SEQ ID NO: 638964 - DNA, 13 bp, D. melanogaster
taaagttaaaaac

SEQ ID NO: 638965 - DNA, 13 bp, D. melanogaster
taaagttaaaaca

SEQ ID NO: 638966 - DNA, 13 bp, D. melanogaster
taaagttaaagtt

SEQ ID NO: 638967 - DNA, 13 bp, D. melanogaster
taaagttaacttt

SEQ ID NO: 638968 - DNA, 13 bp, D. melanogaster
taaagttaagcaa

SEQ ID NO: 638969 - DNA, 13 bp, D. melanogaster
taaagttacaaaa

SEQ ID NO: 638970 - DNA, 13 bp, D. melanogaster
taaagttacaaat

SEQ ID NO: 638971 - DNA, 13 bp, D. melanogaster
taaagttacgaaa

SEQ ID NO: 638972 - DNA, 13 bp, D. melanogaster
taaagttatacaa

SEQ ID NO: 638973 - DNA, 13 bp, D. melanogaster
taaagttatgaaa

SEQ ID NO: 638974 - DNA, 13 bp, D. melanogaster
taaagttcaaaaa

SEQ ID NO: 638975 - DNA, 13 bp, D. melanogaster
taaagttcaaatt

SEQ ID NO: 638976 - DNA, 13 bp, D. melanogaster
taaagttcattaa

SEQ ID NO: 638977 - DNA, 13 bp, D. melanogaster
taaagttccttga

SEQ ID NO: 638978 - DNA, 13 bp, D. melanogaster
taaagttctatga

SEQ ID NO: 638979 - DNA, 13 bp, D. melanogaster
taaagttcttaat

SEQ ID NO: 638980 - DNA, 13 bp, D. melanogaster
taaagttcttcca

SEQ ID NO: 638981 - DNA, 13 bp, D. melanogaster
taaagttctttta

SEQ ID NO: 638982 - DNA, 13 bp, D. melanogaster
taaagttgaaatt

SEQ ID NO: 638983 - DNA, 13 bp, D. melanogaster
taaagttgaattt

SEQ ID NO: 638984 - DNA, 13 bp, D. melanogaster
taaagttgattta

SEQ ID NO: 638985 - DNA, 13 bp, D. melanogaster
taaagttgcatcc

SEQ ID NO: 638986 - DNA, 13 bp, D. melanogaster
taaagttggaaaa

SEQ ID NO: 638987 - DNA, 13 bp, D. melanogaster
taaagttggccaa

SEQ ID NO: 638988 - DNA, 13 bp, D. melanogaster
taaagttgtaaaa

SEQ ID NO: 638989 - DNA, 13 bp, D. melanogaster
taaagttgttaat

SEQ ID NO: 638990 - DNA, 13 bp, D. melanogaster
taaagtttaaaac

SEQ ID NO: 638991 - DNA, 13 bp, D. melanogaster
taaagtttaaagt

SEQ ID NO: 638992 - DNA, 13 bp, D. melanogaster
taaagtttacaat

SEQ ID NO: 638993 - DNA, 13 bp, D. melanogaster
taaagtttacttt

SEQ ID NO: 638994 - DNA, 13 bp, D. melanogaster
taaagtttagttt

SEQ ID NO: 638995 - DNA, 13 bp, D. melanogaster
taaagtttccttt

SEQ ID NO: 638996 - DNA, 13 bp, D. melanogaster
taaagttttaaca

SEQ ID NO: 638997 - DNA, 13 bp, D. melanogaster
taaagttttatgc

SEQ ID NO: 638998 - DNA, 13 bp, D. melanogaster
taaagtttttcaa

SEQ ID NO: 638999 - DNA, 13 bp, D. melanogaster
taaagtttttcat

SEQ ID NO: 639000 - DNA, 13 bp, D. melanogaster
taaataaaaagcg

SEQ ID NO: 639001 - DNA, 14 bp, D. melanogaster
taaataaaaagtgc

SEQ ID NO: 639002 - DNA, 13 bp, D. melanogaster
taaataaaacagc

SEQ ID NO: 639003 - DNA, 13 bp, D. melanogaster
taaataaaacgga

SEQ ID NO: 639004 - DNA, 13 bp, D. melanogaster
taaataaaacgta

SEQ ID NO: 639005 - DNA, 13 bp, D. melanogaster
taaataaaagctg

SEQ ID NO: 639006 - DNA, 13 bp, D. melanogaster
taaataaaagttc

SEQ ID NO: 639007 - DNA, 13 bp, D. melanogaster
taaataaaatcag

SEQ ID NO: 639008 - DNA, 14 bp, D. melanogaster
taaataaaatgcaa

SEQ ID NO: 639009 - DNA, 13 bp, D. melanogaster
taaataaaatgcc

SEQ ID NO: 639010 - DNA, 13 bp, D. melanogaster
taaataaaatggc

SEQ ID NO: 639011 - DNA, 13 bp, D. melanogaster
taaataaaatggg

SEQ ID NO: 639012 - DNA, 13 bp, D. melanogaster
taaataaacaagt

SEQ ID NO: 639013 - DNA, 13 bp, D. melanogaster
taaataaacagca

SEQ ID NO: 639014 - DNA, 13 bp, D. melanogaster
taaataaacgtaa

SEQ ID NO: 639015 - DNA, 14 bp, D. melanogaster
taaataaactgaaa

SEQ ID NO: 639016 - DNA, 13 bp, D. melanogaster
taaataaactgtt

SEQ ID NO: 639017 - DNA, 13 bp, D. melanogaster
taaataaacttca

SEQ ID NO: 639018 - DNA, 13 bp, D. melanogaster
taaataaacttga

SEQ ID NO: 639019 - DNA, 13 bp, D. melanogaster
taaataaagcaca

SEQ ID NO: 639020 - DNA, 14 bp, D. melanogaster
taaataaagttgtt

SEQ ID NO: 639021 - DNA, 14 bp, D. melanogaster
taaataaataagca

SEQ ID NO: 639022 - DNA, 13 bp, D. melanogaster
taaataaatacct

SEQ ID NO: 639023 - DNA, 13 bp, D. melanogaster
taaataaatacga

SEQ ID NO: 639024 - DNA, 13 bp, D. melanogaster
taaataaatagac

SEQ ID NO: 639025 - DNA, 13 bp, D. melanogaster
taaataaatagct

SEQ ID NO: 639026 - DNA, 13 bp, D. melanogaster
taaataaatagtc

SEQ ID NO: 639027 - DNA, 14 bp, D. melanogaster
taaataaatatagc

SEQ ID NO: 639028 - DNA, 13 bp, D. melanogaster
taaataaatccat

SEQ ID NO: 639029 - DNA, 13 bp, D. melanogaster
taaataaatcctt

SEQ ID NO: 639030 - DNA, 13 bp, D. melanogaster
taaataaatcgca

SEQ ID NO: 639031 - DNA, 13 bp, D. melanogaster
taaataaatgcat

SEQ ID NO: 639032 - DNA, 13 bp, D. melanogaster
taaataaatggtc

SEQ ID NO: 639033 - DNA, 13 bp, D. melanogaster
taaataaatgtga

SEQ ID NO: 639034 - DNA, 13 bp, D. melanogaster
taaataaatgttc

SEQ ID NO: 639035 - DNA, 13 bp, D. melanogaster
taaataaattgga

SEQ ID NO: 639036 - DNA, 13 bp, D. melanogaster
taaataaattgtg

SEQ ID NO: 639037 - DNA, 13 bp, D. melanogaster
taaataaatttgc

SEQ ID NO: 639038 - DNA, 13 bp, D. melanogaster
taaataacaatga

SEQ ID NO: 639039 - DNA, 13 bp, D. melanogaster
taaataacttgaa

SEQ ID NO: 639040 - DNA, 14 bp, D. melanogaster
taaataagaaaatc

SEQ ID NO: 639041 - DNA, 13 bp, D. melanogaster
taaataagagttt

SEQ ID NO: 639042 - DNA, 13 bp, D. melanogaster
taaataagcaaac

SEQ ID NO: 639043 - DNA, 13 bp, D. melanogaster
taaataagcaaat

SEQ ID NO: 639044 - DNA, 13 bp, D. melanogaster
taaataagctttt

SEQ ID NO: 639045 - DNA, 13 bp, D. melanogaster
taaataagtcaaa

SEQ ID NO: 639046 - DNA, 13 bp, D. melanogaster
taaataagtgtgt

SEQ ID NO: 639047 - DNA, 13 bp, D. melanogaster
taaataagttgat

SEQ ID NO: 639048 - DNA, 13 bp, D. melanogaster
taaataagttttg

SEQ ID NO: 639049 - DNA, 13 bp, D. melanogaster
taaataataaacg

SEQ ID NO: 639050 - DNA, 14 bp, D. melanogaster
taaataataaatgc

SEQ ID NO: 639051 - DNA, 13 bp, D. melanogaster
taaataataacga

SEQ ID NO: 639052 - DNA, 13 bp, D. melanogaster
taaataatatcca

SEQ ID NO: 639053 - DNA, 13 bp, D. melanogaster
taaataatatcct

SEQ ID NO: 639054 - DNA, 13 bp, D. melanogaster
taaataatccttt

SEQ ID NO: 639055 - DNA, 13 bp, D. melanogaster
taaataatgcaga

SEQ ID NO: 639056 - DNA, 13 bp, D. melanogaster
taaataatgccaa

SEQ ID NO: 639057 - DNA, 13 bp, D. melanogaster
taaataatgcttt

SEQ ID NO: 639058 - DNA, 13 bp, D. melanogaster
taaataattaagc

SEQ ID NO: 639059 - DNA, 13 bp, D. melanogaster
taaataattgaag

SEQ ID NO: 639060 - DNA, 13 bp, D. melanogaster
taaataatttagc

SEQ ID NO: 639061 - DNA, 13 bp, D. melanogaster
taaataatttcga

SEQ ID NO: 639062 - DNA, 16 bp, D. melanogaster
taaataatttcgattg

SEQ ID NO: 639063 - DNA, 14 bp, D. melanogaster
taaataatttcgtt

SEQ ID NO: 639064 - DNA, 13 bp, D. melanogaster
taaatacaaaacg

SEQ ID NO: 639065 - DNA, 13 bp, D. melanogaster
taaatacaaatgc

SEQ ID NO: 639066 - DNA, 13 bp, D. melanogaster
taaatacaaatgt

SEQ ID NO: 639067 - DNA, 13 bp, D. melanogaster
taaatacaatgca

SEQ ID NO: 639068 - DNA, 13 bp, D. melanogaster
taaatacaatttc

SEQ ID NO: 639069 - DNA, 13 bp, D. melanogaster
taaatacacaatt

SEQ ID NO: 639070 - DNA, 13 bp, D. melanogaster
taaatacacatac

SEQ ID NO: 639071 - DNA, 13 bp, D. melanogaster
taaatacacatgt

SEQ ID NO: 639072 - DNA, 13 bp, D. melanogaster
taaatacacattt

SEQ ID NO: 639073 - DNA, 14 bp, D. melanogaster
taaatacacattta

SEQ ID NO: 639074 - DNA, 13 bp, D. melanogaster
taaatacactgaa

SEQ ID NO: 639075 - DNA, 13 bp, D. melanogaster
taaatacacttta

SEQ ID NO: 639076 - DNA, 13 bp, D. melanogaster
taaatacagcaca

SEQ ID NO: 639077 - DNA, 13 bp, D. melanogaster
taaatacagtatt

SEQ ID NO: 639078 - DNA, 13 bp, D. melanogaster
taaatacagtttt

SEQ ID NO: 639079 - DNA, 13 bp, D. melanogaster
taaatacatagtg

SEQ ID NO: 639080 - DNA, 13 bp, D. melanogaster
taaatacatattc

SEQ ID NO: 639081 - DNA, 13 bp, D. melanogaster
taaatacattcaa

SEQ ID NO: 639082 - DNA, 13 bp, D. melanogaster
taaatacattctg

SEQ ID NO: 639083 - DNA, 14 bp, D. melanogaster
taaatacattttgt

SEQ ID NO: 639084 - DNA, 13 bp, D. melanogaster
taaatacccttta

SEQ ID NO: 639085 - DNA, 13 bp, D. melanogaster
taaatacctaaat

SEQ ID NO: 639086 - DNA, 13 bp, D. melanogaster
taaatacctttta

SEQ ID NO: 639087 - DNA, 14 bp, D. melanogaster
taaataccttttga

SEQ ID NO: 639088 - DNA, 13 bp, D. melanogaster
taaatacgaaaat

SEQ ID NO: 639089 - DNA, 13 bp, D. melanogaster
taaatacgaataa

SEQ ID NO: 639090 - DNA, 13 bp, D. melanogaster
taaatacgaatat

SEQ ID NO: 639091 - DNA, 13 bp, D. melanogaster
taaatacgagtat

SEQ ID NO: 639092 - DNA, 13 bp, D. melanogaster
taaatacggaaaa

SEQ ID NO: 639093 - DNA, 13 bp, D. melanogaster
taaatacgtttaa

SEQ ID NO: 639094 - DNA, 13 bp, D. melanogaster
taaatactgtttt

SEQ ID NO: 639095 - DNA, 13 bp, D. melanogaster
taaatactttgaa

SEQ ID NO: 639096 - DNA, 13 bp, D. melanogaster
taaatacttttga

SEQ ID NO: 639097 - DNA, 13 bp, D. melanogaster
taaatagagtgca

SEQ ID NO: 639098 - DNA, 13 bp, D. melanogaster
taaatagatacat

SEQ ID NO: 639099 - DNA, 13 bp, D. melanogaster
taaatagattgaa

SEQ ID NO: 639100 - DNA, 13 bp, D. melanogaster
taaatagcaaaat

SEQ ID NO: 639101 - DNA, 13 bp, D. melanogaster
taaatagcaaaca

SEQ ID NO: 639102 - DNA, 14 bp, D. melanogaster
taaatagcatcatt

SEQ ID NO: 639103 - DNA, 13 bp, D. melanogaster
taaatagcattta

SEQ ID NO: 639104 - DNA, 13 bp, D. melanogaster
taaataggaacac

SEQ ID NO: 639105 - DNA, 13 bp, D. melanogaster
taaataggcaaaa

SEQ ID NO: 639106 - DNA, 13 bp, D. melanogaster
taaatagtaaaca

SEQ ID NO: 639107 - DNA, 13 bp, D. melanogaster
taaatagttacaa

SEQ ID NO: 639108 - DNA, 13 bp, D. melanogaster
taaatagttagtt

SEQ ID NO: 639109 - DNA, 13 bp, D. melanogaster
taaatagttcaaa

SEQ ID NO: 639110 - DNA, 13 bp, D. melanogaster
taaatagtttatg

SEQ ID NO: 639111 - DNA, 13 bp, D. melanogaster
taaatagtttgct

SEQ ID NO: 639112 - DNA, 13 bp, D. melanogaster
taaatagttttct

SEQ ID NO: 639113 - DNA, 13 bp, D. melanogaster
taaatagttttga

SEQ ID NO: 639114 - DNA, 14 bp, D. melanogaster
taaatagttttgaa

SEQ ID NO: 639115 - DNA, 13 bp, D. melanogaster
taaatataaagca

SEQ ID NO: 639116 - DNA, 13 bp, D. melanogaster
taaatataaagct

SEQ ID NO: 639117 - DNA, 14 bp, D. melanogaster
taaatataaatctg

SEQ ID NO: 639118 - DNA, 13 bp, D. melanogaster
taaatatacacat

SEQ ID NO: 639119 - DNA, 14 bp, D. melanogaster
taaatatacatatg

SEQ ID NO: 639120 - DNA, 13 bp, D. melanogaster
taaatatacgtat

SEQ ID NO: 639121 - DNA, 13 bp, D. melanogaster
taaatatagaaac

SEQ ID NO: 639122 - DNA, 13 bp, D. melanogaster
taaatatagcaaa

SEQ ID NO: 639123 - DNA, 13 bp, D. melanogaster
taaatatagctta

SEQ ID NO: 639124 - DNA, 14 bp, D. melanogaster
taaatatagcttag

SEQ ID NO: 639125 - DNA, 14 bp, D. melanogaster
taaatatagtgtga

SEQ ID NO: 639126 - DNA, 13 bp, D. melanogaster
taaatatatctgc

SEQ ID NO: 639127 - DNA, 13 bp, D. melanogaster
taaatatatgttg

SEQ ID NO: 639128 - DNA, 13 bp, D. melanogaster
taaatatatttcc

SEQ ID NO: 639129 - DNA, 13 bp, D. melanogaster
taaatatcaactt

SEQ ID NO: 639130 - DNA, 13 bp, D. melanogaster
taaatatcacaat

SEQ ID NO: 639131 - DNA, 13 bp, D. melanogaster
taaatatcacttt

SEQ ID NO: 639132 - DNA, 13 bp, D. melanogaster
taaatatccattt

SEQ ID NO: 639133 - DNA, 13 bp, D. melanogaster
taaatatctgtgt

SEQ ID NO: 639134 - DNA, 13 bp, D. melanogaster
taaatatgaatca

SEQ ID NO: 639135 - DNA, 13 bp, D. melanogaster
taaatatgaattc

SEQ ID NO: 639136 - DNA, 14 bp, D. melanogaster
taaatatgataact

SEQ ID NO: 639137 - DNA, 13 bp, D. melanogaster
taaatatgcaaat

SEQ ID NO: 639138 - DNA, 13 bp, D. melanogaster
taaatatgcaata

SEQ ID NO: 639139 - DNA, 13 bp, D. melanogaster
taaatatgcaatt

SEQ ID NO: 639140 - DNA, 14 bp, D. melanogaster
taaatatgcaatta

SEQ ID NO: 639141 - DNA, 13 bp, D. melanogaster
taaatatgcacat

SEQ ID NO: 639142 - DNA, 13 bp, D. melanogaster
taaatatgcatac

SEQ ID NO: 639143 - DNA, 13 bp, D. melanogaster
taaatatgccaaa

SEQ ID NO: 639144 - DNA, 13 bp, D. melanogaster
taaatatgctaac

SEQ ID NO: 639145 - DNA, 14 bp, D. melanogaster
taaatatgctaatt

SEQ ID NO: 639146 - DNA, 13 bp, D. melanogaster
taaatatgcttaa

SEQ ID NO: 639147 - DNA, 13 bp, D. melanogaster
taaatatggaatt

SEQ ID NO: 639148 - DNA, 14 bp, D. melanogaster
taaatatggcaaaa

SEQ ID NO: 639149 - DNA, 13 bp, D. melanogaster
taaatatgtaaac

SEQ ID NO: 639150 - DNA, 14 bp, D. melanogaster
taaatatgtacaaa

SEQ ID NO: 639151 - DNA, 14 bp, D. melanogaster
taaatatgtacata

SEQ ID NO: 639152 - DNA, 13 bp, D. melanogaster
taaatatgtacgt

SEQ ID NO: 639153 - DNA, 14 bp, D. melanogaster
taaatatgtatgtg

SEQ ID NO: 639154 - DNA, 13 bp, D. melanogaster
taaatatgtgaaa

SEQ ID NO: 639155 - DNA, 13 bp, D. melanogaster
taaatatgtggtt

SEQ ID NO: 639156 - DNA, 13 bp, D. melanogaster
taaatatgttgta

SEQ ID NO: 639157 - DNA, 13 bp, D. melanogaster
taaatatgttttc

SEQ ID NO: 639158 - DNA, 13 bp, D. melanogaster
taaatattaagtg

SEQ ID NO: 639159 - DNA, 13 bp, D. melanogaster
taaatattaatgg

SEQ ID NO: 639160 - DNA, 13 bp, D. melanogaster
taaatattatgtg

SEQ ID NO: 639161 - DNA, 13 bp, D. melanogaster
taaatattcaagt

SEQ ID NO: 639162 - DNA, 13 bp, D. melanogaster
taaatattcacat

SEQ ID NO: 639163 - DNA, 13 bp, D. melanogaster
taaatattcagca

SEQ ID NO: 639164 - DNA, 13 bp, D. melanogaster
taaatattcagtg

SEQ ID NO: 639165 - DNA, 13 bp, D. melanogaster
taaatattcagtt

SEQ ID NO: 639166 - DNA, 13 bp, D. melanogaster
taaatattccaaa

SEQ ID NO: 639167 - DNA, 14 bp, D. melanogaster
taaatattccattt

SEQ ID NO: 639168 - DNA, 13 bp, D. melanogaster
taaatattccttt

SEQ ID NO: 639169 - DNA, 13 bp, D. melanogaster
taaatattcttga

SEQ ID NO: 639170 - DNA, 13 bp, D. melanogaster
taaatattgcatg

SEQ ID NO: 639171 - DNA, 13 bp, D. melanogaster
taaatattggatt

SEQ ID NO: 639172 - DNA, 13 bp, D. melanogaster
taaatattggtaa

SEQ ID NO: 639173 - DNA, 13 bp, D. melanogaster
taaatattggttt

SEQ ID NO: 639174 - DNA, 13 bp, D. melanogaster
taaatattgtaca

SEQ ID NO: 639175 - DNA, 13 bp, D. melanogaster
taaatattgtgga

SEQ ID NO: 639176 - DNA, 13 bp, D. melanogaster
taaatattgtttg

SEQ ID NO: 639177 - DNA, 13 bp, D. melanogaster
taaatatttaacg

SEQ ID NO: 639178 - DNA, 13 bp, D. melanogaster
taaatatttaagc

SEQ ID NO: 639179 - DNA, 14 bp, D. melanogaster
taaatatttaagca

SEQ ID NO: 639180 - DNA, 14 bp, D. melanogaster
taaatatttaagct

SEQ ID NO: 639181 - DNA, 13 bp, D. melanogaster
taaatatttacag

SEQ ID NO: 639182 - DNA, 13 bp, D. melanogaster
taaatatttaccc

SEQ ID NO: 639183 - DNA, 13 bp, D. melanogaster
taaatatttagca

SEQ ID NO: 639184 - DNA, 14 bp, D. melanogaster
taaatatttatgca

SEQ ID NO: 639185 - DNA, 13 bp, D. melanogaster
taaatatttatgg

SEQ ID NO: 639186 - DNA, 14 bp, D. melanogaster
taaatatttatgtg

SEQ ID NO: 639187 - DNA, 14 bp, D. melanogaster
taaatatttcaatg

SEQ ID NO: 639188 - DNA, 14 bp, D. melanogaster
taaatatttcactt

SEQ ID NO: 639189 - DNA, 13 bp, D. melanogaster
taaatatttcccc

SEQ ID NO: 639190 - DNA, 13 bp, D. melanogaster
taaatatttccga

SEQ ID NO: 639191 - DNA, 13 bp, D. melanogaster
taaatatttcctt

SEQ ID NO: 639192 - DNA, 14 bp, D. melanogaster
taaatatttgaaca

SEQ ID NO: 639193 - DNA, 13 bp, D. melanogaster
taaatatttgaga

SEQ ID NO: 639194 - DNA, 14 bp, D. melanogaster
taaatatttgcatt

SEQ ID NO: 639195 - DNA, 13 bp, D. melanogaster
taaatatttgcca

SEQ ID NO: 639196 - DNA, 13 bp, D. melanogaster
taaatatttggca

SEQ ID NO: 639197 - DNA, 13 bp, D. melanogaster
taaatatttgtac

SEQ ID NO: 639198 - DNA, 14 bp, D. melanogaster
taaatatttgtcaa

SEQ ID NO: 639199 - DNA, 13 bp, D. melanogaster
taaatatttgtga

SEQ ID NO: 639200 - DNA, 13 bp, D. melanogaster
taaatattttagg

SEQ ID NO: 639201 - DNA, 14 bp, D. melanogaster
taaatattttatgg

SEQ ID NO: 639202 - DNA, 13 bp, D. melanogaster
taaatattttccg

SEQ ID NO: 639203 - DNA, 13 bp, D. melanogaster
taaatattttcct

SEQ ID NO: 639204 - DNA, 13 bp, D. melanogaster
taaatcaaaactg

SEQ ID NO: 639205 - DNA, 13 bp, D. melanogaster
taaatcaaaatga

SEQ ID NO: 639206 - DNA, 13 bp, D. melanogaster
taaatcaaaatgg

SEQ ID NO: 639207 - DNA, 13 bp, D. melanogaster
taaatcaaacact

SEQ ID NO: 639208 - DNA, 13 bp, D. melanogaster
taaatcaaacgaa

SEQ ID NO: 639209 - DNA, 13 bp, D. melanogaster
taaatcaaatgaa

SEQ ID NO: 639210 - DNA, 14 bp, D. melanogaster
taaatcaaatgaaa

SEQ ID NO: 639211 - DNA, 13 bp, D. melanogaster
taaatcaaatgtt

SEQ ID NO: 639212 - DNA, 13 bp, D. melanogaster
taaatcaaattgt

SEQ ID NO: 639213 - DNA, 13 bp, D. melanogaster
taaatcaacattt

SEQ ID NO: 639214 - DNA, 13 bp, D. melanogaster
taaatcaactcaa

SEQ ID NO: 639215 - DNA, 13 bp, D. melanogaster
taaatcaagtaat

SEQ ID NO: 639216 - DNA, 13 bp, D. melanogaster
taaatcaagttaa

SEQ ID NO: 639217 - DNA, 13 bp, D. melanogaster
taaatcaataaag

SEQ ID NO: 639218 - DNA, 13 bp, D. melanogaster
taaatcaataagc

SEQ ID NO: 639219 - DNA, 13 bp, D. melanogaster
taaatcaatatca

SEQ ID NO: 639220 - DNA, 13 bp, D. melanogaster
taaatcaatcgaa

SEQ ID NO: 639221 - DNA, 13 bp, D. melanogaster
taaatcaatgcga

SEQ ID NO: 639222 - DNA, 13 bp, D. melanogaster
taaatcaattaca

SEQ ID NO: 639223 - DNA, 13 bp, D. melanogaster
taaatcaatttcg

SEQ ID NO: 639224 - DNA, 13 bp, D. melanogaster
taaatcaatttgt

SEQ ID NO: 639225 - DNA, 13 bp, D. melanogaster
taaatcagaaaat

SEQ ID NO: 639226 - DNA, 13 bp, D. melanogaster
taaatcagttggc

SEQ ID NO: 639227 - DNA, 13 bp, D. melanogaster
taaatcataaatc

SEQ ID NO: 639228 - DNA, 13 bp, D. melanogaster
taaatcatacata

SEQ ID NO: 639229 - DNA, 13 bp, D. melanogaster
taaatcatagaaa

SEQ ID NO: 639230 - DNA, 13 bp, D. melanogaster
taaatcatatcaa

SEQ ID NO: 639231 - DNA, 13 bp, D. melanogaster
taaatcatatttg

SEQ ID NO: 639232 - DNA, 13 bp, D. melanogaster
taaatcatccata

SEQ ID NO: 639233 - DNA, 13 bp, D. melanogaster
taaatcatttgta

SEQ ID NO: 639234 - DNA, 13 bp, D. melanogaster
taaatccaaatta

SEQ ID NO: 639235 - DNA, 13 bp, D. melanogaster
taaatccacgcac

SEQ ID NO: 639236 - DNA, 13 bp, D. melanogaster
taaatccatttta

SEQ ID NO: 639237 - DNA, 13 bp, D. melanogaster
taaatccgataaa

SEQ ID NO: 639238 - DNA, 13 bp, D. melanogaster
taaatcgaaaaag

SEQ ID NO: 639239 - DNA, 13 bp, D. melanogaster
taaatcgaaacaa

SEQ ID NO: 639240 - DNA, 13 bp, D. melanogaster
taaatcgaaatcg

SEQ ID NO: 639241 - DNA, 13 bp, D. melanogaster
taaatcgaacaaa

SEQ ID NO: 639242 - DNA, 13 bp, D. melanogaster
taaatcgaatcga

SEQ ID NO: 639243 - DNA, 13 bp, D. melanogaster
taaatcgaattga

SEQ ID NO: 639244 - DNA, 13 bp, D. melanogaster
taaatcgaatttt

SEQ ID NO: 639245 - DNA, 13 bp, D. melanogaster
taaatcgatttat

SEQ ID NO: 639246 - DNA, 13 bp, D. melanogaster
taaatcgatttct

SEQ ID NO: 639247 - DNA, 13 bp, D. melanogaster
taaatcgattttt

SEQ ID NO: 639248 - DNA, 13 bp, D. melanogaster
taaatcgcaataa

SEQ ID NO: 639249 - DNA, 13 bp, D. melanogaster
taaatcgtaaaaa

SEQ ID NO: 639250 - DNA, 13 bp, D. melanogaster
taaatcgtttaaa

SEQ ID NO: 639251 - DNA, 13 bp, D. melanogaster
taaatcgtttgcc

SEQ ID NO: 639252 - DNA, 13 bp, D. melanogaster
taaatcgttttat

SEQ ID NO: 639253 - DNA, 13 bp, D. melanogaster
taaatctaaattg

SEQ ID NO: 639254 - DNA, 13 bp, D. melanogaster
taaatctaatcta

SEQ ID NO: 639255 - DNA, 13 bp, D. melanogaster
taaatctatgttt

SEQ ID NO: 639256 - DNA, 13 bp, D. melanogaster
taaatctcaattt

SEQ ID NO: 639257 - DNA, 13 bp, D. melanogaster
taaatctgaacat

SEQ ID NO: 639258 - DNA, 13 bp, D. melanogaster
taaatctgaatct

SEQ ID NO: 639259 - DNA, 13 bp, D. melanogaster
taaatctgaattt

SEQ ID NO: 639260 - DNA, 13 bp, D. melanogaster
taaatctgctgga

SEQ ID NO: 639261 - DNA, 13 bp, D. melanogaster
taaatcttaaagt

SEQ ID NO: 639262 - DNA, 13 bp, D. melanogaster
taaatcttctaac

SEQ ID NO: 639263 - DNA, 13 bp, D. melanogaster
taaatctttcaat

SEQ ID NO: 639264 - DNA, 13 bp, D. melanogaster
taaatctttgttt

SEQ ID NO: 639265 - DNA, 13 bp, D. melanogaster
taaatcttttgaa

SEQ ID NO: 639266 - DNA, 13 bp, D. melanogaster
taaatgaaaacga

SEQ ID NO: 639267 - DNA, 13 bp, D. melanogaster
taaatgaaaacta

SEQ ID NO: 639268 - DNA, 13 bp, D. melanogaster
taaatgaaaatca

SEQ ID NO: 639269 - DNA, 13 bp, D. melanogaster
taaatgaaaatcg

SEQ ID NO: 639270 - DNA, 13 bp, D. melanogaster
taaatgaaaatct

SEQ ID NO: 639271 - DNA, 13 bp, D. melanogaster
taaatgaaaatgc

SEQ ID NO: 639272 - DNA, 14 bp, D. melanogaster
taaatgaaaattgt

SEQ ID NO: 639273 - DNA, 13 bp, D. melanogaster
taaatgaaatgat

SEQ ID NO: 639274 - DNA, 13 bp, D. melanogaster
taaatgaaatgtg

SEQ ID NO: 639275 - DNA, 13 bp, D. melanogaster
taaatgaaattga

SEQ ID NO: 639276 - DNA, 13 bp, D. melanogaster
taaatgaaattgc

SEQ ID NO: 639277 - DNA, 13 bp, D. melanogaster
taaatgaactaaa

SEQ ID NO: 639278 - DNA, 13 bp, D. melanogaster
taaatgaagcatt

SEQ ID NO: 639279 - DNA, 13 bp, D. melanogaster
taaatgaagtgag

SEQ ID NO: 639280 - DNA, 13 bp, D. melanogaster
taaatgaatgaat

SEQ ID NO: 639281 - DNA, 14 bp, D. melanogaster
taaatgaatgaatt

SEQ ID NO: 639282 - DNA, 13 bp, D. melanogaster
taaatgaatgttt

SEQ ID NO: 639283 - DNA, 13 bp, D. melanogaster
taaatgaattact

SEQ ID NO: 639284 - DNA, 13 bp, D. melanogaster
taaatgaattgca

SEQ ID NO: 639285 - DNA, 13 bp, D. melanogaster
taaatgaatttgc

SEQ ID NO: 639286 - DNA, 13 bp, D. melanogaster
taaatgacaaaac

SEQ ID NO: 639287 - DNA, 13 bp, D. melanogaster
taaatgacaaaat

SEQ ID NO: 639288 - DNA, 13 bp, D. melanogaster
taaatgacattta

SEQ ID NO: 639289 - DNA, 13 bp, D. melanogaster
taaatgagcaaat

SEQ ID NO: 639290 - DNA, 13 bp, D. melanogaster
taaatgagcttca

SEQ ID NO: 639291 - DNA, 13 bp, D. melanogaster
taaatgagtttta

SEQ ID NO: 639292 - DNA, 13 bp, D. melanogaster
taaatgatgaaat

SEQ ID NO: 639293 - DNA, 13 bp, D. melanogaster
taaatgatgtaaa

SEQ ID NO: 639294 - DNA, 13 bp, D. melanogaster
taaatgattaaac

SEQ ID NO: 639295 - DNA, 13 bp, D. melanogaster
taaatgattaatg

SEQ ID NO: 639296 - DNA, 13 bp, D. melanogaster
taaatgattacaa

SEQ ID NO: 639297 - DNA, 13 bp, D. melanogaster
taaatgatttcaa

SEQ ID NO: 639298 - DNA, 13 bp, D. melanogaster
taaatgatttgaa

SEQ ID NO: 639299 - DNA, 13 bp, D. melanogaster
taaatgatttttg

SEQ ID NO: 639300 - DNA, 14 bp, D. melanogaster
taaatgcaaaataa

SEQ ID NO: 639301 - DNA, 13 bp, D. melanogaster
taaatgcaaacaa

SEQ ID NO: 639302 - DNA, 13 bp, D. melanogaster
taaatgcaaactt

SEQ ID NO: 639303 - DNA, 13 bp, D. melanogaster
taaatgcaaatca

SEQ ID NO: 639304 - DNA, 13 bp, D. melanogaster
taaatgcaaatgg

SEQ ID NO: 639305 - DNA, 14 bp, D. melanogaster
taaatgcaaattaa

SEQ ID NO: 639306 - DNA, 14 bp, D. melanogaster
taaatgcaaattta

SEQ ID NO: 639307 - DNA, 13 bp, D. melanogaster
taaatgcaacaaa

SEQ ID NO: 639308 - DNA, 13 bp, D. melanogaster
taaatgcaactaa

SEQ ID NO: 639309 - DNA, 13 bp, D. melanogaster
taaatgcaacttg

SEQ ID NO: 639310 - DNA, 13 bp, D. melanogaster
taaatgcaagaaa

SEQ ID NO: 639311 - DNA, 13 bp, D. melanogaster
taaatgcaagtgc

SEQ ID NO: 639312 - DNA, 13 bp, D. melanogaster
taaatgcaataaa

SEQ ID NO: 639313 - DNA, 14 bp, D. melanogaster
taaatgcaataaaa

SEQ ID NO: 639314 - DNA, 13 bp, D. melanogaster
taaatgcaatcaa

SEQ ID NO: 639315 - DNA, 13 bp, D. melanogaster
taaatgcaatcag

SEQ ID NO: 639316 - DNA, 14 bp, D. melanogaster
taaatgcaattaat

SEQ ID NO: 639317 - DNA, 13 bp, D. melanogaster
taaatgcaattgc

SEQ ID NO: 639318 - DNA, 14 bp, D. melanogaster
taaatgcaatttat

SEQ ID NO: 639319 - DNA, 13 bp, D. melanogaster
taaatgcaatttg

SEQ ID NO: 639320 - DNA, 13 bp, D. melanogaster
taaatgcacaaaa

SEQ ID NO: 639321 - DNA, 13 bp, D. melanogaster
taaatgcacaaat

SEQ ID NO: 639322 - DNA, 14 bp, D. melanogaster
taaatgcagaaaca

SEQ ID NO: 639323 - DNA, 13 bp, D. melanogaster
taaatgcagacta

SEQ ID NO: 639324 - DNA, 13 bp, D. melanogaster
taaatgcagctaa

SEQ ID NO: 639325 - DNA, 13 bp, D. melanogaster
taaatgcatatta

SEQ ID NO: 639326 - DNA, 13 bp, D. melanogaster
taaatgcattaaa

SEQ ID NO: 639327 - DNA, 13 bp, D. melanogaster
taaatgcattcat

SEQ ID NO: 639328 - DNA, 13 bp, D. melanogaster
taaatgccaaaaa

SEQ ID NO: 639329 - DNA, 13 bp, D. melanogaster
taaatgccaaata

SEQ ID NO: 639330 - DNA, 13 bp, D. melanogaster
taaatgccaataa

SEQ ID NO: 639331 - DNA, 14 bp, D. melanogaster
taaatgccaatatt

SEQ ID NO: 639332 - DNA, 14 bp, D. melanogaster
taaatgccaatgcc

SEQ ID NO: 639333 - DNA, 13 bp, D. melanogaster
taaatgccaattt

SEQ ID NO: 639334 - DNA, 13 bp, D. melanogaster
taaatgccagcca

SEQ ID NO: 639335 - DNA, 13 bp, D. melanogaster
taaatgccataaa

SEQ ID NO: 639336 - DNA, 13 bp, D. melanogaster
taaatgccattta

SEQ ID NO: 639337 - DNA, 13 bp, D. melanogaster
taaatgccatttt

SEQ ID NO: 639338 - DNA, 13 bp, D. melanogaster
taaatgccttttt

SEQ ID NO: 639339 - DNA, 13 bp, D. melanogaster
taaatgcgaaata

SEQ ID NO: 639340 - DNA, 13 bp, D. melanogaster
taaatgcgtttaa

SEQ ID NO: 639341 - DNA, 13 bp, D. melanogaster
taaatgctaaatg

SEQ ID NO: 639342 - DNA, 13 bp, D. melanogaster
taaatgctataaa

SEQ ID NO: 639343 - DNA, 13 bp, D. melanogaster
taaatgctattaa

SEQ ID NO: 639344 - DNA, 13 bp, D. melanogaster
taaatgctgccaa

SEQ ID NO: 639345 - DNA, 13 bp, D. melanogaster
taaatgcttaaaa

SEQ ID NO: 639346 - DNA, 13 bp, D. melanogaster
taaatgcttaaat

SEQ ID NO: 639347 - DNA, 13 bp, D. melanogaster
taaatgcttatta

SEQ ID NO: 639348 - DNA, 13 bp, D. melanogaster
taaatgctttcaa

SEQ ID NO: 639349 - DNA, 13 bp, D. melanogaster
taaatgctttgtt

SEQ ID NO: 639350 - DNA, 14 bp, D. melanogaster
taaatgcttttaaa

SEQ ID NO: 639351 - DNA, 13 bp, D. melanogaster
taaatgcttttca

SEQ ID NO: 639352 - DNA, 13 bp, D. melanogaster
taaatgcttttga

SEQ ID NO: 639353 - DNA, 13 bp, D. melanogaster
taaatggaaaaac

SEQ ID NO: 639354 - DNA, 13 bp, D. melanogaster
taaatggaaaaca

SEQ ID NO: 639355 - DNA, 13 bp, D. melanogaster
taaatggaaaacg

SEQ ID NO: 639356 - DNA, 13 bp, D. melanogaster
taaatggaaacaa

SEQ ID NO: 639357 - DNA, 13 bp, D. melanogaster
taaatggaaatca

SEQ ID NO: 639358 - DNA, 13 bp, D. melanogaster
taaatggaatatt

SEQ ID NO: 639359 - DNA, 13 bp, D. melanogaster
taaatggaatttt

SEQ ID NO: 639360 - DNA, 13 bp, D. melanogaster
taaatggaccgtt

SEQ ID NO: 639361 - DNA, 13 bp, D. melanogaster
taaatggatatat

SEQ ID NO: 639362 - DNA, 13 bp, D. melanogaster
taaatggatattt

SEQ ID NO: 639363 - DNA, 13 bp, D. melanogaster
taaatggatttct

SEQ ID NO: 639364 - DNA, 13 bp, D. melanogaster
taaatggcaaaaa

SEQ ID NO: 639365 - DNA, 13 bp, D. melanogaster
taaatggcaatta

SEQ ID NO: 639366 - DNA, 13 bp, D. melanogaster
taaatggcagcaa

SEQ ID NO: 639367 - DNA, 13 bp, D. melanogaster
taaatggcataaa

SEQ ID NO: 639368 - DNA, 13 bp, D. melanogaster
taaatggcctacg

SEQ ID NO: 639369 - DNA, 14 bp, D. melanogaster
taaatggctaaaaa

SEQ ID NO: 639370 - DNA, 13 bp, D. melanogaster
taaatggctccaa

SEQ ID NO: 639371 - DNA, 13 bp, D. melanogaster
taaatggctttaa

SEQ ID NO: 639372 - DNA, 13 bp, D. melanogaster
taaatgggaaatt

SEQ ID NO: 639373 - DNA, 13 bp, D. melanogaster
taaatgggattat

SEQ ID NO: 639374 - DNA, 13 bp, D. melanogaster
taaatgggcaaat

SEQ ID NO: 639375 - DNA, 13 bp, D. melanogaster
taaatggtaaaca

SEQ ID NO: 639376 - DNA, 14 bp, D. melanogaster
taaatggtaaatgg

SEQ ID NO: 639377 - DNA, 13 bp, D. melanogaster
taaatggtatatt

SEQ ID NO: 639378 - DNA, 13 bp, D. melanogaster
taaatggtatttt

SEQ ID NO: 639379 - DNA, 13 bp, D. melanogaster
taaatggtcaagt

SEQ ID NO: 639380 - DNA, 13 bp, D. melanogaster
taaatggttcaaa

SEQ ID NO: 639381 - DNA, 13 bp, D. melanogaster
taaatggtttcaa

SEQ ID NO: 639382 - DNA, 13 bp, D. melanogaster
taaatggttttat

SEQ ID NO: 639383 - DNA, 13 bp, D. melanogaster
taaatgtaaagca

SEQ ID NO: 639384 - DNA, 13 bp, D. melanogaster
taaatgtaaatac

SEQ ID NO: 639385 - DNA, 13 bp, D. melanogaster
taaatgtaaatga

SEQ ID NO: 639386 - DNA, 13 bp, D. melanogaster
taaatgtaaatgt

SEQ ID NO: 639387 - DNA, 13 bp, D. melanogaster
taaatgtaacaaa

SEQ ID NO: 639388 - DNA, 13 bp, D. melanogaster
taaatgtaagata

SEQ ID NO: 639389 - DNA, 13 bp, D. melanogaster
taaatgtaatcaa

SEQ ID NO: 639390 - DNA, 13 bp, D. melanogaster
taaatgtaattga

SEQ ID NO: 639391 - DNA, 13 bp, D. melanogaster
taaatgtaatttc

SEQ ID NO: 639392 - DNA, 13 bp, D. melanogaster
taaatgtacaaaa

SEQ ID NO: 639393 - DNA, 13 bp, D. melanogaster
taaatgtacaaat

SEQ ID NO: 639394 - DNA, 14 bp, D. melanogaster
taaatgtacaaatt

SEQ ID NO: 639395 - DNA, 13 bp, D. melanogaster
taaatgtacataa

SEQ ID NO: 639396 - DNA, 13 bp, D. melanogaster
taaatgtacatat

SEQ ID NO: 639397 - DNA, 13 bp, D. melanogaster
taaatgtacttaa

SEQ ID NO: 639398 - DNA, 13 bp, D. melanogaster
taaatgtactttt

SEQ ID NO: 639399 - DNA, 13 bp, D. melanogaster
taaatgtagtggt

SEQ ID NO: 639400 - DNA, 14 bp, D. melanogaster
taaatgtatacata

SEQ ID NO: 639401 - DNA, 13 bp, D. melanogaster
taaatgtatatga

SEQ ID NO: 639402 - DNA, 13 bp, D. melanogaster
taaatgtatctaa

SEQ ID NO: 639403 - DNA, 14 bp, D. melanogaster
taaatgtatgcaaa

SEQ ID NO: 639404 - DNA, 14 bp, D. melanogaster
taaatgtattcaaa

SEQ ID NO: 639405 - DNA, 13 bp, D. melanogaster
taaatgtattctt

SEQ ID NO: 639406 - DNA, 13 bp, D. melanogaster
taaatgtattgaa

SEQ ID NO: 639407 - DNA, 13 bp, D. melanogaster
taaatgtatttga

SEQ ID NO: 639408 - DNA, 13 bp, D. melanogaster
taaatgtcaaaat

SEQ ID NO: 639409 - DNA, 13 bp, D. melanogaster
taaatgtcaattg

SEQ ID NO: 639410 - DNA, 13 bp, D. melanogaster
taaatgtctatag

SEQ ID NO: 639411 - DNA, 13 bp, D. melanogaster
taaatgtctttat

SEQ ID NO: 639412 - DNA, 13 bp, D. melanogaster
taaatgtgaaaat

SEQ ID NO: 639413 - DNA, 13 bp, D. melanogaster
taaatgtgaataa

SEQ ID NO: 639414 - DNA, 13 bp, D. melanogaster
taaatgtgaatat

SEQ ID NO: 639415 - DNA, 13 bp, D. melanogaster
taaatgtgaatgt

SEQ ID NO: 639416 - DNA, 13 bp, D. melanogaster
taaatgtgatttt

SEQ ID NO: 639417 - DNA, 13 bp, D. melanogaster
taaatgtgcaatt

SEQ ID NO: 639418 - DNA, 13 bp, D. melanogaster
taaatgtgggcaa

SEQ ID NO: 639419 - DNA, 13 bp, D. melanogaster
taaatgtgtacat

SEQ ID NO: 639420 - DNA, 13 bp, D. melanogaster
taaatgtgtatat

SEQ ID NO: 639421 - DNA, 13 bp, D. melanogaster
taaatgtgtatgt

SEQ ID NO: 639422 - DNA, 13 bp, D. melanogaster
taaatgtgtgtaa

SEQ ID NO: 639423 - DNA, 13 bp, D. melanogaster
taaatgtgtgtgc

SEQ ID NO: 639424 - DNA, 13 bp, D. melanogaster
taaatgtgtgtgt

SEQ ID NO: 639425 - DNA, 13 bp, D. melanogaster
taaatgtgtgttt

SEQ ID NO: 639426 - DNA, 14 bp, D. melanogaster
taaatgtgtgtttt

SEQ ID NO: 639427 - DNA, 13 bp, D. melanogaster
taaatgtgttaaa

SEQ ID NO: 639428 - DNA, 13 bp, D. melanogaster
taaatgttaaaac

SEQ ID NO: 639429 - DNA, 13 bp, D. melanogaster
taaatgttaatca

SEQ ID NO: 639430 - DNA, 14 bp, D. melanogaster
taaatgttaatttc

SEQ ID NO: 639431 - DNA, 13 bp, D. melanogaster
taaatgttcaaaa

SEQ ID NO: 639432 - DNA, 13 bp, D. melanogaster
taaatgttgaata

SEQ ID NO: 639433 - DNA, 13 bp, D. melanogaster
taaatgttggcaa

SEQ ID NO: 639434 - DNA, 13 bp, D. melanogaster
taaatgttgtaaa

SEQ ID NO: 639435 - DNA, 14 bp, D. melanogaster
taaatgttgtaaat

SEQ ID NO: 639436 - DNA, 13 bp, D. melanogaster
taaatgttgtcta

SEQ ID NO: 639437 - DNA, 13 bp, D. melanogaster
taaatgttgttta

SEQ ID NO: 639438 - DNA, 13 bp, D. melanogaster
taaatgtttactg

SEQ ID NO: 639439 - DNA, 13 bp, D. melanogaster
taaatgtttcttt

SEQ ID NO: 639440 - DNA, 13 bp, D. melanogaster
taaatgtttgatt

SEQ ID NO: 639441 - DNA, 13 bp, D. melanogaster
taaatgtttgcat

SEQ ID NO: 639442 - DNA, 13 bp, D. melanogaster
taaatgttttatc

SEQ ID NO: 639443 - DNA, 13 bp, D. melanogaster
taaatgtttttgg

SEQ ID NO: 639444 - DNA, 13 bp, D. melanogaster
taaattaaaatgc

SEQ ID NO: 639445 - DNA, 13 bp, D. melanogaster
taaattaaacaag

SEQ ID NO: 639446 - DNA, 13 bp, D. melanogaster
taaattaaagtac

SEQ ID NO: 639447 - DNA, 13 bp, D. melanogaster
taaattaaatgca

SEQ ID NO: 639448 - DNA, 13 bp, D. melanogaster
taaattaagcaaa

SEQ ID NO: 639449 - DNA, 14 bp, D. melanogaster
taaattaagcaaat

SEQ ID NO: 639450 - DNA, 13 bp, D. melanogaster
taaattaagcaat

SEQ ID NO: 639451 - DNA, 13 bp, D. melanogaster
taaattaagttgt

SEQ ID NO: 639452 - DNA, 13 bp, D. melanogaster
taaattaatgctt

SEQ ID NO: 639453 - DNA, 13 bp, D. melanogaster
taaattacagtgc

SEQ ID NO: 639454 - DNA, 13 bp, D. melanogaster
taaattacatgtt

SEQ ID NO: 639455 - DNA, 13 bp, D. melanogaster
taaattacatttg

SEQ ID NO: 639456 - DNA, 13 bp, D. melanogaster
taaattacccaaa

SEQ ID NO: 639457 - DNA, 13 bp, D. melanogaster
taaattacgtata

SEQ ID NO: 639458 - DNA, 13 bp, D. melanogaster
taaattactcata

SEQ ID NO: 639459 - DNA, 13 bp, D. melanogaster
taaattacttgtt

SEQ ID NO: 639460 - DNA, 13 bp, D. melanogaster
taaattacttttc

SEQ ID NO: 639461 - DNA, 13 bp, D. melanogaster
taaattagaaatg

SEQ ID NO: 639462 - DNA, 13 bp, D. melanogaster
taaattagcagct

SEQ ID NO: 639463 - DNA, 13 bp, D. melanogaster
taaattagctaaa

SEQ ID NO: 639464 - DNA, 13 bp, D. melanogaster
taaattagtgaaa

SEQ ID NO: 639465 - DNA, 13 bp, D. melanogaster
taaattataagca

SEQ ID NO: 639466 - DNA, 13 bp, D. melanogaster
taaattatatgca

SEQ ID NO: 639467 - DNA, 13 bp, D. melanogaster
taaattatattgc

SEQ ID NO: 639468 - DNA, 13 bp, D. melanogaster
taaattatgcata

SEQ ID NO: 639469 - DNA, 13 bp, D. melanogaster
taaattatgcatg

SEQ ID NO: 639470 - DNA, 13 bp, D. melanogaster
taaattatgccaa

SEQ ID NO: 639471 - DNA, 13 bp, D. melanogaster
taaattatgtcaa

SEQ ID NO: 639472 - DNA, 13 bp, D. melanogaster
taaattatgtgca

SEQ ID NO: 639473 - DNA, 13 bp, D. melanogaster
taaattatgtttc

SEQ ID NO: 639474 - DNA, 13 bp, D. melanogaster
taaattattcagt

SEQ ID NO: 639475 - DNA, 13 bp, D. melanogaster
taaattattcgca

SEQ ID NO: 639476 - DNA, 13 bp, D. melanogaster
taaattattgcaa

SEQ ID NO: 639477 - DNA, 13 bp, D. melanogaster
taaattatttgct

SEQ ID NO: 639478 - DNA, 13 bp, D. melanogaster
taaattcaaattc

SEQ ID NO: 639479 - DNA, 14 bp, D. melanogaster
taaattcaaattca

SEQ ID NO: 639480 - DNA, 13 bp, D. melanogaster
taaattcaagaaa

SEQ ID NO: 639481 - DNA, 13 bp, D. melanogaster
taaattcactttc

SEQ ID NO: 639482 - DNA, 13 bp, D. melanogaster
taaattcattttg

SEQ ID NO: 639483 - DNA, 13 bp, D. melanogaster
taaattccaaata

SEQ ID NO: 639484 - DNA, 13 bp, D. melanogaster
taaattccaaatt

SEQ ID NO: 639485 - DNA, 13 bp, D. melanogaster
taaattccattat

SEQ ID NO: 639486 - DNA, 13 bp, D. melanogaster
taaattcccactt

SEQ ID NO: 639487 - DNA, 13 bp, D. melanogaster
taaattcccataa

SEQ ID NO: 639488 - DNA, 13 bp, D. melanogaster
taaattcgaaagg

SEQ ID NO: 639489 - DNA, 13 bp, D. melanogaster
taaattcgataag

SEQ ID NO: 639490 - DNA, 13 bp, D. melanogaster
taaattcgatttg

SEQ ID NO: 639491 - DNA, 13 bp, D. melanogaster
taaattcgatttt

SEQ ID NO: 639492 - DNA, 13 bp, D. melanogaster
taaattcgtatat

SEQ ID NO: 639493 - DNA, 13 bp, D. melanogaster
taaattcgtattt

SEQ ID NO: 639494 - DNA, 13 bp, D. melanogaster
taaattcgttaaa

SEQ ID NO: 639495 - DNA, 13 bp, D. melanogaster
taaattcgtttgt

SEQ ID NO: 639496 - DNA, 13 bp, D. melanogaster
taaattctttgaa

SEQ ID NO: 639497 - DNA, 13 bp, D. melanogaster
taaattcttttgt

SEQ ID NO: 639498 - DNA, 13 bp, D. melanogaster
taaattgaaaaca

SEQ ID NO: 639499 - DNA, 14 bp, D. melanogaster
taaattgaaaagtt

SEQ ID NO: 639500 - DNA, 13 bp, D. melanogaster
taaattgaaagct

SEQ ID NO: 639501 - DNA, 13 bp, D. melanogaster
taaattgaaatca

SEQ ID NO: 639502 - DNA, 14 bp, D. melanogaster
taaattgaaattga

SEQ ID NO: 639503 - DNA, 13 bp, D. melanogaster
taaattgaatgaa

SEQ ID NO: 639504 - DNA, 13 bp, D. melanogaster
taaattgagataa

SEQ ID NO: 639505 - DNA, 14 bp, D. melanogaster
taaattgagattaa

SEQ ID NO: 639506 - DNA, 13 bp, D. melanogaster
taaattgagttta

SEQ ID NO: 639507 - DNA, 13 bp, D. melanogaster
taaattgatattg

SEQ ID NO: 639508 - DNA, 13 bp, D. melanogaster
taaattgatgtat

SEQ ID NO: 639509 - DNA, 13 bp, D. melanogaster
taaattgattgat

SEQ ID NO: 639510 - DNA, 14 bp, D. melanogaster
taaattgattgatt

SEQ ID NO: 639511 - DNA, 13 bp, D. melanogaster
taaattgcaaaat

SEQ ID NO: 639512 - DNA, 13 bp, D. melanogaster
taaattgcaaata

SEQ ID NO: 639513 - DNA, 13 bp, D. melanogaster
taaattgcaacaa

SEQ ID NO: 639514 - DNA, 14 bp, D. melanogaster
taaattgcaataaa

SEQ ID NO: 639515 - DNA, 13 bp, D. melanogaster
taaattgcaatca

SEQ ID NO: 639516 - DNA, 13 bp, D. melanogaster
taaattgcaattt

SEQ ID NO: 639517 - DNA, 14 bp, D. melanogaster
taaattgcaatttt

SEQ ID NO: 639518 - DNA, 13 bp, D. melanogaster
taaattgcacatt

SEQ ID NO: 639519 - DNA, 13 bp, D. melanogaster
taaattgcataat

SEQ ID NO: 639520 - DNA, 13 bp, D. melanogaster
taaattgcataga

SEQ ID NO: 639521 - DNA, 13 bp, D. melanogaster
taaattgcattcg

SEQ ID NO: 639522 - DNA, 13 bp, D. melanogaster
taaattgcattgc

SEQ ID NO: 639523 - DNA, 14 bp, D. melanogaster
taaattgcatttaa

SEQ ID NO: 639524 - DNA, 13 bp, D. melanogaster
taaattgcatttt

SEQ ID NO: 639525 - DNA, 13 bp, D. melanogaster
taaattgccaaat

SEQ ID NO: 639526 - DNA, 13 bp, D. melanogaster
taaattgccattt

SEQ ID NO: 639527 - DNA, 13 bp, D. melanogaster
taaattgccttat

SEQ ID NO: 639528 - DNA, 13 bp, D. melanogaster
taaattgcgcata

SEQ ID NO: 639529 - DNA, 13 bp, D. melanogaster
taaattgctgaaa

SEQ ID NO: 639530 - DNA, 13 bp, D. melanogaster
taaattggaggtg

SEQ ID NO: 639531 - DNA, 13 bp, D. melanogaster
taaattggattat

SEQ ID NO: 639532 - DNA, 13 bp, D. melanogaster
taaattggatttt

SEQ ID NO: 639533 - DNA, 14 bp, D. melanogaster
taaattggccaaat

SEQ ID NO: 639534 - DNA, 13 bp, D. melanogaster
taaattgggtctt

SEQ ID NO: 639535 - DNA, 13 bp, D. melanogaster
taaattggtttaa

SEQ ID NO: 639536 - DNA, 13 bp, D. melanogaster
taaattggtttta

SEQ ID NO: 639537 - DNA, 13 bp, D. melanogaster
taaattggttttg

SEQ ID NO: 639538 - DNA, 13 bp, D. melanogaster
taaattgtaaatc

SEQ ID NO: 639539 - DNA, 14 bp, D. melanogaster
taaattgtaaattg

SEQ ID NO: 639540 - DNA, 13 bp, D. melanogaster
taaattgtaacaa

SEQ ID NO: 639541 - DNA, 14 bp, D. melanogaster
taaattgtaatgat

SEQ ID NO: 639542 - DNA, 14 bp, D. melanogaster
taaattgtatattg

SEQ ID NO: 639543 - DNA, 13 bp, D. melanogaster
taaattgtatttc

SEQ ID NO: 639544 - DNA, 13 bp, D. melanogaster
taaattgtcggct

SEQ ID NO: 639545 - DNA, 14 bp, D. melanogaster
taaattgtgaaata

SEQ ID NO: 639546 - DNA, 13 bp, D. melanogaster
taaattgtgttat

SEQ ID NO: 639547 - DNA, 13 bp, D. melanogaster
taaattgttcaaa

SEQ ID NO: 639548 - DNA, 13 bp, D. melanogaster
taaattgttcatt

SEQ ID NO: 639549 - DNA, 13 bp, D. melanogaster
taaattgttcgaa

SEQ ID NO: 639550 - DNA, 13 bp, D. melanogaster
taaattgttgcaa

SEQ ID NO: 639551 - DNA, 14 bp, D. melanogaster
taaattgtttgctt

SEQ ID NO: 639552 - DNA, 13 bp, D. melanogaster
taaattgtttgtg

SEQ ID NO: 639553 - DNA, 13 bp, D. melanogaster
taaattgttttgc

SEQ ID NO: 639554 - DNA, 13 bp, D. melanogaster
taaatttaaagca

SEQ ID NO: 639555 - DNA, 14 bp, D. melanogaster
taaatttaaattcg

SEQ ID NO: 639556 - DNA, 13 bp, D. melanogaster
taaatttaacatg

SEQ ID NO: 639557 - DNA, 13 bp, D. melanogaster
taaatttaagtga

SEQ ID NO: 639558 - DNA, 13 bp, D. melanogaster
taaatttaagttc

SEQ ID NO: 639559 - DNA, 13 bp, D. melanogaster
taaatttaatagc

SEQ ID NO: 639560 - DNA, 13 bp, D. melanogaster
taaatttacatga

SEQ ID NO: 639561 - DNA, 14 bp, D. melanogaster
taaatttagaaatc

SEQ ID NO: 639562 - DNA, 13 bp, D. melanogaster
taaatttagcaca

SEQ ID NO: 639563 - DNA, 13 bp, D. melanogaster
taaatttatgcaa

SEQ ID NO: 639564 - DNA, 13 bp, D. melanogaster
taaatttattgag

SEQ ID NO: 639565 - DNA, 13 bp, D. melanogaster
taaatttattgcc

SEQ ID NO: 639566 - DNA, 13 bp, D. melanogaster
taaatttattgct

SEQ ID NO: 639567 - DNA, 13 bp, D. melanogaster
taaatttcaaaag

SEQ ID NO: 639568 - DNA, 13 bp, D. melanogaster
taaatttcaacaa

SEQ ID NO: 639569 - DNA, 13 bp, D. melanogaster
taaatttcaagtt

SEQ ID NO: 639570 - DNA, 13 bp, D. melanogaster
taaatttcaattc

SEQ ID NO: 639571 - DNA, 13 bp, D. melanogaster
taaatttcaattg

SEQ ID NO: 639572 - DNA, 14 bp, D. melanogaster
taaatttcaatttg

SEQ ID NO: 639573 - DNA, 13 bp, D. melanogaster
taaatttcacaat

SEQ ID NO: 639574 - DNA, 13 bp, D. melanogaster
taaatttcacata

SEQ ID NO: 639575 - DNA, 14 bp, D. melanogaster
taaatttcagtaat

SEQ ID NO: 639576 - DNA, 13 bp, D. melanogaster
taaatttcatagc

SEQ ID NO: 639577 - DNA, 13 bp, D. melanogaster
taaatttcatcaa

SEQ ID NO: 639578 - DNA, 13 bp, D. melanogaster
taaatttccaaat

SEQ ID NO: 639579 - DNA, 13 bp, D. melanogaster
taaatttccaata

SEQ ID NO: 639580 - DNA, 13 bp, D. melanogaster
taaatttccaatc

SEQ ID NO: 639581 - DNA, 14 bp, D. melanogaster
taaatttccaatcg

SEQ ID NO: 639582 - DNA, 13 bp, D. melanogaster
taaatttcccatt

SEQ ID NO: 639583 - DNA, 13 bp, D. melanogaster
taaatttccttaa

SEQ ID NO: 639584 - DNA, 13 bp, D. melanogaster
taaatttcgaaat

SEQ ID NO: 639585 - DNA, 13 bp, D. melanogaster
taaatttctgttt

SEQ ID NO: 639586 - DNA, 14 bp, D. melanogaster
taaatttctgtttg

SEQ ID NO: 639587 - DNA, 13 bp, D. melanogaster
taaatttctttca

SEQ ID NO: 639588 - DNA, 13 bp, D. melanogaster
taaatttgaaaag

SEQ ID NO: 639589 - DNA, 13 bp, D. melanogaster
taaatttgaaaca

SEQ ID NO: 639590 - DNA, 13 bp, D. melanogaster
taaatttgaaatg

SEQ ID NO: 639591 - DNA, 14 bp, D. melanogaster
taaatttgaatgaa

SEQ ID NO: 639592 - DNA, 14 bp, D. melanogaster
taaatttgaatttc

SEQ ID NO: 639593 - DNA, 14 bp, D. melanogaster
taaatttgacaaaa

SEQ ID NO: 639594 - DNA, 13 bp, D. melanogaster
taaatttgattac

SEQ ID NO: 639595 - DNA, 13 bp, D. melanogaster
taaatttgcaaaa

SEQ ID NO: 639596 - DNA, 13 bp, D. melanogaster
taaatttgcaaac

SEQ ID NO: 639597 - DNA, 13 bp, D. melanogaster
taaatttgcaatt

SEQ ID NO: 639598 - DNA, 13 bp, D. melanogaster
taaatttgccaaa

SEQ ID NO: 639599 - DNA, 14 bp, D. melanogaster
taaatttgcttaaa

SEQ ID NO: 639600 - DNA, 13 bp, D. melanogaster
taaatttgctttt

SEQ ID NO: 639601 - DNA, 13 bp, D. melanogaster
taaatttggaaac

SEQ ID NO: 639602 - DNA, 13 bp, D. melanogaster
taaatttggaatt

SEQ ID NO: 639603 - DNA, 14 bp, D. melanogaster
taaatttggcatat

SEQ ID NO: 639604 - DNA, 13 bp, D. melanogaster
taaatttgtagct

SEQ ID NO: 639605 - DNA, 13 bp, D. melanogaster
taaatttgtatgc

SEQ ID NO: 639606 - DNA, 13 bp, D. melanogaster
taaatttgtatgt

SEQ ID NO: 639607 - DNA, 13 bp, D. melanogaster
taaatttgtattg

SEQ ID NO: 639608 - DNA, 14 bp, D. melanogaster
taaatttgttaaac

SEQ ID NO: 639609 - DNA, 13 bp, D. melanogaster
taaatttgttaag

SEQ ID NO: 639610 - DNA, 13 bp, D. melanogaster
taaatttgttgat

SEQ ID NO: 639611 - DNA, 13 bp, D. melanogaster
taaatttgtttgc

SEQ ID NO: 639612 - DNA, 13 bp, D. melanogaster
taaattttaagca

SEQ ID NO: 639613 - DNA, 13 bp, D. melanogaster
taaattttaagtg

SEQ ID NO: 639614 - DNA, 13 bp, D. melanogaster
taaattttaatcg

SEQ ID NO: 639615 - DNA, 13 bp, D. melanogaster
taaattttaatgg

SEQ ID NO: 639616 - DNA, 13 bp, D. melanogaster
taaattttccaaa

SEQ ID NO: 639617 - DNA, 13 bp, D. melanogaster
taaattttccagc

SEQ ID NO: 639618 - DNA, 13 bp, D. melanogaster
taaattttcccaa

SEQ ID NO: 639619 - DNA, 13 bp, D. melanogaster
taaattttccgaa

SEQ ID NO: 639620 - DNA, 13 bp, D. melanogaster
taaattttctgtt

SEQ ID NO: 639621 - DNA, 13 bp, D. melanogaster
taaattttcttca

SEQ ID NO: 639622 - DNA, 13 bp, D. melanogaster
taaattttgcttt

SEQ ID NO: 639623 - DNA, 13 bp, D. melanogaster
taaattttggtaa

SEQ ID NO: 639624 - DNA, 13 bp, D. melanogaster
taaattttgtttc

SEQ ID NO: 639625 - DNA, 13 bp, D. melanogaster
taaatttttatgc

SEQ ID NO: 639626 - DNA, 13 bp, D. melanogaster
taaatttttccaa

SEQ ID NO: 639627 - DNA, 13 bp, D. melanogaster
taaatttttcgga

SEQ ID NO: 639628 - DNA, 13 bp, D. melanogaster
taaatttttgcca

SEQ ID NO: 639629 - DNA, 13 bp, D. melanogaster
taaatttttgcta

SEQ ID NO: 639630 - DNA, 13 bp, D. melanogaster
taacaaaaaatgt

SEQ ID NO: 639631 - DNA, 14 bp, D. melanogaster
taacaaaaatgtat

SEQ ID NO: 639632 - DNA, 14 bp, D. melanogaster
taacaaaaattgca

SEQ ID NO: 639633 - DNA, 13 bp, D. melanogaster
taacaaaactcca

SEQ ID NO: 639634 - DNA, 13 bp, D. melanogaster
taacaaaagtgat

SEQ ID NO: 639635 - DNA, 14 bp, D. melanogaster
taacaaaatatttg

SEQ ID NO: 639636 - DNA, 13 bp, D. melanogaster
taacaaaatgcag

SEQ ID NO: 639637 - DNA, 13 bp, D. melanogaster
taacaaaatgttt

SEQ ID NO: 639638 - DNA, 13 bp, D. melanogaster
taacaaacaagtt

SEQ ID NO: 639639 - DNA, 14 bp, D. melanogaster
taacaaagaaaatg

SEQ ID NO: 639640 - DNA, 13 bp, D. melanogaster
taacaaaggcaaa

SEQ ID NO: 639641 - DNA, 13 bp, D. melanogaster
taacaaataaatg

SEQ ID NO: 639642 - DNA, 13 bp, D. melanogaster
taacaaatatttc

SEQ ID NO: 639643 - DNA, 13 bp, D. melanogaster
taacaaatccagc

SEQ ID NO: 639644 - DNA, 13 bp, D. melanogaster
taacaaattactt

SEQ ID NO: 639645 - DNA, 13 bp, D. melanogaster
taacaaattattc

SEQ ID NO: 639646 - DNA, 13 bp, D. melanogaster
taacaaattgaaa

SEQ ID NO: 639647 - DNA, 14 bp, D. melanogaster
taacaaattgaaat

SEQ ID NO: 639648 - DNA, 13 bp, D. melanogaster
taacaaatttatg

SEQ ID NO: 639649 - DNA, 13 bp, D. melanogaster
taacaaatttgtt

SEQ ID NO: 639650 - DNA, 13 bp, D. melanogaster
taacaacaaacag

SEQ ID NO: 639651 - DNA, 13 bp, D. melanogaster
taacaacaaattg

SEQ ID NO: 639652 - DNA, 14 bp, D. melanogaster
taacaacaacagca

SEQ ID NO: 639653 - DNA, 13 bp, D. melanogaster
taacaacaatttt

SEQ ID NO: 639654 - DNA, 14 bp, D. melanogaster
taacaacattttca

SEQ ID NO: 639655 - DNA, 13 bp, D. melanogaster
taacaacattttt

SEQ ID NO: 639656 - DNA, 13 bp, D. melanogaster
taacaactataga

SEQ ID NO: 639657 - DNA, 13 bp, D. melanogaster
taacaacttaatt

SEQ ID NO: 639658 - DNA, 13 bp, D. melanogaster
taacaagagagaa

SEQ ID NO: 639659 - DNA, 13 bp, D. melanogaster
taacaagccagca

SEQ ID NO: 639660 - DNA, 13 bp, D. melanogaster
taacaagcttatt

SEQ ID NO: 639661 - DNA, 13 bp, D. melanogaster
taacaagttaaca

SEQ ID NO: 639662 - DNA, 13 bp, D. melanogaster
taacaagtttttg

SEQ ID NO: 639663 - DNA, 13 bp, D. melanogaster
taacaataacagc

SEQ ID NO: 639664 - DNA, 13 bp, D. melanogaster
taacaataacttt

SEQ ID NO: 639665 - DNA, 13 bp, D. melanogaster
taacaataagatt

SEQ ID NO: 639666 - DNA, 13 bp, D. melanogaster
taacaataagttt

SEQ ID NO: 639667 - DNA, 13 bp, D. melanogaster
taacaataataga

SEQ ID NO: 639668 - DNA, 14 bp, D. melanogaster
taacaataatagca

SEQ ID NO: 639669 - DNA, 13 bp, D. melanogaster
taacaataattac

SEQ ID NO: 639670 - DNA, 13 bp, D. melanogaster
taacaataatttc

SEQ ID NO: 639671 - DNA, 13 bp, D. melanogaster
taacaatatgatt

SEQ ID NO: 639672 - DNA, 13 bp, D. melanogaster
taacaatattcaa

SEQ ID NO: 639673 - DNA, 13 bp, D. melanogaster
taacaatattttg

SEQ ID NO: 639674 - DNA, 13 bp, D. melanogaster
taacaatcaattt

SEQ ID NO: 639675 - DNA, 13 bp, D. melanogaster
taacaatcatttt

SEQ ID NO: 639676 - DNA, 13 bp, D. melanogaster
taacaatcgcttc

SEQ ID NO: 639677 - DNA, 13 bp, D. melanogaster
taacaattcaaat

SEQ ID NO: 639678 - DNA, 13 bp, D. melanogaster
taacaattcgctt

SEQ ID NO: 639679 - DNA, 13 bp, D. melanogaster
taacaattgcaat

SEQ ID NO: 639680 - DNA, 13 bp, D. melanogaster
taacaatttcatt

SEQ ID NO: 639681 - DNA, 14 bp, D. melanogaster
taacaatttcattc

SEQ ID NO: 639682 - DNA, 13 bp, D. melanogaster
taacaatttgaaa

SEQ ID NO: 639683 - DNA, 14 bp, D. melanogaster
taacaatttgtaca

SEQ ID NO: 639684 - DNA, 13 bp, D. melanogaster
taacaattttatg

SEQ ID NO: 639685 - DNA, 13 bp, D. melanogaster
taacaatttttca

SEQ ID NO: 639686 - DNA, 13 bp, D. melanogaster
taacaatttttgc

SEQ ID NO: 639687 - DNA, 13 bp, D. melanogaster
taacacaattttt

SEQ ID NO: 639688 - DNA, 13 bp, D. melanogaster
taacacacatcca

SEQ ID NO: 639689 - DNA, 13 bp, D. melanogaster
taacacatatatt

SEQ ID NO: 639690 - DNA, 13 bp, D. melanogaster
taacacattaatt

SEQ ID NO: 639691 - DNA, 13 bp, D. melanogaster
taacaccatcagc

SEQ ID NO: 639692 - DNA, 13 bp, D. melanogaster
taacactttgaaa

SEQ ID NO: 639693 - DNA, 13 bp, D. melanogaster
taacagattttca

SEQ ID NO: 639694 - DNA, 13 bp, D. melanogaster
taacagcaacaac

SEQ ID NO: 639695 - DNA, 14 bp, D. melanogaster
taacagcaacaaca

SEQ ID NO: 639696 - DNA, 14 bp, D. melanogaster
taacagcaacagca

SEQ ID NO: 639697 - DNA, 14 bp, D. melanogaster
taacagcagcagca

SEQ ID NO: 639698 - DNA, 13 bp, D. melanogaster
taacagctgttaa

SEQ ID NO: 639699 - DNA, 13 bp, D. melanogaster
taacaggcagaag

SEQ ID NO: 639700 - DNA, 13 bp, D. melanogaster
taacagtaacagt

SEQ ID NO: 639701 - DNA, 13 bp, D. melanogaster
taacagtaatatt

SEQ ID NO: 639702 - DNA, 13 bp, D. melanogaster
taacagtagtgga

SEQ ID NO: 639703 - DNA, 13 bp, D. melanogaster
taacagttaacag

SEQ ID NO: 639704 - DNA, 13 bp, D. melanogaster
taacataacagcg

SEQ ID NO: 639705 - DNA, 13 bp, D. melanogaster
taacataatcaag

SEQ ID NO: 639706 - DNA, 13 bp, D. melanogaster
taacatacatatt

SEQ ID NO: 639707 - DNA, 13 bp, D. melanogaster
taacatacatttt

SEQ ID NO: 639708 - DNA, 13 bp, D. melanogaster
taacatacctgaa

SEQ ID NO: 639709 - DNA, 13 bp, D. melanogaster
taacatagacatt

SEQ ID NO: 639710 - DNA, 13 bp, D. melanogaster
taacatatagcgt

SEQ ID NO: 639711 - DNA, 13 bp, D. melanogaster
taacatatgcatt

SEQ ID NO: 639712 - DNA, 14 bp, D. melanogaster
taacatatttactt

SEQ ID NO: 639713 - DNA, 13 bp, D. melanogaster
taacatatttcaa

SEQ ID NO: 639714 - DNA, 14 bp, D. melanogaster
taacatatttttag

SEQ ID NO: 639715 - DNA, 14 bp, D. melanogaster
taacatcaacagct

SEQ ID NO: 639716 - DNA, 14 bp, D. melanogaster
taacatcggatcag

SEQ ID NO: 639717 - DNA, 13 bp, D. melanogaster
taacatgatcacc

SEQ ID NO: 639718 - DNA, 13 bp, D. melanogaster
taacattaaacta

SEQ ID NO: 639719 - DNA, 13 bp, D. melanogaster
taacattaacatt

SEQ ID NO: 639720 - DNA, 14 bp, D. melanogaster
taacattaacatta

SEQ ID NO: 639721 - DNA, 13 bp, D. melanogaster
taacattattttc

SEQ ID NO: 639722 - DNA, 13 bp, D. melanogaster
taacattccaaaa

SEQ ID NO: 639723 - DNA, 13 bp, D. melanogaster
taacattgaaaat

SEQ ID NO: 639724 - DNA, 14 bp, D. melanogaster
taacattgatgcca

SEQ ID NO: 639725 - DNA, 13 bp, D. melanogaster
taacatttaaaac

SEQ ID NO: 639726 - DNA, 13 bp, D. melanogaster
taacatttaaaga

SEQ ID NO: 639727 - DNA, 13 bp, D. melanogaster
taacatttaactt

SEQ ID NO: 639728 - DNA, 14 bp, D. melanogaster
taacatttacaaat

SEQ ID NO: 639729 - DNA, 13 bp, D. melanogaster
taacatttatttg

SEQ ID NO: 639730 - DNA, 14 bp, D. melanogaster
taacatttatttga

SEQ ID NO: 639731 - DNA, 13 bp, D. melanogaster
taacatttcaaat

SEQ ID NO: 639732 - DNA, 13 bp, D. melanogaster
taacatttccatt

SEQ ID NO: 639733 - DNA, 13 bp, D. melanogaster
taacatttgcttt

SEQ ID NO: 639734 - DNA, 13 bp, D. melanogaster
taacattttccat

SEQ ID NO: 639735 - DNA, 13 bp, D. melanogaster
taacattttctaa

SEQ ID NO: 639736 - DNA, 13 bp, D. melanogaster
taacattttgtta

SEQ ID NO: 639737 - DNA, 13 bp, D. melanogaster
taaccaaaaccat

SEQ ID NO: 639738 - DNA, 13 bp, D. melanogaster
taaccaaagacac

SEQ ID NO: 639739 - DNA, 13 bp, D. melanogaster
taaccaaagtcag

SEQ ID NO: 639740 - DNA, 13 bp, D. melanogaster
taaccaaatatta

SEQ ID NO: 639741 - DNA, 13 bp, D. melanogaster
taaccaaattgta

SEQ ID NO: 639742 - DNA, 13 bp, D. melanogaster
taaccaacatttt

SEQ ID NO: 639743 - DNA, 13 bp, D. melanogaster
taaccaagaattt

SEQ ID NO: 639744 - DNA, 13 bp, D. melanogaster
taaccaattggat

SEQ ID NO: 639745 - DNA, 13 bp, D. melanogaster
taaccaatttaaa

SEQ ID NO: 639746 - DNA, 13 bp, D. melanogaster
taaccaattttaa

SEQ ID NO: 639747 - DNA, 13 bp, D. melanogaster
taaccacaaaact

SEQ ID NO: 639748 - DNA, 13 bp, D. melanogaster
taaccacagtgac

SEQ ID NO: 639749 - DNA, 14 bp, D. melanogaster
taaccacagtgact

SEQ ID NO: 639750 - DNA, 13 bp, D. melanogaster
taaccaccagttg

SEQ ID NO: 639751 - DNA, 14 bp, D. melanogaster
taaccacctctgcc

SEQ ID NO: 639752 - DNA, 13 bp, D. melanogaster
taaccagtaacca

SEQ ID NO: 639753 - DNA, 13 bp, D. melanogaster
taaccataaatta

SEQ ID NO: 639754 - DNA, 13 bp, D. melanogaster
taaccataattat

SEQ ID NO: 639755 - DNA, 14 bp, D. melanogaster
taaccataattata

SEQ ID NO: 639756 - DNA, 13 bp, D. melanogaster
taaccataatttt

SEQ ID NO: 639757 - DNA, 13 bp, D. melanogaster
taaccatcaaaga

SEQ ID NO: 639758 - DNA, 13 bp, D. melanogaster
taaccatttccat

SEQ ID NO: 639759 - DNA, 13 bp, D. melanogaster
taaccattttcca

SEQ ID NO: 639760 - DNA, 13 bp, D. melanogaster
taacccagaaatc

SEQ ID NO: 639761 - DNA, 14 bp, D. melanogaster
taaccccaaattac

SEQ ID NO: 639762 - DNA, 13 bp, D. melanogaster
taacccttaaccc

SEQ ID NO: 639763 - DNA, 13 bp, D. melanogaster
taaccgcaattaa

SEQ ID NO: 639764 - DNA, 13 bp, D. melanogaster
taaccgccaaatc

SEQ ID NO: 639765 - DNA, 13 bp, D. melanogaster
taaccgccgagct

SEQ ID NO: 639766 - DNA, 13 bp, D. melanogaster
taacctcttggag

SEQ ID NO: 639767 - DNA, 13 bp, D. melanogaster
taacgaaaagctg

SEQ ID NO: 639768 - DNA, 13 bp, D. melanogaster
taacgaaaataac

SEQ ID NO: 639769 - DNA, 13 bp, D. melanogaster
taacgaaaatatt

SEQ ID NO: 639770 - DNA, 14 bp, D. melanogaster
taacgaaaatcaaa

SEQ ID NO: 639771 - DNA, 13 bp, D. melanogaster
taacgaaaatttc

SEQ ID NO: 639772 - DNA, 13 bp, D. melanogaster
taacgaaacaata

SEQ ID NO: 639773 - DNA, 13 bp, D. melanogaster
taacgaaacgaaa

SEQ ID NO: 639774 - DNA, 13 bp, D. melanogaster
taacgaaactatt

SEQ ID NO: 639775 - DNA, 13 bp, D. melanogaster
taacgaaatcaaa

SEQ ID NO: 639776 - DNA, 13 bp, D. melanogaster
taacgaaattaaa

SEQ ID NO: 639777 - DNA, 13 bp, D. melanogaster
taacgaaattagc

SEQ ID NO: 639778 - DNA, 14 bp, D. melanogaster
taacgaaattagca

SEQ ID NO: 639779 - DNA, 13 bp, D. melanogaster
taacgaaattgaa

SEQ ID NO: 639780 - DNA, 13 bp, D. melanogaster
taacgaagaaagc

SEQ ID NO: 639781 - DNA, 13 bp, D. melanogaster
taacgaatcgaaa

SEQ ID NO: 639782 - DNA, 13 bp, D. melanogaster
taacgaatttaat

SEQ ID NO: 639783 - DNA, 13 bp, D. melanogaster
taacgaccgaaat

SEQ ID NO: 639784 - DNA, 13 bp, D. melanogaster
taacgagtcaatt

SEQ ID NO: 639785 - DNA, 13 bp, D. melanogaster
taacgatcgaaaa

SEQ ID NO: 639786 - DNA, 13 bp, D. melanogaster
taacgatttaaat

SEQ ID NO: 639787 - DNA, 14 bp, D. melanogaster
taacgcaaaacaga

SEQ ID NO: 639788 - DNA, 13 bp, D. melanogaster
taacgcaaattaa

SEQ ID NO: 639789 - DNA, 14 bp, D. melanogaster
taacgcacacacac

SEQ ID NO: 639790 - DNA, 13 bp, D. melanogaster
taacgcccacaaa

SEQ ID NO: 639791 - DNA, 14 bp, D. melanogaster
taacgcccacaaac

SEQ ID NO: 639792 - DNA, 13 bp, D. melanogaster
taacgggtataat

SEQ ID NO: 639793 - DNA, 14 bp, D. melanogaster
taacgtagttaaag

SEQ ID NO: 639794 - DNA, 13 bp, D. melanogaster
taacgtatttacc

SEQ ID NO: 639795 - DNA, 13 bp, D. melanogaster
taacgttaaacaa

SEQ ID NO: 639796 - DNA, 13 bp, D. melanogaster
taacgttattatt

SEQ ID NO: 639797 - DNA, 13 bp, D. melanogaster
taactaaaaactt

SEQ ID NO: 639798 - DNA, 13 bp, D. melanogaster
taactaaactaac

SEQ ID NO: 639799 - DNA, 13 bp, D. melanogaster
taactaaagttaa

SEQ ID NO: 639800 - DNA, 13 bp, D. melanogaster
taactaaatacat

SEQ ID NO: 639801 - DNA, 13 bp, D. melanogaster
taactaaatgttt

SEQ ID NO: 639802 - DNA, 13 bp, D. melanogaster
taactaactaaat

SEQ ID NO: 639803 - DNA, 13 bp, D. melanogaster
taactaactaatt

SEQ ID NO: 639804 - DNA, 13 bp, D. melanogaster
taactaactatta

SEQ ID NO: 639805 - DNA, 13 bp, D. melanogaster
taactaactattt

SEQ ID NO: 639806 - DNA, 13 bp, D. melanogaster
taactaactttaa

SEQ ID NO: 639807 - DNA, 13 bp, D. melanogaster
taactaatttgtt

SEQ ID NO: 639808 - DNA, 13 bp, D. melanogaster
taactacaatata

SEQ ID NO: 639809 - DNA, 13 bp, D. melanogaster
taactacaatatt

SEQ ID NO: 639810 - DNA, 13 bp, D. melanogaster
taactacatatat

SEQ ID NO: 639811 - DNA, 13 bp, D. melanogaster
taactacgttaat

SEQ ID NO: 639812 - DNA, 13 bp, D. melanogaster
taactacttttaa

SEQ ID NO: 639813 - DNA, 13 bp, D. melanogaster
taactagattatg

SEQ ID NO: 639814 - DNA, 13 bp, D. melanogaster
taactataactaa

SEQ ID NO: 639815 - DNA, 13 bp, D. melanogaster
taactataactat

SEQ ID NO: 639816 - DNA, 13 bp, D. melanogaster
taactatagtgta

SEQ ID NO: 639817 - DNA, 13 bp, D. melanogaster
taactatatatgt

SEQ ID NO: 639818 - DNA, 13 bp, D. melanogaster
taactatccctat

SEQ ID NO: 639819 - DNA, 13 bp, D. melanogaster
taactatgagttg

SEQ ID NO: 639820 - DNA, 13 bp, D. melanogaster
taactatgcaaaa

SEQ ID NO: 639821 - DNA, 13 bp, D. melanogaster
taactatgtattt

SEQ ID NO: 639822 - DNA, 13 bp, D. melanogaster
taactattccaac

SEQ ID NO: 639823 - DNA, 13 bp, D. melanogaster
taactatttacca

SEQ ID NO: 639824 - DNA, 13 bp, D. melanogaster
taactatttgaat

SEQ ID NO: 639825 - DNA, 13 bp, D. melanogaster
taactattttaga

SEQ ID NO: 639826 - DNA, 13 bp, D. melanogaster
taactattttcaa

SEQ ID NO: 639827 - DNA, 13 bp, D. melanogaster
taactattttgta

SEQ ID NO: 639828 - DNA, 13 bp, D. melanogaster
taactccaatttt

SEQ ID NO: 639829 - DNA, 14 bp, D. melanogaster
taactccacaaatc

SEQ ID NO: 639830 - DNA, 13 bp, D. melanogaster
taactccattacc

SEQ ID NO: 639831 - DNA, 13 bp, D. melanogaster
taactcgaaactt

SEQ ID NO: 639832 - DNA, 13 bp, D. melanogaster
taactgaaaattc

SEQ ID NO: 639833 - DNA, 13 bp, D. melanogaster
taactgaaagtga

SEQ ID NO: 639834 - DNA, 13 bp, D. melanogaster
taactgaaataga

SEQ ID NO: 639835 - DNA, 13 bp, D. melanogaster
taactgaaatata

SEQ ID NO: 639836 - DNA, 13 bp, D. melanogaster
taactgaaattaa

SEQ ID NO: 639837 - DNA, 13 bp, D. melanogaster
taactgaatattt

SEQ ID NO: 639838 - DNA, 13 bp, D. melanogaster
taactgataactg

SEQ ID NO: 639839 - DNA, 13 bp, D. melanogaster
taactgatgcttt

SEQ ID NO: 639840 - DNA, 13 bp, D. melanogaster
taactgcatactc

SEQ ID NO: 639841 - DNA, 13 bp, D. melanogaster
taactgcggggaa

SEQ ID NO: 639842 - DNA, 13 bp, D. melanogaster
taactggaaaatt

SEQ ID NO: 639843 - DNA, 13 bp, D. melanogaster
taactggaaatat

SEQ ID NO: 639844 - DNA, 13 bp, D. melanogaster
taactgtaactgt

SEQ ID NO: 639845 - DNA, 13 bp, D. melanogaster
taacttaaactta

SEQ ID NO: 639846 - DNA, 13 bp, D. melanogaster
taacttaacttaa

SEQ ID NO: 639847 - DNA, 13 bp, D. melanogaster
taacttaagtttt

SEQ ID NO: 639848 - DNA, 13 bp, D. melanogaster
taacttacttaaa

SEQ ID NO: 639849 - DNA, 13 bp, D. melanogaster
taacttattttcc

SEQ ID NO: 639850 - DNA, 13 bp, D. melanogaster
taacttcatattt

SEQ ID NO: 639851 - DNA, 13 bp, D. melanogaster
taacttcgcaaaa

SEQ ID NO: 639852 - DNA, 13 bp, D. melanogaster
taacttcttaaat

SEQ ID NO: 639853 - DNA, 13 bp, D. melanogaster
taacttgactaaa

SEQ ID NO: 639854 - DNA, 14 bp, D. melanogaster
taacttggccaaaa

SEQ ID NO: 639855 - DNA, 13 bp, D. melanogaster
taacttggccaac

SEQ ID NO: 639856 - DNA, 14 bp, D. melanogaster
taacttggctaaaa

SEQ ID NO: 639857 - DNA, 13 bp, D. melanogaster
taacttggttttt

SEQ ID NO: 639858 - DNA, 13 bp, D. melanogaster
taactttaaacat

SEQ ID NO: 639859 - DNA, 13 bp, D. melanogaster
taactttaagttt

SEQ ID NO: 639860 - DNA, 14 bp, D. melanogaster
taactttaatagga

SEQ ID NO: 639861 - DNA, 13 bp, D. melanogaster
taactttaatgaa

SEQ ID NO: 639862 - DNA, 13 bp, D. melanogaster
taactttaatttg

SEQ ID NO: 639863 - DNA, 13 bp, D. melanogaster
taactttacactt

SEQ ID NO: 639864 - DNA, 13 bp, D. melanogaster
taactttacttaa

SEQ ID NO: 639865 - DNA, 13 bp, D. melanogaster
taactttaggttg

SEQ ID NO: 639866 - DNA, 13 bp, D. melanogaster
taactttagttaa

SEQ ID NO: 639867 - DNA, 13 bp, D. melanogaster
taactttatttcc

SEQ ID NO: 639868 - DNA, 13 bp, D. melanogaster
taactttcaaagt

SEQ ID NO: 639869 - DNA, 13 bp, D. melanogaster
taactttcaatta

SEQ ID NO: 639870 - DNA, 13 bp, D. melanogaster
taactttgaattt

SEQ ID NO: 639871 - DNA, 14 bp, D. melanogaster
taactttgagaatt

SEQ ID NO: 639872 - DNA, 13 bp, D. melanogaster
taactttgatgat

SEQ ID NO: 639873 - DNA, 13 bp, D. melanogaster
taactttgatttg

SEQ ID NO: 639874 - DNA, 13 bp, D. melanogaster
taactttgttatt

SEQ ID NO: 639875 - DNA, 13 bp, D. melanogaster
taacttttaagct

SEQ ID NO: 639876 - DNA, 13 bp, D. melanogaster
taacttttaattg

SEQ ID NO: 639877 - DNA, 13 bp, D. melanogaster
taacttttatttg

SEQ ID NO: 639878 - DNA, 13 bp, D. melanogaster
taacttttcgttt

SEQ ID NO: 639879 - DNA, 13 bp, D. melanogaster
taacttttgcaat

SEQ ID NO: 639880 - DNA, 14 bp, D. melanogaster
taacttttgtgttt

SEQ ID NO: 639881 - DNA, 13 bp, D. melanogaster
taactttttgccg

SEQ ID NO: 639882 - DNA, 13 bp, D. melanogaster
taagaaaaacatt

SEQ ID NO: 639883 - DNA, 13 bp, D. melanogaster
taagaaaaatgtt

SEQ ID NO: 639884 - DNA, 13 bp, D. melanogaster
taagaaaacatat

SEQ ID NO: 639885 - DNA, 13 bp, D. melanogaster
taagaaaagttta

SEQ ID NO: 639886 - DNA, 13 bp, D. melanogaster
taagaaaatcata

SEQ ID NO: 639887 - DNA, 13 bp, D. melanogaster
taagaaaattgca

SEQ ID NO: 639888 - DNA, 13 bp, D. melanogaster
taagaaaatttgt

SEQ ID NO: 639889 - DNA, 13 bp, D. melanogaster
taagaaacgatac

SEQ ID NO: 639890 - DNA, 13 bp, D. melanogaster
taagaaactaatt

SEQ ID NO: 639891 - DNA, 13 bp, D. melanogaster
taagaaatacaat

SEQ ID NO: 639892 - DNA, 14 bp, D. melanogaster
taagaaatacaatt

SEQ ID NO: 639893 - DNA, 13 bp, D. melanogaster
taagaaatatgta

SEQ ID NO: 639894 - DNA, 13 bp, D. melanogaster
taagaaatcgatt

SEQ ID NO: 639895 - DNA, 13 bp, D. melanogaster
taagaaatctaaa

SEQ ID NO: 639896 - DNA, 13 bp, D. melanogaster
taagaaatgcaat

SEQ ID NO: 639897 - DNA, 13 bp, D. melanogaster
taagaaatgcata

SEQ ID NO: 639898 - DNA, 14 bp, D. melanogaster
taagaaatgtaaag

SEQ ID NO: 639899 - DNA, 13 bp, D. melanogaster
taagaaattttca

SEQ ID NO: 639900 - DNA, 13 bp, D. melanogaster
taagaacacaagt

SEQ ID NO: 639901 - DNA, 13 bp, D. melanogaster
taagaacccaaat

SEQ ID NO: 639902 - DNA, 13 bp, D. melanogaster
taagaactctttt

SEQ ID NO: 639903 - DNA, 13 bp, D. melanogaster
taagaatacaata

SEQ ID NO: 639904 - DNA, 13 bp, D. melanogaster
taagaatacattt

SEQ ID NO: 639905 - DNA, 13 bp, D. melanogaster
taagaatccaaga

SEQ ID NO: 639906 - DNA, 13 bp, D. melanogaster
taagaattgtttg

SEQ ID NO: 639907 - DNA, 13 bp, D. melanogaster
taagaatttcaaa

SEQ ID NO: 639908 - DNA, 13 bp, D. melanogaster
taagaatttcatt

SEQ ID NO: 639909 - DNA, 13 bp, D. melanogaster
taagaattttggt

SEQ ID NO: 639910 - DNA, 13 bp, D. melanogaster
taagacagagaac

SEQ ID NO: 639911 - DNA, 13 bp, D. melanogaster
taagacgataata

SEQ ID NO: 639912 - DNA, 13 bp, D. melanogaster
taagactgtattt

SEQ ID NO: 639913 - DNA, 13 bp, D. melanogaster
taagactttggct

SEQ ID NO: 639914 - DNA, 13 bp, D. melanogaster
taagagatggaaa

SEQ ID NO: 639915 - DNA, 13 bp, D. melanogaster
taagagcattgat

SEQ ID NO: 639916 - DNA, 13 bp, D. melanogaster
taagagtaaagga

SEQ ID NO: 639917 - DNA, 14 bp, D. melanogaster
taagagtggtggtg

SEQ ID NO: 639918 - DNA, 13 bp, D. melanogaster
taagataaacaat

SEQ ID NO: 639919 - DNA, 13 bp, D. melanogaster
taagataacattt

SEQ ID NO: 639920 - DNA, 13 bp, D. melanogaster
taagataataagt

SEQ ID NO: 639921 - DNA, 13 bp, D. melanogaster
taagatacatatt

SEQ ID NO: 639922 - DNA, 13 bp, D. melanogaster
taagatactattt

SEQ ID NO: 639923 - DNA, 13 bp, D. melanogaster
taagatactttat

SEQ ID NO: 639924 - DNA, 13 bp, D. melanogaster
taagatactttta

SEQ ID NO: 639925 - DNA, 13 bp, D. melanogaster
taagatataagat

SEQ ID NO: 639926 - DNA, 13 bp, D. melanogaster
taagatcaaaaat

SEQ ID NO: 639927 - DNA, 13 bp, D. melanogaster
taagatcaaattt

SEQ ID NO: 639928 - DNA, 14 bp, D. melanogaster
taagatcaaattta

SEQ ID NO: 639929 - DNA, 13 bp, D. melanogaster
taagatggaaata

SEQ ID NO: 639930 - DNA, 13 bp, D. melanogaster
taagatgggaaaa

SEQ ID NO: 639931 - DNA, 13 bp, D. melanogaster
taagattagacac

SEQ ID NO: 639932 - DNA, 13 bp, D. melanogaster
taagattcagttc

SEQ ID NO: 639933 - DNA, 13 bp, D. melanogaster
taagattcattta

SEQ ID NO: 639934 - DNA, 13 bp, D. melanogaster
taagattctttaa

SEQ ID NO: 639935 - DNA, 13 bp, D. melanogaster
taagattgatttt

SEQ ID NO: 639936 - DNA, 13 bp, D. melanogaster
taagattgttatt

SEQ ID NO: 639937 - DNA, 13 bp, D. melanogaster
taagattgtttat

SEQ ID NO: 639938 - DNA, 13 bp, D. melanogaster
taagatttctttt

SEQ ID NO: 639939 - DNA, 15 bp, D. melanogaster
taagatttgtttaca

SEQ ID NO: 639940 - DNA, 13 bp, D. melanogaster
taagcaaaaaacc

SEQ ID NO: 639941 - DNA, 13 bp, D. melanogaster
taagcaaaaagtt

SEQ ID NO: 639942 - DNA, 13 bp, D. melanogaster
taagcaaaaatta

SEQ ID NO: 639943 - DNA, 13 bp, D. melanogaster
taagcaaaacaat

SEQ ID NO: 639944 - DNA, 13 bp, D. melanogaster
taagcaaaacatt

SEQ ID NO: 639945 - DNA, 13 bp, D. melanogaster
taagcaaaattaa

SEQ ID NO: 639946 - DNA, 13 bp, D. melanogaster
taagcaaacaaac

SEQ ID NO: 639947 - DNA, 13 bp, D. melanogaster
taagcaaacaata

SEQ ID NO: 639948 - DNA, 13 bp, D. melanogaster
taagcaaacacaa

SEQ ID NO: 639949 - DNA, 13 bp, D. melanogaster
taagcaaacacat

SEQ ID NO: 639950 - DNA, 13 bp, D. melanogaster
taagcaaacagca

SEQ ID NO: 639951 - DNA, 13 bp, D. melanogaster
taagcaaacatat

SEQ ID NO: 639952 - DNA, 13 bp, D. melanogaster
taagcaaacattt

SEQ ID NO: 639953 - DNA, 13 bp, D. melanogaster
taagcaaactaaa

SEQ ID NO: 639954 - DNA, 13 bp, D. melanogaster
taagcaaagcaaa

SEQ ID NO: 639955 - DNA, 13 bp, D. melanogaster
taagcaaataaac

SEQ ID NO: 639956 - DNA, 13 bp, D. melanogaster
taagcaaataaag

SEQ ID NO: 639957 - DNA, 13 bp, D. melanogaster
taagcaaataatg

SEQ ID NO: 639958 - DNA, 13 bp, D. melanogaster
taagcaaatacaa

SEQ ID NO: 639959 - DNA, 13 bp, D. melanogaster
taagcaaatagtt

SEQ ID NO: 639960 - DNA, 13 bp, D. melanogaster
taagcaaatattg

SEQ ID NO: 639961 - DNA, 14 bp, D. melanogaster
taagcaaatatttg

SEQ ID NO: 639962 - DNA, 13 bp, D. melanogaster
taagcaaattaaa

SEQ ID NO: 639963 - DNA, 13 bp, D. melanogaster
taagcaaattcaa

SEQ ID NO: 639964 - DNA, 13 bp, D. melanogaster
taagcaaatttat

SEQ ID NO: 639965 - DNA, 13 bp, D. melanogaster
taagcaacaaata

SEQ ID NO: 639966 - DNA, 13 bp, D. melanogaster
taagcaacaaatt

SEQ ID NO: 639967 - DNA, 13 bp, D. melanogaster
taagcaacaattt

SEQ ID NO: 639968 - DNA, 13 bp, D. melanogaster
taagcaagtcgac

SEQ ID NO: 639969 - DNA, 13 bp, D. melanogaster
taagcaataaaca

SEQ ID NO: 639970 - DNA, 13 bp, D. melanogaster
taagcaatatttt

SEQ ID NO: 639971 - DNA, 13 bp, D. melanogaster
taagcaattgtac

SEQ ID NO: 639972 - DNA, 13 bp, D. melanogaster
taagcacaaattc

SEQ ID NO: 639973 - DNA, 14 bp, D. melanogaster
taagcacaaattcc

SEQ ID NO: 639974 - DNA, 13 bp, D. melanogaster
taagcacaacatt

SEQ ID NO: 639975 - DNA, 13 bp, D. melanogaster
taagcacacaaaa

SEQ ID NO: 639976 - DNA, 13 bp, D. melanogaster
taagcacacacat

SEQ ID NO: 639977 - DNA, 13 bp, D. melanogaster
taagcactttaaa

SEQ ID NO: 639978 - DNA, 13 bp, D. melanogaster
taagcagcaacaa

SEQ ID NO: 639979 - DNA, 13 bp, D. melanogaster
taagcagcttaaa

SEQ ID NO: 639980 - DNA, 13 bp, D. melanogaster
taagcaggccata

SEQ ID NO: 639981 - DNA, 13 bp, D. melanogaster
taagcagggaaat

SEQ ID NO: 639982 - DNA, 13 bp, D. melanogaster
taagcataaaaat

SEQ ID NO: 639983 - DNA, 13 bp, D. melanogaster
taagcataaatta

SEQ ID NO: 639984 - DNA, 13 bp, D. melanogaster
taagcataatgaa

SEQ ID NO: 639985 - DNA, 13 bp, D. melanogaster
taagcatacgcca

SEQ ID NO: 639986 - DNA, 13 bp, D. melanogaster
taagcatataatt

SEQ ID NO: 639987 - DNA, 13 bp, D. melanogaster
taagcatatagat

SEQ ID NO: 639988 - DNA, 13 bp, D. melanogaster
taagcatatattt

SEQ ID NO: 639989 - DNA, 13 bp, D. melanogaster
taagcatattaaa

SEQ ID NO: 639990 - DNA, 13 bp, D. melanogaster
taagcatattttt

SEQ ID NO: 639991 - DNA, 13 bp, D. melanogaster
taagcatttatat

SEQ ID NO: 639992 - DNA, 13 bp, D. melanogaster
taagcattttaaa

SEQ ID NO: 639993 - DNA, 13 bp, D. melanogaster
taagcattttaca

SEQ ID NO: 639994 - DNA, 13 bp, D. melanogaster
taagcattttcaa

SEQ ID NO: 639995 - DNA, 13 bp, D. melanogaster
taagcattttgtt

SEQ ID NO: 639996 - DNA, 13 bp, D. melanogaster
taagcatttttat

SEQ ID NO: 639997 - DNA, 13 bp, D. melanogaster
taagcatttttca

SEQ ID NO: 639998 - DNA, 13 bp, D. melanogaster
taagcattttttt

SEQ ID NO: 639999 - DNA, 13 bp, D. melanogaster
taagccaaaagaa

SEQ ID NO: 640000 - DNA, 13 bp, D. melanogaster
taagccaaaataa

SEQ ID NO: 640001 - DNA, 13 bp, D. melanogaster
taagccaaataaa

SEQ ID NO: 640002 - DNA, 13 bp, D. melanogaster
taagccaaatgaa

SEQ ID NO: 640003 - DNA, 13 bp, D. melanogaster
taagccaaatggc

SEQ ID NO: 640004 - DNA, 14 bp, D. melanogaster
taagccaacaaaaa

SEQ ID NO: 640005 - DNA, 13 bp, D. melanogaster
taagccaacaaac

SEQ ID NO: 640006 - DNA, 13 bp, D. melanogaster
taagccaacaaat

SEQ ID NO: 640007 - DNA, 13 bp, D. melanogaster
taagccaatttaa

SEQ ID NO: 640008 - DNA, 13 bp, D. melanogaster
taagccatttaag

SEQ ID NO: 640009 - DNA, 13 bp, D. melanogaster
taagccattttca

SEQ ID NO: 640010 - DNA, 13 bp, D. melanogaster
taagccattttta

SEQ ID NO: 640011 - DNA, 13 bp, D. melanogaster
taagcccaaaact

SEQ ID NO: 640012 - DNA, 14 bp, D. melanogaster
taagcccaaaactc

SEQ ID NO: 640013 - DNA, 13 bp, D. melanogaster
taagcccattaaa

SEQ ID NO: 640014 - DNA, 13 bp, D. melanogaster
taagccgcttagc

SEQ ID NO: 640015 - DNA, 13 bp, D. melanogaster
taagccgggccaa

SEQ ID NO: 640016 - DNA, 13 bp, D. melanogaster
taagcctagaaaa

SEQ ID NO: 640017 - DNA, 13 bp, D. melanogaster
taagcctcaagtg

SEQ ID NO: 640018 - DNA, 15 bp, D. melanogaster
taagcctcaagtgct

SEQ ID NO: 640019 - DNA, 14 bp, D. melanogaster
taagcctgcgtgtg

SEQ ID NO: 640020 - DNA, 13 bp, D. melanogaster
taagcgaaaaaca

SEQ ID NO: 640021 - DNA, 14 bp, D. melanogaster
taagcgaaaaacaa

SEQ ID NO: 640022 - DNA, 14 bp, D. melanogaster
taagcgaaaattaa

SEQ ID NO: 640023 - DNA, 13 bp, D. melanogaster
taagcgaaataaa

SEQ ID NO: 640024 - DNA, 13 bp, D. melanogaster
taagcgaatacca

SEQ ID NO: 640025 - DNA, 13 bp, D. melanogaster
taagcggttttga

SEQ ID NO: 640026 - DNA, 13 bp, D. melanogaster
taagctaaaatat

SEQ ID NO: 640027 - DNA, 13 bp, D. melanogaster
taagctaataaaa

SEQ ID NO: 640028 - DNA, 13 bp, D. melanogaster
taagctaattaat

SEQ ID NO: 640029 - DNA, 13 bp, D. melanogaster
taagctacgaatt

SEQ ID NO: 640030 - DNA, 13 bp, D. melanogaster
taagctataaata

SEQ ID NO: 640031 - DNA, 13 bp, D. melanogaster
taagctataaatt

SEQ ID NO: 640032 - DNA, 13 bp, D. melanogaster
taagctataagct

SEQ ID NO: 640033 - DNA, 13 bp, D. melanogaster
taagctcataaat

SEQ ID NO: 640034 - DNA, 13 bp, D. melanogaster
taagctcattaaa

SEQ ID NO: 640035 - DNA, 13 bp, D. melanogaster
taagctgaaaata

SEQ ID NO: 640036 - DNA, 13 bp, D. melanogaster
taagctgacacgg

SEQ ID NO: 640037 - DNA, 13 bp, D. melanogaster
taagctgcaacaa

SEQ ID NO: 640038 - DNA, 13 bp, D. melanogaster
taagctgccagac

SEQ ID NO: 640039 - DNA, 13 bp, D. melanogaster
taagctgctcaaa

SEQ ID NO: 640040 - DNA, 13 bp, D. melanogaster
taagctgctgcca

SEQ ID NO: 640041 - DNA, 13 bp, D. melanogaster
taagctggagacc

SEQ ID NO: 640042 - DNA, 13 bp, D. melanogaster
taagcttaagctt

SEQ ID NO: 640043 - DNA, 13 bp, D. melanogaster
taagcttaatttt

SEQ ID NO: 640044 - DNA, 13 bp, D. melanogaster
taagctttaaaaa

SEQ ID NO: 640045 - DNA, 13 bp, D. melanogaster
taagctttaaagt

SEQ ID NO: 640046 - DNA, 14 bp, D. melanogaster
taaggaaagtaata

SEQ ID NO: 640047 - DNA, 13 bp, D. melanogaster
taaggaaatattt

SEQ ID NO: 640048 - DNA, 13 bp, D. melanogaster
taaggaaatggat

SEQ ID NO: 640049 - DNA, 13 bp, D. melanogaster
taaggaactcaga

SEQ ID NO: 640050 - DNA, 13 bp, D. melanogaster
taaggaatatatt

SEQ ID NO: 640051 - DNA, 13 bp, D. melanogaster
taaggaatatttt

SEQ ID NO: 640052 - DNA, 13 bp, D. melanogaster
taaggacgaaaaa

SEQ ID NO: 640053 - DNA, 13 bp, D. melanogaster
taaggagtataaa

SEQ ID NO: 640054 - DNA, 13 bp, D. melanogaster
taaggataacttt

SEQ ID NO: 640055 - DNA, 13 bp, D. melanogaster
taaggataaggat

SEQ ID NO: 640056 - DNA, 13 bp, D. melanogaster
taaggatcatcaa

SEQ ID NO: 640057 - DNA, 13 bp, D. melanogaster
taaggcaaatatt

SEQ ID NO: 640058 - DNA, 13 bp, D. melanogaster
taaggccaaatgg

SEQ ID NO: 640059 - DNA, 13 bp, D. melanogaster
taaggccaatcaa

SEQ ID NO: 640060 - DNA, 14 bp, D. melanogaster
taaggccgctcgca

SEQ ID NO: 640061 - DNA, 13 bp, D. melanogaster
taaggcggaggag

SEQ ID NO: 640062 - DNA, 13 bp, D. melanogaster
taaggctgaaggc

SEQ ID NO: 640063 - DNA, 13 bp, D. melanogaster
taaggcttgcatc

SEQ ID NO: 640064 - DNA, 13 bp, D. melanogaster
taaggggaaagat

SEQ ID NO: 640065 - DNA, 14 bp, D. melanogaster
taaggggtaacatc

SEQ ID NO: 640066 - DNA, 13 bp, D. melanogaster
taaggtaaacaaa

SEQ ID NO: 640067 - DNA, 13 bp, D. melanogaster
taaggtagccatt

SEQ ID NO: 640068 - DNA, 13 bp, D. melanogaster
taaggtatattta

SEQ ID NO: 640069 - DNA, 13 bp, D. melanogaster
taaggtgaagggc

SEQ ID NO: 640070 - DNA, 13 bp, D. melanogaster
taagtaaacacaa

SEQ ID NO: 640071 - DNA, 13 bp, D. melanogaster
taagtaaacattt

SEQ ID NO: 640072 - DNA, 13 bp, D. melanogaster
taagtaaactaaa

SEQ ID NO: 640073 - DNA, 14 bp, D. melanogaster
taagtaaataaaac

SEQ ID NO: 640074 - DNA, 13 bp, D. melanogaster
taagtaaataagt

SEQ ID NO: 640075 - DNA, 13 bp, D. melanogaster
taagtaaatatgt

SEQ ID NO: 640076 - DNA, 13 bp, D. melanogaster
taagtaaatgttt

SEQ ID NO: 640077 - DNA, 13 bp, D. melanogaster
taagtaaattgaa

SEQ ID NO: 640078 - DNA, 14 bp, D. melanogaster
taagtaaatttaac

SEQ ID NO: 640079 - DNA, 13 bp, D. melanogaster
taagtaacctcaa

SEQ ID NO: 640080 - DNA, 13 bp, D. melanogaster
taagtaagtaagc

SEQ ID NO: 640081 - DNA, 13 bp, D. melanogaster
taagtaatatctt

SEQ ID NO: 640082 - DNA, 13 bp, D. melanogaster
taagtaatcaaat

SEQ ID NO: 640083 - DNA, 13 bp, D. melanogaster
taagtaattgttg

SEQ ID NO: 640084 - DNA, 13 bp, D. melanogaster
taagtacaacaaa

SEQ ID NO: 640085 - DNA, 13 bp, D. melanogaster
taagtacacaaaa

SEQ ID NO: 640086 - DNA, 13 bp, D. melanogaster
taagtacagggta

SEQ ID NO: 640087 - DNA, 13 bp, D. melanogaster
taagtacataaat

SEQ ID NO: 640088 - DNA, 13 bp, D. melanogaster
taagtacatataa

SEQ ID NO: 640089 - DNA, 13 bp, D. melanogaster
taagtacatattt

SEQ ID NO: 640090 - DNA, 13 bp, D. melanogaster
taagtacattgaa

SEQ ID NO: 640091 - DNA, 13 bp, D. melanogaster
taagtactacctg

SEQ ID NO: 640092 - DNA, 13 bp, D. melanogaster
taagtacttaata

SEQ ID NO: 640093 - DNA, 14 bp, D. melanogaster
taagtagcagttaa

SEQ ID NO: 640094 - DNA, 13 bp, D. melanogaster
taagtagttttta

SEQ ID NO: 640095 - DNA, 13 bp, D. melanogaster
taagtagtttttg

SEQ ID NO: 640096 - DNA, 13 bp, D. melanogaster
taagtataaacaa

SEQ ID NO: 640097 - DNA, 13 bp, D. melanogaster
taagtataaagac

SEQ ID NO: 640098 - DNA, 13 bp, D. melanogaster
taagtatatacat

SEQ ID NO: 640099 - DNA, 13 bp, D. melanogaster
taagtatatatag

SEQ ID NO: 640100 - DNA, 13 bp, D. melanogaster
taagtatgcaaat

SEQ ID NO: 640101 - DNA, 13 bp, D. melanogaster
taagtatgtatgt

SEQ ID NO: 640102 - DNA, 14 bp, D. melanogaster
taagtatttcattt

SEQ ID NO: 640103 - DNA, 13 bp, D. melanogaster
taagtatttgaaa

SEQ ID NO: 640104 - DNA, 13 bp, D. melanogaster
taagtatttgtat

SEQ ID NO: 640105 - DNA, 13 bp, D. melanogaster
taagtcaaaacaa

SEQ ID NO: 640106 - DNA, 13 bp, D. melanogaster
taagtcaaataat

SEQ ID NO: 640107 - DNA, 13 bp, D. melanogaster
taagtcataattt

SEQ ID NO: 640108 - DNA, 13 bp, D. melanogaster
taagtcattaaaa

SEQ ID NO: 640109 - DNA, 13 bp, D. melanogaster
taagtccaaatgg

SEQ ID NO: 640110 - DNA, 13 bp, D. melanogaster
taagtctttaaat

SEQ ID NO: 640111 - DNA, 14 bp, D. melanogaster
taagtctttcgttt

SEQ ID NO: 640112 - DNA, 14 bp, D. melanogaster
taagtcttttgttt

SEQ ID NO: 640113 - DNA, 13 bp, D. melanogaster
taagtgaaaaagt

SEQ ID NO: 640114 - DNA, 13 bp, D. melanogaster
taagtgaaatatg

SEQ ID NO: 640115 - DNA, 13 bp, D. melanogaster
taagtgaaatgtt

SEQ ID NO: 640116 - DNA, 13 bp, D. melanogaster
taagtgaaattat

SEQ ID NO: 640117 - DNA, 13 bp, D. melanogaster
taagtgaataaca

SEQ ID NO: 640118 - DNA, 13 bp, D. melanogaster
taagtgaatgaaa

SEQ ID NO: 640119 - DNA, 13 bp, D. melanogaster
taagtgaattaaa

SEQ ID NO: 640120 - DNA, 13 bp, D. melanogaster
taagtgaattaat

SEQ ID NO: 640121 - DNA, 13 bp, D. melanogaster
taagtgaatttat

SEQ ID NO: 640122 - DNA, 13 bp, D. melanogaster
taagtgactgtga

SEQ ID NO: 640123 - DNA, 13 bp, D. melanogaster
taagtgcaaaata

SEQ ID NO: 640124 - DNA, 13 bp, D. melanogaster
taagtgcaaaatt

SEQ ID NO: 640125 - DNA, 13 bp, D. melanogaster
taagtgcaataaa

SEQ ID NO: 640126 - DNA, 13 bp, D. melanogaster
taagtgcacaaat

SEQ ID NO: 640127 - DNA, 13 bp, D. melanogaster
taagtgcactgaa

SEQ ID NO: 640128 - DNA, 13 bp, D. melanogaster
taagtgcatgtgg

SEQ ID NO: 640129 - DNA, 13 bp, D. melanogaster
taagtgccacgcc

SEQ ID NO: 640130 - DNA, 13 bp, D. melanogaster
taagtgctctgct

SEQ ID NO: 640131 - DNA, 13 bp, D. melanogaster
taagtggaagaaa

SEQ ID NO: 640132 - DNA, 13 bp, D. melanogaster
taagtgggaaaat

SEQ ID NO: 640133 - DNA, 13 bp, D. melanogaster
taagtggtaatat

SEQ ID NO: 640134 - DNA, 13 bp, D. melanogaster
taagtggtgtgga

SEQ ID NO: 640135 - DNA, 13 bp, D. melanogaster
taagtgtaagtgt

SEQ ID NO: 640136 - DNA, 13 bp, D. melanogaster
taagtgtaattta

SEQ ID NO: 640137 - DNA, 14 bp, D. melanogaster
taagtgtatataga

SEQ ID NO: 640138 - DNA, 14 bp, D. melanogaster
taagtgtgtgcgtg

SEQ ID NO: 640139 - DNA, 13 bp, D. melanogaster
taagtgtgtgtat

SEQ ID NO: 640140 - DNA, 13 bp, D. melanogaster
taagtgtgtgtgt

SEQ ID NO: 640141 - DNA, 14 bp, D. melanogaster
taagtgtgtgtgtg

SEQ ID NO: 640142 - DNA, 13 bp, D. melanogaster
taagtgttaaaaa

SEQ ID NO: 640143 - DNA, 13 bp, D. melanogaster
taagtgtttgtct

SEQ ID NO: 640144 - DNA, 14 bp, D. melanogaster
taagttaaaaaggc

SEQ ID NO: 640145 - DNA, 13 bp, D. melanogaster
taagttaaattga

SEQ ID NO: 640146 - DNA, 13 bp, D. melanogaster
taagttaacattt

SEQ ID NO: 640147 - DNA, 13 bp, D. melanogaster
taagttaagcaaa

SEQ ID NO: 640148 - DNA, 13 bp, D. melanogaster
taagttaagtaaa

SEQ ID NO: 640149 - DNA, 13 bp, D. melanogaster
taagttaattgag

SEQ ID NO: 640150 - DNA, 13 bp, D. melanogaster
taagttagtctag

SEQ ID NO: 640151 - DNA, 13 bp, D. melanogaster
taagttataagct

SEQ ID NO: 640152 - DNA, 14 bp, D. melanogaster
taagttatgtgtaa

SEQ ID NO: 640153 - DNA, 13 bp, D. melanogaster
taagttattgccc

SEQ ID NO: 640154 - DNA, 14 bp, D. melanogaster
taagttattttcat

SEQ ID NO: 640155 - DNA, 13 bp, D. melanogaster
taagttcacatat

SEQ ID NO: 640156 - DNA, 13 bp, D. melanogaster
taagttcagttca

SEQ ID NO: 640157 - DNA, 13 bp, D. melanogaster
taagttcatttta

SEQ ID NO: 640158 - DNA, 13 bp, D. melanogaster
taagttctataaa

SEQ ID NO: 640159 - DNA, 13 bp, D. melanogaster
taagttctccgat

SEQ ID NO: 640160 - DNA, 13 bp, D. melanogaster
taagttctttaag

SEQ ID NO: 640161 - DNA, 13 bp, D. melanogaster
taagttgaaattt

SEQ ID NO: 640162 - DNA, 13 bp, D. melanogaster
taagttgattaaa

SEQ ID NO: 640163 - DNA, 13 bp, D. melanogaster
taagttgctcagc

SEQ ID NO: 640164 - DNA, 13 bp, D. melanogaster
taagttggaaaaa

SEQ ID NO: 640165 - DNA, 13 bp, D. melanogaster
taagttggaaaat

SEQ ID NO: 640166 - DNA, 13 bp, D. melanogaster
taagttggaaatt

SEQ ID NO: 640167 - DNA, 13 bp, D. melanogaster
taagttggccaaa

SEQ ID NO: 640168 - DNA, 13 bp, D. melanogaster
taagttgtatatt

SEQ ID NO: 640169 - DNA, 14 bp, D. melanogaster
taagtttaaaaatc

SEQ ID NO: 640170 - DNA, 13 bp, D. melanogaster
taagtttaacaaa

SEQ ID NO: 640171 - DNA, 13 bp, D. melanogaster
taagtttaattac

SEQ ID NO: 640172 - DNA, 13 bp, D. melanogaster
taagtttacaaaa

SEQ ID NO: 640173 - DNA, 13 bp, D. melanogaster
taagtttacataa

SEQ ID NO: 640174 - DNA, 14 bp, D. melanogaster
taagtttacataag

SEQ ID NO: 640175 - DNA, 13 bp, D. melanogaster
taagtttacattt

SEQ ID NO: 640176 - DNA, 13 bp, D. melanogaster
taagtttacttat

SEQ ID NO: 640177 - DNA, 13 bp, D. melanogaster
taagtttactttt

SEQ ID NO: 640178 - DNA, 13 bp, D. melanogaster
taagtttattgct

SEQ ID NO: 640179 - DNA, 14 bp, D. melanogaster
taagtttattgctg

SEQ ID NO: 640180 - DNA, 13 bp, D. melanogaster
taagtttcagttt

SEQ ID NO: 640181 - DNA, 13 bp, D. melanogaster
taagtttcctttt

SEQ ID NO: 640182 - DNA, 13 bp, D. melanogaster
taagtttctattt

SEQ ID NO: 640183 - DNA, 13 bp, D. melanogaster
taagtttgattta

SEQ ID NO: 640184 - DNA, 13 bp, D. melanogaster
taagtttgtttaa

SEQ ID NO: 640185 - DNA, 13 bp, D. melanogaster
taagttttaaaac

SEQ ID NO: 640186 - DNA, 13 bp, D. melanogaster
taagttttaagtt

SEQ ID NO: 640187 - DNA, 13 bp, D. melanogaster
taagttttacttt

SEQ ID NO: 640188 - DNA, 13 bp, D. melanogaster
taagttttatgtg

SEQ ID NO: 640189 - DNA, 13 bp, D. melanogaster
taagttttcaagc

SEQ ID NO: 640190 - DNA, 13 bp, D. melanogaster
taagttttcgaaa

SEQ ID NO: 640191 - DNA, 13 bp, D. melanogaster
taagttttctttg

SEQ ID NO: 640192 - DNA, 13 bp, D. melanogaster
taagtttttaatc

SEQ ID NO: 640193 - DNA, 13 bp, D. melanogaster
taagtttttatga

SEQ ID NO: 640194 - DNA, 14 bp, D. melanogaster
taagtttttcattt

SEQ ID NO: 640195 - DNA, 13 bp, D. melanogaster
taataaaaacagt

SEQ ID NO: 640196 - DNA, 13 bp, D. melanogaster
taataaaaacgtt

SEQ ID NO: 640197 - DNA, 13 bp, D. melanogaster
taataaaactatg

SEQ ID NO: 640198 - DNA, 13 bp, D. melanogaster
taataaaactgaa

SEQ ID NO: 640199 - DNA, 13 bp, D. melanogaster
taataaaagcaca

SEQ ID NO: 640200 - DNA, 13 bp, D. melanogaster
taataaaagcatt

SEQ ID NO: 640201 - DNA, 13 bp, D. melanogaster
taataaaagtgca

SEQ ID NO: 640202 - DNA, 13 bp, D. melanogaster
taataaaatagca

SEQ ID NO: 640203 - DNA, 13 bp, D. melanogaster
taataaaatcgat

SEQ ID NO: 640204 - DNA, 13 bp, D. melanogaster
taataaaatcgtt

SEQ ID NO: 640205 - DNA, 13 bp, D. melanogaster
taataaaatgcaa

SEQ ID NO: 640206 - DNA, 13 bp, D. melanogaster
taataaacaagtt

SEQ ID NO: 640207 - DNA, 13 bp, D. melanogaster
taataaacaatct

SEQ ID NO: 640208 - DNA, 13 bp, D. melanogaster
taataaacattac

SEQ ID NO: 640209 - DNA, 13 bp, D. melanogaster
taataaaccattt

SEQ ID NO: 640210 - DNA, 13 bp, D. melanogaster
taataaacttgac

SEQ ID NO: 640211 - DNA, 13 bp, D. melanogaster
taataaacttgtt

SEQ ID NO: 640212 - DNA, 13 bp, D. melanogaster
taataaacttttc

SEQ ID NO: 640213 - DNA, 13 bp, D. melanogaster
taataaagagcat

SEQ ID NO: 640214 - DNA, 13 bp, D. melanogaster
taataaagcaatt

SEQ ID NO: 640215 - DNA, 13 bp, D. melanogaster
taataaagccaaa

SEQ ID NO: 640216 - DNA, 13 bp, D. melanogaster
taataaagctttc

SEQ ID NO: 640217 - DNA, 14 bp, D. melanogaster
taataaagtctcaa

SEQ ID NO: 640218 - DNA, 13 bp, D. melanogaster
taataaataaacg

SEQ ID NO: 640219 - DNA, 13 bp, D. melanogaster
taataaataagtg

SEQ ID NO: 640220 - DNA, 13 bp, D. melanogaster
taataaataccat

SEQ ID NO: 640221 - DNA, 13 bp, D. melanogaster
taataaatacgaa

SEQ ID NO: 640222 - DNA, 13 bp, D. melanogaster
taataaatatgtg

SEQ ID NO: 640223 - DNA, 13 bp, D. melanogaster
taataaatccaat

SEQ ID NO: 640224 - DNA, 13 bp, D. melanogaster
taataaatcgatt

SEQ ID NO: 640225 - DNA, 13 bp, D. melanogaster
taataaatgagtg

SEQ ID NO: 640226 - DNA, 13 bp, D. melanogaster
taataaatggctt

SEQ ID NO: 640227 - DNA, 13 bp, D. melanogaster
taataaatggttt

SEQ ID NO: 640228 - DNA, 13 bp, D. melanogaster
taataaatgtgaa

SEQ ID NO: 640229 - DNA, 13 bp, D. melanogaster
taataaattcctt

SEQ ID NO: 640230 - DNA, 13 bp, D. melanogaster
taataaattgtca

SEQ ID NO: 640231 - DNA, 14 bp, D. melanogaster
taataaatttaacc

SEQ ID NO: 640232 - DNA, 13 bp, D. melanogaster
taataaatttgcc

SEQ ID NO: 640233 - DNA, 13 bp, D. melanogaster
taataacaacatt

SEQ ID NO: 640234 - DNA, 14 bp, D. melanogaster
taataacaataatg

SEQ ID NO: 640235 - DNA, 13 bp, D. melanogaster
taataacacttat

SEQ ID NO: 640236 - DNA, 13 bp, D. melanogaster
taataacagcaac

SEQ ID NO: 640237 - DNA, 13 bp, D. melanogaster
taataacagtata

SEQ ID NO: 640238 - DNA, 14 bp, D. melanogaster
taataacatgaagt

SEQ ID NO: 640239 - DNA, 13 bp, D. melanogaster
taataacgaattc

SEQ ID NO: 640240 - DNA, 14 bp, D. melanogaster
taataagaaatttc

SEQ ID NO: 640241 - DNA, 13 bp, D. melanogaster
taataagatccgg

SEQ ID NO: 640242 - DNA, 13 bp, D. melanogaster
taataagcaattt

SEQ ID NO: 640243 - DNA, 13 bp, D. melanogaster
taataagcacaaa

SEQ ID NO: 640244 - DNA, 13 bp, D. melanogaster
taataagcttgtt

SEQ ID NO: 640245 - DNA, 13 bp, D. melanogaster
taataagcttttt

SEQ ID NO: 640246 - DNA, 13 bp, D. melanogaster
taataagtaaaac

SEQ ID NO: 640247 - DNA, 13 bp, D. melanogaster
taataataaaacg

SEQ ID NO: 640248 - DNA, 14 bp, D. melanogaster
taataataaaagca

SEQ ID NO: 640249 - DNA, 13 bp, D. melanogaster
taataataaacag

SEQ ID NO: 640250 - DNA, 13 bp, D. melanogaster
taataataacaag

SEQ ID NO: 640251 - DNA, 14 bp, D. melanogaster
taataataacaaga

SEQ ID NO: 640252 - DNA, 14 bp, D. melanogaster
taataataacattg

SEQ ID NO: 640253 - DNA, 13 bp, D. melanogaster
taataataactgt

SEQ ID NO: 640254 - DNA, 13 bp, D. melanogaster
taataataagcaa

SEQ ID NO: 640255 - DNA, 13 bp, D. melanogaster
taataataagcga

SEQ ID NO: 640256 - DNA, 15 bp, D. melanogaster
taataataataacga

SEQ ID NO: 640257 - DNA, 13 bp, D. melanogaster
taataataatacc

SEQ ID NO: 640258 - DNA, 14 bp, D. melanogaster
taataataatagca

SEQ ID NO: 640259 - DNA, 13 bp, D. melanogaster
taataataatgag

SEQ ID NO: 640260 - DNA, 13 bp, D. melanogaster
taataataatgca

SEQ ID NO: 640261 - DNA, 13 bp, D. melanogaster
taataataatggt

SEQ ID NO: 640262 - DNA, 14 bp, D. melanogaster
taataataatggtt

SEQ ID NO: 640263 - DNA, 13 bp, D. melanogaster
taataataattcc

SEQ ID NO: 640264 - DNA, 13 bp, D. melanogaster
taataatagtgtt

SEQ ID NO: 640265 - DNA, 13 bp, D. melanogaster
taataatcagttt

SEQ ID NO: 640266 - DNA, 13 bp, D. melanogaster
taataatcatttg

SEQ ID NO: 640267 - DNA, 13 bp, D. melanogaster
taataatccattt

SEQ ID NO: 640268 - DNA, 13 bp, D. melanogaster
taataatgaaagt

SEQ ID NO: 640269 - DNA, 14 bp, D. melanogaster
taataatgacacaa

SEQ ID NO: 640270 - DNA, 14 bp, D. melanogaster
taataatgataatg

SEQ ID NO: 640271 - DNA, 13 bp, D. melanogaster
taataatgatggt

SEQ ID NO: 640272 - DNA, 13 bp, D. melanogaster
taataatgcataa

SEQ ID NO: 640273 - DNA, 13 bp, D. melanogaster
taataatgcatat

SEQ ID NO: 640274 - DNA, 13 bp, D. melanogaster
taataatgtgaaa

SEQ ID NO: 640275 - DNA, 13 bp, D. melanogaster
taataatgttggc

SEQ ID NO: 640276 - DNA, 13 bp, D. melanogaster
taataatgttggt

SEQ ID NO: 640277 - DNA, 13 bp, D. melanogaster
taataatgtttgc

SEQ ID NO: 640278 - DNA, 13 bp, D. melanogaster
taataatgttttc

SEQ ID NO: 640279 - DNA, 14 bp, D. melanogaster
taataattaacggc

SEQ ID NO: 640280 - DNA, 13 bp, D. melanogaster
taataattacaca

SEQ ID NO: 640281 - DNA, 13 bp, D. melanogaster
taataattaccga

SEQ ID NO: 640282 - DNA, 13 bp, D. melanogaster
taataattacgat

SEQ ID NO: 640283 - DNA, 13 bp, D. melanogaster
taataattccaaa

SEQ ID NO: 640284 - DNA, 13 bp, D. melanogaster
taataattccatc

SEQ ID NO: 640285 - DNA, 13 bp, D. melanogaster
taataattcgctt

SEQ ID NO: 640286 - DNA, 13 bp, D. melanogaster
taataattgcatt

SEQ ID NO: 640287 - DNA, 13 bp, D. melanogaster
taataattgccaa

SEQ ID NO: 640288 - DNA, 13 bp, D. melanogaster
taataattgttgt

SEQ ID NO: 640289 - DNA, 13 bp, D. melanogaster
taatacaaattga

SEQ ID NO: 640290 - DNA, 13 bp, D. melanogaster
taatacaaatttg

SEQ ID NO: 640291 - DNA, 14 bp, D. melanogaster
taatacaactgaaa

SEQ ID NO: 640292 - DNA, 13 bp, D. melanogaster
taatacaagtttt

SEQ ID NO: 640293 - DNA, 13 bp, D. melanogaster
taatacaatttca

SEQ ID NO: 640294 - DNA, 14 bp, D. melanogaster
taatacaatttttg

SEQ ID NO: 640295 - DNA, 13 bp, D. melanogaster
taatacacacaca

SEQ ID NO: 640296 - DNA, 13 bp, D. melanogaster
taatacagtataa

SEQ ID NO: 640297 - DNA, 14 bp, D. melanogaster
taatacatacatac

SEQ ID NO: 640298 - DNA, 15 bp, D. melanogaster
taatacatacatata

SEQ ID NO: 640299 - DNA, 13 bp, D. melanogaster
taatacatatatg

SEQ ID NO: 640300 - DNA, 14 bp, D. melanogaster
taatacatatatgt

SEQ ID NO: 640301 - DNA, 13 bp, D. melanogaster
taatacatatttc

SEQ ID NO: 640302 - DNA, 14 bp, D. melanogaster
taatacattttgtt

SEQ ID NO: 640303 - DNA, 13 bp, D. melanogaster
taataccaatcac

SEQ ID NO: 640304 - DNA, 13 bp, D. melanogaster
taataccgaaaat

SEQ ID NO: 640305 - DNA, 13 bp, D. melanogaster
taatactaatgat

SEQ ID NO: 640306 - DNA, 13 bp, D. melanogaster
taatactactact

SEQ ID NO: 640307 - DNA, 13 bp, D. melanogaster
taatactggaata

SEQ ID NO: 640308 - DNA, 13 bp, D. melanogaster
taatacttttcaa

SEQ ID NO: 640309 - DNA, 14 bp, D. melanogaster
taatagaaactaca

SEQ ID NO: 640310 - DNA, 13 bp, D. melanogaster
taatagatacatt

SEQ ID NO: 640311 - DNA, 13 bp, D. melanogaster
taatagatacttt

SEQ ID NO: 640312 - DNA, 14 bp, D. melanogaster
taatagatcaccaa

SEQ ID NO: 640313 - DNA, 13 bp, D. melanogaster
taatagattagaa

SEQ ID NO: 640314 - DNA, 13 bp, D. melanogaster
taatagattagtt

SEQ ID NO: 640315 - DNA, 13 bp, D. melanogaster
taatagcagccaa

SEQ ID NO: 640316 - DNA, 14 bp, D. melanogaster
taatagccaagctg

SEQ ID NO: 640317 - DNA, 13 bp, D. melanogaster
taatagtaacaaa

SEQ ID NO: 640318 - DNA, 13 bp, D. melanogaster
taatagtagtagt

SEQ ID NO: 640319 - DNA, 13 bp, D. melanogaster
taatagtatcatc

SEQ ID NO: 640320 - DNA, 14 bp, D. melanogaster
taatagtatcatca

SEQ ID NO: 640321 - DNA, 14 bp, D. melanogaster
taatagtcaagata

SEQ ID NO: 640322 - DNA, 13 bp, D. melanogaster
taatagtggtatt

SEQ ID NO: 640323 - DNA, 14 bp, D. melanogaster
taatagttggctat

SEQ ID NO: 640324 - DNA, 13 bp, D. melanogaster
taatagttttgaa

SEQ ID NO: 640325 - DNA, 13 bp, D. melanogaster
taatataaaccat

SEQ ID NO: 640326 - DNA, 13 bp, D. melanogaster
taatataaagcaa

SEQ ID NO: 640327 - DNA, 13 bp, D. melanogaster
taatatacacata

SEQ ID NO: 640328 - DNA, 13 bp, D. melanogaster
taatatacatttg

SEQ ID NO: 640329 - DNA, 13 bp, D. melanogaster
taatatacccttt

SEQ ID NO: 640330 - DNA, 13 bp, D. melanogaster
taatatactttgt

SEQ ID NO: 640331 - DNA, 13 bp, D. melanogaster
taatatagaggag

SEQ ID NO: 640332 - DNA, 13 bp, D. melanogaster
taatatatacaca

SEQ ID NO: 640333 - DNA, 13 bp, D. melanogaster
taatatatatgca

SEQ ID NO: 640334 - DNA, 13 bp, D. melanogaster
taatatatgcaat

SEQ ID NO: 640335 - DNA, 14 bp, D. melanogaster
taatatattcgtaa

SEQ ID NO: 640336 - DNA, 13 bp, D. melanogaster
taatatatttcca

SEQ ID NO: 640337 - DNA, 13 bp, D. melanogaster
taatatcaatcaa

SEQ ID NO: 640338 - DNA, 13 bp, D. melanogaster
taatatcaatgtt

SEQ ID NO: 640339 - DNA, 13 bp, D. melanogaster
taatatccaatta

SEQ ID NO: 640340 - DNA, 13 bp, D. melanogaster
taatatccatata

SEQ ID NO: 640341 - DNA, 13 bp, D. melanogaster
taatatcccaaca

SEQ ID NO: 640342 - DNA, 13 bp, D. melanogaster
taatatcctgtca

SEQ ID NO: 640343 - DNA, 13 bp, D. melanogaster
taatatgcaaata

SEQ ID NO: 640344 - DNA, 14 bp, D. melanogaster
taatatgcaaataa

SEQ ID NO: 640345 - DNA, 14 bp, D. melanogaster
taatatgcaagaca

SEQ ID NO: 640346 - DNA, 13 bp, D. melanogaster
taatatgcataaa

SEQ ID NO: 640347 - DNA, 13 bp, D. melanogaster
taatatgcattta

SEQ ID NO: 640348 - DNA, 13 bp, D. melanogaster
taatatgctattt

SEQ ID NO: 640349 - DNA, 13 bp, D. melanogaster
taatatgggtctt

SEQ ID NO: 640350 - DNA, 13 bp, D. melanogaster
taatatgtacata

SEQ ID NO: 640351 - DNA, 13 bp, D. melanogaster
taatatgtaccat

SEQ ID NO: 640352 - DNA, 13 bp, D. melanogaster
taatatgtataac

SEQ ID NO: 640353 - DNA, 13 bp, D. melanogaster
taatatgtatgtt

SEQ ID NO: 640354 - DNA, 13 bp, D. melanogaster
taatattacgttt

SEQ ID NO: 640355 - DNA, 14 bp, D. melanogaster
taatattctaatac

SEQ ID NO: 640356 - DNA, 13 bp, D. melanogaster
taatattgaaaac

SEQ ID NO: 640357 - DNA, 14 bp, D. melanogaster
taatattgatagtt

SEQ ID NO: 640358 - DNA, 13 bp, D. melanogaster
taatattgcaaat

SEQ ID NO: 640359 - DNA, 13 bp, D. melanogaster
taatatttagaag

SEQ ID NO: 640360 - DNA, 13 bp, D. melanogaster
taatatttatagc

SEQ ID NO: 640361 - DNA, 13 bp, D. melanogaster
taatatttatgca

SEQ ID NO: 640362 - DNA, 13 bp, D. melanogaster
taatatttatgcc

SEQ ID NO: 640363 - DNA, 13 bp, D. melanogaster
taatatttatgtg

SEQ ID NO: 640364 - DNA, 13 bp, D. melanogaster
taatatttattgc

SEQ ID NO: 640365 - DNA, 13 bp, D. melanogaster
taatatttcccaa

SEQ ID NO: 640366 - DNA, 13 bp, D. melanogaster
taatatttctttg

SEQ ID NO: 640367 - DNA, 13 bp, D. melanogaster
taatatttgagca

SEQ ID NO: 640368 - DNA, 13 bp, D. melanogaster
taatatttgcatt

SEQ ID NO: 640369 - DNA, 13 bp, D. melanogaster
taatatttggatt

SEQ ID NO: 640370 - DNA, 13 bp, D. melanogaster
taatattttcact

SEQ ID NO: 640371 - DNA, 13 bp, D. melanogaster
taatattttcaga

SEQ ID NO: 640372 - DNA, 13 bp, D. melanogaster
taatattttcgaa

SEQ ID NO: 640373 - DNA, 13 bp, D. melanogaster
taatattttggaa

SEQ ID NO: 640374 - DNA, 13 bp, D. melanogaster
taatatttttccc

SEQ ID NO: 640375 - DNA, 13 bp, D. melanogaster
taatcaaaaatgc

SEQ ID NO: 640376 - DNA, 13 bp, D. melanogaster
taatcaaaatgaa

SEQ ID NO: 640377 - DNA, 13 bp, D. melanogaster
taatcaaaatgtt

SEQ ID NO: 640378 - DNA, 13 bp, D. melanogaster
taatcaaacaatt

SEQ ID NO: 640379 - DNA, 13 bp, D. melanogaster
taatcaaagctaa

SEQ ID NO: 640380 - DNA, 13 bp, D. melanogaster
taatcaaaggcaa

SEQ ID NO: 640381 - DNA, 13 bp, D. melanogaster
taatcaaagttaa

SEQ ID NO: 640382 - DNA, 13 bp, D. melanogaster
taatcaaatcaat

SEQ ID NO: 640383 - DNA, 13 bp, D. melanogaster
taatcaaatcata

SEQ ID NO: 640384 - DNA, 13 bp, D. melanogaster
taatcaaatcgaa

SEQ ID NO: 640385 - DNA, 13 bp, D. melanogaster
taatcaaatcgtt

SEQ ID NO: 640386 - DNA, 13 bp, D. melanogaster
taatcaaatgtat

SEQ ID NO: 640387 - DNA, 13 bp, D. melanogaster
taatcaaattatg

SEQ ID NO: 640388 - DNA, 13 bp, D. melanogaster
taatcaaattgaa

SEQ ID NO: 640389 - DNA, 13 bp, D. melanogaster
taatcaaattgca

SEQ ID NO: 640390 - DNA, 13 bp, D. melanogaster
taatcaacagcaa

SEQ ID NO: 640391 - DNA, 13 bp, D. melanogaster
taatcaacatctg

SEQ ID NO: 640392 - DNA, 13 bp, D. melanogaster
taatcaacattta

SEQ ID NO: 640393 - DNA, 13 bp, D. melanogaster
taatcaacctaca

SEQ ID NO: 640394 - DNA, 13 bp, D. melanogaster
taatcaactttaa

SEQ ID NO: 640395 - DNA, 13 bp, D. melanogaster
taatcaacttttg

SEQ ID NO: 640396 - DNA, 13 bp, D. melanogaster
taatcaagaaaat

SEQ ID NO: 640397 - DNA, 13 bp, D. melanogaster
taatcaagtcata

SEQ ID NO: 640398 - DNA, 13 bp, D. melanogaster
taatcaagttttt

SEQ ID NO: 640399 - DNA, 13 bp, D. melanogaster
taatcaataaatg

SEQ ID NO: 640400 - DNA, 13 bp, D. melanogaster
taatcaataacat

SEQ ID NO: 640401 - DNA, 13 bp, D. melanogaster
taatcaatatcaa

SEQ ID NO: 640402 - DNA, 13 bp, D. melanogaster
taatcaatcaatc

SEQ ID NO: 640403 - DNA, 13 bp, D. melanogaster
taatcaatcaatt

SEQ ID NO: 640404 - DNA, 13 bp, D. melanogaster
taatcaatcattt

SEQ ID NO: 640405 - DNA, 13 bp, D. melanogaster
taatcaatttgaa

SEQ ID NO: 640406 - DNA, 13 bp, D. melanogaster
taatcacaaaatg

SEQ ID NO: 640407 - DNA, 13 bp, D. melanogaster
taatcacttaaaa

SEQ ID NO: 640408 - DNA, 13 bp, D. melanogaster
taatcagtttttt

SEQ ID NO: 640409 - DNA, 14 bp, D. melanogaster
taatcagttttttt

SEQ ID NO: 640410 - DNA, 13 bp, D. melanogaster
taatcataaatgg

SEQ ID NO: 640411 - DNA, 13 bp, D. melanogaster
taatcataacaat

SEQ ID NO: 640412 - DNA, 13 bp, D. melanogaster
taatcataatcat

SEQ ID NO: 640413 - DNA, 13 bp, D. melanogaster
taatcataattga

SEQ ID NO: 640414 - DNA, 13 bp, D. melanogaster
taatcatacgccg

SEQ ID NO: 640415 - DNA, 13 bp, D. melanogaster
taatcatagcaat

SEQ ID NO: 640416 - DNA, 13 bp, D. melanogaster
taatcattgaaaa

SEQ ID NO: 640417 - DNA, 13 bp, D. melanogaster
taatcatttcatt

SEQ ID NO: 640418 - DNA, 13 bp, D. melanogaster
taatcattttcaa

SEQ ID NO: 640419 - DNA, 13 bp, D. melanogaster
taatcatttttgt

SEQ ID NO: 640420 - DNA, 13 bp, D. melanogaster
taatccaaaaatc

SEQ ID NO: 640421 - DNA, 13 bp, D. melanogaster
taatccaaacaat

SEQ ID NO: 640422 - DNA, 13 bp, D. melanogaster
taatccaaatatt

SEQ ID NO: 640423 - DNA, 13 bp, D. melanogaster
taatccacttaat

SEQ ID NO: 640424 - DNA, 13 bp, D. melanogaster
taatccattaaat

SEQ ID NO: 640425 - DNA, 14 bp, D. melanogaster
taatcccagcccac

SEQ ID NO: 640426 - DNA, 13 bp, D. melanogaster
taatccccaaaaa

SEQ ID NO: 640427 - DNA, 13 bp, D. melanogaster
taatcccggccag

SEQ ID NO: 640428 - DNA, 13 bp, D. melanogaster
taatcctttaaat

SEQ ID NO: 640429 - DNA, 13 bp, D. melanogaster
taatcgaaaaata

SEQ ID NO: 640430 - DNA, 13 bp, D. melanogaster
taatcgaaaaatt

SEQ ID NO: 640431 - DNA, 13 bp, D. melanogaster
taatcgaaactgt

SEQ ID NO: 640432 - DNA, 13 bp, D. melanogaster
taatcgaaataaa

SEQ ID NO: 640433 - DNA, 13 bp, D. melanogaster
taatcgaaatgtt

SEQ ID NO: 640434 - DNA, 13 bp, D. melanogaster
taatcgaagtaat

SEQ ID NO: 640435 - DNA, 13 bp, D. melanogaster
taatcgatttttg

SEQ ID NO: 640436 - DNA, 13 bp, D. melanogaster
taatcggaataga

SEQ ID NO: 640437 - DNA, 13 bp, D. melanogaster
taatcgtaataat

SEQ ID NO: 640438 - DNA, 13 bp, D. melanogaster
taatcgtaatcgt

SEQ ID NO: 640439 - DNA, 13 bp, D. melanogaster
taatctattaaag

SEQ ID NO: 640440 - DNA, 13 bp, D. melanogaster
taatctcaactgt

SEQ ID NO: 640441 - DNA, 13 bp, D. melanogaster
taatctcatttgt

SEQ ID NO: 640442 - DNA, 13 bp, D. melanogaster
taatctccatttc

SEQ ID NO: 640443 - DNA, 13 bp, D. melanogaster
taatctctcactt

SEQ ID NO: 640444 - DNA, 13 bp, D. melanogaster
taatctgaataat

SEQ ID NO: 640445 - DNA, 13 bp, D. melanogaster
taatctgcgggac

SEQ ID NO: 640446 - DNA, 13 bp, D. melanogaster
taatctgtctact

SEQ ID NO: 640447 - DNA, 14 bp, D. melanogaster
taatcttaacgatt

SEQ ID NO: 640448 - DNA, 13 bp, D. melanogaster
taatcttaacttt

SEQ ID NO: 640449 - DNA, 13 bp, D. melanogaster
taatcttccaaaa

SEQ ID NO: 640450 - DNA, 14 bp, D. melanogaster
taatcttccaaaat

SEQ ID NO: 640451 - DNA, 13 bp, D. melanogaster
taatcttgcagct

SEQ ID NO: 640452 - DNA, 13 bp, D. melanogaster
taatctttaatct

SEQ ID NO: 640453 - DNA, 13 bp, D. melanogaster
taatctttgaaaa

SEQ ID NO: 640454 - DNA, 13 bp, D. melanogaster
taatgaaaaacta

SEQ ID NO: 640455 - DNA, 13 bp, D. melanogaster
taatgaaaaagtt

SEQ ID NO: 640456 - DNA, 13 bp, D. melanogaster
taatgaaaaatct

SEQ ID NO: 640457 - DNA, 13 bp, D. melanogaster
taatgaaaaatgc

SEQ ID NO: 640458 - DNA, 13 bp, D. melanogaster
taatgaaaacata

SEQ ID NO: 640459 - DNA, 13 bp, D. melanogaster
taatgaaaacatt

SEQ ID NO: 640460 - DNA, 13 bp, D. melanogaster
taatgaaaaccca

SEQ ID NO: 640461 - DNA, 13 bp, D. melanogaster
taatgaaaacgaa

SEQ ID NO: 640462 - DNA, 13 bp, D. melanogaster
taatgaaaagcaa

SEQ ID NO: 640463 - DNA, 13 bp, D. melanogaster
taatgaaaagtta

SEQ ID NO: 640464 - DNA, 13 bp, D. melanogaster
taatgaaaatact

SEQ ID NO: 640465 - DNA, 13 bp, D. melanogaster
taatgaaaatcaa

SEQ ID NO: 640466 - DNA, 13 bp, D. melanogaster
taatgaaaatgca

SEQ ID NO: 640467 - DNA, 13 bp, D. melanogaster
taatgaaaatgtc

SEQ ID NO: 640468 - DNA, 13 bp, D. melanogaster
taatgaaaattca

SEQ ID NO: 640469 - DNA, 13 bp, D. melanogaster
taatgaaaattct

SEQ ID NO: 640470 - DNA, 13 bp, D. melanogaster
taatgaaaccaac

SEQ ID NO: 640471 - DNA, 13 bp, D. melanogaster
taatgaaagcaaa

SEQ ID NO: 640472 - DNA, 14 bp, D. melanogaster
taatgaaataatcg

SEQ ID NO: 640473 - DNA, 14 bp, D. melanogaster
taatgaaatattca

SEQ ID NO: 640474 - DNA, 13 bp, D. melanogaster
taatgaaatccaa

SEQ ID NO: 640475 - DNA, 13 bp, D. melanogaster
taatgaaatcgaa

SEQ ID NO: 640476 - DNA, 13 bp, D. melanogaster
taatgaaatgata

SEQ ID NO: 640477 - DNA, 13 bp, D. melanogaster
taatgaaatgatt

SEQ ID NO: 640478 - DNA, 13 bp, D. melanogaster
taatgaaatggaa

SEQ ID NO: 640479 - DNA, 13 bp, D. melanogaster
taatgaaattcaa

SEQ ID NO: 640480 - DNA, 13 bp, D. melanogaster
taatgaaattgtt

SEQ ID NO: 640481 - DNA, 13 bp, D. melanogaster
taatgaagcattt

SEQ ID NO: 640482 - DNA, 13 bp, D. melanogaster
taatgaagggcaa

SEQ ID NO: 640483 - DNA, 13 bp, D. melanogaster
taatgaagtcaaa

SEQ ID NO: 640484 - DNA, 13 bp, D. melanogaster
taatgaagttaaa

SEQ ID NO: 640485 - DNA, 13 bp, D. melanogaster
taatgaatacata

SEQ ID NO: 640486 - DNA, 13 bp, D. melanogaster
taatgaatatgaa

SEQ ID NO: 640487 - DNA, 13 bp, D. melanogaster
taatgaatatttg

SEQ ID NO: 640488 - DNA, 13 bp, D. melanogaster
taatgaatgaaat

SEQ ID NO: 640489 - DNA, 13 bp, D. melanogaster
taatgaatgaata

SEQ ID NO: 640490 - DNA, 13 bp, D. melanogaster
taatgaattgttt

SEQ ID NO: 640491 - DNA, 13 bp, D. melanogaster
taatgaatttgtt

SEQ ID NO: 640492 - DNA, 13 bp, D. melanogaster
taatgacaaatat

SEQ ID NO: 640493 - DNA, 15 bp, D. melanogaster
taatgacaaatattc

SEQ ID NO: 640494 - DNA, 14 bp, D. melanogaster
taatgacaatataa

SEQ ID NO: 640495 - DNA, 13 bp, D. melanogaster
taatgacaggcag

SEQ ID NO: 640496 - DNA, 13 bp, D. melanogaster
taatgacgatgat

SEQ ID NO: 640497 - DNA, 13 bp, D. melanogaster
taatgacggaagc

SEQ ID NO: 640498 - DNA, 13 bp, D. melanogaster
taatgactggagc

SEQ ID NO: 640499 - DNA, 13 bp, D. melanogaster
taatgacttttaa

SEQ ID NO: 640500 - DNA, 13 bp, D. melanogaster
taatgagattaaa

SEQ ID NO: 640501 - DNA, 13 bp, D. melanogaster
taatgagcaaatt

SEQ ID NO: 640502 - DNA, 13 bp, D. melanogaster
taatgagcacaaa

SEQ ID NO: 640503 - DNA, 13 bp, D. melanogaster
taatgagcatttt

SEQ ID NO: 640504 - DNA, 13 bp, D. melanogaster
taatgagctgcaa

SEQ ID NO: 640505 - DNA, 13 bp, D. melanogaster
taatgagctttaa

SEQ ID NO: 640506 - DNA, 13 bp, D. melanogaster
taatgagttttat

SEQ ID NO: 640507 - DNA, 13 bp, D. melanogaster
taatgagttttcc

SEQ ID NO: 640508 - DNA, 13 bp, D. melanogaster
taatgataatgct

SEQ ID NO: 640509 - DNA, 13 bp, D. melanogaster
taatgatcaaaaa

SEQ ID NO: 640510 - DNA, 14 bp, D. melanogaster
taatgatcaaaaat

SEQ ID NO: 640511 - DNA, 13 bp, D. melanogaster
taatgatcaattt

SEQ ID NO: 640512 - DNA, 13 bp, D. melanogaster
taatgatcttaaa

SEQ ID NO: 640513 - DNA, 13 bp, D. melanogaster
taatgatgaactc

SEQ ID NO: 640514 - DNA, 13 bp, D. melanogaster
taatgatgagttt

SEQ ID NO: 640515 - DNA, 13 bp, D. melanogaster
taatgatgataaa

SEQ ID NO: 640516 - DNA, 13 bp, D. melanogaster
taatgatgatgaa

SEQ ID NO: 640517 - DNA, 14 bp, D. melanogaster
taatgatgatgatg

SEQ ID NO: 640518 - DNA, 13 bp, D. melanogaster
taatgatgattgc

SEQ ID NO: 640519 - DNA, 13 bp, D. melanogaster
taatgatggaaaa

SEQ ID NO: 640520 - DNA, 13 bp, D. melanogaster
taatgattaatga

SEQ ID NO: 640521 - DNA, 13 bp, D. melanogaster
taatgattccaaa

SEQ ID NO: 640522 - DNA, 14 bp, D. melanogaster
taatgattccaaag

SEQ ID NO: 640523 - DNA, 13 bp, D. melanogaster
taatgattccgat

SEQ ID NO: 640524 - DNA, 14 bp, D. melanogaster
taatgatttcaatt

SEQ ID NO: 640525 - DNA, 13 bp, D. melanogaster
taatgattttgaa

SEQ ID NO: 640526 - DNA, 13 bp, D. melanogaster
taatgatttttct

SEQ ID NO: 640527 - DNA, 13 bp, D. melanogaster
taatgcaaaaaac

SEQ ID NO: 640528 - DNA, 13 bp, D. melanogaster
taatgcaaaagaa

SEQ ID NO: 640529 - DNA, 13 bp, D. melanogaster
taatgcaaaattc

SEQ ID NO: 640530 - DNA, 14 bp, D. melanogaster
taatgcaaagataa

SEQ ID NO: 640531 - DNA, 13 bp, D. melanogaster
taatgcaaataaa

SEQ ID NO: 640532 - DNA, 14 bp, D. melanogaster
taatgcaaatattt

SEQ ID NO: 640533 - DNA, 13 bp, D. melanogaster
taatgcaaatgca

SEQ ID NO: 640534 - DNA, 13 bp, D. melanogaster
taatgcaaatgtt

SEQ ID NO: 640535 - DNA, 13 bp, D. melanogaster
taatgcaaattaa

SEQ ID NO: 640536 - DNA, 13 bp, D. melanogaster
taatgcaaatttg

SEQ ID NO: 640537 - DNA, 13 bp, D. melanogaster
taatgcaacaaaa

SEQ ID NO: 640538 - DNA, 13 bp, D. melanogaster
taatgcaacaaat

SEQ ID NO: 640539 - DNA, 13 bp, D. melanogaster
taatgcaataata

SEQ ID NO: 640540 - DNA, 13 bp, D. melanogaster
taatgcaatcaat

SEQ ID NO: 640541 - DNA, 13 bp, D. melanogaster
taatgcaattaat

SEQ ID NO: 640542 - DNA, 13 bp, D. melanogaster
taatgcaattgca

SEQ ID NO: 640543 - DNA, 14 bp, D. melanogaster
taatgcaatttaaa

SEQ ID NO: 640544 - DNA, 13 bp, D. melanogaster
taatgcaatttta

SEQ ID NO: 640545 - DNA, 13 bp, D. melanogaster
taatgcagcaata

SEQ ID NO: 640546 - DNA, 14 bp, D. melanogaster
taatgcagcgccaa

SEQ ID NO: 640547 - DNA, 13 bp, D. melanogaster
taatgcataatta

SEQ ID NO: 640548 - DNA, 14 bp, D. melanogaster
taatgcataattta

SEQ ID NO: 640549 - DNA, 13 bp, D. melanogaster
taatgcatatata

SEQ ID NO: 640550 - DNA, 13 bp, D. melanogaster
taatgcatattta

SEQ ID NO: 640551 - DNA, 13 bp, D. melanogaster
taatgcatatttt

SEQ ID NO: 640552 - DNA, 13 bp, D. melanogaster
taatgcattattt

SEQ ID NO: 640553 - DNA, 13 bp, D. melanogaster
taatgcatttaag

SEQ ID NO: 640554 - DNA, 13 bp, D. melanogaster
taatgcatttcat

SEQ ID NO: 640555 - DNA, 13 bp, D. melanogaster
taatgcattttgt

SEQ ID NO: 640556 - DNA, 13 bp, D. melanogaster
taatgccaaaagt

SEQ ID NO: 640557 - DNA, 13 bp, D. melanogaster
taatgccaactaa

SEQ ID NO: 640558 - DNA, 13 bp, D. melanogaster
taatgccaactta

SEQ ID NO: 640559 - DNA, 13 bp, D. melanogaster
taatgccaataaa

SEQ ID NO: 640560 - DNA, 13 bp, D. melanogaster
taatgccacttaa

SEQ ID NO: 640561 - DNA, 13 bp, D. melanogaster
taatgccagcaat

SEQ ID NO: 640562 - DNA, 13 bp, D. melanogaster
taatgccattttg

SEQ ID NO: 640563 - DNA, 13 bp, D. melanogaster
taatgccgtcgtt

SEQ ID NO: 640564 - DNA, 13 bp, D. melanogaster
taatgcctgtatg

SEQ ID NO: 640565 - DNA, 14 bp, D. melanogaster
taatgcgaaactat

SEQ ID NO: 640566 - DNA, 13 bp, D. melanogaster
taatgcgaatcaa

SEQ ID NO: 640567 - DNA, 13 bp, D. melanogaster
taatgcgatttaa

SEQ ID NO: 640568 - DNA, 13 bp, D. melanogaster
taatgcgattttt

SEQ ID NO: 640569 - DNA, 13 bp, D. melanogaster
taatgcgtttctg

SEQ ID NO: 640570 - DNA, 13 bp, D. melanogaster
taatgctaaatat

SEQ ID NO: 640571 - DNA, 13 bp, D. melanogaster
taatgctaataaa

SEQ ID NO: 640572 - DNA, 13 bp, D. melanogaster
taatgctaatgcc

SEQ ID NO: 640573 - DNA, 13 bp, D. melanogaster
taatgctaatgct

SEQ ID NO: 640574 - DNA, 13 bp, D. melanogaster
taatgctaattta

SEQ ID NO: 640575 - DNA, 13 bp, D. melanogaster
taatgctccattt

SEQ ID NO: 640576 - DNA, 13 bp, D. melanogaster
taatgctgaagaa

SEQ ID NO: 640577 - DNA, 14 bp, D. melanogaster
taatgctgaagaac

SEQ ID NO: 640578 - DNA, 13 bp, D. melanogaster
taatgctgctgct

SEQ ID NO: 640579 - DNA, 13 bp, D. melanogaster
taatgcttaaata

SEQ ID NO: 640580 - DNA, 14 bp, D. melanogaster
taatgctttgtaca

SEQ ID NO: 640581 - DNA, 13 bp, D. melanogaster
taatggaaaagtt

SEQ ID NO: 640582 - DNA, 13 bp, D. melanogaster
taatggaaacaga

SEQ ID NO: 640583 - DNA, 13 bp, D. melanogaster
taatggaaagttt

SEQ ID NO: 640584 - DNA, 13 bp, D. melanogaster
taatggaaattct

SEQ ID NO: 640585 - DNA, 13 bp, D. melanogaster
taatggaaattga

SEQ ID NO: 640586 - DNA, 13 bp, D. melanogaster
taatggaatatct

SEQ ID NO: 640587 - DNA, 14 bp, D. melanogaster
taatggaatatctg

SEQ ID NO: 640588 - DNA, 13 bp, D. melanogaster
taatggaatattt

SEQ ID NO: 640589 - DNA, 13 bp, D. melanogaster
taatggaatggaa

SEQ ID NO: 640590 - DNA, 13 bp, D. melanogaster
taatggaattttc

SEQ ID NO: 640591 - DNA, 13 bp, D. melanogaster
taatggagatcta

SEQ ID NO: 640592 - DNA, 13 bp, D. melanogaster
taatggagttttc

SEQ ID NO: 640593 - DNA, 13 bp, D. melanogaster
taatggataatgg

SEQ ID NO: 640594 - DNA, 13 bp, D. melanogaster
taatggatttatt

SEQ ID NO: 640595 - DNA, 13 bp, D. melanogaster
taatggcaaatta

SEQ ID NO: 640596 - DNA, 13 bp, D. melanogaster
taatggcaattaa

SEQ ID NO: 640597 - DNA, 13 bp, D. melanogaster
taatggcagaagc

SEQ ID NO: 640598 - DNA, 13 bp, D. melanogaster
taatggcattaaa

SEQ ID NO: 640599 - DNA, 13 bp, D. melanogaster
taatggcattttg

SEQ ID NO: 640600 - DNA, 13 bp, D. melanogaster
taatggccaaaat

SEQ ID NO: 640601 - DNA, 13 bp, D. melanogaster
taatggccaccaa

SEQ ID NO: 640602 - DNA, 13 bp, D. melanogaster
taatggccatctc

SEQ ID NO: 640603 - DNA, 13 bp, D. melanogaster
taatggcccaaat

SEQ ID NO: 640604 - DNA, 13 bp, D. melanogaster
taatggcttttgt

SEQ ID NO: 640605 - DNA, 13 bp, D. melanogaster
taatgggaataat

SEQ ID NO: 640606 - DNA, 13 bp, D. melanogaster
taatgggcaaacg

SEQ ID NO: 640607 - DNA, 13 bp, D. melanogaster
taatgggtataat

SEQ ID NO: 640608 - DNA, 13 bp, D. melanogaster
taatggtaataaa

SEQ ID NO: 640609 - DNA, 13 bp, D. melanogaster
taatggtaatggt

SEQ ID NO: 640610 - DNA, 13 bp, D. melanogaster
taatggtcaatat

SEQ ID NO: 640611 - DNA, 13 bp, D. melanogaster
taatggttacaat

SEQ ID NO: 640612 - DNA, 13 bp, D. melanogaster
taatgtaaatgtt

SEQ ID NO: 640613 - DNA, 13 bp, D. melanogaster
taatgtaataatg

SEQ ID NO: 640614 - DNA, 13 bp, D. melanogaster
taatgtaatgaaa

SEQ ID NO: 640615 - DNA, 13 bp, D. melanogaster
taatgtaatgaat

SEQ ID NO: 640616 - DNA, 14 bp, D. melanogaster
taatgtaatgtaat

SEQ ID NO: 640617 - DNA, 13 bp, D. melanogaster
taatgtacataat

SEQ ID NO: 640618 - DNA, 13 bp, D. melanogaster
taatgtacataca

SEQ ID NO: 640619 - DNA, 13 bp, D. melanogaster
taatgtagtaagg

SEQ ID NO: 640620 - DNA, 13 bp, D. melanogaster
taatgtatataca

SEQ ID NO: 640621 - DNA, 14 bp, D. melanogaster
taatgtatgtatat

SEQ ID NO: 640622 - DNA, 14 bp, D. melanogaster
taatgtcaaaaata

SEQ ID NO: 640623 - DNA, 13 bp, D. melanogaster
taatgtcagcatt

SEQ ID NO: 640624 - DNA, 13 bp, D. melanogaster
taatgtccgaaac

SEQ ID NO: 640625 - DNA, 14 bp, D. melanogaster
taatgtcgcttgtt

SEQ ID NO: 640626 - DNA, 13 bp, D. melanogaster
taatgtgaaaaat

SEQ ID NO: 640627 - DNA, 13 bp, D. melanogaster
taatgtgaaaagt

SEQ ID NO: 640628 - DNA, 13 bp, D. melanogaster
taatgtgaaaatt

SEQ ID NO: 640629 - DNA, 13 bp, D. melanogaster
taatgtgaaataa

SEQ ID NO: 640630 - DNA, 13 bp, D. melanogaster
taatgtgaattta

SEQ ID NO: 640631 - DNA, 14 bp, D. melanogaster
taatgtgcatttta

SEQ ID NO: 640632 - DNA, 13 bp, D. melanogaster
taatgtggaactt

SEQ ID NO: 640633 - DNA, 13 bp, D. melanogaster
taatgtggccttc

SEQ ID NO: 640634 - DNA, 13 bp, D. melanogaster
taatgtgtaattt

SEQ ID NO: 640635 - DNA, 13 bp, D. melanogaster
taatgtgtttttc

SEQ ID NO: 640636 - DNA, 14 bp, D. melanogaster
taatgttaatgtta

SEQ ID NO: 640637 - DNA, 13 bp, D. melanogaster
taatgttaattca

SEQ ID NO: 640638 - DNA, 13 bp, D. melanogaster
taatgttagacaa

SEQ ID NO: 640639 - DNA, 13 bp, D. melanogaster
taatgttcaatgt

SEQ ID NO: 640640 - DNA, 13 bp, D. melanogaster
taatgttggccaa

SEQ ID NO: 640641 - DNA, 13 bp, D. melanogaster
taatgtttaatgt

SEQ ID NO: 640642 - DNA, 13 bp, D. melanogaster
taatgtttacatt

SEQ ID NO: 640643 - DNA, 13 bp, D. melanogaster
taatgtttactta

SEQ ID NO: 640644 - DNA, 13 bp, D. melanogaster
taatgttttcata

SEQ ID NO: 640645 - DNA, 14 bp, D. melanogaster
taatgttttcattt

SEQ ID NO: 640646 - DNA, 13 bp, D. melanogaster
taattaaaaacgc

SEQ ID NO: 640647 - DNA, 13 bp, D. melanogaster
taattaaaaatgc

SEQ ID NO: 640648 - DNA, 14 bp, D. melanogaster
taattaaaacgaaa

SEQ ID NO: 640649 - DNA, 13 bp, D. melanogaster
taattaaaactca

SEQ ID NO: 640650 - DNA, 13 bp, D. melanogaster
taattaaaactga

SEQ ID NO: 640651 - DNA, 13 bp, D. melanogaster
taattaaaactgc

SEQ ID NO: 640652 - DNA, 13 bp, D. melanogaster
taattaaaagcaa

SEQ ID NO: 640653 - DNA, 13 bp, D. melanogaster
taattaaaagcat

SEQ ID NO: 640654 - DNA, 13 bp, D. melanogaster
taattaaaagcca

SEQ ID NO: 640655 - DNA, 14 bp, D. melanogaster
taattaaaagccaa

SEQ ID NO: 640656 - DNA, 13 bp, D. melanogaster
taattaaaatcct

SEQ ID NO: 640657 - DNA, 13 bp, D. melanogaster
taattaaaatgca

SEQ ID NO: 640658 - DNA, 14 bp, D. melanogaster
taattaaaatgcaa

SEQ ID NO: 640659 - DNA, 14 bp, D. melanogaster
taattaaaatgcat

SEQ ID NO: 640660 - DNA, 13 bp, D. melanogaster
taattaaaatgct

SEQ ID NO: 640661 - DNA, 14 bp, D. melanogaster
taattaaaatgctg

SEQ ID NO: 640662 - DNA, 13 bp, D. melanogaster
taattaaacagaa

SEQ ID NO: 640663 - DNA, 14 bp, D. melanogaster
taattaaacgaaat

SEQ ID NO: 640664 - DNA, 13 bp, D. melanogaster
taattaaacgcaa

SEQ ID NO: 640665 - DNA, 13 bp, D. melanogaster
taattaaacgctt

SEQ ID NO: 640666 - DNA, 13 bp, D. melanogaster
taattaaagaagt

SEQ ID NO: 640667 - DNA, 13 bp, D. melanogaster
taattaaagacaa

SEQ ID NO: 640668 - DNA, 14 bp, D. melanogaster
taattaaagcaaat

SEQ ID NO: 640669 - DNA, 13 bp, D. melanogaster
taattaaagcagc

SEQ ID NO: 640670 - DNA, 13 bp, D. melanogaster
taattaaagcgaa

SEQ ID NO: 640671 - DNA, 13 bp, D. melanogaster
taattaaagctat

SEQ ID NO: 640672 - DNA, 13 bp, D. melanogaster
taattaaagtgtt

SEQ ID NO: 640673 - DNA, 13 bp, D. melanogaster
taattaaagtttg

SEQ ID NO: 640674 - DNA, 13 bp, D. melanogaster
taattaaatccaa

SEQ ID NO: 640675 - DNA, 13 bp, D. melanogaster
taattaaatgaac

SEQ ID NO: 640676 - DNA, 14 bp, D. melanogaster
taattaaatgcaaa

SEQ ID NO: 640677 - DNA, 14 bp, D. melanogaster
taattaaatgcaat

SEQ ID NO: 640678 - DNA, 13 bp, D. melanogaster
taattaaatgcgc

SEQ ID NO: 640679 - DNA, 13 bp, D. melanogaster
taattaaatgctg

SEQ ID NO: 640680 - DNA, 13 bp, D. melanogaster
taattaaatggaa

SEQ ID NO: 640681 - DNA, 13 bp, D. melanogaster
taattaaatggat

SEQ ID NO: 640682 - DNA, 13 bp, D. melanogaster
taattaaatgtgc

SEQ ID NO: 640683 - DNA, 13 bp, D. melanogaster
taattaaatgtgt

SEQ ID NO: 640684 - DNA, 14 bp, D. melanogaster
taattaaattaagc

SEQ ID NO: 640685 - DNA, 13 bp, D. melanogaster
taattaacaattg

SEQ ID NO: 640686 - DNA, 13 bp, D. melanogaster
taattaacacttt

SEQ ID NO: 640687 - DNA, 13 bp, D. melanogaster
taattaaccaatt

SEQ ID NO: 640688 - DNA, 13 bp, D. melanogaster
taattaacgtaaa

SEQ ID NO: 640689 - DNA, 15 bp, D. melanogaster
taattaacgtaaaca

SEQ ID NO: 640690 - DNA, 14 bp, D. melanogaster
taattaactaaact

SEQ ID NO: 640691 - DNA, 13 bp, D. melanogaster
taattaactgaat

SEQ ID NO: 640692 - DNA, 13 bp, D. melanogaster
taattaacttcat

SEQ ID NO: 640693 - DNA, 13 bp, D. melanogaster
taattaagaaact

SEQ ID NO: 640694 - DNA, 13 bp, D. melanogaster
taattaagattga

SEQ ID NO: 640695 - DNA, 14 bp, D. melanogaster
taattaagcaaaaa

SEQ ID NO: 640696 - DNA, 13 bp, D. melanogaster
taattaagcactt

SEQ ID NO: 640697 - DNA, 13 bp, D. melanogaster
taattaagctaaa

SEQ ID NO: 640698 - DNA, 13 bp, D. melanogaster
taattaagcttaa

SEQ ID NO: 640699 - DNA, 13 bp, D. melanogaster
taattaagtgaat

SEQ ID NO: 640700 - DNA, 13 bp, D. melanogaster
taattaagtgcaa

SEQ ID NO: 640701 - DNA, 13 bp, D. melanogaster
taattaataactg

SEQ ID NO: 640702 - DNA, 14 bp, D. melanogaster
taattaataactga

SEQ ID NO: 640703 - DNA, 13 bp, D. melanogaster
taattaatagcca

SEQ ID NO: 640704 - DNA, 13 bp, D. melanogaster
taattaatcacaa

SEQ ID NO: 640705 - DNA, 14 bp, D. melanogaster
taattaatgcaatt

SEQ ID NO: 640706 - DNA, 13 bp, D. melanogaster
taattaatgccaa

SEQ ID NO: 640707 - DNA, 13 bp, D. melanogaster
taattaatggaaa

SEQ ID NO: 640708 - DNA, 13 bp, D. melanogaster
taattaatggcaa

SEQ ID NO: 640709 - DNA, 13 bp, D. melanogaster
taattaatggcca

SEQ ID NO: 640710 - DNA, 13 bp, D. melanogaster
taattaattagct

SEQ ID NO: 640711 - DNA, 13 bp, D. melanogaster
taattaattgcca

SEQ ID NO: 640712 - DNA, 13 bp, D. melanogaster
taattaatttcca

SEQ ID NO: 640713 - DNA, 13 bp, D. melanogaster
taattaatttcgt

SEQ ID NO: 640714 - DNA, 13 bp, D. melanogaster
taattaatttgtg

SEQ ID NO: 640715 - DNA, 13 bp, D. melanogaster
taattacaaactc

SEQ ID NO: 640716 - DNA, 13 bp, D. melanogaster
taattacaaatgt

SEQ ID NO: 640717 - DNA, 13 bp, D. melanogaster
taattacaattac

SEQ ID NO: 640718 - DNA, 13 bp, D. melanogaster
taattacaatttg

SEQ ID NO: 640719 - DNA, 13 bp, D. melanogaster
taattacacaata

SEQ ID NO: 640720 - DNA, 13 bp, D. melanogaster
taattacacattt

SEQ ID NO: 640721 - DNA, 13 bp, D. melanogaster
taattacactttc

SEQ ID NO: 640722 - DNA, 13 bp, D. melanogaster
taattacagcaaa

SEQ ID NO: 640723 - DNA, 13 bp, D. melanogaster
taattacatttac

SEQ ID NO: 640724 - DNA, 13 bp, D. melanogaster
taattacattttg

SEQ ID NO: 640725 - DNA, 13 bp, D. melanogaster
taattaccataaa

SEQ ID NO: 640726 - DNA, 13 bp, D. melanogaster
taattaccatatt

SEQ ID NO: 640727 - DNA, 13 bp, D. melanogaster
taattaccattgc

SEQ ID NO: 640728 - DNA, 13 bp, D. melanogaster
taattaccattta

SEQ ID NO: 640729 - DNA, 13 bp, D. melanogaster
taattaccgcatt

SEQ ID NO: 640730 - DNA, 13 bp, D. melanogaster
taattacgaaaaa

SEQ ID NO: 640731 - DNA, 13 bp, D. melanogaster
taattacgaattt

SEQ ID NO: 640732 - DNA, 13 bp, D. melanogaster
taattactatagt

SEQ ID NO: 640733 - DNA, 14 bp, D. melanogaster
taattactatagtc

SEQ ID NO: 640734 - DNA, 13 bp, D. melanogaster
taattactgtcca

SEQ ID NO: 640735 - DNA, 13 bp, D. melanogaster
taattacttcaca

SEQ ID NO: 640736 - DNA, 13 bp, D. melanogaster
taattacttttgc

SEQ ID NO: 640737 - DNA, 13 bp, D. melanogaster
taattagaaaagt

SEQ ID NO: 640738 - DNA, 13 bp, D. melanogaster
taattagaccaaa

SEQ ID NO: 640739 - DNA, 13 bp, D. melanogaster
taattagatccta

SEQ ID NO: 640740 - DNA, 13 bp, D. melanogaster
taattagctaaaa

SEQ ID NO: 640741 - DNA, 13 bp, D. melanogaster
taattagctgcaa

SEQ ID NO: 640742 - DNA, 13 bp, D. melanogaster
taattagctttaa

SEQ ID NO: 640743 - DNA, 13 bp, D. melanogaster
taattaggcaaaa

SEQ ID NO: 640744 - DNA, 13 bp, D. melanogaster
taattaggtattt

SEQ ID NO: 640745 - DNA, 14 bp, D. melanogaster
taattaggtattta

SEQ ID NO: 640746 - DNA, 13 bp, D. melanogaster
taattaggttgtt

SEQ ID NO: 640747 - DNA, 13 bp, D. melanogaster
taattagtcatgt

SEQ ID NO: 640748 - DNA, 13 bp, D. melanogaster
taattagtgaaaa

SEQ ID NO: 640749 - DNA, 13 bp, D. melanogaster
taattagttaagt

SEQ ID NO: 640750 - DNA, 13 bp, D. melanogaster
taattagttgcaa

SEQ ID NO: 640751 - DNA, 13 bp, D. melanogaster
taattagtttaca

SEQ ID NO: 640752 - DNA, 13 bp, D. melanogaster
taattagttttca

SEQ ID NO: 640753 - DNA, 13 bp, D. melanogaster
taattagttttgc

SEQ ID NO: 640754 - DNA, 13 bp, D. melanogaster
taattatacaaac

SEQ ID NO: 640755 - DNA, 13 bp, D. melanogaster
taattataccttt

SEQ ID NO: 640756 - DNA, 14 bp, D. melanogaster
taattatagacgtt

SEQ ID NO: 640757 - DNA, 13 bp, D. melanogaster
taattatatgcaa

SEQ ID NO: 640758 - DNA, 13 bp, D. melanogaster
taattatattcga

SEQ ID NO: 640759 - DNA, 13 bp, D. melanogaster
taattatatttgc

SEQ ID NO: 640760 - DNA, 13 bp, D. melanogaster
taattatgaaact

SEQ ID NO: 640761 - DNA, 13 bp, D. melanogaster
taattatgatgat

SEQ ID NO: 640762 - DNA, 13 bp, D. melanogaster
taattatgcaaat

SEQ ID NO: 640763 - DNA, 13 bp, D. melanogaster
taattatgcacat

SEQ ID NO: 640764 - DNA, 13 bp, D. melanogaster
taattatgccaaa

SEQ ID NO: 640765 - DNA, 13 bp, D. melanogaster
taattatgctaat

SEQ ID NO: 640766 - DNA, 13 bp, D. melanogaster
taattatggcaaa

SEQ ID NO: 640767 - DNA, 13 bp, D. melanogaster
taattatggttat

SEQ ID NO: 640768 - DNA, 13 bp, D. melanogaster
taattatgtcatt

SEQ ID NO: 640769 - DNA, 13 bp, D. melanogaster
taattattgaatg

SEQ ID NO: 640770 - DNA, 13 bp, D. melanogaster
taattattgattg

SEQ ID NO: 640771 - DNA, 13 bp, D. melanogaster
taattattgcact

SEQ ID NO: 640772 - DNA, 13 bp, D. melanogaster
taattattgcttt

SEQ ID NO: 640773 - DNA, 13 bp, D. melanogaster
taattattgtcca

SEQ ID NO: 640774 - DNA, 14 bp, D. melanogaster
taattattgtccat

SEQ ID NO: 640775 - DNA, 13 bp, D. melanogaster
taattattttccc

SEQ ID NO: 640776 - DNA, 13 bp, D. melanogaster
taattattttgca

SEQ ID NO: 640777 - DNA, 13 bp, D. melanogaster
taattcaaaatgt

SEQ ID NO: 640778 - DNA, 14 bp, D. melanogaster
taattcaaaccgat

SEQ ID NO: 640779 - DNA, 13 bp, D. melanogaster
taattcaaagtta

SEQ ID NO: 640780 - DNA, 13 bp, D. melanogaster
taattcaaatgca

SEQ ID NO: 640781 - DNA, 14 bp, D. melanogaster
taattcaaattcaa

SEQ ID NO: 640782 - DNA, 14 bp, D. melanogaster
taattcaataaaag

SEQ ID NO: 640783 - DNA, 13 bp, D. melanogaster
taattcaatcaaa

SEQ ID NO: 640784 - DNA, 13 bp, D. melanogaster
taattcaatcaat

SEQ ID NO: 640785 - DNA, 13 bp, D. melanogaster
taattcaatgcaa

SEQ ID NO: 640786 - DNA, 13 bp, D. melanogaster
taattcaattatg

SEQ ID NO: 640787 - DNA, 13 bp, D. melanogaster
taattcaatttac

SEQ ID NO: 640788 - DNA, 13 bp, D. melanogaster
taattcaatttga

SEQ ID NO: 640789 - DNA, 13 bp, D. melanogaster
taattcaatttgc

SEQ ID NO: 640790 - DNA, 13 bp, D. melanogaster
taattcacaaatt

SEQ ID NO: 640791 - DNA, 13 bp, D. melanogaster
taattcacacaat

SEQ ID NO: 640792 - DNA, 13 bp, D. melanogaster
taattcataaatg

SEQ ID NO: 640793 - DNA, 13 bp, D. melanogaster
taattcatatgga

SEQ ID NO: 640794 - DNA, 13 bp, D. melanogaster
taattcattcaat

SEQ ID NO: 640795 - DNA, 14 bp, D. melanogaster
taattcattcataa

SEQ ID NO: 640796 - DNA, 13 bp, D. melanogaster
taattcattccaa

SEQ ID NO: 640797 - DNA, 13 bp, D. melanogaster
taattcatttcct

SEQ ID NO: 640798 - DNA, 13 bp, D. melanogaster
taattccaaattt

SEQ ID NO: 640799 - DNA, 13 bp, D. melanogaster
taattccaattta

SEQ ID NO: 640800 - DNA, 13 bp, D. melanogaster
taattccacaatt

SEQ ID NO: 640801 - DNA, 13 bp, D. melanogaster
taattccataaat

SEQ ID NO: 640802 - DNA, 13 bp, D. melanogaster
taattccatttga

SEQ ID NO: 640803 - DNA, 14 bp, D. melanogaster
taattccttaccca

SEQ ID NO: 640804 - DNA, 13 bp, D. melanogaster
taattcgaaaata

SEQ ID NO: 640805 - DNA, 13 bp, D. melanogaster
taattcgaaatat

SEQ ID NO: 640806 - DNA, 13 bp, D. melanogaster
taattcgaaatta

SEQ ID NO: 640807 - DNA, 13 bp, D. melanogaster
taattcgaatcaa

SEQ ID NO: 640808 - DNA, 13 bp, D. melanogaster
taattcgaatttg

SEQ ID NO: 640809 - DNA, 13 bp, D. melanogaster
taattcgattaaa

SEQ ID NO: 640810 - DNA, 13 bp, D. melanogaster
taattcgcatttt

SEQ ID NO: 640811 - DNA, 13 bp, D. melanogaster
taattcgtatttt

SEQ ID NO: 640812 - DNA, 13 bp, D. melanogaster
taattcgttttta

SEQ ID NO: 640813 - DNA, 13 bp, D. melanogaster
taattcttcggaa

SEQ ID NO: 640814 - DNA, 13 bp, D. melanogaster
taattgaaaaatg

SEQ ID NO: 640815 - DNA, 14 bp, D. melanogaster
taattgaaaaatgc

SEQ ID NO: 640816 - DNA, 14 bp, D. melanogaster
taattgaaaacttt

SEQ ID NO: 640817 - DNA, 13 bp, D. melanogaster
taattgaaaatca

SEQ ID NO: 640818 - DNA, 14 bp, D. melanogaster
taattgaaaatcaa

SEQ ID NO: 640819 - DNA, 14 bp, D. melanogaster
taattgaaaatgtt

SEQ ID NO: 640820 - DNA, 13 bp, D. melanogaster
taattgaaaattc

SEQ ID NO: 640821 - DNA, 14 bp, D. melanogaster
taattgaaaattca

SEQ ID NO: 640822 - DNA, 13 bp, D. melanogaster
taattgaaaattg

SEQ ID NO: 640823 - DNA, 14 bp, D. melanogaster
taattgaaacaatt

SEQ ID NO: 640824 - DNA, 13 bp, D. melanogaster
taattgaaacaca

SEQ ID NO: 640825 - DNA, 13 bp, D. melanogaster
taattgaaagcaa

SEQ ID NO: 640826 - DNA, 13 bp, D. melanogaster
taattgaaagcat

SEQ ID NO: 640827 - DNA, 14 bp, D. melanogaster
taattgaaatattc

SEQ ID NO: 640828 - DNA, 13 bp, D. melanogaster
taattgaaatcaa

SEQ ID NO: 640829 - DNA, 13 bp, D. melanogaster
taattgaaatgcc

SEQ ID NO: 640830 - DNA, 13 bp, D. melanogaster
taattgaaatgtt

SEQ ID NO: 640831 - DNA, 14 bp, D. melanogaster
taattgaaatttca

SEQ ID NO: 640832 - DNA, 13 bp, D. melanogaster
taattgaacataa

SEQ ID NO: 640833 - DNA, 13 bp, D. melanogaster
taattgaagaatt

SEQ ID NO: 640834 - DNA, 13 bp, D. melanogaster
taattgaagttta

SEQ ID NO: 640835 - DNA, 13 bp, D. melanogaster
taattgaataaac

SEQ ID NO: 640836 - DNA, 13 bp, D. melanogaster
taattgaatcgaa

SEQ ID NO: 640837 - DNA, 13 bp, D. melanogaster
taattgaatcgat

SEQ ID NO: 640838 - DNA, 13 bp, D. melanogaster
taattgaatgaat

SEQ ID NO: 640839 - DNA, 13 bp, D. melanogaster
taattgaatgttg

SEQ ID NO: 640840 - DNA, 13 bp, D. melanogaster
taattgaattact

SEQ ID NO: 640841 - DNA, 13 bp, D. melanogaster
taattgaattgaa

SEQ ID NO: 640842 - DNA, 14 bp, D. melanogaster
taattgaattgaat

SEQ ID NO: 640843 - DNA, 13 bp, D. melanogaster
taattgaattgca

SEQ ID NO: 640844 - DNA, 13 bp, D. melanogaster
taattgaattgct

SEQ ID NO: 640845 - DNA, 13 bp, D. melanogaster
taattgaattggc

SEQ ID NO: 640846 - DNA, 14 bp, D. melanogaster
taattgaatttgaa

SEQ ID NO: 640847 - DNA, 13 bp, D. melanogaster
taattgaatttgt

SEQ ID NO: 640848 - DNA, 13 bp, D. melanogaster
taattgacaattt

SEQ ID NO: 640849 - DNA, 13 bp, D. melanogaster
taattgactttaa

SEQ ID NO: 640850 - DNA, 14 bp, D. melanogaster
taattgactttatt

SEQ ID NO: 640851 - DNA, 14 bp, D. melanogaster
taattgacttttaa

SEQ ID NO: 640852 - DNA, 13 bp, D. melanogaster
taattgagtacaa

SEQ ID NO: 640853 - DNA, 13 bp, D. melanogaster
taattgatacgaa

SEQ ID NO: 640854 - DNA, 13 bp, D. melanogaster
taattgatatatg

SEQ ID NO: 640855 - DNA, 13 bp, D. melanogaster
taattgatcaatt

SEQ ID NO: 640856 - DNA, 13 bp, D. melanogaster
taattgatgaaaa

SEQ ID NO: 640857 - DNA, 13 bp, D. melanogaster
taattgatgaata

SEQ ID NO: 640858 - DNA, 13 bp, D. melanogaster
taattgatggcca

SEQ ID NO: 640859 - DNA, 13 bp, D. melanogaster
taattgattaatg

SEQ ID NO: 640860 - DNA, 13 bp, D. melanogaster
taattgattgatt

SEQ ID NO: 640861 - DNA, 13 bp, D. melanogaster
taattgattgctt

SEQ ID NO: 640862 - DNA, 13 bp, D. melanogaster
taattgatttcaa

SEQ ID NO: 640863 - DNA, 13 bp, D. melanogaster
taattgatttgta

SEQ ID NO: 640864 - DNA, 14 bp, D. melanogaster
taattgattttcaa

SEQ ID NO: 640865 - DNA, 13 bp, D. melanogaster
taattgattttcc

SEQ ID NO: 640866 - DNA, 13 bp, D. melanogaster
taattgattttct

SEQ ID NO: 640867 - DNA, 13 bp, D. melanogaster
taattgcaaaaca

SEQ ID NO: 640868 - DNA, 13 bp, D. melanogaster
taattgcaaaatt

SEQ ID NO: 640869 - DNA, 13 bp, D. melanogaster
taattgcaaatat

SEQ ID NO: 640870 - DNA, 13 bp, D. melanogaster
taattgcaataaa

SEQ ID NO: 640871 - DNA, 13 bp, D. melanogaster
taattgcaatcaa

SEQ ID NO: 640872 - DNA, 14 bp, D. melanogaster
taattgcaattaaa

SEQ ID NO: 640873 - DNA, 14 bp, D. melanogaster
taattgcaattgaa

SEQ ID NO: 640874 - DNA, 13 bp, D. melanogaster
taattgcaattta

SEQ ID NO: 640875 - DNA, 14 bp, D. melanogaster
taattgcaatttgt

SEQ ID NO: 640876 - DNA, 13 bp, D. melanogaster
taattgcacaaaa

SEQ ID NO: 640877 - DNA, 13 bp, D. melanogaster
taattgcactttg

SEQ ID NO: 640878 - DNA, 13 bp, D. melanogaster
taattgcataatt

SEQ ID NO: 640879 - DNA, 13 bp, D. melanogaster
taattgcatattt

SEQ ID NO: 640880 - DNA, 14 bp, D. melanogaster
taattgcatatttt

SEQ ID NO: 640881 - DNA, 13 bp, D. melanogaster
taattgcattatt

SEQ ID NO: 640882 - DNA, 14 bp, D. melanogaster
taattgcatttaat

SEQ ID NO: 640883 - DNA, 13 bp, D. melanogaster
taattgcatttgt

SEQ ID NO: 640884 - DNA, 13 bp, D. melanogaster
taattgcattttt

SEQ ID NO: 640885 - DNA, 13 bp, D. melanogaster
taattgccaaaag

SEQ ID NO: 640886 - DNA, 13 bp, D. melanogaster
taattgccaacat

SEQ ID NO: 640887 - DNA, 13 bp, D. melanogaster
taattgccaagaa

SEQ ID NO: 640888 - DNA, 14 bp, D. melanogaster
taattgccaagaat

SEQ ID NO: 640889 - DNA, 13 bp, D. melanogaster
taattgccaattg

SEQ ID NO: 640890 - DNA, 13 bp, D. melanogaster
taattgccagcaa

SEQ ID NO: 640891 - DNA, 13 bp, D. melanogaster
taattgccagtgg

SEQ ID NO: 640892 - DNA, 13 bp, D. melanogaster
taattgccattgt

SEQ ID NO: 640893 - DNA, 13 bp, D. melanogaster
taattgccatttt

SEQ ID NO: 640894 - DNA, 13 bp, D. melanogaster
taattgccggcaa

SEQ ID NO: 640895 - DNA, 13 bp, D. melanogaster
taattgccggcca

SEQ ID NO: 640896 - DNA, 13 bp, D. melanogaster
taattgcctgaat

SEQ ID NO: 640897 - DNA, 13 bp, D. melanogaster
taattgcgcaatt

SEQ ID NO: 640898 - DNA, 13 bp, D. melanogaster
taattgcgctgtt

SEQ ID NO: 640899 - DNA, 13 bp, D. melanogaster
taattgcgtttta

SEQ ID NO: 640900 - DNA, 13 bp, D. melanogaster
taattgcgttttt

SEQ ID NO: 640901 - DNA, 13 bp, D. melanogaster
taattgctaatta

SEQ ID NO: 640902 - DNA, 13 bp, D. melanogaster
taattgctcaatt

SEQ ID NO: 640903 - DNA, 13 bp, D. melanogaster
taattgctggcca

SEQ ID NO: 640904 - DNA, 13 bp, D. melanogaster
taattgctgtttt

SEQ ID NO: 640905 - DNA, 13 bp, D. melanogaster
taattgcttcaat

SEQ ID NO: 640906 - DNA, 13 bp, D. melanogaster
taattgctttcat

SEQ ID NO: 640907 - DNA, 13 bp, D. melanogaster
taattgctttgca

SEQ ID NO: 640908 - DNA, 13 bp, D. melanogaster
taattgcttttgc

SEQ ID NO: 640909 - DNA, 13 bp, D. melanogaster
taattggaaaaca

SEQ ID NO: 640910 - DNA, 13 bp, D. melanogaster
taattggagttca

SEQ ID NO: 640911 - DNA, 13 bp, D. melanogaster
taattggatttaa

SEQ ID NO: 640912 - DNA, 13 bp, D. melanogaster
taattggcaattg

SEQ ID NO: 640913 - DNA, 13 bp, D. melanogaster
taattggccaaaa

SEQ ID NO: 640914 - DNA, 13 bp, D. melanogaster
taattggctttaa

SEQ ID NO: 640915 - DNA, 13 bp, D. melanogaster
taattggctttta

SEQ ID NO: 640916 - DNA, 13 bp, D. melanogaster
taattgggatttt

SEQ ID NO: 640917 - DNA, 13 bp, D. melanogaster
taattggtattta

SEQ ID NO: 640918 - DNA, 13 bp, D. melanogaster
taattggtccgat

SEQ ID NO: 640919 - DNA, 13 bp, D. melanogaster
taattggttaatt

SEQ ID NO: 640920 - DNA, 13 bp, D. melanogaster
taattggtttaat

SEQ ID NO: 640921 - DNA, 13 bp, D. melanogaster
taattgtaaacat

SEQ ID NO: 640922 - DNA, 13 bp, D. melanogaster
taattgtaaatga

SEQ ID NO: 640923 - DNA, 13 bp, D. melanogaster
taattgtaagcat

SEQ ID NO: 640924 - DNA, 13 bp, D. melanogaster
taattgtaattgc

SEQ ID NO: 640925 - DNA, 13 bp, D. melanogaster
taattgtaattgt

SEQ ID NO: 640926 - DNA, 13 bp, D. melanogaster
taattgtacaaat

SEQ ID NO: 640927 - DNA, 13 bp, D. melanogaster
taattgtatatgc

SEQ ID NO: 640928 - DNA, 13 bp, D. melanogaster
taattgtattcaa

SEQ ID NO: 640929 - DNA, 13 bp, D. melanogaster
taattgtattgaa

SEQ ID NO: 640930 - DNA, 13 bp, D. melanogaster
taattgtatttca

SEQ ID NO: 640931 - DNA, 13 bp, D. melanogaster
taattgtatttcg

SEQ ID NO: 640932 - DNA, 13 bp, D. melanogaster
taattgtcagctc

SEQ ID NO: 640933 - DNA, 13 bp, D. melanogaster
taattgtccaagt

SEQ ID NO: 640934 - DNA, 13 bp, D. melanogaster
taattgtgaaata

SEQ ID NO: 640935 - DNA, 14 bp, D. melanogaster
taattgtgatttaa

SEQ ID NO: 640936 - DNA, 13 bp, D. melanogaster
taattgtgcattt

SEQ ID NO: 640937 - DNA, 14 bp, D. melanogaster
taattgtgccttta

SEQ ID NO: 640938 - DNA, 14 bp, D. melanogaster
taattgtgctttga

SEQ ID NO: 640939 - DNA, 13 bp, D. melanogaster
taattgtggcaaa

SEQ ID NO: 640940 - DNA, 13 bp, D. melanogaster
taattgtgtaaaa

SEQ ID NO: 640941 - DNA, 13 bp, D. melanogaster
taattgtgttggt

SEQ ID NO: 640942 - DNA, 13 bp, D. melanogaster
taattgttaattg

SEQ ID NO: 640943 - DNA, 14 bp, D. melanogaster
taattgttgttgct

SEQ ID NO: 640944 - DNA, 13 bp, D. melanogaster
taattgtttaatg

SEQ ID NO: 640945 - DNA, 13 bp, D. melanogaster
taatttaaaacca

SEQ ID NO: 640946 - DNA, 13 bp, D. melanogaster
taatttaaacaag

SEQ ID NO: 640947 - DNA, 13 bp, D. melanogaster
taatttaaagttg

SEQ ID NO: 640948 - DNA, 13 bp, D. melanogaster
taatttaagcttt

SEQ ID NO: 640949 - DNA, 13 bp, D. melanogaster
taatttaagtgca

SEQ ID NO: 640950 - DNA, 13 bp, D. melanogaster
taatttaagtgta

SEQ ID NO: 640951 - DNA, 13 bp, D. melanogaster
taatttaagtttg

SEQ ID NO: 640952 - DNA, 13 bp, D. melanogaster
taatttaattgca

SEQ ID NO: 640953 - DNA, 14 bp, D. melanogaster
taatttaattgcaa

SEQ ID NO: 640954 - DNA, 13 bp, D. melanogaster
taatttaattgct

SEQ ID NO: 640955 - DNA, 13 bp, D. melanogaster
taatttaatttcg

SEQ ID NO: 640956 - DNA, 13 bp, D. melanogaster
taatttacagaaa

SEQ ID NO: 640957 - DNA, 13 bp, D. melanogaster
taatttacatatg

SEQ ID NO: 640958 - DNA, 13 bp, D. melanogaster
taatttaccattt

SEQ ID NO: 640959 - DNA, 13 bp, D. melanogaster
taatttacgaaat

SEQ ID NO: 640960 - DNA, 13 bp, D. melanogaster
taatttacttttg

SEQ ID NO: 640961 - DNA, 13 bp, D. melanogaster
taatttagtgtat

SEQ ID NO: 640962 - DNA, 13 bp, D. melanogaster
taatttatatgca

SEQ ID NO: 640963 - DNA, 13 bp, D. melanogaster
taatttatatgct

SEQ ID NO: 640964 - DNA, 14 bp, D. melanogaster
taatttatgcaaat

SEQ ID NO: 640965 - DNA, 13 bp, D. melanogaster
taatttatgcaat

SEQ ID NO: 640966 - DNA, 13 bp, D. melanogaster
taatttatgcatt

SEQ ID NO: 640967 - DNA, 13 bp, D. melanogaster
taatttatggaat

SEQ ID NO: 640968 - DNA, 13 bp, D. melanogaster
taatttatggtta

SEQ ID NO: 640969 - DNA, 14 bp, D. melanogaster
taatttatgtaaac

SEQ ID NO: 640970 - DNA, 13 bp, D. melanogaster
taatttatgtgaa

SEQ ID NO: 640971 - DNA, 13 bp, D. melanogaster
taatttatgttga

SEQ ID NO: 640972 - DNA, 13 bp, D. melanogaster
taatttattcaac

SEQ ID NO: 640973 - DNA, 13 bp, D. melanogaster
taatttattcaca

SEQ ID NO: 640974 - DNA, 13 bp, D. melanogaster
taatttattgatg

SEQ ID NO: 640975 - DNA, 14 bp, D. melanogaster
taatttattgcatt

SEQ ID NO: 640976 - DNA, 13 bp, D. melanogaster
taatttatttagc

SEQ ID NO: 640977 - DNA, 13 bp, D. melanogaster
taatttatttcac

SEQ ID NO: 640978 - DNA, 13 bp, D. melanogaster
taatttatttgac

SEQ ID NO: 640979 - DNA, 14 bp, D. melanogaster
taatttatttgcca

SEQ ID NO: 640980 - DNA, 14 bp, D. melanogaster
taatttatttttgc

SEQ ID NO: 640981 - DNA, 13 bp, D. melanogaster
taatttcaaaagt

SEQ ID NO: 640982 - DNA, 13 bp, D. melanogaster
taatttcaagcaa

SEQ ID NO: 640983 - DNA, 13 bp, D. melanogaster
taatttcaatcaa

SEQ ID NO: 640984 - DNA, 13 bp, D. melanogaster
taatttcaatgat

SEQ ID NO: 640985 - DNA, 13 bp, D. melanogaster
taatttcaatttc

SEQ ID NO: 640986 - DNA, 13 bp, D. melanogaster
taatttcaatttg

SEQ ID NO: 640987 - DNA, 14 bp, D. melanogaster
taatttcaatttgt

SEQ ID NO: 640988 - DNA, 13 bp, D. melanogaster
taatttcacaaat

SEQ ID NO: 640989 - DNA, 13 bp, D. melanogaster
taatttcacaatt

SEQ ID NO: 640990 - DNA, 13 bp, D. melanogaster
taatttcacattt

SEQ ID NO: 640991 - DNA, 13 bp, D. melanogaster
taatttcagaaat

SEQ ID NO: 640992 - DNA, 13 bp, D. melanogaster
taatttcagttta

SEQ ID NO: 640993 - DNA, 13 bp, D. melanogaster
taatttcatgcaa

SEQ ID NO: 640994 - DNA, 13 bp, D. melanogaster
taatttcattcca

SEQ ID NO: 640995 - DNA, 14 bp, D. melanogaster
taatttccattaaa

SEQ ID NO: 640996 - DNA, 13 bp, D. melanogaster
taatttccattat

SEQ ID NO: 640997 - DNA, 14 bp, D. melanogaster
taatttcccatttt

SEQ ID NO: 640998 - DNA, 13 bp, D. melanogaster
taatttccctact

SEQ ID NO: 640999 - DNA, 13 bp, D. melanogaster
taatttccgaatg

SEQ ID NO: 641000 - DNA, 13 bp, D. melanogaster
taatttccgctgc

SEQ ID NO: 641001 - DNA, 13 bp, D. melanogaster
taatttcctttcc

SEQ ID NO: 641002 - DNA, 13 bp, D. melanogaster
taatttcgaaatt

SEQ ID NO: 641003 - DNA, 13 bp, D. melanogaster
taatttcgagttt

SEQ ID NO: 641004 - DNA, 13 bp, D. melanogaster
taatttcgatatt

SEQ ID NO: 641005 - DNA, 13 bp, D. melanogaster
taatttcgcaaat

SEQ ID NO: 641006 - DNA, 13 bp, D. melanogaster
taatttcggttta

SEQ ID NO: 641007 - DNA, 13 bp, D. melanogaster
taatttcgttatc

SEQ ID NO: 641008 - DNA, 13 bp, D. melanogaster
taatttcgtttaa

SEQ ID NO: 641009 - DNA, 13 bp, D. melanogaster
taatttcgtttct

SEQ ID NO: 641010 - DNA, 14 bp, D. melanogaster
taatttctatgcca

SEQ ID NO: 641011 - DNA, 13 bp, D. melanogaster
taatttctctccc

SEQ ID NO: 641012 - DNA, 13 bp, D. melanogaster
taatttctgattt

SEQ ID NO: 641013 - DNA, 13 bp, D. melanogaster
taatttctgcatt

SEQ ID NO: 641014 - DNA, 13 bp, D. melanogaster
taatttctgttaa

SEQ ID NO: 641015 - DNA, 13 bp, D. melanogaster
taatttcttagtt

SEQ ID NO: 641016 - DNA, 13 bp, D. melanogaster
taatttgaaaatg

SEQ ID NO: 641017 - DNA, 13 bp, D. melanogaster
taatttgacactt

SEQ ID NO: 641018 - DNA, 13 bp, D. melanogaster
taatttgatgaaa

SEQ ID NO: 641019 - DNA, 13 bp, D. melanogaster
taatttgattagt

SEQ ID NO: 641020 - DNA, 13 bp, D. melanogaster
taatttgatttga

SEQ ID NO: 641021 - DNA, 13 bp, D. melanogaster
taatttgcaaaaa

SEQ ID NO: 641022 - DNA, 13 bp, D. melanogaster
taatttgcacaaa

SEQ ID NO: 641023 - DNA, 13 bp, D. melanogaster
taatttgcataaa

SEQ ID NO: 641024 - DNA, 14 bp, D. melanogaster
taatttgcataaat

SEQ ID NO: 641025 - DNA, 13 bp, D. melanogaster
taatttgcataat

SEQ ID NO: 641026 - DNA, 13 bp, D. melanogaster
taatttgcatagt

SEQ ID NO: 641027 - DNA, 13 bp, D. melanogaster
taatttgcatata

SEQ ID NO: 641028 - DNA, 13 bp, D. melanogaster
taatttgcatatt

SEQ ID NO: 641029 - DNA, 13 bp, D. melanogaster
taatttgcatgcc

SEQ ID NO: 641030 - DNA, 13 bp, D. melanogaster
taatttgcatgtg

SEQ ID NO: 641031 - DNA, 13 bp, D. melanogaster
taatttgccaact

SEQ ID NO: 641032 - DNA, 13 bp, D. melanogaster
taatttgccacaa

SEQ ID NO: 641033 - DNA, 13 bp, D. melanogaster
taatttgccatcg

SEQ ID NO: 641034 - DNA, 13 bp, D. melanogaster
taatttgccattt

SEQ ID NO: 641035 - DNA, 13 bp, D. melanogaster
taatttgcccaaa

SEQ ID NO: 641036 - DNA, 13 bp, D. melanogaster
taatttgcctttc

SEQ ID NO: 641037 - DNA, 13 bp, D. melanogaster
taatttgctttgg

SEQ ID NO: 641038 - DNA, 13 bp, D. melanogaster
taatttggaaaat

SEQ ID NO: 641039 - DNA, 13 bp, D. melanogaster
taatttggaaatt

SEQ ID NO: 641040 - DNA, 14 bp, D. melanogaster
taatttggaataaa

SEQ ID NO: 641041 - DNA, 13 bp, D. melanogaster
taatttggccaag

SEQ ID NO: 641042 - DNA, 13 bp, D. melanogaster
taatttggccttt

SEQ ID NO: 641043 - DNA, 14 bp, D. melanogaster
taatttggccttta

SEQ ID NO: 641044 - DNA, 13 bp, D. melanogaster
taatttggctgcc

SEQ ID NO: 641045 - DNA, 13 bp, D. melanogaster
taatttggcttaa

SEQ ID NO: 641046 - DNA, 13 bp, D. melanogaster
taatttgtaagtt

SEQ ID NO: 641047 - DNA, 13 bp, D. melanogaster
taatttgtacaaa

SEQ ID NO: 641048 - DNA, 13 bp, D. melanogaster
taatttgtacttt

SEQ ID NO: 641049 - DNA, 14 bp, D. melanogaster
taatttgtataaac

SEQ ID NO: 641050 - DNA, 13 bp, D. melanogaster
taatttgtgctcg

SEQ ID NO: 641051 - DNA, 14 bp, D. melanogaster
taatttgtgtaaaa

SEQ ID NO: 641052 - DNA, 13 bp, D. melanogaster
taatttgttcgct

SEQ ID NO: 641053 - DNA, 13 bp, D. melanogaster
taatttgttgaat

SEQ ID NO: 641054 - DNA, 13 bp, D. melanogaster
taatttgttgctg

SEQ ID NO: 641055 - DNA, 13 bp, D. melanogaster
taatttgtttaca

SEQ ID NO: 641056 - DNA, 13 bp, D. melanogaster
taatttgtttact

SEQ ID NO: 641057 - DNA, 14 bp, D. melanogaster
taatttgtttactt

SEQ ID NO: 641058 - DNA, 13 bp, D. melanogaster
taatttgtttgaa

SEQ ID NO: 641059 - DNA, 13 bp, D. melanogaster
taatttgttttca

SEQ ID NO: 641060 - DNA, 13 bp, D. melanogaster
taattttaaaacc

SEQ ID NO: 641061 - DNA, 13 bp, D. melanogaster
taattttaaagct

SEQ ID NO: 641062 - DNA, 13 bp, D. melanogaster
taattttaagtga

SEQ ID NO: 641063 - DNA, 14 bp, D. melanogaster
taattttaagtgaa

SEQ ID NO: 641064 - DNA, 13 bp, D. melanogaster
taattttaatgca

SEQ ID NO: 641065 - DNA, 14 bp, D. melanogaster
taattttaatgcaa

SEQ ID NO: 641066 - DNA, 13 bp, D. melanogaster
taattttaattgc

SEQ ID NO: 641067 - DNA, 13 bp, D. melanogaster
taattttatgcaa

SEQ ID NO: 641068 - DNA, 13 bp, D. melanogaster
taattttatgcat

SEQ ID NO: 641069 - DNA, 13 bp, D. melanogaster
taattttatgtgc

SEQ ID NO: 641070 - DNA, 13 bp, D. melanogaster
taattttattcac

SEQ ID NO: 641071 - DNA, 13 bp, D. melanogaster
taattttattgga

SEQ ID NO: 641072 - DNA, 14 bp, D. melanogaster
taattttatttgca

SEQ ID NO: 641073 - DNA, 13 bp, D. melanogaster
taattttcaactt

SEQ ID NO: 641074 - DNA, 13 bp, D. melanogaster
taattttcaatgc

SEQ ID NO: 641075 - DNA, 13 bp, D. melanogaster
taattttcaattc

SEQ ID NO: 641076 - DNA, 13 bp, D. melanogaster
taattttcacaat

SEQ ID NO: 641077 - DNA, 14 bp, D. melanogaster
taattttcattttg

SEQ ID NO: 641078 - DNA, 13 bp, D. melanogaster
taattttccaaat

SEQ ID NO: 641079 - DNA, 13 bp, D. melanogaster
taattttccagct

SEQ ID NO: 641080 - DNA, 13 bp, D. melanogaster
taattttccattg

SEQ ID NO: 641081 - DNA, 13 bp, D. melanogaster
taattttcccatt

SEQ ID NO: 641082 - DNA, 13 bp, D. melanogaster
taattttcgaaat

SEQ ID NO: 641083 - DNA, 13 bp, D. melanogaster
taattttcgagtt

SEQ ID NO: 641084 - DNA, 13 bp, D. melanogaster
taattttcgattt

SEQ ID NO: 641085 - DNA, 14 bp, D. melanogaster
taattttcgcattt

SEQ ID NO: 641086 - DNA, 14 bp, D. melanogaster
taattttctgtatt

SEQ ID NO: 641087 - DNA, 13 bp, D. melanogaster
taattttgaactg

SEQ ID NO: 641088 - DNA, 13 bp, D. melanogaster
taattttgaatgc

SEQ ID NO: 641089 - DNA, 13 bp, D. melanogaster
taattttgatgat

SEQ ID NO: 641090 - DNA, 14 bp, D. melanogaster
taattttgcaaaaa

SEQ ID NO: 641091 - DNA, 13 bp, D. melanogaster
taattttgcacaa

SEQ ID NO: 641092 - DNA, 13 bp, D. melanogaster
taattttgcattt

SEQ ID NO: 641093 - DNA, 14 bp, D. melanogaster
taattttgccagct

SEQ ID NO: 641094 - DNA, 13 bp, D. melanogaster
taattttggccac

SEQ ID NO: 641095 - DNA, 13 bp, D. melanogaster
taattttgtatag

SEQ ID NO: 641096 - DNA, 13 bp, D. melanogaster
taatttttaatgc

SEQ ID NO: 641097 - DNA, 13 bp, D. melanogaster
taatttttacaac

SEQ ID NO: 641098 - DNA, 13 bp, D. melanogaster
taatttttacaag

SEQ ID NO: 641099 - DNA, 14 bp, D. melanogaster
taatttttattgca

SEQ ID NO: 641100 - DNA, 13 bp, D. melanogaster
taatttttcaaag

SEQ ID NO: 641101 - DNA, 13 bp, D. melanogaster
taatttttcacaa

SEQ ID NO: 641102 - DNA, 13 bp, D. melanogaster
taatttttcacac

SEQ ID NO: 641103 - DNA, 14 bp, D. melanogaster
taatttttcacacg

SEQ ID NO: 641104 - DNA, 13 bp, D. melanogaster
taatttttcagtt

SEQ ID NO: 641105 - DNA, 13 bp, D. melanogaster
taatttttgaaga

SEQ ID NO: 641106 - DNA, 13 bp, D. melanogaster
taatttttgcaat

SEQ ID NO: 641107 - DNA, 13 bp, D. melanogaster
taatttttgcatt

SEQ ID NO: 641108 - DNA, 13 bp, D. melanogaster
taatttttgccca

SEQ ID NO: 641109 - DNA, 13 bp, D. melanogaster
taatttttggcca

SEQ ID NO: 641110 - DNA, 13 bp, D. melanogaster
taatttttgggaa

SEQ ID NO: 641111 - DNA, 13 bp, D. melanogaster
taatttttgtaca

SEQ ID NO: 641112 - DNA, 13 bp, D. melanogaster
taatttttgtgca

SEQ ID NO: 641113 - DNA, 13 bp, D. melanogaster
taatttttgtgct

SEQ ID NO: 641114 - DNA, 13 bp, D. melanogaster
taattttttcaac

SEQ ID NO: 641115 - DNA, 13 bp, D. melanogaster
taattttttcgat

SEQ ID NO: 641116 - DNA, 13 bp, D. melanogaster
taattttttgcta

SEQ ID NO: 641117 - DNA, 13 bp, D. melanogaster
taattttttgtcc

SEQ ID NO: 641118 - DNA, 13 bp, D. melanogaster
taatttttttcag

SEQ ID NO: 641119 - DNA, 13 bp, D. melanogaster
taatttttttgca

SEQ ID NO: 641120 - DNA, 13 bp, D. melanogaster
tacaaaaaaatcg

SEQ ID NO: 641121 - DNA, 14 bp, D. melanogaster
tacaaaaaatgcaa

SEQ ID NO: 641122 - DNA, 14 bp, D. melanogaster
tacaaaaaatgcga

SEQ ID NO: 641123 - DNA, 14 bp, D. melanogaster
tacaaaaactcata

SEQ ID NO: 641124 - DNA, 13 bp, D. melanogaster
tacaaaaagaagg

SEQ ID NO: 641125 - DNA, 13 bp, D. melanogaster
tacaaaaataacg

SEQ ID NO: 641126 - DNA, 14 bp, D. melanogaster
tacaaaaatatttg

SEQ ID NO: 641127 - DNA, 13 bp, D. melanogaster
tacaaaaatctat

SEQ ID NO: 641128 - DNA, 13 bp, D. melanogaster
tacaaaaatgata

SEQ ID NO: 641129 - DNA, 13 bp, D. melanogaster
tacaaaaatgcaa

SEQ ID NO: 641130 - DNA, 14 bp, D. melanogaster
tacaaaaatgtaca

SEQ ID NO: 641131 - DNA, 13 bp, D. melanogaster
tacaaaaatgtgt

SEQ ID NO: 641132 - DNA, 13 bp, D. melanogaster
tacaaaaattaag

SEQ ID NO: 641133 - DNA, 13 bp, D. melanogaster
tacaaaacaaatg

SEQ ID NO: 641134 - DNA, 13 bp, D. melanogaster
tacaaaacatact

SEQ ID NO: 641135 - DNA, 14 bp, D. melanogaster
tacaaaacgcccaa

SEQ ID NO: 641136 - DNA, 13 bp, D. melanogaster
tacaaaacgtcta

SEQ ID NO: 641137 - DNA, 13 bp, D. melanogaster
tacaaaactgaat

SEQ ID NO: 641138 - DNA, 13 bp, D. melanogaster
tacaaaagataca

SEQ ID NO: 641139 - DNA, 13 bp, D. melanogaster
tacaaaagcaata

SEQ ID NO: 641140 - DNA, 13 bp, D. melanogaster
tacaaaaggagaa

SEQ ID NO: 641141 - DNA, 13 bp, D. melanogaster
tacaaaagtatct

SEQ ID NO: 641142 - DNA, 13 bp, D. melanogaster
tacaaaagttaat

SEQ ID NO: 641143 - DNA, 13 bp, D. melanogaster
tacaaaagtttaa

SEQ ID NO: 641144 - DNA, 13 bp, D. melanogaster
tacaaaagttttt

SEQ ID NO: 641145 - DNA, 13 bp, D. melanogaster
tacaaaatacttt

SEQ ID NO: 641146 - DNA, 13 bp, D. melanogaster
tacaaaatataag

SEQ ID NO: 641147 - DNA, 13 bp, D. melanogaster
tacaaaatatgtg

SEQ ID NO: 641148 - DNA, 14 bp, D. melanogaster
tacaaaatattttg

SEQ ID NO: 641149 - DNA, 13 bp, D. melanogaster
tacaaaatcacta

SEQ ID NO: 641150 - DNA, 13 bp, D. melanogaster
tacaaaatcttga

SEQ ID NO: 641151 - DNA, 13 bp, D. melanogaster
tacaaaatgaaat

SEQ ID NO: 641152 - DNA, 13 bp, D. melanogaster
tacaaaatgaata

SEQ ID NO: 641153 - DNA, 14 bp, D. melanogaster
tacaaaatgcaaaa

SEQ ID NO: 641154 - DNA, 13 bp, D. melanogaster
tacaaaatgccaa

SEQ ID NO: 641155 - DNA, 13 bp, D. melanogaster
tacaaaatggttt

SEQ ID NO: 641156 - DNA, 13 bp, D. melanogaster
tacaaaatgtatt

SEQ ID NO: 641157 - DNA, 14 bp, D. melanogaster
tacaaaatgtattc

SEQ ID NO: 641158 - DNA, 13 bp, D. melanogaster
tacaaaatgttta

SEQ ID NO: 641159 - DNA, 13 bp, D. melanogaster
tacaaaattaaag

SEQ ID NO: 641160 - DNA, 13 bp, D. melanogaster
tacaaaattatac

SEQ ID NO: 641161 - DNA, 14 bp, D. melanogaster
tacaaaattcaatt

SEQ ID NO: 641162 - DNA, 13 bp, D. melanogaster
tacaaaattcgga

SEQ ID NO: 641163 - DNA, 13 bp, D. melanogaster
tacaaaattgaaa

SEQ ID NO: 641164 - DNA, 13 bp, D. melanogaster
tacaaaattgttt

SEQ ID NO: 641165 - DNA, 13 bp, D. melanogaster
tacaaaatttgta

SEQ ID NO: 641166 - DNA, 13 bp, D. melanogaster
tacaaacaaacag

SEQ ID NO: 641167 - DNA, 13 bp, D. melanogaster
tacaaacagagtt

SEQ ID NO: 641168 - DNA, 13 bp, D. melanogaster
tacaaacatatat

SEQ ID NO: 641169 - DNA, 13 bp, D. melanogaster
tacaaacatttat

SEQ ID NO: 641170 - DNA, 13 bp, D. melanogaster
tacaaacatttta

SEQ ID NO: 641171 - DNA, 13 bp, D. melanogaster
tacaaacattttt

SEQ ID NO: 641172 - DNA, 13 bp, D. melanogaster
tacaaacggaatt

SEQ ID NO: 641173 - DNA, 13 bp, D. melanogaster
tacaaactgccaa

SEQ ID NO: 641174 - DNA, 13 bp, D. melanogaster
tacaaacttctgg

SEQ ID NO: 641175 - DNA, 13 bp, D. melanogaster
tacaaagaaatat

SEQ ID NO: 641176 - DNA, 13 bp, D. melanogaster
tacaaagaaattc

SEQ ID NO: 641177 - DNA, 13 bp, D. melanogaster
tacaaagagctga

SEQ ID NO: 641178 - DNA, 13 bp, D. melanogaster
tacaaagatacat

SEQ ID NO: 641179 - DNA, 13 bp, D. melanogaster
tacaaagattata

SEQ ID NO: 641180 - DNA, 13 bp, D. melanogaster
tacaaagcattat

SEQ ID NO: 641181 - DNA, 13 bp, D. melanogaster
tacaaagccaaaa

SEQ ID NO: 641182 - DNA, 13 bp, D. melanogaster
tacaaagcttgca

SEQ ID NO: 641183 - DNA, 14 bp, D. melanogaster
tacaaagcttgcag

SEQ ID NO: 641184 - DNA, 13 bp, D. melanogaster
tacaaaggaaatt

SEQ ID NO: 641185 - DNA, 13 bp, D. melanogaster
tacaaagtgacca

SEQ ID NO: 641186 - DNA, 13 bp, D. melanogaster
tacaaagttattt

SEQ ID NO: 641187 - DNA, 13 bp, D. melanogaster
tacaaataaagac

SEQ ID NO: 641188 - DNA, 13 bp, D. melanogaster
tacaaataaattg

SEQ ID NO: 641189 - DNA, 13 bp, D. melanogaster
tacaaataacgcc

SEQ ID NO: 641190 - DNA, 13 bp, D. melanogaster
tacaaatacaatt

SEQ ID NO: 641191 - DNA, 13 bp, D. melanogaster
tacaaatacagat

SEQ ID NO: 641192 - DNA, 13 bp, D. melanogaster
tacaaatacatac

SEQ ID NO: 641193 - DNA, 13 bp, D. melanogaster
tacaaatacattt

SEQ ID NO: 641194 - DNA, 13 bp, D. melanogaster
tacaaatacgaaa

SEQ ID NO: 641195 - DNA, 13 bp, D. melanogaster
tacaaatactttt

SEQ ID NO: 641196 - DNA, 13 bp, D. melanogaster
tacaaatatcaca

SEQ ID NO: 641197 - DNA, 13 bp, D. melanogaster
tacaaatatgtgc

SEQ ID NO: 641198 - DNA, 13 bp, D. melanogaster
tacaaatattgca

SEQ ID NO: 641199 - DNA, 13 bp, D. melanogaster
tacaaatattgtt

SEQ ID NO: 641200 - DNA, 13 bp, D. melanogaster
tacaaatatttca

SEQ ID NO: 641201 - DNA, 13 bp, D. melanogaster
tacaaatatttct

SEQ ID NO: 641202 - DNA, 13 bp, D. melanogaster
tacaaatatttga

SEQ ID NO: 641203 - DNA, 14 bp, D. melanogaster
tacaaatatttgca

SEQ ID NO: 641204 - DNA, 13 bp, D. melanogaster
tacaaatcaattg

SEQ ID NO: 641205 - DNA, 13 bp, D. melanogaster
tacaaatccatgt

SEQ ID NO: 641206 - DNA, 13 bp, D. melanogaster
tacaaatcgattt

SEQ ID NO: 641207 - DNA, 13 bp, D. melanogaster
tacaaatgaaata

SEQ ID NO: 641208 - DNA, 14 bp, D. melanogaster
tacaaatgaaatat

SEQ ID NO: 641209 - DNA, 13 bp, D. melanogaster
tacaaatgcaaaa

SEQ ID NO: 641210 - DNA, 14 bp, D. melanogaster
tacaaatgcaaata

SEQ ID NO: 641211 - DNA, 13 bp, D. melanogaster
tacaaatgcaatt

SEQ ID NO: 641212 - DNA, 13 bp, D. melanogaster
tacaaatgcttgt

SEQ ID NO: 641213 - DNA, 14 bp, D. melanogaster
tacaaatggtttca

SEQ ID NO: 641214 - DNA, 13 bp, D. melanogaster
tacaaatgtaatt

SEQ ID NO: 641215 - DNA, 13 bp, D. melanogaster
tacaaattacatt

SEQ ID NO: 641216 - DNA, 13 bp, D. melanogaster
tacaaattataca

SEQ ID NO: 641217 - DNA, 14 bp, D. melanogaster
tacaaattattttc

SEQ ID NO: 641218 - DNA, 13 bp, D. melanogaster
tacaaattcaaat

SEQ ID NO: 641219 - DNA, 13 bp, D. melanogaster
tacaaattcaaca

SEQ ID NO: 641220 - DNA, 13 bp, D. melanogaster
tacaaattcattt

SEQ ID NO: 641221 - DNA, 14 bp, D. melanogaster
tacaaattgaattt

SEQ ID NO: 641222 - DNA, 13 bp, D. melanogaster
tacaaattgcatt

SEQ ID NO: 641223 - DNA, 13 bp, D. melanogaster
tacaaattggaaa

SEQ ID NO: 641224 - DNA, 13 bp, D. melanogaster
tacaaattggtat

SEQ ID NO: 641225 - DNA, 13 bp, D. melanogaster
tacaaattgtata

SEQ ID NO: 641226 - DNA, 13 bp, D. melanogaster
tacaaattgtatt

SEQ ID NO: 641227 - DNA, 13 bp, D. melanogaster
tacaaattgttaa

SEQ ID NO: 641228 - DNA, 13 bp, D. melanogaster
tacaaattgttag

SEQ ID NO: 641229 - DNA, 13 bp, D. melanogaster
tacaaatttaaac

SEQ ID NO: 641230 - DNA, 13 bp, D. melanogaster
tacaaatttaaag

SEQ ID NO: 641231 - DNA, 13 bp, D. melanogaster
tacaaatttatgt

SEQ ID NO: 641232 - DNA, 13 bp, D. melanogaster
tacaaatttgcaa

SEQ ID NO: 641233 - DNA, 13 bp, D. melanogaster
tacaaattttagg

SEQ ID NO: 641234 - DNA, 13 bp, D. melanogaster
tacaaattttatg

SEQ ID NO: 641235 - DNA, 13 bp, D. melanogaster
tacaaattttcca

SEQ ID NO: 641236 - DNA, 13 bp, D. melanogaster
tacaaattttctt

SEQ ID NO: 641237 - DNA, 13 bp, D. melanogaster
tacaaattttgaa

SEQ ID NO: 641238 - DNA, 14 bp, D. melanogaster
tacaaattttggtt

SEQ ID NO: 641239 - DNA, 13 bp, D. melanogaster
tacaaattttgta

SEQ ID NO: 641240 - DNA, 13 bp, D. melanogaster
tacaaatttttca

SEQ ID NO: 641241 - DNA, 13 bp, D. melanogaster
tacaaatttttct

SEQ ID NO: 641242 - DNA, 13 bp, D. melanogaster
tacaaattttttg

SEQ ID NO: 641243 - DNA, 13 bp, D. melanogaster
tacaacaaaaagg

SEQ ID NO: 641244 - DNA, 14 bp, D. melanogaster
tacaacaaaagcaa

SEQ ID NO: 641245 - DNA, 14 bp, D. melanogaster
tacaacaaaattag

SEQ ID NO: 641246 - DNA, 13 bp, D. melanogaster
tacaacaaagtca

SEQ ID NO: 641247 - DNA, 13 bp, D. melanogaster
tacaacaaatttg

SEQ ID NO: 641248 - DNA, 13 bp, D. melanogaster
tacaacaacaact

SEQ ID NO: 641249 - DNA, 13 bp, D. melanogaster
tacaacaacagca

SEQ ID NO: 641250 - DNA, 14 bp, D. melanogaster
tacaacaacagcaa

SEQ ID NO: 641251 - DNA, 14 bp, D. melanogaster
tacaacaacagcag

SEQ ID NO: 641252 - DNA, 14 bp, D. melanogaster
tacaacaatttgaa

SEQ ID NO: 641253 - DNA, 13 bp, D. melanogaster
tacaacaatttgt

SEQ ID NO: 641254 - DNA, 13 bp, D. melanogaster
tacaacagaaaca

SEQ ID NO: 641255 - DNA, 13 bp, D. melanogaster
tacaacagaacaa

SEQ ID NO: 641256 - DNA, 13 bp, D. melanogaster
tacaacagagcat

SEQ ID NO: 641257 - DNA, 13 bp, D. melanogaster
tacaacagcaaca

SEQ ID NO: 641258 - DNA, 13 bp, D. melanogaster
tacaacagcagca

SEQ ID NO: 641259 - DNA, 13 bp, D. melanogaster
tacaacatatata

SEQ ID NO: 641260 - DNA, 13 bp, D. melanogaster
tacaacattttaa

SEQ ID NO: 641261 - DNA, 13 bp, D. melanogaster
tacaacattttgt

SEQ ID NO: 641262 - DNA, 13 bp, D. melanogaster
tacaacctaaacg

SEQ ID NO: 641263 - DNA, 13 bp, D. melanogaster
tacaacgatcgat

SEQ ID NO: 641264 - DNA, 14 bp, D. melanogaster
tacaacgatcgatc

SEQ ID NO: 641265 - DNA, 13 bp, D. melanogaster
tacaacgctaaac

SEQ ID NO: 641266 - DNA, 13 bp, D. melanogaster
tacaactaaatat

SEQ ID NO: 641267 - DNA, 13 bp, D. melanogaster
tacaactacaaca

SEQ ID NO: 641268 - DNA, 13 bp, D. melanogaster
tacaactacaact

SEQ ID NO: 641269 - DNA, 13 bp, D. melanogaster
tacaactataaat

SEQ ID NO: 641270 - DNA, 13 bp, D. melanogaster
tacaactccgtct

SEQ ID NO: 641271 - DNA, 13 bp, D. melanogaster
tacaactgaaaaa

SEQ ID NO: 641272 - DNA, 14 bp, D. melanogaster
tacaactgttcaaa

SEQ ID NO: 641273 - DNA, 13 bp, D. melanogaster
tacaacttcaatt

SEQ ID NO: 641274 - DNA, 13 bp, D. melanogaster
tacaacttttaaa

SEQ ID NO: 641275 - DNA, 13 bp, D. melanogaster
tacaacttttgta

SEQ ID NO: 641276 - DNA, 13 bp, D. melanogaster
tacaactttttca

SEQ ID NO: 641277 - DNA, 13 bp, D. melanogaster
tacaagaaattgc

SEQ ID NO: 641278 - DNA, 13 bp, D. melanogaster
tacaagaagattc

SEQ ID NO: 641279 - DNA, 13 bp, D. melanogaster
tacaagaaggaaa

SEQ ID NO: 641280 - DNA, 13 bp, D. melanogaster
tacaagaagttga

SEQ ID NO: 641281 - DNA, 13 bp, D. melanogaster
tacaagatacatt

SEQ ID NO: 641282 - DNA, 13 bp, D. melanogaster
tacaagcacttca

SEQ ID NO: 641283 - DNA, 13 bp, D. melanogaster
tacaagcccaagt

SEQ ID NO: 641284 - DNA, 13 bp, D. melanogaster
tacaagctaaaag

SEQ ID NO: 641285 - DNA, 13 bp, D. melanogaster
tacaaggaaccca

SEQ ID NO: 641286 - DNA, 13 bp, D. melanogaster
tacaagtacaagt

SEQ ID NO: 641287 - DNA, 13 bp, D. melanogaster
tacaagtacatat

SEQ ID NO: 641288 - DNA, 13 bp, D. melanogaster
tacaagtacgaga

SEQ ID NO: 641289 - DNA, 13 bp, D. melanogaster
tacaagtatattt

SEQ ID NO: 641290 - DNA, 13 bp, D. melanogaster
tacaagtatttat

SEQ ID NO: 641291 - DNA, 13 bp, D. melanogaster
tacaagtgcaaaa

SEQ ID NO: 641292 - DNA, 13 bp, D. melanogaster
tacaagtgcgatt

SEQ ID NO: 641293 - DNA, 13 bp, D. melanogaster
tacaagttgaagc

SEQ ID NO: 641294 - DNA, 13 bp, D. melanogaster
tacaagtttattt

SEQ ID NO: 641295 - DNA, 13 bp, D. melanogaster
tacaagttttttt

SEQ ID NO: 641296 - DNA, 13 bp, D. melanogaster
tacaataaaatga

SEQ ID NO: 641297 - DNA, 13 bp, D. melanogaster
tacaataatattg

SEQ ID NO: 641298 - DNA, 13 bp, D. melanogaster
tacaataatttca

SEQ ID NO: 641299 - DNA, 13 bp, D. melanogaster
tacaataattttc

SEQ ID NO: 641300 - DNA, 14 bp, D. melanogaster
tacaatacaataca

SEQ ID NO: 641301 - DNA, 13 bp, D. melanogaster
tacaatacaatat

SEQ ID NO: 641302 - DNA, 13 bp, D. melanogaster
tacaatacaatta

SEQ ID NO: 641303 - DNA, 13 bp, D. melanogaster
tacaatacaattt

SEQ ID NO: 641304 - DNA, 14 bp, D. melanogaster
tacaatacatacat

SEQ ID NO: 641305 - DNA, 13 bp, D. melanogaster
tacaatacattta

SEQ ID NO: 641306 - DNA, 13 bp, D. melanogaster
tacaatacatttc

SEQ ID NO: 641307 - DNA, 13 bp, D. melanogaster
tacaatagtaaga

SEQ ID NO: 641308 - DNA, 13 bp, D. melanogaster
tacaatatatatc

SEQ ID NO: 641309 - DNA, 13 bp, D. melanogaster
tacaatatatatg

SEQ ID NO: 641310 - DNA, 13 bp, D. melanogaster
tacaatatatgca

SEQ ID NO: 641311 - DNA, 13 bp, D. melanogaster
tacaatatattga

SEQ ID NO: 641312 - DNA, 13 bp, D. melanogaster
tacaatatattgg

SEQ ID NO: 641313 - DNA, 13 bp, D. melanogaster
tacaatatatttg

SEQ ID NO: 641314 - DNA, 13 bp, D. melanogaster
tacaatatgtaca

SEQ ID NO: 641315 - DNA, 13 bp, D. melanogaster
tacaatatgtatt

SEQ ID NO: 641316 - DNA, 13 bp, D. melanogaster
tacaatatgtttt

SEQ ID NO: 641317 - DNA, 13 bp, D. melanogaster
tacaatattacaa

SEQ ID NO: 641318 - DNA, 13 bp, D. melanogaster
tacaatattttgt

SEQ ID NO: 641319 - DNA, 13 bp, D. melanogaster
tacaatcaaatta

SEQ ID NO: 641320 - DNA, 13 bp, D. melanogaster
tacaatgaaaata

SEQ ID NO: 641321 - DNA, 13 bp, D. melanogaster
tacaatgaaaatg

SEQ ID NO: 641322 - DNA, 13 bp, D. melanogaster
tacaatgatctga

SEQ ID NO: 641323 - DNA, 13 bp, D. melanogaster
tacaatgtacaaa

SEQ ID NO: 641324 - DNA, 13 bp, D. melanogaster
tacaatgtatgta

SEQ ID NO: 641325 - DNA, 13 bp, D. melanogaster
tacaatgttaata

SEQ ID NO: 641326 - DNA, 13 bp, D. melanogaster
tacaatgttttaa

SEQ ID NO: 641327 - DNA, 13 bp, D. melanogaster
tacaattaagaac

SEQ ID NO: 641328 - DNA, 13 bp, D. melanogaster
tacaattaagttt

SEQ ID NO: 641329 - DNA, 13 bp, D. melanogaster
tacaattaattca

SEQ ID NO: 641330 - DNA, 13 bp, D. melanogaster
tacaattacaata

SEQ ID NO: 641331 - DNA, 14 bp, D. melanogaster
tacaattacaattt

SEQ ID NO: 641332 - DNA, 13 bp, D. melanogaster
tacaattagtttt

SEQ ID NO: 641333 - DNA, 13 bp, D. melanogaster
tacaattgaaata

SEQ ID NO: 641334 - DNA, 13 bp, D. melanogaster
tacaattgaaatg

SEQ ID NO: 641335 - DNA, 13 bp, D. melanogaster
tacaattgaataa

SEQ ID NO: 641336 - DNA, 13 bp, D. melanogaster
tacaattgatttt

SEQ ID NO: 641337 - DNA, 13 bp, D. melanogaster
tacaattgcaaat

SEQ ID NO: 641338 - DNA, 13 bp, D. melanogaster
tacaattggcaaa

SEQ ID NO: 641339 - DNA, 13 bp, D. melanogaster
tacaattgtatta

SEQ ID NO: 641340 - DNA, 13 bp, D. melanogaster
tacaatttaaact

SEQ ID NO: 641341 - DNA, 13 bp, D. melanogaster
tacaatttaaagt

SEQ ID NO: 641342 - DNA, 14 bp, D. melanogaster
tacaatttacaatt

SEQ ID NO: 641343 - DNA, 13 bp, D. melanogaster
tacaatttacgct

SEQ ID NO: 641344 - DNA, 13 bp, D. melanogaster
tacaatttataca

SEQ ID NO: 641345 - DNA, 13 bp, D. melanogaster
tacaatttattgt

SEQ ID NO: 641346 - DNA, 13 bp, D. melanogaster
tacaatttatttg

SEQ ID NO: 641347 - DNA, 13 bp, D. melanogaster
tacaatttcaatt

SEQ ID NO: 641348 - DNA, 13 bp, D. melanogaster
tacaatttcattt

SEQ ID NO: 641349 - DNA, 13 bp, D. melanogaster
tacaatttcccca

SEQ ID NO: 641350 - DNA, 13 bp, D. melanogaster
tacaatttctatt

SEQ ID NO: 641351 - DNA, 13 bp, D. melanogaster
tacaatttgaatg

SEQ ID NO: 641352 - DNA, 13 bp, D. melanogaster
tacaatttgttaa

SEQ ID NO: 641353 - DNA, 13 bp, D. melanogaster
tacaatttgttga

SEQ ID NO: 641354 - DNA, 13 bp, D. melanogaster
tacaattttaaag

SEQ ID NO: 641355 - DNA, 13 bp, D. melanogaster
tacaattttccca

SEQ ID NO: 641356 - DNA, 13 bp, D. melanogaster
tacaattttgaaa

SEQ ID NO: 641357 - DNA, 13 bp, D. melanogaster
tacaatttttgtg

SEQ ID NO: 641358 - DNA, 13 bp, D. melanogaster
tacaatttttttg

SEQ ID NO: 641359 - DNA, 13 bp, D. melanogaster
tacacaaaagtaa

SEQ ID NO: 641360 - DNA, 13 bp, D. melanogaster
tacacaaaatatt

SEQ ID NO: 641361 - DNA, 13 bp, D. melanogaster
tacacaaaatcat

SEQ ID NO: 641362 - DNA, 13 bp, D. melanogaster
tacacaaaatgta

SEQ ID NO: 641363 - DNA, 14 bp, D. melanogaster
tacacaaaatgtac

SEQ ID NO: 641364 - DNA, 13 bp, D. melanogaster
tacacaaaattat

SEQ ID NO: 641365 - DNA, 13 bp, D. melanogaster
tacacaaacatat

SEQ ID NO: 641366 - DNA, 13 bp, D. melanogaster
tacacaaatattt

SEQ ID NO: 641367 - DNA, 13 bp, D. melanogaster
tacacaaattgtt

SEQ ID NO: 641368 - DNA, 13 bp, D. melanogaster
tacacaaattttt

SEQ ID NO: 641369 - DNA, 13 bp, D. melanogaster
tacacaacaagct

SEQ ID NO: 641370 - DNA, 13 bp, D. melanogaster
tacacaacatcca

SEQ ID NO: 641371 - DNA, 13 bp, D. melanogaster
tacacaacatttt

SEQ ID NO: 641372 - DNA, 13 bp, D. melanogaster
tacacaaccttta

SEQ ID NO: 641373 - DNA, 13 bp, D. melanogaster
tacacaagaaatt

SEQ ID NO: 641374 - DNA, 13 bp, D. melanogaster
tacacaataatgt

SEQ ID NO: 641375 - DNA, 13 bp, D. melanogaster
tacacaatacaca

SEQ ID NO: 641376 - DNA, 13 bp, D. melanogaster
tacacaattttat

SEQ ID NO: 641377 - DNA, 14 bp, D. melanogaster
tacacacacacacg

SEQ ID NO: 641378 - DNA, 13 bp, D. melanogaster
tacacacacacat

SEQ ID NO: 641379 - DNA, 14 bp, D. melanogaster
tacacacacacata

SEQ ID NO: 641380 - DNA, 13 bp, D. melanogaster
tacacacacagac

SEQ ID NO: 641381 - DNA, 14 bp, D. melanogaster
tacacacacataga

SEQ ID NO: 641382 - DNA, 13 bp, D. melanogaster
tacacacactcac

SEQ ID NO: 641383 - DNA, 14 bp, D. melanogaster
tacacacactcaca

SEQ ID NO: 641384 - DNA, 14 bp, D. melanogaster
tacacacagacaca

SEQ ID NO: 641385 - DNA, 13 bp, D. melanogaster
tacacacatacaa

SEQ ID NO: 641386 - DNA, 13 bp, D. melanogaster
tacacacatacat

SEQ ID NO: 641387 - DNA, 14 bp, D. melanogaster
tacacacatatatg

SEQ ID NO: 641388 - DNA, 13 bp, D. melanogaster
tacacacatatgc

SEQ ID NO: 641389 - DNA, 13 bp, D. melanogaster
tacacacatatgt

SEQ ID NO: 641390 - DNA, 13 bp, D. melanogaster
tacacacgcacac

SEQ ID NO: 641391 - DNA, 14 bp, D. melanogaster
tacacacgcacaca

SEQ ID NO: 641392 - DNA, 13 bp, D. melanogaster
tacacactcacac

SEQ ID NO: 641393 - DNA, 14 bp, D. melanogaster
tacacactcacaca

SEQ ID NO: 641394 - DNA, 13 bp, D. melanogaster
tacacacttttga

SEQ ID NO: 641395 - DNA, 13 bp, D. melanogaster
tacacactttttt

SEQ ID NO: 641396 - DNA, 13 bp, D. melanogaster
tacacagaaaaca

SEQ ID NO: 641397 - DNA, 13 bp, D. melanogaster
tacacagaaataa

SEQ ID NO: 641398 - DNA, 13 bp, D. melanogaster
tacacagaacaaa

SEQ ID NO: 641399 - DNA, 13 bp, D. melanogaster
tacacagacacac

SEQ ID NO: 641400 - DNA, 14 bp, D. melanogaster
tacacagacacaca

SEQ ID NO: 641401 - DNA, 14 bp, D. melanogaster
tacacagagaaaaa

SEQ ID NO: 641402 - DNA, 13 bp, D. melanogaster
tacacagagacct

SEQ ID NO: 641403 - DNA, 14 bp, D. melanogaster
tacacagagagaaa

SEQ ID NO: 641404 - DNA, 13 bp, D. melanogaster
tacacagatacat

SEQ ID NO: 641405 - DNA, 13 bp, D. melanogaster
tacacagcatttg

SEQ ID NO: 641406 - DNA, 13 bp, D. melanogaster
tacacagcgaaaa

SEQ ID NO: 641407 - DNA, 14 bp, D. melanogaster
tacacagcgagaaa

SEQ ID NO: 641408 - DNA, 14 bp, D. melanogaster
tacacaggaagaaa

SEQ ID NO: 641409 - DNA, 13 bp, D. melanogaster
tacacagggaaaa

SEQ ID NO: 641410 - DNA, 14 bp, D. melanogaster
tacacagggagaaa

SEQ ID NO: 641411 - DNA, 13 bp, D. melanogaster
tacacagtgagaa

SEQ ID NO: 641412 - DNA, 13 bp, D. melanogaster
tacacatacacac

SEQ ID NO: 641413 - DNA, 14 bp, D. melanogaster
tacacatacacaca

SEQ ID NO: 641414 - DNA, 13 bp, D. melanogaster
tacacatacacat

SEQ ID NO: 641415 - DNA, 13 bp, D. melanogaster
tacacatacataa

SEQ ID NO: 641416 - DNA, 14 bp, D. melanogaster
tacacatacatatg

SEQ ID NO: 641417 - DNA, 13 bp, D. melanogaster
tacacatataaat

SEQ ID NO: 641418 - DNA, 13 bp, D. melanogaster
tacacatatataa

SEQ ID NO: 641419 - DNA, 14 bp, D. melanogaster
tacacatatataca

SEQ ID NO: 641420 - DNA, 13 bp, D. melanogaster
tacacatatattt

SEQ ID NO: 641421 - DNA, 13 bp, D. melanogaster
tacacatcgatca

SEQ ID NO: 641422 - DNA, 13 bp, D. melanogaster
tacacatgcacac

SEQ ID NO: 641423 - DNA, 13 bp, D. melanogaster
tacacatgcatat

SEQ ID NO: 641424 - DNA, 13 bp, D. melanogaster
tacacatgtgtgt

SEQ ID NO: 641425 - DNA, 13 bp, D. melanogaster
tacacattttaaa

SEQ ID NO: 641426 - DNA, 13 bp, D. melanogaster
tacacattttcaa

SEQ ID NO: 641427 - DNA, 14 bp, D. melanogaster
tacacattttgttt

SEQ ID NO: 641428 - DNA, 13 bp, D. melanogaster
tacacatttttat

SEQ ID NO: 641429 - DNA, 13 bp, D. melanogaster
tacacatttttca

SEQ ID NO: 641430 - DNA, 13 bp, D. melanogaster
tacaccaaaaagg

SEQ ID NO: 641431 - DNA, 14 bp, D. melanogaster
tacaccaaacagtg

SEQ ID NO: 641432 - DNA, 16 bp, D. melanogaster
tacaccagctctaaat

SEQ ID NO: 641433 - DNA, 13 bp, D. melanogaster
tacaccgaaaaaa

SEQ ID NO: 641434 - DNA, 14 bp, D. melanogaster
tacaccgaaaaaaa

SEQ ID NO: 641435 - DNA, 13 bp, D. melanogaster
tacaccgaaagaa

SEQ ID NO: 641436 - DNA, 14 bp, D. melanogaster
tacaccgaaagaaa

SEQ ID NO: 641437 - DNA, 14 bp, D. melanogaster
tacacgaaactgta

SEQ ID NO: 641438 - DNA, 14 bp, D. melanogaster
tacacgcagagaaa

SEQ ID NO: 641439 - DNA, 14 bp, D. melanogaster
tacacggagaaaaa

SEQ ID NO: 641440 - DNA, 13 bp, D. melanogaster
tacacggcgaaaa

SEQ ID NO: 641441 - DNA, 14 bp, D. melanogaster
tacacggcgagaaa

SEQ ID NO: 641442 - DNA, 13 bp, D. melanogaster
tacacgtatgtat

SEQ ID NO: 641443 - DNA, 14 bp, D. melanogaster
tacactaaattcat

SEQ ID NO: 641444 - DNA, 14 bp, D. melanogaster
tacactatactata

SEQ ID NO: 641445 - DNA, 13 bp, D. melanogaster
tacactatatata

SEQ ID NO: 641446 - DNA, 14 bp, D. melanogaster
tacactatatatag

SEQ ID NO: 641447 - DNA, 14 bp, D. melanogaster
tacactcaaagaaa

SEQ ID NO: 641448 - DNA, 13 bp, D. melanogaster
tacactcacacac

SEQ ID NO: 641449 - DNA, 14 bp, D. melanogaster
tacactcacacaca

SEQ ID NO: 641450 - DNA, 13 bp, D. melanogaster
tacactcagaaaa

SEQ ID NO: 641451 - DNA, 13 bp, D. melanogaster
tacactcatacac

SEQ ID NO: 641452 - DNA, 14 bp, D. melanogaster
tacactcgaaaaaa

SEQ ID NO: 641453 - DNA, 13 bp, D. melanogaster
tacactcgcacac

SEQ ID NO: 641454 - DNA, 13 bp, D. melanogaster
tacactgaaaaaa

SEQ ID NO: 641455 - DNA, 13 bp, D. melanogaster
tacactgaaaaca

SEQ ID NO: 641456 - DNA, 14 bp, D. melanogaster
tacactgaaacaaa

SEQ ID NO: 641457 - DNA, 14 bp, D. melanogaster
tacactgaaagaaa

SEQ ID NO: 641458 - DNA, 14 bp, D. melanogaster
tacactgaacaaaa

SEQ ID NO: 641459 - DNA, 14 bp, D. melanogaster
tacactgaagaaaa

SEQ ID NO: 641460 - DNA, 14 bp, D. melanogaster
tacactgacagaaa

SEQ ID NO: 641461 - DNA, 13 bp, D. melanogaster
tacactgagaaaa

SEQ ID NO: 641462 - DNA, 14 bp, D. melanogaster
tacactgagaaaaa

SEQ ID NO: 641463 - DNA, 14 bp, D. melanogaster
tacactgagagaaa

SEQ ID NO: 641464 - DNA, 13 bp, D. melanogaster
tacactgagcaaa

SEQ ID NO: 641465 - DNA, 13 bp, D. melanogaster
tacactgagcgaa

SEQ ID NO: 641466 - DNA, 14 bp, D. melanogaster
tacactgagcgaaa

SEQ ID NO: 641467 - DNA, 14 bp, D. melanogaster
tacactgaggaaaa

SEQ ID NO: 641468 - DNA, 13 bp, D. melanogaster
tacactgagggaa

SEQ ID NO: 641469 - DNA, 14 bp, D. melanogaster
tacactgagggaaa

SEQ ID NO: 641470 - DNA, 14 bp, D. melanogaster
tacactgataaaaa

SEQ ID NO: 641471 - DNA, 13 bp, D. melanogaster
tacactgcaaaaa

SEQ ID NO: 641472 - DNA, 13 bp, D. melanogaster
tacactgcactct

SEQ ID NO: 641473 - DNA, 13 bp, D. melanogaster
tacactgcgagaa

SEQ ID NO: 641474 - DNA, 13 bp, D. melanogaster
tacactgcgcgaa

SEQ ID NO: 641475 - DNA, 14 bp, D. melanogaster
tacactgggaaaaa

SEQ ID NO: 641476 - DNA, 14 bp, D. melanogaster
tacactgggagaaa

SEQ ID NO: 641477 - DNA, 13 bp, D. melanogaster
tacactgggcaaa

SEQ ID NO: 641478 - DNA, 14 bp, D. melanogaster
tacactgggcgaaa

SEQ ID NO: 641479 - DNA, 13 bp, D. melanogaster
tacactgtaaaaa

SEQ ID NO: 641480 - DNA, 13 bp, D. melanogaster
tacactgtgagaa

SEQ ID NO: 641481 - DNA, 13 bp, D. melanogaster
tacacttaaagaa

SEQ ID NO: 641482 - DNA, 13 bp, D. melanogaster
tacacttagaaat

SEQ ID NO: 641483 - DNA, 13 bp, D. melanogaster
tacacttcgcccg

SEQ ID NO: 641484 - DNA, 14 bp, D. melanogaster
tacacttgaaaaaa

SEQ ID NO: 641485 - DNA, 13 bp, D. melanogaster
tacacttgaagaa

SEQ ID NO: 641486 - DNA, 13 bp, D. melanogaster
tacacttgcaaaa

SEQ ID NO: 641487 - DNA, 14 bp, D. melanogaster
tacacttgcaaaaa

SEQ ID NO: 641488 - DNA, 13 bp, D. melanogaster
tacactttcaaaa

SEQ ID NO: 641489 - DNA, 13 bp, D. melanogaster
tacacttttaaat

SEQ ID NO: 641490 - DNA, 14 bp, D. melanogaster
tacacttttaaata

SEQ ID NO: 641491 - DNA, 13 bp, D. melanogaster
tacacttttgaaa

SEQ ID NO: 641492 - DNA, 14 bp, D. melanogaster
tacagaaaaaactt

SEQ ID NO: 641493 - DNA, 13 bp, D. melanogaster
tacagaaaaattt

SEQ ID NO: 641494 - DNA, 14 bp, D. melanogaster
tacagaaaaatttg

SEQ ID NO: 641495 - DNA, 14 bp, D. melanogaster
tacagaaaattata

SEQ ID NO: 641496 - DNA, 13 bp, D. melanogaster
tacagaaataatt

SEQ ID NO: 641497 - DNA, 13 bp, D. melanogaster
tacagaaatattt

SEQ ID NO: 641498 - DNA, 13 bp, D. melanogaster
tacagaacaagaa

SEQ ID NO: 641499 - DNA, 13 bp, D. melanogaster
tacagaagttaat

SEQ ID NO: 641500 - DNA, 13 bp, D. melanogaster
tacagaattccct

SEQ ID NO: 641501 - DNA, 13 bp, D. melanogaster
tacagacacagac

SEQ ID NO: 641502 - DNA, 13 bp, D. melanogaster
tacagacatctac

SEQ ID NO: 641503 - DNA, 13 bp, D. melanogaster
tacagagagaaaa

SEQ ID NO: 641504 - DNA, 14 bp, D. melanogaster
tacagagagaaaaa

SEQ ID NO: 641505 - DNA, 13 bp, D. melanogaster
tacagagtctctc

SEQ ID NO: 641506 - DNA, 14 bp, D. melanogaster
tacagatacaaatt

SEQ ID NO: 641507 - DNA, 13 bp, D. melanogaster
tacagatacaact

SEQ ID NO: 641508 - DNA, 13 bp, D. melanogaster
tacagatacacac

SEQ ID NO: 641509 - DNA, 14 bp, D. melanogaster
tacagatacagaaa

SEQ ID NO: 641510 - DNA, 14 bp, D. melanogaster
tacagatacagatg

SEQ ID NO: 641511 - DNA, 13 bp, D. melanogaster
tacagatacagcc

SEQ ID NO: 641512 - DNA, 13 bp, D. melanogaster
tacagatacatct

SEQ ID NO: 641513 - DNA, 13 bp, D. melanogaster
tacagatactttt

SEQ ID NO: 641514 - DNA, 13 bp, D. melanogaster
tacagatatatat

SEQ ID NO: 641515 - DNA, 14 bp, D. melanogaster
tacagatccaaaca

SEQ ID NO: 641516 - DNA, 13 bp, D. melanogaster
tacagatgcggat

SEQ ID NO: 641517 - DNA, 13 bp, D. melanogaster
tacagatgtctgc

SEQ ID NO: 641518 - DNA, 13 bp, D. melanogaster
tacagattcagat

SEQ ID NO: 641519 - DNA, 13 bp, D. melanogaster
tacagattttaaa

SEQ ID NO: 641520 - DNA, 13 bp, D. melanogaster
tacagcaaaaaac

SEQ ID NO: 641521 - DNA, 13 bp, D. melanogaster
tacagcaacaaca

SEQ ID NO: 641522 - DNA, 14 bp, D. melanogaster
tacagcaacaacaa

SEQ ID NO: 641523 - DNA, 13 bp, D. melanogaster
tacagcagcaaca

SEQ ID NO: 641524 - DNA, 13 bp, D. melanogaster
tacagccgacatc

SEQ ID NO: 641525 - DNA, 13 bp, D. melanogaster
tacagcgaacagc

SEQ ID NO: 641526 - DNA, 13 bp, D. melanogaster
tacagctacagct

SEQ ID NO: 641527 - DNA, 13 bp, D. melanogaster
tacagctatagct

SEQ ID NO: 641528 - DNA, 13 bp, D. melanogaster
tacagctcagcaa

SEQ ID NO: 641529 - DNA, 14 bp, D. melanogaster
tacagctgtgttca

SEQ ID NO: 641530 - DNA, 13 bp, D. melanogaster
tacaggcccatca

SEQ ID NO: 641531 - DNA, 13 bp, D. melanogaster
tacaggtgcagat

SEQ ID NO: 641532 - DNA, 13 bp, D. melanogaster
tacagtacagtac

SEQ ID NO: 641533 - DNA, 23 bp, D. melanogaster
tacagtataattcgcttagctgc

SEQ ID NO: 641534 - DNA, 13 bp, D. melanogaster
tacagtcgaactt

SEQ ID NO: 641535 - DNA, 14 bp, D. melanogaster
tacagtcgaacttc

SEQ ID NO: 641536 - DNA, 13 bp, D. melanogaster
tacagtgaagcct

SEQ ID NO: 641537 - DNA, 14 bp, D. melanogaster
tacagtgagagaaa

SEQ ID NO: 641538 - DNA, 13 bp, D. melanogaster
tacagtgagcact

SEQ ID NO: 641539 - DNA, 13 bp, D. melanogaster
tacagtgatcact

SEQ ID NO: 641540 - DNA, 13 bp, D. melanogaster
tacagtgccaact

SEQ ID NO: 641541 - DNA, 13 bp, D. melanogaster
tacagtgcgtttc

SEQ ID NO: 641542 - DNA, 14 bp, D. melanogaster
tacagtgcgtttcg

SEQ ID NO: 641543 - DNA, 13 bp, D. melanogaster
tacagtggtcgcc

SEQ ID NO: 641544 - DNA, 13 bp, D. melanogaster
tacagttcagttc

SEQ ID NO: 641545 - DNA, 13 bp, D. melanogaster
tacagtttcgtgt

SEQ ID NO: 641546 - DNA, 13 bp, D. melanogaster
tacagtttgtcaa

SEQ ID NO: 641547 - DNA, 29 bp, D. melanogaster
tacagtttgtcaagaaactgtttacacac

SEQ ID NO: 641548 - DNA, 13 bp, D. melanogaster
tacagttttaata

SEQ ID NO: 641549 - DNA, 14 bp, D. melanogaster
tacagttttttata

SEQ ID NO: 641550 - DNA, 13 bp, D. melanogaster
tacataaacatta

SEQ ID NO: 641551 - DNA, 13 bp, D. melanogaster
tacataaacattt

SEQ ID NO: 641552 - DNA, 13 bp, D. melanogaster
tacataaactttt

SEQ ID NO: 641553 - DNA, 13 bp, D. melanogaster
tacataaagtata

SEQ ID NO: 641554 - DNA, 14 bp, D. melanogaster
tacataaatacaca

SEQ ID NO: 641555 - DNA, 14 bp, D. melanogaster
tacataaatatgta

SEQ ID NO: 641556 - DNA, 13 bp, D. melanogaster
tacataaatcaat

SEQ ID NO: 641557 - DNA, 13 bp, D. melanogaster
tacataaatcttt

SEQ ID NO: 641558 - DNA, 13 bp, D. melanogaster
tacataaatgaaa

SEQ ID NO: 641559 - DNA, 13 bp, D. melanogaster
tacataaatgcaa

SEQ ID NO: 641560 - DNA, 13 bp, D. melanogaster
tacataaatgcat

SEQ ID NO: 641561 - DNA, 13 bp, D. melanogaster
tacataaatgtat

SEQ ID NO: 641562 - DNA, 13 bp, D. melanogaster
tacataaattcat

SEQ ID NO: 641563 - DNA, 13 bp, D. melanogaster
tacataaattgtt

SEQ ID NO: 641564 - DNA, 13 bp, D. melanogaster
tacataacatatg

SEQ ID NO: 641565 - DNA, 13 bp, D. melanogaster
tacataagtaaaa

SEQ ID NO: 641566 - DNA, 13 bp, D. melanogaster
tacataagtacat

SEQ ID NO: 641567 - DNA, 14 bp, D. melanogaster
tacataagtacata

SEQ ID NO: 641568 - DNA, 15 bp, D. melanogaster
tacataagtacatag

SEQ ID NO: 641569 - DNA, 13 bp, D. melanogaster
tacataagttatt

SEQ ID NO: 641570 - DNA, 13 bp, D. melanogaster
tacataagtttcc

SEQ ID NO: 641571 - DNA, 13 bp, D. melanogaster
tacataatataca

SEQ ID NO: 641572 - DNA, 13 bp, D. melanogaster
tacataatatact

SEQ ID NO: 641573 - DNA, 13 bp, D. melanogaster
tacataattacat

SEQ ID NO: 641574 - DNA, 13 bp, D. melanogaster
tacataatttatg

SEQ ID NO: 641575 - DNA, 13 bp, D. melanogaster
tacataatttcat

SEQ ID NO: 641576 - DNA, 14 bp, D. melanogaster
tacatacaaacata

SEQ ID NO: 641577 - DNA, 13 bp, D. melanogaster
tacatacaaacgt

SEQ ID NO: 641578 - DNA, 13 bp, D. melanogaster
tacatacaaatgt

SEQ ID NO: 641579 - DNA, 13 bp, D. melanogaster
tacatacaacaca

SEQ ID NO: 641580 - DNA, 13 bp, D. melanogaster
tacatacaataca

SEQ ID NO: 641581 - DNA, 13 bp, D. melanogaster
tacatacaatata

SEQ ID NO: 641582 - DNA, 13 bp, D. melanogaster
tacatacaatatg

SEQ ID NO: 641583 - DNA, 14 bp, D. melanogaster
tacatacacacaca

SEQ ID NO: 641584 - DNA, 13 bp, D. melanogaster
tacatacacacat

SEQ ID NO: 641585 - DNA, 13 bp, D. melanogaster
tacatacactgca

SEQ ID NO: 641586 - DNA, 13 bp, D. melanogaster
tacatacataact

SEQ ID NO: 641587 - DNA, 13 bp, D. melanogaster
tacatacataagc

SEQ ID NO: 641588 - DNA, 14 bp, D. melanogaster
tacatacataagta

SEQ ID NO: 641589 - DNA, 13 bp, D. melanogaster
tacatacataatg

SEQ ID NO: 641590 - DNA, 13 bp, D. melanogaster
tacatacatacaa

SEQ ID NO: 641591 - DNA, 14 bp, D. melanogaster
tacatacatacaaa

SEQ ID NO: 641592 - DNA, 14 bp, D. melanogaster
tacatacatacaca

SEQ ID NO: 641593 - DNA, 13 bp, D. melanogaster
tacatacatacag

SEQ ID NO: 641594 - DNA, 14 bp, D. melanogaster
tacatacatacata

SEQ ID NO: 641595 - DNA, 14 bp, D. melanogaster
tacatacatacatc

SEQ ID NO: 641596 - DNA, 14 bp, D. melanogaster
tacatacatacgtt

SEQ ID NO: 641597 - DNA, 14 bp, D. melanogaster
tacatacatactta

SEQ ID NO: 641598 - DNA, 14 bp, D. melanogaster
tacatacatagata

SEQ ID NO: 641599 - DNA, 14 bp, D. melanogaster
tacatacatataag

SEQ ID NO: 641600 - DNA, 14 bp, D. melanogaster
tacatacatatacc

SEQ ID NO: 641601 - DNA, 13 bp, D. melanogaster
tacatacatatag

SEQ ID NO: 641602 - DNA, 14 bp, D. melanogaster
tacatacatatagc

SEQ ID NO: 641603 - DNA, 13 bp, D. melanogaster
tacatacatatat

SEQ ID NO: 641604 - DNA, 14 bp, D. melanogaster
tacatacatatatc

SEQ ID NO: 641605 - DNA, 13 bp, D. melanogaster
tacatacatatga

SEQ ID NO: 641606 - DNA, 14 bp, D. melanogaster
tacatacatatgca

SEQ ID NO: 641607 - DNA, 14 bp, D. melanogaster
tacatacatatgta

SEQ ID NO: 641608 - DNA, 16 bp, D. melanogaster
tacatacatatgtatg

SEQ ID NO: 641609 - DNA, 14 bp, D. melanogaster
tacatacatatgtc

SEQ ID NO: 641610 - DNA, 14 bp, D. melanogaster
tacatacatatgtg

SEQ ID NO: 641611 - DNA, 13 bp, D. melanogaster
tacatacatatta

SEQ ID NO: 641612 - DNA, 14 bp, D. melanogaster
tacatacatattaa

SEQ ID NO: 641613 - DNA, 14 bp, D. melanogaster
tacatacatattta

SEQ ID NO: 641614 - DNA, 14 bp, D. melanogaster
tacatacatatttt

SEQ ID NO: 641615 - DNA, 13 bp, D. melanogaster
tacatacatcata

SEQ ID NO: 641616 - DNA, 14 bp, D. melanogaster
tacatacatcatat

SEQ ID NO: 641617 - DNA, 13 bp, D. melanogaster
tacatacatccat

SEQ ID NO: 641618 - DNA, 13 bp, D. melanogaster
tacatacatctat

SEQ ID NO: 641619 - DNA, 13 bp, D. melanogaster
tacatacatgcaa

SEQ ID NO: 641620 - DNA, 14 bp, D. melanogaster
tacatacatgcaca

SEQ ID NO: 641621 - DNA, 14 bp, D. melanogaster
tacatacatgcatg

SEQ ID NO: 641622 - DNA, 13 bp, D. melanogaster
tacatacatggaa

SEQ ID NO: 641623 - DNA, 14 bp, D. melanogaster
tacatacatgtgtg

SEQ ID NO: 641624 - DNA, 13 bp, D. melanogaster
tacatacattaaa

SEQ ID NO: 641625 - DNA, 13 bp, D. melanogaster
tacatacattcat

SEQ ID NO: 641626 - DNA, 14 bp, D. melanogaster
tacatacattcata

SEQ ID NO: 641627 - DNA, 13 bp, D. melanogaster
tacatacatttat

SEQ ID NO: 641628 - DNA, 13 bp, D. melanogaster
tacatacattttt

SEQ ID NO: 641629 - DNA, 14 bp, D. melanogaster
tacatacattttta

SEQ ID NO: 641630 - DNA, 13 bp, D. melanogaster
tacatacctaatt

SEQ ID NO: 641631 - DNA, 13 bp, D. melanogaster
tacatacgagtat

SEQ ID NO: 641632 - DNA, 14 bp, D. melanogaster
tacatacgagtata

SEQ ID NO: 641633 - DNA, 13 bp, D. melanogaster
tacatacgtacac

SEQ ID NO: 641634 - DNA, 13 bp, D. melanogaster
tacatacgtatat

SEQ ID NO: 641635 - DNA, 14 bp, D. melanogaster
tacatacgtatata

SEQ ID NO: 641636 - DNA, 13 bp, D. melanogaster
tacatacgtgtgt

SEQ ID NO: 641637 - DNA, 13 bp, D. melanogaster
tacatactatata

SEQ ID NO: 641638 - DNA, 13 bp, D. melanogaster
tacatacttatgt

SEQ ID NO: 641639 - DNA, 13 bp, D. melanogaster
tacatacttattt

SEQ ID NO: 641640 - DNA, 13 bp, D. melanogaster
tacatactttgag

SEQ ID NO: 641641 - DNA, 14 bp, D. melanogaster
tacatactttgaga

SEQ ID NO: 641642 - DNA, 13 bp, D. melanogaster
tacatacttttca

SEQ ID NO: 641643 - DNA, 13 bp, D. melanogaster
tacatagaaaaag

SEQ ID NO: 641644 - DNA, 13 bp, D. melanogaster
tacatagagcaac

SEQ ID NO: 641645 - DNA, 13 bp, D. melanogaster
tacatagatacaa

SEQ ID NO: 641646 - DNA, 13 bp, D. melanogaster
tacatagatacat

SEQ ID NO: 641647 - DNA, 13 bp, D. melanogaster
tacatagatatgt

SEQ ID NO: 641648 - DNA, 13 bp, D. melanogaster
tacatagccaatc

SEQ ID NO: 641649 - DNA, 13 bp, D. melanogaster
tacatagtacata

SEQ ID NO: 641650 - DNA, 14 bp, D. melanogaster
tacatataaatatg

SEQ ID NO: 641651 - DNA, 13 bp, D. melanogaster
tacatataaatgt

SEQ ID NO: 641652 - DNA, 14 bp, D. melanogaster
tacatataaatgta

SEQ ID NO: 641653 - DNA, 13 bp, D. melanogaster
tacatataataca

SEQ ID NO: 641654 - DNA, 13 bp, D. melanogaster
tacatatacaaac

SEQ ID NO: 641655 - DNA, 13 bp, D. melanogaster
tacatatacacat

SEQ ID NO: 641656 - DNA, 13 bp, D. melanogaster
tacatatacatac

SEQ ID NO: 641657 - DNA, 14 bp, D. melanogaster
tacatatacataca

SEQ ID NO: 641658 - DNA, 13 bp, D. melanogaster
tacatatacatag

SEQ ID NO: 641659 - DNA, 14 bp, D. melanogaster
tacatatacataga

SEQ ID NO: 641660 - DNA, 13 bp, D. melanogaster
tacatatacatat

SEQ ID NO: 641661 - DNA, 14 bp, D. melanogaster
tacatatacatata

SEQ ID NO: 641662 - DNA, 14 bp, D. melanogaster
tacatatacatatt

SEQ ID NO: 641663 - DNA, 13 bp, D. melanogaster
tacatatacatgt

SEQ ID NO: 641664 - DNA, 13 bp, D. melanogaster
tacatatacctat

SEQ ID NO: 641665 - DNA, 13 bp, D. melanogaster
tacatatacgttt

SEQ ID NO: 641666 - DNA, 13 bp, D. melanogaster
tacatatactata

SEQ ID NO: 641667 - DNA, 13 bp, D. melanogaster
tacatatagacat

SEQ ID NO: 641668 - DNA, 13 bp, D. melanogaster
tacatatagtaca

SEQ ID NO: 641669 - DNA, 13 bp, D. melanogaster
tacatatataaac

SEQ ID NO: 641670 - DNA, 13 bp, D. melanogaster
tacatatataaag

SEQ ID NO: 641671 - DNA, 13 bp, D. melanogaster
tacatatataagc

SEQ ID NO: 641672 - DNA, 14 bp, D. melanogaster
tacatatatacaca

SEQ ID NO: 641673 - DNA, 14 bp, D. melanogaster
tacatatatacatt

SEQ ID NO: 641674 - DNA, 14 bp, D. melanogaster
tacatatataccaa

SEQ ID NO: 641675 - DNA, 13 bp, D. melanogaster
tacatatatactt

SEQ ID NO: 641676 - DNA, 14 bp, D. melanogaster
tacatatatacttt

SEQ ID NO: 641677 - DNA, 13 bp, D. melanogaster
tacatatatagaa

SEQ ID NO: 641678 - DNA, 13 bp, D. melanogaster
tacatatatagac

SEQ ID NO: 641679 - DNA, 13 bp, D. melanogaster
tacatatatagat

SEQ ID NO: 641680 - DNA, 14 bp, D. melanogaster
tacatatatagtat

SEQ ID NO: 641681 - DNA, 14 bp, D. melanogaster
tacatatatataag

SEQ ID NO: 641682 - DNA, 13 bp, D. melanogaster
tacatatatatac

SEQ ID NO: 641683 - DNA, 14 bp, D. melanogaster
tacatatatataga

SEQ ID NO: 641684 - DNA, 13 bp, D. melanogaster
tacatatatatca

SEQ ID NO: 641685 - DNA, 13 bp, D. melanogaster
tacatatatatga

SEQ ID NO: 641686 - DNA, 13 bp, D. melanogaster
tacatatatatgt

SEQ ID NO: 641687 - DNA, 14 bp, D. melanogaster
tacatatatatgta

SEQ ID NO: 641688 - DNA, 13 bp, D. melanogaster
tacatatatcaac

SEQ ID NO: 641689 - DNA, 13 bp, D. melanogaster
tacatatatcagt

SEQ ID NO: 641690 - DNA, 14 bp, D. melanogaster
tacatatatcatat

SEQ ID NO: 641691 - DNA, 13 bp, D. melanogaster
tacatatatcatt

SEQ ID NO: 641692 - DNA, 14 bp, D. melanogaster
tacatatatcattt

SEQ ID NO: 641693 - DNA, 13 bp, D. melanogaster
tacatatatccta

SEQ ID NO: 641694 - DNA, 13 bp, D. melanogaster
tacatatatcctt

SEQ ID NO: 641695 - DNA, 13 bp, D. melanogaster
tacatatatcgaa

SEQ ID NO: 641696 - DNA, 13 bp, D. melanogaster
tacatatatctaa

SEQ ID NO: 641697 - DNA, 14 bp, D. melanogaster
tacatatatctatg

SEQ ID NO: 641698 - DNA, 13 bp, D. melanogaster
tacatatatctgc

SEQ ID NO: 641699 - DNA, 13 bp, D. melanogaster
tacatatatctgt

SEQ ID NO: 641700 - DNA, 13 bp, D. melanogaster
tacatatatgaat

SEQ ID NO: 641701 - DNA, 13 bp, D. melanogaster
tacatatatgatt

SEQ ID NO: 641702 - DNA, 14 bp, D. melanogaster
tacatatatgattt

SEQ ID NO: 641703 - DNA, 14 bp, D. melanogaster
tacatatatgcata

SEQ ID NO: 641704 - DNA, 14 bp, D. melanogaster
tacatatatgcatt

SEQ ID NO: 641705 - DNA, 13 bp, D. melanogaster
tacatatatgctt

SEQ ID NO: 641706 - DNA, 13 bp, D. melanogaster
tacatatatggat

SEQ ID NO: 641707 - DNA, 13 bp, D. melanogaster
tacatatatggca

SEQ ID NO: 641708 - DNA, 14 bp, D. melanogaster
tacatatatggcaa

SEQ ID NO: 641709 - DNA, 13 bp, D. melanogaster
tacatatatgtag

SEQ ID NO: 641710 - DNA, 13 bp, D. melanogaster
tacatatatgtgc

SEQ ID NO: 641711 - DNA, 14 bp, D. melanogaster
tacatatatgtgca

SEQ ID NO: 641712 - DNA, 13 bp, D. melanogaster
tacatatatgtgt

SEQ ID NO: 641713 - DNA, 14 bp, D. melanogaster
tacatatatgtgtg

SEQ ID NO: 641714 - DNA, 13 bp, D. melanogaster
tacatatatgtta

SEQ ID NO: 641715 - DNA, 13 bp, D. melanogaster
tacatatattcgt

SEQ ID NO: 641716 - DNA, 13 bp, D. melanogaster
tacatatattgtt

SEQ ID NO: 641717 - DNA, 14 bp, D. melanogaster
tacatatatttatg

SEQ ID NO: 641718 - DNA, 13 bp, D. melanogaster
tacatatatttct

SEQ ID NO: 641719 - DNA, 13 bp, D. melanogaster
tacatatatttgg

SEQ ID NO: 641720 - DNA, 13 bp, D. melanogaster
tacatatattttc

SEQ ID NO: 641721 - DNA, 13 bp, D. melanogaster
tacatatattttg

SEQ ID NO: 641722 - DNA, 13 bp, D. melanogaster
tacatatccatat

SEQ ID NO: 641723 - DNA, 13 bp, D. melanogaster
tacatatctacat

SEQ ID NO: 641724 - DNA, 13 bp, D. melanogaster
tacatatctcgct

SEQ ID NO: 641725 - DNA, 13 bp, D. melanogaster
tacatatcttaaa

SEQ ID NO: 641726 - DNA, 13 bp, D. melanogaster
tacatatgaatgt

SEQ ID NO: 641727 - DNA, 14 bp, D. melanogaster
tacatatgcacata

SEQ ID NO: 641728 - DNA, 13 bp, D. melanogaster
tacatatgcagat

SEQ ID NO: 641729 - DNA, 14 bp, D. melanogaster
tacatatgcatata

SEQ ID NO: 641730 - DNA, 13 bp, D. melanogaster
tacatatgcatgc

SEQ ID NO: 641731 - DNA, 13 bp, D. melanogaster
tacatatgcattt

SEQ ID NO: 641732 - DNA, 13 bp, D. melanogaster
tacatatgcgaat

SEQ ID NO: 641733 - DNA, 13 bp, D. melanogaster
tacatatgcgttt

SEQ ID NO: 641734 - DNA, 14 bp, D. melanogaster
tacatatgtaaata

SEQ ID NO: 641735 - DNA, 14 bp, D. melanogaster
tacatatgtaaatg

SEQ ID NO: 641736 - DNA, 13 bp, D. melanogaster
tacatatgtaact

SEQ ID NO: 641737 - DNA, 13 bp, D. melanogaster
tacatatgtaagt

SEQ ID NO: 641738 - DNA, 14 bp, D. melanogaster
tacatatgtaagtg

SEQ ID NO: 641739 - DNA, 13 bp, D. melanogaster
tacatatgtacac

SEQ ID NO: 641740 - DNA, 14 bp, D. melanogaster
tacatatgtacata

SEQ ID NO: 641741 - DNA, 14 bp, D. melanogaster
tacatatgtacatg

SEQ ID NO: 641742 - DNA, 14 bp, D. melanogaster
tacatatgtacatt

SEQ ID NO: 641743 - DNA, 13 bp, D. melanogaster
tacatatgtacca

SEQ ID NO: 641744 - DNA, 14 bp, D. melanogaster
tacatatgtacgta

SEQ ID NO: 641745 - DNA, 14 bp, D. melanogaster
tacatatgtacgtg

SEQ ID NO: 641746 - DNA, 14 bp, D. melanogaster
tacatatgtacgtt

SEQ ID NO: 641747 - DNA, 13 bp, D. melanogaster
tacatatgtactt

SEQ ID NO: 641748 - DNA, 13 bp, D. melanogaster
tacatatgtagaa

SEQ ID NO: 641749 - DNA, 13 bp, D. melanogaster
tacatatgtagat

SEQ ID NO: 641750 - DNA, 13 bp, D. melanogaster
tacatatgtagct

SEQ ID NO: 641751 - DNA, 13 bp, D. melanogaster
tacatatgtaggt

SEQ ID NO: 641752 - DNA, 13 bp, D. melanogaster
tacatatgtataa

SEQ ID NO: 641753 - DNA, 14 bp, D. melanogaster
tacatatgtatatg

SEQ ID NO: 641754 - DNA, 14 bp, D. melanogaster
tacatatgtatatt

SEQ ID NO: 641755 - DNA, 13 bp, D. melanogaster
tacatatgtatct

SEQ ID NO: 641756 - DNA, 14 bp, D. melanogaster
tacatatgtatctc

SEQ ID NO: 641757 - DNA, 13 bp, D. melanogaster
tacatatgtatgc

SEQ ID NO: 641758 - DNA, 14 bp, D. melanogaster
tacatatgtatgca

SEQ ID NO: 641759 - DNA, 13 bp, D. melanogaster
tacatatgtatgt

SEQ ID NO: 641760 - DNA, 14 bp, D. melanogaster
tacatatgtatgta

SEQ ID NO: 641761 - DNA, 14 bp, D. melanogaster
tacatatgtatgtg

SEQ ID NO: 641762 - DNA, 13 bp, D. melanogaster
tacatatgtattt

SEQ ID NO: 641763 - DNA, 14 bp, D. melanogaster
tacatatgtattta

SEQ ID NO: 641764 - DNA, 14 bp, D. melanogaster
tacatatgtatttc

SEQ ID NO: 641765 - DNA, 14 bp, D. melanogaster
tacatatgtatttg

SEQ ID NO: 641766 - DNA, 13 bp, D. melanogaster
tacatatgtgaaa

SEQ ID NO: 641767 - DNA, 13 bp, D. melanogaster
tacatatgttaaa

SEQ ID NO: 641768 - DNA, 13 bp, D. melanogaster
tacatattacaaa

SEQ ID NO: 641769 - DNA, 13 bp, D. melanogaster
tacatattacatt

SEQ ID NO: 641770 - DNA, 13 bp, D. melanogaster
tacatattatgta

SEQ ID NO: 641771 - DNA, 13 bp, D. melanogaster
tacatattcatgt

SEQ ID NO: 641772 - DNA, 13 bp, D. melanogaster
tacatattcgtat

SEQ ID NO: 641773 - DNA, 13 bp, D. melanogaster
tacatattgattt

SEQ ID NO: 641774 - DNA, 13 bp, D. melanogaster
tacatattgtatt

SEQ ID NO: 641775 - DNA, 13 bp, D. melanogaster
tacatatttaaag

SEQ ID NO: 641776 - DNA, 13 bp, D. melanogaster
tacatatttaagt

SEQ ID NO: 641777 - DNA, 13 bp, D. melanogaster
tacatatttacaa

SEQ ID NO: 641778 - DNA, 14 bp, D. melanogaster
tacatatttacata

SEQ ID NO: 641779 - DNA, 13 bp, D. melanogaster
tacatatttactt

SEQ ID NO: 641780 - DNA, 13 bp, D. melanogaster
tacatatttatgc

SEQ ID NO: 641781 - DNA, 13 bp, D. melanogaster
tacatatttatgt

SEQ ID NO: 641782 - DNA, 14 bp, D. melanogaster
tacatatttatgta

SEQ ID NO: 641783 - DNA, 13 bp, D. melanogaster
tacatatttcatt

SEQ ID NO: 641784 - DNA, 13 bp, D. melanogaster
tacatatttctaa

SEQ ID NO: 641785 - DNA, 13 bp, D. melanogaster
tacatatttctct

SEQ ID NO: 641786 - DNA, 13 bp, D. melanogaster
tacatatttgaat

SEQ ID NO: 641787 - DNA, 13 bp, D. melanogaster
tacatatttgtat

SEQ ID NO: 641788 - DNA, 13 bp, D. melanogaster
tacatatttgtgt

SEQ ID NO: 641789 - DNA, 13 bp, D. melanogaster
tacatatttgttt

SEQ ID NO: 641790 - DNA, 14 bp, D. melanogaster
tacatatttgtttt

SEQ ID NO: 641791 - DNA, 13 bp, D. melanogaster
tacatattttcct

SEQ ID NO: 641792 - DNA, 13 bp, D. melanogaster
tacatattttgca

SEQ ID NO: 641793 - DNA, 14 bp, D. melanogaster
tacatattttttgt

SEQ ID NO: 641794 - DNA, 14 bp, D. melanogaster
tacatcatattgaa

SEQ ID NO: 641795 - DNA, 13 bp, D. melanogaster
tacatcatcatca

SEQ ID NO: 641796 - DNA, 14 bp, D. melanogaster
tacatcatcatcat

SEQ ID NO: 641797 - DNA, 13 bp, D. melanogaster
tacatccacatcc

SEQ ID NO: 641798 - DNA, 13 bp, D. melanogaster
tacatccagaaac

SEQ ID NO: 641799 - DNA, 13 bp, D. melanogaster
tacatccatacat

SEQ ID NO: 641800 - DNA, 13 bp, D. melanogaster
tacatccatttga

SEQ ID NO: 641801 - DNA, 13 bp, D. melanogaster
tacatctgttaat

SEQ ID NO: 641802 - DNA, 13 bp, D. melanogaster
tacatcttaaaaa

SEQ ID NO: 641803 - DNA, 13 bp, D. melanogaster
tacatgaaaatat

SEQ ID NO: 641804 - DNA, 15 bp, D. melanogaster
tacatgaagaacttg

SEQ ID NO: 641805 - DNA, 13 bp, D. melanogaster
tacatgaatatat

SEQ ID NO: 641806 - DNA, 13 bp, D. melanogaster
tacatgaatctgg

SEQ ID NO: 641807 - DNA, 13 bp, D. melanogaster
tacatgacagaga

SEQ ID NO: 641808 - DNA, 13 bp, D. melanogaster
tacatgatgatcc

SEQ ID NO: 641809 - DNA, 13 bp, D. melanogaster
tacatgcacacat

SEQ ID NO: 641810 - DNA, 14 bp, D. melanogaster
tacatgcatacata

SEQ ID NO: 641811 - DNA, 13 bp, D. melanogaster
tacatgcatatat

SEQ ID NO: 641812 - DNA, 14 bp, D. melanogaster
tacatgcatatata

SEQ ID NO: 641813 - DNA, 13 bp, D. melanogaster
tacatgcatgtat

SEQ ID NO: 641814 - DNA, 13 bp, D. melanogaster
tacatgcatttat

SEQ ID NO: 641815 - DNA, 16 bp, D. melanogaster
tacatggcgaccgtga

SEQ ID NO: 641816 - DNA, 13 bp, D. melanogaster
tacatggcgtata

SEQ ID NO: 641817 - DNA, 14 bp, D. melanogaster
tacatgtacataaa

SEQ ID NO: 641818 - DNA, 13 bp, D. melanogaster
tacatgtacatac

SEQ ID NO: 641819 - DNA, 13 bp, D. melanogaster
tacatgtacatat

SEQ ID NO: 641820 - DNA, 14 bp, D. melanogaster
tacatgtacatata

SEQ ID NO: 641821 - DNA, 14 bp, D. melanogaster
tacatgtacatgta

SEQ ID NO: 641822 - DNA, 13 bp, D. melanogaster
tacatgtatattt

SEQ ID NO: 641823 - DNA, 14 bp, D. melanogaster
tacatgtatgtata

SEQ ID NO: 641824 - DNA, 13 bp, D. melanogaster
tacatgtatgtgt

SEQ ID NO: 641825 - DNA, 13 bp, D. melanogaster
tacatgtattaaa

SEQ ID NO: 641826 - DNA, 13 bp, D. melanogaster
tacatgtattttt

SEQ ID NO: 641827 - DNA, 13 bp, D. melanogaster
tacatgtgtacat

SEQ ID NO: 641828 - DNA, 13 bp, D. melanogaster
tacatgtgtatat

SEQ ID NO: 641829 - DNA, 14 bp, D. melanogaster
tacatgtgtatata

SEQ ID NO: 641830 - DNA, 13 bp, D. melanogaster
tacatgtgtatgt

SEQ ID NO: 641831 - DNA, 13 bp, D. melanogaster
tacatgtttatgt

SEQ ID NO: 641832 - DNA, 13 bp, D. melanogaster
tacatgttttatt

SEQ ID NO: 641833 - DNA, 13 bp, D. melanogaster
tacattaaacatt

SEQ ID NO: 641834 - DNA, 13 bp, D. melanogaster
tacattaaataca

SEQ ID NO: 641835 - DNA, 13 bp, D. melanogaster
tacattaactttt

SEQ ID NO: 641836 - DNA, 13 bp, D. melanogaster
tacattaagtttt

SEQ ID NO: 641837 - DNA, 13 bp, D. melanogaster
tacattacaaatt

SEQ ID NO: 641838 - DNA, 13 bp, D. melanogaster
tacattacataca

SEQ ID NO: 641839 - DNA, 14 bp, D. melanogaster
tacattacatttta

SEQ ID NO: 641840 - DNA, 13 bp, D. melanogaster
tacattagtatat

SEQ ID NO: 641841 - DNA, 13 bp, D. melanogaster
tacattatatatg

SEQ ID NO: 641842 - DNA, 13 bp, D. melanogaster
tacattcaaataa

SEQ ID NO: 641843 - DNA, 13 bp, D. melanogaster
tacattcaacact

SEQ ID NO: 641844 - DNA, 13 bp, D. melanogaster
tacattcaattaa

SEQ ID NO: 641845 - DNA, 14 bp, D. melanogaster
tacattcatacata

SEQ ID NO: 641846 - DNA, 13 bp, D. melanogaster
tacattcatatat

SEQ ID NO: 641847 - DNA, 14 bp, D. melanogaster
tacattcatatata

SEQ ID NO: 641848 - DNA, 13 bp, D. melanogaster
tacattcattcat

SEQ ID NO: 641849 - DNA, 13 bp, D. melanogaster
tacattccatttt

SEQ ID NO: 641850 - DNA, 13 bp, D. melanogaster
tacattcctttga

SEQ ID NO: 641851 - DNA, 13 bp, D. melanogaster
tacattcgttcat

SEQ ID NO: 641852 - DNA, 13 bp, D. melanogaster
tacattctacatt

SEQ ID NO: 641853 - DNA, 13 bp, D. melanogaster
tacattcttatct

SEQ ID NO: 641854 - DNA, 13 bp, D. melanogaster
tacattgagaaat

SEQ ID NO: 641855 - DNA, 13 bp, D. melanogaster
tacattgataact

SEQ ID NO: 641856 - DNA, 13 bp, D. melanogaster
tacattgcagacg

SEQ ID NO: 641857 - DNA, 13 bp, D. melanogaster
tacattgtacagg

SEQ ID NO: 641858 - DNA, 13 bp, D. melanogaster
tacattgtacata

SEQ ID NO: 641859 - DNA, 13 bp, D. melanogaster
tacattgtacatt

SEQ ID NO: 641860 - DNA, 13 bp, D. melanogaster
tacattgtatttt

SEQ ID NO: 641861 - DNA, 13 bp, D. melanogaster
tacattgtgacac

SEQ ID NO: 641862 - DNA, 14 bp, D. melanogaster
tacattgtttaaca

SEQ ID NO: 641863 - DNA, 13 bp, D. melanogaster
tacattgtttatt

SEQ ID NO: 641864 - DNA, 14 bp, D. melanogaster
tacattgtttttat

SEQ ID NO: 641865 - DNA, 14 bp, D. melanogaster
tacatttaaaatct

SEQ ID NO: 641866 - DNA, 13 bp, D. melanogaster
tacatttaaacat

SEQ ID NO: 641867 - DNA, 13 bp, D. melanogaster
tacatttaaattc

SEQ ID NO: 641868 - DNA, 13 bp, D. melanogaster
tacatttaaattg

SEQ ID NO: 641869 - DNA, 13 bp, D. melanogaster
tacatttaactaa

SEQ ID NO: 641870 - DNA, 13 bp, D. melanogaster
tacatttaagttt

SEQ ID NO: 641871 - DNA, 13 bp, D. melanogaster
tacatttaatgaa

SEQ ID NO: 641872 - DNA, 13 bp, D. melanogaster
tacatttacacat

SEQ ID NO: 641873 - DNA, 13 bp, D. melanogaster
tacatttacataa

SEQ ID NO: 641874 - DNA, 13 bp, D. melanogaster
tacatttacatta

SEQ ID NO: 641875 - DNA, 13 bp, D. melanogaster
tacatttacattt

SEQ ID NO: 641876 - DNA, 14 bp, D. melanogaster
tacatttacattta

SEQ ID NO: 641877 - DNA, 14 bp, D. melanogaster
tacatttaccacaa

SEQ ID NO: 641878 - DNA, 13 bp, D. melanogaster
tacatttagtaca

SEQ ID NO: 641879 - DNA, 14 bp, D. melanogaster
tacatttatctgca

SEQ ID NO: 641880 - DNA, 13 bp, D. melanogaster
tacatttatggca

SEQ ID NO: 641881 - DNA, 13 bp, D. melanogaster
tacatttatttca

SEQ ID NO: 641882 - DNA, 13 bp, D. melanogaster
tacatttcaaatg

SEQ ID NO: 641883 - DNA, 13 bp, D. melanogaster
tacatttcaataa

SEQ ID NO: 641884 - DNA, 13 bp, D. melanogaster
tacatttcaattt

SEQ ID NO: 641885 - DNA, 13 bp, D. melanogaster
tacatttccatca

SEQ ID NO: 641886 - DNA, 13 bp, D. melanogaster
tacatttccattt

SEQ ID NO: 641887 - DNA, 13 bp, D. melanogaster
tacatttcccttc

SEQ ID NO: 641888 - DNA, 13 bp, D. melanogaster
tacatttgaatca

SEQ ID NO: 641889 - DNA, 13 bp, D. melanogaster
tacatttgatttt

SEQ ID NO: 641890 - DNA, 13 bp, D. melanogaster
tacatttgccaaa

SEQ ID NO: 641891 - DNA, 13 bp, D. melanogaster
tacatttgtaaat

SEQ ID NO: 641892 - DNA, 14 bp, D. melanogaster
tacatttgtacata

SEQ ID NO: 641893 - DNA, 13 bp, D. melanogaster
tacatttgtatct

SEQ ID NO: 641894 - DNA, 13 bp, D. melanogaster
tacatttgtttaa

SEQ ID NO: 641895 - DNA, 14 bp, D. melanogaster
tacatttgtttatt

SEQ ID NO: 641896 - DNA, 13 bp, D. melanogaster
tacatttgtttgt

SEQ ID NO: 641897 - DNA, 13 bp, D. melanogaster
tacatttgttttg

SEQ ID NO: 641898 - DNA, 13 bp, D. melanogaster
tacattttaaaga

SEQ ID NO: 641899 - DNA, 13 bp, D. melanogaster
tacattttaaagc

SEQ ID NO: 641900 - DNA, 13 bp, D. melanogaster
tacattttaagat

SEQ ID NO: 641901 - DNA, 13 bp, D. melanogaster
tacattttaatgc

SEQ ID NO: 641902 - DNA, 13 bp, D. melanogaster
tacattttacatt

SEQ ID NO: 641903 - DNA, 13 bp, D. melanogaster
tacattttagttt

SEQ ID NO: 641904 - DNA, 13 bp, D. melanogaster
tacattttataca

SEQ ID NO: 641905 - DNA, 13 bp, D. melanogaster
tacattttatggc

SEQ ID NO: 641906 - DNA, 14 bp, D. melanogaster
tacattttattgtt

SEQ ID NO: 641907 - DNA, 14 bp, D. melanogaster
tacattttatttgc

SEQ ID NO: 641908 - DNA, 13 bp, D. melanogaster
tacattttcataa

SEQ ID NO: 641909 - DNA, 13 bp, D. melanogaster
tacattttccaaa

SEQ ID NO: 641910 - DNA, 13 bp, D. melanogaster
tacattttccaca

SEQ ID NO: 641911 - DNA, 13 bp, D. melanogaster
tacattttccagc

SEQ ID NO: 641912 - DNA, 14 bp, D. melanogaster
tacattttgaaaat

SEQ ID NO: 641913 - DNA, 13 bp, D. melanogaster
tacattttgaaat

SEQ ID NO: 641914 - DNA, 13 bp, D. melanogaster
tacattttgatgt

SEQ ID NO: 641915 - DNA, 13 bp, D. melanogaster
tacattttggctt

SEQ ID NO: 641916 - DNA, 14 bp, D. melanogaster
tacattttgtaaat

SEQ ID NO: 641917 - DNA, 13 bp, D. melanogaster
tacattttgtatg

SEQ ID NO: 641918 - DNA, 13 bp, D. melanogaster
tacattttgtgta

SEQ ID NO: 641919 - DNA, 13 bp, D. melanogaster
tacattttgtgtg

SEQ ID NO: 641920 - DNA, 13 bp, D. melanogaster
tacattttgttta

SEQ ID NO: 641921 - DNA, 14 bp, D. melanogaster
tacatttttaaaag

SEQ ID NO: 641922 - DNA, 14 bp, D. melanogaster
tacatttttaaatg

SEQ ID NO: 641923 - DNA, 13 bp, D. melanogaster
tacatttttaagt

SEQ ID NO: 641924 - DNA, 13 bp, D. melanogaster
tacatttttatga

SEQ ID NO: 641925 - DNA, 13 bp, D. melanogaster
tacatttttccca

SEQ ID NO: 641926 - DNA, 13 bp, D. melanogaster
tacatttttgctg

SEQ ID NO: 641927 - DNA, 13 bp, D. melanogaster
tacatttttggtt

SEQ ID NO: 641928 - DNA, 13 bp, D. melanogaster
tacatttttgtaa

SEQ ID NO: 641929 - DNA, 14 bp, D. melanogaster
tacatttttgtaat

SEQ ID NO: 641930 - DNA, 13 bp, D. melanogaster
tacatttttgtat

SEQ ID NO: 641931 - DNA, 13 bp, D. melanogaster
tacattttttagt

SEQ ID NO: 641932 - DNA, 13 bp, D. melanogaster
tacattttttatg

SEQ ID NO: 641933 - DNA, 13 bp, D. melanogaster
tacattttttcga

SEQ ID NO: 641934 - DNA, 13 bp, D. melanogaster
tacattttttgta

SEQ ID NO: 641935 - DNA, 14 bp, D. melanogaster
tacattttttgtat

SEQ ID NO: 641936 - DNA, 13 bp, D. melanogaster
tacatttttttcg

SEQ ID NO: 641937 - DNA, 13 bp, D. melanogaster
taccaaaaaatgt

SEQ ID NO: 641938 - DNA, 13 bp, D. melanogaster
taccaaaacattt

SEQ ID NO: 641939 - DNA, 13 bp, D. melanogaster
taccaaaactttt

SEQ ID NO: 641940 - DNA, 13 bp, D. melanogaster
taccaaaataacg

SEQ ID NO: 641941 - DNA, 14 bp, D. melanogaster
taccaaacaaatga

SEQ ID NO: 641942 - DNA, 13 bp, D. melanogaster
taccaaacatttt

SEQ ID NO: 641943 - DNA, 13 bp, D. melanogaster
taccaaagaaacc

SEQ ID NO: 641944 - DNA, 13 bp, D. melanogaster
taccaaagaattg

SEQ ID NO: 641945 - DNA, 13 bp, D. melanogaster
taccaaataccaa

SEQ ID NO: 641946 - DNA, 13 bp, D. melanogaster
taccaaatactgc

SEQ ID NO: 641947 - DNA, 14 bp, D. melanogaster
taccaaatagacta

SEQ ID NO: 641948 - DNA, 13 bp, D. melanogaster
taccaaatcaaat

SEQ ID NO: 641949 - DNA, 13 bp, D. melanogaster
taccaaatgaact

SEQ ID NO: 641950 - DNA, 13 bp, D. melanogaster
taccaaatttgaa

SEQ ID NO: 641951 - DNA, 13 bp, D. melanogaster
taccaacagattt

SEQ ID NO: 641952 - DNA, 13 bp, D. melanogaster
taccaatacaatt

SEQ ID NO: 641953 - DNA, 14 bp, D. melanogaster
taccaatacaatta

SEQ ID NO: 641954 - DNA, 14 bp, D. melanogaster
taccaataccaata

SEQ ID NO: 641955 - DNA, 13 bp, D. melanogaster
taccaatccgagc

SEQ ID NO: 641956 - DNA, 13 bp, D. melanogaster
taccaatctatta

SEQ ID NO: 641957 - DNA, 13 bp, D. melanogaster
taccaatggaatt

SEQ ID NO: 641958 - DNA, 13 bp, D. melanogaster
taccaattcatgg

SEQ ID NO: 641959 - DNA, 13 bp, D. melanogaster
taccaattccaaa

SEQ ID NO: 641960 - DNA, 13 bp, D. melanogaster
taccacaatataa

SEQ ID NO: 641961 - DNA, 13 bp, D. melanogaster
taccacaatttat

SEQ ID NO: 641962 - DNA, 13 bp, D. melanogaster
taccacgaccagt

SEQ ID NO: 641963 - DNA, 14 bp, D. melanogaster
taccacgcccactc

SEQ ID NO: 641964 - DNA, 13 bp, D. melanogaster
taccactgccact

SEQ ID NO: 641965 - DNA, 13 bp, D. melanogaster
taccagaagatgt

SEQ ID NO: 641966 - DNA, 13 bp, D. melanogaster
taccagcagcaga

SEQ ID NO: 641967 - DNA, 13 bp, D. melanogaster
taccagggcatta

SEQ ID NO: 641968 - DNA, 13 bp, D. melanogaster
taccaggtgcctg

SEQ ID NO: 641969 - DNA, 14 bp, D. melanogaster
taccagtggaaacc

SEQ ID NO: 641970 - DNA, 13 bp, D. melanogaster
taccagttaccag

SEQ ID NO: 641971 - DNA, 14 bp, D. melanogaster
taccatacatacat

SEQ ID NO: 641972 - DNA, 13 bp, D. melanogaster
taccatatacata

SEQ ID NO: 641973 - DNA, 14 bp, D. melanogaster
taccatatacatat

SEQ ID NO: 641974 - DNA, 13 bp, D. melanogaster
taccatatatatg

SEQ ID NO: 641975 - DNA, 13 bp, D. melanogaster
taccatatatatt

SEQ ID NO: 641976 - DNA, 13 bp, D. melanogaster
taccatattttct

SEQ ID NO: 641977 - DNA, 13 bp, D. melanogaster
taccatcatcaaa

SEQ ID NO: 641978 - DNA, 13 bp, D. melanogaster
taccattaccatt

SEQ ID NO: 641979 - DNA, 13 bp, D. melanogaster
taccattataccc

SEQ ID NO: 641980 - DNA, 13 bp, D. melanogaster
taccattcggttt

SEQ ID NO: 641981 - DNA, 13 bp, D. melanogaster
taccattgtaaaa

SEQ ID NO: 641982 - DNA, 13 bp, D. melanogaster
taccatttaaaat

SEQ ID NO: 641983 - DNA, 13 bp, D. melanogaster
taccatttaccat

SEQ ID NO: 641984 - DNA, 13 bp, D. melanogaster
taccatttatatt

SEQ ID NO: 641985 - DNA, 14 bp, D. melanogaster
taccatttatattg

SEQ ID NO: 641986 - DNA, 13 bp, D. melanogaster
taccatttcaatt

SEQ ID NO: 641987 - DNA, 13 bp, D. melanogaster
taccatttcagtt

SEQ ID NO: 641988 - DNA, 13 bp, D. melanogaster
taccatttccacc

SEQ ID NO: 641989 - DNA, 13 bp, D. melanogaster
taccatttctaag

SEQ ID NO: 641990 - DNA, 13 bp, D. melanogaster
taccattttccat

SEQ ID NO: 641991 - DNA, 13 bp, D. melanogaster
taccattttccca

SEQ ID NO: 641992 - DNA, 13 bp, D. melanogaster
tacccaaaaatta

SEQ ID NO: 641993 - DNA, 13 bp, D. melanogaster
tacccaacactga

SEQ ID NO: 641994 - DNA, 13 bp, D. melanogaster
tacccaacccatg

SEQ ID NO: 641995 - DNA, 13 bp, D. melanogaster
tacccaagaaaat

SEQ ID NO: 641996 - DNA, 14 bp, D. melanogaster
tacccaattccgac

SEQ ID NO: 641997 - DNA, 13 bp, D. melanogaster
tacccacgcacac

SEQ ID NO: 641998 - DNA, 14 bp, D. melanogaster
tacccacgcacaca

SEQ ID NO: 641999 - DNA, 13 bp, D. melanogaster
tacccagactcca

SEQ ID NO: 642000 - DNA, 13 bp, D. melanogaster
tacccatacccac

SEQ ID NO: 642001 - DNA, 13 bp, D. melanogaster
tacccatatatac

SEQ ID NO: 642002 - DNA, 13 bp, D. melanogaster
tacccatcaacag

SEQ ID NO: 642003 - DNA, 13 bp, D. melanogaster
tacccatgcccat

SEQ ID NO: 642004 - DNA, 13 bp, D. melanogaster
tacccatgcggca

SEQ ID NO: 642005 - DNA, 13 bp, D. melanogaster
tacccattactca

SEQ ID NO: 642006 - DNA, 13 bp, D. melanogaster
tacccattatttg

SEQ ID NO: 642007 - DNA, 14 bp, D. melanogaster
tacccattcccatt

SEQ ID NO: 642008 - DNA, 13 bp, D. melanogaster
tacccatttccaa

SEQ ID NO: 642009 - DNA, 13 bp, D. melanogaster
tacccctacagca

SEQ ID NO: 642010 - DNA, 14 bp, D. melanogaster
taccccttaaaaaa

SEQ ID NO: 642011 - DNA, 13 bp, D. melanogaster
tacccgctgccgg

SEQ ID NO: 642012 - DNA, 14 bp, D. melanogaster
taccctaatatgta

SEQ ID NO: 642013 - DNA, 13 bp, D. melanogaster
taccctgtactta

SEQ ID NO: 642014 - DNA, 14 bp, D. melanogaster
taccctgtacttat

SEQ ID NO: 642015 - DNA, 13 bp, D. melanogaster
tacccttcatttc

SEQ ID NO: 642016 - DNA, 13 bp, D. melanogaster
taccgaaaataaa

SEQ ID NO: 642017 - DNA, 13 bp, D. melanogaster
taccgcaaactgc

SEQ ID NO: 642018 - DNA, 13 bp, D. melanogaster
taccgcacaaaaa

SEQ ID NO: 642019 - DNA, 13 bp, D. melanogaster
taccgctccacat

SEQ ID NO: 642020 - DNA, 13 bp, D. melanogaster
taccgctccgcat

SEQ ID NO: 642021 - DNA, 13 bp, D. melanogaster
taccggcaacatg

SEQ ID NO: 642022 - DNA, 13 bp, D. melanogaster
taccgtacaacca

SEQ ID NO: 642023 - DNA, 13 bp, D. melanogaster
taccgttaccaaa

SEQ ID NO: 642024 - DNA, 13 bp, D. melanogaster
tacctaaagatat

SEQ ID NO: 642025 - DNA, 13 bp, D. melanogaster
tacctacacacat

SEQ ID NO: 642026 - DNA, 14 bp, D. melanogaster
tacctacatacata

SEQ ID NO: 642027 - DNA, 14 bp, D. melanogaster
tacctacctaccta

SEQ ID NO: 642028 - DNA, 13 bp, D. melanogaster
tacctataatatt

SEQ ID NO: 642029 - DNA, 13 bp, D. melanogaster
tacctatacctat

SEQ ID NO: 642030 - DNA, 13 bp, D. melanogaster
tacctatgtatat

SEQ ID NO: 642031 - DNA, 14 bp, D. melanogaster
tacctatgtatgta

SEQ ID NO: 642032 - DNA, 13 bp, D. melanogaster
tacctattttcta

SEQ ID NO: 642033 - DNA, 13 bp, D. melanogaster
tacctccagcaga

SEQ ID NO: 642034 - DNA, 13 bp, D. melanogaster
tacctcgacttta

SEQ ID NO: 642035 - DNA, 13 bp, D. melanogaster
tacctgtctggcg

SEQ ID NO: 642036 - DNA, 13 bp, D. melanogaster
tacctgtctgtat

SEQ ID NO: 642037 - DNA, 13 bp, D. melanogaster
tacctgtgatcaa

SEQ ID NO: 642038 - DNA, 13 bp, D. melanogaster
tacctgttcccca

SEQ ID NO: 642039 - DNA, 13 bp, D. melanogaster
tacctgtttaacg

SEQ ID NO: 642040 - DNA, 14 bp, D. melanogaster
taccttaccttacc

SEQ ID NO: 642041 - DNA, 13 bp, D. melanogaster
taccttccaggtg

SEQ ID NO: 642042 - DNA, 13 bp, D. melanogaster
taccttgaacgac

SEQ ID NO: 642043 - DNA, 14 bp, D. melanogaster
taccttggccagtt

SEQ ID NO: 642044 - DNA, 13 bp, D. melanogaster
tacctttagctgt

SEQ ID NO: 642045 - DNA, 14 bp, D. melanogaster
tacctttatttttg

SEQ ID NO: 642046 - DNA, 13 bp, D. melanogaster
taccttttcgcat

SEQ ID NO: 642047 - DNA, 13 bp, D. melanogaster
tacctttttggtg

SEQ ID NO: 642048 - DNA, 14 bp, D. melanogaster
tacgaaaaaaacat

SEQ ID NO: 642049 - DNA, 13 bp, D. melanogaster
tacgaaaaaatat

SEQ ID NO: 642050 - DNA, 13 bp, D. melanogaster
tacgaaaaatatt

SEQ ID NO: 642051 - DNA, 13 bp, D. melanogaster
tacgaaaataatt

SEQ ID NO: 642052 - DNA, 13 bp, D. melanogaster
tacgaaaattaaa

SEQ ID NO: 642053 - DNA, 13 bp, D. melanogaster
tacgaaataaatt

SEQ ID NO: 642054 - DNA, 13 bp, D. melanogaster
tacgaaatatatt

SEQ ID NO: 642055 - DNA, 13 bp, D. melanogaster
tacgaaatgcatt

SEQ ID NO: 642056 - DNA, 13 bp, D. melanogaster
tacgaaattggca

SEQ ID NO: 642057 - DNA, 13 bp, D. melanogaster
tacgaacacacaa

SEQ ID NO: 642058 - DNA, 14 bp, D. melanogaster
tacgaaccgattac

SEQ ID NO: 642059 - DNA, 13 bp, D. melanogaster
tacgaacgatatg

SEQ ID NO: 642060 - DNA, 13 bp, D. melanogaster
tacgaagtagaaa

SEQ ID NO: 642061 - DNA, 13 bp, D. melanogaster
tacgaataacggg

SEQ ID NO: 642062 - DNA, 13 bp, D. melanogaster
tacgaatacataa

SEQ ID NO: 642063 - DNA, 13 bp, D. melanogaster
tacgaatatttat

SEQ ID NO: 642064 - DNA, 13 bp, D. melanogaster
tacgacctaataa

SEQ ID NO: 642065 - DNA, 13 bp, D. melanogaster
tacgacttcgact

SEQ ID NO: 642066 - DNA, 14 bp, D. melanogaster
tacgagctcaacga

SEQ ID NO: 642067 - DNA, 14 bp, D. melanogaster
tacgagtaaaaaaa

SEQ ID NO: 642068 - DNA, 14 bp, D. melanogaster
tacgagtacgagta

SEQ ID NO: 642069 - DNA, 13 bp, D. melanogaster
tacgagtatatac

SEQ ID NO: 642070 - DNA, 13 bp, D. melanogaster
tacgagtatatcc

SEQ ID NO: 642071 - DNA, 13 bp, D. melanogaster
tacgagtatatgt

SEQ ID NO: 642072 - DNA, 14 bp, D. melanogaster
tacgagtatatgta

SEQ ID NO: 642073 - DNA, 14 bp, D. melanogaster
tacgagtatatgtg

SEQ ID NO: 642074 - DNA, 13 bp, D. melanogaster
tacgagtatgtat

SEQ ID NO: 642075 - DNA, 14 bp, D. melanogaster
tacgagtatgtatg

SEQ ID NO: 642076 - DNA, 13 bp, D. melanogaster
tacgagtatgtgc

SEQ ID NO: 642077 - DNA, 14 bp, D. melanogaster
tacgagtgcacttg

SEQ ID NO: 642078 - DNA, 14 bp, D. melanogaster
tacgagttcaacga

SEQ ID NO: 642079 - DNA, 13 bp, D. melanogaster
tacgatacctata

SEQ ID NO: 642080 - DNA, 13 bp, D. melanogaster
tacgatatgagtt

SEQ ID NO: 642081 - DNA, 13 bp, D. melanogaster
tacgatcttcttc

SEQ ID NO: 642082 - DNA, 13 bp, D. melanogaster
tacgattacgatt

SEQ ID NO: 642083 - DNA, 13 bp, D. melanogaster
tacgattcgattc

SEQ ID NO: 642084 - DNA, 13 bp, D. melanogaster
tacgatttcgatt

SEQ ID NO: 642085 - DNA, 13 bp, D. melanogaster
tacgattttaaat

SEQ ID NO: 642086 - DNA, 13 bp, D. melanogaster
tacgattttattt

SEQ ID NO: 642087 - DNA, 13 bp, D. melanogaster
tacgcaaatattt

SEQ ID NO: 642088 - DNA, 14 bp, D. melanogaster
tacgcacacacaca

SEQ ID NO: 642089 - DNA, 13 bp, D. melanogaster
tacgcacacgcac

SEQ ID NO: 642090 - DNA, 13 bp, D. melanogaster
tacgcacgcacac

SEQ ID NO: 642091 - DNA, 13 bp, D. melanogaster
tacgcagcgtggc

SEQ ID NO: 642092 - DNA, 13 bp, D. melanogaster
tacgcagtgttgt

SEQ ID NO: 642093 - DNA, 13 bp, D. melanogaster
tacgcataaataa

SEQ ID NO: 642094 - DNA, 13 bp, D. melanogaster
tacgcatacatat

SEQ ID NO: 642095 - DNA, 13 bp, D. melanogaster
tacgcatacgaca

SEQ ID NO: 642096 - DNA, 13 bp, D. melanogaster
tacgcatacgcaa

SEQ ID NO: 642097 - DNA, 13 bp, D. melanogaster
tacgcatacgcac

SEQ ID NO: 642098 - DNA, 13 bp, D. melanogaster
tacgcatttattt

SEQ ID NO: 642099 - DNA, 13 bp, D. melanogaster
tacgccacgttgc

SEQ ID NO: 642100 - DNA, 13 bp, D. melanogaster
tacgccagcagcg

SEQ ID NO: 642101 - DNA, 13 bp, D. melanogaster
tacgccatgtggt

SEQ ID NO: 642102 - DNA, 13 bp, D. melanogaster
tacgccatgttgt

SEQ ID NO: 642103 - DNA, 13 bp, D. melanogaster
tacgccgtgtggt

SEQ ID NO: 642104 - DNA, 13 bp, D. melanogaster
tacgcgtgtgtgt

SEQ ID NO: 642105 - DNA, 13 bp, D. melanogaster
tacgcgttgttgc

SEQ ID NO: 642106 - DNA, 13 bp, D. melanogaster
tacgctaaggaga

SEQ ID NO: 642107 - DNA, 13 bp, D. melanogaster
tacgctcaatatg

SEQ ID NO: 642108 - DNA, 15 bp, D. melanogaster
tacgctgctcttctg

SEQ ID NO: 642109 - DNA, 13 bp, D. melanogaster
tacgctggccaac

SEQ ID NO: 642110 - DNA, 13 bp, D. melanogaster
tacgcttcaagaa

SEQ ID NO: 642111 - DNA, 14 bp, D. melanogaster
tacgcttcaagaag

SEQ ID NO: 642112 - DNA, 13 bp, D. melanogaster
tacggaaatgcca

SEQ ID NO: 642113 - DNA, 13 bp, D. melanogaster
tacggaatacaaa

SEQ ID NO: 642114 - DNA, 13 bp, D. melanogaster
tacggaatacgga

SEQ ID NO: 642115 - DNA, 13 bp, D. melanogaster
tacggacaaacgg

SEQ ID NO: 642116 - DNA, 14 bp, D. melanogaster
tacggacagacgga

SEQ ID NO: 642117 - DNA, 13 bp, D. melanogaster
tacggacggacag

SEQ ID NO: 642118 - DNA, 14 bp, D. melanogaster
tacggacggacaga

SEQ ID NO: 642119 - DNA, 13 bp, D. melanogaster
tacggcaagaacc

SEQ ID NO: 642120 - DNA, 13 bp, D. melanogaster
tacggcaggaaaa

SEQ ID NO: 642121 - DNA, 13 bp, D. melanogaster
tacggcggatttc

SEQ ID NO: 642122 - DNA, 13 bp, D. melanogaster
tacggctcgattc

SEQ ID NO: 642123 - DNA, 13 bp, D. melanogaster
tacggggcgtatg

SEQ ID NO: 642124 - DNA, 13 bp, D. melanogaster
tacggtaggaaaa

SEQ ID NO: 642125 - DNA, 13 bp, D. melanogaster
tacgtaatccact

SEQ ID NO: 642126 - DNA, 14 bp, D. melanogaster
tacgtacaactttt

SEQ ID NO: 642127 - DNA, 14 bp, D. melanogaster
tacgtacatatgta

SEQ ID NO: 642128 - DNA, 14 bp, D. melanogaster
tacgtacatatgtg

SEQ ID NO: 642129 - DNA, 13 bp, D. melanogaster
tacgtacgtacgt

SEQ ID NO: 642130 - DNA, 14 bp, D. melanogaster
tacgtacgtacgta

SEQ ID NO: 642131 - DNA, 13 bp, D. melanogaster
tacgtacgtatgt

SEQ ID NO: 642132 - DNA, 14 bp, D. melanogaster
tacgtatacatata

SEQ ID NO: 642133 - DNA, 13 bp, D. melanogaster
tacgtatacgaca

SEQ ID NO: 642134 - DNA, 13 bp, D. melanogaster
tacgtatacgcat

SEQ ID NO: 642135 - DNA, 13 bp, D. melanogaster
tacgtatacgtaa

SEQ ID NO: 642136 - DNA, 14 bp, D. melanogaster
tacgtatacgtaat

SEQ ID NO: 642137 - DNA, 13 bp, D. melanogaster
tacgtatacgtat

SEQ ID NO: 642138 - DNA, 14 bp, D. melanogaster
tacgtatataaata

SEQ ID NO: 642139 - DNA, 13 bp, D. melanogaster
tacgtatatatgt

SEQ ID NO: 642140 - DNA, 13 bp, D. melanogaster
tacgtatattttt

SEQ ID NO: 642141 - DNA, 14 bp, D. melanogaster
tacgtatattttta

SEQ ID NO: 642142 - DNA, 14 bp, D. melanogaster
tacgtatgtacata

SEQ ID NO: 642143 - DNA, 13 bp, D. melanogaster
tacgtatgtatat

SEQ ID NO: 642144 - DNA, 14 bp, D. melanogaster
tacgtatgtatgta

SEQ ID NO: 642145 - DNA, 13 bp, D. melanogaster
tacgtatgtattt

SEQ ID NO: 642146 - DNA, 14 bp, D. melanogaster
tacgtccacgacgt

SEQ ID NO: 642147 - DNA, 13 bp, D. melanogaster
tacgtgcagacat

SEQ ID NO: 642148 - DNA, 13 bp, D. melanogaster
tacgtggatgtat

SEQ ID NO: 642149 - DNA, 13 bp, D. melanogaster
tacgtgggctata

SEQ ID NO: 642150 - DNA, 13 bp, D. melanogaster
tacgtgtagaaca

SEQ ID NO: 642151 - DNA, 13 bp, D. melanogaster
tacgtgtatatat

SEQ ID NO: 642152 - DNA, 15 bp, D. melanogaster
tacgtgtatatgtat

SEQ ID NO: 642153 - DNA, 13 bp, D. melanogaster
tacgtgtgcacac

SEQ ID NO: 642154 - DNA, 13 bp, D. melanogaster
tacgtgtgcgtgt

SEQ ID NO: 642155 - DNA, 13 bp, D. melanogaster
tacgtgtgtatgt

SEQ ID NO: 642156 - DNA, 13 bp, D. melanogaster
tacgtgtgtgtgt

SEQ ID NO: 642157 - DNA, 13 bp, D. melanogaster
tacgttaataatt

SEQ ID NO: 642158 - DNA, 13 bp, D. melanogaster
tacgttacgcaca

SEQ ID NO: 642159 - DNA, 14 bp, D. melanogaster
tacgttatggaaaa

SEQ ID NO: 642160 - DNA, 13 bp, D. melanogaster
tacgttctccaag

SEQ ID NO: 642161 - DNA, 13 bp, D. melanogaster
tacgtttaattta

SEQ ID NO: 642162 - DNA, 13 bp, D. melanogaster
tacgtttacgttt

SEQ ID NO: 642163 - DNA, 13 bp, D. melanogaster
tacgtttgaagtt

SEQ ID NO: 642164 - DNA, 14 bp, D. melanogaster
tacgtttgcctgca

SEQ ID NO: 642165 - DNA, 13 bp, D. melanogaster
tacgtttgtatgt

SEQ ID NO: 642166 - DNA, 13 bp, D. melanogaster
tacgttttaattt

SEQ ID NO: 642167 - DNA, 13 bp, D. melanogaster
tacgttttcattt

SEQ ID NO: 642168 - DNA, 13 bp, D. melanogaster
tactaaaatactt

SEQ ID NO: 642169 - DNA, 13 bp, D. melanogaster
tactaaaatgata

SEQ ID NO: 642170 - DNA, 13 bp, D. melanogaster
tactaaatacaac

SEQ ID NO: 642171 - DNA, 13 bp, D. melanogaster
tactaaatgaaaa

SEQ ID NO: 642172 - DNA, 13 bp, D. melanogaster
tactaataccaat

SEQ ID NO: 642173 - DNA, 13 bp, D. melanogaster
tactaatggaatt

SEQ ID NO: 642174 - DNA, 13 bp, D. melanogaster
tactaatttcgaa

SEQ ID NO: 642175 - DNA, 13 bp, D. melanogaster
tactacaatatat

SEQ ID NO: 642176 - DNA, 14 bp, D. melanogaster
tactacagtaccca

SEQ ID NO: 642177 - DNA, 13 bp, D. melanogaster
tactacatacata

SEQ ID NO: 642178 - DNA, 13 bp, D. melanogaster
tactacattacca

SEQ ID NO: 642179 - DNA, 15 bp, D. melanogaster
tactacctgatccaa

SEQ ID NO: 642180 - DNA, 13 bp, D. melanogaster
tactacgagtata

SEQ ID NO: 642181 - DNA, 13 bp, D. melanogaster
tactactactaaa

SEQ ID NO: 642182 - DNA, 13 bp, D. melanogaster
tactactactact

SEQ ID NO: 642183 - DNA, 14 bp, D. melanogaster
tactactactactt

SEQ ID NO: 642184 - DNA, 13 bp, D. melanogaster
tactactactata

SEQ ID NO: 642185 - DNA, 13 bp, D. melanogaster
tactactactttg

SEQ ID NO: 642186 - DNA, 13 bp, D. melanogaster
tactactatacta

SEQ ID NO: 642187 - DNA, 13 bp, D. melanogaster
tactactattact

SEQ ID NO: 642188 - DNA, 13 bp, D. melanogaster
tactatacaaata

SEQ ID NO: 642189 - DNA, 13 bp, D. melanogaster
tactatacatttt

SEQ ID NO: 642190 - DNA, 13 bp, D. melanogaster
tactatactacta

SEQ ID NO: 642191 - DNA, 14 bp, D. melanogaster
tactatagtcaata

SEQ ID NO: 642192 - DNA, 14 bp, D. melanogaster
tactatatactata

SEQ ID NO: 642193 - DNA, 13 bp, D. melanogaster
tactatatataca

SEQ ID NO: 642194 - DNA, 14 bp, D. melanogaster
tactatatatgtac

SEQ ID NO: 642195 - DNA, 14 bp, D. melanogaster
tactatatgtatat

SEQ ID NO: 642196 - DNA, 13 bp, D. melanogaster
tactatatgtatg

SEQ ID NO: 642197 - DNA, 14 bp, D. melanogaster
tactatcaacgaaa

SEQ ID NO: 642198 - DNA, 13 bp, D. melanogaster
tactatcgaaaag

SEQ ID NO: 642199 - DNA, 14 bp, D. melanogaster
tactatctcaagac

SEQ ID NO: 642200 - DNA, 13 bp, D. melanogaster
tactatgtatata

SEQ ID NO: 642201 - DNA, 13 bp, D. melanogaster
tactatgtatgta

SEQ ID NO: 642202 - DNA, 13 bp, D. melanogaster
tactattactatt

SEQ ID NO: 642203 - DNA, 13 bp, D. melanogaster
tactattatgccc

SEQ ID NO: 642204 - DNA, 13 bp, D. melanogaster
tactattttgaat

SEQ ID NO: 642205 - DNA, 13 bp, D. melanogaster
tactatttttatg

SEQ ID NO: 642206 - DNA, 13 bp, D. melanogaster
tactatttttgat

SEQ ID NO: 642207 - DNA, 13 bp, D. melanogaster
tactcaaaatatt

SEQ ID NO: 642208 - DNA, 13 bp, D. melanogaster
tactcaactagtg

SEQ ID NO: 642209 - DNA, 13 bp, D. melanogaster
tactcacaatatt

SEQ ID NO: 642210 - DNA, 14 bp, D. melanogaster
tactcacaatattc

SEQ ID NO: 642211 - DNA, 13 bp, D. melanogaster
tactcacagcaaa

SEQ ID NO: 642212 - DNA, 13 bp, D. melanogaster
tactcactgtggc

SEQ ID NO: 642213 - DNA, 13 bp, D. melanogaster
tactcagatactc

SEQ ID NO: 642214 - DNA, 14 bp, D. melanogaster
tactcagctagtgt

SEQ ID NO: 642215 - DNA, 13 bp, D. melanogaster
tactcagctattg

SEQ ID NO: 642216 - DNA, 13 bp, D. melanogaster
tactcagtactca

SEQ ID NO: 642217 - DNA, 13 bp, D. melanogaster
tactcagtttttg

SEQ ID NO: 642218 - DNA, 13 bp, D. melanogaster
tactcataaatat

SEQ ID NO: 642219 - DNA, 13 bp, D. melanogaster
tactcatacgcaa

SEQ ID NO: 642220 - DNA, 13 bp, D. melanogaster
tactcatactcat

SEQ ID NO: 642221 - DNA, 13 bp, D. melanogaster
tactcatatatat

SEQ ID NO: 642222 - DNA, 14 bp, D. melanogaster
tactcatatttttc

SEQ ID NO: 642223 - DNA, 13 bp, D. melanogaster
tactccacggcca

SEQ ID NO: 642224 - DNA, 13 bp, D. melanogaster
tactccactccac

SEQ ID NO: 642225 - DNA, 14 bp, D. melanogaster
tactccagttactt

SEQ ID NO: 642226 - DNA, 13 bp, D. melanogaster
tactccttttgat

SEQ ID NO: 642227 - DNA, 13 bp, D. melanogaster
tactcgaaaaagt

SEQ ID NO: 642228 - DNA, 13 bp, D. melanogaster
tactcgagtggtc

SEQ ID NO: 642229 - DNA, 13 bp, D. melanogaster
tactcgtacatac

SEQ ID NO: 642230 - DNA, 13 bp, D. melanogaster
tactcgtacatat

SEQ ID NO: 642231 - DNA, 13 bp, D. melanogaster
tactcgtactcgt

SEQ ID NO: 642232 - DNA, 14 bp, D. melanogaster
tactcgtactcgta

SEQ ID NO: 642233 - DNA, 13 bp, D. melanogaster
tactcgtatatat

SEQ ID NO: 642234 - DNA, 13 bp, D. melanogaster
tactcgtatatgt

SEQ ID NO: 642235 - DNA, 13 bp, D. melanogaster
tactcgtatgtac

SEQ ID NO: 642236 - DNA, 13 bp, D. melanogaster
tactcgtatttgt

SEQ ID NO: 642237 - DNA, 13 bp, D. melanogaster
tactctacgagta

SEQ ID NO: 642238 - DNA, 14 bp, D. melanogaster
tactctacgagtaa

SEQ ID NO: 642239 - DNA, 13 bp, D. melanogaster
tactctacgatct

SEQ ID NO: 642240 - DNA, 13 bp, D. melanogaster
tactcttatcatt

SEQ ID NO: 642241 - DNA, 13 bp, D. melanogaster
tactctttcaaat

SEQ ID NO: 642242 - DNA, 13 bp, D. melanogaster
tactgaaataagt

SEQ ID NO: 642243 - DNA, 13 bp, D. melanogaster
tactgaaattatt

SEQ ID NO: 642244 - DNA, 13 bp, D. melanogaster
tactgaatcctaa

SEQ ID NO: 642245 - DNA, 13 bp, D. melanogaster
tactgaggaattt

SEQ ID NO: 642246 - DNA, 14 bp, D. melanogaster
tactgatcacattg

SEQ ID NO: 642247 - DNA, 13 bp, D. melanogaster
tactgcaaactac

SEQ ID NO: 642248 - DNA, 13 bp, D. melanogaster
tactgcaacaccc

SEQ ID NO: 642249 - DNA, 13 bp, D. melanogaster
tactgcaactgca

SEQ ID NO: 642250 - DNA, 13 bp, D. melanogaster
tactgcaatgtag

SEQ ID NO: 642251 - DNA, 13 bp, D. melanogaster
tactgcagaaaac

SEQ ID NO: 642252 - DNA, 13 bp, D. melanogaster
tactgcagagttt

SEQ ID NO: 642253 - DNA, 13 bp, D. melanogaster
tactgcagcagct

SEQ ID NO: 642254 - DNA, 13 bp, D. melanogaster
tactgcagcatat

SEQ ID NO: 642255 - DNA, 14 bp, D. melanogaster
tactgcagtagtta

SEQ ID NO: 642256 - DNA, 13 bp, D. melanogaster
tactgccaataaa

SEQ ID NO: 642257 - DNA, 13 bp, D. melanogaster
tactgcccaccgc

SEQ ID NO: 642258 - DNA, 13 bp, D. melanogaster
tactgccgctgct

SEQ ID NO: 642259 - DNA, 13 bp, D. melanogaster
tactgctgcgctg

SEQ ID NO: 642260 - DNA, 14 bp, D. melanogaster
tactgctgctgctt

SEQ ID NO: 642261 - DNA, 13 bp, D. melanogaster
tactgctgctgtt

SEQ ID NO: 642262 - DNA, 13 bp, D. melanogaster
tactgctgttgct

SEQ ID NO: 642263 - DNA, 14 bp, D. melanogaster
tactgcttcgcccc

SEQ ID NO: 642264 - DNA, 13 bp, D. melanogaster
tactggaaaaaaa

SEQ ID NO: 642265 - DNA, 14 bp, D. melanogaster
tactggaatagatt

SEQ ID NO: 642266 - DNA, 13 bp, D. melanogaster
tactggccagcag

SEQ ID NO: 642267 - DNA, 13 bp, D. melanogaster
tactggcgttccc

SEQ ID NO: 642268 - DNA, 13 bp, D. melanogaster
tactggtactggt

SEQ ID NO: 642269 - DNA, 13 bp, D. melanogaster
tactggttactgg

SEQ ID NO: 642270 - DNA, 13 bp, D. melanogaster
tactgtacctata

SEQ ID NO: 642271 - DNA, 13 bp, D. melanogaster
tactgtatatata

SEQ ID NO: 642272 - DNA, 13 bp, D. melanogaster
tactgtatgccat

SEQ ID NO: 642273 - DNA, 13 bp, D. melanogaster
tactgtgtgtgtg

SEQ ID NO: 642274 - DNA, 13 bp, D. melanogaster
tacttaaaacatt

SEQ ID NO: 642275 - DNA, 13 bp, D. melanogaster
tacttaaaagttt

SEQ ID NO: 642276 - DNA, 13 bp, D. melanogaster
tacttaaaatgaa

SEQ ID NO: 642277 - DNA, 13 bp, D. melanogaster
tacttaaatttca

SEQ ID NO: 642278 - DNA, 13 bp, D. melanogaster
tacttaacatata

SEQ ID NO: 642279 - DNA, 13 bp, D. melanogaster
tacttaagggcat

SEQ ID NO: 642280 - DNA, 13 bp, D. melanogaster
tacttaatgttta

SEQ ID NO: 642281 - DNA, 13 bp, D. melanogaster
tacttaattactt

SEQ ID NO: 642282 - DNA, 13 bp, D. melanogaster
tacttaattgatt

SEQ ID NO: 642283 - DNA, 13 bp, D. melanogaster
tacttacaaacac

SEQ ID NO: 642284 - DNA, 13 bp, D. melanogaster
tacttacacacac

SEQ ID NO: 642285 - DNA, 14 bp, D. melanogaster
tacttacatacata

SEQ ID NO: 642286 - DNA, 14 bp, D. melanogaster
tacttacatttata

SEQ ID NO: 642287 - DNA, 13 bp, D. melanogaster
tacttactattcg

SEQ ID NO: 642288 - DNA, 14 bp, D. melanogaster
tacttactattcgt

SEQ ID NO: 642289 - DNA, 13 bp, D. melanogaster
tacttacttactt

SEQ ID NO: 642290 - DNA, 13 bp, D. melanogaster
tacttataaacaa

SEQ ID NO: 642291 - DNA, 13 bp, D. melanogaster
tacttatacttac

SEQ ID NO: 642292 - DNA, 14 bp, D. melanogaster
tacttatacttata

SEQ ID NO: 642293 - DNA, 14 bp, D. melanogaster
tacttatatacata

SEQ ID NO: 642294 - DNA, 13 bp, D. melanogaster
tacttatatgtat

SEQ ID NO: 642295 - DNA, 14 bp, D. melanogaster
tacttatatgtata

SEQ ID NO: 642296 - DNA, 13 bp, D. melanogaster
tacttatgtacat

SEQ ID NO: 642297 - DNA, 13 bp, D. melanogaster
tacttatgtatat

SEQ ID NO: 642298 - DNA, 13 bp, D. melanogaster
tacttattgttta

SEQ ID NO: 642299 - DNA, 13 bp, D. melanogaster
tacttatttgcat

SEQ ID NO: 642300 - DNA, 13 bp, D. melanogaster
tacttcaacagca

SEQ ID NO: 642301 - DNA, 13 bp, D. melanogaster
tacttcaatcaca

SEQ ID NO: 642302 - DNA, 14 bp, D. melanogaster
tacttcaatcacat

SEQ ID NO: 642303 - DNA, 13 bp, D. melanogaster
tacttcacatcga

SEQ ID NO: 642304 - DNA, 13 bp, D. melanogaster
tacttcctgtttt

SEQ ID NO: 642305 - DNA, 15 bp, D. melanogaster
tacttcgatttcgtg

SEQ ID NO: 642306 - DNA, 13 bp, D. melanogaster
tacttctcctacg

SEQ ID NO: 642307 - DNA, 14 bp, D. melanogaster
tacttctcctacgt

SEQ ID NO: 642308 - DNA, 14 bp, D. melanogaster
tacttctgatgtag

SEQ ID NO: 642309 - DNA, 14 bp, D. melanogaster
tacttcttcatatt

SEQ ID NO: 642310 - DNA, 13 bp, D. melanogaster
tacttcttcatca

SEQ ID NO: 642311 - DNA, 13 bp, D. melanogaster
tacttcttctcca

SEQ ID NO: 642312 - DNA, 13 bp, D. melanogaster
tacttcttgatga

SEQ ID NO: 642313 - DNA, 13 bp, D. melanogaster
tacttgaaaataa

SEQ ID NO: 642314 - DNA, 13 bp, D. melanogaster
tacttgaaatttc

SEQ ID NO: 642315 - DNA, 13 bp, D. melanogaster
tacttgaataatt

SEQ ID NO: 642316 - DNA, 13 bp, D. melanogaster
tacttgcaaatat

SEQ ID NO: 642317 - DNA, 13 bp, D. melanogaster
tacttggaaccga

SEQ ID NO: 642318 - DNA, 13 bp, D. melanogaster
tacttggaatcgc

SEQ ID NO: 642319 - DNA, 13 bp, D. melanogaster
tacttggacaatt

SEQ ID NO: 642320 - DNA, 13 bp, D. melanogaster
tacttggccaaaa

SEQ ID NO: 642321 - DNA, 13 bp, D. melanogaster
tacttgtacattt

SEQ ID NO: 642322 - DNA, 13 bp, D. melanogaster
tacttgtacttgt

SEQ ID NO: 642323 - DNA, 14 bp, D. melanogaster
tacttgtacttgta

SEQ ID NO: 642324 - DNA, 13 bp, D. melanogaster
tacttgtagagtt

SEQ ID NO: 642325 - DNA, 13 bp, D. melanogaster
tacttgtatatat

SEQ ID NO: 642326 - DNA, 13 bp, D. melanogaster
tacttgtgtgtgt

SEQ ID NO: 642327 - DNA, 13 bp, D. melanogaster
tactttaaaaaac

SEQ ID NO: 642328 - DNA, 13 bp, D. melanogaster
tactttaaaaatg

SEQ ID NO: 642329 - DNA, 13 bp, D. melanogaster
tactttaagaatt

SEQ ID NO: 642330 - DNA, 13 bp, D. melanogaster
tactttagaaaat

SEQ ID NO: 642331 - DNA, 13 bp, D. melanogaster
tactttatatact

SEQ ID NO: 642332 - DNA, 13 bp, D. melanogaster
tactttatatttg

SEQ ID NO: 642333 - DNA, 13 bp, D. melanogaster
tactttcaattaa

SEQ ID NO: 642334 - DNA, 13 bp, D. melanogaster
tactttcaattat

SEQ ID NO: 642335 - DNA, 13 bp, D. melanogaster
tactttccattta

SEQ ID NO: 642336 - DNA, 14 bp, D. melanogaster
tactttctgcaatt

SEQ ID NO: 642337 - DNA, 13 bp, D. melanogaster
tactttctttgga

SEQ ID NO: 642338 - DNA, 13 bp, D. melanogaster
tactttgaatttc

SEQ ID NO: 642339 - DNA, 13 bp, D. melanogaster
tactttgattttc

SEQ ID NO: 642340 - DNA, 13 bp, D. melanogaster
tactttgcggcgc

SEQ ID NO: 642341 - DNA, 13 bp, D. melanogaster
tactttgctcttc

SEQ ID NO: 642342 - DNA, 13 bp, D. melanogaster
tacttttaaacaa

SEQ ID NO: 642343 - DNA, 13 bp, D. melanogaster
tacttttaaagcg

SEQ ID NO: 642344 - DNA, 13 bp, D. melanogaster
tacttttaagcgc

SEQ ID NO: 642345 - DNA, 13 bp, D. melanogaster
tacttttaatcaa

SEQ ID NO: 642346 - DNA, 13 bp, D. melanogaster
tacttttaatgaa

SEQ ID NO: 642347 - DNA, 13 bp, D. melanogaster
tacttttaatttg

SEQ ID NO: 642348 - DNA, 14 bp, D. melanogaster
tacttttagctttt

SEQ ID NO: 642349 - DNA, 13 bp, D. melanogaster
tacttttatgtac

SEQ ID NO: 642350 - DNA, 13 bp, D. melanogaster
tacttttattcgc

SEQ ID NO: 642351 - DNA, 13 bp, D. melanogaster
tacttttcaaaga

SEQ ID NO: 642352 - DNA, 13 bp, D. melanogaster
tacttttcaacaa

SEQ ID NO: 642353 - DNA, 14 bp, D. melanogaster
tacttttcaatgaa

SEQ ID NO: 642354 - DNA, 13 bp, D. melanogaster
tacttttcagttt

SEQ ID NO: 642355 - DNA, 13 bp, D. melanogaster
tacttttcattca

SEQ ID NO: 642356 - DNA, 13 bp, D. melanogaster
tacttttccaact

SEQ ID NO: 642357 - DNA, 13 bp, D. melanogaster
tacttttccgttt

SEQ ID NO: 642358 - DNA, 13 bp, D. melanogaster
tacttttcgtact

SEQ ID NO: 642359 - DNA, 13 bp, D. melanogaster
tacttttgaatat

SEQ ID NO: 642360 - DNA, 13 bp, D. melanogaster
tacttttgatttc

SEQ ID NO: 642361 - DNA, 13 bp, D. melanogaster
tacttttggcaaa

SEQ ID NO: 642362 - DNA, 13 bp, D. melanogaster
tacttttggccaa

SEQ ID NO: 642363 - DNA, 13 bp, D. melanogaster
tacttttgtgggc

SEQ ID NO: 642364 - DNA, 13 bp, D. melanogaster
tactttttaacta

SEQ ID NO: 642365 - DNA, 13 bp, D. melanogaster
tactttttgaaaa

SEQ ID NO: 642366 - DNA, 13 bp, D. melanogaster
tactttttgcaca

SEQ ID NO: 642367 - DNA, 14 bp, D. melanogaster
tactttttgcacaa

SEQ ID NO: 642368 - DNA, 13 bp, D. melanogaster
tactttttgcatt

SEQ ID NO: 642369 - DNA, 13 bp, D. melanogaster
tagaaaaaacgag

SEQ ID NO: 642370 - DNA, 13 bp, D. melanogaster
tagaaaaacaatt

SEQ ID NO: 642371 - DNA, 13 bp, D. melanogaster
tagaaaaacttat

SEQ ID NO: 642372 - DNA, 14 bp, D. melanogaster
tagaaaaagaagca

SEQ ID NO: 642373 - DNA, 13 bp, D. melanogaster
tagaaaaagtaca

SEQ ID NO: 642374 - DNA, 13 bp, D. melanogaster
tagaaaaatatcc

SEQ ID NO: 642375 - DNA, 13 bp, D. melanogaster
tagaaaaatgcca

SEQ ID NO: 642376 - DNA, 13 bp, D. melanogaster
tagaaaaatgtta

SEQ ID NO: 642377 - DNA, 13 bp, D. melanogaster
tagaaaaatgttt

SEQ ID NO: 642378 - DNA, 13 bp, D. melanogaster
tagaaaacacttt

SEQ ID NO: 642379 - DNA, 13 bp, D. melanogaster
tagaaaacatatt

SEQ ID NO: 642380 - DNA, 13 bp, D. melanogaster
tagaaaacatttc

SEQ ID NO: 642381 - DNA, 13 bp, D. melanogaster
tagaaaaccaagt

SEQ ID NO: 642382 - DNA, 13 bp, D. melanogaster
tagaaaactttaa

SEQ ID NO: 642383 - DNA, 13 bp, D. melanogaster
tagaaaagaactg

SEQ ID NO: 642384 - DNA, 13 bp, D. melanogaster
tagaaaatatatc

SEQ ID NO: 642385 - DNA, 13 bp, D. melanogaster
tagaaaatcaata

SEQ ID NO: 642386 - DNA, 13 bp, D. melanogaster
tagaaaatcagtt

SEQ ID NO: 642387 - DNA, 13 bp, D. melanogaster
tagaaaatttgaa

SEQ ID NO: 642388 - DNA, 13 bp, D. melanogaster
tagaaacaaacgg

SEQ ID NO: 642389 - DNA, 13 bp, D. melanogaster
tagaaacaatcct

SEQ ID NO: 642390 - DNA, 13 bp, D. melanogaster
tagaaacatttgt

SEQ ID NO: 642391 - DNA, 13 bp, D. melanogaster
tagaaacgaattt

SEQ ID NO: 642392 - DNA, 13 bp, D. melanogaster
tagaaactagaaa

SEQ ID NO: 642393 - DNA, 13 bp, D. melanogaster
tagaaactatttt

SEQ ID NO: 642394 - DNA, 13 bp, D. melanogaster
tagaaagatatat

SEQ ID NO: 642395 - DNA, 14 bp, D. melanogaster
tagaaagcttaaaa

SEQ ID NO: 642396 - DNA, 13 bp, D. melanogaster
tagaaatacaatt

SEQ ID NO: 642397 - DNA, 14 bp, D. melanogaster
tagaaatagccaaa

SEQ ID NO: 642398 - DNA, 13 bp, D. melanogaster
tagaaatagtcaa

SEQ ID NO: 642399 - DNA, 13 bp, D. melanogaster
tagaaatattgtt

SEQ ID NO: 642400 - DNA, 13 bp, D. melanogaster
tagaaatcttgaa

SEQ ID NO: 642401 - DNA, 14 bp, D. melanogaster
tagaaatgaaacga

SEQ ID NO: 642402 - DNA, 13 bp, D. melanogaster
tagaaatgttaaa

SEQ ID NO: 642403 - DNA, 13 bp, D. melanogaster
tagaaatgttttt

SEQ ID NO: 642404 - DNA, 13 bp, D. melanogaster
tagaaattaaagt

SEQ ID NO: 642405 - DNA, 13 bp, D. melanogaster
tagaaattcaaat

SEQ ID NO: 642406 - DNA, 13 bp, D. melanogaster
tagaaattccaac

SEQ ID NO: 642407 - DNA, 14 bp, D. melanogaster
tagaaattctaaaa

SEQ ID NO: 642408 - DNA, 13 bp, D. melanogaster
tagaaattgattc

SEQ ID NO: 642409 - DNA, 13 bp, D. melanogaster
tagaaattggaaa

SEQ ID NO: 642410 - DNA, 14 bp, D. melanogaster
tagaaattgttaat

SEQ ID NO: 642411 - DNA, 13 bp, D. melanogaster
tagaaattgtttt

SEQ ID NO: 642412 - DNA, 13 bp, D. melanogaster
tagaaatttacaa

SEQ ID NO: 642413 - DNA, 13 bp, D. melanogaster
tagaaatttacac

SEQ ID NO: 642414 - DNA, 13 bp, D. melanogaster
tagaaatttcaaa

SEQ ID NO: 642415 - DNA, 13 bp, D. melanogaster
tagaaatttgttt

SEQ ID NO: 642416 - DNA, 13 bp, D. melanogaster
tagaaattttaca

SEQ ID NO: 642417 - DNA, 13 bp, D. melanogaster
tagaacaactgtc

SEQ ID NO: 642418 - DNA, 13 bp, D. melanogaster
tagaacatttaaa

SEQ ID NO: 642419 - DNA, 13 bp, D. melanogaster
tagaaccattaga

SEQ ID NO: 642420 - DNA, 13 bp, D. melanogaster
tagaactagaaaa

SEQ ID NO: 642421 - DNA, 13 bp, D. melanogaster
tagaagaagctaa

SEQ ID NO: 642422 - DNA, 13 bp, D. melanogaster
tagaagagccgca

SEQ ID NO: 642423 - DNA, 13 bp, D. melanogaster
tagaagatttaga

SEQ ID NO: 642424 - DNA, 14 bp, D. melanogaster
tagaagatttagat

SEQ ID NO: 642425 - DNA, 13 bp, D. melanogaster
tagaagatttgaa

SEQ ID NO: 642426 - DNA, 13 bp, D. melanogaster
tagaagatttgga

SEQ ID NO: 642427 - DNA, 13 bp, D. melanogaster
tagaagattttaa

SEQ ID NO: 642428 - DNA, 13 bp, D. melanogaster
tagaagtgcccgc

SEQ ID NO: 642429 - DNA, 14 bp, D. melanogaster
tagaataaacaaca

SEQ ID NO: 642430 - DNA, 13 bp, D. melanogaster
tagaatagaatag

SEQ ID NO: 642431 - DNA, 13 bp, D. melanogaster
tagaatattcatg

SEQ ID NO: 642432 - DNA, 13 bp, D. melanogaster
tagaatatttgtc

SEQ ID NO: 642433 - DNA, 13 bp, D. melanogaster
tagaatatttttg

SEQ ID NO: 642434 - DNA, 13 bp, D. melanogaster
tagaatcagaacc

SEQ ID NO: 642435 - DNA, 13 bp, D. melanogaster
tagaatctgtgca

SEQ ID NO: 642436 - DNA, 13 bp, D. melanogaster
tagaatgcagaaa

SEQ ID NO: 642437 - DNA, 13 bp, D. melanogaster
tagaatgtttatt

SEQ ID NO: 642438 - DNA, 13 bp, D. melanogaster
tagaatttcattt

SEQ ID NO: 642439 - DNA, 13 bp, D. melanogaster
tagaatttgaatt

SEQ ID NO: 642440 - DNA, 13 bp, D. melanogaster
tagaatttgttta

SEQ ID NO: 642441 - DNA, 13 bp, D. melanogaster
tagaattttacaa

SEQ ID NO: 642442 - DNA, 13 bp, D. melanogaster
tagaattttagaa

SEQ ID NO: 642443 - DNA, 13 bp, D. melanogaster
tagaattttgaaa

SEQ ID NO: 642444 - DNA, 13 bp, D. melanogaster
tagacaaaaatcc

SEQ ID NO: 642445 - DNA, 13 bp, D. melanogaster
tagacaaaatcta

SEQ ID NO: 642446 - DNA, 13 bp, D. melanogaster
tagacaaataaat

SEQ ID NO: 642447 - DNA, 13 bp, D. melanogaster
tagacaatatagc

SEQ ID NO: 642448 - DNA, 14 bp, D. melanogaster
tagacacacaacaa

SEQ ID NO: 642449 - DNA, 13 bp, D. melanogaster
tagacacagtatt

SEQ ID NO: 642450 - DNA, 13 bp, D. melanogaster
tagacatttatac

SEQ ID NO: 642451 - DNA, 13 bp, D. melanogaster
tagacatttctta

SEQ ID NO: 642452 - DNA, 14 bp, D. melanogaster
tagaccatttaatt

SEQ ID NO: 642453 - DNA, 14 bp, D. melanogaster
tagaccgctttatt

SEQ ID NO: 642454 - DNA, 13 bp, D. melanogaster
tagacgaccagat

SEQ ID NO: 642455 - DNA, 13 bp, D. melanogaster
tagacgttttgta

SEQ ID NO: 642456 - DNA, 13 bp, D. melanogaster
tagactgcggcta

SEQ ID NO: 642457 - DNA, 13 bp, D. melanogaster
tagacttttaatt

SEQ ID NO: 642458 - DNA, 13 bp, D. melanogaster
tagagaaaaacat

SEQ ID NO: 642459 - DNA, 13 bp, D. melanogaster
tagagaaatatgt

SEQ ID NO: 642460 - DNA, 13 bp, D. melanogaster
tagagaagtgcaa

SEQ ID NO: 642461 - DNA, 14 bp, D. melanogaster
tagagacaaagacg

SEQ ID NO: 642462 - DNA, 13 bp, D. melanogaster
tagagagcgagag

SEQ ID NO: 642463 - DNA, 13 bp, D. melanogaster
tagagagctgcac

SEQ ID NO: 642464 - DNA, 13 bp, D. melanogaster
tagagcaaaggct

SEQ ID NO: 642465 - DNA, 13 bp, D. melanogaster
tagagcaactcac

SEQ ID NO: 642466 - DNA, 13 bp, D. melanogaster
tagaggaatataa

SEQ ID NO: 642467 - DNA, 13 bp, D. melanogaster
tagaggattgttg

SEQ ID NO: 642468 - DNA, 14 bp, D. melanogaster
tagaggtggagaaa

SEQ ID NO: 642469 - DNA, 13 bp, D. melanogaster
tagagtaaacata

SEQ ID NO: 642470 - DNA, 13 bp, D. melanogaster
tagagtagagtag

SEQ ID NO: 642471 - DNA, 13 bp, D. melanogaster
tagagtcgttgaa

SEQ ID NO: 642472 - DNA, 13 bp, D. melanogaster
tagagtgacgatg

SEQ ID NO: 642473 - DNA, 13 bp, D. melanogaster
tagagtgggtgtg

SEQ ID NO: 642474 - DNA, 13 bp, D. melanogaster
tagataaattcaa

SEQ ID NO: 642475 - DNA, 13 bp, D. melanogaster
tagataatgaaat

SEQ ID NO: 642476 - DNA, 13 bp, D. melanogaster
tagatacacacac

SEQ ID NO: 642477 - DNA, 14 bp, D. melanogaster
tagatacagataca

SEQ ID NO: 642478 - DNA, 14 bp, D. melanogaster
tagatacatacata

SEQ ID NO: 642479 - DNA, 13 bp, D. melanogaster
tagatacttagat

SEQ ID NO: 642480 - DNA, 14 bp, D. melanogaster
tagatactttttaa

SEQ ID NO: 642481 - DNA, 13 bp, D. melanogaster
tagatagatataa

SEQ ID NO: 642482 - DNA, 14 bp, D. melanogaster
tagatagatataga

SEQ ID NO: 642483 - DNA, 13 bp, D. melanogaster
tagatagatattt

SEQ ID NO: 642484 - DNA, 13 bp, D. melanogaster
tagatagttagat

SEQ ID NO: 642485 - DNA, 13 bp, D. melanogaster
tagatataatcga

SEQ ID NO: 642486 - DNA, 13 bp, D. melanogaster
tagatatacaaat

SEQ ID NO: 642487 - DNA, 13 bp, D. melanogaster
tagatatagatac

SEQ ID NO: 642488 - DNA, 13 bp, D. melanogaster
tagatatagatat

SEQ ID NO: 642489 - DNA, 13 bp, D. melanogaster
tagatatatatgt

SEQ ID NO: 642490 - DNA, 13 bp, D. melanogaster
tagatatatttac

SEQ ID NO: 642491 - DNA, 13 bp, D. melanogaster
tagatatcgaaag

SEQ ID NO: 642492 - DNA, 13 bp, D. melanogaster
tagatatgtatat

SEQ ID NO: 642493 - DNA, 14 bp, D. melanogaster
tagatatgtatata

SEQ ID NO: 642494 - DNA, 13 bp, D. melanogaster
tagatattaagga

SEQ ID NO: 642495 - DNA, 13 bp, D. melanogaster
tagatatttgaag

SEQ ID NO: 642496 - DNA, 13 bp, D. melanogaster
tagatctttagat

SEQ ID NO: 642497 - DNA, 14 bp, D. melanogaster
tagatgatataata

SEQ ID NO: 642498 - DNA, 13 bp, D. melanogaster
tagatgatgaatt

SEQ ID NO: 642499 - DNA, 13 bp, D. melanogaster
tagatggcttatt

SEQ ID NO: 642500 - DNA, 13 bp, D. melanogaster
tagatgttagttg

SEQ ID NO: 642501 - DNA, 13 bp, D. melanogaster
tagattaagttat

SEQ ID NO: 642502 - DNA, 14 bp, D. melanogaster
tagattaagttcta

SEQ ID NO: 642503 - DNA, 14 bp, D. melanogaster
tagattagaagttg

SEQ ID NO: 642504 - DNA, 13 bp, D. melanogaster
tagattatagatt

SEQ ID NO: 642505 - DNA, 13 bp, D. melanogaster
tagattcactaga

SEQ ID NO: 642506 - DNA, 14 bp, D. melanogaster
tagattcgttgaaa

SEQ ID NO: 642507 - DNA, 13 bp, D. melanogaster
tagattggacagc

SEQ ID NO: 642508 - DNA, 13 bp, D. melanogaster
tagattgtaagta

SEQ ID NO: 642509 - DNA, 13 bp, D. melanogaster
tagatttaaattg

SEQ ID NO: 642510 - DNA, 13 bp, D. melanogaster
tagatttagattt

SEQ ID NO: 642511 - DNA, 14 bp, D. melanogaster
tagatttagattta

SEQ ID NO: 642512 - DNA, 13 bp, D. melanogaster
tagatttgactat

SEQ ID NO: 642513 - DNA, 13 bp, D. melanogaster
tagatttgttgaa

SEQ ID NO: 642514 - DNA, 13 bp, D. melanogaster
tagattttaagaa

SEQ ID NO: 642515 - DNA, 13 bp, D. melanogaster
tagattttccaaa

SEQ ID NO: 642516 - DNA, 13 bp, D. melanogaster
tagattttgaaat

SEQ ID NO: 642517 - DNA, 13 bp, D. melanogaster
tagatttttattc

SEQ ID NO: 642518 - DNA, 13 bp, D. melanogaster
tagcaaaaataac

SEQ ID NO: 642519 - DNA, 13 bp, D. melanogaster
tagcaaaaataat

SEQ ID NO: 642520 - DNA, 14 bp, D. melanogaster
tagcaaaaataatg

SEQ ID NO: 642521 - DNA, 13 bp, D. melanogaster
tagcaaaaattaa

SEQ ID NO: 642522 - DNA, 13 bp, D. melanogaster
tagcaaaacaaac

SEQ ID NO: 642523 - DNA, 13 bp, D. melanogaster
tagcaaaatttaa

SEQ ID NO: 642524 - DNA, 13 bp, D. melanogaster
tagcaaacaaata

SEQ ID NO: 642525 - DNA, 13 bp, D. melanogaster
tagcaaacatttt

SEQ ID NO: 642526 - DNA, 13 bp, D. melanogaster
tagcaaactgaat

SEQ ID NO: 642527 - DNA, 13 bp, D. melanogaster
tagcaaagggcta

SEQ ID NO: 642528 - DNA, 13 bp, D. melanogaster
tagcaaagtttaa

SEQ ID NO: 642529 - DNA, 13 bp, D. melanogaster
tagcaaatagcaa

SEQ ID NO: 642530 - DNA, 13 bp, D. melanogaster
tagcaaatatatt

SEQ ID NO: 642531 - DNA, 13 bp, D. melanogaster
tagcaaatatttg

SEQ ID NO: 642532 - DNA, 13 bp, D. melanogaster
tagcaaatcgata

SEQ ID NO: 642533 - DNA, 13 bp, D. melanogaster
tagcaaatgcaaa

SEQ ID NO: 642534 - DNA, 13 bp, D. melanogaster
tagcaaattaaat

SEQ ID NO: 642535 - DNA, 14 bp, D. melanogaster
tagcaacaacaaca

SEQ ID NO: 642536 - DNA, 13 bp, D. melanogaster
tagcaacaataat

SEQ ID NO: 642537 - DNA, 13 bp, D. melanogaster
tagcaacagcaac

SEQ ID NO: 642538 - DNA, 14 bp, D. melanogaster
tagcaacagcaaca

SEQ ID NO: 642539 - DNA, 15 bp, D. melanogaster
tagcaacagcaacag

SEQ ID NO: 642540 - DNA, 13 bp, D. melanogaster
tagcaactagcaa

SEQ ID NO: 642541 - DNA, 13 bp, D. melanogaster
tagcaactgcaac

SEQ ID NO: 642542 - DNA, 13 bp, D. melanogaster
tagcaacttgcaa

SEQ ID NO: 642543 - DNA, 13 bp, D. melanogaster
tagcaataaaaat

SEQ ID NO: 642544 - DNA, 13 bp, D. melanogaster
tagcaataaacgg

SEQ ID NO: 642545 - DNA, 13 bp, D. melanogaster
tagcaataaatgt

SEQ ID NO: 642546 - DNA, 13 bp, D. melanogaster
tagcaataataat

SEQ ID NO: 642547 - DNA, 13 bp, D. melanogaster
tagcaatacacat

SEQ ID NO: 642548 - DNA, 13 bp, D. melanogaster
tagcaatagcaat

SEQ ID NO: 642549 - DNA, 14 bp, D. melanogaster
tagcaatagcaata

SEQ ID NO: 642550 - DNA, 13 bp, D. melanogaster
tagcaatattgtt

SEQ ID NO: 642551 - DNA, 13 bp, D. melanogaster
tagcaatgaaatt

SEQ ID NO: 642552 - DNA, 13 bp, D. melanogaster
tagcaattaatta

SEQ ID NO: 642553 - DNA, 13 bp, D. melanogaster
tagcaatttgcat

SEQ ID NO: 642554 - DNA, 13 bp, D. melanogaster
tagcacaaaacaa

SEQ ID NO: 642555 - DNA, 13 bp, D. melanogaster
tagcacacttttt

SEQ ID NO: 642556 - DNA, 13 bp, D. melanogaster
tagcaccaaactc

SEQ ID NO: 642557 - DNA, 13 bp, D. melanogaster
tagcactgtaatt

SEQ ID NO: 642558 - DNA, 13 bp, D. melanogaster
tagcagaaaccga

SEQ ID NO: 642559 - DNA, 13 bp, D. melanogaster
tagcagacatctg

SEQ ID NO: 642560 - DNA, 14 bp, D. melanogaster
tagcagacccaaaa

SEQ ID NO: 642561 - DNA, 13 bp, D. melanogaster
tagcagcaacaac

SEQ ID NO: 642562 - DNA, 14 bp, D. melanogaster
tagcagcaacaaca

SEQ ID NO: 642563 - DNA, 13 bp, D. melanogaster
tagcagcagcaac

SEQ ID NO: 642564 - DNA, 14 bp, D. melanogaster
tagcagcagcaaca

SEQ ID NO: 642565 - DNA, 15 bp, D. melanogaster
tagcagcagcagcaa

SEQ ID NO: 642566 - DNA, 13 bp, D. melanogaster
tagcagcagcatt

SEQ ID NO: 642567 - DNA, 13 bp, D. melanogaster
tagcagtcatctt

SEQ ID NO: 642568 - DNA, 13 bp, D. melanogaster
tagcataaattta

SEQ ID NO: 642569 - DNA, 13 bp, D. melanogaster
tagcataattatt

SEQ ID NO: 642570 - DNA, 13 bp, D. melanogaster
tagcataatttta

SEQ ID NO: 642571 - DNA, 14 bp, D. melanogaster
tagcatacttttgt

SEQ ID NO: 642572 - DNA, 13 bp, D. melanogaster
tagcatcattcaa

SEQ ID NO: 642573 - DNA, 13 bp, D. melanogaster
tagcattaaaaat

SEQ ID NO: 642574 - DNA, 13 bp, D. melanogaster
tagcattaaatat

SEQ ID NO: 642575 - DNA, 13 bp, D. melanogaster
tagcattaaatca

SEQ ID NO: 642576 - DNA, 13 bp, D. melanogaster
tagcattagctac

SEQ ID NO: 642577 - DNA, 13 bp, D. melanogaster
tagcattctcttt

SEQ ID NO: 642578 - DNA, 13 bp, D. melanogaster
tagcattctgcaa

SEQ ID NO: 642579 - DNA, 13 bp, D. melanogaster
tagcattggtaat

SEQ ID NO: 642580 - DNA, 13 bp, D. melanogaster
tagcatttaactt

SEQ ID NO: 642581 - DNA, 13 bp, D. melanogaster
tagcatttagcat

SEQ ID NO: 642582 - DNA, 13 bp, D. melanogaster
tagcatttattgt

SEQ ID NO: 642583 - DNA, 13 bp, D. melanogaster
tagcatttcattt

SEQ ID NO: 642584 - DNA, 13 bp, D. melanogaster
tagcatttgcatt

SEQ ID NO: 642585 - DNA, 13 bp, D. melanogaster
tagcattttgcaa

SEQ ID NO: 642586 - DNA, 13 bp, D. melanogaster
tagccaaaaacaa

SEQ ID NO: 642587 - DNA, 13 bp, D. melanogaster
tagccaaaagttt

SEQ ID NO: 642588 - DNA, 13 bp, D. melanogaster
tagccaaacaaat

SEQ ID NO: 642589 - DNA, 13 bp, D. melanogaster
tagccaaactaga

SEQ ID NO: 642590 - DNA, 14 bp, D. melanogaster
tagccaaagactgc

SEQ ID NO: 642591 - DNA, 13 bp, D. melanogaster
tagccaaagtttt

SEQ ID NO: 642592 - DNA, 13 bp, D. melanogaster
tagccaagctgcc

SEQ ID NO: 642593 - DNA, 13 bp, D. melanogaster
tagccaagttaat

SEQ ID NO: 642594 - DNA, 13 bp, D. melanogaster
tagccaagttata

SEQ ID NO: 642595 - DNA, 13 bp, D. melanogaster
tagccacaaaaat

SEQ ID NO: 642596 - DNA, 15 bp, D. melanogaster
tagccacaacaatag

SEQ ID NO: 642597 - DNA, 13 bp, D. melanogaster
tagccacacggaa

SEQ ID NO: 642598 - DNA, 13 bp, D. melanogaster
tagccacgccccc

SEQ ID NO: 642599 - DNA, 13 bp, D. melanogaster
tagccagcacagc

SEQ ID NO: 642600 - DNA, 13 bp, D. melanogaster
tagccagccagcc

SEQ ID NO: 642601 - DNA, 13 bp, D. melanogaster
tagccaggcgatt

SEQ ID NO: 642602 - DNA, 13 bp, D. melanogaster
tagccatcgccat

SEQ ID NO: 642603 - DNA, 13 bp, D. melanogaster
tagccatgcaaat

SEQ ID NO: 642604 - DNA, 13 bp, D. melanogaster
tagccattattta

SEQ ID NO: 642605 - DNA, 13 bp, D. melanogaster
tagccattgttta

SEQ ID NO: 642606 - DNA, 13 bp, D. melanogaster
tagccatttattt

SEQ ID NO: 642607 - DNA, 13 bp, D. melanogaster
tagccatttccaa

SEQ ID NO: 642608 - DNA, 14 bp, D. melanogaster
tagccatttccaaa

SEQ ID NO: 642609 - DNA, 13 bp, D. melanogaster
tagccatttcgga

SEQ ID NO: 642610 - DNA, 13 bp, D. melanogaster
tagccatttttat

SEQ ID NO: 642611 - DNA, 13 bp, D. melanogaster
tagcccacgtaag

SEQ ID NO: 642612 - DNA, 13 bp, D. melanogaster
tagcccccaaaaa

SEQ ID NO: 642613 - DNA, 13 bp, D. melanogaster
tagccggaataac

SEQ ID NO: 642614 - DNA, 13 bp, D. melanogaster
tagcctcaaccgc

SEQ ID NO: 642615 - DNA, 14 bp, D. melanogaster
tagcctccgaaaat

SEQ ID NO: 642616 - DNA, 13 bp, D. melanogaster
tagccttaacaat

SEQ ID NO: 642617 - DNA, 13 bp, D. melanogaster
tagcctttgcaac

SEQ ID NO: 642618 - DNA, 13 bp, D. melanogaster
tagcgaaagaaat

SEQ ID NO: 642619 - DNA, 13 bp, D. melanogaster
tagcgaacacttc

SEQ ID NO: 642620 - DNA, 14 bp, D. melanogaster
tagcgaatttagaa

SEQ ID NO: 642621 - DNA, 13 bp, D. melanogaster
tagcgattttaaa

SEQ ID NO: 642622 - DNA, 13 bp, D. melanogaster
tagcgcactcaac

SEQ ID NO: 642623 - DNA, 13 bp, D. melanogaster
tagcgctttatct

SEQ ID NO: 642624 - DNA, 13 bp, D. melanogaster
tagcggcaattca

SEQ ID NO: 642625 - DNA, 13 bp, D. melanogaster
tagcgtcaataca

SEQ ID NO: 642626 - DNA, 13 bp, D. melanogaster
tagctacaagttg

SEQ ID NO: 642627 - DNA, 13 bp, D. melanogaster
tagctagcaaaag

SEQ ID NO: 642628 - DNA, 13 bp, D. melanogaster
tagctagctagct

SEQ ID NO: 642629 - DNA, 13 bp, D. melanogaster
tagctagttttat

SEQ ID NO: 642630 - DNA, 13 bp, D. melanogaster
tagctataaatat

SEQ ID NO: 642631 - DNA, 13 bp, D. melanogaster
tagctatagcttt

SEQ ID NO: 642632 - DNA, 13 bp, D. melanogaster
tagctatatatat

SEQ ID NO: 642633 - DNA, 14 bp, D. melanogaster
tagctatatatata

SEQ ID NO: 642634 - DNA, 13 bp, D. melanogaster
tagctatgtatgt

SEQ ID NO: 642635 - DNA, 13 bp, D. melanogaster
tagctatttcggt

SEQ ID NO: 642636 - DNA, 13 bp, D. melanogaster
tagctcaattttt

SEQ ID NO: 642637 - DNA, 13 bp, D. melanogaster
tagctccttaatt

SEQ ID NO: 642638 - DNA, 13 bp, D. melanogaster
tagctctccttcc

SEQ ID NO: 642639 - DNA, 13 bp, D. melanogaster
tagctgaacccaa

SEQ ID NO: 642640 - DNA, 13 bp, D. melanogaster
tagctgagtaaag

SEQ ID NO: 642641 - DNA, 15 bp, D. melanogaster
tagctgagtaccggg

SEQ ID NO: 642642 - DNA, 13 bp, D. melanogaster
tagctgattttaa

SEQ ID NO: 642643 - DNA, 13 bp, D. melanogaster
tagctgcatcggc

SEQ ID NO: 642644 - DNA, 13 bp, D. melanogaster
tagctgcattttt

SEQ ID NO: 642645 - DNA, 13 bp, D. melanogaster
tagctgccacaac

SEQ ID NO: 642646 - DNA, 13 bp, D. melanogaster
tagctgctcaaaa

SEQ ID NO: 642647 - DNA, 14 bp, D. melanogaster
tagctgctgctgct

SEQ ID NO: 642648 - DNA, 13 bp, D. melanogaster
tagctgctttcga

SEQ ID NO: 642649 - DNA, 14 bp, D. melanogaster
tagctggcaaaatt

SEQ ID NO: 642650 - DNA, 13 bp, D. melanogaster
tagctggctggct

SEQ ID NO: 642651 - DNA, 13 bp, D. melanogaster
tagctgttagctg

SEQ ID NO: 642652 - DNA, 13 bp, D. melanogaster
tagctgttgctgt

SEQ ID NO: 642653 - DNA, 14 bp, D. melanogaster
tagctgttgttgtt

SEQ ID NO: 642654 - DNA, 13 bp, D. melanogaster
tagctgtttcgta

SEQ ID NO: 642655 - DNA, 13 bp, D. melanogaster
tagcttaaaatta

SEQ ID NO: 642656 - DNA, 13 bp, D. melanogaster
tagcttaaacttt

SEQ ID NO: 642657 - DNA, 13 bp, D. melanogaster
tagcttaatattt

SEQ ID NO: 642658 - DNA, 13 bp, D. melanogaster
tagcttccttttt

SEQ ID NO: 642659 - DNA, 13 bp, D. melanogaster
tagcttctttttc

SEQ ID NO: 642660 - DNA, 13 bp, D. melanogaster
tagctttaaaaaa

SEQ ID NO: 642661 - DNA, 13 bp, D. melanogaster
tagctttaatttt

SEQ ID NO: 642662 - DNA, 13 bp, D. melanogaster
tagctttagtttc

SEQ ID NO: 642663 - DNA, 13 bp, D. melanogaster
tagctttgtataa

SEQ ID NO: 642664 - DNA, 13 bp, D. melanogaster
tagcttttataat

SEQ ID NO: 642665 - DNA, 13 bp, D. melanogaster
tagcttttatagt

SEQ ID NO: 642666 - DNA, 14 bp, D. melanogaster
tagcttttatagtt

SEQ ID NO: 642667 - DNA, 13 bp, D. melanogaster
taggaaaaacaat

SEQ ID NO: 642668 - DNA, 14 bp, D. melanogaster
taggaaaaacttca

SEQ ID NO: 642669 - DNA, 13 bp, D. melanogaster
taggaaaatgtaa

SEQ ID NO: 642670 - DNA, 13 bp, D. melanogaster
taggaaaggtgga

SEQ ID NO: 642671 - DNA, 13 bp, D. melanogaster
taggaaattgtat

SEQ ID NO: 642672 - DNA, 13 bp, D. melanogaster
taggaagagcaaa

SEQ ID NO: 642673 - DNA, 13 bp, D. melanogaster
taggaataaatga

SEQ ID NO: 642674 - DNA, 13 bp, D. melanogaster
taggaataggaat

SEQ ID NO: 642675 - DNA, 13 bp, D. melanogaster
taggaatgtttat

SEQ ID NO: 642676 - DNA, 13 bp, D. melanogaster
taggaattggaat

SEQ ID NO: 642677 - DNA, 14 bp, D. melanogaster
taggaatttccttt

SEQ ID NO: 642678 - DNA, 13 bp, D. melanogaster
taggagataataa

SEQ ID NO: 642679 - DNA, 13 bp, D. melanogaster
taggattaaaaat

SEQ ID NO: 642680 - DNA, 15 bp, D. melanogaster
taggattttgtgagt

SEQ ID NO: 642681 - DNA, 13 bp, D. melanogaster
taggcaaacacaa

SEQ ID NO: 642682 - DNA, 13 bp, D. melanogaster
taggcaacaacaa

SEQ ID NO: 642683 - DNA, 13 bp, D. melanogaster
taggcaacacttt

SEQ ID NO: 642684 - DNA, 13 bp, D. melanogaster
taggcaacataat

SEQ ID NO: 642685 - DNA, 13 bp, D. melanogaster
taggcatatatat

SEQ ID NO: 642686 - DNA, 13 bp, D. melanogaster
taggcccacagac

SEQ ID NO: 642687 - DNA, 13 bp, D. melanogaster
tagggaaacattt

SEQ ID NO: 642688 - DNA, 13 bp, D. melanogaster
tagggaatcttaa

SEQ ID NO: 642689 - DNA, 13 bp, D. melanogaster
tagggatggttag

SEQ ID NO: 642690 - DNA, 13 bp, D. melanogaster
tagggggcgtggc

SEQ ID NO: 642691 - DNA, 13 bp, D. melanogaster
tagggtctttggt

SEQ ID NO: 642692 - DNA, 14 bp, D. melanogaster
tagggtctttggta

SEQ ID NO: 642693 - DNA, 13 bp, D. melanogaster
tagggtggacctt

SEQ ID NO: 642694 - DNA, 13 bp, D. melanogaster
taggtaattatta

SEQ ID NO: 642695 - DNA, 13 bp, D. melanogaster
taggtacatatat

SEQ ID NO: 642696 - DNA, 14 bp, D. melanogaster
taggtacatatata

SEQ ID NO: 642697 - DNA, 13 bp, D. melanogaster
taggtctgcattt

SEQ ID NO: 642698 - DNA, 13 bp, D. melanogaster
taggtgattttaa

SEQ ID NO: 642699 - DNA, 13 bp, D. melanogaster
taggtggcgccac

SEQ ID NO: 642700 - DNA, 13 bp, D. melanogaster
taggtggtattaa

SEQ ID NO: 642701 - DNA, 13 bp, D. melanogaster
taggttaaaaatt

SEQ ID NO: 642702 - DNA, 13 bp, D. melanogaster
taggttataatat

SEQ ID NO: 642703 - DNA, 13 bp, D. melanogaster
taggttttctatc

SEQ ID NO: 642704 - DNA, 13 bp, D. melanogaster
tagtaaaaacaat

SEQ ID NO: 642705 - DNA, 13 bp, D. melanogaster
tagtaaaagtttt

SEQ ID NO: 642706 - DNA, 13 bp, D. melanogaster
tagtaacaaaatt

SEQ ID NO: 642707 - DNA, 13 bp, D. melanogaster
tagtaaccatcga

SEQ ID NO: 642708 - DNA, 13 bp, D. melanogaster
tagtaacgggtat

SEQ ID NO: 642709 - DNA, 13 bp, D. melanogaster
tagtaactattcc

SEQ ID NO: 642710 - DNA, 13 bp, D. melanogaster
tagtaagaaatat

SEQ ID NO: 642711 - DNA, 13 bp, D. melanogaster
tagtaagcatata

SEQ ID NO: 642712 - DNA, 14 bp, D. melanogaster
tagtaatagactat

SEQ ID NO: 642713 - DNA, 13 bp, D. melanogaster
tagtaatagtagt

SEQ ID NO: 642714 - DNA, 13 bp, D. melanogaster
tagtaattgaaat

SEQ ID NO: 642715 - DNA, 13 bp, D. melanogaster
tagtaattgacta

SEQ ID NO: 642716 - DNA, 14 bp, D. melanogaster
tagtaattttgttg

SEQ ID NO: 642717 - DNA, 13 bp, D. melanogaster
tagtacacaacag

SEQ ID NO: 642718 - DNA, 13 bp, D. melanogaster
tagtacatatgta

SEQ ID NO: 642719 - DNA, 13 bp, D. melanogaster
tagtagcaaaaat

SEQ ID NO: 642720 - DNA, 14 bp, D. melanogaster
tagtagcgcaaata

SEQ ID NO: 642721 - DNA, 13 bp, D. melanogaster
tagtagtaatagt

SEQ ID NO: 642722 - DNA, 13 bp, D. melanogaster
tagtagtagtaat

SEQ ID NO: 642723 - DNA, 14 bp, D. melanogaster
tagtagtagtagtt

SEQ ID NO: 642724 - DNA, 13 bp, D. melanogaster
tagtagtatagta

SEQ ID NO: 642725 - DNA, 13 bp, D. melanogaster
tagtagtattatt

SEQ ID NO: 642726 - DNA, 13 bp, D. melanogaster
tagtagttgtagt

SEQ ID NO: 642727 - DNA, 14 bp, D. melanogaster
tagtatacatacat

SEQ ID NO: 642728 - DNA, 14 bp, D. melanogaster
tagtatacatatat

SEQ ID NO: 642729 - DNA, 13 bp, D. melanogaster
tagtatacccaaa

SEQ ID NO: 642730 - DNA, 13 bp, D. melanogaster
tagtataccctta

SEQ ID NO: 642731 - DNA, 13 bp, D. melanogaster
tagtatacccttt

SEQ ID NO: 642732 - DNA, 13 bp, D. melanogaster
tagtatatatatg

SEQ ID NO: 642733 - DNA, 13 bp, D. melanogaster
tagtatatatgta

SEQ ID NO: 642734 - DNA, 13 bp, D. melanogaster
tagtattgtaaat

SEQ ID NO: 642735 - DNA, 13 bp, D. melanogaster
tagtattgtgatg

SEQ ID NO: 642736 - DNA, 13 bp, D. melanogaster
tagtattttcaaa

SEQ ID NO: 642737 - DNA, 14 bp, D. melanogaster
tagtcaaataaata

SEQ ID NO: 642738 - DNA, 13 bp, D. melanogaster
tagtcaaatattt

SEQ ID NO: 642739 - DNA, 13 bp, D. melanogaster
tagtcaaattttt

SEQ ID NO: 642740 - DNA, 14 bp, D. melanogaster
tagtcaaatttttg

SEQ ID NO: 642741 - DNA, 13 bp, D. melanogaster
tagtcaaggaaga

SEQ ID NO: 642742 - DNA, 13 bp, D. melanogaster
tagtcaattacta

SEQ ID NO: 642743 - DNA, 13 bp, D. melanogaster
tagtcataaatat

SEQ ID NO: 642744 - DNA, 75 bp, D. melanogaster
tagtcatacatacctaattatacatagccaatctagtcataagcttatacactcatacacccatccttaacatac

SEQ ID NO: 642745 - DNA, 13 bp, D. melanogaster
tagtccagtgctc

SEQ ID NO: 642746 - DNA, 14 bp, D. melanogaster
tagtccgtagtccg

SEQ ID NO: 642747 - DNA, 13 bp, D. melanogaster
tagtcgaaatatg

SEQ ID NO: 642748 - DNA, 13 bp, D. melanogaster
tagtcgaggaact

SEQ ID NO: 642749 - DNA, 13 bp, D. melanogaster
tagtcgagtcaaa

SEQ ID NO: 642750 - DNA, 13 bp, D. melanogaster
tagtcgatttcaa

SEQ ID NO: 642751 - DNA, 14 bp, D. melanogaster
tagtctatttggta

SEQ ID NO: 642752 - DNA, 18 bp, D. melanogaster
tagtcttaagctgagatc

SEQ ID NO: 642753 - DNA, 13 bp, D. melanogaster
tagtctttgctca

SEQ ID NO: 642754 - DNA, 13 bp, D. melanogaster
tagtctttggatt

SEQ ID NO: 642755 - DNA, 13 bp, D. melanogaster
tagtgaaaaacaa

SEQ ID NO: 642756 - DNA, 13 bp, D. melanogaster
tagtgaaacagtt

SEQ ID NO: 642757 - DNA, 13 bp, D. melanogaster
tagtgaaacccaa

SEQ ID NO: 642758 - DNA, 13 bp, D. melanogaster
tagtgaacacaga

SEQ ID NO: 642759 - DNA, 13 bp, D. melanogaster
tagtgaactttgc

SEQ ID NO: 642760 - DNA, 14 bp, D. melanogaster
tagtgacaaattcg

SEQ ID NO: 642761 - DNA, 13 bp, D. melanogaster
tagtgaccaacaa

SEQ ID NO: 642762 - DNA, 13 bp, D. melanogaster
tagtgaccatctt

SEQ ID NO: 642763 - DNA, 13 bp, D. melanogaster
tagtgacgaagcg

SEQ ID NO: 642764 - DNA, 14 bp, D. melanogaster
tagtgacgaagcgc

SEQ ID NO: 642765 - DNA, 13 bp, D. melanogaster
tagtgagtgagtg

SEQ ID NO: 642766 - DNA, 13 bp, D. melanogaster
tagtgatcctgat

SEQ ID NO: 642767 - DNA, 13 bp, D. melanogaster
tagtgcaaatatt

SEQ ID NO: 642768 - DNA, 13 bp, D. melanogaster
tagtgctattatt

SEQ ID NO: 642769 - DNA, 14 bp, D. melanogaster
tagtgcttggaaga

SEQ ID NO: 642770 - DNA, 13 bp, D. melanogaster
tagtggagtgccg

SEQ ID NO: 642771 - DNA, 14 bp, D. melanogaster
tagtggcataaata

SEQ ID NO: 642772 - DNA, 13 bp, D. melanogaster
tagtggctgcgga

SEQ ID NO: 642773 - DNA, 13 bp, D. melanogaster
tagtggcttttat

SEQ ID NO: 642774 - DNA, 13 bp, D. melanogaster
tagtgtataatgg

SEQ ID NO: 642775 - DNA, 13 bp, D. melanogaster
tagtgtatggaaa

SEQ ID NO: 642776 - DNA, 13 bp, D. melanogaster
tagtgtgagtgtg

SEQ ID NO: 642777 - DNA, 13 bp, D. melanogaster
tagttaaagcctt

SEQ ID NO: 642778 - DNA, 13 bp, D. melanogaster
tagttaagatttt

SEQ ID NO: 642779 - DNA, 13 bp, D. melanogaster
tagttaagttaag

SEQ ID NO: 642780 - DNA, 13 bp, D. melanogaster
tagttaatagtta

SEQ ID NO: 642781 - DNA, 13 bp, D. melanogaster
tagttaccaaatt

SEQ ID NO: 642782 - DNA, 14 bp, D. melanogaster
tagttactaatgaa

SEQ ID NO: 642783 - DNA, 13 bp, D. melanogaster
tagttagcaacaa

SEQ ID NO: 642784 - DNA, 13 bp, D. melanogaster
tagttagcttttt

SEQ ID NO: 642785 - DNA, 13 bp, D. melanogaster
tagttagttagta

SEQ ID NO: 642786 - DNA, 13 bp, D. melanogaster
tagttagttagtt

SEQ ID NO: 642787 - DNA, 13 bp, D. melanogaster
tagttagttatat

SEQ ID NO: 642788 - DNA, 13 bp, D. melanogaster
tagttataatgaa

SEQ ID NO: 642789 - DNA, 13 bp, D. melanogaster
tagttatagtaat

SEQ ID NO: 642790 - DNA, 13 bp, D. melanogaster
tagttatcctatc

SEQ ID NO: 642791 - DNA, 13 bp, D. melanogaster
tagttatctgctg

SEQ ID NO: 642792 - DNA, 13 bp, D. melanogaster
tagttattcattt

SEQ ID NO: 642793 - DNA, 14 bp, D. melanogaster
tagttcaaagaccc

SEQ ID NO: 642794 - DNA, 13 bp, D. melanogaster
tagttctctgcag

SEQ ID NO: 642795 - DNA, 13 bp, D. melanogaster
tagttgaatattt

SEQ ID NO: 642796 - DNA, 13 bp, D. melanogaster
tagttgatttttc

SEQ ID NO: 642797 - DNA, 13 bp, D. melanogaster
tagttgcaaaata

SEQ ID NO: 642798 - DNA, 13 bp, D. melanogaster
tagttgcatattt

SEQ ID NO: 642799 - DNA, 13 bp, D. melanogaster
tagttgcatttaa

SEQ ID NO: 642800 - DNA, 13 bp, D. melanogaster
tagttgctagttg

SEQ ID NO: 642801 - DNA, 14 bp, D. melanogaster
tagttgctgctgct

SEQ ID NO: 642802 - DNA, 13 bp, D. melanogaster
tagttgctgttgt

SEQ ID NO: 642803 - DNA, 13 bp, D. melanogaster
tagttggcaattg

SEQ ID NO: 642804 - DNA, 13 bp, D. melanogaster
tagttggcacaat

SEQ ID NO: 642805 - DNA, 13 bp, D. melanogaster
tagttggcatttt

SEQ ID NO: 642806 - DNA, 13 bp, D. melanogaster
tagttggtagttg

SEQ ID NO: 642807 - DNA, 13 bp, D. melanogaster
tagttgtagtgtg

SEQ ID NO: 642808 - DNA, 14 bp, D. melanogaster
tagttgttattgta

SEQ ID NO: 642809 - DNA, 13 bp, D. melanogaster
tagttgttgttct

SEQ ID NO: 642810 - DNA, 13 bp, D. melanogaster
tagtttaaaattg

SEQ ID NO: 642811 - DNA, 16 bp, D. melanogaster
tagtttaattctaaat

SEQ ID NO: 642812 - DNA, 13 bp, D. melanogaster
tagtttagtagtt

SEQ ID NO: 642813 - DNA, 13 bp, D. melanogaster
tagtttatttcat

SEQ ID NO: 642814 - DNA, 14 bp, D. melanogaster
tagtttcaaattat

SEQ ID NO: 642815 - DNA, 13 bp, D. melanogaster
tagtttcaataaa

SEQ ID NO: 642816 - DNA, 13 bp, D. melanogaster
tagtttcagaaat

SEQ ID NO: 642817 - DNA, 13 bp, D. melanogaster
tagtttcagtttt

SEQ ID NO: 642818 - DNA, 13 bp, D. melanogaster
tagtttcatattt

SEQ ID NO: 642819 - DNA, 13 bp, D. melanogaster
tagtttcatttta

SEQ ID NO: 642820 - DNA, 13 bp, D. melanogaster
tagtttccatttc

SEQ ID NO: 642821 - DNA, 13 bp, D. melanogaster
tagtttcgatttc

SEQ ID NO: 642822 - DNA, 13 bp, D. melanogaster
tagtttcgatttt

SEQ ID NO: 642823 - DNA, 13 bp, D. melanogaster
tagtttcgttgtt

SEQ ID NO: 642824 - DNA, 13 bp, D. melanogaster
tagtttctagttt

SEQ ID NO: 642825 - DNA, 13 bp, D. melanogaster
tagtttgaattta

SEQ ID NO: 642826 - DNA, 13 bp, D. melanogaster
tagtttgcaaact

SEQ ID NO: 642827 - DNA, 13 bp, D. melanogaster
tagtttgcagtat

SEQ ID NO: 642828 - DNA, 13 bp, D. melanogaster
tagtttgctcatg

SEQ ID NO: 642829 - DNA, 13 bp, D. melanogaster
tagtttggctata

SEQ ID NO: 642830 - DNA, 13 bp, D. melanogaster
tagtttgggccac

SEQ ID NO: 642831 - DNA, 13 bp, D. melanogaster
tagtttgtttcgt

SEQ ID NO: 642832 - DNA, 13 bp, D. melanogaster
tagttttaaagct

SEQ ID NO: 642833 - DNA, 13 bp, D. melanogaster
tagttttacgcct

SEQ ID NO: 642834 - DNA, 13 bp, D. melanogaster
tagttttagttaa

SEQ ID NO: 642835 - DNA, 13 bp, D. melanogaster
tagttttatttac

SEQ ID NO: 642836 - DNA, 14 bp, D. melanogaster
tagttttatttcat

SEQ ID NO: 642837 - DNA, 13 bp, D. melanogaster
tagttttcaatat

SEQ ID NO: 642838 - DNA, 13 bp, D. melanogaster
tagttttcatata

SEQ ID NO: 642839 - DNA, 13 bp, D. melanogaster
tagttttcccatt

SEQ ID NO: 642840 - DNA, 14 bp, D. melanogaster
tagttttcctccgt

SEQ ID NO: 642841 - DNA, 13 bp, D. melanogaster
tagttttcggagg

SEQ ID NO: 642842 - DNA, 13 bp, D. melanogaster
tagttttctaaaa

SEQ ID NO: 642843 - DNA, 13 bp, D. melanogaster
tagttttgaaatt

SEQ ID NO: 642844 - DNA, 13 bp, D. melanogaster
tagttttgaagtt

SEQ ID NO: 642845 - DNA, 13 bp, D. melanogaster
tagttttgcatac

SEQ ID NO: 642846 - DNA, 14 bp, D. melanogaster
tagttttgtaaact

SEQ ID NO: 642847 - DNA, 13 bp, D. melanogaster
tagttttgtaaat

SEQ ID NO: 642848 - DNA, 13 bp, D. melanogaster
tagtttttcagtt

SEQ ID NO: 642849 - DNA, 14 bp, D. melanogaster
tagtttttcatgtt

SEQ ID NO: 642850 - DNA, 13 bp, D. melanogaster
tagtttttcccat

SEQ ID NO: 642851 - DNA, 13 bp, D. melanogaster
tagtttttgaaaa

SEQ ID NO: 642852 - DNA, 13 bp, D. melanogaster
tagtttttgagct

SEQ ID NO: 642853 - DNA, 13 bp, D. melanogaster
tagtttttgatgc

SEQ ID NO: 642854 - DNA, 13 bp, D. melanogaster
tagtttttgtcaa

SEQ ID NO: 642855 - DNA, 13 bp, D. melanogaster
tagttttttgcca

SEQ ID NO: 642856 - DNA, 13 bp, D. melanogaster
tataaaaacaatg

SEQ ID NO: 642857 - DNA, 14 bp, D. melanogaster
tataaaaactagaa

SEQ ID NO: 642858 - DNA, 13 bp, D. melanogaster
tataaaaagaact

SEQ ID NO: 642859 - DNA, 13 bp, D. melanogaster
tataaaaagcatt

SEQ ID NO: 642860 - DNA, 13 bp, D. melanogaster
tataaaaagcgaa

SEQ ID NO: 642861 - DNA, 13 bp, D. melanogaster
tataaaaagcttt

SEQ ID NO: 642862 - DNA, 13 bp, D. melanogaster
tataaaaagtgca

SEQ ID NO: 642863 - DNA, 13 bp, D. melanogaster
tataaaaatagac

SEQ ID NO: 642864 - DNA, 13 bp, D. melanogaster
tataaaaatcgaa

SEQ ID NO: 642865 - DNA, 13 bp, D. melanogaster
tataaaaatgcaa

SEQ ID NO: 642866 - DNA, 14 bp, D. melanogaster
tataaaaatgcaaa

SEQ ID NO: 642867 - DNA, 13 bp, D. melanogaster
tataaaaatgcac

SEQ ID NO: 642868 - DNA, 13 bp, D. melanogaster
tataaaaatgcca

SEQ ID NO: 642869 - DNA, 13 bp, D. melanogaster
tataaaacagttt

SEQ ID NO: 642870 - DNA, 13 bp, D. melanogaster
tataaaacatttc

SEQ ID NO: 642871 - DNA, 13 bp, D. melanogaster
tataaaacgtaat

SEQ ID NO: 642872 - DNA, 13 bp, D. melanogaster
tataaaagatgag

SEQ ID NO: 642873 - DNA, 13 bp, D. melanogaster
tataaaagcagcg

SEQ ID NO: 642874 - DNA, 14 bp, D. melanogaster
tataaaagctaaaa

SEQ ID NO: 642875 - DNA, 13 bp, D. melanogaster
tataaaagctaga

SEQ ID NO: 642876 - DNA, 14 bp, D. melanogaster
tataaaagctagaa

SEQ ID NO: 642877 - DNA, 13 bp, D. melanogaster
tataaaatcgaat

SEQ ID NO: 642878 - DNA, 14 bp, D. melanogaster
tataaaatgcattt

SEQ ID NO: 642879 - DNA, 13 bp, D. melanogaster
tataaaatgcttt

SEQ ID NO: 642880 - DNA, 13 bp, D. melanogaster
tataaaatgtatc

SEQ ID NO: 642881 - DNA, 14 bp, D. melanogaster
tataaaatgtatca

SEQ ID NO: 642882 - DNA, 13 bp, D. melanogaster
tataaaattcgat

SEQ ID NO: 642883 - DNA, 13 bp, D. melanogaster
tataaacaaactt

SEQ ID NO: 642884 - DNA, 13 bp, D. melanogaster
tataaacaaatgt

SEQ ID NO: 642885 - DNA, 13 bp, D. melanogaster
tataaacaacagt

SEQ ID NO: 642886 - DNA, 13 bp, D. melanogaster
tataaacaatagt

SEQ ID NO: 642887 - DNA, 13 bp, D. melanogaster
tataaacatatgt

SEQ ID NO: 642888 - DNA, 13 bp, D. melanogaster
tataaaccaaatt

SEQ ID NO: 642889 - DNA, 13 bp, D. melanogaster
tataaaccaatta

SEQ ID NO: 642890 - DNA, 13 bp, D. melanogaster
tataaaccataat

SEQ ID NO: 642891 - DNA, 14 bp, D. melanogaster
tataaacgaaagct

SEQ ID NO: 642892 - DNA, 13 bp, D. melanogaster
tataaactatttg

SEQ ID NO: 642893 - DNA, 13 bp, D. melanogaster
tataaactgtata

SEQ ID NO: 642894 - DNA, 13 bp, D. melanogaster
tataaagctgttt

SEQ ID NO: 642895 - DNA, 14 bp, D. melanogaster
tataaagtatacat

SEQ ID NO: 642896 - DNA, 13 bp, D. melanogaster
tataaagtattct

SEQ ID NO: 642897 - DNA, 13 bp, D. melanogaster
tataaagtcaagt

SEQ ID NO: 642898 - DNA, 13 bp, D. melanogaster
tataaataaacgt

SEQ ID NO: 642899 - DNA, 13 bp, D. melanogaster
tataaataaagca

SEQ ID NO: 642900 - DNA, 13 bp, D. melanogaster
tataaataaagct

SEQ ID NO: 642901 - DNA, 13 bp, D. melanogaster
tataaatacattc

SEQ ID NO: 642902 - DNA, 13 bp, D. melanogaster
tataaatagaaac

SEQ ID NO: 642903 - DNA, 13 bp, D. melanogaster
tataaatagctta

SEQ ID NO: 642904 - DNA, 13 bp, D. melanogaster
tataaatagtcgg

SEQ ID NO: 642905 - DNA, 14 bp, D. melanogaster
tataaatagtcggc

SEQ ID NO: 642906 - DNA, 13 bp, D. melanogaster
tataaatatcaca

SEQ ID NO: 642907 - DNA, 14 bp, D. melanogaster
tataaatatgcaaa

SEQ ID NO: 642908 - DNA, 14 bp, D. melanogaster
tataaatatgtaca

SEQ ID NO: 642909 - DNA, 13 bp, D. melanogaster
tataaatattcca

SEQ ID NO: 642910 - DNA, 13 bp, D. melanogaster
tataaatatttgg

SEQ ID NO: 642911 - DNA, 13 bp, D. melanogaster
tataaatcaaact

SEQ ID NO: 642912 - DNA, 13 bp, D. melanogaster
tataaatcgacga

SEQ ID NO: 642913 - DNA, 14 bp, D. melanogaster
tataaatgatgagt

SEQ ID NO: 642914 - DNA, 13 bp, D. melanogaster
tataaatgcaaaa

SEQ ID NO: 642915 - DNA, 14 bp, D. melanogaster
tataaatgcaaaaa

SEQ ID NO: 642916 - DNA, 13 bp, D. melanogaster
tataaatgcaact

SEQ ID NO: 642917 - DNA, 13 bp, D. melanogaster
tataaatgcacaa

SEQ ID NO: 642918 - DNA, 13 bp, D. melanogaster
tataaatgccaaa

SEQ ID NO: 642919 - DNA, 13 bp, D. melanogaster
tataaatgtactt

SEQ ID NO: 642920 - DNA, 14 bp, D. melanogaster
tataaatgtatgta

SEQ ID NO: 642921 - DNA, 13 bp, D. melanogaster
tataaattccaat

SEQ ID NO: 642922 - DNA, 13 bp, D. melanogaster
tataaattgcaat

SEQ ID NO: 642923 - DNA, 13 bp, D. melanogaster
tataaattgctaa

SEQ ID NO: 642924 - DNA, 13 bp, D. melanogaster
tataaattgctta

SEQ ID NO: 642925 - DNA, 13 bp, D. melanogaster
tataaattggttt

SEQ ID NO: 642926 - DNA, 13 bp, D. melanogaster
tataaattgtgaa

SEQ ID NO: 642927 - DNA, 13 bp, D. melanogaster
tataaatttcagt

SEQ ID NO: 642928 - DNA, 13 bp, D. melanogaster
tataaatttcgat

SEQ ID NO: 642929 - DNA, 13 bp, D. melanogaster
tataacaagtatt

SEQ ID NO: 642930 - DNA, 13 bp, D. melanogaster
tataacaatgtta

SEQ ID NO: 642931 - DNA, 13 bp, D. melanogaster
tataacataacat

SEQ ID NO: 642932 - DNA, 13 bp, D. melanogaster
tataacattttcc

SEQ ID NO: 642933 - DNA, 13 bp, D. melanogaster
tataaccacatca

SEQ ID NO: 642934 - DNA, 13 bp, D. melanogaster
tataaccagaatt

SEQ ID NO: 642935 - DNA, 13 bp, D. melanogaster
tataaccataaat

SEQ ID NO: 642936 - DNA, 13 bp, D. melanogaster
tataacctaaagt

SEQ ID NO: 642937 - DNA, 13 bp, D. melanogaster
tataacgcatacg

SEQ ID NO: 642938 - DNA, 13 bp, D. melanogaster
tataactaactat

SEQ ID NO: 642939 - DNA, 13 bp, D. melanogaster
tataactacatat

SEQ ID NO: 642940 - DNA, 13 bp, D. melanogaster
tataactagaaaa

SEQ ID NO: 642941 - DNA, 13 bp, D. melanogaster
tataactatgcac

SEQ ID NO: 642942 - DNA, 13 bp, D. melanogaster
tataactatttac

SEQ ID NO: 642943 - DNA, 13 bp, D. melanogaster
tataactcctaca

SEQ ID NO: 642944 - DNA, 13 bp, D. melanogaster
tataacttataac

SEQ ID NO: 642945 - DNA, 14 bp, D. melanogaster
tataacttataact

SEQ ID NO: 642946 - DNA, 13 bp, D. melanogaster
tataacttcattt

SEQ ID NO: 642947 - DNA, 13 bp, D. melanogaster
tataacttttttg

SEQ ID NO: 642948 - DNA, 14 bp, D. melanogaster
tataacttttttgg

SEQ ID NO: 642949 - DNA, 13 bp, D. melanogaster
tataagaacattt

SEQ ID NO: 642950 - DNA, 13 bp, D. melanogaster
tataagaattcaa

SEQ ID NO: 642951 - DNA, 13 bp, D. melanogaster
tataagatcaccc

SEQ ID NO: 642952 - DNA, 13 bp, D. melanogaster
tataagcaaaata

SEQ ID NO: 642953 - DNA, 13 bp, D. melanogaster
tataagcaaatat

SEQ ID NO: 642954 - DNA, 13 bp, D. melanogaster
tataagcaacaaa

SEQ ID NO: 642955 - DNA, 13 bp, D. melanogaster
tataagcttaaat

SEQ ID NO: 642956 - DNA, 13 bp, D. melanogaster
tataagctttaaa

SEQ ID NO: 642957 - DNA, 13 bp, D. melanogaster
tataagctttatt

SEQ ID NO: 642958 - DNA, 13 bp, D. melanogaster
tataaggatataa

SEQ ID NO: 642959 - DNA, 13 bp, D. melanogaster
tataagtaagagc

SEQ ID NO: 642960 - DNA, 13 bp, D. melanogaster
tataagtacatat

SEQ ID NO: 642961 - DNA, 13 bp, D. melanogaster
tataagtataagt

SEQ ID NO: 642962 - DNA, 13 bp, D. melanogaster
tataagtatgttt

SEQ ID NO: 642963 - DNA, 13 bp, D. melanogaster
tataagtgtgtgt

SEQ ID NO: 642964 - DNA, 13 bp, D. melanogaster
tataagtttttct

SEQ ID NO: 642965 - DNA, 13 bp, D. melanogaster
tataataaaatgc

SEQ ID NO: 642966 - DNA, 13 bp, D. melanogaster
tataataaatgag

SEQ ID NO: 642967 - DNA, 13 bp, D. melanogaster
tataataatacca

SEQ ID NO: 642968 - DNA, 13 bp, D. melanogaster
tataataatgcaa

SEQ ID NO: 642969 - DNA, 13 bp, D. melanogaster
tataataccataa

SEQ ID NO: 642970 - DNA, 13 bp, D. melanogaster
tataatagataac

SEQ ID NO: 642971 - DNA, 14 bp, D. melanogaster
tataatagataacc

SEQ ID NO: 642972 - DNA, 13 bp, D. melanogaster
tataataggaatg

SEQ ID NO: 642973 - DNA, 13 bp, D. melanogaster
tataatagtatag

SEQ ID NO: 642974 - DNA, 14 bp, D. melanogaster
tataatatatatgc

SEQ ID NO: 642975 - DNA, 13 bp, D. melanogaster
tataatatcatcc

SEQ ID NO: 642976 - DNA, 13 bp, D. melanogaster
tataatatttggg

SEQ ID NO: 642977 - DNA, 13 bp, D. melanogaster
tataatcaattac

SEQ ID NO: 642978 - DNA, 13 bp, D. melanogaster
tataatcaccgat

SEQ ID NO: 642979 - DNA, 13 bp, D. melanogaster
tataatccaagtt

SEQ ID NO: 642980 - DNA, 13 bp, D. melanogaster
tataatcgaaaat

SEQ ID NO: 642981 - DNA, 13 bp, D. melanogaster
tataatcgaattt

SEQ ID NO: 642982 - DNA, 13 bp, D. melanogaster
tataatgaaatca

SEQ ID NO: 642983 - DNA, 13 bp, D. melanogaster
tataatgcaattt

SEQ ID NO: 642984 - DNA, 13 bp, D. melanogaster
tataatggaaaca

SEQ ID NO: 642985 - DNA, 13 bp, D. melanogaster
tataatggaatat

SEQ ID NO: 642986 - DNA, 13 bp, D. melanogaster
tataatgtaatgt

SEQ ID NO: 642987 - DNA, 13 bp, D. melanogaster
tataatgtatgta

SEQ ID NO: 642988 - DNA, 13 bp, D. melanogaster
tataattaaatgc

SEQ ID NO: 642989 - DNA, 13 bp, D. melanogaster
tataattaagcaa

SEQ ID NO: 642990 - DNA, 13 bp, D. melanogaster
tataattaaggaa

SEQ ID NO: 642991 - DNA, 13 bp, D. melanogaster
tataattacatac

SEQ ID NO: 642992 - DNA, 13 bp, D. melanogaster
tataattccaatt

SEQ ID NO: 642993 - DNA, 13 bp, D. melanogaster
tataattccattt

SEQ ID NO: 642994 - DNA, 13 bp, D. melanogaster
tataattgcaaag

SEQ ID NO: 642995 - DNA, 13 bp, D. melanogaster
tataattgcatta

SEQ ID NO: 642996 - DNA, 13 bp, D. melanogaster
tataattgctttt

SEQ ID NO: 642997 - DNA, 13 bp, D. melanogaster
tataattggcttg

SEQ ID NO: 642998 - DNA, 13 bp, D. melanogaster
tataatttaaagc

SEQ ID NO: 642999 - DNA, 13 bp, D. melanogaster
tataatttccatt

SEQ ID NO: 643000 - DNA, 13 bp, D. melanogaster
tataatttggaaa

SEQ ID NO: 643001 - DNA, 13 bp, D. melanogaster
tataattttcaac

SEQ ID NO: 643002 - DNA, 13 bp, D. melanogaster
tataattttcttg

SEQ ID NO: 643003 - DNA, 13 bp, D. melanogaster
tataattttgtac

SEQ ID NO: 643004 - DNA, 13 bp, D. melanogaster
tataatttttagc

SEQ ID NO: 643005 - DNA, 13 bp, D. melanogaster
tatacaaaaatcc

SEQ ID NO: 643006 - DNA, 13 bp, D. melanogaster
tatacaaaaattc

SEQ ID NO: 643007 - DNA, 13 bp, D. melanogaster
tatacaaaactat

SEQ ID NO: 643008 - DNA, 13 bp, D. melanogaster
tatacaaaagttt

SEQ ID NO: 643009 - DNA, 13 bp, D. melanogaster
tatacaaaataag

SEQ ID NO: 643010 - DNA, 13 bp, D. melanogaster
tatacaaaatgaa

SEQ ID NO: 643011 - DNA, 13 bp, D. melanogaster
tatacaaaatgta

SEQ ID NO: 643012 - DNA, 13 bp, D. melanogaster
tatacaaaattcg

SEQ ID NO: 643013 - DNA, 13 bp, D. melanogaster
tatacaaactata

SEQ ID NO: 643014 - DNA, 13 bp, D. melanogaster
tatacaaagaata

SEQ ID NO: 643015 - DNA, 13 bp, D. melanogaster
tatacaaaggaaa

SEQ ID NO: 643016 - DNA, 13 bp, D. melanogaster
tatacaaatactt

SEQ ID NO: 643017 - DNA, 14 bp, D. melanogaster
tatacaaatgaata

SEQ ID NO: 643018 - DNA, 13 bp, D. melanogaster
tatacaaattaag

SEQ ID NO: 643019 - DNA, 13 bp, D. melanogaster
tatacaaattctt

SEQ ID NO: 643020 - DNA, 13 bp, D. melanogaster
tatacaacaattt

SEQ ID NO: 643021 - DNA, 13 bp, D. melanogaster
tatacaacatttt

SEQ ID NO: 643022 - DNA, 13 bp, D. melanogaster
tatacaacttaga

SEQ ID NO: 643023 - DNA, 13 bp, D. melanogaster
tatacaagaaaat

SEQ ID NO: 643024 - DNA, 13 bp, D. melanogaster
tatacaatacatt

SEQ ID NO: 643025 - DNA, 13 bp, D. melanogaster
tatacaatataag

SEQ ID NO: 643026 - DNA, 13 bp, D. melanogaster
tatacaatataca

SEQ ID NO: 643027 - DNA, 13 bp, D. melanogaster
tatacaatatatc

SEQ ID NO: 643028 - DNA, 13 bp, D. melanogaster
tatacaatttgtt

SEQ ID NO: 643029 - DNA, 13 bp, D. melanogaster
tatacacacaata

SEQ ID NO: 643030 - DNA, 13 bp, D. melanogaster
tatacacacaatt

SEQ ID NO: 643031 - DNA, 13 bp, D. melanogaster
tatacacacacaa

SEQ ID NO: 643032 - DNA, 13 bp, D. melanogaster
tatacacacacac

SEQ ID NO: 643033 - DNA, 14 bp, D. melanogaster
tatacacacacaca

SEQ ID NO: 643034 - DNA, 13 bp, D. melanogaster
tatacacacattt

SEQ ID NO: 643035 - DNA, 13 bp, D. melanogaster
tatacacactggc

SEQ ID NO: 643036 - DNA, 14 bp, D. melanogaster
tatacacagacata

SEQ ID NO: 643037 - DNA, 13 bp, D. melanogaster
tatacacagcaga

SEQ ID NO: 643038 - DNA, 13 bp, D. melanogaster
tatacacatatat

SEQ ID NO: 643039 - DNA, 14 bp, D. melanogaster
tatacacatatatg

SEQ ID NO: 643040 - DNA, 13 bp, D. melanogaster
tatacacatgcat

SEQ ID NO: 643041 - DNA, 13 bp, D. melanogaster
tatacacatgtat

SEQ ID NO: 643042 - DNA, 13 bp, D. melanogaster
tatacaccatcaa

SEQ ID NO: 643043 - DNA, 13 bp, D. melanogaster
tatacacgaaaaa

SEQ ID NO: 643044 - DNA, 13 bp, D. melanogaster
tatacactttata

SEQ ID NO: 643045 - DNA, 13 bp, D. melanogaster
tatacagaaaatg

SEQ ID NO: 643046 - DNA, 13 bp, D. melanogaster
tatacagataaaa

SEQ ID NO: 643047 - DNA, 14 bp, D. melanogaster
tatacagatatatt

SEQ ID NO: 643048 - DNA, 14 bp, D. melanogaster
tatacataaatatg

SEQ ID NO: 643049 - DNA, 13 bp, D. melanogaster
tatacataaatga

SEQ ID NO: 643050 - DNA, 13 bp, D. melanogaster
tatacatacaata

SEQ ID NO: 643051 - DNA, 14 bp, D. melanogaster
tatacatacacaca

SEQ ID NO: 643052 - DNA, 14 bp, D. melanogaster
tatacatacatacg

SEQ ID NO: 643053 - DNA, 14 bp, D. melanogaster
tatacatacatata

SEQ ID NO: 643054 - DNA, 17 bp, D. melanogaster
tatacatacatatataa

SEQ ID NO: 643055 - DNA, 17 bp, D. melanogaster
tatacatacatatatag

SEQ ID NO: 643056 - DNA, 13 bp, D. melanogaster
tatacatacatca

SEQ ID NO: 643057 - DNA, 13 bp, D. melanogaster
tatacatacatct

SEQ ID NO: 643058 - DNA, 14 bp, D. melanogaster
tatacatacatgca

SEQ ID NO: 643059 - DNA, 13 bp, D. melanogaster
tatacatacatgt

SEQ ID NO: 643060 - DNA, 14 bp, D. melanogaster
tatacatacattta

SEQ ID NO: 643061 - DNA, 13 bp, D. melanogaster
tatacatacgtac

SEQ ID NO: 643062 - DNA, 13 bp, D. melanogaster
tatacatacgtgt

SEQ ID NO: 643063 - DNA, 14 bp, D. melanogaster
tatacatactcgta

SEQ ID NO: 643064 - DNA, 13 bp, D. melanogaster
tatacatagatgt

SEQ ID NO: 643065 - DNA, 13 bp, D. melanogaster
tatacatagccaa

SEQ ID NO: 643066 - DNA, 13 bp, D. melanogaster
tatacatataaac

SEQ ID NO: 643067 - DNA, 13 bp, D. melanogaster
tatacatataatg

SEQ ID NO: 643068 - DNA, 13 bp, D. melanogaster
tatacatatacaa

SEQ ID NO: 643069 - DNA, 13 bp, D. melanogaster
tatacatatacag

SEQ ID NO: 643070 - DNA, 14 bp, D. melanogaster
tatacatatacgta

SEQ ID NO: 643071 - DNA, 13 bp, D. melanogaster
tatacatatacta

SEQ ID NO: 643072 - DNA, 13 bp, D. melanogaster
tatacatatactt

SEQ ID NO: 643073 - DNA, 14 bp, D. melanogaster
tatacatatacttt

SEQ ID NO: 643074 - DNA, 16 bp, D. melanogaster
tatacatatatacatt

SEQ ID NO: 643075 - DNA, 14 bp, D. melanogaster
tatacatatatagc

SEQ ID NO: 643076 - DNA, 14 bp, D. melanogaster
tatacatatatagg

SEQ ID NO: 643077 - DNA, 14 bp, D. melanogaster
tatacatatatagt

SEQ ID NO: 643078 - DNA, 14 bp, D. melanogaster
tatacatatatatc

SEQ ID NO: 643079 - DNA, 13 bp, D. melanogaster
tatacatatatca

SEQ ID NO: 643080 - DNA, 14 bp, D. melanogaster
tatacatatatcat

SEQ ID NO: 643081 - DNA, 14 bp, D. melanogaster
tatacatatatcta

SEQ ID NO: 643082 - DNA, 13 bp, D. melanogaster
tatacatatatga

SEQ ID NO: 643083 - DNA, 14 bp, D. melanogaster
tatacatatatgag

SEQ ID NO: 643084 - DNA, 13 bp, D. melanogaster
tatacatatatgg

SEQ ID NO: 643085 - DNA, 16 bp, D. melanogaster
tatacatatatgtatg

SEQ ID NO: 643086 - DNA, 14 bp, D. melanogaster
tatacatatattac

SEQ ID NO: 643087 - DNA, 14 bp, D. melanogaster
tatacatatattcc

SEQ ID NO: 643088 - DNA, 14 bp, D. melanogaster
tatacatatattct

SEQ ID NO: 643089 - DNA, 13 bp, D. melanogaster
tatacatatattg

SEQ ID NO: 643090 - DNA, 13 bp, D. melanogaster
tatacatatctat

SEQ ID NO: 643091 - DNA, 13 bp, D. melanogaster
tatacatatgcac

SEQ ID NO: 643092 - DNA, 13 bp, D. melanogaster
tatacatatgtaa

SEQ ID NO: 643093 - DNA, 13 bp, D. melanogaster
tatacatatgtac

SEQ ID NO: 643094 - DNA, 13 bp, D. melanogaster
tatacatatgtat

SEQ ID NO: 643095 - DNA, 15 bp, D. melanogaster
tatacatatgtattt

SEQ ID NO: 643096 - DNA, 13 bp, D. melanogaster
tatacatatgtct

SEQ ID NO: 643097 - DNA, 13 bp, D. melanogaster
tatacatatgtgc

SEQ ID NO: 643098 - DNA, 13 bp, D. melanogaster
tatacatatgtgt

SEQ ID NO: 643099 - DNA, 14 bp, D. melanogaster
tatacatgtacata

SEQ ID NO: 643100 - DNA, 13 bp, D. melanogaster
tatacatgtgtat

SEQ ID NO: 643101 - DNA, 13 bp, D. melanogaster
tatacatgtgtgt

SEQ ID NO: 643102 - DNA, 13 bp, D. melanogaster
tatacattattga

SEQ ID NO: 643103 - DNA, 13 bp, D. melanogaster
tatacattgtata

SEQ ID NO: 643104 - DNA, 13 bp, D. melanogaster
tatacatttaaac

SEQ ID NO: 643105 - DNA, 13 bp, D. melanogaster
tatacatttaaca

SEQ ID NO: 643106 - DNA, 13 bp, D. melanogaster
tatacatttgaaa

SEQ ID NO: 643107 - DNA, 13 bp, D. melanogaster
tatacatttgttt

SEQ ID NO: 643108 - DNA, 13 bp, D. melanogaster
tatacattttaca

SEQ ID NO: 643109 - DNA, 14 bp, D. melanogaster
tatacattttacat

SEQ ID NO: 643110 - DNA, 13 bp, D. melanogaster
tatacattttaga

SEQ ID NO: 643111 - DNA, 13 bp, D. melanogaster
tatacattttcca

SEQ ID NO: 643112 - DNA, 13 bp, D. melanogaster
tatacattttgtt

SEQ ID NO: 643113 - DNA, 14 bp, D. melanogaster
tataccacaaaatc

SEQ ID NO: 643114 - DNA, 13 bp, D. melanogaster
tataccacatata

SEQ ID NO: 643115 - DNA, 13 bp, D. melanogaster
tataccagttact

SEQ ID NO: 643116 - DNA, 13 bp, D. melanogaster
tataccataccat

SEQ ID NO: 643117 - DNA, 13 bp, D. melanogaster
tataccatatact

SEQ ID NO: 643118 - DNA, 13 bp, D. melanogaster
tataccatatatt

SEQ ID NO: 643119 - DNA, 13 bp, D. melanogaster
tataccattttac

SEQ ID NO: 643120 - DNA, 13 bp, D. melanogaster
tataccattttta

SEQ ID NO: 643121 - DNA, 14 bp, D. melanogaster
tatacccaaaatgg

SEQ ID NO: 643122 - DNA, 13 bp, D. melanogaster
tatacccaaatat

SEQ ID NO: 643123 - DNA, 13 bp, D. melanogaster
tatacccttgcag

SEQ ID NO: 643124 - DNA, 13 bp, D. melanogaster
tataccgcatata

SEQ ID NO: 643125 - DNA, 14 bp, D. melanogaster
tataccgcatatag

SEQ ID NO: 643126 - DNA, 13 bp, D. melanogaster
tatacctatgtat

SEQ ID NO: 643127 - DNA, 13 bp, D. melanogaster
tataccttaaaaa

SEQ ID NO: 643128 - DNA, 13 bp, D. melanogaster
tataccttatata

SEQ ID NO: 643129 - DNA, 13 bp, D. melanogaster
tatacgaaataat

SEQ ID NO: 643130 - DNA, 13 bp, D. melanogaster
tatacgaagtcat

SEQ ID NO: 643131 - DNA, 13 bp, D. melanogaster
tatacgacatgtg

SEQ ID NO: 643132 - DNA, 14 bp, D. melanogaster
tatacgcaacgttg

SEQ ID NO: 643133 - DNA, 13 bp, D. melanogaster
tatacgcaatata

SEQ ID NO: 643134 - DNA, 13 bp, D. melanogaster
tatacgcaatttt

SEQ ID NO: 643135 - DNA, 14 bp, D. melanogaster
tatacgccacgttg

SEQ ID NO: 643136 - DNA, 13 bp, D. melanogaster
tatacgccatagc

SEQ ID NO: 643137 - DNA, 13 bp, D. melanogaster
tatacgccatgta

SEQ ID NO: 643138 - DNA, 13 bp, D. melanogaster
tatacgccgcatg

SEQ ID NO: 643139 - DNA, 13 bp, D. melanogaster
tatacgccgtgtg

SEQ ID NO: 643140 - DNA, 13 bp, D. melanogaster
tatacgctgctct

SEQ ID NO: 643141 - DNA, 13 bp, D. melanogaster
tatacggacggac

SEQ ID NO: 643142 - DNA, 13 bp, D. melanogaster
tatacgtaacgtg

SEQ ID NO: 643143 - DNA, 13 bp, D. melanogaster
tatacgtaataaa

SEQ ID NO: 643144 - DNA, 13 bp, D. melanogaster
tatacgtaatatt

SEQ ID NO: 643145 - DNA, 13 bp, D. melanogaster
tatacgtaatttt

SEQ ID NO: 643146 - DNA, 14 bp, D. melanogaster
tatacgtacataca

SEQ ID NO: 643147 - DNA, 13 bp, D. melanogaster
tatacgtatatac

SEQ ID NO: 643148 - DNA, 13 bp, D. melanogaster
tatacgtatattt

SEQ ID NO: 643149 - DNA, 13 bp, D. melanogaster
tatacgtatttat

SEQ ID NO: 643150 - DNA, 13 bp, D. melanogaster
tatacgtgatttt

SEQ ID NO: 643151 - DNA, 13 bp, D. melanogaster
tatacgtttattt

SEQ ID NO: 643152 - DNA, 13 bp, D. melanogaster
tatactaatgtac

SEQ ID NO: 643153 - DNA, 13 bp, D. melanogaster
tatactactacta

SEQ ID NO: 643154 - DNA, 14 bp, D. melanogaster
tatactagattcgt

SEQ ID NO: 643155 - DNA, 14 bp, D. melanogaster
tatactatatatac

SEQ ID NO: 643156 - DNA, 14 bp, D. melanogaster
tatactatatatag

SEQ ID NO: 643157 - DNA, 13 bp, D. melanogaster
tatactatatatg

SEQ ID NO: 643158 - DNA, 13 bp, D. melanogaster
tatactatatgtt

SEQ ID NO: 643159 - DNA, 13 bp, D. melanogaster
tatactatattcg

SEQ ID NO: 643160 - DNA, 13 bp, D. melanogaster
tatactatgtatg

SEQ ID NO: 643161 - DNA, 13 bp, D. melanogaster
tatactcagttta

SEQ ID NO: 643162 - DNA, 13 bp, D. melanogaster
tatactcagtttt

SEQ ID NO: 643163 - DNA, 14 bp, D. melanogaster
tatactcgtacata

SEQ ID NO: 643164 - DNA, 13 bp, D. melanogaster
tatactctacgat

SEQ ID NO: 643165 - DNA, 13 bp, D. melanogaster
tatactctatata

SEQ ID NO: 643166 - DNA, 13 bp, D. melanogaster
tatactcttatat

SEQ ID NO: 643167 - DNA, 13 bp, D. melanogaster
tatactctttaaa

SEQ ID NO: 643168 - DNA, 13 bp, D. melanogaster
tatacttacttat

SEQ ID NO: 643169 - DNA, 14 bp, D. melanogaster
tatacttatactta

SEQ ID NO: 643170 - DNA, 14 bp, D. melanogaster
tatacttatgtata

SEQ ID NO: 643171 - DNA, 13 bp, D. melanogaster
tatacttgatatg

SEQ ID NO: 643172 - DNA, 13 bp, D. melanogaster
tatactttagaaa

SEQ ID NO: 643173 - DNA, 13 bp, D. melanogaster
tatactttataca

SEQ ID NO: 643174 - DNA, 14 bp, D. melanogaster
tatactttatatac

SEQ ID NO: 643175 - DNA, 13 bp, D. melanogaster
tatactttatgta

SEQ ID NO: 643176 - DNA, 13 bp, D. melanogaster
tatactttgaaaa

SEQ ID NO: 643177 - DNA, 13 bp, D. melanogaster
tatactttgtggc

SEQ ID NO: 643178 - DNA, 14 bp, D. melanogaster
tatactttgttcat

SEQ ID NO: 643179 - DNA, 13 bp, D. melanogaster
tatagaaaattgt

SEQ ID NO: 643180 - DNA, 13 bp, D. melanogaster
tatagaaactata

SEQ ID NO: 643181 - DNA, 13 bp, D. melanogaster
tatagaaatcaaa

SEQ ID NO: 643182 - DNA, 13 bp, D. melanogaster
tatagaaatgtaa

SEQ ID NO: 643183 - DNA, 13 bp, D. melanogaster
tatagaaattttc

SEQ ID NO: 643184 - DNA, 13 bp, D. melanogaster
tatagaacatttt

SEQ ID NO: 643185 - DNA, 13 bp, D. melanogaster
tatagaagagcta

SEQ ID NO: 643186 - DNA, 13 bp, D. melanogaster
tatagaataatac

SEQ ID NO: 643187 - DNA, 13 bp, D. melanogaster
tatagaatatctt

SEQ ID NO: 643188 - DNA, 13 bp, D. melanogaster
tatagacaaaaat

SEQ ID NO: 643189 - DNA, 13 bp, D. melanogaster
tatagacatatat

SEQ ID NO: 643190 - DNA, 14 bp, D. melanogaster
tatagacatatata

SEQ ID NO: 643191 - DNA, 13 bp, D. melanogaster
tatagactatata

SEQ ID NO: 643192 - DNA, 13 bp, D. melanogaster
tatagagatatat

SEQ ID NO: 643193 - DNA, 13 bp, D. melanogaster
tatagagtatata

SEQ ID NO: 643194 - DNA, 13 bp, D. melanogaster
tatagatacagat

SEQ ID NO: 643195 - DNA, 14 bp, D. melanogaster
tatagatacagata

SEQ ID NO: 643196 - DNA, 13 bp, D. melanogaster
tatagatacatat

SEQ ID NO: 643197 - DNA, 13 bp, D. melanogaster
tatagatagatat

SEQ ID NO: 643198 - DNA, 14 bp, D. melanogaster
tatagatatagata

SEQ ID NO: 643199 - DNA, 13 bp, D. melanogaster
tatagatgcagtt

SEQ ID NO: 643200 - DNA, 13 bp, D. melanogaster
tatagatgtaaaa

SEQ ID NO: 643201 - DNA, 14 bp, D. melanogaster
tatagatgtaagaa

SEQ ID NO: 643202 - DNA, 14 bp, D. melanogaster
tatagcaaaaataa

SEQ ID NO: 643203 - DNA, 13 bp, D. melanogaster
tatagcaaatata

SEQ ID NO: 643204 - DNA, 13 bp, D. melanogaster
tatagcaataaaa

SEQ ID NO: 643205 - DNA, 13 bp, D. melanogaster
tatagcacatatt

SEQ ID NO: 643206 - DNA, 13 bp, D. melanogaster
tatagcatatata

SEQ ID NO: 643207 - DNA, 14 bp, D. melanogaster
tatagcatatatat

SEQ ID NO: 643208 - DNA, 13 bp, D. melanogaster
tatagcattctct

SEQ ID NO: 643209 - DNA, 14 bp, D. melanogaster
tatagcattctctt

SEQ ID NO: 643210 - DNA, 13 bp, D. melanogaster
tatagcattttaa

SEQ ID NO: 643211 - DNA, 13 bp, D. melanogaster
tatagccacaact

SEQ ID NO: 643212 - DNA, 13 bp, D. melanogaster
tatagccatatag

SEQ ID NO: 643213 - DNA, 13 bp, D. melanogaster
tatagccattata

SEQ ID NO: 643214 - DNA, 14 bp, D. melanogaster
tatagccattataa

SEQ ID NO: 643215 - DNA, 13 bp, D. melanogaster
tatagcttcgatc

SEQ ID NO: 643216 - DNA, 13 bp, D. melanogaster
tatagcttttata

SEQ ID NO: 643217 - DNA, 13 bp, D. melanogaster
tatagctttttat

SEQ ID NO: 643218 - DNA, 13 bp, D. melanogaster
tataggaaaattg

SEQ ID NO: 643219 - DNA, 13 bp, D. melanogaster
tataggaataaat

SEQ ID NO: 643220 - DNA, 13 bp, D. melanogaster
tataggagaagtt

SEQ ID NO: 643221 - DNA, 13 bp, D. melanogaster
tataggatatctg

SEQ ID NO: 643222 - DNA, 13 bp, D. melanogaster
tataggtatcgta

SEQ ID NO: 643223 - DNA, 13 bp, D. melanogaster
tatagtacaattt

SEQ ID NO: 643224 - DNA, 13 bp, D. melanogaster
tatagtatagtat

SEQ ID NO: 643225 - DNA, 14 bp, D. melanogaster
tatagtatagtata

SEQ ID NO: 643226 - DNA, 13 bp, D. melanogaster
tatagtatatatg

SEQ ID NO: 643227 - DNA, 13 bp, D. melanogaster
tatagtatgtata

SEQ ID NO: 643228 - DNA, 13 bp, D. melanogaster
tatagtcaataat

SEQ ID NO: 643229 - DNA, 14 bp, D. melanogaster
tatagtcaataatt

SEQ ID NO: 643230 - DNA, 13 bp, D. melanogaster
tatagtcatcatt

SEQ ID NO: 643231 - DNA, 13 bp, D. melanogaster
tatagtccagtgc

SEQ ID NO: 643232 - DNA, 14 bp, D. melanogaster
tatagtcgagttcc

SEQ ID NO: 643233 - DNA, 13 bp, D. melanogaster
tatagtgtataat

SEQ ID NO: 643234 - DNA, 14 bp, D. melanogaster
tatagttaagattt

SEQ ID NO: 643235 - DNA, 13 bp, D. melanogaster
tatagttagttat

SEQ ID NO: 643236 - DNA, 13 bp, D. melanogaster
tatagttattact

SEQ ID NO: 643237 - DNA, 13 bp, D. melanogaster
tatagtttacaaa

SEQ ID NO: 643238 - DNA, 13 bp, D. melanogaster
tatagtttctaaa

SEQ ID NO: 643239 - DNA, 13 bp, D. melanogaster
tatagttttacac

SEQ ID NO: 643240 - DNA, 13 bp, D. melanogaster
tatataaaccatt

SEQ ID NO: 643241 - DNA, 13 bp, D. melanogaster
tatataaatacca

SEQ ID NO: 643242 - DNA, 13 bp, D. melanogaster
tatataaatatgc

SEQ ID NO: 643243 - DNA, 13 bp, D. melanogaster
tatataaatggaa

SEQ ID NO: 643244 - DNA, 13 bp, D. melanogaster
tatataacatatg

SEQ ID NO: 643245 - DNA, 13 bp, D. melanogaster
tatataagcataa

SEQ ID NO: 643246 - DNA, 14 bp, D. melanogaster
tatataaggtctgc

SEQ ID NO: 643247 - DNA, 13 bp, D. melanogaster
tatataaggtgtt

SEQ ID NO: 643248 - DNA, 13 bp, D. melanogaster
tatataatcaatg

SEQ ID NO: 643249 - DNA, 13 bp, D. melanogaster
tatataatgcatt

SEQ ID NO: 643250 - DNA, 13 bp, D. melanogaster
tatataatggata

SEQ ID NO: 643251 - DNA, 14 bp, D. melanogaster
tatatacaaatgaa

SEQ ID NO: 643252 - DNA, 13 bp, D. melanogaster
tatatacaaatgt

SEQ ID NO: 643253 - DNA, 14 bp, D. melanogaster
tatatacaaatgta

SEQ ID NO: 643254 - DNA, 13 bp, D. melanogaster
tatatacaacatt

SEQ ID NO: 643255 - DNA, 13 bp, D. melanogaster
tatatacaagaaa

SEQ ID NO: 643256 - DNA, 14 bp, D. melanogaster
tatatacaatatac

SEQ ID NO: 643257 - DNA, 13 bp, D. melanogaster
tatatacacaaat

SEQ ID NO: 643258 - DNA, 13 bp, D. melanogaster
tatatacacacaa

SEQ ID NO: 643259 - DNA, 14 bp, D. melanogaster
tatatacacacaca

SEQ ID NO: 643260 - DNA, 13 bp, D. melanogaster
tatatacacacgc

SEQ ID NO: 643261 - DNA, 14 bp, D. melanogaster
tatatacacataca

SEQ ID NO: 643262 - DNA, 13 bp, D. melanogaster
tatatacacatat

SEQ ID NO: 643263 - DNA, 13 bp, D. melanogaster
tatatacacatct

SEQ ID NO: 643264 - DNA, 14 bp, D. melanogaster
tatatacacatgta

SEQ ID NO: 643265 - DNA, 13 bp, D. melanogaster
tatatacacattt

SEQ ID NO: 643266 - DNA, 14 bp, D. melanogaster
tatatacacatttt

SEQ ID NO: 643267 - DNA, 13 bp, D. melanogaster
tatatacacttat

SEQ ID NO: 643268 - DNA, 13 bp, D. melanogaster
tatatacactttt

SEQ ID NO: 643269 - DNA, 14 bp, D. melanogaster
tatatacagatata

SEQ ID NO: 643270 - DNA, 13 bp, D. melanogaster
tatatacataaga

SEQ ID NO: 643271 - DNA, 15 bp, D. melanogaster
tatatacatacacat

SEQ ID NO: 643272 - DNA, 15 bp, D. melanogaster
tatatacatacatac

SEQ ID NO: 643273 - DNA, 15 bp, D. melanogaster
tatatacatacatat

SEQ ID NO: 643274 - DNA, 14 bp, D. melanogaster
tatatacatacatg

SEQ ID NO: 643275 - DNA, 14 bp, D. melanogaster
tatatacatacatt

SEQ ID NO: 643276 - DNA, 13 bp, D. melanogaster
tatatacatacgt

SEQ ID NO: 643277 - DNA, 13 bp, D. melanogaster
tatatacatactt

SEQ ID NO: 643278 - DNA, 13 bp, D. melanogaster
tatatacatagat

SEQ ID NO: 643279 - DNA, 14 bp, D. melanogaster
tatatacataggta

SEQ ID NO: 643280 - DNA, 13 bp, D. melanogaster
tatatacatagta

SEQ ID NO: 643281 - DNA, 13 bp, D. melanogaster
tatatacatagtt

SEQ ID NO: 643282 - DNA, 14 bp, D. melanogaster
tatatacatataac

SEQ ID NO: 643283 - DNA, 16 bp, D. melanogaster
tatatacatatgtgtg

SEQ ID NO: 643284 - DNA, 13 bp, D. melanogaster
tatatacatattc

SEQ ID NO: 643285 - DNA, 13 bp, D. melanogaster
tatatacatgcat

SEQ ID NO: 643286 - DNA, 13 bp, D. melanogaster
tatatacatgtat

SEQ ID NO: 643287 - DNA, 13 bp, D. melanogaster
tatatacattaac

SEQ ID NO: 643288 - DNA, 13 bp, D. melanogaster
tatatacatttcg

SEQ ID NO: 643289 - DNA, 13 bp, D. melanogaster
tatataccatata

SEQ ID NO: 643290 - DNA, 13 bp, D. melanogaster
tatataccatatt

SEQ ID NO: 643291 - DNA, 13 bp, D. melanogaster
tatataccttata

SEQ ID NO: 643292 - DNA, 13 bp, D. melanogaster
tatatacctttta

SEQ ID NO: 643293 - DNA, 13 bp, D. melanogaster
tatatacgaaaat

SEQ ID NO: 643294 - DNA, 13 bp, D. melanogaster
tatatacgaaata

SEQ ID NO: 643295 - DNA, 14 bp, D. melanogaster
tatatacgaacata

SEQ ID NO: 643296 - DNA, 14 bp, D. melanogaster
tatatacgaatata

SEQ ID NO: 643297 - DNA, 14 bp, D. melanogaster
tatatacgagtata

SEQ ID NO: 643298 - DNA, 13 bp, D. melanogaster
tatatacgatcct

SEQ ID NO: 643299 - DNA, 13 bp, D. melanogaster
tatatacgctgct

SEQ ID NO: 643300 - DNA, 13 bp, D. melanogaster
tatatacgtacat

SEQ ID NO: 643301 - DNA, 14 bp, D. melanogaster
tatatacgtacata

SEQ ID NO: 643302 - DNA, 13 bp, D. melanogaster
tatatacgtacgt

SEQ ID NO: 643303 - DNA, 13 bp, D. melanogaster
tatatacgtatat

SEQ ID NO: 643304 - DNA, 14 bp, D. melanogaster
tatatacgtatata

SEQ ID NO: 643305 - DNA, 14 bp, D. melanogaster
tatatacgtatatt

SEQ ID NO: 643306 - DNA, 16 bp, D. melanogaster
tatatacgtatgtata

SEQ ID NO: 643307 - DNA, 13 bp, D. melanogaster
tatatacgtctgc

SEQ ID NO: 643308 - DNA, 13 bp, D. melanogaster
tatatacgttttt

SEQ ID NO: 643309 - DNA, 14 bp, D. melanogaster
tatatactacatat

SEQ ID NO: 643310 - DNA, 14 bp, D. melanogaster
tatatactatatac

SEQ ID NO: 643311 - DNA, 13 bp, D. melanogaster
tatatactatgta

SEQ ID NO: 643312 - DNA, 14 bp, D. melanogaster
tatatactcgttta

SEQ ID NO: 643313 - DNA, 13 bp, D. melanogaster
tatatactctata

SEQ ID NO: 643314 - DNA, 13 bp, D. melanogaster
tatatactgaacg

SEQ ID NO: 643315 - DNA, 13 bp, D. melanogaster
tatatactgtata

SEQ ID NO: 643316 - DNA, 14 bp, D. melanogaster
tatatacttatatg

SEQ ID NO: 643317 - DNA, 13 bp, D. melanogaster
tatatacttatgt

SEQ ID NO: 643318 - DNA, 13 bp, D. melanogaster
tatatactttcaa

SEQ ID NO: 643319 - DNA, 13 bp, D. melanogaster
tatatactttgca

SEQ ID NO: 643320 - DNA, 13 bp, D. melanogaster
tatatactttgtt

SEQ ID NO: 643321 - DNA, 13 bp, D. melanogaster
tatatagaaaaca

SEQ ID NO: 643322 - DNA, 13 bp, D. melanogaster
tatatagaaaatg

SEQ ID NO: 643323 - DNA, 13 bp, D. melanogaster
tatatagaataca

SEQ ID NO: 643324 - DNA, 13 bp, D. melanogaster
tatatagagaaat

SEQ ID NO: 643325 - DNA, 13 bp, D. melanogaster
tatatagagtata

SEQ ID NO: 643326 - DNA, 13 bp, D. melanogaster
tatatagataaga

SEQ ID NO: 643327 - DNA, 13 bp, D. melanogaster
tatatagatacat

SEQ ID NO: 643328 - DNA, 13 bp, D. melanogaster
tatatagattttg

SEQ ID NO: 643329 - DNA, 13 bp, D. melanogaster
tatatagcaatat

SEQ ID NO: 643330 - DNA, 13 bp, D. melanogaster
tatataggaatat

SEQ ID NO: 643331 - DNA, 13 bp, D. melanogaster
tatataggatata

SEQ ID NO: 643332 - DNA, 14 bp, D. melanogaster
tatataggatatat

SEQ ID NO: 643333 - DNA, 14 bp, D. melanogaster
tatataggtatata

SEQ ID NO: 643334 - DNA, 13 bp, D. melanogaster
tatataggtttat

SEQ ID NO: 643335 - DNA, 14 bp, D. melanogaster
tatatagtacatat

SEQ ID NO: 643336 - DNA, 13 bp, D. melanogaster
tatatagtataca

SEQ ID NO: 643337 - DNA, 14 bp, D. melanogaster
tatatagtatagta

SEQ ID NO: 643338 - DNA, 14 bp, D. melanogaster
tatatagtcggaaa

SEQ ID NO: 643339 - DNA, 13 bp, D. melanogaster
tatatagtttcaa

SEQ ID NO: 643340 - DNA, 13 bp, D. melanogaster
tatatagtttcta

SEQ ID NO: 643341 - DNA, 13 bp, D. melanogaster
tatatataaaagc

SEQ ID NO: 643342 - DNA, 13 bp, D. melanogaster
tatatataaacgt

SEQ ID NO: 643343 - DNA, 13 bp, D. melanogaster
tatatataaagca

SEQ ID NO: 643344 - DNA, 13 bp, D. melanogaster
tatatataaatcg

SEQ ID NO: 643345 - DNA, 13 bp, D. melanogaster
tatatataaatgc

SEQ ID NO: 643346 - DNA, 13 bp, D. melanogaster
tatatatacaatc

SEQ ID NO: 643347 - DNA, 14 bp, D. melanogaster
tatatatacacaca

SEQ ID NO: 643348 - DNA, 13 bp, D. melanogaster
tatatatacacag

SEQ ID NO: 643349 - DNA, 14 bp, D. melanogaster
tatatatacacatt

SEQ ID NO: 643350 - DNA, 13 bp, D. melanogaster
tatatatacatac

SEQ ID NO: 643351 - DNA, 14 bp, D. melanogaster
tatatatacatacg

SEQ ID NO: 643352 - DNA, 14 bp, D. melanogaster
tatatatacatatg

SEQ ID NO: 643353 - DNA, 13 bp, D. melanogaster
tatatataccaaa

SEQ ID NO: 643354 - DNA, 13 bp, D. melanogaster
tatatataccaat

SEQ ID NO: 643355 - DNA, 13 bp, D. melanogaster
tatatataccata

SEQ ID NO: 643356 - DNA, 14 bp, D. melanogaster
tatatataccatat

SEQ ID NO: 643357 - DNA, 13 bp, D. melanogaster
tatatatacccat

SEQ ID NO: 643358 - DNA, 15 bp, D. melanogaster
tatatatacctatat

SEQ ID NO: 643359 - DNA, 13 bp, D. melanogaster
tatatatacgatt

SEQ ID NO: 643360 - DNA, 14 bp, D. melanogaster
tatatatacgtatg

SEQ ID NO: 643361 - DNA, 13 bp, D. melanogaster
tatatatacttca

SEQ ID NO: 643362 - DNA, 13 bp, D. melanogaster
tatatatacttgt

SEQ ID NO: 643363 - DNA, 14 bp, D. melanogaster
tatatatactttac

SEQ ID NO: 643364 - DNA, 13 bp, D. melanogaster
tatatatactttc

SEQ ID NO: 643365 - DNA, 13 bp, D. melanogaster
tatatatagacaa

SEQ ID NO: 643366 - DNA, 14 bp, D. melanogaster
tatatatagacata

SEQ ID NO: 643367 - DNA, 13 bp, D. melanogaster
tatatatagagaa

SEQ ID NO: 643368 - DNA, 13 bp, D. melanogaster
tatatatagagat

SEQ ID NO: 643369 - DNA, 14 bp, D. melanogaster
tatatatagataga

SEQ ID NO: 643370 - DNA, 14 bp, D. melanogaster
tatatatagatatc

SEQ ID NO: 643371 - DNA, 13 bp, D. melanogaster
tatatataggaat

SEQ ID NO: 643372 - DNA, 13 bp, D. melanogaster
tatatataggtat

SEQ ID NO: 643373 - DNA, 14 bp, D. melanogaster
tatatataggtata

SEQ ID NO: 643374 - DNA, 14 bp, D. melanogaster
tatatatagtatac

SEQ ID NO: 643375 - DNA, 14 bp, D. melanogaster
tatatatataaagg

SEQ ID NO: 643376 - DNA, 14 bp, D. melanogaster
tatatatatacatg

SEQ ID NO: 643377 - DNA, 13 bp, D. melanogaster
tatatatatacca

SEQ ID NO: 643378 - DNA, 14 bp, D. melanogaster
tatatatataccat

SEQ ID NO: 643379 - DNA, 13 bp, D. melanogaster
tatatatatacgc

SEQ ID NO: 643380 - DNA, 14 bp, D. melanogaster
tatatatatactca

SEQ ID NO: 643381 - DNA, 14 bp, D. melanogaster
tatatatatacttg

SEQ ID NO: 643382 - DNA, 13 bp, D. melanogaster
tatatatatagac

SEQ ID NO: 643383 - DNA, 14 bp, D. melanogaster
tatatatatagatg

SEQ ID NO: 643384 - DNA, 13 bp, D. melanogaster
tatatatatagcg

SEQ ID NO: 643385 - DNA, 13 bp, D. melanogaster
tatatatataggg

SEQ ID NO: 643386 - DNA, 13 bp, D. melanogaster
tatatatatagtg

SEQ ID NO: 643387 - DNA, 14 bp, D. melanogaster
tatatatatatacg

SEQ ID NO: 643388 - DNA, 14 bp, D. melanogaster
tatatatatatcca

SEQ ID NO: 643389 - DNA, 14 bp, D. melanogaster
tatatatatatctc

SEQ ID NO: 643390 - DNA, 14 bp, D. melanogaster
tatatatatatgag

SEQ ID NO: 643391 - DNA, 15 bp, D. melanogaster
tatatatatatgcta

SEQ ID NO: 643392 - DNA, 14 bp, D. melanogaster
tatatatatatggc

SEQ ID NO: 643393 - DNA, 14 bp, D. melanogaster
tatatatatatggg

SEQ ID NO: 643394 - DNA, 14 bp, D. melanogaster
tatatatatatgtc

SEQ ID NO: 643395 - DNA, 14 bp, D. melanogaster
tatatatatatgtg

SEQ ID NO: 643396 - DNA, 14 bp, D. melanogaster
tatatatatattcg

SEQ ID NO: 643397 - DNA, 14 bp, D. melanogaster
tatatatatattgc

SEQ ID NO: 643398 - DNA, 13 bp, D. melanogaster
tatatatatcaag

SEQ ID NO: 643399 - DNA, 13 bp, D. melanogaster
tatatatatcaca

SEQ ID NO: 643400 - DNA, 13 bp, D. melanogaster
tatatatatcagt

SEQ ID NO: 643401 - DNA, 13 bp, D. melanogaster
tatatatatccat

SEQ ID NO: 643402 - DNA, 13 bp, D. melanogaster
tatatatatcgaa

SEQ ID NO: 643403 - DNA, 13 bp, D. melanogaster
tatatatatcgat

SEQ ID NO: 643404 - DNA, 14 bp, D. melanogaster
tatatatatctaca

SEQ ID NO: 643405 - DNA, 14 bp, D. melanogaster
tatatatatctatc

SEQ ID NO: 643406 - DNA, 14 bp, D. melanogaster
tatatatatgaatg

SEQ ID NO: 643407 - DNA, 13 bp, D. melanogaster
tatatatatgact

SEQ ID NO: 643408 - DNA, 13 bp, D. melanogaster
tatatatatgcac

SEQ ID NO: 643409 - DNA, 14 bp, D. melanogaster
tatatatatgcatt

SEQ ID NO: 643410 - DNA, 14 bp, D. melanogaster
tatatatatgctat

SEQ ID NO: 643411 - DNA, 13 bp, D. melanogaster
tatatatatggag

SEQ ID NO: 643412 - DNA, 13 bp, D. melanogaster
tatatatatggca

SEQ ID NO: 643413 - DNA, 14 bp, D. melanogaster
tatatatatgtaga

SEQ ID NO: 643414 - DNA, 14 bp, D. melanogaster
tatatatatgtgca

SEQ ID NO: 643415 - DNA, 13 bp, D. melanogaster
tatatatattacg

SEQ ID NO: 643416 - DNA, 13 bp, D. melanogaster
tatatatattcct

SEQ ID NO: 643417 - DNA, 14 bp, D. melanogaster
tatatatattcgta

SEQ ID NO: 643418 - DNA, 14 bp, D. melanogaster
tatatatattgctt

SEQ ID NO: 643419 - DNA, 13 bp, D. melanogaster
tatatatatttcg

SEQ ID NO: 643420 - DNA, 14 bp, D. melanogaster
tatatatatttctg

SEQ ID NO: 643421 - DNA, 13 bp, D. melanogaster
tatatatatttgc

SEQ ID NO: 643422 - DNA, 13 bp, D. melanogaster
tatatatatttgg

SEQ ID NO: 643423 - DNA, 13 bp, D. melanogaster
tatatatcagttt

SEQ ID NO: 643424 - DNA, 13 bp, D. melanogaster
tatatatccacat

SEQ ID NO: 643425 - DNA, 13 bp, D. melanogaster
tatatatccatac

SEQ ID NO: 643426 - DNA, 13 bp, D. melanogaster
tatatatccatat

SEQ ID NO: 643427 - DNA, 14 bp, D. melanogaster
tatatatccatata

SEQ ID NO: 643428 - DNA, 13 bp, D. melanogaster
tatatatccattt

SEQ ID NO: 643429 - DNA, 14 bp, D. melanogaster
tatatatcctatat

SEQ ID NO: 643430 - DNA, 14 bp, D. melanogaster
tatatatcgtatat

SEQ ID NO: 643431 - DNA, 14 bp, D. melanogaster
tatatatctacata

SEQ ID NO: 643432 - DNA, 14 bp, D. melanogaster
tatatatctatatg

SEQ ID NO: 643433 - DNA, 13 bp, D. melanogaster
tatatatctatgt

SEQ ID NO: 643434 - DNA, 14 bp, D. melanogaster
tatatatgatatca

SEQ ID NO: 643435 - DNA, 13 bp, D. melanogaster
tatatatgattct

SEQ ID NO: 643436 - DNA, 13 bp, D. melanogaster
tatatatgcactt

SEQ ID NO: 643437 - DNA, 14 bp, D. melanogaster
tatatatgcatatg

SEQ ID NO: 643438 - DNA, 13 bp, D. melanogaster
tatatatgccaca

SEQ ID NO: 643439 - DNA, 13 bp, D. melanogaster
tatatatgcgata

SEQ ID NO: 643440 - DNA, 13 bp, D. melanogaster
tatatatgctttt

SEQ ID NO: 643441 - DNA, 13 bp, D. melanogaster
tatatatggatga

SEQ ID NO: 643442 - DNA, 13 bp, D. melanogaster
tatatatgtaagt

SEQ ID NO: 643443 - DNA, 14 bp, D. melanogaster
tatatatgtacaat

SEQ ID NO: 643444 - DNA, 16 bp, D. melanogaster
tatatatgtacatatt

SEQ ID NO: 643445 - DNA, 14 bp, D. melanogaster
tatatatgtactat

SEQ ID NO: 643446 - DNA, 13 bp, D. melanogaster
tatatatgtagct

SEQ ID NO: 643447 - DNA, 13 bp, D. melanogaster
tatatatgtatac

SEQ ID NO: 643448 - DNA, 14 bp, D. melanogaster
tatatatgtataca

SEQ ID NO: 643449 - DNA, 14 bp, D. melanogaster
tatatatgtataga

SEQ ID NO: 643450 - DNA, 13 bp, D. melanogaster
tatatatgtatca

SEQ ID NO: 643451 - DNA, 13 bp, D. melanogaster
tatatatgtatcc

SEQ ID NO: 643452 - DNA, 13 bp, D. melanogaster
tatatatgtatct

SEQ ID NO: 643453 - DNA, 14 bp, D. melanogaster
tatatatgtatgca

SEQ ID NO: 643454 - DNA, 15 bp, D. melanogaster
tatatatgtatgtgc

SEQ ID NO: 643455 - DNA, 13 bp, D. melanogaster
tatatatgtattg

SEQ ID NO: 643456 - DNA, 13 bp, D. melanogaster
tatatatgtctat

SEQ ID NO: 643457 - DNA, 13 bp, D. melanogaster
tatatatgtctgt

SEQ ID NO: 643458 - DNA, 13 bp, D. melanogaster
tatatatgtgtat

SEQ ID NO: 643459 - DNA, 14 bp, D. melanogaster
tatatatgtgtatg

SEQ ID NO: 643460 - DNA, 14 bp, D. melanogaster
tatatatgtgtgtt

SEQ ID NO: 643461 - DNA, 13 bp, D. melanogaster
tatatatgttctt

SEQ ID NO: 643462 - DNA, 13 bp, D. melanogaster
tatatatgtttac

SEQ ID NO: 643463 - DNA, 13 bp, D. melanogaster
tatatattcaaca

SEQ ID NO: 643464 - DNA, 13 bp, D. melanogaster
tatatattcatac

SEQ ID NO: 643465 - DNA, 13 bp, D. melanogaster
tatatattcatgt

SEQ ID NO: 643466 - DNA, 13 bp, D. melanogaster
tatatattcccat

SEQ ID NO: 643467 - DNA, 13 bp, D. melanogaster
tatatattcctat

SEQ ID NO: 643468 - DNA, 13 bp, D. melanogaster
tatatattcttgt

SEQ ID NO: 643469 - DNA, 13 bp, D. melanogaster
tatatattgcata

SEQ ID NO: 643470 - DNA, 13 bp, D. melanogaster
tatatattgctat

SEQ ID NO: 643471 - DNA, 14 bp, D. melanogaster
tatatattgtacat

SEQ ID NO: 643472 - DNA, 14 bp, D. melanogaster
tatatattgtagta

SEQ ID NO: 643473 - DNA, 13 bp, D. melanogaster
tatatatttagct

SEQ ID NO: 643474 - DNA, 13 bp, D. melanogaster
tatatatttatcc

SEQ ID NO: 643475 - DNA, 13 bp, D. melanogaster
tatatatttatgc

SEQ ID NO: 643476 - DNA, 13 bp, D. melanogaster
tatatatttatgg

SEQ ID NO: 643477 - DNA, 13 bp, D. melanogaster
tatatatttcaag

SEQ ID NO: 643478 - DNA, 13 bp, D. melanogaster
tatatatttcaca

SEQ ID NO: 643479 - DNA, 13 bp, D. melanogaster
tatatatttcagt

SEQ ID NO: 643480 - DNA, 13 bp, D. melanogaster
tatatatttccac

SEQ ID NO: 643481 - DNA, 13 bp, D. melanogaster
tatatatttccct

SEQ ID NO: 643482 - DNA, 13 bp, D. melanogaster
tatatatttcgat

SEQ ID NO: 643483 - DNA, 13 bp, D. melanogaster
tatatatttgagt

SEQ ID NO: 643484 - DNA, 13 bp, D. melanogaster
tatatatttgcat

SEQ ID NO: 643485 - DNA, 14 bp, D. melanogaster
tatatatttgcata

SEQ ID NO: 643486 - DNA, 13 bp, D. melanogaster
tatatattttccg

SEQ ID NO: 643487 - DNA, 13 bp, D. melanogaster
tatatattttcgt

SEQ ID NO: 643488 - DNA, 13 bp, D. melanogaster
tatatattttgga

SEQ ID NO: 643489 - DNA, 13 bp, D. melanogaster
tatatatttttgc

SEQ ID NO: 643490 - DNA, 14 bp, D. melanogaster
tatatatttttgct

SEQ ID NO: 643491 - DNA, 14 bp, D. melanogaster
tatatattttttgc

SEQ ID NO: 643492 - DNA, 13 bp, D. melanogaster
tatatcaaaaact

SEQ ID NO: 643493 - DNA, 13 bp, D. melanogaster
tatatcagattca

SEQ ID NO: 643494 - DNA, 13 bp, D. melanogaster
tatatcatatatc

SEQ ID NO: 643495 - DNA, 13 bp, D. melanogaster
tatatcatcatat

SEQ ID NO: 643496 - DNA, 13 bp, D. melanogaster
tatatcatttcat

SEQ ID NO: 643497 - DNA, 13 bp, D. melanogaster
tatatccaaagaa

SEQ ID NO: 643498 - DNA, 13 bp, D. melanogaster
tatatccatatat

SEQ ID NO: 643499 - DNA, 14 bp, D. melanogaster
tatatccatatata

SEQ ID NO: 643500 - DNA, 13 bp, D. melanogaster
tatatccatcaat

SEQ ID NO: 643501 - DNA, 13 bp, D. melanogaster
tatatccatttaa

SEQ ID NO: 643502 - DNA, 13 bp, D. melanogaster
tatatccgcttcc

SEQ ID NO: 643503 - DNA, 13 bp, D. melanogaster
tatatccgtatat

SEQ ID NO: 643504 - DNA, 13 bp, D. melanogaster
tatatccttatat

SEQ ID NO: 643505 - DNA, 13 bp, D. melanogaster
tatatccttgaaa

SEQ ID NO: 643506 - DNA, 13 bp, D. melanogaster
tatatcgagggta

SEQ ID NO: 643507 - DNA, 13 bp, D. melanogaster
tatatcgatattt

SEQ ID NO: 643508 - DNA, 13 bp, D. melanogaster
tatatcgatgcta

SEQ ID NO: 643509 - DNA, 13 bp, D. melanogaster
tatatcgcatata

SEQ ID NO: 643510 - DNA, 13 bp, D. melanogaster
tatatctacaata

SEQ ID NO: 643511 - DNA, 13 bp, D. melanogaster
tatatctactata

SEQ ID NO: 643512 - DNA, 14 bp, D. melanogaster
tatatctactatat

SEQ ID NO: 643513 - DNA, 13 bp, D. melanogaster
tatatctataact

SEQ ID NO: 643514 - DNA, 13 bp, D. melanogaster
tatatctatacat

SEQ ID NO: 643515 - DNA, 14 bp, D. melanogaster
tatatctatacata

SEQ ID NO: 643516 - DNA, 14 bp, D. melanogaster
tatatctatatcta

SEQ ID NO: 643517 - DNA, 13 bp, D. melanogaster
tatatctatcatt

SEQ ID NO: 643518 - DNA, 14 bp, D. melanogaster
tatatctatgtatt

SEQ ID NO: 643519 - DNA, 13 bp, D. melanogaster
tatatctctatat

SEQ ID NO: 643520 - DNA, 14 bp, D. melanogaster
tatatctgttgaca

SEQ ID NO: 643521 - DNA, 13 bp, D. melanogaster
tatatctttgtat

SEQ ID NO: 643522 - DNA, 13 bp, D. melanogaster
tatatgaaaatgt

SEQ ID NO: 643523 - DNA, 13 bp, D. melanogaster
tatatgaaacata

SEQ ID NO: 643524 - DNA, 13 bp, D. melanogaster
tatatgaagaaat

SEQ ID NO: 643525 - DNA, 13 bp, D. melanogaster
tatatgaagtaaa

SEQ ID NO: 643526 - DNA, 14 bp, D. melanogaster
tatatgaatatatg

SEQ ID NO: 643527 - DNA, 13 bp, D. melanogaster
tatatgacaaatt

SEQ ID NO: 643528 - DNA, 13 bp, D. melanogaster
tatatgacaattt

SEQ ID NO: 643529 - DNA, 13 bp, D. melanogaster
tatatgagcgaac

SEQ ID NO: 643530 - DNA, 13 bp, D. melanogaster
tatatgatatgaa

SEQ ID NO: 643531 - DNA, 13 bp, D. melanogaster
tatatgatgatgg

SEQ ID NO: 643532 - DNA, 13 bp, D. melanogaster
tatatgattctta

SEQ ID NO: 643533 - DNA, 13 bp, D. melanogaster
tatatgatttcaa

SEQ ID NO: 643534 - DNA, 14 bp, D. melanogaster
tatatgatttttca

SEQ ID NO: 643535 - DNA, 13 bp, D. melanogaster
tatatgcaaaaat

SEQ ID NO: 643536 - DNA, 14 bp, D. melanogaster
tatatgcatataaa

SEQ ID NO: 643537 - DNA, 13 bp, D. melanogaster
tatatgcatatat

SEQ ID NO: 643538 - DNA, 15 bp, D. melanogaster
tatatgcatatatat

SEQ ID NO: 643539 - DNA, 14 bp, D. melanogaster
tatatgcatatatg

SEQ ID NO: 643540 - DNA, 13 bp, D. melanogaster
tatatgcatggca

SEQ ID NO: 643541 - DNA, 13 bp, D. melanogaster
tatatgcatgtat

SEQ ID NO: 643542 - DNA, 13 bp, D. melanogaster
tatatgcattaca

SEQ ID NO: 643543 - DNA, 13 bp, D. melanogaster
tatatgcatttaa

SEQ ID NO: 643544 - DNA, 13 bp, D. melanogaster
tatatgcatttat

SEQ ID NO: 643545 - DNA, 13 bp, D. melanogaster
tatatgccataag

SEQ ID NO: 643546 - DNA, 13 bp, D. melanogaster
tatatgccatata

SEQ ID NO: 643547 - DNA, 13 bp, D. melanogaster
tatatgcgcataa

SEQ ID NO: 643548 - DNA, 13 bp, D. melanogaster
tatatgcgtatat

SEQ ID NO: 643549 - DNA, 13 bp, D. melanogaster
tatatgctaattt

SEQ ID NO: 643550 - DNA, 13 bp, D. melanogaster
tatatgctatata

SEQ ID NO: 643551 - DNA, 13 bp, D. melanogaster
tatatgctatatg

SEQ ID NO: 643552 - DNA, 14 bp, D. melanogaster
tatatggaatatat

SEQ ID NO: 643553 - DNA, 14 bp, D. melanogaster
tatatggatatata

SEQ ID NO: 643554 - DNA, 13 bp, D. melanogaster
tatatggatattt

SEQ ID NO: 643555 - DNA, 13 bp, D. melanogaster
tatatggatgact

SEQ ID NO: 643556 - DNA, 13 bp, D. melanogaster
tatatggccaaaa

SEQ ID NO: 643557 - DNA, 13 bp, D. melanogaster
tatatggccaaac

SEQ ID NO: 643558 - DNA, 13 bp, D. melanogaster
tatatgggatata

SEQ ID NO: 643559 - DNA, 14 bp, D. melanogaster
tatatgggatatat

SEQ ID NO: 643560 - DNA, 13 bp, D. melanogaster
tatatggtatatg

SEQ ID NO: 643561 - DNA, 13 bp, D. melanogaster
tatatggtgtatg

SEQ ID NO: 643562 - DNA, 13 bp, D. melanogaster
tatatggtttata

SEQ ID NO: 643563 - DNA, 13 bp, D. melanogaster
tatatgtaaacat

SEQ ID NO: 643564 - DNA, 14 bp, D. melanogaster
tatatgtaaataca

SEQ ID NO: 643565 - DNA, 13 bp, D. melanogaster
tatatgtacaaac

SEQ ID NO: 643566 - DNA, 13 bp, D. melanogaster
tatatgtacacaa

SEQ ID NO: 643567 - DNA, 13 bp, D. melanogaster
tatatgtacacat

SEQ ID NO: 643568 - DNA, 14 bp, D. melanogaster
tatatgtacataga

SEQ ID NO: 643569 - DNA, 16 bp, D. melanogaster
tatatgtacatatatg

SEQ ID NO: 643570 - DNA, 14 bp, D. melanogaster
tatatgtacatatg

SEQ ID NO: 643571 - DNA, 14 bp, D. melanogaster
tatatgtacatatt

SEQ ID NO: 643572 - DNA, 14 bp, D. melanogaster
tatatgtacattta

SEQ ID NO: 643573 - DNA, 13 bp, D. melanogaster
tatatgtacgaat

SEQ ID NO: 643574 - DNA, 14 bp, D. melanogaster
tatatgtacgagta

SEQ ID NO: 643575 - DNA, 13 bp, D. melanogaster
tatatgtacgtac

SEQ ID NO: 643576 - DNA, 13 bp, D. melanogaster
tatatgtacgtat

SEQ ID NO: 643577 - DNA, 14 bp, D. melanogaster
tatatgtacgtatt

SEQ ID NO: 643578 - DNA, 13 bp, D. melanogaster
tatatgtactatg

SEQ ID NO: 643579 - DNA, 13 bp, D. melanogaster
tatatgtacttac

SEQ ID NO: 643580 - DNA, 13 bp, D. melanogaster
tatatgtacttat

SEQ ID NO: 643581 - DNA, 13 bp, D. melanogaster
tatatgtacttgt

SEQ ID NO: 643582 - DNA, 13 bp, D. melanogaster
tatatgtagaaat

SEQ ID NO: 643583 - DNA, 13 bp, D. melanogaster
tatatgtagatat

SEQ ID NO: 643584 - DNA, 14 bp, D. melanogaster
tatatgtagatata

SEQ ID NO: 643585 - DNA, 14 bp, D. melanogaster
tatatgtagatgat

SEQ ID NO: 643586 - DNA, 13 bp, D. melanogaster
tatatgtaggtat

SEQ ID NO: 643587 - DNA, 14 bp, D. melanogaster
tatatgtagtatat

SEQ ID NO: 643588 - DNA, 13 bp, D. melanogaster
tatatgtataatg

SEQ ID NO: 643589 - DNA, 13 bp, D. melanogaster
tatatgtatagaa

SEQ ID NO: 643590 - DNA, 13 bp, D. melanogaster
tatatgtatatac

SEQ ID NO: 643591 - DNA, 14 bp, D. melanogaster
tatatgtatatagc

SEQ ID NO: 643592 - DNA, 14 bp, D. melanogaster
tatatgtatatatg

SEQ ID NO: 643593 - DNA, 14 bp, D. melanogaster
tatatgtatatcat

SEQ ID NO: 643594 - DNA, 14 bp, D. melanogaster
tatatgtatatctg

SEQ ID NO: 643595 - DNA, 13 bp, D. melanogaster
tatatgtatatgg

SEQ ID NO: 643596 - DNA, 14 bp, D. melanogaster
tatatgtatatgga

SEQ ID NO: 643597 - DNA, 14 bp, D. melanogaster
tatatgtatatgtg

SEQ ID NO: 643598 - DNA, 14 bp, D. melanogaster
tatatgtatatgtt

SEQ ID NO: 643599 - DNA, 13 bp, D. melanogaster
tatatgtatattc

SEQ ID NO: 643600 - DNA, 13 bp, D. melanogaster
tatatgtatctat

SEQ ID NO: 643601 - DNA, 13 bp, D. melanogaster
tatatgtatctga

SEQ ID NO: 643602 - DNA, 13 bp, D. melanogaster
tatatgtatgcat

SEQ ID NO: 643603 - DNA, 13 bp, D. melanogaster
tatatgtatgcct

SEQ ID NO: 643604 - DNA, 13 bp, D. melanogaster
tatatgtatggat

SEQ ID NO: 643605 - DNA, 13 bp, D. melanogaster
tatatgtatggtc

SEQ ID NO: 643606 - DNA, 14 bp, D. melanogaster
tatatgtatggtcg

SEQ ID NO: 643607 - DNA, 13 bp, D. melanogaster
tatatgtatgtaa

SEQ ID NO: 643608 - DNA, 14 bp, D. melanogaster
tatatgtatgtaag

SEQ ID NO: 643609 - DNA, 15 bp, D. melanogaster
tatatgtatgtacat

SEQ ID NO: 643610 - DNA, 13 bp, D. melanogaster
tatatgtatgtag

SEQ ID NO: 643611 - DNA, 14 bp, D. melanogaster
tatatgtatgtagt

SEQ ID NO: 643612 - DNA, 14 bp, D. melanogaster
tatatgtatgtata

SEQ ID NO: 643613 - DNA, 14 bp, D. melanogaster
tatatgtatgtgtt

SEQ ID NO: 643614 - DNA, 13 bp, D. melanogaster
tatatgtattcaa

SEQ ID NO: 643615 - DNA, 13 bp, D. melanogaster
tatatgtatttct

SEQ ID NO: 643616 - DNA, 14 bp, D. melanogaster
tatatgtcgcagat

SEQ ID NO: 643617 - DNA, 13 bp, D. melanogaster
tatatgtgaatat

SEQ ID NO: 643618 - DNA, 13 bp, D. melanogaster
tatatgtgatata

SEQ ID NO: 643619 - DNA, 13 bp, D. melanogaster
tatatgtgcatac

SEQ ID NO: 643620 - DNA, 13 bp, D. melanogaster
tatatgtgcatat

SEQ ID NO: 643621 - DNA, 13 bp, D. melanogaster
tatatgtggtctt

SEQ ID NO: 643622 - DNA, 13 bp, D. melanogaster
tatatgtgtaaat

SEQ ID NO: 643623 - DNA, 14 bp, D. melanogaster
tatatgtgtataaa

SEQ ID NO: 643624 - DNA, 13 bp, D. melanogaster
tatatgtgtatat

SEQ ID NO: 643625 - DNA, 14 bp, D. melanogaster
tatatgtgtatata

SEQ ID NO: 643626 - DNA, 13 bp, D. melanogaster
tatatgtgtgtat

SEQ ID NO: 643627 - DNA, 13 bp, D. melanogaster
tatatgttatatg

SEQ ID NO: 643628 - DNA, 13 bp, D. melanogaster
tatatgttcatat

SEQ ID NO: 643629 - DNA, 13 bp, D. melanogaster
tatatgtttatac

SEQ ID NO: 643630 - DNA, 13 bp, D. melanogaster
tatatgtttatct

SEQ ID NO: 643631 - DNA, 13 bp, D. melanogaster
tatatgtttttgc

SEQ ID NO: 643632 - DNA, 13 bp, D. melanogaster
tatattaagtggt

SEQ ID NO: 643633 - DNA, 13 bp, D. melanogaster
tatattacgtata

SEQ ID NO: 643634 - DNA, 14 bp, D. melanogaster
tatattagttgcat

SEQ ID NO: 643635 - DNA, 13 bp, D. melanogaster
tatattattatgc

SEQ ID NO: 643636 - DNA, 14 bp, D. melanogaster
tatattattcaaac

SEQ ID NO: 643637 - DNA, 13 bp, D. melanogaster
tatattatttgct

SEQ ID NO: 643638 - DNA, 13 bp, D. melanogaster
tatattcaagttg

SEQ ID NO: 643639 - DNA, 13 bp, D. melanogaster
tatattcaattga

SEQ ID NO: 643640 - DNA, 13 bp, D. melanogaster
tatattcataatg

SEQ ID NO: 643641 - DNA, 13 bp, D. melanogaster
tatattcatattc

SEQ ID NO: 643642 - DNA, 13 bp, D. melanogaster
tatattccaaatt

SEQ ID NO: 643643 - DNA, 13 bp, D. melanogaster
tatattccatata

SEQ ID NO: 643644 - DNA, 14 bp, D. melanogaster
tatattccatatat

SEQ ID NO: 643645 - DNA, 13 bp, D. melanogaster
tatattccattat

SEQ ID NO: 643646 - DNA, 13 bp, D. melanogaster
tatattcgaaaat

SEQ ID NO: 643647 - DNA, 13 bp, D. melanogaster
tatattcgctgca

SEQ ID NO: 643648 - DNA, 13 bp, D. melanogaster
tatattcgtatat

SEQ ID NO: 643649 - DNA, 13 bp, D. melanogaster
tatattcttaatc

SEQ ID NO: 643650 - DNA, 13 bp, D. melanogaster
tatattcttgata

SEQ ID NO: 643651 - DNA, 13 bp, D. melanogaster
tatattcttgatc

SEQ ID NO: 643652 - DNA, 14 bp, D. melanogaster
tatattcttgatca

SEQ ID NO: 643653 - DNA, 13 bp, D. melanogaster
tatattgaaacca

SEQ ID NO: 643654 - DNA, 13 bp, D. melanogaster
tatattgatttca

SEQ ID NO: 643655 - DNA, 13 bp, D. melanogaster
tatattgattttc

SEQ ID NO: 643656 - DNA, 13 bp, D. melanogaster
tatattgcaaaaa

SEQ ID NO: 643657 - DNA, 14 bp, D. melanogaster
tatattgcatatat

SEQ ID NO: 643658 - DNA, 13 bp, D. melanogaster
tatattgcatttt

SEQ ID NO: 643659 - DNA, 13 bp, D. melanogaster
tatattgccattt

SEQ ID NO: 643660 - DNA, 13 bp, D. melanogaster
tatattgggtgca

SEQ ID NO: 643661 - DNA, 13 bp, D. melanogaster
tatattgtacata

SEQ ID NO: 643662 - DNA, 13 bp, D. melanogaster
tatattgtatatc

SEQ ID NO: 643663 - DNA, 14 bp, D. melanogaster
tatattgtatgtat

SEQ ID NO: 643664 - DNA, 13 bp, D. melanogaster
tatattgtatttc

SEQ ID NO: 643665 - DNA, 13 bp, D. melanogaster
tatattgtcaaaa

SEQ ID NO: 643666 - DNA, 13 bp, D. melanogaster
tatattgtcaagt

SEQ ID NO: 643667 - DNA, 13 bp, D. melanogaster
tatattgtggtat

SEQ ID NO: 643668 - DNA, 13 bp, D. melanogaster
tatatttaaactg

SEQ ID NO: 643669 - DNA, 13 bp, D. melanogaster
tatatttaaatgc

SEQ ID NO: 643670 - DNA, 14 bp, D. melanogaster
tatatttaaatgca

SEQ ID NO: 643671 - DNA, 13 bp, D. melanogaster
tatatttaaatgg

SEQ ID NO: 643672 - DNA, 13 bp, D. melanogaster
tatatttaacaga

SEQ ID NO: 643673 - DNA, 13 bp, D. melanogaster
tatatttaagtac

SEQ ID NO: 643674 - DNA, 13 bp, D. melanogaster
tatatttatgcac

SEQ ID NO: 643675 - DNA, 13 bp, D. melanogaster
tatatttatgtgg

SEQ ID NO: 643676 - DNA, 13 bp, D. melanogaster
tatatttattgtc

SEQ ID NO: 643677 - DNA, 13 bp, D. melanogaster
tatatttatttcg

SEQ ID NO: 643678 - DNA, 14 bp, D. melanogaster
tatatttattttcg

SEQ ID NO: 643679 - DNA, 13 bp, D. melanogaster
tatatttcacaat

SEQ ID NO: 643680 - DNA, 13 bp, D. melanogaster
tatatttcatatg

SEQ ID NO: 643681 - DNA, 13 bp, D. melanogaster
tatatttccaaca

SEQ ID NO: 643682 - DNA, 13 bp, D. melanogaster
tatatttccagtt

SEQ ID NO: 643683 - DNA, 13 bp, D. melanogaster
tatatttcgggtg

SEQ ID NO: 643684 - DNA, 13 bp, D. melanogaster
tatatttctatac

SEQ ID NO: 643685 - DNA, 13 bp, D. melanogaster
tatatttctgtat

SEQ ID NO: 643686 - DNA, 13 bp, D. melanogaster
tatatttgaaaag

SEQ ID NO: 643687 - DNA, 13 bp, D. melanogaster
tatatttgaatct

SEQ ID NO: 643688 - DNA, 13 bp, D. melanogaster
tatatttgacttt

SEQ ID NO: 643689 - DNA, 13 bp, D. melanogaster
tatatttgcatta

SEQ ID NO: 643690 - DNA, 13 bp, D. melanogaster
tatatttgcgttt

SEQ ID NO: 643691 - DNA, 13 bp, D. melanogaster
tatatttggaaaa

SEQ ID NO: 643692 - DNA, 13 bp, D. melanogaster
tatatttggactt

SEQ ID NO: 643693 - DNA, 13 bp, D. melanogaster
tatatttgtacat

SEQ ID NO: 643694 - DNA, 13 bp, D. melanogaster
tatatttgttcat

SEQ ID NO: 643695 - DNA, 13 bp, D. melanogaster
tatatttgtttac

SEQ ID NO: 643696 - DNA, 14 bp, D. melanogaster
tatattttcaaaag

SEQ ID NO: 643697 - DNA, 13 bp, D. melanogaster
tatattttcaaac

SEQ ID NO: 643698 - DNA, 13 bp, D. melanogaster
tatattttcagca

SEQ ID NO: 643699 - DNA, 13 bp, D. melanogaster
tatattttcagct

SEQ ID NO: 643700 - DNA, 13 bp, D. melanogaster
tatattttccaaa

SEQ ID NO: 643701 - DNA, 14 bp, D. melanogaster
tatattttccaaaa

SEQ ID NO: 643702 - DNA, 13 bp, D. melanogaster
tatattttcgaaa

SEQ ID NO: 643703 - DNA, 13 bp, D. melanogaster
tatattttgaagt

SEQ ID NO: 643704 - DNA, 13 bp, D. melanogaster
tatattttgcaat

SEQ ID NO: 643705 - DNA, 13 bp, D. melanogaster
tatattttgcatt

SEQ ID NO: 643706 - DNA, 13 bp, D. melanogaster
tatattttgctat

SEQ ID NO: 643707 - DNA, 13 bp, D. melanogaster
tatattttggaaa

SEQ ID NO: 643708 - DNA, 14 bp, D. melanogaster
tatattttggaaaa

SEQ ID NO: 643709 - DNA, 13 bp, D. melanogaster
tatatttttaagg

SEQ ID NO: 643710 - DNA, 13 bp, D. melanogaster
tatatttttagca

SEQ ID NO: 643711 - DNA, 13 bp, D. melanogaster
tatatttttccca

SEQ ID NO: 643712 - DNA, 14 bp, D. melanogaster
tatatttttcccaa

SEQ ID NO: 643713 - DNA, 13 bp, D. melanogaster
tatatttttgcaa

SEQ ID NO: 643714 - DNA, 14 bp, D. melanogaster
tatatttttggaaa

SEQ ID NO: 643715 - DNA, 13 bp, D. melanogaster
tatatttttggga

SEQ ID NO: 643716 - DNA, 13 bp, D. melanogaster
tatatttttgggc

SEQ ID NO: 643717 - DNA, 13 bp, D. melanogaster
tatattttttcga

SEQ ID NO: 643718 - DNA, 13 bp, D. melanogaster
tatattttttgca

SEQ ID NO: 643719 - DNA, 13 bp, D. melanogaster
tatcaaaaaatgt

SEQ ID NO: 643720 - DNA, 13 bp, D. melanogaster
tatcaaaaacatt

SEQ ID NO: 643721 - DNA, 13 bp, D. melanogaster
tatcaaaaactat

SEQ ID NO: 643722 - DNA, 13 bp, D. melanogaster
tatcaaaaactta

SEQ ID NO: 643723 - DNA, 13 bp, D. melanogaster
tatcaaaaattca

SEQ ID NO: 643724 - DNA, 13 bp, D. melanogaster
tatcaaaacaatt

SEQ ID NO: 643725 - DNA, 13 bp, D. melanogaster
tatcaaaacattt

SEQ ID NO: 643726 - DNA, 13 bp, D. melanogaster
tatcaaaagcatc

SEQ ID NO: 643727 - DNA, 13 bp, D. melanogaster
tatcaaaagtatg

SEQ ID NO: 643728 - DNA, 13 bp, D. melanogaster
tatcaaaagtgtg

SEQ ID NO: 643729 - DNA, 13 bp, D. melanogaster
tatcaaaagtttt

SEQ ID NO: 643730 - DNA, 13 bp, D. melanogaster
tatcaaaatcaac

SEQ ID NO: 643731 - DNA, 13 bp, D. melanogaster
tatcaaaatcata

SEQ ID NO: 643732 - DNA, 14 bp, D. melanogaster
tatcaaaatcatag

SEQ ID NO: 643733 - DNA, 13 bp, D. melanogaster
tatcaaaatcgaa

SEQ ID NO: 643734 - DNA, 13 bp, D. melanogaster
tatcaaaatggga

SEQ ID NO: 643735 - DNA, 13 bp, D. melanogaster
tatcaaaattcaa

SEQ ID NO: 643736 - DNA, 13 bp, D. melanogaster
tatcaaaatttgt

SEQ ID NO: 643737 - DNA, 13 bp, D. melanogaster
tatcaaacaattg

SEQ ID NO: 643738 - DNA, 13 bp, D. melanogaster
tatcaaacaattt

SEQ ID NO: 643739 - DNA, 13 bp, D. melanogaster
tatcaaagaggta

SEQ ID NO: 643740 - DNA, 13 bp, D. melanogaster
tatcaaagcaact

SEQ ID NO: 643741 - DNA, 13 bp, D. melanogaster
tatcaaataaatc

SEQ ID NO: 643742 - DNA, 13 bp, D. melanogaster
tatcaaatcgaat

SEQ ID NO: 643743 - DNA, 15 bp, D. melanogaster
tatcaaatgctgttg

SEQ ID NO: 643744 - DNA, 13 bp, D. melanogaster
tatcaaattgttt

SEQ ID NO: 643745 - DNA, 13 bp, D. melanogaster
tatcaaatttcca

SEQ ID NO: 643746 - DNA, 13 bp, D. melanogaster
tatcaacaacaac

SEQ ID NO: 643747 - DNA, 13 bp, D. melanogaster
tatcaacaattta

SEQ ID NO: 643748 - DNA, 13 bp, D. melanogaster
tatcaacacattt

SEQ ID NO: 643749 - DNA, 14 bp, D. melanogaster
tatcaacacatttt

SEQ ID NO: 643750 - DNA, 13 bp, D. melanogaster
tatcaacagcaat

SEQ ID NO: 643751 - DNA, 13 bp, D. melanogaster
tatcaacatattt

SEQ ID NO: 643752 - DNA, 13 bp, D. melanogaster
tatcaacattcag

SEQ ID NO: 643753 - DNA, 13 bp, D. melanogaster
tatcaacatttat

SEQ ID NO: 643754 - DNA, 13 bp, D. melanogaster
tatcaacattttg

SEQ ID NO: 643755 - DNA, 13 bp, D. melanogaster
tatcaacgaaatc

SEQ ID NO: 643756 - DNA, 14 bp, D. melanogaster
tatcaacgctagca

SEQ ID NO: 643757 - DNA, 13 bp, D. melanogaster
tatcaactattat

SEQ ID NO: 643758 - DNA, 13 bp, D. melanogaster
tatcaactttttg

SEQ ID NO: 643759 - DNA, 14 bp, D. melanogaster
tatcaagaagatct

SEQ ID NO: 643760 - DNA, 14 bp, D. melanogaster
tatcaagaatatat

SEQ ID NO: 643761 - DNA, 14 bp, D. melanogaster
tatcaaggtgaggt

SEQ ID NO: 643762 - DNA, 13 bp, D. melanogaster
tatcaataaaaag

SEQ ID NO: 643763 - DNA, 13 bp, D. melanogaster
tatcaataacaat

SEQ ID NO: 643764 - DNA, 14 bp, D. melanogaster
tatcaatatgttta

SEQ ID NO: 643765 - DNA, 13 bp, D. melanogaster
tatcaatcaatat

SEQ ID NO: 643766 - DNA, 13 bp, D. melanogaster
tatcaatcatttt

SEQ ID NO: 643767 - DNA, 13 bp, D. melanogaster
tatcaatccagtt

SEQ ID NO: 643768 - DNA, 13 bp, D. melanogaster
tatcaatgatttt

SEQ ID NO: 643769 - DNA, 13 bp, D. melanogaster
tatcaatggagca

SEQ ID NO: 643770 - DNA, 13 bp, D. melanogaster
tatcaattaattg

SEQ ID NO: 643771 - DNA, 13 bp, D. melanogaster
tatcaattatcaa

SEQ ID NO: 643772 - DNA, 13 bp, D. melanogaster
tatcaattccaat

SEQ ID NO: 643773 - DNA, 14 bp, D. melanogaster
tatcaattcctcaa

SEQ ID NO: 643774 - DNA, 13 bp, D. melanogaster
tatcaatttcaat

SEQ ID NO: 643775 - DNA, 13 bp, D. melanogaster
tatcaatttcact

SEQ ID NO: 643776 - DNA, 13 bp, D. melanogaster
tatcaatttcatt

SEQ ID NO: 643777 - DNA, 13 bp, D. melanogaster
tatcaatttcgat

SEQ ID NO: 643778 - DNA, 13 bp, D. melanogaster
tatcaatttgaaa

SEQ ID NO: 643779 - DNA, 13 bp, D. melanogaster
tatcacaaactat

SEQ ID NO: 643780 - DNA, 13 bp, D. melanogaster
tatcaccattaag

SEQ ID NO: 643781 - DNA, 14 bp, D. melanogaster
tatcacgcatacgc

SEQ ID NO: 643782 - DNA, 14 bp, D. melanogaster
tatcactaaatgaa

SEQ ID NO: 643783 - DNA, 13 bp, D. melanogaster
tatcactctgggc

SEQ ID NO: 643784 - DNA, 13 bp, D. melanogaster
tatcacttttatc

SEQ ID NO: 643785 - DNA, 14 bp, D. melanogaster
tatcagaaacgcac

SEQ ID NO: 643786 - DNA, 13 bp, D. melanogaster
tatcagaattcgg

SEQ ID NO: 643787 - DNA, 13 bp, D. melanogaster
tatcagaatttta

SEQ ID NO: 643788 - DNA, 13 bp, D. melanogaster
tatcagcaagttt

SEQ ID NO: 643789 - DNA, 13 bp, D. melanogaster
tatcagctcatcc

SEQ ID NO: 643790 - DNA, 13 bp, D. melanogaster
tatcagtatcagt

SEQ ID NO: 643791 - DNA, 14 bp, D. melanogaster
tatcataaataatg

SEQ ID NO: 643792 - DNA, 13 bp, D. melanogaster
tatcatacataca

SEQ ID NO: 643793 - DNA, 13 bp, D. melanogaster
tatcatatatcat

SEQ ID NO: 643794 - DNA, 13 bp, D. melanogaster
tatcatatcatat

SEQ ID NO: 643795 - DNA, 14 bp, D. melanogaster
tatcatatcatata

SEQ ID NO: 643796 - DNA, 13 bp, D. melanogaster
tatcatattgcta

SEQ ID NO: 643797 - DNA, 13 bp, D. melanogaster
tatcatcaaaaga

SEQ ID NO: 643798 - DNA, 13 bp, D. melanogaster
tatcatcaaactt

SEQ ID NO: 643799 - DNA, 14 bp, D. melanogaster
tatcatcatatcat

SEQ ID NO: 643800 - DNA, 13 bp, D. melanogaster
tatcatcatcatc

SEQ ID NO: 643801 - DNA, 13 bp, D. melanogaster
tatcatcattatt

SEQ ID NO: 643802 - DNA, 13 bp, D. melanogaster
tatcatcgtcttc

SEQ ID NO: 643803 - DNA, 13 bp, D. melanogaster
tatcatcttcatc

SEQ ID NO: 643804 - DNA, 13 bp, D. melanogaster
tatcattagaaaa

SEQ ID NO: 643805 - DNA, 14 bp, D. melanogaster
tatcattagtatta

SEQ ID NO: 643806 - DNA, 13 bp, D. melanogaster
tatcattatcaaa

SEQ ID NO: 643807 - DNA, 14 bp, D. melanogaster
tatcattatcatta

SEQ ID NO: 643808 - DNA, 13 bp, D. melanogaster
tatcattgttgtt

SEQ ID NO: 643809 - DNA, 14 bp, D. melanogaster
tatcatttaaacca

SEQ ID NO: 643810 - DNA, 13 bp, D. melanogaster
tatcatttacaaa

SEQ ID NO: 643811 - DNA, 13 bp, D. melanogaster
tatcatttatcaa

SEQ ID NO: 643812 - DNA, 13 bp, D. melanogaster
tatcattttccaa

SEQ ID NO: 643813 - DNA, 14 bp, D. melanogaster
tatcattttgccag

SEQ ID NO: 643814 - DNA, 13 bp, D. melanogaster
tatcatttttgta

SEQ ID NO: 643815 - DNA, 13 bp, D. melanogaster
tatccaaaatata

SEQ ID NO: 643816 - DNA, 13 bp, D. melanogaster
tatccaaaatgta

SEQ ID NO: 643817 - DNA, 13 bp, D. melanogaster
tatccaaacacac

SEQ ID NO: 643818 - DNA, 13 bp, D. melanogaster
tatccaaacattt

SEQ ID NO: 643819 - DNA, 13 bp, D. melanogaster
tatccaaagaaat

SEQ ID NO: 643820 - DNA, 13 bp, D. melanogaster
tatccaaagtttt

SEQ ID NO: 643821 - DNA, 13 bp, D. melanogaster
tatccaacaattt

SEQ ID NO: 643822 - DNA, 14 bp, D. melanogaster
tatccaacaatttt

SEQ ID NO: 643823 - DNA, 13 bp, D. melanogaster
tatccacaacttt

SEQ ID NO: 643824 - DNA, 13 bp, D. melanogaster
tatccacatccac

SEQ ID NO: 643825 - DNA, 14 bp, D. melanogaster
tatccacatccaca

SEQ ID NO: 643826 - DNA, 13 bp, D. melanogaster
tatccacatttgc

SEQ ID NO: 643827 - DNA, 14 bp, D. melanogaster
tatccacatttgcc

SEQ ID NO: 643828 - DNA, 13 bp, D. melanogaster
tatccactatcca

SEQ ID NO: 643829 - DNA, 13 bp, D. melanogaster
tatccagtatcca

SEQ ID NO: 643830 - DNA, 13 bp, D. melanogaster
tatccataaatat

SEQ ID NO: 643831 - DNA, 13 bp, D. melanogaster
tatccatacccat

SEQ ID NO: 643832 - DNA, 13 bp, D. melanogaster
tatccatatatac

SEQ ID NO: 643833 - DNA, 13 bp, D. melanogaster
tatccatccatat

SEQ ID NO: 643834 - DNA, 13 bp, D. melanogaster
tatccatgtccat

SEQ ID NO: 643835 - DNA, 14 bp, D. melanogaster
tatccatgtccatt

SEQ ID NO: 643836 - DNA, 13 bp, D. melanogaster
tatccattatata

SEQ ID NO: 643837 - DNA, 13 bp, D. melanogaster
tatccattgctct

SEQ ID NO: 643838 - DNA, 13 bp, D. melanogaster
tatccatttatat

SEQ ID NO: 643839 - DNA, 13 bp, D. melanogaster
tatccatttcaaa

SEQ ID NO: 643840 - DNA, 13 bp, D. melanogaster
tatcccaagcatt

SEQ ID NO: 643841 - DNA, 13 bp, D. melanogaster
tatcccagaaaaa

SEQ ID NO: 643842 - DNA, 14 bp, D. melanogaster
tatcccagaaaaat

SEQ ID NO: 643843 - DNA, 13 bp, D. melanogaster
tatcccgtaaacc

SEQ ID NO: 643844 - DNA, 13 bp, D. melanogaster
tatcccttttggc

SEQ ID NO: 643845 - DNA, 13 bp, D. melanogaster
tatccgaaaccaa

SEQ ID NO: 643846 - DNA, 13 bp, D. melanogaster
tatccgatagata

SEQ ID NO: 643847 - DNA, 14 bp, D. melanogaster
tatccgcatccgca

SEQ ID NO: 643848 - DNA, 13 bp, D. melanogaster
tatccgccagata

SEQ ID NO: 643849 - DNA, 14 bp, D. melanogaster
tatccgccagatac

SEQ ID NO: 643850 - DNA, 13 bp, D. melanogaster
tatccgcgatgtt

SEQ ID NO: 643851 - DNA, 13 bp, D. melanogaster
tatccgtatccgt

SEQ ID NO: 643852 - DNA, 13 bp, D. melanogaster
tatccgtatctgt

SEQ ID NO: 643853 - DNA, 14 bp, D. melanogaster
tatccgtatctgtg

SEQ ID NO: 643854 - DNA, 14 bp, D. melanogaster
tatcctattatctg

SEQ ID NO: 643855 - DNA, 13 bp, D. melanogaster
tatcctcgcagca

SEQ ID NO: 643856 - DNA, 13 bp, D. melanogaster
tatcctggctgcc

SEQ ID NO: 643857 - DNA, 13 bp, D. melanogaster
tatcctgtccctc

SEQ ID NO: 643858 - DNA, 13 bp, D. melanogaster
tatccttatcctt

SEQ ID NO: 643859 - DNA, 13 bp, D. melanogaster
tatcctttaaatg

SEQ ID NO: 643860 - DNA, 13 bp, D. melanogaster
tatcctttatcct

SEQ ID NO: 643861 - DNA, 14 bp, D. melanogaster
tatcgaaaaggaaa

SEQ ID NO: 643862 - DNA, 13 bp, D. melanogaster
tatcgaaaataat

SEQ ID NO: 643863 - DNA, 13 bp, D. melanogaster
tatcgaaaatgaa

SEQ ID NO: 643864 - DNA, 13 bp, D. melanogaster
tatcgaaatcaat

SEQ ID NO: 643865 - DNA, 13 bp, D. melanogaster
tatcgaaattgaa

SEQ ID NO: 643866 - DNA, 13 bp, D. melanogaster
tatcgaatatttt

SEQ ID NO: 643867 - DNA, 13 bp, D. melanogaster
tatcgaatcgaat

SEQ ID NO: 643868 - DNA, 13 bp, D. melanogaster
tatcgagaaactt

SEQ ID NO: 643869 - DNA, 13 bp, D. melanogaster
tatcgataaatat

SEQ ID NO: 643870 - DNA, 13 bp, D. melanogaster
tatcgatacatat

SEQ ID NO: 643871 - DNA, 14 bp, D. melanogaster
tatcgatagatatt

SEQ ID NO: 643872 - DNA, 13 bp, D. melanogaster
tatcgatatatat

SEQ ID NO: 643873 - DNA, 13 bp, D. melanogaster
tatcgatatatcg

SEQ ID NO: 643874 - DNA, 13 bp, D. melanogaster
tatcgatatccca

SEQ ID NO: 643875 - DNA, 14 bp, D. melanogaster
tatcgatatcccag

SEQ ID NO: 643876 - DNA, 13 bp, D. melanogaster
tatcgatcacttt

SEQ ID NO: 643877 - DNA, 13 bp, D. melanogaster
tatcgatcgcatt

SEQ ID NO: 643878 - DNA, 13 bp, D. melanogaster
tatcgatctgtat

SEQ ID NO: 643879 - DNA, 13 bp, D. melanogaster
tatcgattataga

SEQ ID NO: 643880 - DNA, 13 bp, D. melanogaster
tatcgatttctat

SEQ ID NO: 643881 - DNA, 13 bp, D. melanogaster
tatcgatttgaaa

SEQ ID NO: 643882 - DNA, 14 bp, D. melanogaster
tatcgatttgattt

SEQ ID NO: 643883 - DNA, 13 bp, D. melanogaster
tatcgatttggtt

SEQ ID NO: 643884 - DNA, 13 bp, D. melanogaster
tatcgattttatt

SEQ ID NO: 643885 - DNA, 13 bp, D. melanogaster
tatcgcaaattta

SEQ ID NO: 643886 - DNA, 13 bp, D. melanogaster
tatcgcatatata

SEQ ID NO: 643887 - DNA, 13 bp, D. melanogaster
tatcgcgaatact

SEQ ID NO: 643888 - DNA, 13 bp, D. melanogaster
tatcgctgtgcca

SEQ ID NO: 643889 - DNA, 14 bp, D. melanogaster
tatcggaaaattct

SEQ ID NO: 643890 - DNA, 13 bp, D. melanogaster
tatcggatatagt

SEQ ID NO: 643891 - DNA, 14 bp, D. melanogaster
tatcgtaataaaga

SEQ ID NO: 643892 - DNA, 16 bp, D. melanogaster
tatcgtatcgtatcgt

SEQ ID NO: 643893 - DNA, 13 bp, D. melanogaster
tatcgtatttatt

SEQ ID NO: 643894 - DNA, 14 bp, D. melanogaster
tatcgtcgatttat

SEQ ID NO: 643895 - DNA, 13 bp, D. melanogaster
tatcgtcggttct

SEQ ID NO: 643896 - DNA, 13 bp, D. melanogaster
tatcgtgatgggc

SEQ ID NO: 643897 - DNA, 13 bp, D. melanogaster
tatcgttgtcgca

SEQ ID NO: 643898 - DNA, 13 bp, D. melanogaster
tatcgttgtggtc

SEQ ID NO: 643899 - DNA, 13 bp, D. melanogaster
tatcgttgttgtt

SEQ ID NO: 643900 - DNA, 13 bp, D. melanogaster
tatcgtttcttaa

SEQ ID NO: 643901 - DNA, 13 bp, D. melanogaster
tatctaaaagatg

SEQ ID NO: 643902 - DNA, 13 bp, D. melanogaster
tatctaaacaatt

SEQ ID NO: 643903 - DNA, 14 bp, D. melanogaster
tatctaaagatcta

SEQ ID NO: 643904 - DNA, 13 bp, D. melanogaster
tatctaaatatct

SEQ ID NO: 643905 - DNA, 13 bp, D. melanogaster
tatctaatagtcg

SEQ ID NO: 643906 - DNA, 13 bp, D. melanogaster
tatctaatatcta

SEQ ID NO: 643907 - DNA, 13 bp, D. melanogaster
tatctacaagata

SEQ ID NO: 643908 - DNA, 14 bp, D. melanogaster
tatctacatacata

SEQ ID NO: 643909 - DNA, 13 bp, D. melanogaster
tatctacatatac

SEQ ID NO: 643910 - DNA, 14 bp, D. melanogaster
tatctacatatatc

SEQ ID NO: 643911 - DNA, 14 bp, D. melanogaster
tatctacatatgta

SEQ ID NO: 643912 - DNA, 13 bp, D. melanogaster
tatctaccaattt

SEQ ID NO: 643913 - DNA, 13 bp, D. melanogaster
tatctaccagaac

SEQ ID NO: 643914 - DNA, 13 bp, D. melanogaster
tatctaccagcaa

SEQ ID NO: 643915 - DNA, 13 bp, D. melanogaster
tatctacctatct

SEQ ID NO: 643916 - DNA, 13 bp, D. melanogaster
tatctactacaaa

SEQ ID NO: 643917 - DNA, 13 bp, D. melanogaster
tatctagaagata

SEQ ID NO: 643918 - DNA, 13 bp, D. melanogaster
tatctatacacac

SEQ ID NO: 643919 - DNA, 13 bp, D. melanogaster
tatctatagatat

SEQ ID NO: 643920 - DNA, 13 bp, D. melanogaster
tatctatatacac

SEQ ID NO: 643921 - DNA, 13 bp, D. melanogaster
tatctatatatct

SEQ ID NO: 643922 - DNA, 13 bp, D. melanogaster
tatctatatattc

SEQ ID NO: 643923 - DNA, 13 bp, D. melanogaster
tatctatatctat

SEQ ID NO: 643924 - DNA, 14 bp, D. melanogaster
tatctatatctata

SEQ ID NO: 643925 - DNA, 13 bp, D. melanogaster
tatctatatctct

SEQ ID NO: 643926 - DNA, 14 bp, D. melanogaster
tatctatcaaaact

SEQ ID NO: 643927 - DNA, 13 bp, D. melanogaster
tatctatccatct

SEQ ID NO: 643928 - DNA, 13 bp, D. melanogaster
tatctatcgatat

SEQ ID NO: 643929 - DNA, 13 bp, D. melanogaster
tatctatcggata

SEQ ID NO: 643930 - DNA, 14 bp, D. melanogaster
tatctatcggatat

SEQ ID NO: 643931 - DNA, 13 bp, D. melanogaster
tatctatctatat

SEQ ID NO: 643932 - DNA, 14 bp, D. melanogaster
tatctatctatata

SEQ ID NO: 643933 - DNA, 13 bp, D. melanogaster
tatctatctatgt

SEQ ID NO: 643934 - DNA, 13 bp, D. melanogaster
tatctatctctct

SEQ ID NO: 643935 - DNA, 13 bp, D. melanogaster
tatctatctgtat

SEQ ID NO: 643936 - DNA, 13 bp, D. melanogaster
tatctatgtacat

SEQ ID NO: 643937 - DNA, 13 bp, D. melanogaster
tatctatgtatat

SEQ ID NO: 643938 - DNA, 14 bp, D. melanogaster
tatctatgtatata

SEQ ID NO: 643939 - DNA, 14 bp, D. melanogaster
tatctatgtatatg

SEQ ID NO: 643940 - DNA, 13 bp, D. melanogaster
tatctatgtatct

SEQ ID NO: 643941 - DNA, 14 bp, D. melanogaster
tatctatgtatctt

SEQ ID NO: 643942 - DNA, 13 bp, D. melanogaster
tatctattgattt

SEQ ID NO: 643943 - DNA, 13 bp, D. melanogaster
tatctattgttat

SEQ ID NO: 643944 - DNA, 13 bp, D. melanogaster
tatctcaaaaact

SEQ ID NO: 643945 - DNA, 13 bp, D. melanogaster
tatctcaaaatta

SEQ ID NO: 643946 - DNA, 14 bp, D. melanogaster
tatctcaaaattat

SEQ ID NO: 643947 - DNA, 13 bp, D. melanogaster
tatctcaaagata

SEQ ID NO: 643948 - DNA, 13 bp, D. melanogaster
tatctcacaaaca

SEQ ID NO: 643949 - DNA, 13 bp, D. melanogaster
tatctcacagata

SEQ ID NO: 643950 - DNA, 13 bp, D. melanogaster
tatctcacggata

SEQ ID NO: 643951 - DNA, 13 bp, D. melanogaster
tatctctatatat

SEQ ID NO: 643952 - DNA, 13 bp, D. melanogaster
tatctctatctgt

SEQ ID NO: 643953 - DNA, 14 bp, D. melanogaster
tatctctatctgta

SEQ ID NO: 643954 - DNA, 13 bp, D. melanogaster
tatctctcagata

SEQ ID NO: 643955 - DNA, 13 bp, D. melanogaster
tatctgaaaatat

SEQ ID NO: 643956 - DNA, 13 bp, D. melanogaster
tatctgaaaccca

SEQ ID NO: 643957 - DNA, 13 bp, D. melanogaster
tatctgaaagata

SEQ ID NO: 643958 - DNA, 13 bp, D. melanogaster
tatctgaagaaaa

SEQ ID NO: 643959 - DNA, 13 bp, D. melanogaster
tatctgaatatct

SEQ ID NO: 643960 - DNA, 13 bp, D. melanogaster
tatctgaatggca

SEQ ID NO: 643961 - DNA, 13 bp, D. melanogaster
tatctgacagata

SEQ ID NO: 643962 - DNA, 13 bp, D. melanogaster
tatctgagtatct

SEQ ID NO: 643963 - DNA, 14 bp, D. melanogaster
tatctgagtatctg

SEQ ID NO: 643964 - DNA, 14 bp, D. melanogaster
tatctgatagtcga

SEQ ID NO: 643965 - DNA, 14 bp, D. melanogaster
tatctgatagtcgt

SEQ ID NO: 643966 - DNA, 13 bp, D. melanogaster
tatctgatatctg

SEQ ID NO: 643967 - DNA, 13 bp, D. melanogaster
tatctgatcgaga

SEQ ID NO: 643968 - DNA, 13 bp, D. melanogaster
tatctgatgatgg

SEQ ID NO: 643969 - DNA, 13 bp, D. melanogaster
tatctgatggaat

SEQ ID NO: 643970 - DNA, 13 bp, D. melanogaster
tatctgcaaatgt

SEQ ID NO: 643971 - DNA, 13 bp, D. melanogaster
tatctgcaactgt

SEQ ID NO: 643972 - DNA, 13 bp, D. melanogaster
tatctgcaagata

SEQ ID NO: 643973 - DNA, 13 bp, D. melanogaster
tatctgcacctgt

SEQ ID NO: 643974 - DNA, 13 bp, D. melanogaster
tatctgcagctgt

SEQ ID NO: 643975 - DNA, 13 bp, D. melanogaster
tatctgcatttgt

SEQ ID NO: 643976 - DNA, 13 bp, D. melanogaster
tatctgcattttt

SEQ ID NO: 643977 - DNA, 13 bp, D. melanogaster
tatctgccagata

SEQ ID NO: 643978 - DNA, 13 bp, D. melanogaster
tatctgcgcatgc

SEQ ID NO: 643979 - DNA, 13 bp, D. melanogaster
tatctgcgtatct

SEQ ID NO: 643980 - DNA, 13 bp, D. melanogaster
tatctgctgaaac

SEQ ID NO: 643981 - DNA, 13 bp, D. melanogaster
tatctgctggata

SEQ ID NO: 643982 - DNA, 13 bp, D. melanogaster
tatctggatagtc

SEQ ID NO: 643983 - DNA, 13 bp, D. melanogaster
tatctggatatct

SEQ ID NO: 643984 - DNA, 13 bp, D. melanogaster
tatctggcagata

SEQ ID NO: 643985 - DNA, 14 bp, D. melanogaster
tatctggcagatac

SEQ ID NO: 643986 - DNA, 13 bp, D. melanogaster
tatctggcggata

SEQ ID NO: 643987 - DNA, 14 bp, D. melanogaster
tatctggtggaatc

SEQ ID NO: 643988 - DNA, 14 bp, D. melanogaster
tatctgtaagatac

SEQ ID NO: 643989 - DNA, 13 bp, D. melanogaster
tatctgtaatctt

SEQ ID NO: 643990 - DNA, 13 bp, D. melanogaster
tatctgtatatat

SEQ ID NO: 643991 - DNA, 14 bp, D. melanogaster
tatctgtatatctg

SEQ ID NO: 643992 - DNA, 13 bp, D. melanogaster
tatctgtatattt

SEQ ID NO: 643993 - DNA, 13 bp, D. melanogaster
tatctgtatccgc

SEQ ID NO: 643994 - DNA, 13 bp, D. melanogaster
tatctgtatcggt

SEQ ID NO: 643995 - DNA, 13 bp, D. melanogaster
tatctgtatctac

SEQ ID NO: 643996 - DNA, 13 bp, D. melanogaster
tatctgtatctct

SEQ ID NO: 643997 - DNA, 14 bp, D. melanogaster
tatctgtatctctg

SEQ ID NO: 643998 - DNA, 13 bp, D. melanogaster
tatctgtatctga

SEQ ID NO: 643999 - DNA, 14 bp, D. melanogaster
tatctgtatctgaa

SEQ ID NO: 644000 - DNA, 14 bp, D. melanogaster
tatctgtatctgag

SEQ ID NO: 644001 - DNA, 13 bp, D. melanogaster
tatctgtatctgc

SEQ ID NO: 644002 - DNA, 14 bp, D. melanogaster
tatctgtatctgcg

SEQ ID NO: 644003 - DNA, 14 bp, D. melanogaster
tatctgtatctgtt

SEQ ID NO: 644004 - DNA, 13 bp, D. melanogaster
tatctgtatcttg

SEQ ID NO: 644005 - DNA, 13 bp, D. melanogaster
tatctgtatcttt

SEQ ID NO: 644006 - DNA, 14 bp, D. melanogaster
tatctgtatctttt

SEQ ID NO: 644007 - DNA, 13 bp, D. melanogaster
tatctgtatttaa

SEQ ID NO: 644008 - DNA, 14 bp, D. melanogaster
tatctgtattttta

SEQ ID NO: 644009 - DNA, 14 bp, D. melanogaster
tatctgtcagatac

SEQ ID NO: 644010 - DNA, 13 bp, D. melanogaster
tatctgtgagata

SEQ ID NO: 644011 - DNA, 13 bp, D. melanogaster
tatctgtgcatct

SEQ ID NO: 644012 - DNA, 13 bp, D. melanogaster
tatctgtgtatat

SEQ ID NO: 644013 - DNA, 13 bp, D. melanogaster
tatctgtgtatct

SEQ ID NO: 644014 - DNA, 14 bp, D. melanogaster
tatctgtgtatctg

SEQ ID NO: 644015 - DNA, 13 bp, D. melanogaster
tatctgtgtgtgg

SEQ ID NO: 644016 - DNA, 13 bp, D. melanogaster
tatctgtgtgtgt

SEQ ID NO: 644017 - DNA, 13 bp, D. melanogaster
tatctgtgtttgt

SEQ ID NO: 644018 - DNA, 13 bp, D. melanogaster
tatctgttctgct

SEQ ID NO: 644019 - DNA, 13 bp, D. melanogaster
tatctgtttctgt

SEQ ID NO: 644020 - DNA, 13 bp, D. melanogaster
tatctgtttttaa

SEQ ID NO: 644021 - DNA, 13 bp, D. melanogaster
tatcttaaagata

SEQ ID NO: 644022 - DNA, 14 bp, D. melanogaster
tatcttaaagatac

SEQ ID NO: 644023 - DNA, 13 bp, D. melanogaster
tatcttatagttt

SEQ ID NO: 644024 - DNA, 13 bp, D. melanogaster
tatcttatatatc

SEQ ID NO: 644025 - DNA, 13 bp, D. melanogaster
tatcttcaaaatc

SEQ ID NO: 644026 - DNA, 13 bp, D. melanogaster
tatcttcaagata

SEQ ID NO: 644027 - DNA, 13 bp, D. melanogaster
tatcttcgaagag

SEQ ID NO: 644028 - DNA, 13 bp, D. melanogaster
tatcttcggttta

SEQ ID NO: 644029 - DNA, 13 bp, D. melanogaster
tatcttctacaat

SEQ ID NO: 644030 - DNA, 13 bp, D. melanogaster
tatcttctagata

SEQ ID NO: 644031 - DNA, 13 bp, D. melanogaster
tatcttgaaaata

SEQ ID NO: 644032 - DNA, 13 bp, D. melanogaster
tatcttgactatt

SEQ ID NO: 644033 - DNA, 13 bp, D. melanogaster
tatcttgaggcac

SEQ ID NO: 644034 - DNA, 13 bp, D. melanogaster
tatcttgcagata

SEQ ID NO: 644035 - DNA, 14 bp, D. melanogaster
tatcttgcagatac

SEQ ID NO: 644036 - DNA, 13 bp, D. melanogaster
tatcttggctgat

SEQ ID NO: 644037 - DNA, 13 bp, D. melanogaster
tatctttaaaaac

SEQ ID NO: 644038 - DNA, 13 bp, D. melanogaster
tatctttaagata

SEQ ID NO: 644039 - DNA, 14 bp, D. melanogaster
tatctttaagatac

SEQ ID NO: 644040 - DNA, 13 bp, D. melanogaster
tatctttaattca

SEQ ID NO: 644041 - DNA, 14 bp, D. melanogaster
tatctttaattcaa

SEQ ID NO: 644042 - DNA, 13 bp, D. melanogaster
tatctttatgaac

SEQ ID NO: 644043 - DNA, 13 bp, D. melanogaster
tatctttcagata

SEQ ID NO: 644044 - DNA, 14 bp, D. melanogaster
tatctttcagatac

SEQ ID NO: 644045 - DNA, 14 bp, D. melanogaster
tatctttgagatac

SEQ ID NO: 644046 - DNA, 13 bp, D. melanogaster
tatctttgcatct

SEQ ID NO: 644047 - DNA, 13 bp, D. melanogaster
tatctttgtatct

SEQ ID NO: 644048 - DNA, 14 bp, D. melanogaster
tatctttgtatctg

SEQ ID NO: 644049 - DNA, 13 bp, D. melanogaster
tatctttttgaaa

SEQ ID NO: 644050 - DNA, 14 bp, D. melanogaster
tatctttttgaact

SEQ ID NO: 644051 - DNA, 13 bp, D. melanogaster
tatgaaaaaatgt

SEQ ID NO: 644052 - DNA, 13 bp, D. melanogaster
tatgaaaaacaat

SEQ ID NO: 644053 - DNA, 13 bp, D. melanogaster
tatgaaaaaccag

SEQ ID NO: 644054 - DNA, 13 bp, D. melanogaster
tatgaaaaattgt

SEQ ID NO: 644055 - DNA, 13 bp, D. melanogaster
tatgaaaacaaca

SEQ ID NO: 644056 - DNA, 13 bp, D. melanogaster
tatgaaaacattt

SEQ ID NO: 644057 - DNA, 13 bp, D. melanogaster
tatgaaaaccaaa

SEQ ID NO: 644058 - DNA, 13 bp, D. melanogaster
tatgaaaacttta

SEQ ID NO: 644059 - DNA, 13 bp, D. melanogaster
tatgaaaagcaaa

SEQ ID NO: 644060 - DNA, 13 bp, D. melanogaster
tatgaaaataaca

SEQ ID NO: 644061 - DNA, 13 bp, D. melanogaster
tatgaaaataacc

SEQ ID NO: 644062 - DNA, 13 bp, D. melanogaster
tatgaaaataact

SEQ ID NO: 644063 - DNA, 13 bp, D. melanogaster
tatgaaaataatg

SEQ ID NO: 644064 - DNA, 14 bp, D. melanogaster
tatgaaaatatttg

SEQ ID NO: 644065 - DNA, 13 bp, D. melanogaster
tatgaaaatgaca

SEQ ID NO: 644066 - DNA, 13 bp, D. melanogaster
tatgaaaatgcag

SEQ ID NO: 644067 - DNA, 13 bp, D. melanogaster
tatgaaaatggaa

SEQ ID NO: 644068 - DNA, 13 bp, D. melanogaster
tatgaaaatttca

SEQ ID NO: 644069 - DNA, 13 bp, D. melanogaster
tatgaaacaattt

SEQ ID NO: 644070 - DNA, 13 bp, D. melanogaster
tatgaaactattt

SEQ ID NO: 644071 - DNA, 13 bp, D. melanogaster
tatgaaacttaaa

SEQ ID NO: 644072 - DNA, 13 bp, D. melanogaster
tatgaaaggtttg

SEQ ID NO: 644073 - DNA, 13 bp, D. melanogaster
tatgaaatacaaa

SEQ ID NO: 644074 - DNA, 13 bp, D. melanogaster
tatgaaatatttg

SEQ ID NO: 644075 - DNA, 13 bp, D. melanogaster
tatgaaatcaaaa

SEQ ID NO: 644076 - DNA, 13 bp, D. melanogaster
tatgaaatcattt

SEQ ID NO: 644077 - DNA, 14 bp, D. melanogaster
tatgaaatctattc

SEQ ID NO: 644078 - DNA, 13 bp, D. melanogaster
tatgaaatgaaat

SEQ ID NO: 644079 - DNA, 13 bp, D. melanogaster
tatgaaatgcatt

SEQ ID NO: 644080 - DNA, 14 bp, D. melanogaster
tatgaaatgggtcc

SEQ ID NO: 644081 - DNA, 13 bp, D. melanogaster
tatgaaatggtat

SEQ ID NO: 644082 - DNA, 13 bp, D. melanogaster
tatgaaattaaag

SEQ ID NO: 644083 - DNA, 13 bp, D. melanogaster
tatgaaattcaat

SEQ ID NO: 644084 - DNA, 13 bp, D. melanogaster
tatgaaatttgaa

SEQ ID NO: 644085 - DNA, 13 bp, D. melanogaster
tatgaacatttta

SEQ ID NO: 644086 - DNA, 13 bp, D. melanogaster
tatgaacccaatg

SEQ ID NO: 644087 - DNA, 13 bp, D. melanogaster
tatgaacgaatgt

SEQ ID NO: 644088 - DNA, 13 bp, D. melanogaster
tatgaacgtcaag

SEQ ID NO: 644089 - DNA, 13 bp, D. melanogaster
tatgaagaacaca

SEQ ID NO: 644090 - DNA, 13 bp, D. melanogaster
tatgaagatatat

SEQ ID NO: 644091 - DNA, 13 bp, D. melanogaster
tatgaaggtgcag

SEQ ID NO: 644092 - DNA, 13 bp, D. melanogaster
tatgaagtctttc

SEQ ID NO: 644093 - DNA, 13 bp, D. melanogaster
tatgaagtttatt

SEQ ID NO: 644094 - DNA, 13 bp, D. melanogaster
tatgaataaaatc

SEQ ID NO: 644095 - DNA, 13 bp, D. melanogaster
tatgaataaacat

SEQ ID NO: 644096 - DNA, 13 bp, D. melanogaster
tatgaatacaaat

SEQ ID NO: 644097 - DNA, 13 bp, D. melanogaster
tatgaatatatct

SEQ ID NO: 644098 - DNA, 13 bp, D. melanogaster
tatgaatatgaaa

SEQ ID NO: 644099 - DNA, 14 bp, D. melanogaster
tatgaatatgaaat

SEQ ID NO: 644100 - DNA, 13 bp, D. melanogaster
tatgaatatgaat

SEQ ID NO: 644101 - DNA, 13 bp, D. melanogaster
tatgaatatgatt

SEQ ID NO: 644102 - DNA, 13 bp, D. melanogaster
tatgaatatgtat

SEQ ID NO: 644103 - DNA, 14 bp, D. melanogaster
tatgaatatttcat

SEQ ID NO: 644104 - DNA, 13 bp, D. melanogaster
tatgaatatttga

SEQ ID NO: 644105 - DNA, 13 bp, D. melanogaster
tatgaatgaaaag

SEQ ID NO: 644106 - DNA, 13 bp, D. melanogaster
tatgaatgaaaat

SEQ ID NO: 644107 - DNA, 13 bp, D. melanogaster
tatgaatgctttt

SEQ ID NO: 644108 - DNA, 13 bp, D. melanogaster
tatgaatggaaaa

SEQ ID NO: 644109 - DNA, 14 bp, D. melanogaster
tatgaatggccaca

SEQ ID NO: 644110 - DNA, 13 bp, D. melanogaster
tatgaatgtaaaa

SEQ ID NO: 644111 - DNA, 13 bp, D. melanogaster
tatgaattagttt

SEQ ID NO: 644112 - DNA, 13 bp, D. melanogaster
tatgaatttcaat

SEQ ID NO: 644113 - DNA, 13 bp, D. melanogaster
tatgaatttctaa

SEQ ID NO: 644114 - DNA, 13 bp, D. melanogaster
tatgaatttgaat

SEQ ID NO: 644115 - DNA, 14 bp, D. melanogaster
tatgacaatggact

SEQ ID NO: 644116 - DNA, 13 bp, D. melanogaster
tatgacacacact

SEQ ID NO: 644117 - DNA, 14 bp, D. melanogaster
tatgacagaaagtt

SEQ ID NO: 644118 - DNA, 13 bp, D. melanogaster
tatgacatattta

SEQ ID NO: 644119 - DNA, 13 bp, D. melanogaster
tatgacattattt

SEQ ID NO: 644120 - DNA, 13 bp, D. melanogaster
tatgacattttta

SEQ ID NO: 644121 - DNA, 14 bp, D. melanogaster
tatgaccattttta

SEQ ID NO: 644122 - DNA, 13 bp, D. melanogaster
tatgacttttgca

SEQ ID NO: 644123 - DNA, 14 bp, D. melanogaster
tatgacttttgcaa

SEQ ID NO: 644124 - DNA, 13 bp, D. melanogaster
tatgagaacaaga

SEQ ID NO: 644125 - DNA, 13 bp, D. melanogaster
tatgagcaatgtg

SEQ ID NO: 644126 - DNA, 14 bp, D. melanogaster
tatgagctgattta

SEQ ID NO: 644127 - DNA, 13 bp, D. melanogaster
tatgagcttttaa

SEQ ID NO: 644128 - DNA, 13 bp, D. melanogaster
tatgaggctggat

SEQ ID NO: 644129 - DNA, 13 bp, D. melanogaster
tatgagtaatttt

SEQ ID NO: 644130 - DNA, 13 bp, D. melanogaster
tatgagtatgagt

SEQ ID NO: 644131 - DNA, 13 bp, D. melanogaster
tatgagtgtgtgt

SEQ ID NO: 644132 - DNA, 14 bp, D. melanogaster
tatgagtgtgtgtg

SEQ ID NO: 644133 - DNA, 13 bp, D. melanogaster
tatgataaatgat

SEQ ID NO: 644134 - DNA, 13 bp, D. melanogaster
tatgataatgaaa

SEQ ID NO: 644135 - DNA, 13 bp, D. melanogaster
tatgataatgata

SEQ ID NO: 644136 - DNA, 13 bp, D. melanogaster
tatgataatgatg

SEQ ID NO: 644137 - DNA, 13 bp, D. melanogaster
tatgatatgataa

SEQ ID NO: 644138 - DNA, 13 bp, D. melanogaster
tatgatcaaaata

SEQ ID NO: 644139 - DNA, 13 bp, D. melanogaster
tatgatcgctttt

SEQ ID NO: 644140 - DNA, 14 bp, D. melanogaster
tatgatcgcttttt

SEQ ID NO: 644141 - DNA, 13 bp, D. melanogaster
tatgatcttcatc

SEQ ID NO: 644142 - DNA, 14 bp, D. melanogaster
tatgatggaaatgt

SEQ ID NO: 644143 - DNA, 13 bp, D. melanogaster
tatgatgtaacat

SEQ ID NO: 644144 - DNA, 13 bp, D. melanogaster
tatgatgtaatga

SEQ ID NO: 644145 - DNA, 14 bp, D. melanogaster
tatgattaatactt

SEQ ID NO: 644146 - DNA, 13 bp, D. melanogaster
tatgattacgaaa

SEQ ID NO: 644147 - DNA, 13 bp, D. melanogaster
tatgattactttt

SEQ ID NO: 644148 - DNA, 13 bp, D. melanogaster
tatgattattatg

SEQ ID NO: 644149 - DNA, 13 bp, D. melanogaster
tatgattattgca

SEQ ID NO: 644150 - DNA, 13 bp, D. melanogaster
tatgattcatatt

SEQ ID NO: 644151 - DNA, 13 bp, D. melanogaster
tatgattgtatat

SEQ ID NO: 644152 - DNA, 13 bp, D. melanogaster
tatgattgttttc

SEQ ID NO: 644153 - DNA, 13 bp, D. melanogaster
tatgatttatatg

SEQ ID NO: 644154 - DNA, 13 bp, D. melanogaster
tatgatttatgat

SEQ ID NO: 644155 - DNA, 13 bp, D. melanogaster
tatgatttatgta

SEQ ID NO: 644156 - DNA, 13 bp, D. melanogaster
tatgatttatttc

SEQ ID NO: 644157 - DNA, 13 bp, D. melanogaster
tatgatttccatt

SEQ ID NO: 644158 - DNA, 13 bp, D. melanogaster
tatgatttctttg

SEQ ID NO: 644159 - DNA, 14 bp, D. melanogaster
tatgattttgtgta

SEQ ID NO: 644160 - DNA, 13 bp, D. melanogaster
tatgcaaaaagaa

SEQ ID NO: 644161 - DNA, 13 bp, D. melanogaster
tatgcaaaaatca

SEQ ID NO: 644162 - DNA, 13 bp, D. melanogaster
tatgcaaaaccaa

SEQ ID NO: 644163 - DNA, 13 bp, D. melanogaster
tatgcaaaacgaa

SEQ ID NO: 644164 - DNA, 14 bp, D. melanogaster
tatgcaaaactaaa

SEQ ID NO: 644165 - DNA, 13 bp, D. melanogaster
tatgcaaaactta

SEQ ID NO: 644166 - DNA, 13 bp, D. melanogaster
tatgcaaaagaag

SEQ ID NO: 644167 - DNA, 13 bp, D. melanogaster
tatgcaaaagata

SEQ ID NO: 644168 - DNA, 13 bp, D. melanogaster
tatgcaaaagtaa

SEQ ID NO: 644169 - DNA, 13 bp, D. melanogaster
tatgcaaaagttt

SEQ ID NO: 644170 - DNA, 13 bp, D. melanogaster
tatgcaaaatatt

SEQ ID NO: 644171 - DNA, 14 bp, D. melanogaster
tatgcaaaatattt

SEQ ID NO: 644172 - DNA, 13 bp, D. melanogaster
tatgcaaaatgca

SEQ ID NO: 644173 - DNA, 13 bp, D. melanogaster
tatgcaaaatgtg

SEQ ID NO: 644174 - DNA, 13 bp, D. melanogaster
tatgcaaaattat

SEQ ID NO: 644175 - DNA, 14 bp, D. melanogaster
tatgcaaaattctt

SEQ ID NO: 644176 - DNA, 13 bp, D. melanogaster
tatgcaaaattgt

SEQ ID NO: 644177 - DNA, 13 bp, D. melanogaster
tatgcaaaattta

SEQ ID NO: 644178 - DNA, 13 bp, D. melanogaster
tatgcaaacaaaa

SEQ ID NO: 644179 - DNA, 13 bp, D. melanogaster
tatgcaaacacaa

SEQ ID NO: 644180 - DNA, 13 bp, D. melanogaster
tatgcaaacacac

SEQ ID NO: 644181 - DNA, 13 bp, D. melanogaster
tatgcaaacgaaa

SEQ ID NO: 644182 - DNA, 13 bp, D. melanogaster
tatgcaaagcaaa

SEQ ID NO: 644183 - DNA, 13 bp, D. melanogaster
tatgcaaataaat

SEQ ID NO: 644184 - DNA, 13 bp, D. melanogaster
tatgcaaataaga

SEQ ID NO: 644185 - DNA, 13 bp, D. melanogaster
tatgcaaatacat

SEQ ID NO: 644186 - DNA, 13 bp, D. melanogaster
tatgcaaatagcc

SEQ ID NO: 644187 - DNA, 13 bp, D. melanogaster
tatgcaaataggc

SEQ ID NO: 644188 - DNA, 13 bp, D. melanogaster
tatgcaaatatat

SEQ ID NO: 644189 - DNA, 14 bp, D. melanogaster
tatgcaaatatata

SEQ ID NO: 644190 - DNA, 13 bp, D. melanogaster
tatgcaaatatta

SEQ ID NO: 644191 - DNA, 13 bp, D. melanogaster
tatgcaaatattc

SEQ ID NO: 644192 - DNA, 13 bp, D. melanogaster
tatgcaaatcaaa

SEQ ID NO: 644193 - DNA, 14 bp, D. melanogaster
tatgcaaatcaaat

SEQ ID NO: 644194 - DNA, 13 bp, D. melanogaster
tatgcaaatcaga

SEQ ID NO: 644195 - DNA, 13 bp, D. melanogaster
tatgcaaatcagc

SEQ ID NO: 644196 - DNA, 13 bp, D. melanogaster
tatgcaaatccaa

SEQ ID NO: 644197 - DNA, 13 bp, D. melanogaster
tatgcaaatctcg

SEQ ID NO: 644198 - DNA, 13 bp, D. melanogaster
tatgcaaatcttt

SEQ ID NO: 644199 - DNA, 13 bp, D. melanogaster
tatgcaaatgagc

SEQ ID NO: 644200 - DNA, 13 bp, D. melanogaster
tatgcaaatgatg

SEQ ID NO: 644201 - DNA, 13 bp, D. melanogaster
tatgcaaatgcaa

SEQ ID NO: 644202 - DNA, 14 bp, D. melanogaster
tatgcaaatgcaaa

SEQ ID NO: 644203 - DNA, 14 bp, D. melanogaster
tatgcaaatgcaat

SEQ ID NO: 644204 - DNA, 13 bp, D. melanogaster
tatgcaaatgcac

SEQ ID NO: 644205 - DNA, 13 bp, D. melanogaster
tatgcaaatgcca

SEQ ID NO: 644206 - DNA, 13 bp, D. melanogaster
tatgcaaatgcct

SEQ ID NO: 644207 - DNA, 13 bp, D. melanogaster
tatgcaaatgtta

SEQ ID NO: 644208 - DNA, 13 bp, D. melanogaster
tatgcaaatgttt

SEQ ID NO: 644209 - DNA, 14 bp, D. melanogaster
tatgcaaatgtttg

SEQ ID NO: 644210 - DNA, 14 bp, D. melanogaster
tatgcaaattaaaa

SEQ ID NO: 644211 - DNA, 13 bp, D. melanogaster
tatgcaaattaat

SEQ ID NO: 644212 - DNA, 14 bp, D. melanogaster
tatgcaaattaatt

SEQ ID NO: 644213 - DNA, 13 bp, D. melanogaster
tatgcaaattcaa

SEQ ID NO: 644214 - DNA, 13 bp, D. melanogaster
tatgcaaattcca

SEQ ID NO: 644215 - DNA, 13 bp, D. melanogaster
tatgcaaattcgc

SEQ ID NO: 644216 - DNA, 13 bp, D. melanogaster
tatgcaaattctg

SEQ ID NO: 644217 - DNA, 14 bp, D. melanogaster
tatgcaaattctgg

SEQ ID NO: 644218 - DNA, 13 bp, D. melanogaster
tatgcaaattgct

SEQ ID NO: 644219 - DNA, 13 bp, D. melanogaster
tatgcaaattggc

SEQ ID NO: 644220 - DNA, 13 bp, D. melanogaster
tatgcaaattgtt

SEQ ID NO: 644221 - DNA, 13 bp, D. melanogaster
tatgcaaatttct

SEQ ID NO: 644222 - DNA, 13 bp, D. melanogaster
tatgcaaatttta

SEQ ID NO: 644223 - DNA, 14 bp, D. melanogaster
tatgcaaattttaa

SEQ ID NO: 644224 - DNA, 13 bp, D. melanogaster
tatgcaaattttt

SEQ ID NO: 644225 - DNA, 14 bp, D. melanogaster
tatgcaaatttttt

SEQ ID NO: 644226 - DNA, 13 bp, D. melanogaster
tatgcaacaacaa

SEQ ID NO: 644227 - DNA, 13 bp, D. melanogaster
tatgcaacaattt

SEQ ID NO: 644228 - DNA, 13 bp, D. melanogaster
tatgcaacgaaaa

SEQ ID NO: 644229 - DNA, 13 bp, D. melanogaster
tatgcaagttaaa

SEQ ID NO: 644230 - DNA, 13 bp, D. melanogaster
tatgcaataataa

SEQ ID NO: 644231 - DNA, 13 bp, D. melanogaster
tatgcaataattt

SEQ ID NO: 644232 - DNA, 13 bp, D. melanogaster
tatgcaatataca

SEQ ID NO: 644233 - DNA, 13 bp, D. melanogaster
tatgcaatattaa

SEQ ID NO: 644234 - DNA, 13 bp, D. melanogaster
tatgcaatcattt

SEQ ID NO: 644235 - DNA, 13 bp, D. melanogaster
tatgcaatgaaaa

SEQ ID NO: 644236 - DNA, 13 bp, D. melanogaster
tatgcaatgaatt

SEQ ID NO: 644237 - DNA, 13 bp, D. melanogaster
tatgcaatgcaac

SEQ ID NO: 644238 - DNA, 13 bp, D. melanogaster
tatgcaattgttt

SEQ ID NO: 644239 - DNA, 14 bp, D. melanogaster
tatgcaatttaaat

SEQ ID NO: 644240 - DNA, 13 bp, D. melanogaster
tatgcaatttgaa

SEQ ID NO: 644241 - DNA, 13 bp, D. melanogaster
tatgcaattttat

SEQ ID NO: 644242 - DNA, 14 bp, D. melanogaster
tatgcaattttatt

SEQ ID NO: 644243 - DNA, 13 bp, D. melanogaster
tatgcacaaatat

SEQ ID NO: 644244 - DNA, 13 bp, D. melanogaster
tatgcacaatttc

SEQ ID NO: 644245 - DNA, 13 bp, D. melanogaster
tatgcacacatat

SEQ ID NO: 644246 - DNA, 13 bp, D. melanogaster
tatgcacatataa

SEQ ID NO: 644247 - DNA, 13 bp, D. melanogaster
tatgcacatatgt

SEQ ID NO: 644248 - DNA, 13 bp, D. melanogaster
tatgcaccgaata

SEQ ID NO: 644249 - DNA, 13 bp, D. melanogaster
tatgcaccttttc

SEQ ID NO: 644250 - DNA, 13 bp, D. melanogaster
tatgcacgcagtt

SEQ ID NO: 644251 - DNA, 13 bp, D. melanogaster
tatgcagatattt

SEQ ID NO: 644252 - DNA, 13 bp, D. melanogaster
tatgcagattgcg

SEQ ID NO: 644253 - DNA, 14 bp, D. melanogaster
tatgcagcgcagtg

SEQ ID NO: 644254 - DNA, 13 bp, D. melanogaster
tatgcagtcaaag

SEQ ID NO: 644255 - DNA, 13 bp, D. melanogaster
tatgcagttttat

SEQ ID NO: 644256 - DNA, 13 bp, D. melanogaster
tatgcataaaata

SEQ ID NO: 644257 - DNA, 13 bp, D. melanogaster
tatgcataataat

SEQ ID NO: 644258 - DNA, 13 bp, D. melanogaster
tatgcataatgca

SEQ ID NO: 644259 - DNA, 13 bp, D. melanogaster
tatgcataattat

SEQ ID NO: 644260 - DNA, 14 bp, D. melanogaster
tatgcatacataca

SEQ ID NO: 644261 - DNA, 13 bp, D. melanogaster
tatgcatacatgt

SEQ ID NO: 644262 - DNA, 13 bp, D. melanogaster
tatgcatataata

SEQ ID NO: 644263 - DNA, 13 bp, D. melanogaster
tatgcatatacat

SEQ ID NO: 644264 - DNA, 14 bp, D. melanogaster
tatgcatatacata

SEQ ID NO: 644265 - DNA, 13 bp, D. melanogaster
tatgcatatagat

SEQ ID NO: 644266 - DNA, 14 bp, D. melanogaster
tatgcatatataca

SEQ ID NO: 644267 - DNA, 13 bp, D. melanogaster
tatgcatatattc

SEQ ID NO: 644268 - DNA, 13 bp, D. melanogaster
tatgcatatattg

SEQ ID NO: 644269 - DNA, 14 bp, D. melanogaster
tatgcatatatttt

SEQ ID NO: 644270 - DNA, 13 bp, D. melanogaster
tatgcatatgcac

SEQ ID NO: 644271 - DNA, 13 bp, D. melanogaster
tatgcatatgcat

SEQ ID NO: 644272 - DNA, 14 bp, D. melanogaster
tatgcatatgcatg

SEQ ID NO: 644273 - DNA, 13 bp, D. melanogaster
tatgcatatgctt

SEQ ID NO: 644274 - DNA, 14 bp, D. melanogaster
tatgcatatgtatg

SEQ ID NO: 644275 - DNA, 13 bp, D. melanogaster
tatgcatatgtgt

SEQ ID NO: 644276 - DNA, 13 bp, D. melanogaster
tatgcatattaaa

SEQ ID NO: 644277 - DNA, 13 bp, D. melanogaster
tatgcatattcaa

SEQ ID NO: 644278 - DNA, 13 bp, D. melanogaster
tatgcatatttag

SEQ ID NO: 644279 - DNA, 13 bp, D. melanogaster
tatgcatatttat

SEQ ID NO: 644280 - DNA, 14 bp, D. melanogaster
tatgcatatttttt

SEQ ID NO: 644281 - DNA, 13 bp, D. melanogaster
tatgcatgagctt

SEQ ID NO: 644282 - DNA, 14 bp, D. melanogaster
tatgcatgtacata

SEQ ID NO: 644283 - DNA, 13 bp, D. melanogaster
tatgcatgtattt

SEQ ID NO: 644284 - DNA, 13 bp, D. melanogaster
tatgcatgtgcat

SEQ ID NO: 644285 - DNA, 14 bp, D. melanogaster
tatgcatgtgtgtg

SEQ ID NO: 644286 - DNA, 13 bp, D. melanogaster
tatgcattatatg

SEQ ID NO: 644287 - DNA, 13 bp, D. melanogaster
tatgcattatgta

SEQ ID NO: 644288 - DNA, 13 bp, D. melanogaster
tatgcatttacat

SEQ ID NO: 644289 - DNA, 13 bp, D. melanogaster
tatgcatttcaaa

SEQ ID NO: 644290 - DNA, 14 bp, D. melanogaster
tatgcatttcattt

SEQ ID NO: 644291 - DNA, 13 bp, D. melanogaster
tatgcatttgatt

SEQ ID NO: 644292 - DNA, 13 bp, D. melanogaster
tatgcatttgcat

SEQ ID NO: 644293 - DNA, 13 bp, D. melanogaster
tatgcatttgtat

SEQ ID NO: 644294 - DNA, 13 bp, D. melanogaster
tatgcattttaat

SEQ ID NO: 644295 - DNA, 13 bp, D. melanogaster
tatgccaaaaaaa

SEQ ID NO: 644296 - DNA, 13 bp, D. melanogaster
tatgccaaaaaca

SEQ ID NO: 644297 - DNA, 13 bp, D. melanogaster
tatgccaaaaatg

SEQ ID NO: 644298 - DNA, 13 bp, D. melanogaster
tatgccaataaaa

SEQ ID NO: 644299 - DNA, 13 bp, D. melanogaster
tatgccaattttt

SEQ ID NO: 644300 - DNA, 13 bp, D. melanogaster
tatgccacataaa

SEQ ID NO: 644301 - DNA, 13 bp, D. melanogaster
tatgccaccaatt

SEQ ID NO: 644302 - DNA, 13 bp, D. melanogaster
tatgccactttaa

SEQ ID NO: 644303 - DNA, 13 bp, D. melanogaster
tatgccataaaaa

SEQ ID NO: 644304 - DNA, 13 bp, D. melanogaster
tatgccatatata

SEQ ID NO: 644305 - DNA, 13 bp, D. melanogaster
tatgccatatgcc

SEQ ID NO: 644306 - DNA, 13 bp, D. melanogaster
tatgccatcattt

SEQ ID NO: 644307 - DNA, 13 bp, D. melanogaster
tatgccatcgcat

SEQ ID NO: 644308 - DNA, 13 bp, D. melanogaster
tatgccatctgcg

SEQ ID NO: 644309 - DNA, 13 bp, D. melanogaster
tatgccatttgca

SEQ ID NO: 644310 - DNA, 13 bp, D. melanogaster
tatgccctccttg

SEQ ID NO: 644311 - DNA, 13 bp, D. melanogaster
tatgcccttcacc

SEQ ID NO: 644312 - DNA, 13 bp, D. melanogaster
tatgccttctttt

SEQ ID NO: 644313 - DNA, 13 bp, D. melanogaster
tatgccttgaatg

SEQ ID NO: 644314 - DNA, 13 bp, D. melanogaster
tatgcgaaaataa

SEQ ID NO: 644315 - DNA, 13 bp, D. melanogaster
tatgcgaattttt

SEQ ID NO: 644316 - DNA, 13 bp, D. melanogaster
tatgcgactggca

SEQ ID NO: 644317 - DNA, 13 bp, D. melanogaster
tatgcgcaacatt

SEQ ID NO: 644318 - DNA, 13 bp, D. melanogaster
tatgcgcaattaa

SEQ ID NO: 644319 - DNA, 13 bp, D. melanogaster
tatgcgctgcatt

SEQ ID NO: 644320 - DNA, 13 bp, D. melanogaster
tatgcgtaatatg

SEQ ID NO: 644321 - DNA, 13 bp, D. melanogaster
tatgcgtaatatt

SEQ ID NO: 644322 - DNA, 13 bp, D. melanogaster
tatgcgtagttct

SEQ ID NO: 644323 - DNA, 13 bp, D. melanogaster
tatgcgtatgtat

SEQ ID NO: 644324 - DNA, 13 bp, D. melanogaster
tatgcgtatgtgt

SEQ ID NO: 644325 - DNA, 13 bp, D. melanogaster
tatgcgtgtgtgc

SEQ ID NO: 644326 - DNA, 13 bp, D. melanogaster
tatgctaaataaa

SEQ ID NO: 644327 - DNA, 13 bp, D. melanogaster
tatgctaattaaa

SEQ ID NO: 644328 - DNA, 13 bp, D. melanogaster
tatgctacaaaat

SEQ ID NO: 644329 - DNA, 13 bp, D. melanogaster
tatgctacacttt

SEQ ID NO: 644330 - DNA, 13 bp, D. melanogaster
tatgctatatatt

SEQ ID NO: 644331 - DNA, 13 bp, D. melanogaster
tatgctatgaaaa

SEQ ID NO: 644332 - DNA, 13 bp, D. melanogaster
tatgctatgattt

SEQ ID NO: 644333 - DNA, 13 bp, D. melanogaster
tatgctatggaaa

SEQ ID NO: 644334 - DNA, 13 bp, D. melanogaster
tatgctcaaaaat

SEQ ID NO: 644335 - DNA, 14 bp, D. melanogaster
tatgctgctgctgc

SEQ ID NO: 644336 - DNA, 13 bp, D. melanogaster
tatgctgttcaac

SEQ ID NO: 644337 - DNA, 13 bp, D. melanogaster
tatgcttaaatta

SEQ ID NO: 644338 - DNA, 13 bp, D. melanogaster
tatgcttctattt

SEQ ID NO: 644339 - DNA, 13 bp, D. melanogaster
tatgcttgttgct

SEQ ID NO: 644340 - DNA, 13 bp, D. melanogaster
tatgctttaaatt

SEQ ID NO: 644341 - DNA, 13 bp, D. melanogaster
tatgctttctatc

SEQ ID NO: 644342 - DNA, 13 bp, D. melanogaster
tatgctttgattt

SEQ ID NO: 644343 - DNA, 13 bp, D. melanogaster
tatggaaaaatta

SEQ ID NO: 644344 - DNA, 13 bp, D. melanogaster
tatggaaaataca

SEQ ID NO: 644345 - DNA, 13 bp, D. melanogaster
tatggaaaatttt

SEQ ID NO: 644346 - DNA, 14 bp, D. melanogaster
tatggaaatggaaa

SEQ ID NO: 644347 - DNA, 13 bp, D. melanogaster
tatggaaattaaa

SEQ ID NO: 644348 - DNA, 13 bp, D. melanogaster
tatggaatatatg

SEQ ID NO: 644349 - DNA, 14 bp, D. melanogaster
tatggacaataatt

SEQ ID NO: 644350 - DNA, 13 bp, D. melanogaster
tatggagaattac

SEQ ID NO: 644351 - DNA, 13 bp, D. melanogaster
tatggagcaagac

SEQ ID NO: 644352 - DNA, 13 bp, D. melanogaster
tatggaggctttg

SEQ ID NO: 644353 - DNA, 13 bp, D. melanogaster
tatggagttttat

SEQ ID NO: 644354 - DNA, 13 bp, D. melanogaster
tatggataaagtg

SEQ ID NO: 644355 - DNA, 13 bp, D. melanogaster
tatggatacaata

SEQ ID NO: 644356 - DNA, 13 bp, D. melanogaster
tatggatatatgg

SEQ ID NO: 644357 - DNA, 13 bp, D. melanogaster
tatggatatattt

SEQ ID NO: 644358 - DNA, 14 bp, D. melanogaster
tatggatttatcta

SEQ ID NO: 644359 - DNA, 13 bp, D. melanogaster
tatggcaaaaata

SEQ ID NO: 644360 - DNA, 13 bp, D. melanogaster
tatggcaaatgaa

SEQ ID NO: 644361 - DNA, 13 bp, D. melanogaster
tatggcaactaag

SEQ ID NO: 644362 - DNA, 14 bp, D. melanogaster
tatggcaagtaatt

SEQ ID NO: 644363 - DNA, 13 bp, D. melanogaster
tatggcaatgttg

SEQ ID NO: 644364 - DNA, 13 bp, D. melanogaster
tatggcacacatt

SEQ ID NO: 644365 - DNA, 14 bp, D. melanogaster
tatggcataaaata

SEQ ID NO: 644366 - DNA, 13 bp, D. melanogaster
tatggcatatata

SEQ ID NO: 644367 - DNA, 13 bp, D. melanogaster
tatggcattatat

SEQ ID NO: 644368 - DNA, 13 bp, D. melanogaster
tatggccaaaaca

SEQ ID NO: 644369 - DNA, 13 bp, D. melanogaster
tatggccaaaata

SEQ ID NO: 644370 - DNA, 13 bp, D. melanogaster
tatggccaaatga

SEQ ID NO: 644371 - DNA, 13 bp, D. melanogaster
tatggccacacga

SEQ ID NO: 644372 - DNA, 13 bp, D. melanogaster
tatggccagcggc

SEQ ID NO: 644373 - DNA, 13 bp, D. melanogaster
tatggccattaaa

SEQ ID NO: 644374 - DNA, 13 bp, D. melanogaster
tatggcccaaaaa

SEQ ID NO: 644375 - DNA, 13 bp, D. melanogaster
tatggcgccattt

SEQ ID NO: 644376 - DNA, 13 bp, D. melanogaster
tatggctatatat

SEQ ID NO: 644377 - DNA, 13 bp, D. melanogaster
tatggctattgct

SEQ ID NO: 644378 - DNA, 13 bp, D. melanogaster
tatggctcacagt

SEQ ID NO: 644379 - DNA, 13 bp, D. melanogaster
tatggctccgagc

SEQ ID NO: 644380 - DNA, 14 bp, D. melanogaster
tatggctgcaccga

SEQ ID NO: 644381 - DNA, 13 bp, D. melanogaster
tatggcttaaatt

SEQ ID NO: 644382 - DNA, 14 bp, D. melanogaster
tatggcttaaattt

SEQ ID NO: 644383 - DNA, 13 bp, D. melanogaster
tatggcttccttt

SEQ ID NO: 644384 - DNA, 14 bp, D. melanogaster
tatggcttcctttg

SEQ ID NO: 644385 - DNA, 13 bp, D. melanogaster
tatggctttacgg

SEQ ID NO: 644386 - DNA, 13 bp, D. melanogaster
tatgggaaaatat

SEQ ID NO: 644387 - DNA, 13 bp, D. melanogaster
tatgggagagaaa

SEQ ID NO: 644388 - DNA, 14 bp, D. melanogaster
tatgggcgtggcag

SEQ ID NO: 644389 - DNA, 13 bp, D. melanogaster
tatgggtatatgg

SEQ ID NO: 644390 - DNA, 13 bp, D. melanogaster
tatgggtggtcag

SEQ ID NO: 644391 - DNA, 13 bp, D. melanogaster
tatgggttatggg

SEQ ID NO: 644392 - DNA, 13 bp, D. melanogaster
tatggtaaccaaa

SEQ ID NO: 644393 - DNA, 13 bp, D. melanogaster
tatggtatggtat

SEQ ID NO: 644394 - DNA, 13 bp, D. melanogaster
tatggtcactttg

SEQ ID NO: 644395 - DNA, 13 bp, D. melanogaster
tatggtcggaaac

SEQ ID NO: 644396 - DNA, 14 bp, D. melanogaster
tatggtcggaaacg

SEQ ID NO: 644397 - DNA, 13 bp, D. melanogaster
tatggtggtaaaa

SEQ ID NO: 644398 - DNA, 13 bp, D. melanogaster
tatggttatggtt

SEQ ID NO: 644399 - DNA, 13 bp, D. melanogaster
tatggttccttgc

SEQ ID NO: 644400 - DNA, 13 bp, D. melanogaster
tatggttgtatgt

SEQ ID NO: 644401 - DNA, 13 bp, D. melanogaster
tatgtaaaaatac

SEQ ID NO: 644402 - DNA, 13 bp, D. melanogaster
tatgtaaacttat

SEQ ID NO: 644403 - DNA, 14 bp, D. melanogaster
tatgtaaagacttg

SEQ ID NO: 644404 - DNA, 13 bp, D. melanogaster
tatgtaaataaga

SEQ ID NO: 644405 - DNA, 13 bp, D. melanogaster
tatgtaaatacat

SEQ ID NO: 644406 - DNA, 13 bp, D. melanogaster
tatgtaaatagtt

SEQ ID NO: 644407 - DNA, 14 bp, D. melanogaster
tatgtaaatatgta

SEQ ID NO: 644408 - DNA, 13 bp, D. melanogaster
tatgtaaatattc

SEQ ID NO: 644409 - DNA, 13 bp, D. melanogaster
tatgtaaatgaat

SEQ ID NO: 644410 - DNA, 13 bp, D. melanogaster
tatgtaaatgatt

SEQ ID NO: 644411 - DNA, 13 bp, D. melanogaster
tatgtaaatggaa

SEQ ID NO: 644412 - DNA, 13 bp, D. melanogaster
tatgtaaatgtgt

SEQ ID NO: 644413 - DNA, 13 bp, D. melanogaster
tatgtaaatgtta

SEQ ID NO: 644414 - DNA, 13 bp, D. melanogaster
tatgtaaatgttt

SEQ ID NO: 644415 - DNA, 13 bp, D. melanogaster
tatgtaaattttg

SEQ ID NO: 644416 - DNA, 13 bp, D. melanogaster
tatgtaagtatgt

SEQ ID NO: 644417 - DNA, 14 bp, D. melanogaster
tatgtaagtatgta

SEQ ID NO: 644418 - DNA, 13 bp, D. melanogaster
tatgtaataaagt

SEQ ID NO: 644419 - DNA, 13 bp, D. melanogaster
tatgtaatatatg

SEQ ID NO: 644420 - DNA, 13 bp, D. melanogaster
tatgtaatatgta

SEQ ID NO: 644421 - DNA, 14 bp, D. melanogaster
tatgtaatatgtaa

SEQ ID NO: 644422 - DNA, 13 bp, D. melanogaster
tatgtaattgaaa

SEQ ID NO: 644423 - DNA, 13 bp, D. melanogaster
tatgtacaaaaaa

SEQ ID NO: 644424 - DNA, 13 bp, D. melanogaster
tatgtacaaatat

SEQ ID NO: 644425 - DNA, 13 bp, D. melanogaster
tatgtacaaatgt

SEQ ID NO: 644426 - DNA, 14 bp, D. melanogaster
tatgtacaatacat

SEQ ID NO: 644427 - DNA, 13 bp, D. melanogaster
tatgtacacacaa

SEQ ID NO: 644428 - DNA, 14 bp, D. melanogaster
tatgtacacacata

SEQ ID NO: 644429 - DNA, 13 bp, D. melanogaster
tatgtacacatgt

SEQ ID NO: 644430 - DNA, 14 bp, D. melanogaster
tatgtacataaata

SEQ ID NO: 644431 - DNA, 14 bp, D. melanogaster
tatgtacataaatg

SEQ ID NO: 644432 - DNA, 13 bp, D. melanogaster
tatgtacataaca

SEQ ID NO: 644433 - DNA, 14 bp, D. melanogaster
tatgtacataatat

SEQ ID NO: 644434 - DNA, 13 bp, D. melanogaster
tatgtacatacac

SEQ ID NO: 644435 - DNA, 14 bp, D. melanogaster
tatgtacatacaca

SEQ ID NO: 644436 - DNA, 13 bp, D. melanogaster
tatgtacatactt

SEQ ID NO: 644437 - DNA, 14 bp, D. melanogaster
tatgtacatacttt

SEQ ID NO: 644438 - DNA, 13 bp, D. melanogaster
tatgtacatagat

SEQ ID NO: 644439 - DNA, 13 bp, D. melanogaster
tatgtacatataa

SEQ ID NO: 644440 - DNA, 13 bp, D. melanogaster
tatgtacatatag

SEQ ID NO: 644441 - DNA, 14 bp, D. melanogaster
tatgtacatatatc

SEQ ID NO: 644442 - DNA, 14 bp, D. melanogaster
tatgtacatatatg

SEQ ID NO: 644443 - DNA, 14 bp, D. melanogaster
tatgtacatatatt

SEQ ID NO: 644444 - DNA, 13 bp, D. melanogaster
tatgtacatatgc

SEQ ID NO: 644445 - DNA, 14 bp, D. melanogaster
tatgtacatatgca

SEQ ID NO: 644446 - DNA, 13 bp, D. melanogaster
tatgtacatatgt

SEQ ID NO: 644447 - DNA, 14 bp, D. melanogaster
tatgtacatatgtg

SEQ ID NO: 644448 - DNA, 13 bp, D. melanogaster
tatgtacatatta

SEQ ID NO: 644449 - DNA, 13 bp, D. melanogaster
tatgtacatattg

SEQ ID NO: 644450 - DNA, 14 bp, D. melanogaster
tatgtacatatttc

SEQ ID NO: 644451 - DNA, 13 bp, D. melanogaster
tatgtacatctgt

SEQ ID NO: 644452 - DNA, 14 bp, D. melanogaster
tatgtacatgcata

SEQ ID NO: 644453 - DNA, 13 bp, D. melanogaster
tatgtacatgtac

SEQ ID NO: 644454 - DNA, 14 bp, D. melanogaster
tatgtacatgtatg

SEQ ID NO: 644455 - DNA, 13 bp, D. melanogaster
tatgtacatgtgt

SEQ ID NO: 644456 - DNA, 13 bp, D. melanogaster
tatgtacattgta

SEQ ID NO: 644457 - DNA, 14 bp, D. melanogaster
tatgtacatttaaa

SEQ ID NO: 644458 - DNA, 13 bp, D. melanogaster
tatgtacatttga

SEQ ID NO: 644459 - DNA, 13 bp, D. melanogaster
tatgtacatttgt

SEQ ID NO: 644460 - DNA, 14 bp, D. melanogaster
tatgtacatttgta

SEQ ID NO: 644461 - DNA, 14 bp, D. melanogaster
tatgtacattttta

SEQ ID NO: 644462 - DNA, 13 bp, D. melanogaster
tatgtaccatgta

SEQ ID NO: 644463 - DNA, 13 bp, D. melanogaster
tatgtacctacat

SEQ ID NO: 644464 - DNA, 13 bp, D. melanogaster
tatgtacctatat

SEQ ID NO: 644465 - DNA, 13 bp, D. melanogaster
tatgtacgtacgt

SEQ ID NO: 644466 - DNA, 14 bp, D. melanogaster
tatgtacgtacgta

SEQ ID NO: 644467 - DNA, 14 bp, D. melanogaster
tatgtacgtatgta

SEQ ID NO: 644468 - DNA, 13 bp, D. melanogaster
tatgtactacata

SEQ ID NO: 644469 - DNA, 13 bp, D. melanogaster
tatgtactatata

SEQ ID NO: 644470 - DNA, 13 bp, D. melanogaster
tatgtactatgta

SEQ ID NO: 644471 - DNA, 13 bp, D. melanogaster
tatgtacttatat

SEQ ID NO: 644472 - DNA, 13 bp, D. melanogaster
tatgtacttatgt

SEQ ID NO: 644473 - DNA, 14 bp, D. melanogaster
tatgtacttatgta

SEQ ID NO: 644474 - DNA, 13 bp, D. melanogaster
tatgtacttatta

SEQ ID NO: 644475 - DNA, 13 bp, D. melanogaster
tatgtactttaaa

SEQ ID NO: 644476 - DNA, 13 bp, D. melanogaster
tatgtactttata

SEQ ID NO: 644477 - DNA, 13 bp, D. melanogaster
tatgtactttttg

SEQ ID NO: 644478 - DNA, 14 bp, D. melanogaster
tatgtagatataaa

SEQ ID NO: 644479 - DNA, 13 bp, D. melanogaster
tatgtagtatata

SEQ ID NO: 644480 - DNA, 13 bp, D. melanogaster
tatgtataaaaac

SEQ ID NO: 644481 - DNA, 13 bp, D. melanogaster
tatgtataaactt

SEQ ID NO: 644482 - DNA, 13 bp, D. melanogaster
tatgtataaatac

SEQ ID NO: 644483 - DNA, 14 bp, D. melanogaster
tatgtataaatatg

SEQ ID NO: 644484 - DNA, 13 bp, D. melanogaster
tatgtataacata

SEQ ID NO: 644485 - DNA, 13 bp, D. melanogaster
tatgtataagaaa

SEQ ID NO: 644486 - DNA, 13 bp, D. melanogaster
tatgtataagtat

SEQ ID NO: 644487 - DNA, 13 bp, D. melanogaster
tatgtataatgta

SEQ ID NO: 644488 - DNA, 14 bp, D. melanogaster
tatgtataatgtat

SEQ ID NO: 644489 - DNA, 14 bp, D. melanogaster
tatgtataattagg

SEQ ID NO: 644490 - DNA, 13 bp, D. melanogaster
tatgtatacacaa

SEQ ID NO: 644491 - DNA, 14 bp, D. melanogaster
tatgtatacacata

SEQ ID NO: 644492 - DNA, 13 bp, D. melanogaster
tatgtatacataa

SEQ ID NO: 644493 - DNA, 13 bp, D. melanogaster
tatgtatacttat

SEQ ID NO: 644494 - DNA, 13 bp, D. melanogaster
tatgtatagaaaa

SEQ ID NO: 644495 - DNA, 13 bp, D. melanogaster
tatgtatagtata

SEQ ID NO: 644496 - DNA, 13 bp, D. melanogaster
tatgtatataacc

SEQ ID NO: 644497 - DNA, 14 bp, D. melanogaster
tatgtatataagta

SEQ ID NO: 644498 - DNA, 14 bp, D. melanogaster
tatgtatatacata

SEQ ID NO: 644499 - DNA, 13 bp, D. melanogaster
tatgtatatacgt

SEQ ID NO: 644500 - DNA, 13 bp, D. melanogaster
tatgtatatagaa

SEQ ID NO: 644501 - DNA, 13 bp, D. melanogaster
tatgtatatagca

SEQ ID NO: 644502 - DNA, 13 bp, D. melanogaster
tatgtatatagct

SEQ ID NO: 644503 - DNA, 13 bp, D. melanogaster
tatgtatatagtg

SEQ ID NO: 644504 - DNA, 13 bp, D. melanogaster
tatgtatatagtt

SEQ ID NO: 644505 - DNA, 13 bp, D. melanogaster
tatgtatatatag

SEQ ID NO: 644506 - DNA, 13 bp, D. melanogaster
tatgtatatatgg

SEQ ID NO: 644507 - DNA, 13 bp, D. melanogaster
tatgtatatatgt

SEQ ID NO: 644508 - DNA, 14 bp, D. melanogaster
tatgtatatatgta

SEQ ID NO: 644509 - DNA, 14 bp, D. melanogaster
tatgtatatatgtg

SEQ ID NO: 644510 - DNA, 13 bp, D. melanogaster
tatgtatatattc

SEQ ID NO: 644511 - DNA, 14 bp, D. melanogaster
tatgtatatatttc

SEQ ID NO: 644512 - DNA, 13 bp, D. melanogaster
tatgtatatccaa

SEQ ID NO: 644513 - DNA, 13 bp, D. melanogaster
tatgtatatctgt

SEQ ID NO: 644514 - DNA, 13 bp, D. melanogaster
tatgtatatctta

SEQ ID NO: 644515 - DNA, 13 bp, D. melanogaster
tatgtatatgaac

SEQ ID NO: 644516 - DNA, 13 bp, D. melanogaster
tatgtatatgcag

SEQ ID NO: 644517 - DNA, 13 bp, D. melanogaster
tatgtatatgcat

SEQ ID NO: 644518 - DNA, 14 bp, D. melanogaster
tatgtatatgcatg

SEQ ID NO: 644519 - DNA, 13 bp, D. melanogaster
tatgtatatgcga

SEQ ID NO: 644520 - DNA, 13 bp, D. melanogaster
tatgtatatggat

SEQ ID NO: 644521 - DNA, 13 bp, D. melanogaster
tatgtatatggca

SEQ ID NO: 644522 - DNA, 14 bp, D. melanogaster
tatgtatatgtaga

SEQ ID NO: 644523 - DNA, 14 bp, D. melanogaster
tatgtatatgtatg

SEQ ID NO: 644524 - DNA, 16 bp, D. melanogaster
tatgtatatgtatgtg

SEQ ID NO: 644525 - DNA, 14 bp, D. melanogaster
tatgtatatgtgtg

SEQ ID NO: 644526 - DNA, 14 bp, D. melanogaster
tatgtatatgtttg

SEQ ID NO: 644527 - DNA, 13 bp, D. melanogaster
tatgtatattctt

SEQ ID NO: 644528 - DNA, 14 bp, D. melanogaster
tatgtatattgttg

SEQ ID NO: 644529 - DNA, 13 bp, D. melanogaster
tatgtatatttct

SEQ ID NO: 644530 - DNA, 13 bp, D. melanogaster
tatgtatctcaaa

SEQ ID NO: 644531 - DNA, 13 bp, D. melanogaster
tatgtatcttaat

SEQ ID NO: 644532 - DNA, 13 bp, D. melanogaster
tatgtatcttgta

SEQ ID NO: 644533 - DNA, 13 bp, D. melanogaster
tatgtatgaacgt

SEQ ID NO: 644534 - DNA, 13 bp, D. melanogaster
tatgtatgaagtt

SEQ ID NO: 644535 - DNA, 13 bp, D. melanogaster
tatgtatgattga

SEQ ID NO: 644536 - DNA, 14 bp, D. melanogaster
tatgtatgattgaa

SEQ ID NO: 644537 - DNA, 13 bp, D. melanogaster
tatgtatgattta

SEQ ID NO: 644538 - DNA, 13 bp, D. melanogaster
tatgtatgcacat

SEQ ID NO: 644539 - DNA, 14 bp, D. melanogaster
tatgtatgcatatg

SEQ ID NO: 644540 - DNA, 14 bp, D. melanogaster
tatgtatgcatatt

SEQ ID NO: 644541 - DNA, 13 bp, D. melanogaster
tatgtatgcatga

SEQ ID NO: 644542 - DNA, 13 bp, D. melanogaster
tatgtatgcattt

SEQ ID NO: 644543 - DNA, 13 bp, D. melanogaster
tatgtatgcgtat

SEQ ID NO: 644544 - DNA, 13 bp, D. melanogaster
tatgtatgctatt

SEQ ID NO: 644545 - DNA, 13 bp, D. melanogaster
tatgtatgcttaa

SEQ ID NO: 644546 - DNA, 13 bp, D. melanogaster
tatgtatggcttg

SEQ ID NO: 644547 - DNA, 14 bp, D. melanogaster
tatgtatggtatgt

SEQ ID NO: 644548 - DNA, 13 bp, D. melanogaster
tatgtatgtaagc

SEQ ID NO: 644549 - DNA, 13 bp, D. melanogaster
tatgtatgtaagt

SEQ ID NO: 644550 - DNA, 13 bp, D. melanogaster
tatgtatgtacaa

SEQ ID NO: 644551 - DNA, 14 bp, D. melanogaster
tatgtatgtacaaa

SEQ ID NO: 644552 - DNA, 14 bp, D. melanogaster
tatgtatgtacaat

SEQ ID NO: 644553 - DNA, 13 bp, D. melanogaster
tatgtatgtacac

SEQ ID NO: 644554 - DNA, 14 bp, D. melanogaster
tatgtatgtacaca

SEQ ID NO: 644555 - DNA, 14 bp, D. melanogaster
tatgtatgtacatt

SEQ ID NO: 644556 - DNA, 13 bp, D. melanogaster
tatgtatgtacct

SEQ ID NO: 644557 - DNA, 13 bp, D. melanogaster
tatgtatgtacgt

SEQ ID NO: 644558 - DNA, 14 bp, D. melanogaster
tatgtatgtactta

SEQ ID NO: 644559 - DNA, 13 bp, D. melanogaster
tatgtatgtagct

SEQ ID NO: 644560 - DNA, 13 bp, D. melanogaster
tatgtatgtataa

SEQ ID NO: 644561 - DNA, 14 bp, D. melanogaster
tatgtatgtataat

SEQ ID NO: 644562 - DNA, 15 bp, D. melanogaster
tatgtatgtatatga

SEQ ID NO: 644563 - DNA, 13 bp, D. melanogaster
tatgtatgtatct

SEQ ID NO: 644564 - DNA, 13 bp, D. melanogaster
tatgtatgtatga

SEQ ID NO: 644565 - DNA, 14 bp, D. melanogaster
tatgtatgtatgcg

SEQ ID NO: 644566 - DNA, 13 bp, D. melanogaster
tatgtatgtatgt

SEQ ID NO: 644567 - DNA, 14 bp, D. melanogaster
tatgtatgtatgta

SEQ ID NO: 644568 - DNA, 14 bp, D. melanogaster
tatgtatgtatgtt

SEQ ID NO: 644569 - DNA, 14 bp, D. melanogaster
tatgtatgtattgt

SEQ ID NO: 644570 - DNA, 13 bp, D. melanogaster
tatgtatgtccat

SEQ ID NO: 644571 - DNA, 13 bp, D. melanogaster
tatgtatgtgaaa

SEQ ID NO: 644572 - DNA, 14 bp, D. melanogaster
tatgtatgtgcata

SEQ ID NO: 644573 - DNA, 13 bp, D. melanogaster
tatgtatgtgcct

SEQ ID NO: 644574 - DNA, 13 bp, D. melanogaster
tatgtatgtgcga

SEQ ID NO: 644575 - DNA, 13 bp, D. melanogaster
tatgtatgtgtgc

SEQ ID NO: 644576 - DNA, 14 bp, D. melanogaster
tatgtatgtgtgca

SEQ ID NO: 644577 - DNA, 14 bp, D. melanogaster
tatgtatgtgtgta

SEQ ID NO: 644578 - DNA, 13 bp, D. melanogaster
tatgtatgtttaa

SEQ ID NO: 644579 - DNA, 14 bp, D. melanogaster
tatgtatgtttaaa

SEQ ID NO: 644580 - DNA, 13 bp, D. melanogaster
tatgtatgttttc

SEQ ID NO: 644581 - DNA, 13 bp, D. melanogaster
tatgtattacatt

SEQ ID NO: 644582 - DNA, 13 bp, D. melanogaster
tatgtattcatta

SEQ ID NO: 644583 - DNA, 13 bp, D. melanogaster
tatgtattggtgt

SEQ ID NO: 644584 - DNA, 14 bp, D. melanogaster
tatgtattgtatgt

SEQ ID NO: 644585 - DNA, 13 bp, D. melanogaster
tatgtatttacca

SEQ ID NO: 644586 - DNA, 13 bp, D. melanogaster
tatgtatttcatt

SEQ ID NO: 644587 - DNA, 13 bp, D. melanogaster
tatgtattttcca

SEQ ID NO: 644588 - DNA, 13 bp, D. melanogaster
tatgtattttcta

SEQ ID NO: 644589 - DNA, 13 bp, D. melanogaster
tatgtcatatttt

SEQ ID NO: 644590 - DNA, 13 bp, D. melanogaster
tatgtcatccata

SEQ ID NO: 644591 - DNA, 13 bp, D. melanogaster
tatgtccgtctgt

SEQ ID NO: 644592 - DNA, 13 bp, D. melanogaster
tatgtgaaaataa

SEQ ID NO: 644593 - DNA, 13 bp, D. melanogaster
tatgtgaatatat

SEQ ID NO: 644594 - DNA, 13 bp, D. melanogaster
tatgtgaatatgt

SEQ ID NO: 644595 - DNA, 13 bp, D. melanogaster
tatgtgagcgaaa

SEQ ID NO: 644596 - DNA, 14 bp, D. melanogaster
tatgtgcatacata

SEQ ID NO: 644597 - DNA, 13 bp, D. melanogaster
tatgtgcatatat

SEQ ID NO: 644598 - DNA, 14 bp, D. melanogaster
tatgtgcatatata

SEQ ID NO: 644599 - DNA, 13 bp, D. melanogaster
tatgtgcatatta

SEQ ID NO: 644600 - DNA, 13 bp, D. melanogaster
tatgtgcatgtat

SEQ ID NO: 644601 - DNA, 13 bp, D. melanogaster
tatgtgcatgtgt

SEQ ID NO: 644602 - DNA, 13 bp, D. melanogaster
tatgtgccgcgaa

SEQ ID NO: 644603 - DNA, 13 bp, D. melanogaster
tatgtgcgacaaa

SEQ ID NO: 644604 - DNA, 13 bp, D. melanogaster
tatgtgcgtatgt

SEQ ID NO: 644605 - DNA, 13 bp, D. melanogaster
tatgtgctatatg

SEQ ID NO: 644606 - DNA, 14 bp, D. melanogaster
tatgtggaaaatat

SEQ ID NO: 644607 - DNA, 13 bp, D. melanogaster
tatgtggaaaatt

SEQ ID NO: 644608 - DNA, 13 bp, D. melanogaster
tatgtggatatgt

SEQ ID NO: 644609 - DNA, 13 bp, D. melanogaster
tatgtggcactgt

SEQ ID NO: 644610 - DNA, 13 bp, D. melanogaster
tatgtggcacttt

SEQ ID NO: 644611 - DNA, 13 bp, D. melanogaster
tatgtggctatat

SEQ ID NO: 644612 - DNA, 13 bp, D. melanogaster
tatgtggttatgt

SEQ ID NO: 644613 - DNA, 13 bp, D. melanogaster
tatgtgtaaatat

SEQ ID NO: 644614 - DNA, 14 bp, D. melanogaster
tatgtgtaaatata

SEQ ID NO: 644615 - DNA, 13 bp, D. melanogaster
tatgtgtacacac

SEQ ID NO: 644616 - DNA, 13 bp, D. melanogaster
tatgtgtacataa

SEQ ID NO: 644617 - DNA, 13 bp, D. melanogaster
tatgtgtataata

SEQ ID NO: 644618 - DNA, 13 bp, D. melanogaster
tatgtgtatacat

SEQ ID NO: 644619 - DNA, 14 bp, D. melanogaster
tatgtgtatacata

SEQ ID NO: 644620 - DNA, 13 bp, D. melanogaster
tatgtgtatatag

SEQ ID NO: 644621 - DNA, 13 bp, D. melanogaster
tatgtgtatatat

SEQ ID NO: 644622 - DNA, 14 bp, D. melanogaster
tatgtgtatatata

SEQ ID NO: 644623 - DNA, 13 bp, D. melanogaster
tatgtgtatgtac

SEQ ID NO: 644624 - DNA, 13 bp, D. melanogaster
tatgtgtatgtgc

SEQ ID NO: 644625 - DNA, 13 bp, D. melanogaster
tatgtgtatgtgt

SEQ ID NO: 644626 - DNA, 14 bp, D. melanogaster
tatgtgtatgtgtg

SEQ ID NO: 644627 - DNA, 13 bp, D. melanogaster
tatgtgtattaaa

SEQ ID NO: 644628 - DNA, 13 bp, D. melanogaster
tatgtgtgcatat

SEQ ID NO: 644629 - DNA, 13 bp, D. melanogaster
tatgtgtgcgtgc

SEQ ID NO: 644630 - DNA, 13 bp, D. melanogaster
tatgtgtgcgttt

SEQ ID NO: 644631 - DNA, 14 bp, D. melanogaster
tatgtgtgctcttt

SEQ ID NO: 644632 - DNA, 13 bp, D. melanogaster
tatgtgtgggtgc

SEQ ID NO: 644633 - DNA, 13 bp, D. melanogaster
tatgtgtgtaaat

SEQ ID NO: 644634 - DNA, 14 bp, D. melanogaster
tatgtgtgtacata

SEQ ID NO: 644635 - DNA, 13 bp, D. melanogaster
tatgtgtgtatat

SEQ ID NO: 644636 - DNA, 13 bp, D. melanogaster
tatgtgtgtatgt

SEQ ID NO: 644637 - DNA, 13 bp, D. melanogaster
tatgtgtgtgcac

SEQ ID NO: 644638 - DNA, 13 bp, D. melanogaster
tatgtgtgtgcat

SEQ ID NO: 644639 - DNA, 13 bp, D. melanogaster
tatgtgtgtgcgc

SEQ ID NO: 644640 - DNA, 14 bp, D. melanogaster
tatgtgtgtgtgta

SEQ ID NO: 644641 - DNA, 13 bp, D. melanogaster
tatgtgtgtttaa

SEQ ID NO: 644642 - DNA, 13 bp, D. melanogaster
tatgtgttctttc

SEQ ID NO: 644643 - DNA, 14 bp, D. melanogaster
tatgtgttgtctgt

SEQ ID NO: 644644 - DNA, 13 bp, D. melanogaster
tatgtgtttgaaa

SEQ ID NO: 644645 - DNA, 13 bp, D. melanogaster
tatgtgtttgctt

SEQ ID NO: 644646 - DNA, 13 bp, D. melanogaster
tatgttaaaaaag

SEQ ID NO: 644647 - DNA, 13 bp, D. melanogaster
tatgttatacata

SEQ ID NO: 644648 - DNA, 13 bp, D. melanogaster
tatgttatgtatg

SEQ ID NO: 644649 - DNA, 14 bp, D. melanogaster
tatgttatgttatg

SEQ ID NO: 644650 - DNA, 13 bp, D. melanogaster
tatgttcaaaata

SEQ ID NO: 644651 - DNA, 13 bp, D. melanogaster
tatgttcgtatat

SEQ ID NO: 644652 - DNA, 13 bp, D. melanogaster
tatgttcgttttc

SEQ ID NO: 644653 - DNA, 14 bp, D. melanogaster
tatgttctgttttg

SEQ ID NO: 644654 - DNA, 13 bp, D. melanogaster
tatgttcttcagt

SEQ ID NO: 644655 - DNA, 13 bp, D. melanogaster
tatgttgaaaatg

SEQ ID NO: 644656 - DNA, 13 bp, D. melanogaster
tatgttgctatta

SEQ ID NO: 644657 - DNA, 13 bp, D. melanogaster
tatgttgtatata

SEQ ID NO: 644658 - DNA, 13 bp, D. melanogaster
tatgtttaaagaa

SEQ ID NO: 644659 - DNA, 13 bp, D. melanogaster
tatgtttaacaac

SEQ ID NO: 644660 - DNA, 14 bp, D. melanogaster
tatgtttaacaaca

SEQ ID NO: 644661 - DNA, 13 bp, D. melanogaster
tatgtttaacttt

SEQ ID NO: 644662 - DNA, 13 bp, D. melanogaster
tatgtttaattct

SEQ ID NO: 644663 - DNA, 13 bp, D. melanogaster
tatgtttacacaa

SEQ ID NO: 644664 - DNA, 13 bp, D. melanogaster
tatgtttactcta

SEQ ID NO: 644665 - DNA, 13 bp, D. melanogaster
tatgtttataagg

SEQ ID NO: 644666 - DNA, 13 bp, D. melanogaster
tatgtttatgaaa

SEQ ID NO: 644667 - DNA, 13 bp, D. melanogaster
tatgtttcatata

SEQ ID NO: 644668 - DNA, 13 bp, D. melanogaster
tatgtttgccatt

SEQ ID NO: 644669 - DNA, 13 bp, D. melanogaster
tatgtttgtacat

SEQ ID NO: 644670 - DNA, 14 bp, D. melanogaster
tatgtttgtatgta

SEQ ID NO: 644671 - DNA, 13 bp, D. melanogaster
tatgttttacatt

SEQ ID NO: 644672 - DNA, 13 bp, D. melanogaster
tatgttttgccaa

SEQ ID NO: 644673 - DNA, 13 bp, D. melanogaster
tatgttttgtaac

SEQ ID NO: 644674 - DNA, 13 bp, D. melanogaster
tatgttttgtatc

SEQ ID NO: 644675 - DNA, 13 bp, D. melanogaster
tatgtttttaaac

SEQ ID NO: 644676 - DNA, 13 bp, D. melanogaster
tatgtttttgaaa

SEQ ID NO: 644677 - DNA, 13 bp, D. melanogaster
tattaaaaaacga

SEQ ID NO: 644678 - DNA, 13 bp, D. melanogaster
tattaaaaaactg

SEQ ID NO: 644679 - DNA, 13 bp, D. melanogaster
tattaaaaatggt

SEQ ID NO: 644680 - DNA, 13 bp, D. melanogaster
tattaaaaattcc

SEQ ID NO: 644681 - DNA, 13 bp, D. melanogaster
tattaaaactgtt

SEQ ID NO: 644682 - DNA, 13 bp, D. melanogaster
tattaaaagtcac

SEQ ID NO: 644683 - DNA, 13 bp, D. melanogaster
tattaaaagttac

SEQ ID NO: 644684 - DNA, 13 bp, D. melanogaster
tattaaaagttct

SEQ ID NO: 644685 - DNA, 13 bp, D. melanogaster
tattaaaatcacc

SEQ ID NO: 644686 - DNA, 13 bp, D. melanogaster
tattaaaatcggg

SEQ ID NO: 644687 - DNA, 13 bp, D. melanogaster
tattaaaatggaa

SEQ ID NO: 644688 - DNA, 13 bp, D. melanogaster
tattaaacaagaa

SEQ ID NO: 644689 - DNA, 13 bp, D. melanogaster
tattaaacatttg

SEQ ID NO: 644690 - DNA, 13 bp, D. melanogaster
tattaaaccattt

SEQ ID NO: 644691 - DNA, 13 bp, D. melanogaster
tattaaacgaaat

SEQ ID NO: 644692 - DNA, 13 bp, D. melanogaster
tattaaacggaaa

SEQ ID NO: 644693 - DNA, 13 bp, D. melanogaster
tattaaagcaata

SEQ ID NO: 644694 - DNA, 13 bp, D. melanogaster
tattaaagcgaaa

SEQ ID NO: 644695 - DNA, 13 bp, D. melanogaster
tattaaagtgcaa

SEQ ID NO: 644696 - DNA, 14 bp, D. melanogaster
tattaaagttaaag

SEQ ID NO: 644697 - DNA, 13 bp, D. melanogaster
tattaaatacaga

SEQ ID NO: 644698 - DNA, 14 bp, D. melanogaster
tattaaatacgttt

SEQ ID NO: 644699 - DNA, 14 bp, D. melanogaster
tattaaatcatttg

SEQ ID NO: 644700 - DNA, 13 bp, D. melanogaster
tattaaatgcaaa

SEQ ID NO: 644701 - DNA, 14 bp, D. melanogaster
tattaaatgcaatt

SEQ ID NO: 644702 - DNA, 13 bp, D. melanogaster
tattaaatgcttt

SEQ ID NO: 644703 - DNA, 13 bp, D. melanogaster
tattaaatttctg

SEQ ID NO: 644704 - DNA, 13 bp, D. melanogaster
tattaaatttgtg

SEQ ID NO: 644705 - DNA, 13 bp, D. melanogaster
tattaacaaattg

SEQ ID NO: 644706 - DNA, 13 bp, D. melanogaster
tattaacaattgt

SEQ ID NO: 644707 - DNA, 13 bp, D. melanogaster
tattaacaatttc

SEQ ID NO: 644708 - DNA, 14 bp, D. melanogaster
tattaactacatca

SEQ ID NO: 644709 - DNA, 13 bp, D. melanogaster
tattaagcaattt

SEQ ID NO: 644710 - DNA, 13 bp, D. melanogaster
tattaagcatacg

SEQ ID NO: 644711 - DNA, 13 bp, D. melanogaster
tattaagcttaat

SEQ ID NO: 644712 - DNA, 13 bp, D. melanogaster
tattaagtaaatg

SEQ ID NO: 644713 - DNA, 13 bp, D. melanogaster
tattaagtactta

SEQ ID NO: 644714 - DNA, 13 bp, D. melanogaster
tattaagtattca

SEQ ID NO: 644715 - DNA, 13 bp, D. melanogaster
tattaagtcaaat

SEQ ID NO: 644716 - DNA, 14 bp, D. melanogaster
tattaagtcaaatg

SEQ ID NO: 644717 - DNA, 13 bp, D. melanogaster
tattaagtgattt

SEQ ID NO: 644718 - DNA, 13 bp, D. melanogaster
tattaagttttct

SEQ ID NO: 644719 - DNA, 13 bp, D. melanogaster
tattaataaaacc

SEQ ID NO: 644720 - DNA, 13 bp, D. melanogaster
tattaatagctta

SEQ ID NO: 644721 - DNA, 13 bp, D. melanogaster
tattaatatgcaa

SEQ ID NO: 644722 - DNA, 13 bp, D. melanogaster
tattaatcatatc

SEQ ID NO: 644723 - DNA, 13 bp, D. melanogaster
tattaatgcaatt

SEQ ID NO: 644724 - DNA, 13 bp, D. melanogaster
tattaatgccatt

SEQ ID NO: 644725 - DNA, 14 bp, D. melanogaster
tattaatgtgtttg

SEQ ID NO: 644726 - DNA, 13 bp, D. melanogaster
tattaattggcaa

SEQ ID NO: 644727 - DNA, 13 bp, D. melanogaster
tattaatttggcc

SEQ ID NO: 644728 - DNA, 13 bp, D. melanogaster
tattaatttgtca

SEQ ID NO: 644729 - DNA, 14 bp, D. melanogaster
tattacaaaatatg

SEQ ID NO: 644730 - DNA, 13 bp, D. melanogaster
tattacaacattt

SEQ ID NO: 644731 - DNA, 13 bp, D. melanogaster
tattacaattttc

SEQ ID NO: 644732 - DNA, 13 bp, D. melanogaster
tattacacaattt

SEQ ID NO: 644733 - DNA, 14 bp, D. melanogaster
tattacactttaca

SEQ ID NO: 644734 - DNA, 13 bp, D. melanogaster
tattacagaagat

SEQ ID NO: 644735 - DNA, 13 bp, D. melanogaster
tattacagcattt

SEQ ID NO: 644736 - DNA, 13 bp, D. melanogaster
tattacatacata

SEQ ID NO: 644737 - DNA, 13 bp, D. melanogaster
tattacatatatg

SEQ ID NO: 644738 - DNA, 13 bp, D. melanogaster
tattacatttttg

SEQ ID NO: 644739 - DNA, 13 bp, D. melanogaster
tattaccaaagaa

SEQ ID NO: 644740 - DNA, 13 bp, D. melanogaster
tattaccaataaa

SEQ ID NO: 644741 - DNA, 13 bp, D. melanogaster
tattaccaatttt

SEQ ID NO: 644742 - DNA, 13 bp, D. melanogaster
tattacctctttg

SEQ ID NO: 644743 - DNA, 13 bp, D. melanogaster
tattacgagcaac

SEQ ID NO: 644744 - DNA, 13 bp, D. melanogaster
tattacgatatct

SEQ ID NO: 644745 - DNA, 13 bp, D. melanogaster
tattacgctactt

SEQ ID NO: 644746 - DNA, 13 bp, D. melanogaster
tattacgtcattt

SEQ ID NO: 644747 - DNA, 13 bp, D. melanogaster
tattacgttattt

SEQ ID NO: 644748 - DNA, 13 bp, D. melanogaster
tattacgttttat

SEQ ID NO: 644749 - DNA, 14 bp, D. melanogaster
tattacgttttata

SEQ ID NO: 644750 - DNA, 13 bp, D. melanogaster
tattactaatctc

SEQ ID NO: 644751 - DNA, 13 bp, D. melanogaster
tattactattact

SEQ ID NO: 644752 - DNA, 14 bp, D. melanogaster
tattactattacta

SEQ ID NO: 644753 - DNA, 13 bp, D. melanogaster
tattactttcgcc

SEQ ID NO: 644754 - DNA, 14 bp, D. melanogaster
tattacttttgcaa

SEQ ID NO: 644755 - DNA, 13 bp, D. melanogaster
tattagaggcaac

SEQ ID NO: 644756 - DNA, 13 bp, D. melanogaster
tattagataaacg

SEQ ID NO: 644757 - DNA, 13 bp, D. melanogaster
tattagcaaataa

SEQ ID NO: 644758 - DNA, 13 bp, D. melanogaster
tattagcatttat

SEQ ID NO: 644759 - DNA, 13 bp, D. melanogaster
tattagccaagtt

SEQ ID NO: 644760 - DNA, 13 bp, D. melanogaster
tattagtagaaca

SEQ ID NO: 644761 - DNA, 13 bp, D. melanogaster
tattagtcttgta

SEQ ID NO: 644762 - DNA, 13 bp, D. melanogaster
tattagtgcaata

SEQ ID NO: 644763 - DNA, 14 bp, D. melanogaster
tattagtgcaataa

SEQ ID NO: 644764 - DNA, 13 bp, D. melanogaster
tattataaaatgg

SEQ ID NO: 644765 - DNA, 13 bp, D. melanogaster
tattatacattca

SEQ ID NO: 644766 - DNA, 13 bp, D. melanogaster
tattatacctggt

SEQ ID NO: 644767 - DNA, 13 bp, D. melanogaster
tattatacgtata

SEQ ID NO: 644768 - DNA, 13 bp, D. melanogaster
tattatatacgaa

SEQ ID NO: 644769 - DNA, 15 bp, D. melanogaster
tattatatacgaaca

SEQ ID NO: 644770 - DNA, 13 bp, D. melanogaster
tattatatacttg

SEQ ID NO: 644771 - DNA, 14 bp, D. melanogaster
tattatatacttga

SEQ ID NO: 644772 - DNA, 14 bp, D. melanogaster
tattatatatgtac

SEQ ID NO: 644773 - DNA, 13 bp, D. melanogaster
tattatatcatct

SEQ ID NO: 644774 - DNA, 13 bp, D. melanogaster
tattatatgtgac

SEQ ID NO: 644775 - DNA, 13 bp, D. melanogaster
tattatattcaga

SEQ ID NO: 644776 - DNA, 13 bp, D. melanogaster
tattatcaacaaa

SEQ ID NO: 644777 - DNA, 13 bp, D. melanogaster
tattatcaatcaa

SEQ ID NO: 644778 - DNA, 13 bp, D. melanogaster
tattatcacaaaa

SEQ ID NO: 644779 - DNA, 13 bp, D. melanogaster
tattatcagtgtt

SEQ ID NO: 644780 - DNA, 13 bp, D. melanogaster
tattatcattatc

SEQ ID NO: 644781 - DNA, 13 bp, D. melanogaster
tattatccagttt

SEQ ID NO: 644782 - DNA, 13 bp, D. melanogaster
tattatcgaaaat

SEQ ID NO: 644783 - DNA, 13 bp, D. melanogaster
tattatctgagtg

SEQ ID NO: 644784 - DNA, 13 bp, D. melanogaster
tattatcttgtta

SEQ ID NO: 644785 - DNA, 13 bp, D. melanogaster
tattatgaaaatg

SEQ ID NO: 644786 - DNA, 13 bp, D. melanogaster
tattatgatttca

SEQ ID NO: 644787 - DNA, 13 bp, D. melanogaster
tattatgcacaaa

SEQ ID NO: 644788 - DNA, 13 bp, D. melanogaster
tattatgcgaata

SEQ ID NO: 644789 - DNA, 13 bp, D. melanogaster
tattatgcgtgtt

SEQ ID NO: 644790 - DNA, 13 bp, D. melanogaster
tattatgtacata

SEQ ID NO: 644791 - DNA, 14 bp, D. melanogaster
tattatgtacatat

SEQ ID NO: 644792 - DNA, 13 bp, D. melanogaster
tattatgtactta

SEQ ID NO: 644793 - DNA, 13 bp, D. melanogaster
tattatgtatgta

SEQ ID NO: 644794 - DNA, 13 bp, D. melanogaster
tattattaaagca

SEQ ID NO: 644795 - DNA, 13 bp, D. melanogaster
tattattaaatgg

SEQ ID NO: 644796 - DNA, 13 bp, D. melanogaster
tattattaagtca

SEQ ID NO: 644797 - DNA, 13 bp, D. melanogaster
tattattactttg

SEQ ID NO: 644798 - DNA, 13 bp, D. melanogaster
tattattagcatt

SEQ ID NO: 644799 - DNA, 13 bp, D. melanogaster
tattattagtcat

SEQ ID NO: 644800 - DNA, 13 bp, D. melanogaster
tattattataacc

SEQ ID NO: 644801 - DNA, 13 bp, D. melanogaster
tattattatgcca

SEQ ID NO: 644802 - DNA, 13 bp, D. melanogaster
tattattatgtgc

SEQ ID NO: 644803 - DNA, 14 bp, D. melanogaster
tattattattatcg

SEQ ID NO: 644804 - DNA, 13 bp, D. melanogaster
tattattattcca

SEQ ID NO: 644805 - DNA, 13 bp, D. melanogaster
tattattcatgca

SEQ ID NO: 644806 - DNA, 13 bp, D. melanogaster
tattattcgaatt

SEQ ID NO: 644807 - DNA, 13 bp, D. melanogaster
tattattgaaatg

SEQ ID NO: 644808 - DNA, 13 bp, D. melanogaster
tattattgaattg

SEQ ID NO: 644809 - DNA, 13 bp, D. melanogaster
tattattgatttc

SEQ ID NO: 644810 - DNA, 13 bp, D. melanogaster
tattattgcaaat

SEQ ID NO: 644811 - DNA, 13 bp, D. melanogaster
tattattgcaatt

SEQ ID NO: 644812 - DNA, 14 bp, D. melanogaster
tattattgcaattt

SEQ ID NO: 644813 - DNA, 14 bp, D. melanogaster
tattattgctatta

SEQ ID NO: 644814 - DNA, 13 bp, D. melanogaster
tattattgctgtt

SEQ ID NO: 644815 - DNA, 13 bp, D. melanogaster
tattattggaaat

SEQ ID NO: 644816 - DNA, 14 bp, D. melanogaster
tattattgtacttt

SEQ ID NO: 644817 - DNA, 13 bp, D. melanogaster
tattatttacact

SEQ ID NO: 644818 - DNA, 13 bp, D. melanogaster
tattatttaccat

SEQ ID NO: 644819 - DNA, 13 bp, D. melanogaster
tattatttacgaa

SEQ ID NO: 644820 - DNA, 14 bp, D. melanogaster
tattatttatgcat

SEQ ID NO: 644821 - DNA, 13 bp, D. melanogaster
tattatttccact

SEQ ID NO: 644822 - DNA, 13 bp, D. melanogaster
tattatttcgttc

SEQ ID NO: 644823 - DNA, 13 bp, D. melanogaster
tattatttctatg

SEQ ID NO: 644824 - DNA, 13 bp, D. melanogaster
tattatttgcata

SEQ ID NO: 644825 - DNA, 13 bp, D. melanogaster
tattatttgctaa

SEQ ID NO: 644826 - DNA, 13 bp, D. melanogaster
tattatttgctta

SEQ ID NO: 644827 - DNA, 14 bp, D. melanogaster
tattatttgcttaa

SEQ ID NO: 644828 - DNA, 13 bp, D. melanogaster
tattatttggaaa

SEQ ID NO: 644829 - DNA, 13 bp, D. melanogaster
tattattttgacc

SEQ ID NO: 644830 - DNA, 13 bp, D. melanogaster
tattattttgctg

SEQ ID NO: 644831 - DNA, 13 bp, D. melanogaster
tattattttggcc

SEQ ID NO: 644832 - DNA, 14 bp, D. melanogaster
tattatttttaagc

SEQ ID NO: 644833 - DNA, 13 bp, D. melanogaster
tattatttttcag

SEQ ID NO: 644834 - DNA, 14 bp, D. melanogaster
tattatttttgatc

SEQ ID NO: 644835 - DNA, 13 bp, D. melanogaster
tattcaaaaacat

SEQ ID NO: 644836 - DNA, 13 bp, D. melanogaster
tattcaaaaccca

SEQ ID NO: 644837 - DNA, 13 bp, D. melanogaster
tattcaaaacttg

SEQ ID NO: 644838 - DNA, 13 bp, D. melanogaster
tattcaaaagatt

SEQ ID NO: 644839 - DNA, 13 bp, D. melanogaster
tattcaaaataga

SEQ ID NO: 644840 - DNA, 13 bp, D. melanogaster
tattcaaaatgaa

SEQ ID NO: 644841 - DNA, 13 bp, D. melanogaster
tattcaaaatgac

SEQ ID NO: 644842 - DNA, 13 bp, D. melanogaster
tattcaaaatgtt

SEQ ID NO: 644843 - DNA, 13 bp, D. melanogaster
tattcaaaattca

SEQ ID NO: 644844 - DNA, 13 bp, D. melanogaster
tattcaaacggga

SEQ ID NO: 644845 - DNA, 13 bp, D. melanogaster
tattcaaactgaa

SEQ ID NO: 644846 - DNA, 13 bp, D. melanogaster
tattcaaagaaaa

SEQ ID NO: 644847 - DNA, 13 bp, D. melanogaster
tattcaaagaaat

SEQ ID NO: 644848 - DNA, 13 bp, D. melanogaster
tattcaaaggaaa

SEQ ID NO: 644849 - DNA, 13 bp, D. melanogaster
tattcaaaggcct

SEQ ID NO: 644850 - DNA, 13 bp, D. melanogaster
tattcaaagtttt

SEQ ID NO: 644851 - DNA, 13 bp, D. melanogaster
tattcaaatagtt

SEQ ID NO: 644852 - DNA, 13 bp, D. melanogaster
tattcaaatattc

SEQ ID NO: 644853 - DNA, 13 bp, D. melanogaster
tattcaaatcaaa

SEQ ID NO: 644854 - DNA, 13 bp, D. melanogaster
tattcaaatcatt

SEQ ID NO: 644855 - DNA, 13 bp, D. melanogaster
tattcaaatgatt

SEQ ID NO: 644856 - DNA, 13 bp, D. melanogaster
tattcaaattatg

SEQ ID NO: 644857 - DNA, 13 bp, D. melanogaster
tattcaaattcaa

SEQ ID NO: 644858 - DNA, 13 bp, D. melanogaster
tattcaaattcat

SEQ ID NO: 644859 - DNA, 13 bp, D. melanogaster
tattcaaattcta

SEQ ID NO: 644860 - DNA, 13 bp, D. melanogaster
tattcaaattgaa

SEQ ID NO: 644861 - DNA, 13 bp, D. melanogaster
tattcaaattgat

SEQ ID NO: 644862 - DNA, 13 bp, D. melanogaster
tattcaaattgtt

SEQ ID NO: 644863 - DNA, 14 bp, D. melanogaster
tattcaaatttgaa

SEQ ID NO: 644864 - DNA, 13 bp, D. melanogaster
tattcaacaattt

SEQ ID NO: 644865 - DNA, 14 bp, D. melanogaster
tattcaacaatttt

SEQ ID NO: 644866 - DNA, 13 bp, D. melanogaster
tattcaaccaaaa

SEQ ID NO: 644867 - DNA, 13 bp, D. melanogaster
tattcaaccaaac

SEQ ID NO: 644868 - DNA, 13 bp, D. melanogaster
tattcaactattt

SEQ ID NO: 644869 - DNA, 13 bp, D. melanogaster
tattcaagaagat

SEQ ID NO: 644870 - DNA, 13 bp, D. melanogaster
tattcaagaattt

SEQ ID NO: 644871 - DNA, 13 bp, D. melanogaster
tattcaagttaaa

SEQ ID NO: 644872 - DNA, 13 bp, D. melanogaster
tattcaagttgcc

SEQ ID NO: 644873 - DNA, 14 bp, D. melanogaster
tattcaatatctat

SEQ ID NO: 644874 - DNA, 13 bp, D. melanogaster
tattcaatcgttc

SEQ ID NO: 644875 - DNA, 13 bp, D. melanogaster
tattcaatgatat

SEQ ID NO: 644876 - DNA, 13 bp, D. melanogaster
tattcaattaact

SEQ ID NO: 644877 - DNA, 13 bp, D. melanogaster
tattcaattgaaa

SEQ ID NO: 644878 - DNA, 13 bp, D. melanogaster
tattcaattggaa

SEQ ID NO: 644879 - DNA, 13 bp, D. melanogaster
tattcaatttcat

SEQ ID NO: 644880 - DNA, 13 bp, D. melanogaster
tattcaatttgaa

SEQ ID NO: 644881 - DNA, 13 bp, D. melanogaster
tattcaattttga

SEQ ID NO: 644882 - DNA, 13 bp, D. melanogaster
tattcacaaattg

SEQ ID NO: 644883 - DNA, 13 bp, D. melanogaster
tattcacacaaat

SEQ ID NO: 644884 - DNA, 13 bp, D. melanogaster
tattcacatattt

SEQ ID NO: 644885 - DNA, 13 bp, D. melanogaster
tattcacatttgt

SEQ ID NO: 644886 - DNA, 13 bp, D. melanogaster
tattcaccaatat

SEQ ID NO: 644887 - DNA, 13 bp, D. melanogaster
tattcacttaatt

SEQ ID NO: 644888 - DNA, 13 bp, D. melanogaster
tattcagaaatat

SEQ ID NO: 644889 - DNA, 13 bp, D. melanogaster
tattcagacaatt

SEQ ID NO: 644890 - DNA, 13 bp, D. melanogaster
tattcagatttat

SEQ ID NO: 644891 - DNA, 14 bp, D. melanogaster
tattcagggtatta

SEQ ID NO: 644892 - DNA, 13 bp, D. melanogaster
tattcagtattta

SEQ ID NO: 644893 - DNA, 13 bp, D. melanogaster
tattcagtttgtt

SEQ ID NO: 644894 - DNA, 13 bp, D. melanogaster
tattcagttttat

SEQ ID NO: 644895 - DNA, 13 bp, D. melanogaster
tattcataaaatg

SEQ ID NO: 644896 - DNA, 14 bp, D. melanogaster
tattcatatgtata

SEQ ID NO: 644897 - DNA, 13 bp, D. melanogaster
tattcatatgttt

SEQ ID NO: 644898 - DNA, 13 bp, D. melanogaster
tattcatattcat

SEQ ID NO: 644899 - DNA, 13 bp, D. melanogaster
tattcatcatttg

SEQ ID NO: 644900 - DNA, 14 bp, D. melanogaster
tattcattatgaaa

SEQ ID NO: 644901 - DNA, 13 bp, D. melanogaster
tattcattcagtt

SEQ ID NO: 644902 - DNA, 13 bp, D. melanogaster
tattcattgaaat

SEQ ID NO: 644903 - DNA, 13 bp, D. melanogaster
tattcattgaatg

SEQ ID NO: 644904 - DNA, 13 bp, D. melanogaster
tattcatttaaca

SEQ ID NO: 644905 - DNA, 13 bp, D. melanogaster
tattcatttacaa

SEQ ID NO: 644906 - DNA, 13 bp, D. melanogaster
tattcatttcaag

SEQ ID NO: 644907 - DNA, 13 bp, D. melanogaster
tattcatttgatt

SEQ ID NO: 644908 - DNA, 13 bp, D. melanogaster
tattcatttgctg

SEQ ID NO: 644909 - DNA, 13 bp, D. melanogaster
tattcattttgta

SEQ ID NO: 644910 - DNA, 13 bp, D. melanogaster
tattccaaaaata

SEQ ID NO: 644911 - DNA, 13 bp, D. melanogaster
tattccaaaatat

SEQ ID NO: 644912 - DNA, 13 bp, D. melanogaster
tattccaaattac

SEQ ID NO: 644913 - DNA, 13 bp, D. melanogaster
tattccaaattgt

SEQ ID NO: 644914 - DNA, 13 bp, D. melanogaster
tattccaacaaat

SEQ ID NO: 644915 - DNA, 13 bp, D. melanogaster
tattccaacacca

SEQ ID NO: 644916 - DNA, 13 bp, D. melanogaster
tattccacttatt

SEQ ID NO: 644917 - DNA, 13 bp, D. melanogaster
tattccagagaaa

SEQ ID NO: 644918 - DNA, 13 bp, D. melanogaster
tattccagtgcct

SEQ ID NO: 644919 - DNA, 13 bp, D. melanogaster
tattccattaaaa

SEQ ID NO: 644920 - DNA, 13 bp, D. melanogaster
tattccatttgaa

SEQ ID NO: 644921 - DNA, 13 bp, D. melanogaster
tattcccaaaaag

SEQ ID NO: 644922 - DNA, 13 bp, D. melanogaster
tattccccaatat

SEQ ID NO: 644923 - DNA, 13 bp, D. melanogaster
tattccctgcatt

SEQ ID NO: 644924 - DNA, 14 bp, D. melanogaster
tattccgattattc

SEQ ID NO: 644925 - DNA, 15 bp, D. melanogaster
tattccggtgccaat

SEQ ID NO: 644926 - DNA, 13 bp, D. melanogaster
tattccgtattcc

SEQ ID NO: 644927 - DNA, 14 bp, D. melanogaster
tattccgtattccg

SEQ ID NO: 644928 - DNA, 13 bp, D. melanogaster
tattcctatatat

SEQ ID NO: 644929 - DNA, 13 bp, D. melanogaster
tattcctatcata

SEQ ID NO: 644930 - DNA, 13 bp, D. melanogaster
tattcctattcct

SEQ ID NO: 644931 - DNA, 13 bp, D. melanogaster
tattcctgtattt

SEQ ID NO: 644932 - DNA, 13 bp, D. melanogaster
tattccttaaata

SEQ ID NO: 644933 - DNA, 13 bp, D. melanogaster
tattccttctctg

SEQ ID NO: 644934 - DNA, 13 bp, D. melanogaster
tattccttttaaa

SEQ ID NO: 644935 - DNA, 13 bp, D. melanogaster
tattcgaaaattt

SEQ ID NO: 644936 - DNA, 13 bp, D. melanogaster
tattcgaaacaat

SEQ ID NO: 644937 - DNA, 13 bp, D. melanogaster
tattcgaatatat

SEQ ID NO: 644938 - DNA, 13 bp, D. melanogaster
tattcgaattaaa

SEQ ID NO: 644939 - DNA, 13 bp, D. melanogaster
tattcgagtattt

SEQ ID NO: 644940 - DNA, 13 bp, D. melanogaster
tattcgataaaaa

SEQ ID NO: 644941 - DNA, 13 bp, D. melanogaster
tattcgattcgat

SEQ ID NO: 644942 - DNA, 13 bp, D. melanogaster
tattcgatttatt

SEQ ID NO: 644943 - DNA, 13 bp, D. melanogaster
tattcgatttcat

SEQ ID NO: 644944 - DNA, 13 bp, D. melanogaster
tattcgatttgtt

SEQ ID NO: 644945 - DNA, 13 bp, D. melanogaster
tattcgattttat

SEQ ID NO: 644946 - DNA, 13 bp, D. melanogaster
tattcgcataata

SEQ ID NO: 644947 - DNA, 13 bp, D. melanogaster
tattcgcattcgc

SEQ ID NO: 644948 - DNA, 14 bp, D. melanogaster
tattcgcattcgca

SEQ ID NO: 644949 - DNA, 13 bp, D. melanogaster
tattcgcttaatc

SEQ ID NO: 644950 - DNA, 14 bp, D. melanogaster
tattcggtaactcc

SEQ ID NO: 644951 - DNA, 13 bp, D. melanogaster
tattcgtagtttt

SEQ ID NO: 644952 - DNA, 13 bp, D. melanogaster
tattcgtattatt

SEQ ID NO: 644953 - DNA, 13 bp, D. melanogaster
tattcgtattcgc

SEQ ID NO: 644954 - DNA, 13 bp, D. melanogaster
tattcgtatttat

SEQ ID NO: 644955 - DNA, 13 bp, D. melanogaster
tattcgtgttcat

SEQ ID NO: 644956 - DNA, 13 bp, D. melanogaster
tattctaatcaaa

SEQ ID NO: 644957 - DNA, 13 bp, D. melanogaster
tattctacaaaag

SEQ ID NO: 644958 - DNA, 13 bp, D. melanogaster
tattctactacta

SEQ ID NO: 644959 - DNA, 14 bp, D. melanogaster
tattctagttaatt

SEQ ID NO: 644960 - DNA, 13 bp, D. melanogaster
tattctattctcc

SEQ ID NO: 644961 - DNA, 14 bp, D. melanogaster
tattctcaaagaga

SEQ ID NO: 644962 - DNA, 13 bp, D. melanogaster
tattctcccaaaa

SEQ ID NO: 644963 - DNA, 13 bp, D. melanogaster
tattctccgcttc

SEQ ID NO: 644964 - DNA, 13 bp, D. melanogaster
tattctctgcttt

SEQ ID NO: 644965 - DNA, 13 bp, D. melanogaster
tattctgaacttg

SEQ ID NO: 644966 - DNA, 13 bp, D. melanogaster
tattctgggaatt

SEQ ID NO: 644967 - DNA, 13 bp, D. melanogaster
tattctgtaaact

SEQ ID NO: 644968 - DNA, 13 bp, D. melanogaster
tattcttcaagct

SEQ ID NO: 644969 - DNA, 13 bp, D. melanogaster
tattcttcacatc

SEQ ID NO: 644970 - DNA, 13 bp, D. melanogaster
tattcttttgaaa

SEQ ID NO: 644971 - DNA, 13 bp, D. melanogaster
tattgaaaaacaa

SEQ ID NO: 644972 - DNA, 14 bp, D. melanogaster
tattgaaaaacttt

SEQ ID NO: 644973 - DNA, 13 bp, D. melanogaster
tattgaaaaagtt

SEQ ID NO: 644974 - DNA, 13 bp, D. melanogaster
tattgaaaacaaa

SEQ ID NO: 644975 - DNA, 14 bp, D. melanogaster
tattgaaaacaaaa

SEQ ID NO: 644976 - DNA, 13 bp, D. melanogaster
tattgaaaaccaa

SEQ ID NO: 644977 - DNA, 13 bp, D. melanogaster
tattgaaaactta

SEQ ID NO: 644978 - DNA, 14 bp, D. melanogaster
tattgaaaactttt

SEQ ID NO: 644979 - DNA, 13 bp, D. melanogaster
tattgaaaagtat

SEQ ID NO: 644980 - DNA, 13 bp, D. melanogaster
tattgaaaatcat

SEQ ID NO: 644981 - DNA, 13 bp, D. melanogaster
tattgaaaatgtg

SEQ ID NO: 644982 - DNA, 13 bp, D. melanogaster
tattgaaaattga

SEQ ID NO: 644983 - DNA, 13 bp, D. melanogaster
tattgaaacaatt

SEQ ID NO: 644984 - DNA, 13 bp, D. melanogaster
tattgaaacattt

SEQ ID NO: 644985 - DNA, 13 bp, D. melanogaster
tattgaaaccaat

SEQ ID NO: 644986 - DNA, 15 bp, D. melanogaster
tattgaaaccaatct

SEQ ID NO: 644987 - DNA, 13 bp, D. melanogaster
tattgaaagaaat

SEQ ID NO: 644988 - DNA, 13 bp, D. melanogaster
tattgaaataaac

SEQ ID NO: 644989 - DNA, 13 bp, D. melanogaster
tattgaaatagtt

SEQ ID NO: 644990 - DNA, 13 bp, D. melanogaster
tattgaaatcaaa

SEQ ID NO: 644991 - DNA, 13 bp, D. melanogaster
tattgaaatgtaa

SEQ ID NO: 644992 - DNA, 13 bp, D. melanogaster
tattgaaatgttg

SEQ ID NO: 644993 - DNA, 13 bp, D. melanogaster
tattgaaattgaa

SEQ ID NO: 644994 - DNA, 14 bp, D. melanogaster
tattgaaattgaaa

SEQ ID NO: 644995 - DNA, 14 bp, D. melanogaster
tattgaaattgaat

SEQ ID NO: 644996 - DNA, 14 bp, D. melanogaster
tattgaaatttatg

SEQ ID NO: 644997 - DNA, 13 bp, D. melanogaster
tattgaacatttt

SEQ ID NO: 644998 - DNA, 13 bp, D. melanogaster
tattgaagaaacc

SEQ ID NO: 644999 - DNA, 13 bp, D. melanogaster
tattgaagaaata

SEQ ID NO: 645000 - DNA, 13 bp, D. melanogaster
tattgaagtattt

SEQ ID NO: 645001 - DNA, 13 bp, D. melanogaster
tattgaatacttt

SEQ ID NO: 645002 - DNA, 13 bp, D. melanogaster
tattgaatatgaa

SEQ ID NO: 645003 - DNA, 14 bp, D. melanogaster
tattgaatatttca

SEQ ID NO: 645004 - DNA, 13 bp, D. melanogaster
tattgaatcttct

SEQ ID NO: 645005 - DNA, 13 bp, D. melanogaster
tattgaatgaaat

SEQ ID NO: 645006 - DNA, 13 bp, D. melanogaster
tattgaattagtt

SEQ ID NO: 645007 - DNA, 13 bp, D. melanogaster
tattgaattatgc

SEQ ID NO: 645008 - DNA, 14 bp, D. melanogaster
tattgaattgaatt

SEQ ID NO: 645009 - DNA, 13 bp, D. melanogaster
tattgaattgtgg

SEQ ID NO: 645010 - DNA, 13 bp, D. melanogaster
tattgacaaatat

SEQ ID NO: 645011 - DNA, 13 bp, D. melanogaster
tattgacaatatt

SEQ ID NO: 645012 - DNA, 13 bp, D. melanogaster
tattgacaattaa

SEQ ID NO: 645013 - DNA, 13 bp, D. melanogaster
tattgacgaaatt

SEQ ID NO: 645014 - DNA, 13 bp, D. melanogaster
tattgagaaaata

SEQ ID NO: 645015 - DNA, 13 bp, D. melanogaster
tattgataaaaac

SEQ ID NO: 645016 - DNA, 13 bp, D. melanogaster
tattgataacaaa

SEQ ID NO: 645017 - DNA, 13 bp, D. melanogaster
tattgataacatt

SEQ ID NO: 645018 - DNA, 13 bp, D. melanogaster
tattgatatccca

SEQ ID NO: 645019 - DNA, 13 bp, D. melanogaster
tattgatatgata

SEQ ID NO: 645020 - DNA, 13 bp, D. melanogaster
tattgatattgat

SEQ ID NO: 645021 - DNA, 13 bp, D. melanogaster
tattgatcaaaaa

SEQ ID NO: 645022 - DNA, 13 bp, D. melanogaster
tattgatgaaaat

SEQ ID NO: 645023 - DNA, 13 bp, D. melanogaster
tattgattgaatt

SEQ ID NO: 645024 - DNA, 13 bp, D. melanogaster
tattgattgatta

SEQ ID NO: 645025 - DNA, 13 bp, D. melanogaster
tattgatttccca

SEQ ID NO: 645026 - DNA, 13 bp, D. melanogaster
tattgattttact

SEQ ID NO: 645027 - DNA, 13 bp, D. melanogaster
tattgattttcca

SEQ ID NO: 645028 - DNA, 13 bp, D. melanogaster
tattgattttcct

SEQ ID NO: 645029 - DNA, 13 bp, D. melanogaster
tattgattttgca

SEQ ID NO: 645030 - DNA, 13 bp, D. melanogaster
tattgcaaaaaaa

SEQ ID NO: 645031 - DNA, 14 bp, D. melanogaster
tattgcaaaaaaaa

SEQ ID NO: 645032 - DNA, 13 bp, D. melanogaster
tattgcaaaagtt

SEQ ID NO: 645033 - DNA, 14 bp, D. melanogaster
tattgcaaaatgga

SEQ ID NO: 645034 - DNA, 13 bp, D. melanogaster
tattgcaaataaa

SEQ ID NO: 645035 - DNA, 13 bp, D. melanogaster
tattgcaaatata

SEQ ID NO: 645036 - DNA, 13 bp, D. melanogaster
tattgcaaattta

SEQ ID NO: 645037 - DNA, 13 bp, D. melanogaster
tattgcaacaaaa

SEQ ID NO: 645038 - DNA, 13 bp, D. melanogaster
tattgcaacattt

SEQ ID NO: 645039 - DNA, 13 bp, D. melanogaster
tattgcaagaaga

SEQ ID NO: 645040 - DNA, 13 bp, D. melanogaster
tattgcaagatat

SEQ ID NO: 645041 - DNA, 13 bp, D. melanogaster
tattgcaattgca

SEQ ID NO: 645042 - DNA, 13 bp, D. melanogaster
tattgcaatttat

SEQ ID NO: 645043 - DNA, 13 bp, D. melanogaster
tattgcacatatt

SEQ ID NO: 645044 - DNA, 13 bp, D. melanogaster
tattgcagttgtt

SEQ ID NO: 645045 - DNA, 13 bp, D. melanogaster
tattgcagtttat

SEQ ID NO: 645046 - DNA, 13 bp, D. melanogaster
tattgcatactta

SEQ ID NO: 645047 - DNA, 13 bp, D. melanogaster
tattgcatataat

SEQ ID NO: 645048 - DNA, 13 bp, D. melanogaster
tattgcatattta

SEQ ID NO: 645049 - DNA, 13 bp, D. melanogaster
tattgcatatttt

SEQ ID NO: 645050 - DNA, 14 bp, D. melanogaster
tattgcattgtatt

SEQ ID NO: 645051 - DNA, 13 bp, D. melanogaster
tattgcatttaaa

SEQ ID NO: 645052 - DNA, 13 bp, D. melanogaster
tattgcatttaag

SEQ ID NO: 645053 - DNA, 14 bp, D. melanogaster
tattgcatttattt

SEQ ID NO: 645054 - DNA, 13 bp, D. melanogaster
tattgcattttgt

SEQ ID NO: 645055 - DNA, 13 bp, D. melanogaster
tattgcatttttg

SEQ ID NO: 645056 - DNA, 13 bp, D. melanogaster
tattgccaaaatt

SEQ ID NO: 645057 - DNA, 13 bp, D. melanogaster
tattgccaacatt

SEQ ID NO: 645058 - DNA, 13 bp, D. melanogaster
tattgccacagca

SEQ ID NO: 645059 - DNA, 13 bp, D. melanogaster
tattgccacgccc

SEQ ID NO: 645060 - DNA, 13 bp, D. melanogaster
tattgccattaaa

SEQ ID NO: 645061 - DNA, 13 bp, D. melanogaster
tattgcgaaatta

SEQ ID NO: 645062 - DNA, 13 bp, D. melanogaster
tattgcgcttcaa

SEQ ID NO: 645063 - DNA, 13 bp, D. melanogaster
tattgcgtatacg

SEQ ID NO: 645064 - DNA, 13 bp, D. melanogaster
tattgcgttttat

SEQ ID NO: 645065 - DNA, 13 bp, D. melanogaster
tattgctaattat

SEQ ID NO: 645066 - DNA, 13 bp, D. melanogaster
tattgctatattt

SEQ ID NO: 645067 - DNA, 13 bp, D. melanogaster
tattgctattatt

SEQ ID NO: 645068 - DNA, 13 bp, D. melanogaster
tattgctgcagtt

SEQ ID NO: 645069 - DNA, 14 bp, D. melanogaster
tattgctgctgctg

SEQ ID NO: 645070 - DNA, 13 bp, D. melanogaster
tattgctgttatt

SEQ ID NO: 645071 - DNA, 14 bp, D. melanogaster
tattgctgttgctg

SEQ ID NO: 645072 - DNA, 13 bp, D. melanogaster
tattgctgttgtt

SEQ ID NO: 645073 - DNA, 13 bp, D. melanogaster
tattgcttaatat

SEQ ID NO: 645074 - DNA, 13 bp, D. melanogaster
tattgctttaaat

SEQ ID NO: 645075 - DNA, 13 bp, D. melanogaster
tattgctttaata

SEQ ID NO: 645076 - DNA, 13 bp, D. melanogaster
tattgcttttgcc

SEQ ID NO: 645077 - DNA, 14 bp, D. melanogaster
tattggaaaaatat

SEQ ID NO: 645078 - DNA, 14 bp, D. melanogaster
tattggaaagtttt

SEQ ID NO: 645079 - DNA, 13 bp, D. melanogaster
tattggaaatata

SEQ ID NO: 645080 - DNA, 14 bp, D. melanogaster
tattggaaatattt

SEQ ID NO: 645081 - DNA, 13 bp, D. melanogaster
tattggaaatttt

SEQ ID NO: 645082 - DNA, 13 bp, D. melanogaster
tattggaacattt

SEQ ID NO: 645083 - DNA, 13 bp, D. melanogaster
tattggaattatg

SEQ ID NO: 645084 - DNA, 13 bp, D. melanogaster
tattggaattttc

SEQ ID NO: 645085 - DNA, 13 bp, D. melanogaster
tattggatatatt

SEQ ID NO: 645086 - DNA, 14 bp, D. melanogaster
tattggattacaat

SEQ ID NO: 645087 - DNA, 13 bp, D. melanogaster
tattggcaaaaaa

SEQ ID NO: 645088 - DNA, 13 bp, D. melanogaster
tattggcaaatat

SEQ ID NO: 645089 - DNA, 13 bp, D. melanogaster
tattggcaactga

SEQ ID NO: 645090 - DNA, 13 bp, D. melanogaster
tattggcactgct

SEQ ID NO: 645091 - DNA, 13 bp, D. melanogaster
tattggcatttcc

SEQ ID NO: 645092 - DNA, 13 bp, D. melanogaster
tattggccaaatt

SEQ ID NO: 645093 - DNA, 13 bp, D. melanogaster
tattggccacaaa

SEQ ID NO: 645094 - DNA, 13 bp, D. melanogaster
tattggctacaaa

SEQ ID NO: 645095 - DNA, 13 bp, D. melanogaster
tattgggcatttc

SEQ ID NO: 645096 - DNA, 15 bp, D. melanogaster
tattgggtgcacttc

SEQ ID NO: 645097 - DNA, 13 bp, D. melanogaster
tattggtatggca

SEQ ID NO: 645098 - DNA, 13 bp, D. melanogaster
tattggtattggt

SEQ ID NO: 645099 - DNA, 13 bp, D. melanogaster
tattggtgtatgc

SEQ ID NO: 645100 - DNA, 13 bp, D. melanogaster
tattggttctatg

SEQ ID NO: 645101 - DNA, 13 bp, D. melanogaster
tattggttgaaaa

SEQ ID NO: 645102 - DNA, 14 bp, D. melanogaster
tattggtttattac

SEQ ID NO: 645103 - DNA, 13 bp, D. melanogaster
tattggtttcatc

SEQ ID NO: 645104 - DNA, 13 bp, D. melanogaster
tattgtaaaacgg

SEQ ID NO: 645105 - DNA, 13 bp, D. melanogaster
tattgtaaaagtt

SEQ ID NO: 645106 - DNA, 14 bp, D. melanogaster
tattgtaaaattgc

SEQ ID NO: 645107 - DNA, 13 bp, D. melanogaster
tattgtaaacaaa

SEQ ID NO: 645108 - DNA, 13 bp, D. melanogaster
tattgtaaacaat

SEQ ID NO: 645109 - DNA, 13 bp, D. melanogaster
tattgtaaatgaa

SEQ ID NO: 645110 - DNA, 13 bp, D. melanogaster
tattgtaaatgtt

SEQ ID NO: 645111 - DNA, 13 bp, D. melanogaster
tattgtacaaata

SEQ ID NO: 645112 - DNA, 13 bp, D. melanogaster
tattgtacaattt

SEQ ID NO: 645113 - DNA, 13 bp, D. melanogaster
tattgtacatata

SEQ ID NO: 645114 - DNA, 13 bp, D. melanogaster
tattgtacatatg

SEQ ID NO: 645115 - DNA, 13 bp, D. melanogaster
tattgtacatttt

SEQ ID NO: 645116 - DNA, 14 bp, D. melanogaster
tattgtacattttt

SEQ ID NO: 645117 - DNA, 13 bp, D. melanogaster
tattgtacttaaa

SEQ ID NO: 645118 - DNA, 13 bp, D. melanogaster
tattgtagatata

SEQ ID NO: 645119 - DNA, 13 bp, D. melanogaster
tattgtatacata

SEQ ID NO: 645120 - DNA, 13 bp, D. melanogaster
tattgtatataga

SEQ ID NO: 645121 - DNA, 13 bp, D. melanogaster
tattgtatatatg

SEQ ID NO: 645122 - DNA, 13 bp, D. melanogaster
tattgtatattca

SEQ ID NO: 645123 - DNA, 13 bp, D. melanogaster
tattgtatatttc

SEQ ID NO: 645124 - DNA, 13 bp, D. melanogaster
tattgtatccaaa

SEQ ID NO: 645125 - DNA, 13 bp, D. melanogaster
tattgtattcaat

SEQ ID NO: 645126 - DNA, 13 bp, D. melanogaster
tattgtattgtac

SEQ ID NO: 645127 - DNA, 13 bp, D. melanogaster
tattgtattttcc

SEQ ID NO: 645128 - DNA, 13 bp, D. melanogaster
tattgtcaaaaat

SEQ ID NO: 645129 - DNA, 13 bp, D. melanogaster
tattgtcaaatat

SEQ ID NO: 645130 - DNA, 14 bp, D. melanogaster
tattgtcatttatt

SEQ ID NO: 645131 - DNA, 13 bp, D. melanogaster
tattgtgaattaa

SEQ ID NO: 645132 - DNA, 13 bp, D. melanogaster
tattgtgtaatta

SEQ ID NO: 645133 - DNA, 13 bp, D. melanogaster
tattgtgttatca

SEQ ID NO: 645134 - DNA, 13 bp, D. melanogaster
tattgttaaacaa

SEQ ID NO: 645135 - DNA, 13 bp, D. melanogaster
tattgttacattt

SEQ ID NO: 645136 - DNA, 13 bp, D. melanogaster
tattgttatacaa

SEQ ID NO: 645137 - DNA, 13 bp, D. melanogaster
tattgttatctat

SEQ ID NO: 645138 - DNA, 13 bp, D. melanogaster
tattgttattaca

SEQ ID NO: 645139 - DNA, 14 bp, D. melanogaster
tattgttattatct

SEQ ID NO: 645140 - DNA, 13 bp, D. melanogaster
tattgttcaattt

SEQ ID NO: 645141 - DNA, 13 bp, D. melanogaster
tattgttcctaaa

SEQ ID NO: 645142 - DNA, 13 bp, D. melanogaster
tattgttcttaaa

SEQ ID NO: 645143 - DNA, 14 bp, D. melanogaster
tattgttgcatact

SEQ ID NO: 645144 - DNA, 13 bp, D. melanogaster
tattgttgccgct

SEQ ID NO: 645145 - DNA, 13 bp, D. melanogaster
tattgttgctgtg

SEQ ID NO: 645146 - DNA, 14 bp, D. melanogaster
tattgttgctgttg

SEQ ID NO: 645147 - DNA, 13 bp, D. melanogaster
tattgttggaaat

SEQ ID NO: 645148 - DNA, 13 bp, D. melanogaster
tattgttgtactt

SEQ ID NO: 645149 - DNA, 13 bp, D. melanogaster
tattgttgttact

SEQ ID NO: 645150 - DNA, 13 bp, D. melanogaster
tattgtttaaatg

SEQ ID NO: 645151 - DNA, 13 bp, D. melanogaster
tattgtttacaaa

SEQ ID NO: 645152 - DNA, 13 bp, D. melanogaster
tattgtttataag

SEQ ID NO: 645153 - DNA, 13 bp, D. melanogaster
tattgtttatgga

SEQ ID NO: 645154 - DNA, 14 bp, D. melanogaster
tattgtttatggat

SEQ ID NO: 645155 - DNA, 13 bp, D. melanogaster
tattgtttgccaa

SEQ ID NO: 645156 - DNA, 13 bp, D. melanogaster
tattgttttcaaa

SEQ ID NO: 645157 - DNA, 13 bp, D. melanogaster
tattgttttcaat

SEQ ID NO: 645158 - DNA, 13 bp, D. melanogaster
tattgttttcgat

SEQ ID NO: 645159 - DNA, 13 bp, D. melanogaster
tattgttttcgct

SEQ ID NO: 645160 - DNA, 13 bp, D. melanogaster
tattgttttggct

SEQ ID NO: 645161 - DNA, 13 bp, D. melanogaster
tatttaaaaacca

SEQ ID NO: 645162 - DNA, 13 bp, D. melanogaster
tatttaaaaagca

SEQ ID NO: 645163 - DNA, 13 bp, D. melanogaster
tatttaaaaagtg

SEQ ID NO: 645164 - DNA, 13 bp, D. melanogaster
tatttaaaagtgt

SEQ ID NO: 645165 - DNA, 13 bp, D. melanogaster
tatttaaaatgca

SEQ ID NO: 645166 - DNA, 14 bp, D. melanogaster
tatttaaaatgcac

SEQ ID NO: 645167 - DNA, 13 bp, D. melanogaster
tatttaaaatgct

SEQ ID NO: 645168 - DNA, 13 bp, D. melanogaster
tatttaaaatgga

SEQ ID NO: 645169 - DNA, 13 bp, D. melanogaster
tatttaaacacaa

SEQ ID NO: 645170 - DNA, 13 bp, D. melanogaster
tatttaaacatgc

SEQ ID NO: 645171 - DNA, 13 bp, D. melanogaster
tatttaaaccgtt

SEQ ID NO: 645172 - DNA, 13 bp, D. melanogaster
tatttaaactttg

SEQ ID NO: 645173 - DNA, 13 bp, D. melanogaster
tatttaaagcaaa

SEQ ID NO: 645174 - DNA, 14 bp, D. melanogaster
tatttaaagcaaat

SEQ ID NO: 645175 - DNA, 14 bp, D. melanogaster
tatttaaagcaatt

SEQ ID NO: 645176 - DNA, 13 bp, D. melanogaster
tatttaaagccaa

SEQ ID NO: 645177 - DNA, 13 bp, D. melanogaster
tatttaaagctta

SEQ ID NO: 645178 - DNA, 13 bp, D. melanogaster
tatttaaagcttt

SEQ ID NO: 645179 - DNA, 13 bp, D. melanogaster
tatttaaaggaaa

SEQ ID NO: 645180 - DNA, 13 bp, D. melanogaster
tatttaaagtgca

SEQ ID NO: 645181 - DNA, 13 bp, D. melanogaster
tatttaaatacca

SEQ ID NO: 645182 - DNA, 13 bp, D. melanogaster
tatttaaatacct

SEQ ID NO: 645183 - DNA, 13 bp, D. melanogaster
tatttaaatcgaa

SEQ ID NO: 645184 - DNA, 14 bp, D. melanogaster
tatttaaatgcatt

SEQ ID NO: 645185 - DNA, 13 bp, D. melanogaster
tatttaaatgcct

SEQ ID NO: 645186 - DNA, 13 bp, D. melanogaster
tatttaaattgca

SEQ ID NO: 645187 - DNA, 14 bp, D. melanogaster
tatttaaattgcaa

SEQ ID NO: 645188 - DNA, 13 bp, D. melanogaster
tatttaaattgga

SEQ ID NO: 645189 - DNA, 13 bp, D. melanogaster
tatttaaattggt

SEQ ID NO: 645190 - DNA, 13 bp, D. melanogaster
tatttaaatttcg

SEQ ID NO: 645191 - DNA, 13 bp, D. melanogaster
tatttaaatttgc

SEQ ID NO: 645192 - DNA, 13 bp, D. melanogaster
tatttaacaaact

SEQ ID NO: 645193 - DNA, 13 bp, D. melanogaster
tatttaacaacac

SEQ ID NO: 645194 - DNA, 13 bp, D. melanogaster
tatttaacaagaa

SEQ ID NO: 645195 - DNA, 14 bp, D. melanogaster
tatttaacacattt

SEQ ID NO: 645196 - DNA, 13 bp, D. melanogaster
tatttaaccaaaa

SEQ ID NO: 645197 - DNA, 13 bp, D. melanogaster
tatttaacccttt

SEQ ID NO: 645198 - DNA, 13 bp, D. melanogaster
tatttaactaaca

SEQ ID NO: 645199 - DNA, 14 bp, D. melanogaster
tatttaactgaaaa

SEQ ID NO: 645200 - DNA, 13 bp, D. melanogaster
tatttaactttca

SEQ ID NO: 645201 - DNA, 13 bp, D. melanogaster
tatttaacttttg

SEQ ID NO: 645202 - DNA, 13 bp, D. melanogaster
tatttaagagaat

SEQ ID NO: 645203 - DNA, 13 bp, D. melanogaster
tatttaagatcaa

SEQ ID NO: 645204 - DNA, 13 bp, D. melanogaster
tatttaagcaaaa

SEQ ID NO: 645205 - DNA, 13 bp, D. melanogaster
tatttaagcataa

SEQ ID NO: 645206 - DNA, 13 bp, D. melanogaster
tatttaagccaaa

SEQ ID NO: 645207 - DNA, 13 bp, D. melanogaster
tatttaagccaat

SEQ ID NO: 645208 - DNA, 13 bp, D. melanogaster
tatttaagccatt

SEQ ID NO: 645209 - DNA, 13 bp, D. melanogaster
tatttaagcttat

SEQ ID NO: 645210 - DNA, 13 bp, D. melanogaster
tatttaaggaata

SEQ ID NO: 645211 - DNA, 13 bp, D. melanogaster
tatttaagtatgt

SEQ ID NO: 645212 - DNA, 13 bp, D. melanogaster
tatttaagtgaaa

SEQ ID NO: 645213 - DNA, 13 bp, D. melanogaster
tatttaagttcag

SEQ ID NO: 645214 - DNA, 13 bp, D. melanogaster
tatttaagttctt

SEQ ID NO: 645215 - DNA, 13 bp, D. melanogaster
tatttaataccaa

SEQ ID NO: 645216 - DNA, 13 bp, D. melanogaster
tatttaatatgca

SEQ ID NO: 645217 - DNA, 13 bp, D. melanogaster
tatttaatgcaaa

SEQ ID NO: 645218 - DNA, 13 bp, D. melanogaster
tatttaatgcatt

SEQ ID NO: 645219 - DNA, 13 bp, D. melanogaster
tatttaatgcttt

SEQ ID NO: 645220 - DNA, 13 bp, D. melanogaster
tatttaatgtttc

SEQ ID NO: 645221 - DNA, 13 bp, D. melanogaster
tatttaattggaa

SEQ ID NO: 645222 - DNA, 13 bp, D. melanogaster
tatttaattgttc

SEQ ID NO: 645223 - DNA, 13 bp, D. melanogaster
tatttacaaaaac

SEQ ID NO: 645224 - DNA, 13 bp, D. melanogaster
tatttacaaaaca

SEQ ID NO: 645225 - DNA, 13 bp, D. melanogaster
tatttacaaaaga

SEQ ID NO: 645226 - DNA, 13 bp, D. melanogaster
tatttacaaatgt

SEQ ID NO: 645227 - DNA, 13 bp, D. melanogaster
tatttacaacaaa

SEQ ID NO: 645228 - DNA, 13 bp, D. melanogaster
tatttacaacatg

SEQ ID NO: 645229 - DNA, 13 bp, D. melanogaster
tatttacaagtgc

SEQ ID NO: 645230 - DNA, 13 bp, D. melanogaster
tatttacaatttg

SEQ ID NO: 645231 - DNA, 13 bp, D. melanogaster
tatttacacaaat

SEQ ID NO: 645232 - DNA, 13 bp, D. melanogaster
tatttacacaata

SEQ ID NO: 645233 - DNA, 13 bp, D. melanogaster
tatttacacaatt

SEQ ID NO: 645234 - DNA, 14 bp, D. melanogaster
tatttacacaattt

SEQ ID NO: 645235 - DNA, 13 bp, D. melanogaster
tatttacacattt

SEQ ID NO: 645236 - DNA, 13 bp, D. melanogaster
tatttacacttaa

SEQ ID NO: 645237 - DNA, 13 bp, D. melanogaster
tatttacagtatt

SEQ ID NO: 645238 - DNA, 13 bp, D. melanogaster
tatttacagtgtt

SEQ ID NO: 645239 - DNA, 13 bp, D. melanogaster
tatttacataagt

SEQ ID NO: 645240 - DNA, 14 bp, D. melanogaster
tatttacatataca

SEQ ID NO: 645241 - DNA, 13 bp, D. melanogaster
tatttacatatgc

SEQ ID NO: 645242 - DNA, 13 bp, D. melanogaster
tatttacattaca

SEQ ID NO: 645243 - DNA, 14 bp, D. melanogaster
tatttacatttaca

SEQ ID NO: 645244 - DNA, 13 bp, D. melanogaster
tatttaccaattt

SEQ ID NO: 645245 - DNA, 13 bp, D. melanogaster
tatttaccattta

SEQ ID NO: 645246 - DNA, 13 bp, D. melanogaster
tatttacccaatt

SEQ ID NO: 645247 - DNA, 13 bp, D. melanogaster
tatttacccgcaa

SEQ ID NO: 645248 - DNA, 13 bp, D. melanogaster
tatttacgaatta

SEQ ID NO: 645249 - DNA, 13 bp, D. melanogaster
tatttacgaattt

SEQ ID NO: 645250 - DNA, 13 bp, D. melanogaster
tatttactaggac

SEQ ID NO: 645251 - DNA, 13 bp, D. melanogaster
tatttactgaaaa

SEQ ID NO: 645252 - DNA, 13 bp, D. melanogaster
tatttacttaact

SEQ ID NO: 645253 - DNA, 13 bp, D. melanogaster
tatttacttagtt

SEQ ID NO: 645254 - DNA, 13 bp, D. melanogaster
tatttactttgat

SEQ ID NO: 645255 - DNA, 14 bp, D. melanogaster
tatttagaaaaaca

SEQ ID NO: 645256 - DNA, 13 bp, D. melanogaster
tatttataacatg

SEQ ID NO: 645257 - DNA, 13 bp, D. melanogaster
tatttataatgct

SEQ ID NO: 645258 - DNA, 13 bp, D. melanogaster
tatttatacacat

SEQ ID NO: 645259 - DNA, 14 bp, D. melanogaster
tatttatacacatt

SEQ ID NO: 645260 - DNA, 13 bp, D. melanogaster
tatttatacactt

SEQ ID NO: 645261 - DNA, 13 bp, D. melanogaster
tatttatacgaat

SEQ ID NO: 645262 - DNA, 13 bp, D. melanogaster
tatttatactgtt

SEQ ID NO: 645263 - DNA, 14 bp, D. melanogaster
tatttatactgttt

SEQ ID NO: 645264 - DNA, 13 bp, D. melanogaster
tatttatagcaat

SEQ ID NO: 645265 - DNA, 13 bp, D. melanogaster
tatttatagtact

SEQ ID NO: 645266 - DNA, 13 bp, D. melanogaster
tatttatagtttc

SEQ ID NO: 645267 - DNA, 13 bp, D. melanogaster
tatttatatatcc

SEQ ID NO: 645268 - DNA, 13 bp, D. melanogaster
tatttatatatcg

SEQ ID NO: 645269 - DNA, 13 bp, D. melanogaster
tatttatatgcat

SEQ ID NO: 645270 - DNA, 14 bp, D. melanogaster
tatttatatgcata

SEQ ID NO: 645271 - DNA, 13 bp, D. melanogaster
tatttatatgcta

SEQ ID NO: 645272 - DNA, 13 bp, D. melanogaster
tatttatatggaa

SEQ ID NO: 645273 - DNA, 13 bp, D. melanogaster
tatttatattcca

SEQ ID NO: 645274 - DNA, 13 bp, D. melanogaster
tatttatgaaaag

SEQ ID NO: 645275 - DNA, 13 bp, D. melanogaster
tatttatgaaagt

SEQ ID NO: 645276 - DNA, 13 bp, D. melanogaster
tatttatgaacat

SEQ ID NO: 645277 - DNA, 13 bp, D. melanogaster
tatttatgaactg

SEQ ID NO: 645278 - DNA, 13 bp, D. melanogaster
tatttatgagata

SEQ ID NO: 645279 - DNA, 13 bp, D. melanogaster
tatttatgatttc

SEQ ID NO: 645280 - DNA, 13 bp, D. melanogaster
tatttatgcaata

SEQ ID NO: 645281 - DNA, 13 bp, D. melanogaster
tatttatgcaatg

SEQ ID NO: 645282 - DNA, 13 bp, D. melanogaster
tatttatgcattc

SEQ ID NO: 645283 - DNA, 13 bp, D. melanogaster
tatttatgctgat

SEQ ID NO: 645284 - DNA, 13 bp, D. melanogaster
tatttatggatat

SEQ ID NO: 645285 - DNA, 14 bp, D. melanogaster
tatttatggcattt

SEQ ID NO: 645286 - DNA, 13 bp, D. melanogaster
tatttatggcttc

SEQ ID NO: 645287 - DNA, 13 bp, D. melanogaster
tatttatgggctt

SEQ ID NO: 645288 - DNA, 13 bp, D. melanogaster
tatttatgtacaa

SEQ ID NO: 645289 - DNA, 13 bp, D. melanogaster
tatttatgtacgt

SEQ ID NO: 645290 - DNA, 14 bp, D. melanogaster
tatttatgtataca

SEQ ID NO: 645291 - DNA, 13 bp, D. melanogaster
tatttatgtatct

SEQ ID NO: 645292 - DNA, 13 bp, D. melanogaster
tatttatgtatgc

SEQ ID NO: 645293 - DNA, 13 bp, D. melanogaster
tatttatgtgaat

SEQ ID NO: 645294 - DNA, 13 bp, D. melanogaster
tatttatgtgtac

SEQ ID NO: 645295 - DNA, 13 bp, D. melanogaster
tatttatgttgca

SEQ ID NO: 645296 - DNA, 14 bp, D. melanogaster
tatttatgttgcaa

SEQ ID NO: 645297 - DNA, 14 bp, D. melanogaster
tatttattacattg

SEQ ID NO: 645298 - DNA, 13 bp, D. melanogaster
tatttattagcca

SEQ ID NO: 645299 - DNA, 13 bp, D. melanogaster
tatttattcacat

SEQ ID NO: 645300 - DNA, 13 bp, D. melanogaster
tatttattccaaa

SEQ ID NO: 645301 - DNA, 13 bp, D. melanogaster
tatttattccaat

SEQ ID NO: 645302 - DNA, 13 bp, D. melanogaster
tatttattcgaaa

SEQ ID NO: 645303 - DNA, 13 bp, D. melanogaster
tatttattgacca

SEQ ID NO: 645304 - DNA, 14 bp, D. melanogaster
tatttattgcaaat

SEQ ID NO: 645305 - DNA, 13 bp, D. melanogaster
tatttattgcaca

SEQ ID NO: 645306 - DNA, 14 bp, D. melanogaster
tatttattgcttta

SEQ ID NO: 645307 - DNA, 13 bp, D. melanogaster
tatttattgtgaa

SEQ ID NO: 645308 - DNA, 13 bp, D. melanogaster
tatttattgttac

SEQ ID NO: 645309 - DNA, 13 bp, D. melanogaster
tatttattgttcc

SEQ ID NO: 645310 - DNA, 14 bp, D. melanogaster
tatttatttagcca

SEQ ID NO: 645311 - DNA, 13 bp, D. melanogaster
tatttatttagct

SEQ ID NO: 645312 - DNA, 13 bp, D. melanogaster
tatttatttagtc

SEQ ID NO: 645313 - DNA, 13 bp, D. melanogaster
tatttatttatgc

SEQ ID NO: 645314 - DNA, 13 bp, D. melanogaster
tatttatttccaa

SEQ ID NO: 645315 - DNA, 13 bp, D. melanogaster
tatttatttcgat

SEQ ID NO: 645316 - DNA, 13 bp, D. melanogaster
tatttatttcgcc

SEQ ID NO: 645317 - DNA, 13 bp, D. melanogaster
tatttatttgaac

SEQ ID NO: 645318 - DNA, 13 bp, D. melanogaster
tatttatttgatc

SEQ ID NO: 645319 - DNA, 14 bp, D. melanogaster
tatttatttgcata

SEQ ID NO: 645320 - DNA, 14 bp, D. melanogaster
tatttatttgcatt

SEQ ID NO: 645321 - DNA, 13 bp, D. melanogaster
tatttatttgcca

SEQ ID NO: 645322 - DNA, 14 bp, D. melanogaster
tatttatttgccaa

SEQ ID NO: 645323 - DNA, 13 bp, D. melanogaster
tatttatttgcct

SEQ ID NO: 645324 - DNA, 14 bp, D. melanogaster
tatttatttgcctt

SEQ ID NO: 645325 - DNA, 13 bp, D. melanogaster
tatttatttgcta

SEQ ID NO: 645326 - DNA, 13 bp, D. melanogaster
tatttatttgtca

SEQ ID NO: 645327 - DNA, 13 bp, D. melanogaster
tatttattttacg

SEQ ID NO: 645328 - DNA, 13 bp, D. melanogaster
tatttattttgcc

SEQ ID NO: 645329 - DNA, 13 bp, D. melanogaster
tatttcaaaaact

SEQ ID NO: 645330 - DNA, 13 bp, D. melanogaster
tatttcaaaaaga

SEQ ID NO: 645331 - DNA, 13 bp, D. melanogaster
tatttcaaaaagt

SEQ ID NO: 645332 - DNA, 14 bp, D. melanogaster
tatttcaaaaatgt

SEQ ID NO: 645333 - DNA, 13 bp, D. melanogaster
tatttcaaaagaa

SEQ ID NO: 645334 - DNA, 13 bp, D. melanogaster
tatttcaaaatac

SEQ ID NO: 645335 - DNA, 13 bp, D. melanogaster
tatttcaaaatca

SEQ ID NO: 645336 - DNA, 13 bp, D. melanogaster
tatttcaaactaa

SEQ ID NO: 645337 - DNA, 13 bp, D. melanogaster
tatttcaaagatt

SEQ ID NO: 645338 - DNA, 13 bp, D. melanogaster
tatttcaaagtta

SEQ ID NO: 645339 - DNA, 13 bp, D. melanogaster
tatttcaaataac

SEQ ID NO: 645340 - DNA, 13 bp, D. melanogaster
tatttcaaatgaa

SEQ ID NO: 645341 - DNA, 13 bp, D. melanogaster
tatttcaacaaaa

SEQ ID NO: 645342 - DNA, 13 bp, D. melanogaster
tatttcaacaaat

SEQ ID NO: 645343 - DNA, 13 bp, D. melanogaster
tatttcaactatt

SEQ ID NO: 645344 - DNA, 13 bp, D. melanogaster
tatttcaactgca

SEQ ID NO: 645345 - DNA, 14 bp, D. melanogaster
tatttcaactgcaa

SEQ ID NO: 645346 - DNA, 13 bp, D. melanogaster
tatttcaataact

SEQ ID NO: 645347 - DNA, 13 bp, D. melanogaster
tatttcaataatc

SEQ ID NO: 645348 - DNA, 13 bp, D. melanogaster
tatttcaatacat

SEQ ID NO: 645349 - DNA, 13 bp, D. melanogaster
tatttcaatcaaa

SEQ ID NO: 645350 - DNA, 13 bp, D. melanogaster
tatttcaatgata

SEQ ID NO: 645351 - DNA, 13 bp, D. melanogaster
tatttcaatgttt

SEQ ID NO: 645352 - DNA, 13 bp, D. melanogaster
tatttcaattaag

SEQ ID NO: 645353 - DNA, 13 bp, D. melanogaster
tatttcaattgaa

SEQ ID NO: 645354 - DNA, 13 bp, D. melanogaster
tatttcaatttcg

SEQ ID NO: 645355 - DNA, 13 bp, D. melanogaster
tatttcacaaaaa

SEQ ID NO: 645356 - DNA, 13 bp, D. melanogaster
tatttcacaaatt

SEQ ID NO: 645357 - DNA, 14 bp, D. melanogaster
tatttcacaaattt

SEQ ID NO: 645358 - DNA, 13 bp, D. melanogaster
tatttcacaattt

SEQ ID NO: 645359 - DNA, 13 bp, D. melanogaster
tatttcactaaat

SEQ ID NO: 645360 - DNA, 13 bp, D. melanogaster
tatttcagaatat

SEQ ID NO: 645361 - DNA, 14 bp, D. melanogaster
tatttcagaatata

SEQ ID NO: 645362 - DNA, 13 bp, D. melanogaster
tatttcagatatt

SEQ ID NO: 645363 - DNA, 13 bp, D. melanogaster
tatttcagcattt

SEQ ID NO: 645364 - DNA, 13 bp, D. melanogaster
tatttcataattg

SEQ ID NO: 645365 - DNA, 13 bp, D. melanogaster
tatttcatcatat

SEQ ID NO: 645366 - DNA, 13 bp, D. melanogaster
tatttcatgaaat

SEQ ID NO: 645367 - DNA, 13 bp, D. melanogaster
tatttcatgaata

SEQ ID NO: 645368 - DNA, 13 bp, D. melanogaster
tatttcattagct

SEQ ID NO: 645369 - DNA, 13 bp, D. melanogaster
tatttcattcaaa

SEQ ID NO: 645370 - DNA, 13 bp, D. melanogaster
tatttcattgaaa

SEQ ID NO: 645371 - DNA, 13 bp, D. melanogaster
tatttcatttcaa

SEQ ID NO: 645372 - DNA, 13 bp, D. melanogaster
tatttccaaaaac

SEQ ID NO: 645373 - DNA, 13 bp, D. melanogaster
tatttccaaaaat

SEQ ID NO: 645374 - DNA, 13 bp, D. melanogaster
tatttccaaaatt

SEQ ID NO: 645375 - DNA, 13 bp, D. melanogaster
tatttccaatgtt

SEQ ID NO: 645376 - DNA, 13 bp, D. melanogaster
tatttccataaat

SEQ ID NO: 645377 - DNA, 13 bp, D. melanogaster
tatttccataatt

SEQ ID NO: 645378 - DNA, 13 bp, D. melanogaster
tatttcccaaatt

SEQ ID NO: 645379 - DNA, 13 bp, D. melanogaster
tatttcccacttt

SEQ ID NO: 645380 - DNA, 14 bp, D. melanogaster
tatttccgtttccg

SEQ ID NO: 645381 - DNA, 13 bp, D. melanogaster
tatttcctaatta

SEQ ID NO: 645382 - DNA, 13 bp, D. melanogaster
tatttcctacata

SEQ ID NO: 645383 - DNA, 13 bp, D. melanogaster
tatttcgaaaaac

SEQ ID NO: 645384 - DNA, 13 bp, D. melanogaster
tatttcgaaataa

SEQ ID NO: 645385 - DNA, 13 bp, D. melanogaster
tatttcgaatttt

SEQ ID NO: 645386 - DNA, 14 bp, D. melanogaster
tatttcgaattttg

SEQ ID NO: 645387 - DNA, 13 bp, D. melanogaster
tatttcgatatat

SEQ ID NO: 645388 - DNA, 13 bp, D. melanogaster
tatttcgatattt

SEQ ID NO: 645389 - DNA, 13 bp, D. melanogaster
tatttcgatttcg

SEQ ID NO: 645390 - DNA, 13 bp, D. melanogaster
tatttcgccattt

SEQ ID NO: 645391 - DNA, 13 bp, D. melanogaster
tatttcgctccat

SEQ ID NO: 645392 - DNA, 13 bp, D. melanogaster
tatttcggtttat

SEQ ID NO: 645393 - DNA, 13 bp, D. melanogaster
tatttcgtattaa

SEQ ID NO: 645394 - DNA, 13 bp, D. melanogaster
tatttcgttgtta

SEQ ID NO: 645395 - DNA, 14 bp, D. melanogaster
tatttctaaaggtg

SEQ ID NO: 645396 - DNA, 13 bp, D. melanogaster
tatttctaacatg

SEQ ID NO: 645397 - DNA, 14 bp, D. melanogaster
tatttctaatcgta

SEQ ID NO: 645398 - DNA, 13 bp, D. melanogaster
tatttctatgtat

SEQ ID NO: 645399 - DNA, 13 bp, D. melanogaster
tatttctcagtgt

SEQ ID NO: 645400 - DNA, 13 bp, D. melanogaster
tatttctccaagt

SEQ ID NO: 645401 - DNA, 13 bp, D. melanogaster
tatttctgaaaat

SEQ ID NO: 645402 - DNA, 13 bp, D. melanogaster
tatttctgaatgc

SEQ ID NO: 645403 - DNA, 13 bp, D. melanogaster
tatttctgattag

SEQ ID NO: 645404 - DNA, 13 bp, D. melanogaster
tatttctgatttc

SEQ ID NO: 645405 - DNA, 13 bp, D. melanogaster
tatttctgcattt

SEQ ID NO: 645406 - DNA, 13 bp, D. melanogaster
tatttctgcgcct

SEQ ID NO: 645407 - DNA, 13 bp, D. melanogaster
tatttctggaaaa

SEQ ID NO: 645408 - DNA, 13 bp, D. melanogaster
tatttctggcatt

SEQ ID NO: 645409 - DNA, 13 bp, D. melanogaster
tatttctggttct

SEQ ID NO: 645410 - DNA, 13 bp, D. melanogaster
tatttctgtaaca

SEQ ID NO: 645411 - DNA, 13 bp, D. melanogaster
tatttctgtatat

SEQ ID NO: 645412 - DNA, 13 bp, D. melanogaster
tatttctgtgttc

SEQ ID NO: 645413 - DNA, 13 bp, D. melanogaster
tatttcttaactc

SEQ ID NO: 645414 - DNA, 13 bp, D. melanogaster
tatttcttattgc

SEQ ID NO: 645415 - DNA, 13 bp, D. melanogaster
tatttcttcgccg

SEQ ID NO: 645416 - DNA, 13 bp, D. melanogaster
tatttcttgataa

SEQ ID NO: 645417 - DNA, 14 bp, D. melanogaster
tatttcttgataaa

SEQ ID NO: 645418 - DNA, 13 bp, D. melanogaster
tatttcttgttgg

SEQ ID NO: 645419 - DNA, 13 bp, D. melanogaster
tatttctttgaat

SEQ ID NO: 645420 - DNA, 13 bp, D. melanogaster
tatttgaaaacat

SEQ ID NO: 645421 - DNA, 13 bp, D. melanogaster
tatttgaaaagca

SEQ ID NO: 645422 - DNA, 13 bp, D. melanogaster
tatttgaaaagtg

SEQ ID NO: 645423 - DNA, 14 bp, D. melanogaster
tatttgaaaagttt

SEQ ID NO: 645424 - DNA, 13 bp, D. melanogaster
tatttgaaaatgc

SEQ ID NO: 645425 - DNA, 13 bp, D. melanogaster
tatttgaaaattc

SEQ ID NO: 645426 - DNA, 13 bp, D. melanogaster
tatttgaaactaa

SEQ ID NO: 645427 - DNA, 13 bp, D. melanogaster
tatttgaaatgga

SEQ ID NO: 645428 - DNA, 13 bp, D. melanogaster
tatttgaaatttc

SEQ ID NO: 645429 - DNA, 13 bp, D. melanogaster
tatttgaacaata

SEQ ID NO: 645430 - DNA, 13 bp, D. melanogaster
tatttgaagggca

SEQ ID NO: 645431 - DNA, 13 bp, D. melanogaster
tatttgaatatga

SEQ ID NO: 645432 - DNA, 13 bp, D. melanogaster
tatttgaattgaa

SEQ ID NO: 645433 - DNA, 13 bp, D. melanogaster
tatttgacttttg

SEQ ID NO: 645434 - DNA, 13 bp, D. melanogaster
tatttgataattg

SEQ ID NO: 645435 - DNA, 13 bp, D. melanogaster
tatttgatatatg

SEQ ID NO: 645436 - DNA, 13 bp, D. melanogaster
tatttgatatttc

SEQ ID NO: 645437 - DNA, 13 bp, D. melanogaster
tatttgatcaacg

SEQ ID NO: 645438 - DNA, 13 bp, D. melanogaster
tatttgatgaaat

SEQ ID NO: 645439 - DNA, 14 bp, D. melanogaster
tatttgatgaaatc

SEQ ID NO: 645440 - DNA, 13 bp, D. melanogaster
tatttgatgaccg

SEQ ID NO: 645441 - DNA, 13 bp, D. melanogaster
tatttgattaact

SEQ ID NO: 645442 - DNA, 13 bp, D. melanogaster
tatttgattactt

SEQ ID NO: 645443 - DNA, 13 bp, D. melanogaster
tatttgatttact

SEQ ID NO: 645444 - DNA, 13 bp, D. melanogaster
tatttgatttcat

SEQ ID NO: 645445 - DNA, 13 bp, D. melanogaster
tatttgatttgaa

SEQ ID NO: 645446 - DNA, 14 bp, D. melanogaster
tatttgatttgaaa

SEQ ID NO: 645447 - DNA, 13 bp, D. melanogaster
tatttgatttgct

SEQ ID NO: 645448 - DNA, 13 bp, D. melanogaster
tatttgattttca

SEQ ID NO: 645449 - DNA, 14 bp, D. melanogaster
tatttgattttcat

SEQ ID NO: 645450 - DNA, 13 bp, D. melanogaster
tatttgattttcc

SEQ ID NO: 645451 - DNA, 13 bp, D. melanogaster
tatttgattttcg

SEQ ID NO: 645452 - DNA, 13 bp, D. melanogaster
tatttgcaaaaat

SEQ ID NO: 645453 - DNA, 13 bp, D. melanogaster
tatttgcaaaatg

SEQ ID NO: 645454 - DNA, 13 bp, D. melanogaster
tatttgcaaattg

SEQ ID NO: 645455 - DNA, 14 bp, D. melanogaster
tatttgcaacaaaa

SEQ ID NO: 645456 - DNA, 13 bp, D. melanogaster
tatttgcaataaa

SEQ ID NO: 645457 - DNA, 13 bp, D. melanogaster
tatttgcaatcaa

SEQ ID NO: 645458 - DNA, 13 bp, D. melanogaster
tatttgcaatctg

SEQ ID NO: 645459 - DNA, 14 bp, D. melanogaster
tatttgcaatttaa

SEQ ID NO: 645460 - DNA, 13 bp, D. melanogaster
tatttgcacaaca

SEQ ID NO: 645461 - DNA, 13 bp, D. melanogaster
tatttgcacaatt

SEQ ID NO: 645462 - DNA, 13 bp, D. melanogaster
tatttgcacagca

SEQ ID NO: 645463 - DNA, 13 bp, D. melanogaster
tatttgcacagtt

SEQ ID NO: 645464 - DNA, 13 bp, D. melanogaster
tatttgcacattt

SEQ ID NO: 645465 - DNA, 13 bp, D. melanogaster
tatttgcagaaat

SEQ ID NO: 645466 - DNA, 13 bp, D. melanogaster
tatttgcataata

SEQ ID NO: 645467 - DNA, 13 bp, D. melanogaster
tatttgcatacgc

SEQ ID NO: 645468 - DNA, 13 bp, D. melanogaster
tatttgcatatat

SEQ ID NO: 645469 - DNA, 13 bp, D. melanogaster
tatttgcatatga

SEQ ID NO: 645470 - DNA, 13 bp, D. melanogaster
tatttgcatatgt

SEQ ID NO: 645471 - DNA, 13 bp, D. melanogaster
tatttgcatattt

SEQ ID NO: 645472 - DNA, 13 bp, D. melanogaster
tatttgcatgcca

SEQ ID NO: 645473 - DNA, 14 bp, D. melanogaster
tatttgcattattt

SEQ ID NO: 645474 - DNA, 13 bp, D. melanogaster
tatttgcattgat

SEQ ID NO: 645475 - DNA, 14 bp, D. melanogaster
tatttgcatttttg

SEQ ID NO: 645476 - DNA, 13 bp, D. melanogaster
tatttgccaaata

SEQ ID NO: 645477 - DNA, 13 bp, D. melanogaster
tatttgccaaatt

SEQ ID NO: 645478 - DNA, 13 bp, D. melanogaster
tatttgccaacaa

SEQ ID NO: 645479 - DNA, 13 bp, D. melanogaster
tatttgccaactt

SEQ ID NO: 645480 - DNA, 13 bp, D. melanogaster
tatttgccaagtg

SEQ ID NO: 645481 - DNA, 13 bp, D. melanogaster
tatttgccacaaa

SEQ ID NO: 645482 - DNA, 13 bp, D. melanogaster
tatttgccacaca

SEQ ID NO: 645483 - DNA, 13 bp, D. melanogaster
tatttgccagttt

SEQ ID NO: 645484 - DNA, 13 bp, D. melanogaster
tatttgccataat

SEQ ID NO: 645485 - DNA, 14 bp, D. melanogaster
tatttgccattttt

SEQ ID NO: 645486 - DNA, 13 bp, D. melanogaster
tatttgcccaact

SEQ ID NO: 645487 - DNA, 13 bp, D. melanogaster
tatttgcctattt

SEQ ID NO: 645488 - DNA, 13 bp, D. melanogaster
tatttgcctgcat

SEQ ID NO: 645489 - DNA, 13 bp, D. melanogaster
tatttgcctttat

SEQ ID NO: 645490 - DNA, 13 bp, D. melanogaster
tatttgcctttta

SEQ ID NO: 645491 - DNA, 13 bp, D. melanogaster
tatttgcgcaaaa

SEQ ID NO: 645492 - DNA, 13 bp, D. melanogaster
tatttgcgctttt

SEQ ID NO: 645493 - DNA, 13 bp, D. melanogaster
tatttgctattta

SEQ ID NO: 645494 - DNA, 13 bp, D. melanogaster
tatttgctgaatt

SEQ ID NO: 645495 - DNA, 13 bp, D. melanogaster
tatttgctgttta

SEQ ID NO: 645496 - DNA, 13 bp, D. melanogaster
tatttgcttaaac

SEQ ID NO: 645497 - DNA, 13 bp, D. melanogaster
tatttgcttaaat

SEQ ID NO: 645498 - DNA, 13 bp, D. melanogaster
tatttgcttagcc

SEQ ID NO: 645499 - DNA, 13 bp, D. melanogaster
tatttgcttattg

SEQ ID NO: 645500 - DNA, 13 bp, D. melanogaster
tatttgctttcaa

SEQ ID NO: 645501 - DNA, 13 bp, D. melanogaster
tatttgctttgct

SEQ ID NO: 645502 - DNA, 13 bp, D. melanogaster
tatttgctttggc

SEQ ID NO: 645503 - DNA, 13 bp, D. melanogaster
tatttgctttggg

SEQ ID NO: 645504 - DNA, 14 bp, D. melanogaster
tatttgcttttaat

SEQ ID NO: 645505 - DNA, 13 bp, D. melanogaster
tatttggaaaacg

SEQ ID NO: 645506 - DNA, 13 bp, D. melanogaster
tatttggaaagaa

SEQ ID NO: 645507 - DNA, 13 bp, D. melanogaster
tatttggaaatat

SEQ ID NO: 645508 - DNA, 13 bp, D. melanogaster
tatttggaagatt

SEQ ID NO: 645509 - DNA, 13 bp, D. melanogaster
tatttggaattgg

SEQ ID NO: 645510 - DNA, 13 bp, D. melanogaster
tatttggagcatt

SEQ ID NO: 645511 - DNA, 13 bp, D. melanogaster
tatttggattaat

SEQ ID NO: 645512 - DNA, 13 bp, D. melanogaster
tatttggcaaatt

SEQ ID NO: 645513 - DNA, 13 bp, D. melanogaster
tatttggcatatt

SEQ ID NO: 645514 - DNA, 13 bp, D. melanogaster
tatttggcattgc

SEQ ID NO: 645515 - DNA, 13 bp, D. melanogaster
tatttggccaaga

SEQ ID NO: 645516 - DNA, 13 bp, D. melanogaster
tatttggccaatt

SEQ ID NO: 645517 - DNA, 13 bp, D. melanogaster
tatttggcgaaaa

SEQ ID NO: 645518 - DNA, 13 bp, D. melanogaster
tatttggcgataa

SEQ ID NO: 645519 - DNA, 13 bp, D. melanogaster
tatttggcgttca

SEQ ID NO: 645520 - DNA, 13 bp, D. melanogaster
tatttggctttgc

SEQ ID NO: 645521 - DNA, 14 bp, D. melanogaster
tatttgggatttta

SEQ ID NO: 645522 - DNA, 13 bp, D. melanogaster
tatttgggcctgc

SEQ ID NO: 645523 - DNA, 13 bp, D. melanogaster
tatttgggtcaca

SEQ ID NO: 645524 - DNA, 14 bp, D. melanogaster
tatttgggtcacaa

SEQ ID NO: 645525 - DNA, 13 bp, D. melanogaster
tatttggtcggcg

SEQ ID NO: 645526 - DNA, 13 bp, D. melanogaster
tatttggtcggtg

SEQ ID NO: 645527 - DNA, 13 bp, D. melanogaster
tatttggtggcat

SEQ ID NO: 645528 - DNA, 13 bp, D. melanogaster
tatttggtgtcat

SEQ ID NO: 645529 - DNA, 13 bp, D. melanogaster
tatttggttaaat

SEQ ID NO: 645530 - DNA, 13 bp, D. melanogaster
tatttggttgtac

SEQ ID NO: 645531 - DNA, 13 bp, D. melanogaster
tatttgtaaacat

SEQ ID NO: 645532 - DNA, 13 bp, D. melanogaster
tatttgtaaatgt

SEQ ID NO: 645533 - DNA, 13 bp, D. melanogaster
tatttgtaagctt

SEQ ID NO: 645534 - DNA, 13 bp, D. melanogaster
tatttgtacatta

SEQ ID NO: 645535 - DNA, 13 bp, D. melanogaster
tatttgtatactt

SEQ ID NO: 645536 - DNA, 13 bp, D. melanogaster
tatttgtatctgg

SEQ ID NO: 645537 - DNA, 13 bp, D. melanogaster
tatttgtatgctt

SEQ ID NO: 645538 - DNA, 13 bp, D. melanogaster
tatttgtattcct

SEQ ID NO: 645539 - DNA, 13 bp, D. melanogaster
tatttgtattcgt

SEQ ID NO: 645540 - DNA, 13 bp, D. melanogaster
tatttgtatttac

SEQ ID NO: 645541 - DNA, 13 bp, D. melanogaster
tatttgtatttca

SEQ ID NO: 645542 - DNA, 13 bp, D. melanogaster
tatttgtgcaaaa

SEQ ID NO: 645543 - DNA, 13 bp, D. melanogaster
tatttgtgcaaca

SEQ ID NO: 645544 - DNA, 13 bp, D. melanogaster
tatttgtgcaatt

SEQ ID NO: 645545 - DNA, 13 bp, D. melanogaster
tatttgtgcattt

SEQ ID NO: 645546 - DNA, 14 bp, D. melanogaster
tatttgtgtaaaat

SEQ ID NO: 645547 - DNA, 13 bp, D. melanogaster
tatttgtgtatct

SEQ ID NO: 645548 - DNA, 13 bp, D. melanogaster
tatttgttaaaag

SEQ ID NO: 645549 - DNA, 13 bp, D. melanogaster
tatttgttaaaca

SEQ ID NO: 645550 - DNA, 13 bp, D. melanogaster
tatttgttcatat

SEQ ID NO: 645551 - DNA, 13 bp, D. melanogaster
tatttgttgaaaa

SEQ ID NO: 645552 - DNA, 14 bp, D. melanogaster
tatttgttgcatat

SEQ ID NO: 645553 - DNA, 13 bp, D. melanogaster
tatttgttggcat

SEQ ID NO: 645554 - DNA, 13 bp, D. melanogaster
tatttgttggctt

SEQ ID NO: 645555 - DNA, 14 bp, D. melanogaster
tatttgttgtgctg

SEQ ID NO: 645556 - DNA, 14 bp, D. melanogaster
tatttgttgttgct

SEQ ID NO: 645557 - DNA, 13 bp, D. melanogaster
tatttgtttaact

SEQ ID NO: 645558 - DNA, 14 bp, D. melanogaster
tatttgtttgcatt

SEQ ID NO: 645559 - DNA, 14 bp, D. melanogaster
tatttgttttatcg

SEQ ID NO: 645560 - DNA, 13 bp, D. melanogaster
tatttgttttggc

SEQ ID NO: 645561 - DNA, 13 bp, D. melanogaster
tattttaaaaagg

SEQ ID NO: 645562 - DNA, 13 bp, D. melanogaster
tattttaaaacga

SEQ ID NO: 645563 - DNA, 13 bp, D. melanogaster
tattttaaaagca

SEQ ID NO: 645564 - DNA, 13 bp, D. melanogaster
tattttaaaagct

SEQ ID NO: 645565 - DNA, 13 bp, D. melanogaster
tattttaaaagga

SEQ ID NO: 645566 - DNA, 13 bp, D. melanogaster
tattttaaaagtg

SEQ ID NO: 645567 - DNA, 13 bp, D. melanogaster
tattttaaaatgg

SEQ ID NO: 645568 - DNA, 13 bp, D. melanogaster
tattttaaagcaa

SEQ ID NO: 645569 - DNA, 14 bp, D. melanogaster
tattttaaagcaaa

SEQ ID NO: 645570 - DNA, 13 bp, D. melanogaster
tattttaaagcca

SEQ ID NO: 645571 - DNA, 13 bp, D. melanogaster
tattttaaagcta

SEQ ID NO: 645572 - DNA, 13 bp, D. melanogaster
tattttaaatgtg

SEQ ID NO: 645573 - DNA, 13 bp, D. melanogaster
tattttaactggt

SEQ ID NO: 645574 - DNA, 13 bp, D. melanogaster
tattttaactgtt

SEQ ID NO: 645575 - DNA, 13 bp, D. melanogaster
tattttaagcaaa

SEQ ID NO: 645576 - DNA, 14 bp, D. melanogaster
tattttaagcattt

SEQ ID NO: 645577 - DNA, 13 bp, D. melanogaster
tattttaagctaa

SEQ ID NO: 645578 - DNA, 14 bp, D. melanogaster
tattttaagctttt

SEQ ID NO: 645579 - DNA, 13 bp, D. melanogaster
tattttaagtaca

SEQ ID NO: 645580 - DNA, 13 bp, D. melanogaster
tattttaatgatg

SEQ ID NO: 645581 - DNA, 13 bp, D. melanogaster
tattttaatgtac

SEQ ID NO: 645582 - DNA, 13 bp, D. melanogaster
tattttaattagc

SEQ ID NO: 645583 - DNA, 13 bp, D. melanogaster
tattttaattgca

SEQ ID NO: 645584 - DNA, 13 bp, D. melanogaster
tattttaattgtc

SEQ ID NO: 645585 - DNA, 14 bp, D. melanogaster
tattttaattgtca

SEQ ID NO: 645586 - DNA, 14 bp, D. melanogaster
tattttaatttgtc

SEQ ID NO: 645587 - DNA, 13 bp, D. melanogaster
tattttacaacaa

SEQ ID NO: 645588 - DNA, 13 bp, D. melanogaster
tattttacaacca

SEQ ID NO: 645589 - DNA, 13 bp, D. melanogaster
tattttacaacga

SEQ ID NO: 645590 - DNA, 14 bp, D. melanogaster
tattttacaacgat

SEQ ID NO: 645591 - DNA, 13 bp, D. melanogaster
tattttacatgca

SEQ ID NO: 645592 - DNA, 13 bp, D. melanogaster
tattttactttgc

SEQ ID NO: 645593 - DNA, 13 bp, D. melanogaster
tattttagaaact

SEQ ID NO: 645594 - DNA, 13 bp, D. melanogaster
tattttagacaaa

SEQ ID NO: 645595 - DNA, 13 bp, D. melanogaster
tattttagcaaaa

SEQ ID NO: 645596 - DNA, 13 bp, D. melanogaster
tattttagctatt

SEQ ID NO: 645597 - DNA, 13 bp, D. melanogaster
tattttataccaa

SEQ ID NO: 645598 - DNA, 13 bp, D. melanogaster
tattttatagttc

SEQ ID NO: 645599 - DNA, 13 bp, D. melanogaster
tattttatatgct

SEQ ID NO: 645600 - DNA, 13 bp, D. melanogaster
tattttatccaaa

SEQ ID NO: 645601 - DNA, 13 bp, D. melanogaster
tattttatctatg

SEQ ID NO: 645602 - DNA, 13 bp, D. melanogaster
tattttatgcaaa

SEQ ID NO: 645603 - DNA, 14 bp, D. melanogaster
tattttatgcaaat

SEQ ID NO: 645604 - DNA, 13 bp, D. melanogaster
tattttatgcaat

SEQ ID NO: 645605 - DNA, 13 bp, D. melanogaster
tattttatgcata

SEQ ID NO: 645606 - DNA, 13 bp, D. melanogaster
tattttatgcatg

SEQ ID NO: 645607 - DNA, 13 bp, D. melanogaster
tattttatgcatt

SEQ ID NO: 645608 - DNA, 13 bp, D. melanogaster
tattttatggcat

SEQ ID NO: 645609 - DNA, 13 bp, D. melanogaster
tattttatgtgct

SEQ ID NO: 645610 - DNA, 13 bp, D. melanogaster
tattttattaagc

SEQ ID NO: 645611 - DNA, 13 bp, D. melanogaster
tattttattgaag

SEQ ID NO: 645612 - DNA, 13 bp, D. melanogaster
tattttattgcat

SEQ ID NO: 645613 - DNA, 13 bp, D. melanogaster
tattttattgtac

SEQ ID NO: 645614 - DNA, 13 bp, D. melanogaster
tattttatttcga

SEQ ID NO: 645615 - DNA, 13 bp, D. melanogaster
tattttatttcgc

SEQ ID NO: 645616 - DNA, 13 bp, D. melanogaster
tattttatttgca

SEQ ID NO: 645617 - DNA, 13 bp, D. melanogaster
tattttcaaaaga

SEQ ID NO: 645618 - DNA, 13 bp, D. melanogaster
tattttcaaaagc

SEQ ID NO: 645619 - DNA, 13 bp, D. melanogaster
tattttcaaaatc

SEQ ID NO: 645620 - DNA, 13 bp, D. melanogaster
tattttcaaagtt

SEQ ID NO: 645621 - DNA, 13 bp, D. melanogaster
tattttcaacaaa

SEQ ID NO: 645622 - DNA, 13 bp, D. melanogaster
tattttcaagata

SEQ ID NO: 645623 - DNA, 13 bp, D. melanogaster
tattttcaagtat

SEQ ID NO: 645624 - DNA, 15 bp, D. melanogaster
tattttcaagtatat

SEQ ID NO: 645625 - DNA, 13 bp, D. melanogaster
tattttcaataac

SEQ ID NO: 645626 - DNA, 13 bp, D. melanogaster
tattttcaatgaa

SEQ ID NO: 645627 - DNA, 13 bp, D. melanogaster
tattttcacaaat

SEQ ID NO: 645628 - DNA, 13 bp, D. melanogaster
tattttcagtttc

SEQ ID NO: 645629 - DNA, 13 bp, D. melanogaster
tattttcataatg

SEQ ID NO: 645630 - DNA, 13 bp, D. melanogaster
tattttcatatgt

SEQ ID NO: 645631 - DNA, 13 bp, D. melanogaster
tattttcattacc

SEQ ID NO: 645632 - DNA, 13 bp, D. melanogaster
tattttcattgaa

SEQ ID NO: 645633 - DNA, 13 bp, D. melanogaster
tattttcatttcg

SEQ ID NO: 645634 - DNA, 14 bp, D. melanogaster
tattttcatttcgt

SEQ ID NO: 645635 - DNA, 13 bp, D. melanogaster
tattttcatttgg

SEQ ID NO: 645636 - DNA, 13 bp, D. melanogaster
tattttccaaatg

SEQ ID NO: 645637 - DNA, 13 bp, D. melanogaster
tattttccaagaa

SEQ ID NO: 645638 - DNA, 13 bp, D. melanogaster
tattttccaatat

SEQ ID NO: 645639 - DNA, 13 bp, D. melanogaster
tattttccaatta

SEQ ID NO: 645640 - DNA, 13 bp, D. melanogaster
tattttccaattg

SEQ ID NO: 645641 - DNA, 14 bp, D. melanogaster
tattttccacagca

SEQ ID NO: 645642 - DNA, 13 bp, D. melanogaster
tattttccagctt

SEQ ID NO: 645643 - DNA, 13 bp, D. melanogaster
tattttccataat

SEQ ID NO: 645644 - DNA, 13 bp, D. melanogaster
tattttccatgtt

SEQ ID NO: 645645 - DNA, 13 bp, D. melanogaster
tattttccattgt

SEQ ID NO: 645646 - DNA, 13 bp, D. melanogaster
tattttccatttg

SEQ ID NO: 645647 - DNA, 13 bp, D. melanogaster
tattttcccactt

SEQ ID NO: 645648 - DNA, 13 bp, D. melanogaster
tattttcccagct

SEQ ID NO: 645649 - DNA, 13 bp, D. melanogaster
tattttccccagt

SEQ ID NO: 645650 - DNA, 13 bp, D. melanogaster
tattttccgcaat

SEQ ID NO: 645651 - DNA, 13 bp, D. melanogaster
tattttccgcttt

SEQ ID NO: 645652 - DNA, 13 bp, D. melanogaster
tattttcctaaaa

SEQ ID NO: 645653 - DNA, 13 bp, D. melanogaster
tattttcctgctg

SEQ ID NO: 645654 - DNA, 13 bp, D. melanogaster
tattttcctggaa

SEQ ID NO: 645655 - DNA, 13 bp, D. melanogaster
tattttcgaaaaa

SEQ ID NO: 645656 - DNA, 13 bp, D. melanogaster
tattttcgaaccg

SEQ ID NO: 645657 - DNA, 13 bp, D. melanogaster
tattttcgagtgc

SEQ ID NO: 645658 - DNA, 13 bp, D. melanogaster
tattttcgagttt

SEQ ID NO: 645659 - DNA, 13 bp, D. melanogaster
tattttcgatgtt

SEQ ID NO: 645660 - DNA, 13 bp, D. melanogaster
tattttcgcatat

SEQ ID NO: 645661 - DNA, 13 bp, D. melanogaster
tattttcgcattt

SEQ ID NO: 645662 - DNA, 13 bp, D. melanogaster
tattttcgccaat

SEQ ID NO: 645663 - DNA, 13 bp, D. melanogaster
tattttcgccacg

SEQ ID NO: 645664 - DNA, 13 bp, D. melanogaster
tattttcggtatt

SEQ ID NO: 645665 - DNA, 13 bp, D. melanogaster
tattttcgtaatt

SEQ ID NO: 645666 - DNA, 13 bp, D. melanogaster
tattttcgtactt

SEQ ID NO: 645667 - DNA, 13 bp, D. melanogaster
tattttcgttaat

SEQ ID NO: 645668 - DNA, 13 bp, D. melanogaster
tattttcgtttcg

SEQ ID NO: 645669 - DNA, 14 bp, D. melanogaster
tattttctacattc

SEQ ID NO: 645670 - DNA, 13 bp, D. melanogaster
tattttctagatt

SEQ ID NO: 645671 - DNA, 13 bp, D. melanogaster
tattttctagctt

SEQ ID NO: 645672 - DNA, 13 bp, D. melanogaster
tattttctcaata

SEQ ID NO: 645673 - DNA, 13 bp, D. melanogaster
tattttctctgtg

SEQ ID NO: 645674 - DNA, 14 bp, D. melanogaster
tattttctctgtgt

SEQ ID NO: 645675 - DNA, 13 bp, D. melanogaster
tattttctgaaat

SEQ ID NO: 645676 - DNA, 13 bp, D. melanogaster
tattttctgaatt

SEQ ID NO: 645677 - DNA, 13 bp, D. melanogaster
tattttctgatat

SEQ ID NO: 645678 - DNA, 14 bp, D. melanogaster
tattttctgatatt

SEQ ID NO: 645679 - DNA, 13 bp, D. melanogaster
tattttctgcaaa

SEQ ID NO: 645680 - DNA, 13 bp, D. melanogaster
tattttctgcatt

SEQ ID NO: 645681 - DNA, 13 bp, D. melanogaster
tattttctgcgtt

SEQ ID NO: 645682 - DNA, 13 bp, D. melanogaster
tattttctggcca

SEQ ID NO: 645683 - DNA, 13 bp, D. melanogaster
tattttctgttaa

SEQ ID NO: 645684 - DNA, 13 bp, D. melanogaster
tattttctttaag

SEQ ID NO: 645685 - DNA, 13 bp, D. melanogaster
tattttctttgca

SEQ ID NO: 645686 - DNA, 13 bp, D. melanogaster
tattttgaaaaac

SEQ ID NO: 645687 - DNA, 13 bp, D. melanogaster
tattttgaaaaca

SEQ ID NO: 645688 - DNA, 13 bp, D. melanogaster
tattttgaaaact

SEQ ID NO: 645689 - DNA, 13 bp, D. melanogaster
tattttgaatagc

SEQ ID NO: 645690 - DNA, 13 bp, D. melanogaster
tattttgaatagt

SEQ ID NO: 645691 - DNA, 14 bp, D. melanogaster
tattttgaattaag

SEQ ID NO: 645692 - DNA, 13 bp, D. melanogaster
tattttgacaatt

SEQ ID NO: 645693 - DNA, 13 bp, D. melanogaster
tattttgactatt

SEQ ID NO: 645694 - DNA, 13 bp, D. melanogaster
tattttgacttac

SEQ ID NO: 645695 - DNA, 13 bp, D. melanogaster
tattttgagcaaa

SEQ ID NO: 645696 - DNA, 13 bp, D. melanogaster
tattttgatcaaa

SEQ ID NO: 645697 - DNA, 13 bp, D. melanogaster
tattttgatttca

SEQ ID NO: 645698 - DNA, 14 bp, D. melanogaster
tattttgatttcca

SEQ ID NO: 645699 - DNA, 13 bp, D. melanogaster
tattttgcaaaat

SEQ ID NO: 645700 - DNA, 13 bp, D. melanogaster
tattttgcaaagt

SEQ ID NO: 645701 - DNA, 14 bp, D. melanogaster
tattttgcaaagta

SEQ ID NO: 645702 - DNA, 13 bp, D. melanogaster
tattttgcaagta

SEQ ID NO: 645703 - DNA, 13 bp, D. melanogaster
tattttgcaatgt

SEQ ID NO: 645704 - DNA, 13 bp, D. melanogaster
tattttgcaattt

SEQ ID NO: 645705 - DNA, 14 bp, D. melanogaster
tattttgcaatttg

SEQ ID NO: 645706 - DNA, 14 bp, D. melanogaster
tattttgcacattt

SEQ ID NO: 645707 - DNA, 13 bp, D. melanogaster
tattttgcataaa

SEQ ID NO: 645708 - DNA, 14 bp, D. melanogaster
tattttgcataatt

SEQ ID NO: 645709 - DNA, 13 bp, D. melanogaster
tattttgcatatt

SEQ ID NO: 645710 - DNA, 14 bp, D. melanogaster
tattttgcatattt

SEQ ID NO: 645711 - DNA, 13 bp, D. melanogaster
tattttgcattaa

SEQ ID NO: 645712 - DNA, 13 bp, D. melanogaster
tattttgccataa

SEQ ID NO: 645713 - DNA, 13 bp, D. melanogaster
tattttgctcgac

SEQ ID NO: 645714 - DNA, 13 bp, D. melanogaster
tattttgctcggc

SEQ ID NO: 645715 - DNA, 13 bp, D. melanogaster
tattttggaaaaa

SEQ ID NO: 645716 - DNA, 13 bp, D. melanogaster
tattttggaaatt

SEQ ID NO: 645717 - DNA, 14 bp, D. melanogaster
tattttggaaatta

SEQ ID NO: 645718 - DNA, 14 bp, D. melanogaster
tattttggaattcc

SEQ ID NO: 645719 - DNA, 13 bp, D. melanogaster
tattttggagaat

SEQ ID NO: 645720 - DNA, 13 bp, D. melanogaster
tattttggcaaaa

SEQ ID NO: 645721 - DNA, 13 bp, D. melanogaster
tattttggcaaac

SEQ ID NO: 645722 - DNA, 13 bp, D. melanogaster
tattttggccaaa

SEQ ID NO: 645723 - DNA, 13 bp, D. melanogaster
tattttggccaga

SEQ ID NO: 645724 - DNA, 13 bp, D. melanogaster
tattttggccttt

SEQ ID NO: 645725 - DNA, 13 bp, D. melanogaster
tattttggtaaat

SEQ ID NO: 645726 - DNA, 13 bp, D. melanogaster
tattttgtaagca

SEQ ID NO: 645727 - DNA, 13 bp, D. melanogaster
tattttgtacaaa

SEQ ID NO: 645728 - DNA, 13 bp, D. melanogaster
tattttgtacaat

SEQ ID NO: 645729 - DNA, 13 bp, D. melanogaster
tattttgtacaga

SEQ ID NO: 645730 - DNA, 13 bp, D. melanogaster
tattttgtacata

SEQ ID NO: 645731 - DNA, 13 bp, D. melanogaster
tattttgtacatt

SEQ ID NO: 645732 - DNA, 13 bp, D. melanogaster
tattttgtatact

SEQ ID NO: 645733 - DNA, 13 bp, D. melanogaster
tattttgtattcc

SEQ ID NO: 645734 - DNA, 13 bp, D. melanogaster
tattttgtcaaat

SEQ ID NO: 645735 - DNA, 13 bp, D. melanogaster
tattttgtctata

SEQ ID NO: 645736 - DNA, 13 bp, D. melanogaster
tattttgtgcaaa

SEQ ID NO: 645737 - DNA, 13 bp, D. melanogaster
tattttgtgttgc

SEQ ID NO: 645738 - DNA, 13 bp, D. melanogaster
tattttgttagca

SEQ ID NO: 645739 - DNA, 13 bp, D. melanogaster
tattttgttggcc

SEQ ID NO: 645740 - DNA, 13 bp, D. melanogaster
tattttgttgtac

SEQ ID NO: 645741 - DNA, 13 bp, D. melanogaster
tattttgtttgca

SEQ ID NO: 645742 - DNA, 14 bp, D. melanogaster
tatttttaaaagca

SEQ ID NO: 645743 - DNA, 13 bp, D. melanogaster
tatttttaaacac

SEQ ID NO: 645744 - DNA, 13 bp, D. melanogaster
tatttttaaacgc

SEQ ID NO: 645745 - DNA, 13 bp, D. melanogaster
tatttttaaagga

SEQ ID NO: 645746 - DNA, 13 bp, D. melanogaster
tatttttaaccaa

SEQ ID NO: 645747 - DNA, 13 bp, D. melanogaster
tatttttaacgat

SEQ ID NO: 645748 - DNA, 13 bp, D. melanogaster
tatttttaagaac

SEQ ID NO: 645749 - DNA, 13 bp, D. melanogaster
tatttttaagagt

SEQ ID NO: 645750 - DNA, 13 bp, D. melanogaster
tatttttaagcca

SEQ ID NO: 645751 - DNA, 13 bp, D. melanogaster
tatttttaaggat

SEQ ID NO: 645752 - DNA, 13 bp, D. melanogaster
tatttttaatacg

SEQ ID NO: 645753 - DNA, 13 bp, D. melanogaster
tatttttacacac

SEQ ID NO: 645754 - DNA, 13 bp, D. melanogaster
tatttttacattg

SEQ ID NO: 645755 - DNA, 13 bp, D. melanogaster
tatttttaccaaa

SEQ ID NO: 645756 - DNA, 14 bp, D. melanogaster
tatttttaccaaat

SEQ ID NO: 645757 - DNA, 13 bp, D. melanogaster
tatttttacgatt

SEQ ID NO: 645758 - DNA, 13 bp, D. melanogaster
tatttttactgta

SEQ ID NO: 645759 - DNA, 13 bp, D. melanogaster
tatttttagagat

SEQ ID NO: 645760 - DNA, 13 bp, D. melanogaster
tatttttatagca

SEQ ID NO: 645761 - DNA, 13 bp, D. melanogaster
tatttttatggcc

SEQ ID NO: 645762 - DNA, 13 bp, D. melanogaster
tatttttatggct

SEQ ID NO: 645763 - DNA, 13 bp, D. melanogaster
tatttttattcgc

SEQ ID NO: 645764 - DNA, 13 bp, D. melanogaster
tatttttattggc

SEQ ID NO: 645765 - DNA, 13 bp, D. melanogaster
tatttttcacaaa

SEQ ID NO: 645766 - DNA, 13 bp, D. melanogaster
tatttttccaact

SEQ ID NO: 645767 - DNA, 14 bp, D. melanogaster
tatttttccaataa

SEQ ID NO: 645768 - DNA, 13 bp, D. melanogaster
tatttttccagct

SEQ ID NO: 645769 - DNA, 13 bp, D. melanogaster
tatttttcgcata

SEQ ID NO: 645770 - DNA, 14 bp, D. melanogaster
tatttttcgcataa

SEQ ID NO: 645771 - DNA, 13 bp, D. melanogaster
tatttttcggaaa

SEQ ID NO: 645772 - DNA, 13 bp, D. melanogaster
tatttttcggctt

SEQ ID NO: 645773 - DNA, 13 bp, D. melanogaster
tatttttctgagt

SEQ ID NO: 645774 - DNA, 13 bp, D. melanogaster
tatttttgaaact

SEQ ID NO: 645775 - DNA, 13 bp, D. melanogaster
tatttttgaaaga

SEQ ID NO: 645776 - DNA, 13 bp, D. melanogaster
tatttttgaacat

SEQ ID NO: 645777 - DNA, 13 bp, D. melanogaster
tatttttgaagtc

SEQ ID NO: 645778 - DNA, 13 bp, D. melanogaster
tatttttgaatgc

SEQ ID NO: 645779 - DNA, 13 bp, D. melanogaster
tatttttgaatgg

SEQ ID NO: 645780 - DNA, 13 bp, D. melanogaster
tatttttgacagc

SEQ ID NO: 645781 - DNA, 13 bp, D. melanogaster
tatttttgacatt

SEQ ID NO: 645782 - DNA, 13 bp, D. melanogaster
tatttttgatcaa

SEQ ID NO: 645783 - DNA, 13 bp, D. melanogaster
tatttttgatcag

SEQ ID NO: 645784 - DNA, 13 bp, D. melanogaster
tatttttgcacca

SEQ ID NO: 645785 - DNA, 14 bp, D. melanogaster
tatttttgcaccag

SEQ ID NO: 645786 - DNA, 13 bp, D. melanogaster
tatttttgcatat

SEQ ID NO: 645787 - DNA, 13 bp, D. melanogaster
tatttttgccaaa

SEQ ID NO: 645788 - DNA, 13 bp, D. melanogaster
tatttttgccagt

SEQ ID NO: 645789 - DNA, 13 bp, D. melanogaster
tatttttgcgaaa

SEQ ID NO: 645790 - DNA, 13 bp, D. melanogaster
tatttttggaaaa

SEQ ID NO: 645791 - DNA, 13 bp, D. melanogaster
tatttttggaaat

SEQ ID NO: 645792 - DNA, 14 bp, D. melanogaster
tatttttggccaaa

SEQ ID NO: 645793 - DNA, 13 bp, D. melanogaster
tatttttggccat

SEQ ID NO: 645794 - DNA, 13 bp, D. melanogaster
tatttttgggaat

SEQ ID NO: 645795 - DNA, 13 bp, D. melanogaster
tatttttgggcat

SEQ ID NO: 645796 - DNA, 13 bp, D. melanogaster
tatttttgggcga

SEQ ID NO: 645797 - DNA, 14 bp, D. melanogaster
tatttttgggcgat

SEQ ID NO: 645798 - DNA, 15 bp, D. melanogaster
tatttttgggcgatg

SEQ ID NO: 645799 - DNA, 13 bp, D. melanogaster
tatttttggtaaa

SEQ ID NO: 645800 - DNA, 13 bp, D. melanogaster
tatttttggtcaa

SEQ ID NO: 645801 - DNA, 13 bp, D. melanogaster
tatttttgtatac

SEQ ID NO: 645802 - DNA, 13 bp, D. melanogaster
tatttttgtgctg

SEQ ID NO: 645803 - DNA, 13 bp, D. melanogaster
tatttttgtggcc

SEQ ID NO: 645804 - DNA, 13 bp, D. melanogaster
tatttttgtggct

SEQ ID NO: 645805 - DNA, 14 bp, D. melanogaster
tatttttgtgggct

SEQ ID NO: 645806 - DNA, 13 bp, D. melanogaster
tattttttaagtc

SEQ ID NO: 645807 - DNA, 13 bp, D. melanogaster
tattttttatgcc

SEQ ID NO: 645808 - DNA, 13 bp, D. melanogaster
tattttttcacca

SEQ ID NO: 645809 - DNA, 13 bp, D. melanogaster
tattttttcggtg

SEQ ID NO: 645810 - DNA, 13 bp, D. melanogaster
tattttttggcag

SEQ ID NO: 645811 - DNA, 14 bp, D. melanogaster
tattttttggcatc

SEQ ID NO: 645812 - DNA, 13 bp, D. melanogaster
tattttttgtgcc

SEQ ID NO: 645813 - DNA, 13 bp, D. melanogaster
tattttttgtgcg

SEQ ID NO: 645814 - DNA, 14 bp, D. melanogaster
tatttttttcggtg

SEQ ID NO: 645815 - DNA, 13 bp, D. melanogaster
tcaaaaaaccgca

SEQ ID NO: 645816 - DNA, 13 bp, D. melanogaster
tcaaaaaacttca

SEQ ID NO: 645817 - DNA, 13 bp, D. melanogaster
tcaaaaaatactt

SEQ ID NO: 645818 - DNA, 15 bp, D. melanogaster
tcaaaaaatcgtggc

SEQ ID NO: 645819 - DNA, 13 bp, D. melanogaster
tcaaaaaatggaa

SEQ ID NO: 645820 - DNA, 13 bp, D. melanogaster
tcaaaaacaagta

SEQ ID NO: 645821 - DNA, 13 bp, D. melanogaster
tcaaaaacacatt

SEQ ID NO: 645822 - DNA, 13 bp, D. melanogaster
tcaaaaacagttt

SEQ ID NO: 645823 - DNA, 13 bp, D. melanogaster
tcaaaaaccagaa

SEQ ID NO: 645824 - DNA, 13 bp, D. melanogaster
tcaaaaaccattt

SEQ ID NO: 645825 - DNA, 13 bp, D. melanogaster
tcaaaaactatag

SEQ ID NO: 645826 - DNA, 14 bp, D. melanogaster
tcaaaaactataga

SEQ ID NO: 645827 - DNA, 13 bp, D. melanogaster
tcaaaaactccca

SEQ ID NO: 645828 - DNA, 13 bp, D. melanogaster
tcaaaaactttgg

SEQ ID NO: 645829 - DNA, 13 bp, D. melanogaster
tcaaaaagaaatc

SEQ ID NO: 645830 - DNA, 14 bp, D. melanogaster
tcaaaaagcattca

SEQ ID NO: 645831 - DNA, 13 bp, D. melanogaster
tcaaaaagggtaa

SEQ ID NO: 645832 - DNA, 13 bp, D. melanogaster
tcaaaaagtaata

SEQ ID NO: 645833 - DNA, 13 bp, D. melanogaster
tcaaaaagtattt

SEQ ID NO: 645834 - DNA, 13 bp, D. melanogaster
tcaaaaagtcaaa

SEQ ID NO: 645835 - DNA, 13 bp, D. melanogaster
tcaaaaagtgata

SEQ ID NO: 645836 - DNA, 13 bp, D. melanogaster
tcaaaaagttaaa

SEQ ID NO: 645837 - DNA, 13 bp, D. melanogaster
tcaaaaagttata

SEQ ID NO: 645838 - DNA, 13 bp, D. melanogaster
tcaaaaataatgt

SEQ ID NO: 645839 - DNA, 13 bp, D. melanogaster
tcaaaaatagtaa

SEQ ID NO: 645840 - DNA, 14 bp, D. melanogaster
tcaaaaatagtaag

SEQ ID NO: 645841 - DNA, 14 bp, D. melanogaster
tcaaaaatatcttt

SEQ ID NO: 645842 - DNA, 13 bp, D. melanogaster
tcaaaaatatgta

SEQ ID NO: 645843 - DNA, 13 bp, D. melanogaster
tcaaaaatattcg

SEQ ID NO: 645844 - DNA, 13 bp, D. melanogaster
tcaaaaatcaatt

SEQ ID NO: 645845 - DNA, 13 bp, D. melanogaster
tcaaaaatcgaat

SEQ ID NO: 645846 - DNA, 13 bp, D. melanogaster
tcaaaaatcgatt

SEQ ID NO: 645847 - DNA, 14 bp, D. melanogaster
tcaaaaatgaacaa

SEQ ID NO: 645848 - DNA, 13 bp, D. melanogaster
tcaaaaatgaatt

SEQ ID NO: 645849 - DNA, 13 bp, D. melanogaster
tcaaaaatgcaag

SEQ ID NO: 645850 - DNA, 13 bp, D. melanogaster
tcaaaaatgcgaa

SEQ ID NO: 645851 - DNA, 13 bp, D. melanogaster
tcaaaaatggaaa

SEQ ID NO: 645852 - DNA, 13 bp, D. melanogaster
tcaaaaatggctc

SEQ ID NO: 645853 - DNA, 13 bp, D. melanogaster
tcaaaaatgtaaa

SEQ ID NO: 645854 - DNA, 13 bp, D. melanogaster
tcaaaaatgtatt

SEQ ID NO: 645855 - DNA, 14 bp, D. melanogaster
tcaaaaatgtattt

SEQ ID NO: 645856 - DNA, 13 bp, D. melanogaster
tcaaaaatgtgga

SEQ ID NO: 645857 - DNA, 13 bp, D. melanogaster
tcaaaaatgtttc

SEQ ID NO: 645858 - DNA, 13 bp, D. melanogaster
tcaaaaattcaac

SEQ ID NO: 645859 - DNA, 13 bp, D. melanogaster
tcaaaaattcatt

SEQ ID NO: 645860 - DNA, 13 bp, D. melanogaster
tcaaaaattcgat

SEQ ID NO: 645861 - DNA, 13 bp, D. melanogaster
tcaaaaattctac

SEQ ID NO: 645862 - DNA, 13 bp, D. melanogaster
tcaaaaattgaaa

SEQ ID NO: 645863 - DNA, 13 bp, D. melanogaster
tcaaaaattgttt

SEQ ID NO: 645864 - DNA, 13 bp, D. melanogaster
tcaaaaatttcca

SEQ ID NO: 645865 - DNA, 13 bp, D. melanogaster
tcaaaacaaagca

SEQ ID NO: 645866 - DNA, 13 bp, D. melanogaster
tcaaaacaaatcg

SEQ ID NO: 645867 - DNA, 13 bp, D. melanogaster
tcaaaacaagaat

SEQ ID NO: 645868 - DNA, 13 bp, D. melanogaster
tcaaaacaagcaa

SEQ ID NO: 645869 - DNA, 14 bp, D. melanogaster
tcaaaacaataagg

SEQ ID NO: 645870 - DNA, 13 bp, D. melanogaster
tcaaaacaattat

SEQ ID NO: 645871 - DNA, 13 bp, D. melanogaster
tcaaaacagtttt

SEQ ID NO: 645872 - DNA, 13 bp, D. melanogaster
tcaaaacataagc

SEQ ID NO: 645873 - DNA, 14 bp, D. melanogaster
tcaaaacataagca

SEQ ID NO: 645874 - DNA, 13 bp, D. melanogaster
tcaaaacatattt

SEQ ID NO: 645875 - DNA, 13 bp, D. melanogaster
tcaaaacatttat

SEQ ID NO: 645876 - DNA, 13 bp, D. melanogaster
tcaaaacatttta

SEQ ID NO: 645877 - DNA, 13 bp, D. melanogaster
tcaaaacattttt

SEQ ID NO: 645878 - DNA, 13 bp, D. melanogaster
tcaaaaccataat

SEQ ID NO: 645879 - DNA, 13 bp, D. melanogaster
tcaaaacccatat

SEQ ID NO: 645880 - DNA, 13 bp, D. melanogaster
tcaaaaccgaaaa

SEQ ID NO: 645881 - DNA, 14 bp, D. melanogaster
tcaaaaccttttga

SEQ ID NO: 645882 - DNA, 14 bp, D. melanogaster
tcaaaacgaaaaca

SEQ ID NO: 645883 - DNA, 13 bp, D. melanogaster
tcaaaacgacaaa

SEQ ID NO: 645884 - DNA, 13 bp, D. melanogaster
tcaaaactaaaga

SEQ ID NO: 645885 - DNA, 14 bp, D. melanogaster
tcaaaactatttat

SEQ ID NO: 645886 - DNA, 13 bp, D. melanogaster
tcaaaactcaatt

SEQ ID NO: 645887 - DNA, 13 bp, D. melanogaster
tcaaaactctttt

SEQ ID NO: 645888 - DNA, 13 bp, D. melanogaster
tcaaaactgaaat

SEQ ID NO: 645889 - DNA, 13 bp, D. melanogaster
tcaaaactgctaa

SEQ ID NO: 645890 - DNA, 13 bp, D. melanogaster
tcaaaactttatc

SEQ ID NO: 645891 - DNA, 13 bp, D. melanogaster
tcaaaactttcca

SEQ ID NO: 645892 - DNA, 13 bp, D. melanogaster
tcaaaacttttat

SEQ ID NO: 645893 - DNA, 13 bp, D. melanogaster
tcaaaagaatttt

SEQ ID NO: 645894 - DNA, 13 bp, D. melanogaster
tcaaaagcaaaag

SEQ ID NO: 645895 - DNA, 14 bp, D. melanogaster
tcaaaagcaaaagc

SEQ ID NO: 645896 - DNA, 13 bp, D. melanogaster
tcaaaagcaaata

SEQ ID NO: 645897 - DNA, 13 bp, D. melanogaster
tcaaaagcaaatc

SEQ ID NO: 645898 - DNA, 13 bp, D. melanogaster
tcaaaagcaacaa

SEQ ID NO: 645899 - DNA, 13 bp, D. melanogaster
tcaaaagcaattt

SEQ ID NO: 645900 - DNA, 13 bp, D. melanogaster
tcaaaagcacaaa

SEQ ID NO: 645901 - DNA, 13 bp, D. melanogaster
tcaaaagcatctc

SEQ ID NO: 645902 - DNA, 13 bp, D. melanogaster
tcaaaagcatctg

SEQ ID NO: 645903 - DNA, 13 bp, D. melanogaster
tcaaaagcatttc

SEQ ID NO: 645904 - DNA, 13 bp, D. melanogaster
tcaaaagccaaac

SEQ ID NO: 645905 - DNA, 13 bp, D. melanogaster
tcaaaagcgattt

SEQ ID NO: 645906 - DNA, 13 bp, D. melanogaster
tcaaaagctaacc

SEQ ID NO: 645907 - DNA, 13 bp, D. melanogaster
tcaaaagctttaa

SEQ ID NO: 645908 - DNA, 13 bp, D. melanogaster
tcaaaaggaattt

SEQ ID NO: 645909 - DNA, 13 bp, D. melanogaster
tcaaaaggaggga

SEQ ID NO: 645910 - DNA, 13 bp, D. melanogaster
tcaaaaggagtaa

SEQ ID NO: 645911 - DNA, 13 bp, D. melanogaster
tcaaaaggggttt

SEQ ID NO: 645912 - DNA, 13 bp, D. melanogaster
tcaaaaggtattt

SEQ ID NO: 645913 - DNA, 13 bp, D. melanogaster
tcaaaagtaataa

SEQ ID NO: 645914 - DNA, 13 bp, D. melanogaster
tcaaaagtattta

SEQ ID NO: 645915 - DNA, 13 bp, D. melanogaster
tcaaaagtatttc

SEQ ID NO: 645916 - DNA, 13 bp, D. melanogaster
tcaaaagtatttt

SEQ ID NO: 645917 - DNA, 13 bp, D. melanogaster
tcaaaagtcaatt

SEQ ID NO: 645918 - DNA, 13 bp, D. melanogaster
tcaaaagtgaaat

SEQ ID NO: 645919 - DNA, 13 bp, D. melanogaster
tcaaaagtgtcaa

SEQ ID NO: 645920 - DNA, 13 bp, D. melanogaster
tcaaaagtgtggg

SEQ ID NO: 645921 - DNA, 14 bp, D. melanogaster
tcaaaagtgtgggc

SEQ ID NO: 645922 - DNA, 13 bp, D. melanogaster
tcaaaagttattt

SEQ ID NO: 645923 - DNA, 13 bp, D. melanogaster
tcaaaagtttatt

SEQ ID NO: 645924 - DNA, 13 bp, D. melanogaster
tcaaaataataga

SEQ ID NO: 645925 - DNA, 13 bp, D. melanogaster
tcaaaatacaaga

SEQ ID NO: 645926 - DNA, 14 bp, D. melanogaster
tcaaaatacaattt

SEQ ID NO: 645927 - DNA, 14 bp, D. melanogaster
tcaaaatagtcaac

SEQ ID NO: 645928 - DNA, 13 bp, D. melanogaster
tcaaaatagtttt

SEQ ID NO: 645929 - DNA, 13 bp, D. melanogaster
tcaaaatatttga

SEQ ID NO: 645930 - DNA, 13 bp, D. melanogaster
tcaaaatcaaatc

SEQ ID NO: 645931 - DNA, 13 bp, D. melanogaster
tcaaaatcaaatt

SEQ ID NO: 645932 - DNA, 13 bp, D. melanogaster
tcaaaatcaactt

SEQ ID NO: 645933 - DNA, 13 bp, D. melanogaster
tcaaaatcaatca

SEQ ID NO: 645934 - DNA, 13 bp, D. melanogaster
tcaaaatcagaat

SEQ ID NO: 645935 - DNA, 13 bp, D. melanogaster
tcaaaatcatatt

SEQ ID NO: 645936 - DNA, 13 bp, D. melanogaster
tcaaaatcatttt

SEQ ID NO: 645937 - DNA, 13 bp, D. melanogaster
tcaaaatccaaat

SEQ ID NO: 645938 - DNA, 13 bp, D. melanogaster
tcaaaatcgaaat

SEQ ID NO: 645939 - DNA, 14 bp, D. melanogaster
tcaaaatcgaaatc

SEQ ID NO: 645940 - DNA, 14 bp, D. melanogaster
tcaaaatcgaattc

SEQ ID NO: 645941 - DNA, 13 bp, D. melanogaster
tcaaaatcgacca

SEQ ID NO: 645942 - DNA, 13 bp, D. melanogaster
tcaaaatctattt

SEQ ID NO: 645943 - DNA, 13 bp, D. melanogaster
tcaaaatgaagaa

SEQ ID NO: 645944 - DNA, 13 bp, D. melanogaster
tcaaaatgacaaa

SEQ ID NO: 645945 - DNA, 13 bp, D. melanogaster
tcaaaatgactat

SEQ ID NO: 645946 - DNA, 13 bp, D. melanogaster
tcaaaatgattta

SEQ ID NO: 645947 - DNA, 13 bp, D. melanogaster
tcaaaatgcaaaa

SEQ ID NO: 645948 - DNA, 13 bp, D. melanogaster
tcaaaatgcaatt

SEQ ID NO: 645949 - DNA, 14 bp, D. melanogaster
tcaaaatgcaattt

SEQ ID NO: 645950 - DNA, 13 bp, D. melanogaster
tcaaaatgcagag

SEQ ID NO: 645951 - DNA, 13 bp, D. melanogaster
tcaaaatgccaaa

SEQ ID NO: 645952 - DNA, 13 bp, D. melanogaster
tcaaaatgccagc

SEQ ID NO: 645953 - DNA, 14 bp, D. melanogaster
tcaaaatggaagag

SEQ ID NO: 645954 - DNA, 13 bp, D. melanogaster
tcaaaatggcatt

SEQ ID NO: 645955 - DNA, 13 bp, D. melanogaster
tcaaaatggtttt

SEQ ID NO: 645956 - DNA, 13 bp, D. melanogaster
tcaaaatgtaaat

SEQ ID NO: 645957 - DNA, 13 bp, D. melanogaster
tcaaaatgtaagc

SEQ ID NO: 645958 - DNA, 13 bp, D. melanogaster
tcaaaatgtaatt

SEQ ID NO: 645959 - DNA, 14 bp, D. melanogaster
tcaaaatgtaattg

SEQ ID NO: 645960 - DNA, 13 bp, D. melanogaster
tcaaaatgttaat

SEQ ID NO: 645961 - DNA, 13 bp, D. melanogaster
tcaaaatgttatt

SEQ ID NO: 645962 - DNA, 13 bp, D. melanogaster
tcaaaatgtttga

SEQ ID NO: 645963 - DNA, 13 bp, D. melanogaster
tcaaaatgtttgt

SEQ ID NO: 645964 - DNA, 13 bp, D. melanogaster
tcaaaatgttttg

SEQ ID NO: 645965 - DNA, 13 bp, D. melanogaster
tcaaaattaatca

SEQ ID NO: 645966 - DNA, 13 bp, D. melanogaster
tcaaaattaattg

SEQ ID NO: 645967 - DNA, 13 bp, D. melanogaster
tcaaaattgaaaa

SEQ ID NO: 645968 - DNA, 13 bp, D. melanogaster
tcaaaattggcaa

SEQ ID NO: 645969 - DNA, 13 bp, D. melanogaster
tcaaaattgtaaa

SEQ ID NO: 645970 - DNA, 13 bp, D. melanogaster
tcaaaattgttta

SEQ ID NO: 645971 - DNA, 14 bp, D. melanogaster
tcaaaattgtttaa

SEQ ID NO: 645972 - DNA, 13 bp, D. melanogaster
tcaaaattgtttg

SEQ ID NO: 645973 - DNA, 13 bp, D. melanogaster
tcaaaattgtttt

SEQ ID NO: 645974 - DNA, 13 bp, D. melanogaster
tcaaaatttaatg

SEQ ID NO: 645975 - DNA, 13 bp, D. melanogaster
tcaaaatttccaa

SEQ ID NO: 645976 - DNA, 13 bp, D. melanogaster
tcaaaatttgaaa

SEQ ID NO: 645977 - DNA, 14 bp, D. melanogaster
tcaaaatttgaaaa

SEQ ID NO: 645978 - DNA, 13 bp, D. melanogaster
tcaaaatttgtca

SEQ ID NO: 645979 - DNA, 13 bp, D. melanogaster
tcaaaatttgttc

SEQ ID NO: 645980 - DNA, 14 bp, D. melanogaster
tcaaaatttgttta

SEQ ID NO: 645981 - DNA, 13 bp, D. melanogaster
tcaaaattttgca

SEQ ID NO: 645982 - DNA, 13 bp, D. melanogaster
tcaaaattttgct

SEQ ID NO: 645983 - DNA, 13 bp, D. melanogaster
tcaaacaaaatct

SEQ ID NO: 645984 - DNA, 13 bp, D. melanogaster
tcaaacaaaatgg

SEQ ID NO: 645985 - DNA, 13 bp, D. melanogaster
tcaaacaacatat

SEQ ID NO: 645986 - DNA, 13 bp, D. melanogaster
tcaaacaatttca

SEQ ID NO: 645987 - DNA, 13 bp, D. melanogaster
tcaaacaatttgc

SEQ ID NO: 645988 - DNA, 14 bp, D. melanogaster
tcaaacaattttat

SEQ ID NO: 645989 - DNA, 14 bp, D. melanogaster
tcaaacacataaag

SEQ ID NO: 645990 - DNA, 13 bp, D. melanogaster
tcaaacacatttt

SEQ ID NO: 645991 - DNA, 13 bp, D. melanogaster
tcaaacagaaaca

SEQ ID NO: 645992 - DNA, 14 bp, D. melanogaster
tcaaacatacaaat

SEQ ID NO: 645993 - DNA, 13 bp, D. melanogaster
tcaaacatacata

SEQ ID NO: 645994 - DNA, 13 bp, D. melanogaster
tcaaacatttgtc

SEQ ID NO: 645995 - DNA, 13 bp, D. melanogaster
tcaaacatttttt

SEQ ID NO: 645996 - DNA, 13 bp, D. melanogaster
tcaaaccaaacat

SEQ ID NO: 645997 - DNA, 13 bp, D. melanogaster
tcaaaccaagtga

SEQ ID NO: 645998 - DNA, 13 bp, D. melanogaster
tcaaaccagtcat

SEQ ID NO: 645999 - DNA, 13 bp, D. melanogaster
tcaaaccattttt

SEQ ID NO: 646000 - DNA, 14 bp, D. melanogaster
tcaaaccatttttt

SEQ ID NO: 646001 - DNA, 13 bp, D. melanogaster
tcaaacgggatct

SEQ ID NO: 646002 - DNA, 13 bp, D. melanogaster
tcaaacgtattta

SEQ ID NO: 646003 - DNA, 13 bp, D. melanogaster
tcaaactactaca

SEQ ID NO: 646004 - DNA, 13 bp, D. melanogaster
tcaaactcaaaat

SEQ ID NO: 646005 - DNA, 13 bp, D. melanogaster
tcaaactcaaatg

SEQ ID NO: 646006 - DNA, 13 bp, D. melanogaster
tcaaactgaaaaa

SEQ ID NO: 646007 - DNA, 13 bp, D. melanogaster
tcaaactgaaact

SEQ ID NO: 646008 - DNA, 13 bp, D. melanogaster
tcaaactgtctta

SEQ ID NO: 646009 - DNA, 13 bp, D. melanogaster
tcaaactttttaa

SEQ ID NO: 646010 - DNA, 13 bp, D. melanogaster
tcaaagaaaactt

SEQ ID NO: 646011 - DNA, 13 bp, D. melanogaster
tcaaagaaaagct

SEQ ID NO: 646012 - DNA, 13 bp, D. melanogaster
tcaaagaaaagga

SEQ ID NO: 646013 - DNA, 13 bp, D. melanogaster
tcaaagaaaagtt

SEQ ID NO: 646014 - DNA, 13 bp, D. melanogaster
tcaaagaaaatgt

SEQ ID NO: 646015 - DNA, 13 bp, D. melanogaster
tcaaagaaatcat

SEQ ID NO: 646016 - DNA, 13 bp, D. melanogaster
tcaaagaaatttc

SEQ ID NO: 646017 - DNA, 13 bp, D. melanogaster
tcaaagaactgca

SEQ ID NO: 646018 - DNA, 13 bp, D. melanogaster
tcaaagaacttct

SEQ ID NO: 646019 - DNA, 13 bp, D. melanogaster
tcaaagaatattt

SEQ ID NO: 646020 - DNA, 13 bp, D. melanogaster
tcaaagacaacaa

SEQ ID NO: 646021 - DNA, 13 bp, D. melanogaster
tcaaagacaatag

SEQ ID NO: 646022 - DNA, 13 bp, D. melanogaster
tcaaagacaatct

SEQ ID NO: 646023 - DNA, 13 bp, D. melanogaster
tcaaagacttaaa

SEQ ID NO: 646024 - DNA, 14 bp, D. melanogaster
tcaaagagcaactg

SEQ ID NO: 646025 - DNA, 13 bp, D. melanogaster
tcaaagagcacaa

SEQ ID NO: 646026 - DNA, 13 bp, D. melanogaster
tcaaagagctaaa

SEQ ID NO: 646027 - DNA, 13 bp, D. melanogaster
tcaaagagttttt

SEQ ID NO: 646028 - DNA, 13 bp, D. melanogaster
tcaaagataaata

SEQ ID NO: 646029 - DNA, 14 bp, D. melanogaster
tcaaagatgccaaa

SEQ ID NO: 646030 - DNA, 13 bp, D. melanogaster
tcaaagattctga

SEQ ID NO: 646031 - DNA, 14 bp, D. melanogaster
tcaaagatttcagt

SEQ ID NO: 646032 - DNA, 13 bp, D. melanogaster
tcaaagatttttt

SEQ ID NO: 646033 - DNA, 13 bp, D. melanogaster
tcaaagcaaaaac

SEQ ID NO: 646034 - DNA, 14 bp, D. melanogaster
tcaaagcaaaaaca

SEQ ID NO: 646035 - DNA, 13 bp, D. melanogaster
tcaaagcaaaaat

SEQ ID NO: 646036 - DNA, 13 bp, D. melanogaster
tcaaagcaaaaca

SEQ ID NO: 646037 - DNA, 13 bp, D. melanogaster
tcaaagcaaatca

SEQ ID NO: 646038 - DNA, 13 bp, D. melanogaster
tcaaagcaacgag

SEQ ID NO: 646039 - DNA, 13 bp, D. melanogaster
tcaaagccaacaa

SEQ ID NO: 646040 - DNA, 13 bp, D. melanogaster
tcaaagccagcgg

SEQ ID NO: 646041 - DNA, 14 bp, D. melanogaster
tcaaagccagcgga

SEQ ID NO: 646042 - DNA, 13 bp, D. melanogaster
tcaaagcgaaaaa

SEQ ID NO: 646043 - DNA, 13 bp, D. melanogaster
tcaaagctgtttg

SEQ ID NO: 646044 - DNA, 13 bp, D. melanogaster
tcaaaggagatcg

SEQ ID NO: 646045 - DNA, 14 bp, D. melanogaster
tcaaaggagatcgg

SEQ ID NO: 646046 - DNA, 13 bp, D. melanogaster
tcaaaggattttc

SEQ ID NO: 646047 - DNA, 13 bp, D. melanogaster
tcaaaggcaattt

SEQ ID NO: 646048 - DNA, 13 bp, D. melanogaster
tcaaaggtgagaa

SEQ ID NO: 646049 - DNA, 13 bp, D. melanogaster
tcaaaggttggca

SEQ ID NO: 646050 - DNA, 14 bp, D. melanogaster
tcaaagtaaacaaa

SEQ ID NO: 646051 - DNA, 13 bp, D. melanogaster
tcaaagtaaataa

SEQ ID NO: 646052 - DNA, 13 bp, D. melanogaster
tcaaagtaagatc

SEQ ID NO: 646053 - DNA, 13 bp, D. melanogaster
tcaaagtatgtaa

SEQ ID NO: 646054 - DNA, 13 bp, D. melanogaster
tcaaagtatttaa

SEQ ID NO: 646055 - DNA, 14 bp, D. melanogaster
tcaaagtcaaagtc

SEQ ID NO: 646056 - DNA, 13 bp, D. melanogaster
tcaaagtcaaatt

SEQ ID NO: 646057 - DNA, 13 bp, D. melanogaster
tcaaagtcaagtt

SEQ ID NO: 646058 - DNA, 13 bp, D. melanogaster
tcaaagtgaaaag

SEQ ID NO: 646059 - DNA, 13 bp, D. melanogaster
tcaaagtgcaatt

SEQ ID NO: 646060 - DNA, 13 bp, D. melanogaster
tcaaagtgcattt

SEQ ID NO: 646061 - DNA, 13 bp, D. melanogaster
tcaaagtggaaaa

SEQ ID NO: 646062 - DNA, 13 bp, D. melanogaster
tcaaagtgtgctg

SEQ ID NO: 646063 - DNA, 13 bp, D. melanogaster
tcaaagttaaaat

SEQ ID NO: 646064 - DNA, 13 bp, D. melanogaster
tcaaagttaaagt

SEQ ID NO: 646065 - DNA, 13 bp, D. melanogaster
tcaaagttcaaaa

SEQ ID NO: 646066 - DNA, 13 bp, D. melanogaster
tcaaagttcaatg

SEQ ID NO: 646067 - DNA, 13 bp, D. melanogaster
tcaaagttgaaaa

SEQ ID NO: 646068 - DNA, 13 bp, D. melanogaster
tcaaagttggaaa

SEQ ID NO: 646069 - DNA, 13 bp, D. melanogaster
tcaaagttttctg

SEQ ID NO: 646070 - DNA, 13 bp, D. melanogaster
tcaaagttttttt

SEQ ID NO: 646071 - DNA, 14 bp, D. melanogaster
tcaaataaaagcaa

SEQ ID NO: 646072 - DNA, 13 bp, D. melanogaster
tcaaataaaagtg

SEQ ID NO: 646073 - DNA, 13 bp, D. melanogaster
tcaaataaaatcg

SEQ ID NO: 646074 - DNA, 14 bp, D. melanogaster
tcaaataaaatcgt

SEQ ID NO: 646075 - DNA, 14 bp, D. melanogaster
tcaaataaaatgaa

SEQ ID NO: 646076 - DNA, 13 bp, D. melanogaster
tcaaataaaatgc

SEQ ID NO: 646077 - DNA, 13 bp, D. melanogaster
tcaaataaaattc

SEQ ID NO: 646078 - DNA, 14 bp, D. melanogaster
tcaaataaataatg

SEQ ID NO: 646079 - DNA, 13 bp, D. melanogaster
tcaaataaatatc

SEQ ID NO: 646080 - DNA, 13 bp, D. melanogaster
tcaaataaatgca

SEQ ID NO: 646081 - DNA, 13 bp, D. melanogaster
tcaaataataatc

SEQ ID NO: 646082 - DNA, 13 bp, D. melanogaster
tcaaataatcagt

SEQ ID NO: 646083 - DNA, 14 bp, D. melanogaster
tcaaataatcagtt

SEQ ID NO: 646084 - DNA, 13 bp, D. melanogaster
tcaaataattgaa

SEQ ID NO: 646085 - DNA, 13 bp, D. melanogaster
tcaaataatttcc

SEQ ID NO: 646086 - DNA, 13 bp, D. melanogaster
tcaaataatttgt

SEQ ID NO: 646087 - DNA, 13 bp, D. melanogaster
tcaaatacatatt

SEQ ID NO: 646088 - DNA, 14 bp, D. melanogaster
tcaaatacttcaaa

SEQ ID NO: 646089 - DNA, 14 bp, D. melanogaster
tcaaatagccaaac

SEQ ID NO: 646090 - DNA, 15 bp, D. melanogaster
tcaaataggtttctt

SEQ ID NO: 646091 - DNA, 13 bp, D. melanogaster
tcaaatatcaaat

SEQ ID NO: 646092 - DNA, 13 bp, D. melanogaster
tcaaatatcgaat

SEQ ID NO: 646093 - DNA, 13 bp, D. melanogaster
tcaaatatgaaat

SEQ ID NO: 646094 - DNA, 13 bp, D. melanogaster
tcaaatatgtaaa

SEQ ID NO: 646095 - DNA, 13 bp, D. melanogaster
tcaaatattaaag

SEQ ID NO: 646096 - DNA, 13 bp, D. melanogaster
tcaaatattcaat

SEQ ID NO: 646097 - DNA, 13 bp, D. melanogaster
tcaaatattcgtt

SEQ ID NO: 646098 - DNA, 13 bp, D. melanogaster
tcaaatattgaag

SEQ ID NO: 646099 - DNA, 13 bp, D. melanogaster
tcaaatatttaca

SEQ ID NO: 646100 - DNA, 13 bp, D. melanogaster
tcaaatattttct

SEQ ID NO: 646101 - DNA, 14 bp, D. melanogaster
tcaaatattttgtt

SEQ ID NO: 646102 - DNA, 13 bp, D. melanogaster
tcaaatatttttg

SEQ ID NO: 646103 - DNA, 13 bp, D. melanogaster
tcaaatcaaaagc

SEQ ID NO: 646104 - DNA, 13 bp, D. melanogaster
tcaaatcaaagtc

SEQ ID NO: 646105 - DNA, 13 bp, D. melanogaster
tcaaatcaaagtt

SEQ ID NO: 646106 - DNA, 13 bp, D. melanogaster
tcaaatcaaatat

SEQ ID NO: 646107 - DNA, 13 bp, D. melanogaster
tcaaatcaaatca

SEQ ID NO: 646108 - DNA, 14 bp, D. melanogaster
tcaaatcaaatcaa

SEQ ID NO: 646109 - DNA, 13 bp, D. melanogaster
tcaaatcaaatcg

SEQ ID NO: 646110 - DNA, 13 bp, D. melanogaster
tcaaatcaaatga

SEQ ID NO: 646111 - DNA, 13 bp, D. melanogaster
tcaaatcaatatt

SEQ ID NO: 646112 - DNA, 13 bp, D. melanogaster
tcaaatcaatcaa

SEQ ID NO: 646113 - DNA, 13 bp, D. melanogaster
tcaaatcaattcc

SEQ ID NO: 646114 - DNA, 13 bp, D. melanogaster
tcaaatcattttt

SEQ ID NO: 646115 - DNA, 14 bp, D. melanogaster
tcaaatccaaatcc

SEQ ID NO: 646116 - DNA, 13 bp, D. melanogaster
tcaaatccacatg

SEQ ID NO: 646117 - DNA, 13 bp, D. melanogaster
tcaaatcgaactg

SEQ ID NO: 646118 - DNA, 14 bp, D. melanogaster
tcaaatcgaactgg

SEQ ID NO: 646119 - DNA, 13 bp, D. melanogaster
tcaaatcgataac

SEQ ID NO: 646120 - DNA, 13 bp, D. melanogaster
tcaaatcgataga

SEQ ID NO: 646121 - DNA, 14 bp, D. melanogaster
tcaaatcgatagaa

SEQ ID NO: 646122 - DNA, 13 bp, D. melanogaster
tcaaatcgatgaa

SEQ ID NO: 646123 - DNA, 13 bp, D. melanogaster
tcaaatcgatttc

SEQ ID NO: 646124 - DNA, 13 bp, D. melanogaster
tcaaatcgatttg

SEQ ID NO: 646125 - DNA, 13 bp, D. melanogaster
tcaaatcggcaat

SEQ ID NO: 646126 - DNA, 13 bp, D. melanogaster
tcaaatctgctta

SEQ ID NO: 646127 - DNA, 13 bp, D. melanogaster
tcaaatgaaaaca

SEQ ID NO: 646128 - DNA, 13 bp, D. melanogaster
tcaaatgaaaata

SEQ ID NO: 646129 - DNA, 13 bp, D. melanogaster
tcaaatgaaatat

SEQ ID NO: 646130 - DNA, 13 bp, D. melanogaster
tcaaatgaatatg

SEQ ID NO: 646131 - DNA, 13 bp, D. melanogaster
tcaaatgaatttg

SEQ ID NO: 646132 - DNA, 13 bp, D. melanogaster
tcaaatgaatttt

SEQ ID NO: 646133 - DNA, 13 bp, D. melanogaster
tcaaatgacaatt

SEQ ID NO: 646134 - DNA, 13 bp, D. melanogaster
tcaaatgacttaa

SEQ ID NO: 646135 - DNA, 13 bp, D. melanogaster
tcaaatgagatga

SEQ ID NO: 646136 - DNA, 14 bp, D. melanogaster
tcaaatgagcctgc

SEQ ID NO: 646137 - DNA, 13 bp, D. melanogaster
tcaaatgataaat

SEQ ID NO: 646138 - DNA, 14 bp, D. melanogaster
tcaaatgataaatt

SEQ ID NO: 646139 - DNA, 13 bp, D. melanogaster
tcaaatgatattt

SEQ ID NO: 646140 - DNA, 13 bp, D. melanogaster
tcaaatgatcaaa

SEQ ID NO: 646141 - DNA, 13 bp, D. melanogaster
tcaaatgattgtt

SEQ ID NO: 646142 - DNA, 14 bp, D. melanogaster
tcaaatgatttatt

SEQ ID NO: 646143 - DNA, 13 bp, D. melanogaster
tcaaatgcaaaat

SEQ ID NO: 646144 - DNA, 13 bp, D. melanogaster
tcaaatgcaaact

SEQ ID NO: 646145 - DNA, 13 bp, D. melanogaster
tcaaatgcaaagc

SEQ ID NO: 646146 - DNA, 14 bp, D. melanogaster
tcaaatgcaaatga

SEQ ID NO: 646147 - DNA, 14 bp, D. melanogaster
tcaaatgcaaatgc

SEQ ID NO: 646148 - DNA, 13 bp, D. melanogaster
tcaaatgcaaatt

SEQ ID NO: 646149 - DNA, 13 bp, D. melanogaster
tcaaatgccactt

SEQ ID NO: 646150 - DNA, 13 bp, D. melanogaster
tcaaatgctttac

SEQ ID NO: 646151 - DNA, 14 bp, D. melanogaster
tcaaatgctttact

SEQ ID NO: 646152 - DNA, 13 bp, D. melanogaster
tcaaatggaaatc

SEQ ID NO: 646153 - DNA, 13 bp, D. melanogaster
tcaaatggaattc

SEQ ID NO: 646154 - DNA, 13 bp, D. melanogaster
tcaaatggatttc

SEQ ID NO: 646155 - DNA, 13 bp, D. melanogaster
tcaaatggcaaac

SEQ ID NO: 646156 - DNA, 13 bp, D. melanogaster
tcaaatggcaaca

SEQ ID NO: 646157 - DNA, 13 bp, D. melanogaster
tcaaatggcattt

SEQ ID NO: 646158 - DNA, 13 bp, D. melanogaster
tcaaatggccaaa

SEQ ID NO: 646159 - DNA, 13 bp, D. melanogaster
tcaaatggcgcca

SEQ ID NO: 646160 - DNA, 13 bp, D. melanogaster
tcaaatgggattt

SEQ ID NO: 646161 - DNA, 13 bp, D. melanogaster
tcaaatggtggaa

SEQ ID NO: 646162 - DNA, 13 bp, D. melanogaster
tcaaatgtataaa

SEQ ID NO: 646163 - DNA, 13 bp, D. melanogaster
tcaaatgtatatt

SEQ ID NO: 646164 - DNA, 13 bp, D. melanogaster
tcaaatgtcattt

SEQ ID NO: 646165 - DNA, 13 bp, D. melanogaster
tcaaatgtggaat

SEQ ID NO: 646166 - DNA, 13 bp, D. melanogaster
tcaaatgttattt

SEQ ID NO: 646167 - DNA, 13 bp, D. melanogaster
tcaaatgtttaaa

SEQ ID NO: 646168 - DNA, 13 bp, D. melanogaster
tcaaatgtttcaa

SEQ ID NO: 646169 - DNA, 13 bp, D. melanogaster
tcaaatgttttaa

SEQ ID NO: 646170 - DNA, 15 bp, D. melanogaster
tcaaatgttttaagt

SEQ ID NO: 646171 - DNA, 14 bp, D. melanogaster
tcaaattaaacttt

SEQ ID NO: 646172 - DNA, 13 bp, D. melanogaster
tcaaattaaagaa

SEQ ID NO: 646173 - DNA, 13 bp, D. melanogaster
tcaaattaacatt

SEQ ID NO: 646174 - DNA, 13 bp, D. melanogaster
tcaaattaatcaa

SEQ ID NO: 646175 - DNA, 13 bp, D. melanogaster
tcaaattaatgaa

SEQ ID NO: 646176 - DNA, 13 bp, D. melanogaster
tcaaattaatgta

SEQ ID NO: 646177 - DNA, 13 bp, D. melanogaster
tcaaattacgcat

SEQ ID NO: 646178 - DNA, 13 bp, D. melanogaster
tcaaattacttta

SEQ ID NO: 646179 - DNA, 13 bp, D. melanogaster
tcaaattattcaa

SEQ ID NO: 646180 - DNA, 13 bp, D. melanogaster
tcaaattcaaaat

SEQ ID NO: 646181 - DNA, 13 bp, D. melanogaster
tcaaattcaaagg

SEQ ID NO: 646182 - DNA, 13 bp, D. melanogaster
tcaaattcaaatt

SEQ ID NO: 646183 - DNA, 14 bp, D. melanogaster
tcaaattcaaattc

SEQ ID NO: 646184 - DNA, 13 bp, D. melanogaster
tcaaattcaagtt

SEQ ID NO: 646185 - DNA, 14 bp, D. melanogaster
tcaaattcaagttc

SEQ ID NO: 646186 - DNA, 14 bp, D. melanogaster
tcaaattcaattta

SEQ ID NO: 646187 - DNA, 13 bp, D. melanogaster
tcaaattcattca

SEQ ID NO: 646188 - DNA, 13 bp, D. melanogaster
tcaaattcattga

SEQ ID NO: 646189 - DNA, 13 bp, D. melanogaster
tcaaattccaaat

SEQ ID NO: 646190 - DNA, 13 bp, D. melanogaster
tcaaattcgaaat

SEQ ID NO: 646191 - DNA, 13 bp, D. melanogaster
tcaaattcgatcg

SEQ ID NO: 646192 - DNA, 13 bp, D. melanogaster
tcaaattctaacc

SEQ ID NO: 646193 - DNA, 14 bp, D. melanogaster
tcaaattctaacca

SEQ ID NO: 646194 - DNA, 13 bp, D. melanogaster
tcaaattgaataa

SEQ ID NO: 646195 - DNA, 13 bp, D. melanogaster
tcaaattgaatat

SEQ ID NO: 646196 - DNA, 13 bp, D. melanogaster
tcaaattgatatt

SEQ ID NO: 646197 - DNA, 13 bp, D. melanogaster
tcaaattgcaaat

SEQ ID NO: 646198 - DNA, 13 bp, D. melanogaster
tcaaattgctaaa

SEQ ID NO: 646199 - DNA, 13 bp, D. melanogaster
tcaaattggaaat

SEQ ID NO: 646200 - DNA, 13 bp, D. melanogaster
tcaaattgttcaa

SEQ ID NO: 646201 - DNA, 13 bp, D. melanogaster
tcaaattgtttca

SEQ ID NO: 646202 - DNA, 13 bp, D. melanogaster
tcaaattgtttgg

SEQ ID NO: 646203 - DNA, 13 bp, D. melanogaster
tcaaatttaaagt

SEQ ID NO: 646204 - DNA, 13 bp, D. melanogaster
tcaaatttaacag

SEQ ID NO: 646205 - DNA, 13 bp, D. melanogaster
tcaaatttaagtt

SEQ ID NO: 646206 - DNA, 13 bp, D. melanogaster
tcaaatttatcaa

SEQ ID NO: 646207 - DNA, 13 bp, D. melanogaster
tcaaatttatgaa

SEQ ID NO: 646208 - DNA, 13 bp, D. melanogaster
tcaaatttattca

SEQ ID NO: 646209 - DNA, 13 bp, D. melanogaster
tcaaatttatttc

SEQ ID NO: 646210 - DNA, 13 bp, D. melanogaster
tcaaatttcaaat

SEQ ID NO: 646211 - DNA, 13 bp, D. melanogaster
tcaaatttcattt

SEQ ID NO: 646212 - DNA, 13 bp, D. melanogaster
tcaaatttccaat

SEQ ID NO: 646213 - DNA, 13 bp, D. melanogaster
tcaaatttcgcat

SEQ ID NO: 646214 - DNA, 13 bp, D. melanogaster
tcaaatttgaaat

SEQ ID NO: 646215 - DNA, 13 bp, D. melanogaster
tcaaatttgcaca

SEQ ID NO: 646216 - DNA, 13 bp, D. melanogaster
tcaaatttggaaa

SEQ ID NO: 646217 - DNA, 13 bp, D. melanogaster
tcaaatttgggaa

SEQ ID NO: 646218 - DNA, 13 bp, D. melanogaster
tcaaatttgttta

SEQ ID NO: 646219 - DNA, 13 bp, D. melanogaster
tcaaattttattg

SEQ ID NO: 646220 - DNA, 13 bp, D. melanogaster
tcaaattttcttc

SEQ ID NO: 646221 - DNA, 13 bp, D. melanogaster
tcaaattttgcaa

SEQ ID NO: 646222 - DNA, 13 bp, D. melanogaster
tcaaattttgtct

SEQ ID NO: 646223 - DNA, 13 bp, D. melanogaster
tcaaatttttcaa

SEQ ID NO: 646224 - DNA, 13 bp, D. melanogaster
tcaaatttttggc

SEQ ID NO: 646225 - DNA, 13 bp, D. melanogaster
tcaacaaaaaagt

SEQ ID NO: 646226 - DNA, 13 bp, D. melanogaster
tcaacaaaaatgt

SEQ ID NO: 646227 - DNA, 13 bp, D. melanogaster
tcaacaaaatcga

SEQ ID NO: 646228 - DNA, 13 bp, D. melanogaster
tcaacaaaatgtt

SEQ ID NO: 646229 - DNA, 13 bp, D. melanogaster
tcaacaaacttgc

SEQ ID NO: 646230 - DNA, 13 bp, D. melanogaster
tcaacaaagccaa

SEQ ID NO: 646231 - DNA, 13 bp, D. melanogaster
tcaacaaataatt

SEQ ID NO: 646232 - DNA, 14 bp, D. melanogaster
tcaacaaataattt

SEQ ID NO: 646233 - DNA, 13 bp, D. melanogaster
tcaacaaatattt

SEQ ID NO: 646234 - DNA, 14 bp, D. melanogaster
tcaacaaatattta

SEQ ID NO: 646235 - DNA, 13 bp, D. melanogaster
tcaacaaatcaac

SEQ ID NO: 646236 - DNA, 13 bp, D. melanogaster
tcaacaaatcagc

SEQ ID NO: 646237 - DNA, 13 bp, D. melanogaster
tcaacaaatgttt

SEQ ID NO: 646238 - DNA, 13 bp, D. melanogaster
tcaacaaattcaa

SEQ ID NO: 646239 - DNA, 13 bp, D. melanogaster
tcaacaaattgca

SEQ ID NO: 646240 - DNA, 13 bp, D. melanogaster
tcaacaaattgta

SEQ ID NO: 646241 - DNA, 13 bp, D. melanogaster
tcaacaaattgtt

SEQ ID NO: 646242 - DNA, 13 bp, D. melanogaster
tcaacaacaacag

SEQ ID NO: 646243 - DNA, 14 bp, D. melanogaster
tcaacaacaacagc

SEQ ID NO: 646244 - DNA, 14 bp, D. melanogaster
tcaacaacaagaca

SEQ ID NO: 646245 - DNA, 14 bp, D. melanogaster
tcaacaacaataat

SEQ ID NO: 646246 - DNA, 14 bp, D. melanogaster
tcaacaaccactaa

SEQ ID NO: 646247 - DNA, 13 bp, D. melanogaster
tcaacaacttcca

SEQ ID NO: 646248 - DNA, 13 bp, D. melanogaster
tcaacaacttcgt

SEQ ID NO: 646249 - DNA, 13 bp, D. melanogaster
tcaacaacttttc

SEQ ID NO: 646250 - DNA, 13 bp, D. melanogaster
tcaacaagccaaa

SEQ ID NO: 646251 - DNA, 13 bp, D. melanogaster
tcaacaataattt

SEQ ID NO: 646252 - DNA, 13 bp, D. melanogaster
tcaacaatcaaca

SEQ ID NO: 646253 - DNA, 13 bp, D. melanogaster
tcaacaatcatta

SEQ ID NO: 646254 - DNA, 15 bp, D. melanogaster
tcaacaatcattgcc

SEQ ID NO: 646255 - DNA, 13 bp, D. melanogaster
tcaacaatcctct

SEQ ID NO: 646256 - DNA, 13 bp, D. melanogaster
tcaacaatgaaat

SEQ ID NO: 646257 - DNA, 13 bp, D. melanogaster
tcaacaatgtcgt

SEQ ID NO: 646258 - DNA, 13 bp, D. melanogaster
tcaacaattattt

SEQ ID NO: 646259 - DNA, 13 bp, D. melanogaster
tcaacaattgttt

SEQ ID NO: 646260 - DNA, 13 bp, D. melanogaster
tcaacaatttcca

SEQ ID NO: 646261 - DNA, 13 bp, D. melanogaster
tcaacacaaatta

SEQ ID NO: 646262 - DNA, 13 bp, D. melanogaster
tcaacacattttt

SEQ ID NO: 646263 - DNA, 13 bp, D. melanogaster
tcaacaccttttt

SEQ ID NO: 646264 - DNA, 13 bp, D. melanogaster
tcaacagaattcc

SEQ ID NO: 646265 - DNA, 13 bp, D. melanogaster
tcaacagatatat

SEQ ID NO: 646266 - DNA, 14 bp, D. melanogaster
tcaacagcaacaac

SEQ ID NO: 646267 - DNA, 13 bp, D. melanogaster
tcaacagcagccg

SEQ ID NO: 646268 - DNA, 13 bp, D. melanogaster
tcaacaggaaacg

SEQ ID NO: 646269 - DNA, 14 bp, D. melanogaster
tcaacaggaaacga

SEQ ID NO: 646270 - DNA, 14 bp, D. melanogaster
tcaacatagcaatg

SEQ ID NO: 646271 - DNA, 13 bp, D. melanogaster
tcaacatcaaaat

SEQ ID NO: 646272 - DNA, 13 bp, D. melanogaster
tcaacatcaattt

SEQ ID NO: 646273 - DNA, 14 bp, D. melanogaster
tcaacatcatcatc

SEQ ID NO: 646274 - DNA, 13 bp, D. melanogaster
tcaacatctccta

SEQ ID NO: 646275 - DNA, 13 bp, D. melanogaster
tcaacattatttt

SEQ ID NO: 646276 - DNA, 13 bp, D. melanogaster
tcaacatttacat

SEQ ID NO: 646277 - DNA, 13 bp, D. melanogaster
tcaacatttcaac

SEQ ID NO: 646278 - DNA, 13 bp, D. melanogaster
tcaacattttcaa

SEQ ID NO: 646279 - DNA, 13 bp, D. melanogaster
tcaacattttcat

SEQ ID NO: 646280 - DNA, 14 bp, D. melanogaster
tcaacatttttaaa

SEQ ID NO: 646281 - DNA, 13 bp, D. melanogaster
tcaaccatccatc

SEQ ID NO: 646282 - DNA, 13 bp, D. melanogaster
tcaaccgcccaaa

SEQ ID NO: 646283 - DNA, 13 bp, D. melanogaster
tcaaccttaagtt

SEQ ID NO: 646284 - DNA, 13 bp, D. melanogaster
tcaacgaaatcaa

SEQ ID NO: 646285 - DNA, 14 bp, D. melanogaster
tcaacgaaatcaaa

SEQ ID NO: 646286 - DNA, 13 bp, D. melanogaster
tcaacgaatttag

SEQ ID NO: 646287 - DNA, 13 bp, D. melanogaster
tcaacgaattttt

SEQ ID NO: 646288 - DNA, 13 bp, D. melanogaster
tcaacgagatatg

SEQ ID NO: 646289 - DNA, 13 bp, D. melanogaster
tcaacgaggtatg

SEQ ID NO: 646290 - DNA, 13 bp, D. melanogaster
tcaacgagtatgt

SEQ ID NO: 646291 - DNA, 14 bp, D. melanogaster
tcaacgcacaaagt

SEQ ID NO: 646292 - DNA, 13 bp, D. melanogaster
tcaacgccaacga

SEQ ID NO: 646293 - DNA, 13 bp, D. melanogaster
tcaacgctctttt

SEQ ID NO: 646294 - DNA, 13 bp, D. melanogaster
tcaacgctttgat

SEQ ID NO: 646295 - DNA, 13 bp, D. melanogaster
tcaacggaactct

SEQ ID NO: 646296 - DNA, 14 bp, D. melanogaster
tcaacggatcccag

SEQ ID NO: 646297 - DNA, 13 bp, D. melanogaster
tcaacgggagagt

SEQ ID NO: 646298 - DNA, 13 bp, D. melanogaster
tcaacggtgtttt

SEQ ID NO: 646299 - DNA, 13 bp, D. melanogaster
tcaacgtggaatc

SEQ ID NO: 646300 - DNA, 14 bp, D. melanogaster
tcaacgtggaatcg

SEQ ID NO: 646301 - DNA, 14 bp, D. melanogaster
tcaacgttttcaag

SEQ ID NO: 646302 - DNA, 13 bp, D. melanogaster
tcaacgttttttt

SEQ ID NO: 646303 - DNA, 13 bp, D. melanogaster
tcaactaaatgtt

SEQ ID NO: 646304 - DNA, 13 bp, D. melanogaster
tcaactaattgaa

SEQ ID NO: 646305 - DNA, 13 bp, D. melanogaster
tcaactacgttca

SEQ ID NO: 646306 - DNA, 13 bp, D. melanogaster
tcaactatatatt

SEQ ID NO: 646307 - DNA, 14 bp, D. melanogaster
tcaactattataat

SEQ ID NO: 646308 - DNA, 13 bp, D. melanogaster
tcaactatttata

SEQ ID NO: 646309 - DNA, 13 bp, D. melanogaster
tcaactcaactcg

SEQ ID NO: 646310 - DNA, 13 bp, D. melanogaster
tcaactcaactga

SEQ ID NO: 646311 - DNA, 13 bp, D. melanogaster
tcaactccaactc

SEQ ID NO: 646312 - DNA, 13 bp, D. melanogaster
tcaactcttttat

SEQ ID NO: 646313 - DNA, 14 bp, D. melanogaster
tcaactgaactgaa

SEQ ID NO: 646314 - DNA, 14 bp, D. melanogaster
tcaactgaagagtt

SEQ ID NO: 646315 - DNA, 13 bp, D. melanogaster
tcaactgaagctg

SEQ ID NO: 646316 - DNA, 13 bp, D. melanogaster
tcaactgcaacac

SEQ ID NO: 646317 - DNA, 13 bp, D. melanogaster
tcaactgcagcaa

SEQ ID NO: 646318 - DNA, 13 bp, D. melanogaster
tcaactggcaact

SEQ ID NO: 646319 - DNA, 14 bp, D. melanogaster
tcaactggctgaca

SEQ ID NO: 646320 - DNA, 15 bp, D. melanogaster
tcaactgtgattttt

SEQ ID NO: 646321 - DNA, 13 bp, D. melanogaster
tcaacttaattta

SEQ ID NO: 646322 - DNA, 13 bp, D. melanogaster
tcaacttaatttt

SEQ ID NO: 646323 - DNA, 13 bp, D. melanogaster
tcaacttcaacgg

SEQ ID NO: 646324 - DNA, 13 bp, D. melanogaster
tcaacttcaattt

SEQ ID NO: 646325 - DNA, 13 bp, D. melanogaster
tcaacttcatttg

SEQ ID NO: 646326 - DNA, 13 bp, D. melanogaster
tcaacttcttgta

SEQ ID NO: 646327 - DNA, 13 bp, D. melanogaster
tcaacttgaactt

SEQ ID NO: 646328 - DNA, 13 bp, D. melanogaster
tcaacttggccag

SEQ ID NO: 646329 - DNA, 13 bp, D. melanogaster
tcaacttgttttc

SEQ ID NO: 646330 - DNA, 13 bp, D. melanogaster
tcaactttaaaat

SEQ ID NO: 646331 - DNA, 13 bp, D. melanogaster
tcaactttattaa

SEQ ID NO: 646332 - DNA, 13 bp, D. melanogaster
tcaactttgattt

SEQ ID NO: 646333 - DNA, 13 bp, D. melanogaster
tcaactttgtgtg

SEQ ID NO: 646334 - DNA, 13 bp, D. melanogaster
tcaactttgtttg

SEQ ID NO: 646335 - DNA, 13 bp, D. melanogaster
tcaacttttggcc

SEQ ID NO: 646336 - DNA, 13 bp, D. melanogaster
tcaactttttcca

SEQ ID NO: 646337 - DNA, 13 bp, D. melanogaster
tcaacttttttgc

SEQ ID NO: 646338 - DNA, 13 bp, D. melanogaster
tcaagaaaaagga

SEQ ID NO: 646339 - DNA, 13 bp, D. melanogaster
tcaagaaagagcg

SEQ ID NO: 646340 - DNA, 13 bp, D. melanogaster
tcaagaaatataa

SEQ ID NO: 646341 - DNA, 13 bp, D. melanogaster
tcaagaaattgtt

SEQ ID NO: 646342 - DNA, 13 bp, D. melanogaster
tcaagaacccttt

SEQ ID NO: 646343 - DNA, 13 bp, D. melanogaster
tcaagaatataaa

SEQ ID NO: 646344 - DNA, 13 bp, D. melanogaster
tcaagaatatatg

SEQ ID NO: 646345 - DNA, 14 bp, D. melanogaster
tcaagaatatattt

SEQ ID NO: 646346 - DNA, 13 bp, D. melanogaster
tcaagaatatctt

SEQ ID NO: 646347 - DNA, 13 bp, D. melanogaster
tcaagaatgtaaa

SEQ ID NO: 646348 - DNA, 14 bp, D. melanogaster
tcaagaattaaaat

SEQ ID NO: 646349 - DNA, 13 bp, D. melanogaster
tcaagaattccat

SEQ ID NO: 646350 - DNA, 14 bp, D. melanogaster
tcaagaattccatt

SEQ ID NO: 646351 - DNA, 13 bp, D. melanogaster
tcaagaatttatt

SEQ ID NO: 646352 - DNA, 13 bp, D. melanogaster
tcaagacaaagat

SEQ ID NO: 646353 - DNA, 13 bp, D. melanogaster
tcaagacaaatca

SEQ ID NO: 646354 - DNA, 13 bp, D. melanogaster
tcaagacgttctg

SEQ ID NO: 646355 - DNA, 13 bp, D. melanogaster
tcaagagaaagct

SEQ ID NO: 646356 - DNA, 13 bp, D. melanogaster
tcaagatctgcgt

SEQ ID NO: 646357 - DNA, 13 bp, D. melanogaster
tcaagatgcaaaa

SEQ ID NO: 646358 - DNA, 13 bp, D. melanogaster
tcaagcaaattgt

SEQ ID NO: 646359 - DNA, 13 bp, D. melanogaster
tcaagcaatttca

SEQ ID NO: 646360 - DNA, 13 bp, D. melanogaster
tcaagcacatgat

SEQ ID NO: 646361 - DNA, 13 bp, D. melanogaster
tcaagcatacgcc

SEQ ID NO: 646362 - DNA, 13 bp, D. melanogaster
tcaagcattgcag

SEQ ID NO: 646363 - DNA, 13 bp, D. melanogaster
tcaagccaaacaa

SEQ ID NO: 646364 - DNA, 13 bp, D. melanogaster
tcaagccaattgc

SEQ ID NO: 646365 - DNA, 14 bp, D. melanogaster
tcaagccaattgca

SEQ ID NO: 646366 - DNA, 13 bp, D. melanogaster
tcaagccagaagt

SEQ ID NO: 646367 - DNA, 13 bp, D. melanogaster
tcaagccatcgct

SEQ ID NO: 646368 - DNA, 13 bp, D. melanogaster
tcaagccttgttg

SEQ ID NO: 646369 - DNA, 13 bp, D. melanogaster
tcaagcctttgga

SEQ ID NO: 646370 - DNA, 13 bp, D. melanogaster
tcaagcgaaaatt

SEQ ID NO: 646371 - DNA, 14 bp, D. melanogaster
tcaagcgacaccac

SEQ ID NO: 646372 - DNA, 13 bp, D. melanogaster
tcaagcggttaca

SEQ ID NO: 646373 - DNA, 13 bp, D. melanogaster
tcaagctgcaaaa

SEQ ID NO: 646374 - DNA, 14 bp, D. melanogaster
tcaagctgcgctgc

SEQ ID NO: 646375 - DNA, 13 bp, D. melanogaster
tcaagctgttgcc

SEQ ID NO: 646376 - DNA, 13 bp, D. melanogaster
tcaaggaagcgtt

SEQ ID NO: 646377 - DNA, 13 bp, D. melanogaster
tcaaggacaaacc

SEQ ID NO: 646378 - DNA, 13 bp, D. melanogaster
tcaaggaggtcat

SEQ ID NO: 646379 - DNA, 13 bp, D. melanogaster
tcaagggaaattc

SEQ ID NO: 646380 - DNA, 13 bp, D. melanogaster
tcaaggtgaaagt

SEQ ID NO: 646381 - DNA, 13 bp, D. melanogaster
tcaaggtgcccaa

SEQ ID NO: 646382 - DNA, 14 bp, D. melanogaster
tcaaggtgcccaaa

SEQ ID NO: 646383 - DNA, 13 bp, D. melanogaster
tcaaggttgttct

SEQ ID NO: 646384 - DNA, 13 bp, D. melanogaster
tcaagtaattcgg

SEQ ID NO: 646385 - DNA, 13 bp, D. melanogaster
tcaagtacagaca

SEQ ID NO: 646386 - DNA, 13 bp, D. melanogaster
tcaagtatataat

SEQ ID NO: 646387 - DNA, 13 bp, D. melanogaster
tcaagtatttatt

SEQ ID NO: 646388 - DNA, 14 bp, D. melanogaster
tcaagtcaagtcaa

SEQ ID NO: 646389 - DNA, 13 bp, D. melanogaster
tcaagtcaatcaa

SEQ ID NO: 646390 - DNA, 13 bp, D. melanogaster
tcaagtcaattaa

SEQ ID NO: 646391 - DNA, 14 bp, D. melanogaster
tcaagtcgttcaag

SEQ ID NO: 646392 - DNA, 13 bp, D. melanogaster
tcaagtcgttttg

SEQ ID NO: 646393 - DNA, 13 bp, D. melanogaster
tcaagtgaaaagt

SEQ ID NO: 646394 - DNA, 13 bp, D. melanogaster
tcaagtgaaattt

SEQ ID NO: 646395 - DNA, 13 bp, D. melanogaster
tcaagtgattttt

SEQ ID NO: 646396 - DNA, 13 bp, D. melanogaster
tcaagtgcaaatg

SEQ ID NO: 646397 - DNA, 13 bp, D. melanogaster
tcaagtgcaataa

SEQ ID NO: 646398 - DNA, 13 bp, D. melanogaster
tcaagtgcacttt

SEQ ID NO: 646399 - DNA, 13 bp, D. melanogaster
tcaagtgcagcaa

SEQ ID NO: 646400 - DNA, 13 bp, D. melanogaster
tcaagtgcagttt

SEQ ID NO: 646401 - DNA, 13 bp, D. melanogaster
tcaagtgctgcaa

SEQ ID NO: 646402 - DNA, 13 bp, D. melanogaster
tcaagtggaaaat

SEQ ID NO: 646403 - DNA, 13 bp, D. melanogaster
tcaagtggaaatg

SEQ ID NO: 646404 - DNA, 13 bp, D. melanogaster
tcaagtggaagaa

SEQ ID NO: 646405 - DNA, 14 bp, D. melanogaster
tcaagtggaagaaa

SEQ ID NO: 646406 - DNA, 13 bp, D. melanogaster
tcaagtggcaaat

SEQ ID NO: 646407 - DNA, 13 bp, D. melanogaster
tcaagtggccaag

SEQ ID NO: 646408 - DNA, 13 bp, D. melanogaster
tcaagtggctggc

SEQ ID NO: 646409 - DNA, 13 bp, D. melanogaster
tcaagtggtcaag

SEQ ID NO: 646410 - DNA, 13 bp, D. melanogaster
tcaagtggtcaat

SEQ ID NO: 646411 - DNA, 13 bp, D. melanogaster
tcaagtgtaaatt

SEQ ID NO: 646412 - DNA, 13 bp, D. melanogaster
tcaagtgttttcc

SEQ ID NO: 646413 - DNA, 13 bp, D. melanogaster
tcaagttaatttt

SEQ ID NO: 646414 - DNA, 13 bp, D. melanogaster
tcaagttcaaaaa

SEQ ID NO: 646415 - DNA, 13 bp, D. melanogaster
tcaagttcaaaac

SEQ ID NO: 646416 - DNA, 13 bp, D. melanogaster
tcaagttcaaagt

SEQ ID NO: 646417 - DNA, 13 bp, D. melanogaster
tcaagttcaaggt

SEQ ID NO: 646418 - DNA, 13 bp, D. melanogaster
tcaagttcaagtg

SEQ ID NO: 646419 - DNA, 13 bp, D. melanogaster
tcaagttcaatga

SEQ ID NO: 646420 - DNA, 13 bp, D. melanogaster
tcaagttcaatgc

SEQ ID NO: 646421 - DNA, 13 bp, D. melanogaster
tcaagttcaattc

SEQ ID NO: 646422 - DNA, 13 bp, D. melanogaster
tcaagttcaattt

SEQ ID NO: 646423 - DNA, 13 bp, D. melanogaster
tcaagttccccga

SEQ ID NO: 646424 - DNA, 13 bp, D. melanogaster
tcaagttctattt

SEQ ID NO: 646425 - DNA, 13 bp, D. melanogaster
tcaagttcttcat

SEQ ID NO: 646426 - DNA, 13 bp, D. melanogaster
tcaagttggccaa

SEQ ID NO: 646427 - DNA, 14 bp, D. melanogaster
tcaagtttaacttt

SEQ ID NO: 646428 - DNA, 13 bp, D. melanogaster
tcaagtttaattt

SEQ ID NO: 646429 - DNA, 13 bp, D. melanogaster
tcaagtttacaaa

SEQ ID NO: 646430 - DNA, 14 bp, D. melanogaster
tcaagtttattttc

SEQ ID NO: 646431 - DNA, 13 bp, D. melanogaster
tcaagtttgggaa

SEQ ID NO: 646432 - DNA, 13 bp, D. melanogaster
tcaagttttaaaa

SEQ ID NO: 646433 - DNA, 13 bp, D. melanogaster
tcaagttttaaat

SEQ ID NO: 646434 - DNA, 13 bp, D. melanogaster
tcaagtttttggc

SEQ ID NO: 646435 - DNA, 13 bp, D. melanogaster
tcaataaaaatcc

SEQ ID NO: 646436 - DNA, 13 bp, D. melanogaster
tcaataaaaatga

SEQ ID NO: 646437 - DNA, 13 bp, D. melanogaster
tcaataaaaatgt

SEQ ID NO: 646438 - DNA, 13 bp, D. melanogaster
tcaataaaacgaa

SEQ ID NO: 646439 - DNA, 13 bp, D. melanogaster
tcaataaaaggtg

SEQ ID NO: 646440 - DNA, 13 bp, D. melanogaster
tcaataaaagttg

SEQ ID NO: 646441 - DNA, 13 bp, D. melanogaster
tcaataaaattgt

SEQ ID NO: 646442 - DNA, 13 bp, D. melanogaster
tcaataaaatttc

SEQ ID NO: 646443 - DNA, 13 bp, D. melanogaster
tcaataaacattt

SEQ ID NO: 646444 - DNA, 13 bp, D. melanogaster
tcaataaacccaa

SEQ ID NO: 646445 - DNA, 14 bp, D. melanogaster
tcaataaacgttaa

SEQ ID NO: 646446 - DNA, 13 bp, D. melanogaster
tcaataaactaat

SEQ ID NO: 646447 - DNA, 13 bp, D. melanogaster
tcaataaagcaaa

SEQ ID NO: 646448 - DNA, 14 bp, D. melanogaster
tcaataaataaaag

SEQ ID NO: 646449 - DNA, 13 bp, D. melanogaster
tcaataaatgtct

SEQ ID NO: 646450 - DNA, 13 bp, D. melanogaster
tcaataaatgttc

SEQ ID NO: 646451 - DNA, 13 bp, D. melanogaster
tcaataaattaca

SEQ ID NO: 646452 - DNA, 13 bp, D. melanogaster
tcaataaatttac

SEQ ID NO: 646453 - DNA, 13 bp, D. melanogaster
tcaataaattttg

SEQ ID NO: 646454 - DNA, 13 bp, D. melanogaster
tcaataacgaaca

SEQ ID NO: 646455 - DNA, 13 bp, D. melanogaster
tcaataactaaat

SEQ ID NO: 646456 - DNA, 13 bp, D. melanogaster
tcaataagcaaaa

SEQ ID NO: 646457 - DNA, 13 bp, D. melanogaster
tcaataaggccag

SEQ ID NO: 646458 - DNA, 14 bp, D. melanogaster
tcaataaggccagg

SEQ ID NO: 646459 - DNA, 13 bp, D. melanogaster
tcaataataattc

SEQ ID NO: 646460 - DNA, 13 bp, D. melanogaster
tcaataatgtata

SEQ ID NO: 646461 - DNA, 13 bp, D. melanogaster
tcaataattgtta

SEQ ID NO: 646462 - DNA, 13 bp, D. melanogaster
tcaataattgttt

SEQ ID NO: 646463 - DNA, 13 bp, D. melanogaster
tcaatacagcaaa

SEQ ID NO: 646464 - DNA, 13 bp, D. melanogaster
tcaatacatattt

SEQ ID NO: 646465 - DNA, 13 bp, D. melanogaster
tcaatacattcaa

SEQ ID NO: 646466 - DNA, 13 bp, D. melanogaster
tcaatacatttaa

SEQ ID NO: 646467 - DNA, 13 bp, D. melanogaster
tcaatacattttt

SEQ ID NO: 646468 - DNA, 13 bp, D. melanogaster
tcaataccaactt

SEQ ID NO: 646469 - DNA, 13 bp, D. melanogaster
tcaataccctttc

SEQ ID NO: 646470 - DNA, 13 bp, D. melanogaster
tcaatacgagaat

SEQ ID NO: 646471 - DNA, 13 bp, D. melanogaster
tcaatagaaatat

SEQ ID NO: 646472 - DNA, 13 bp, D. melanogaster
tcaatagaaatta

SEQ ID NO: 646473 - DNA, 13 bp, D. melanogaster
tcaatagaaattt

SEQ ID NO: 646474 - DNA, 14 bp, D. melanogaster
tcaatagaaattta

SEQ ID NO: 646475 - DNA, 13 bp, D. melanogaster
tcaatagacattt

SEQ ID NO: 646476 - DNA, 13 bp, D. melanogaster
tcaatagataatt

SEQ ID NO: 646477 - DNA, 13 bp, D. melanogaster
tcaatagccaagt

SEQ ID NO: 646478 - DNA, 14 bp, D. melanogaster
tcaatagccaagtc

SEQ ID NO: 646479 - DNA, 13 bp, D. melanogaster
tcaatagctactt

SEQ ID NO: 646480 - DNA, 15 bp, D. melanogaster
tcaatagtaaataaa

SEQ ID NO: 646481 - DNA, 13 bp, D. melanogaster
tcaatataaacgt

SEQ ID NO: 646482 - DNA, 14 bp, D. melanogaster
tcaatataaacgta

SEQ ID NO: 646483 - DNA, 13 bp, D. melanogaster
tcaatatatattc

SEQ ID NO: 646484 - DNA, 13 bp, D. melanogaster
tcaatatatgtat

SEQ ID NO: 646485 - DNA, 13 bp, D. melanogaster
tcaatatattcaa

SEQ ID NO: 646486 - DNA, 13 bp, D. melanogaster
tcaatatatttca

SEQ ID NO: 646487 - DNA, 13 bp, D. melanogaster
tcaatatatttgt

SEQ ID NO: 646488 - DNA, 13 bp, D. melanogaster
tcaatatcaaatt

SEQ ID NO: 646489 - DNA, 13 bp, D. melanogaster
tcaatatgaagaa

SEQ ID NO: 646490 - DNA, 13 bp, D. melanogaster
tcaatatgaataa

SEQ ID NO: 646491 - DNA, 13 bp, D. melanogaster
tcaatatgcattt

SEQ ID NO: 646492 - DNA, 13 bp, D. melanogaster
tcaatatgtttag

SEQ ID NO: 646493 - DNA, 13 bp, D. melanogaster
tcaatatgttttt

SEQ ID NO: 646494 - DNA, 13 bp, D. melanogaster
tcaatattaaatc

SEQ ID NO: 646495 - DNA, 13 bp, D. melanogaster
tcaatattatcga

SEQ ID NO: 646496 - DNA, 13 bp, D. melanogaster
tcaatatttcata

SEQ ID NO: 646497 - DNA, 13 bp, D. melanogaster
tcaatatttgaat

SEQ ID NO: 646498 - DNA, 13 bp, D. melanogaster
tcaatatttgcca

SEQ ID NO: 646499 - DNA, 13 bp, D. melanogaster
tcaatattttaac

SEQ ID NO: 646500 - DNA, 13 bp, D. melanogaster
tcaatattttcaa

SEQ ID NO: 646501 - DNA, 13 bp, D. melanogaster
tcaatattttcgt

SEQ ID NO: 646502 - DNA, 13 bp, D. melanogaster
tcaatattttgtg

SEQ ID NO: 646503 - DNA, 13 bp, D. melanogaster
tcaatatttttca

SEQ ID NO: 646504 - DNA, 13 bp, D. melanogaster
tcaatatttttcc

SEQ ID NO: 646505 - DNA, 13 bp, D. melanogaster
tcaatcaaaaact

SEQ ID NO: 646506 - DNA, 13 bp, D. melanogaster
tcaatcaaaaatg

SEQ ID NO: 646507 - DNA, 13 bp, D. melanogaster
tcaatcaaaagtt

SEQ ID NO: 646508 - DNA, 14 bp, D. melanogaster
tcaatcaaaatcaa

SEQ ID NO: 646509 - DNA, 13 bp, D. melanogaster
tcaatcaaatcaa

SEQ ID NO: 646510 - DNA, 13 bp, D. melanogaster
tcaatcaaatcag

SEQ ID NO: 646511 - DNA, 13 bp, D. melanogaster
tcaatcaaattgg

SEQ ID NO: 646512 - DNA, 13 bp, D. melanogaster
tcaatcaaatttt

SEQ ID NO: 646513 - DNA, 14 bp, D. melanogaster
tcaatcaacaactt

SEQ ID NO: 646514 - DNA, 13 bp, D. melanogaster
tcaatcaacattt

SEQ ID NO: 646515 - DNA, 14 bp, D. melanogaster
tcaatcaacatttg

SEQ ID NO: 646516 - DNA, 13 bp, D. melanogaster
tcaatcaagccaa

SEQ ID NO: 646517 - DNA, 13 bp, D. melanogaster
tcaatcaagcggc

SEQ ID NO: 646518 - DNA, 13 bp, D. melanogaster
tcaatcaatcaac

SEQ ID NO: 646519 - DNA, 13 bp, D. melanogaster
tcaatcaatcaat

SEQ ID NO: 646520 - DNA, 14 bp, D. melanogaster
tcaatcaatcaata

SEQ ID NO: 646521 - DNA, 13 bp, D. melanogaster
tcaatcaatcagc

SEQ ID NO: 646522 - DNA, 13 bp, D. melanogaster
tcaatcaattaat

SEQ ID NO: 646523 - DNA, 13 bp, D. melanogaster
tcaatcaattcaa

SEQ ID NO: 646524 - DNA, 13 bp, D. melanogaster
tcaatcaattgtt

SEQ ID NO: 646525 - DNA, 13 bp, D. melanogaster
tcaatcaatttga

SEQ ID NO: 646526 - DNA, 13 bp, D. melanogaster
tcaatcacatttt

SEQ ID NO: 646527 - DNA, 13 bp, D. melanogaster
tcaatcagctgtt

SEQ ID NO: 646528 - DNA, 13 bp, D. melanogaster
tcaatcatacgca

SEQ ID NO: 646529 - DNA, 13 bp, D. melanogaster
tcaatcatgtgtc

SEQ ID NO: 646530 - DNA, 13 bp, D. melanogaster
tcaatcattttta

SEQ ID NO: 646531 - DNA, 13 bp, D. melanogaster
tcaatcccagccc

SEQ ID NO: 646532 - DNA, 13 bp, D. melanogaster
tcaatcgaaataa

SEQ ID NO: 646533 - DNA, 13 bp, D. melanogaster
tcaatcgatcgat

SEQ ID NO: 646534 - DNA, 13 bp, D. melanogaster
tcaatcgatttcc

SEQ ID NO: 646535 - DNA, 13 bp, D. melanogaster
tcaatcgatttta

SEQ ID NO: 646536 - DNA, 14 bp, D. melanogaster
tcaatcgatttttt

SEQ ID NO: 646537 - DNA, 13 bp, D. melanogaster
tcaatctgaatct

SEQ ID NO: 646538 - DNA, 14 bp, D. melanogaster
tcaatctgaatctg

SEQ ID NO: 646539 - DNA, 13 bp, D. melanogaster
tcaatctggttgg

SEQ ID NO: 646540 - DNA, 13 bp, D. melanogaster
tcaatcttaatta

SEQ ID NO: 646541 - DNA, 13 bp, D. melanogaster
tcaatgaaaacaa

SEQ ID NO: 646542 - DNA, 14 bp, D. melanogaster
tcaatgaaaacata

SEQ ID NO: 646543 - DNA, 13 bp, D. melanogaster
tcaatgaaaagtt

SEQ ID NO: 646544 - DNA, 13 bp, D. melanogaster
tcaatgaaaataa

SEQ ID NO: 646545 - DNA, 13 bp, D. melanogaster
tcaatgaaaattg

SEQ ID NO: 646546 - DNA, 13 bp, D. melanogaster
tcaatgaaacaaa

SEQ ID NO: 646547 - DNA, 13 bp, D. melanogaster
tcaatgaaataaa

SEQ ID NO: 646548 - DNA, 13 bp, D. melanogaster
tcaatgaaatacc

SEQ ID NO: 646549 - DNA, 14 bp, D. melanogaster
tcaatgaaatacca

SEQ ID NO: 646550 - DNA, 14 bp, D. melanogaster
tcaatgaaatagca

SEQ ID NO: 646551 - DNA, 13 bp, D. melanogaster
tcaatgaaatata

SEQ ID NO: 646552 - DNA, 13 bp, D. melanogaster
tcaatgaagaaat

SEQ ID NO: 646553 - DNA, 14 bp, D. melanogaster
tcaatgaagaaata

SEQ ID NO: 646554 - DNA, 13 bp, D. melanogaster
tcaatgaattttt

SEQ ID NO: 646555 - DNA, 13 bp, D. melanogaster
tcaatgacaatat

SEQ ID NO: 646556 - DNA, 13 bp, D. melanogaster
tcaatgaggaggc

SEQ ID NO: 646557 - DNA, 13 bp, D. melanogaster
tcaatgatggtgt

SEQ ID NO: 646558 - DNA, 13 bp, D. melanogaster
tcaatgatttaat

SEQ ID NO: 646559 - DNA, 13 bp, D. melanogaster
tcaatgattttat

SEQ ID NO: 646560 - DNA, 13 bp, D. melanogaster
tcaatgcaaaaaa

SEQ ID NO: 646561 - DNA, 13 bp, D. melanogaster
tcaatgcaactga

SEQ ID NO: 646562 - DNA, 13 bp, D. melanogaster
tcaatgcaatatt

SEQ ID NO: 646563 - DNA, 13 bp, D. melanogaster
tcaatgcattttc

SEQ ID NO: 646564 - DNA, 13 bp, D. melanogaster
tcaatgcccttaa

SEQ ID NO: 646565 - DNA, 13 bp, D. melanogaster
tcaatgcctatta

SEQ ID NO: 646566 - DNA, 14 bp, D. melanogaster
tcaatgcctattat

SEQ ID NO: 646567 - DNA, 15 bp, D. melanogaster
tcaatgccttctgca

SEQ ID NO: 646568 - DNA, 13 bp, D. melanogaster
tcaatgcgaagct

SEQ ID NO: 646569 - DNA, 13 bp, D. melanogaster
tcaatgctgaccc

SEQ ID NO: 646570 - DNA, 13 bp, D. melanogaster
tcaatgctttttg

SEQ ID NO: 646571 - DNA, 13 bp, D. melanogaster
tcaatggaaaaat

SEQ ID NO: 646572 - DNA, 13 bp, D. melanogaster
tcaatggaaaata

SEQ ID NO: 646573 - DNA, 13 bp, D. melanogaster
tcaatggaaatgc

SEQ ID NO: 646574 - DNA, 13 bp, D. melanogaster
tcaatggatattt

SEQ ID NO: 646575 - DNA, 13 bp, D. melanogaster
tcaatggattttt

SEQ ID NO: 646576 - DNA, 13 bp, D. melanogaster
tcaatggcagcag

SEQ ID NO: 646577 - DNA, 13 bp, D. melanogaster
tcaatggccaaat

SEQ ID NO: 646578 - DNA, 13 bp, D. melanogaster
tcaatgggttttt

SEQ ID NO: 646579 - DNA, 13 bp, D. melanogaster
tcaatggtttttt

SEQ ID NO: 646580 - DNA, 13 bp, D. melanogaster
tcaatgtacttac

SEQ ID NO: 646581 - DNA, 13 bp, D. melanogaster
tcaatgtattttt

SEQ ID NO: 646582 - DNA, 13 bp, D. melanogaster
tcaatgtcaatgt

SEQ ID NO: 646583 - DNA, 13 bp, D. melanogaster
tcaatgtcgatga

SEQ ID NO: 646584 - DNA, 13 bp, D. melanogaster
tcaatgttaatgg

SEQ ID NO: 646585 - DNA, 13 bp, D. melanogaster
tcaatgttacaat

SEQ ID NO: 646586 - DNA, 14 bp, D. melanogaster
tcaattaaaaactt

SEQ ID NO: 646587 - DNA, 13 bp, D. melanogaster
tcaattaaaaatg

SEQ ID NO: 646588 - DNA, 13 bp, D. melanogaster
tcaattaaaactt

SEQ ID NO: 646589 - DNA, 13 bp, D. melanogaster
tcaattaaaatgt

SEQ ID NO: 646590 - DNA, 13 bp, D. melanogaster
tcaattaaagtca

SEQ ID NO: 646591 - DNA, 14 bp, D. melanogaster
tcaattaaattgaa

SEQ ID NO: 646592 - DNA, 13 bp, D. melanogaster
tcaattaaatttg

SEQ ID NO: 646593 - DNA, 13 bp, D. melanogaster
tcaattaaccaaa

SEQ ID NO: 646594 - DNA, 13 bp, D. melanogaster
tcaattaagctga

SEQ ID NO: 646595 - DNA, 13 bp, D. melanogaster
tcaattaagtgcc

SEQ ID NO: 646596 - DNA, 13 bp, D. melanogaster
tcaattaatgcaa

SEQ ID NO: 646597 - DNA, 13 bp, D. melanogaster
tcaattaattgaa

SEQ ID NO: 646598 - DNA, 13 bp, D. melanogaster
tcaattaattgat

SEQ ID NO: 646599 - DNA, 13 bp, D. melanogaster
tcaattaattgca

SEQ ID NO: 646600 - DNA, 13 bp, D. melanogaster
tcaattaattgta

SEQ ID NO: 646601 - DNA, 13 bp, D. melanogaster
tcaattaatttac

SEQ ID NO: 646602 - DNA, 13 bp, D. melanogaster
tcaattaatttgc

SEQ ID NO: 646603 - DNA, 14 bp, D. melanogaster
tcaattacaatcaa

SEQ ID NO: 646604 - DNA, 13 bp, D. melanogaster
tcaattacatttt

SEQ ID NO: 646605 - DNA, 13 bp, D. melanogaster
tcaattacttttc

SEQ ID NO: 646606 - DNA, 13 bp, D. melanogaster
tcaattagcataa

SEQ ID NO: 646607 - DNA, 13 bp, D. melanogaster
tcaattagcattt

SEQ ID NO: 646608 - DNA, 13 bp, D. melanogaster
tcaattagccaaa

SEQ ID NO: 646609 - DNA, 13 bp, D. melanogaster
tcaattaggcaaa

SEQ ID NO: 646610 - DNA, 13 bp, D. melanogaster
tcaattagtggca

SEQ ID NO: 646611 - DNA, 13 bp, D. melanogaster
tcaattagttaaa

SEQ ID NO: 646612 - DNA, 13 bp, D. melanogaster
tcaattagtttta

SEQ ID NO: 646613 - DNA, 13 bp, D. melanogaster
tcaattatcaatt

SEQ ID NO: 646614 - DNA, 13 bp, D. melanogaster
tcaattatgaatg

SEQ ID NO: 646615 - DNA, 13 bp, D. melanogaster
tcaattatgattt

SEQ ID NO: 646616 - DNA, 14 bp, D. melanogaster
tcaattatgcaaat

SEQ ID NO: 646617 - DNA, 13 bp, D. melanogaster
tcaattatgcttt

SEQ ID NO: 646618 - DNA, 13 bp, D. melanogaster
tcaattatggcca

SEQ ID NO: 646619 - DNA, 13 bp, D. melanogaster
tcaattattcaat

SEQ ID NO: 646620 - DNA, 13 bp, D. melanogaster
tcaattatttcga

SEQ ID NO: 646621 - DNA, 13 bp, D. melanogaster
tcaattatttgat

SEQ ID NO: 646622 - DNA, 13 bp, D. melanogaster
tcaattattttgt

SEQ ID NO: 646623 - DNA, 13 bp, D. melanogaster
tcaattcaaaaat

SEQ ID NO: 646624 - DNA, 13 bp, D. melanogaster
tcaattcaaaatg

SEQ ID NO: 646625 - DNA, 13 bp, D. melanogaster
tcaattcaaatgt

SEQ ID NO: 646626 - DNA, 13 bp, D. melanogaster
tcaattcaattcc

SEQ ID NO: 646627 - DNA, 13 bp, D. melanogaster
tcaattcaattcg

SEQ ID NO: 646628 - DNA, 14 bp, D. melanogaster
tcaattcaattcga

SEQ ID NO: 646629 - DNA, 13 bp, D. melanogaster
tcaattcaatttg

SEQ ID NO: 646630 - DNA, 13 bp, D. melanogaster
tcaattcagcgca

SEQ ID NO: 646631 - DNA, 13 bp, D. melanogaster
tcaattcattcat

SEQ ID NO: 646632 - DNA, 13 bp, D. melanogaster
tcaattcgaattc

SEQ ID NO: 646633 - DNA, 13 bp, D. melanogaster
tcaattctaattt

SEQ ID NO: 646634 - DNA, 14 bp, D. melanogaster
tcaattcttatttg

SEQ ID NO: 646635 - DNA, 13 bp, D. melanogaster
tcaattctttcaa

SEQ ID NO: 646636 - DNA, 13 bp, D. melanogaster
tcaattctttggt

SEQ ID NO: 646637 - DNA, 14 bp, D. melanogaster
tcaattctttggta

SEQ ID NO: 646638 - DNA, 13 bp, D. melanogaster
tcaattgaaaagt

SEQ ID NO: 646639 - DNA, 13 bp, D. melanogaster
tcaattgaaaatc

SEQ ID NO: 646640 - DNA, 13 bp, D. melanogaster
tcaattgaaaatt

SEQ ID NO: 646641 - DNA, 13 bp, D. melanogaster
tcaattgaaatcg

SEQ ID NO: 646642 - DNA, 13 bp, D. melanogaster
tcaattgaaatgt

SEQ ID NO: 646643 - DNA, 13 bp, D. melanogaster
tcaattgaaattc

SEQ ID NO: 646644 - DNA, 13 bp, D. melanogaster
tcaattgaaattt

SEQ ID NO: 646645 - DNA, 13 bp, D. melanogaster
tcaattgaatata

SEQ ID NO: 646646 - DNA, 13 bp, D. melanogaster
tcaattgaatgca

SEQ ID NO: 646647 - DNA, 13 bp, D. melanogaster
tcaattgaattca

SEQ ID NO: 646648 - DNA, 13 bp, D. melanogaster
tcaattgatttga

SEQ ID NO: 646649 - DNA, 14 bp, D. melanogaster
tcaattgattttaa

SEQ ID NO: 646650 - DNA, 13 bp, D. melanogaster
tcaattgcaagct

SEQ ID NO: 646651 - DNA, 13 bp, D. melanogaster
tcaattgcaatgt

SEQ ID NO: 646652 - DNA, 13 bp, D. melanogaster
tcaattgcaatta

SEQ ID NO: 646653 - DNA, 13 bp, D. melanogaster
tcaattgcattaa

SEQ ID NO: 646654 - DNA, 13 bp, D. melanogaster
tcaattgcatttg

SEQ ID NO: 646655 - DNA, 13 bp, D. melanogaster
tcaattgccattt

SEQ ID NO: 646656 - DNA, 13 bp, D. melanogaster
tcaattggaaatt

SEQ ID NO: 646657 - DNA, 13 bp, D. melanogaster
tcaattggaattt

SEQ ID NO: 646658 - DNA, 13 bp, D. melanogaster
tcaattggcacca

SEQ ID NO: 646659 - DNA, 13 bp, D. melanogaster
tcaattggccagc

SEQ ID NO: 646660 - DNA, 13 bp, D. melanogaster
tcaattgtaattg

SEQ ID NO: 646661 - DNA, 13 bp, D. melanogaster
tcaattgtatttt

SEQ ID NO: 646662 - DNA, 13 bp, D. melanogaster
tcaattgtcaaat

SEQ ID NO: 646663 - DNA, 13 bp, D. melanogaster
tcaattgtcaact

SEQ ID NO: 646664 - DNA, 13 bp, D. melanogaster
tcaattgtggaat

SEQ ID NO: 646665 - DNA, 13 bp, D. melanogaster
tcaattgttaatt

SEQ ID NO: 646666 - DNA, 13 bp, D. melanogaster
tcaattgttattt

SEQ ID NO: 646667 - DNA, 13 bp, D. melanogaster
tcaattgttcaat

SEQ ID NO: 646668 - DNA, 13 bp, D. melanogaster
tcaattgtttata

SEQ ID NO: 646669 - DNA, 13 bp, D. melanogaster
tcaattgtttatg

SEQ ID NO: 646670 - DNA, 13 bp, D. melanogaster
tcaattgtttgca

SEQ ID NO: 646671 - DNA, 13 bp, D. melanogaster
tcaattgtttgcc

SEQ ID NO: 646672 - DNA, 13 bp, D. melanogaster
tcaattgtttgtt

SEQ ID NO: 646673 - DNA, 13 bp, D. melanogaster
tcaattgttttcg

SEQ ID NO: 646674 - DNA, 13 bp, D. melanogaster
tcaatttaaagca

SEQ ID NO: 646675 - DNA, 13 bp, D. melanogaster
tcaatttaaatgc

SEQ ID NO: 646676 - DNA, 13 bp, D. melanogaster
tcaatttaaattg

SEQ ID NO: 646677 - DNA, 13 bp, D. melanogaster
tcaatttaacttt

SEQ ID NO: 646678 - DNA, 13 bp, D. melanogaster
tcaatttaattgc

SEQ ID NO: 646679 - DNA, 13 bp, D. melanogaster
tcaatttacatat

SEQ ID NO: 646680 - DNA, 13 bp, D. melanogaster
tcaatttatcaat

SEQ ID NO: 646681 - DNA, 13 bp, D. melanogaster
tcaatttattcat

SEQ ID NO: 646682 - DNA, 13 bp, D. melanogaster
tcaatttattgat

SEQ ID NO: 646683 - DNA, 13 bp, D. melanogaster
tcaatttattgcc

SEQ ID NO: 646684 - DNA, 13 bp, D. melanogaster
tcaatttattgta

SEQ ID NO: 646685 - DNA, 13 bp, D. melanogaster
tcaatttattttg

SEQ ID NO: 646686 - DNA, 13 bp, D. melanogaster
tcaatttcaaaat

SEQ ID NO: 646687 - DNA, 13 bp, D. melanogaster
tcaatttcaaact

SEQ ID NO: 646688 - DNA, 13 bp, D. melanogaster
tcaatttcaatca

SEQ ID NO: 646689 - DNA, 13 bp, D. melanogaster
tcaatttcaatgc

SEQ ID NO: 646690 - DNA, 13 bp, D. melanogaster
tcaatttcaattt

SEQ ID NO: 646691 - DNA, 14 bp, D. melanogaster
tcaatttcaatttg

SEQ ID NO: 646692 - DNA, 13 bp, D. melanogaster
tcaatttcagttt

SEQ ID NO: 646693 - DNA, 13 bp, D. melanogaster
tcaatttcatggc

SEQ ID NO: 646694 - DNA, 13 bp, D. melanogaster
tcaatttcattat

SEQ ID NO: 646695 - DNA, 13 bp, D. melanogaster
tcaatttcattcg

SEQ ID NO: 646696 - DNA, 13 bp, D. melanogaster
tcaatttccatat

SEQ ID NO: 646697 - DNA, 13 bp, D. melanogaster
tcaatttccattt

SEQ ID NO: 646698 - DNA, 13 bp, D. melanogaster
tcaatttcgattc

SEQ ID NO: 646699 - DNA, 14 bp, D. melanogaster
tcaatttcgatttc

SEQ ID NO: 646700 - DNA, 13 bp, D. melanogaster
tcaatttcgtttg

SEQ ID NO: 646701 - DNA, 13 bp, D. melanogaster
tcaatttcgtttt

SEQ ID NO: 646702 - DNA, 13 bp, D. melanogaster
tcaatttctaatt

SEQ ID NO: 646703 - DNA, 13 bp, D. melanogaster
tcaatttgaaaac

SEQ ID NO: 646704 - DNA, 13 bp, D. melanogaster
tcaatttgaaaag

SEQ ID NO: 646705 - DNA, 13 bp, D. melanogaster
tcaatttgaaatc

SEQ ID NO: 646706 - DNA, 13 bp, D. melanogaster
tcaatttgaaatt

SEQ ID NO: 646707 - DNA, 13 bp, D. melanogaster
tcaatttgaataa

SEQ ID NO: 646708 - DNA, 13 bp, D. melanogaster
tcaatttgaatta

SEQ ID NO: 646709 - DNA, 13 bp, D. melanogaster
tcaatttgatatt

SEQ ID NO: 646710 - DNA, 14 bp, D. melanogaster
tcaatttgatattg

SEQ ID NO: 646711 - DNA, 13 bp, D. melanogaster
tcaatttgatgtt

SEQ ID NO: 646712 - DNA, 14 bp, D. melanogaster
tcaatttgcaaaaa

SEQ ID NO: 646713 - DNA, 13 bp, D. melanogaster
tcaatttgcaatt

SEQ ID NO: 646714 - DNA, 13 bp, D. melanogaster
tcaatttgcatgt

SEQ ID NO: 646715 - DNA, 14 bp, D. melanogaster
tcaatttgcatttc

SEQ ID NO: 646716 - DNA, 13 bp, D. melanogaster
tcaatttgccaaa

SEQ ID NO: 646717 - DNA, 13 bp, D. melanogaster
tcaatttgccagc

SEQ ID NO: 646718 - DNA, 13 bp, D. melanogaster
tcaatttgccggc

SEQ ID NO: 646719 - DNA, 13 bp, D. melanogaster
tcaatttgcgttt

SEQ ID NO: 646720 - DNA, 14 bp, D. melanogaster
tcaatttgctgcaa

SEQ ID NO: 646721 - DNA, 13 bp, D. melanogaster
tcaatttgctttt

SEQ ID NO: 646722 - DNA, 13 bp, D. melanogaster
tcaatttggccaa

SEQ ID NO: 646723 - DNA, 13 bp, D. melanogaster
tcaatttggcttt

SEQ ID NO: 646724 - DNA, 13 bp, D. melanogaster
tcaatttggttta

SEQ ID NO: 646725 - DNA, 13 bp, D. melanogaster
tcaatttgtatta

SEQ ID NO: 646726 - DNA, 13 bp, D. melanogaster
tcaatttgtattt

SEQ ID NO: 646727 - DNA, 13 bp, D. melanogaster
tcaatttgtgcgc

SEQ ID NO: 646728 - DNA, 13 bp, D. melanogaster
tcaatttgttaaa

SEQ ID NO: 646729 - DNA, 13 bp, D. melanogaster
tcaatttgttaag

SEQ ID NO: 646730 - DNA, 13 bp, D. melanogaster
tcaatttgtttta

SEQ ID NO: 646731 - DNA, 13 bp, D. melanogaster
tcaattttaaatc

SEQ ID NO: 646732 - DNA, 13 bp, D. melanogaster
tcaattttcaaac

SEQ ID NO: 646733 - DNA, 13 bp, D. melanogaster
tcaattttcaaat

SEQ ID NO: 646734 - DNA, 13 bp, D. melanogaster
tcaattttcaatt

SEQ ID NO: 646735 - DNA, 13 bp, D. melanogaster
tcaattttccagc

SEQ ID NO: 646736 - DNA, 13 bp, D. melanogaster
tcaattttcgctt

SEQ ID NO: 646737 - DNA, 13 bp, D. melanogaster
tcaattttgaaaa

SEQ ID NO: 646738 - DNA, 13 bp, D. melanogaster
tcaattttgaatt

SEQ ID NO: 646739 - DNA, 13 bp, D. melanogaster
tcaattttgcaat

SEQ ID NO: 646740 - DNA, 13 bp, D. melanogaster
tcaattttgtttg

SEQ ID NO: 646741 - DNA, 13 bp, D. melanogaster
tcaatttttagtt

SEQ ID NO: 646742 - DNA, 13 bp, D. melanogaster
tcaatttttatgc

SEQ ID NO: 646743 - DNA, 13 bp, D. melanogaster
tcaatttttgatg

SEQ ID NO: 646744 - DNA, 13 bp, D. melanogaster
tcaatttttgatt

SEQ ID NO: 646745 - DNA, 13 bp, D. melanogaster
tcaattttttcaa

SEQ ID NO: 646746 - DNA, 13 bp, D. melanogaster
tcaattttttggc

SEQ ID NO: 646747 - DNA, 14 bp, D. melanogaster
tcacaaaatcagaa

SEQ ID NO: 646748 - DNA, 13 bp, D. melanogaster
tcacaaaatttat

SEQ ID NO: 646749 - DNA, 13 bp, D. melanogaster
tcacaaaatttca

SEQ ID NO: 646750 - DNA, 13 bp, D. melanogaster
tcacaaacacaat

SEQ ID NO: 646751 - DNA, 14 bp, D. melanogaster
tcacaaacacaatt

SEQ ID NO: 646752 - DNA, 13 bp, D. melanogaster
tcacaaacatttt

SEQ ID NO: 646753 - DNA, 13 bp, D. melanogaster
tcacaaacctgtt

SEQ ID NO: 646754 - DNA, 13 bp, D. melanogaster
tcacaaactattt

SEQ ID NO: 646755 - DNA, 13 bp, D. melanogaster
tcacaaagtcaaa

SEQ ID NO: 646756 - DNA, 13 bp, D. melanogaster
tcacaaatcaaat

SEQ ID NO: 646757 - DNA, 13 bp, D. melanogaster
tcacaaattaatt

SEQ ID NO: 646758 - DNA, 15 bp, D. melanogaster
tcacaaattttagaa

SEQ ID NO: 646759 - DNA, 13 bp, D. melanogaster
tcacaagcaaagt

SEQ ID NO: 646760 - DNA, 13 bp, D. melanogaster
tcacaagtcccca

SEQ ID NO: 646761 - DNA, 13 bp, D. melanogaster
tcacaatatgttt

SEQ ID NO: 646762 - DNA, 13 bp, D. melanogaster
tcacaatgtattg

SEQ ID NO: 646763 - DNA, 13 bp, D. melanogaster
tcacaattatttt

SEQ ID NO: 646764 - DNA, 13 bp, D. melanogaster
tcacaattttgat

SEQ ID NO: 646765 - DNA, 13 bp, D. melanogaster
tcacacaagcaag

SEQ ID NO: 646766 - DNA, 14 bp, D. melanogaster
tcacacacacacat

SEQ ID NO: 646767 - DNA, 13 bp, D. melanogaster
tcacacacacact

SEQ ID NO: 646768 - DNA, 13 bp, D. melanogaster
tcacacacataca

SEQ ID NO: 646769 - DNA, 14 bp, D. melanogaster
tcacacacatacac

SEQ ID NO: 646770 - DNA, 13 bp, D. melanogaster
tcacacacgcaca

SEQ ID NO: 646771 - DNA, 13 bp, D. melanogaster
tcacacagataca

SEQ ID NO: 646772 - DNA, 14 bp, D. melanogaster
tcacacagatactc

SEQ ID NO: 646773 - DNA, 13 bp, D. melanogaster
tcacacagcaaac

SEQ ID NO: 646774 - DNA, 13 bp, D. melanogaster
tcacacagttcat

SEQ ID NO: 646775 - DNA, 14 bp, D. melanogaster
tcacacagttcatt

SEQ ID NO: 646776 - DNA, 14 bp, D. melanogaster
tcacacatgaacac

SEQ ID NO: 646777 - DNA, 14 bp, D. melanogaster
tcacacgccgacca

SEQ ID NO: 646778 - DNA, 13 bp, D. melanogaster
tcacactcacaca

SEQ ID NO: 646779 - DNA, 13 bp, D. melanogaster
tcacactcgcaca

SEQ ID NO: 646780 - DNA, 13 bp, D. melanogaster
tcacacttttaaa

SEQ ID NO: 646781 - DNA, 13 bp, D. melanogaster
tcacagagcaaaa

SEQ ID NO: 646782 - DNA, 13 bp, D. melanogaster
tcacagcaaaaaa

SEQ ID NO: 646783 - DNA, 14 bp, D. melanogaster
tcacagcaaaaaac

SEQ ID NO: 646784 - DNA, 13 bp, D. melanogaster
tcacagcgcaaac

SEQ ID NO: 646785 - DNA, 13 bp, D. melanogaster
tcacagctgttca

SEQ ID NO: 646786 - DNA, 13 bp, D. melanogaster
tcacagttaaaaa

SEQ ID NO: 646787 - DNA, 13 bp, D. melanogaster
tcacataaaatgc

SEQ ID NO: 646788 - DNA, 13 bp, D. melanogaster
tcacatacacaca

SEQ ID NO: 646789 - DNA, 14 bp, D. melanogaster
tcacatacacacac

SEQ ID NO: 646790 - DNA, 14 bp, D. melanogaster
tcacatacatatat

SEQ ID NO: 646791 - DNA, 13 bp, D. melanogaster
tcacatacatatg

SEQ ID NO: 646792 - DNA, 14 bp, D. melanogaster
tcacatatataagt

SEQ ID NO: 646793 - DNA, 14 bp, D. melanogaster
tcacatatatatat

SEQ ID NO: 646794 - DNA, 13 bp, D. melanogaster
tcacatatatgta

SEQ ID NO: 646795 - DNA, 13 bp, D. melanogaster
tcacatatttata

SEQ ID NO: 646796 - DNA, 13 bp, D. melanogaster
tcacatcaaagac

SEQ ID NO: 646797 - DNA, 13 bp, D. melanogaster
tcacatccacatc

SEQ ID NO: 646798 - DNA, 14 bp, D. melanogaster
tcacatccacatcc

SEQ ID NO: 646799 - DNA, 14 bp, D. melanogaster
tcacatcctgctca

SEQ ID NO: 646800 - DNA, 13 bp, D. melanogaster
tcacatgcattgt

SEQ ID NO: 646801 - DNA, 13 bp, D. melanogaster
tcacattaaaaat

SEQ ID NO: 646802 - DNA, 13 bp, D. melanogaster
tcacattcacaca

SEQ ID NO: 646803 - DNA, 13 bp, D. melanogaster
tcacattcacata

SEQ ID NO: 646804 - DNA, 13 bp, D. melanogaster
tcacattcccatt

SEQ ID NO: 646805 - DNA, 13 bp, D. melanogaster
tcacattgccttc

SEQ ID NO: 646806 - DNA, 13 bp, D. melanogaster
tcacatttccaca

SEQ ID NO: 646807 - DNA, 13 bp, D. melanogaster
tcacatttcgcat

SEQ ID NO: 646808 - DNA, 13 bp, D. melanogaster
tcacatttctgtt

SEQ ID NO: 646809 - DNA, 13 bp, D. melanogaster
tcacatttgattt

SEQ ID NO: 646810 - DNA, 13 bp, D. melanogaster
tcacattttaaaa

SEQ ID NO: 646811 - DNA, 13 bp, D. melanogaster
tcacatttttccc

SEQ ID NO: 646812 - DNA, 13 bp, D. melanogaster
tcacatttttggc

SEQ ID NO: 646813 - DNA, 13 bp, D. melanogaster
tcacattttttgt

SEQ ID NO: 646814 - DNA, 13 bp, D. melanogaster
tcaccaaagaaag

SEQ ID NO: 646815 - DNA, 13 bp, D. melanogaster
tcaccaaattttt

SEQ ID NO: 646816 - DNA, 13 bp, D. melanogaster
tcaccaacatcat

SEQ ID NO: 646817 - DNA, 13 bp, D. melanogaster
tcaccaagtacac

SEQ ID NO: 646818 - DNA, 13 bp, D. melanogaster
tcaccaagtgaac

SEQ ID NO: 646819 - DNA, 13 bp, D. melanogaster
tcaccaccagcaa

SEQ ID NO: 646820 - DNA, 14 bp, D. melanogaster
tcaccaccagcaat

SEQ ID NO: 646821 - DNA, 13 bp, D. melanogaster
tcaccacgttggt

SEQ ID NO: 646822 - DNA, 13 bp, D. melanogaster
tcaccagcagcag

SEQ ID NO: 646823 - DNA, 13 bp, D. melanogaster
tcaccatcagcat

SEQ ID NO: 646824 - DNA, 13 bp, D. melanogaster
tcaccatcatcaa

SEQ ID NO: 646825 - DNA, 13 bp, D. melanogaster
tcaccatcatcgt

SEQ ID NO: 646826 - DNA, 13 bp, D. melanogaster
tcaccatcgccat

SEQ ID NO: 646827 - DNA, 14 bp, D. melanogaster
tcaccatcgccatc

SEQ ID NO: 646828 - DNA, 13 bp, D. melanogaster
tcaccatctccat

SEQ ID NO: 646829 - DNA, 13 bp, D. melanogaster
tcaccattaagct

SEQ ID NO: 646830 - DNA, 13 bp, D. melanogaster
tcaccattcacca

SEQ ID NO: 646831 - DNA, 13 bp, D. melanogaster
tcacccatttatg

SEQ ID NO: 646832 - DNA, 13 bp, D. melanogaster
tcacccgctgcga

SEQ ID NO: 646833 - DNA, 13 bp, D. melanogaster
tcaccctgagtgc

SEQ ID NO: 646834 - DNA, 13 bp, D. melanogaster
tcaccgccgaagc

SEQ ID NO: 646835 - DNA, 13 bp, D. melanogaster
tcacctacaaaat

SEQ ID NO: 646836 - DNA, 13 bp, D. melanogaster
tcacctgttcaat

SEQ ID NO: 646837 - DNA, 14 bp, D. melanogaster
tcacctgttcaatc

SEQ ID NO: 646838 - DNA, 13 bp, D. melanogaster
tcacctgtttttc

SEQ ID NO: 646839 - DNA, 13 bp, D. melanogaster
tcacgaatttatt

SEQ ID NO: 646840 - DNA, 14 bp, D. melanogaster
tcacgcacacacac

SEQ ID NO: 646841 - DNA, 13 bp, D. melanogaster
tcacgcacgcaca

SEQ ID NO: 646842 - DNA, 14 bp, D. melanogaster
tcacgcatacgcac

SEQ ID NO: 646843 - DNA, 13 bp, D. melanogaster
tcacgccacttaa

SEQ ID NO: 646844 - DNA, 14 bp, D. melanogaster
tcacgcccacactt

SEQ ID NO: 646845 - DNA, 13 bp, D. melanogaster
tcacgcccacatt

SEQ ID NO: 646846 - DNA, 13 bp, D. melanogaster
tcacgcccactct

SEQ ID NO: 646847 - DNA, 13 bp, D. melanogaster
tcacgctgccatc

SEQ ID NO: 646848 - DNA, 13 bp, D. melanogaster
tcacggaacttaa

SEQ ID NO: 646849 - DNA, 13 bp, D. melanogaster
tcacgggcaaaat

SEQ ID NO: 646850 - DNA, 13 bp, D. melanogaster
tcacgtatacgca

SEQ ID NO: 646851 - DNA, 13 bp, D. melanogaster
tcacgttgaatgc

SEQ ID NO: 646852 - DNA, 14 bp, D. melanogaster
tcacgttgaatgcg

SEQ ID NO: 646853 - DNA, 13 bp, D. melanogaster
tcactaaatattt

SEQ ID NO: 646854 - DNA, 13 bp, D. melanogaster
tcactaaatgctt

SEQ ID NO: 646855 - DNA, 13 bp, D. melanogaster
tcactaactgttt

SEQ ID NO: 646856 - DNA, 13 bp, D. melanogaster
tcactaataagca

SEQ ID NO: 646857 - DNA, 13 bp, D. melanogaster
tcactattttagc

SEQ ID NO: 646858 - DNA, 13 bp, D. melanogaster
tcactcaatttat

SEQ ID NO: 646859 - DNA, 13 bp, D. melanogaster
tcactcacacaca

SEQ ID NO: 646860 - DNA, 14 bp, D. melanogaster
tcactcacacacac

SEQ ID NO: 646861 - DNA, 13 bp, D. melanogaster
tcactcacacacg

SEQ ID NO: 646862 - DNA, 14 bp, D. melanogaster
tcactcacacactc

SEQ ID NO: 646863 - DNA, 14 bp, D. melanogaster
tcactcactcactc

SEQ ID NO: 646864 - DNA, 13 bp, D. melanogaster
tcactcagtattt

SEQ ID NO: 646865 - DNA, 14 bp, D. melanogaster
tcactcagtcagtc

SEQ ID NO: 646866 - DNA, 13 bp, D. melanogaster
tcactctgggcgc

SEQ ID NO: 646867 - DNA, 13 bp, D. melanogaster
tcactgaagtttt

SEQ ID NO: 646868 - DNA, 13 bp, D. melanogaster
tcactgagaacac

SEQ ID NO: 646869 - DNA, 13 bp, D. melanogaster
tcactgcactcgt

SEQ ID NO: 646870 - DNA, 13 bp, D. melanogaster
tcactgctttaaa

SEQ ID NO: 646871 - DNA, 13 bp, D. melanogaster
tcactggagcgcc

SEQ ID NO: 646872 - DNA, 13 bp, D. melanogaster
tcactggcaactg

SEQ ID NO: 646873 - DNA, 13 bp, D. melanogaster
tcactgtatgcgt

SEQ ID NO: 646874 - DNA, 13 bp, D. melanogaster
tcactgtgaaaac

SEQ ID NO: 646875 - DNA, 13 bp, D. melanogaster
tcacttaaaaaat

SEQ ID NO: 646876 - DNA, 14 bp, D. melanogaster
tcacttaaaattat

SEQ ID NO: 646877 - DNA, 13 bp, D. melanogaster
tcacttaactttt

SEQ ID NO: 646878 - DNA, 13 bp, D. melanogaster
tcacttaattaaa

SEQ ID NO: 646879 - DNA, 13 bp, D. melanogaster
tcacttacaactt

SEQ ID NO: 646880 - DNA, 13 bp, D. melanogaster
tcacttattgctt

SEQ ID NO: 646881 - DNA, 13 bp, D. melanogaster
tcacttatttttg

SEQ ID NO: 646882 - DNA, 13 bp, D. melanogaster
tcacttcactttt

SEQ ID NO: 646883 - DNA, 14 bp, D. melanogaster
tcacttcgaactgg

SEQ ID NO: 646884 - DNA, 13 bp, D. melanogaster
tcacttcttttac

SEQ ID NO: 646885 - DNA, 13 bp, D. melanogaster
tcacttgagatcg

SEQ ID NO: 646886 - DNA, 13 bp, D. melanogaster
tcacttgcacttt

SEQ ID NO: 646887 - DNA, 13 bp, D. melanogaster
tcacttgccattt

SEQ ID NO: 646888 - DNA, 13 bp, D. melanogaster
tcacttggcaatt

SEQ ID NO: 646889 - DNA, 13 bp, D. melanogaster
tcacttgttgttg

SEQ ID NO: 646890 - DNA, 14 bp, D. melanogaster
tcacttgtttgttt

SEQ ID NO: 646891 - DNA, 13 bp, D. melanogaster
tcactttatccat

SEQ ID NO: 646892 - DNA, 13 bp, D. melanogaster
tcactttattgat

SEQ ID NO: 646893 - DNA, 13 bp, D. melanogaster
tcactttcaatta

SEQ ID NO: 646894 - DNA, 13 bp, D. melanogaster
tcactttcacttc

SEQ ID NO: 646895 - DNA, 13 bp, D. melanogaster
tcactttcagttg

SEQ ID NO: 646896 - DNA, 13 bp, D. melanogaster
tcactttcatttc

SEQ ID NO: 646897 - DNA, 13 bp, D. melanogaster
tcactttcggact

SEQ ID NO: 646898 - DNA, 13 bp, D. melanogaster
tcactttcgttgg

SEQ ID NO: 646899 - DNA, 13 bp, D. melanogaster
tcactttcgtttg

SEQ ID NO: 646900 - DNA, 13 bp, D. melanogaster
tcactttgcaaaa

SEQ ID NO: 646901 - DNA, 14 bp, D. melanogaster
tcactttgcaaaag

SEQ ID NO: 646902 - DNA, 13 bp, D. melanogaster
tcactttgccacc

SEQ ID NO: 646903 - DNA, 13 bp, D. melanogaster
tcactttggccaa

SEQ ID NO: 646904 - DNA, 13 bp, D. melanogaster
tcactttgtttat

SEQ ID NO: 646905 - DNA, 13 bp, D. melanogaster
tcactttgttttc

SEQ ID NO: 646906 - DNA, 13 bp, D. melanogaster
tcacttttccagc

SEQ ID NO: 646907 - DNA, 13 bp, D. melanogaster
tcactttttgctg

SEQ ID NO: 646908 - DNA, 13 bp, D. melanogaster
tcagaaaactaga

SEQ ID NO: 646909 - DNA, 13 bp, D. melanogaster
tcagaaaagttct

SEQ ID NO: 646910 - DNA, 13 bp, D. melanogaster
tcagaaaatattt

SEQ ID NO: 646911 - DNA, 13 bp, D. melanogaster
tcagaaaatcaaa

SEQ ID NO: 646912 - DNA, 13 bp, D. melanogaster
tcagaaacagaaa

SEQ ID NO: 646913 - DNA, 13 bp, D. melanogaster
tcagaaagtgcct

SEQ ID NO: 646914 - DNA, 13 bp, D. melanogaster
tcagaaatattta

SEQ ID NO: 646915 - DNA, 13 bp, D. melanogaster
tcagaaatcagaa

SEQ ID NO: 646916 - DNA, 13 bp, D. melanogaster
tcagaaatcgcat

SEQ ID NO: 646917 - DNA, 13 bp, D. melanogaster
tcagaaattgaaa

SEQ ID NO: 646918 - DNA, 13 bp, D. melanogaster
tcagaacaactac

SEQ ID NO: 646919 - DNA, 13 bp, D. melanogaster
tcagaagatttat

SEQ ID NO: 646920 - DNA, 13 bp, D. melanogaster
tcagaagtattgg

SEQ ID NO: 646921 - DNA, 13 bp, D. melanogaster
tcagaatcagaat

SEQ ID NO: 646922 - DNA, 14 bp, D. melanogaster
tcagaatcagcatc

SEQ ID NO: 646923 - DNA, 13 bp, D. melanogaster
tcagaatctttga

SEQ ID NO: 646924 - DNA, 14 bp, D. melanogaster
tcagaatgaaaact

SEQ ID NO: 646925 - DNA, 13 bp, D. melanogaster
tcagacagtttat

SEQ ID NO: 646926 - DNA, 13 bp, D. melanogaster
tcagacattgatg

SEQ ID NO: 646927 - DNA, 13 bp, D. melanogaster
tcagacgaaaacg

SEQ ID NO: 646928 - DNA, 13 bp, D. melanogaster
tcagactcagact

SEQ ID NO: 646929 - DNA, 13 bp, D. melanogaster
tcagactttctgg

SEQ ID NO: 646930 - DNA, 13 bp, D. melanogaster
tcagagaaagcaa

SEQ ID NO: 646931 - DNA, 13 bp, D. melanogaster
tcagagaacaata

SEQ ID NO: 646932 - DNA, 14 bp, D. melanogaster
tcagagagagcagg

SEQ ID NO: 646933 - DNA, 13 bp, D. melanogaster
tcagagagccact

SEQ ID NO: 646934 - DNA, 13 bp, D. melanogaster
tcagagagtaaat

SEQ ID NO: 646935 - DNA, 13 bp, D. melanogaster
tcagagatggaaa

SEQ ID NO: 646936 - DNA, 13 bp, D. melanogaster
tcagagcattaat

SEQ ID NO: 646937 - DNA, 13 bp, D. melanogaster
tcagagcctcaat

SEQ ID NO: 646938 - DNA, 13 bp, D. melanogaster
tcagagttcagag

SEQ ID NO: 646939 - DNA, 14 bp, D. melanogaster
tcagatacagatac

SEQ ID NO: 646940 - DNA, 13 bp, D. melanogaster
tcagatacccctt

SEQ ID NO: 646941 - DNA, 14 bp, D. melanogaster
tcagatacccttta

SEQ ID NO: 646942 - DNA, 13 bp, D. melanogaster
tcagatactcaga

SEQ ID NO: 646943 - DNA, 13 bp, D. melanogaster
tcagatacttttg

SEQ ID NO: 646944 - DNA, 13 bp, D. melanogaster
tcagatacttttt

SEQ ID NO: 646945 - DNA, 13 bp, D. melanogaster
tcagatatccgtt

SEQ ID NO: 646946 - DNA, 13 bp, D. melanogaster
tcagatcagatca

SEQ ID NO: 646947 - DNA, 14 bp, D. melanogaster
tcagatcagatcag

SEQ ID NO: 646948 - DNA, 13 bp, D. melanogaster
tcagatccaaacc

SEQ ID NO: 646949 - DNA, 13 bp, D. melanogaster
tcagatctataaa

SEQ ID NO: 646950 - DNA, 13 bp, D. melanogaster
tcagatctgccaa

SEQ ID NO: 646951 - DNA, 13 bp, D. melanogaster
tcagatgatgatg

SEQ ID NO: 646952 - DNA, 13 bp, D. melanogaster
tcagatgcagata

SEQ ID NO: 646953 - DNA, 13 bp, D. melanogaster
tcagatggaattg

SEQ ID NO: 646954 - DNA, 13 bp, D. melanogaster
tcagatgggcgat

SEQ ID NO: 646955 - DNA, 13 bp, D. melanogaster
tcagatgttgatt

SEQ ID NO: 646956 - DNA, 13 bp, D. melanogaster
tcagattaagagc

SEQ ID NO: 646957 - DNA, 13 bp, D. melanogaster
tcagattcaaata

SEQ ID NO: 646958 - DNA, 13 bp, D. melanogaster
tcagattcacgga

SEQ ID NO: 646959 - DNA, 13 bp, D. melanogaster
tcagattcagatc

SEQ ID NO: 646960 - DNA, 14 bp, D. melanogaster
tcagattcagattc

SEQ ID NO: 646961 - DNA, 14 bp, D. melanogaster
tcagattcagattt

SEQ ID NO: 646962 - DNA, 14 bp, D. melanogaster
tcagattcggattc

SEQ ID NO: 646963 - DNA, 13 bp, D. melanogaster
tcagattctgatt

SEQ ID NO: 646964 - DNA, 13 bp, D. melanogaster
tcagattctgtgc

SEQ ID NO: 646965 - DNA, 13 bp, D. melanogaster
tcagattcttgag

SEQ ID NO: 646966 - DNA, 13 bp, D. melanogaster
tcagattgcaaat

SEQ ID NO: 646967 - DNA, 13 bp, D. melanogaster
tcagatttcagat

SEQ ID NO: 646968 - DNA, 14 bp, D. melanogaster
tcagatttgtggaa

SEQ ID NO: 646969 - DNA, 14 bp, D. melanogaster
tcagattttttgtt

SEQ ID NO: 646970 - DNA, 15 bp, D. melanogaster
tcagcaaaaactacg

SEQ ID NO: 646971 - DNA, 13 bp, D. melanogaster
tcagcaaaaatgt

SEQ ID NO: 646972 - DNA, 13 bp, D. melanogaster
tcagcaaaatatt

SEQ ID NO: 646973 - DNA, 13 bp, D. melanogaster
tcagcaaagcaaa

SEQ ID NO: 646974 - DNA, 13 bp, D. melanogaster
tcagcaaatgcaa

SEQ ID NO: 646975 - DNA, 14 bp, D. melanogaster
tcagcaacaacaac

SEQ ID NO: 646976 - DNA, 13 bp, D. melanogaster
tcagcaacacacc

SEQ ID NO: 646977 - DNA, 13 bp, D. melanogaster
tcagcaactgttt

SEQ ID NO: 646978 - DNA, 13 bp, D. melanogaster
tcagcaaggagtt

SEQ ID NO: 646979 - DNA, 13 bp, D. melanogaster
tcagcaataaaat

SEQ ID NO: 646980 - DNA, 13 bp, D. melanogaster
tcagcaatttaat

SEQ ID NO: 646981 - DNA, 13 bp, D. melanogaster
tcagcacccaagt

SEQ ID NO: 646982 - DNA, 13 bp, D. melanogaster
tcagcagaacttt

SEQ ID NO: 646983 - DNA, 13 bp, D. melanogaster
tcagcagagtctt

SEQ ID NO: 646984 - DNA, 13 bp, D. melanogaster
tcagcagagtgga

SEQ ID NO: 646985 - DNA, 13 bp, D. melanogaster
tcagcagcaaaaa

SEQ ID NO: 646986 - DNA, 13 bp, D. melanogaster
tcagcagcaacaa

SEQ ID NO: 646987 - DNA, 13 bp, D. melanogaster
tcagcagcaacac

SEQ ID NO: 646988 - DNA, 13 bp, D. melanogaster
tcagcagcagcaa

SEQ ID NO: 646989 - DNA, 14 bp, D. melanogaster
tcagcagcagcaac

SEQ ID NO: 646990 - DNA, 13 bp, D. melanogaster
tcagcagcagcca

SEQ ID NO: 646991 - DNA, 13 bp, D. melanogaster
tcagcagcagcgg

SEQ ID NO: 646992 - DNA, 13 bp, D. melanogaster
tcagcagcagtcg

SEQ ID NO: 646993 - DNA, 13 bp, D. melanogaster
tcagcagcattta

SEQ ID NO: 646994 - DNA, 13 bp, D. melanogaster
tcagcagcatttt

SEQ ID NO: 646995 - DNA, 13 bp, D. melanogaster
tcagcagccccaa

SEQ ID NO: 646996 - DNA, 13 bp, D. melanogaster
tcagcatcagcat

SEQ ID NO: 646997 - DNA, 15 bp, D. melanogaster
tcagcatcagcatca

SEQ ID NO: 646998 - DNA, 13 bp, D. melanogaster
tcagcatcatcag

SEQ ID NO: 646999 - DNA, 13 bp, D. melanogaster
tcagcatcatcat

SEQ ID NO: 647000 - DNA, 13 bp, D. melanogaster
tcagcatccccac

SEQ ID NO: 647001 - DNA, 13 bp, D. melanogaster
tcagcatccgaca

SEQ ID NO: 647002 - DNA, 13 bp, D. melanogaster
tcagcattaattt

SEQ ID NO: 647003 - DNA, 14 bp, D. melanogaster
tcagcattaatttt

SEQ ID NO: 647004 - DNA, 13 bp, D. melanogaster
tcagcattatggg

SEQ ID NO: 647005 - DNA, 13 bp, D. melanogaster
tcagcattcacac

SEQ ID NO: 647006 - DNA, 13 bp, D. melanogaster
tcagcattcccac

SEQ ID NO: 647007 - DNA, 13 bp, D. melanogaster
tcagcattgacca

SEQ ID NO: 647008 - DNA, 13 bp, D. melanogaster
tcagcatttcctg

SEQ ID NO: 647009 - DNA, 13 bp, D. melanogaster
tcagcatttgcat

SEQ ID NO: 647010 - DNA, 13 bp, D. melanogaster
tcagcattttaat

SEQ ID NO: 647011 - DNA, 13 bp, D. melanogaster
tcagcattttatt

SEQ ID NO: 647012 - DNA, 13 bp, D. melanogaster
tcagcatttttca

SEQ ID NO: 647013 - DNA, 13 bp, D. melanogaster
tcagccaaaaaaa

SEQ ID NO: 647014 - DNA, 14 bp, D. melanogaster
tcagccaaaaaaaa

SEQ ID NO: 647015 - DNA, 13 bp, D. melanogaster
tcagccaaatcaa

SEQ ID NO: 647016 - DNA, 14 bp, D. melanogaster
tcagccaactcaaa

SEQ ID NO: 647017 - DNA, 13 bp, D. melanogaster
tcagccaagggtt

SEQ ID NO: 647018 - DNA, 13 bp, D. melanogaster
tcagccacgcccc

SEQ ID NO: 647019 - DNA, 14 bp, D. melanogaster
tcagccacgccccc

SEQ ID NO: 647020 - DNA, 13 bp, D. melanogaster
tcagccagccagc

SEQ ID NO: 647021 - DNA, 13 bp, D. melanogaster
tcagccagccagt

SEQ ID NO: 647022 - DNA, 14 bp, D. melanogaster
tcagccagccagtc

SEQ ID NO: 647023 - DNA, 13 bp, D. melanogaster
tcagccagcgaaa

SEQ ID NO: 647024 - DNA, 13 bp, D. melanogaster
tcagccatcatca

SEQ ID NO: 647025 - DNA, 13 bp, D. melanogaster
tcagcccacagtc

SEQ ID NO: 647026 - DNA, 14 bp, D. melanogaster
tcagcccacagtca

SEQ ID NO: 647027 - DNA, 13 bp, D. melanogaster
tcagcccggaaaa

SEQ ID NO: 647028 - DNA, 13 bp, D. melanogaster
tcagcctcatttt

SEQ ID NO: 647029 - DNA, 13 bp, D. melanogaster
tcagcctgcacag

SEQ ID NO: 647030 - DNA, 13 bp, D. melanogaster
tcagcgaaatgaa

SEQ ID NO: 647031 - DNA, 13 bp, D. melanogaster
tcagcgagaactt

SEQ ID NO: 647032 - DNA, 13 bp, D. melanogaster
tcagcgcaacaac

SEQ ID NO: 647033 - DNA, 13 bp, D. melanogaster
tcagcgcagcagt

SEQ ID NO: 647034 - DNA, 13 bp, D. melanogaster
tcagcgcggcagt

SEQ ID NO: 647035 - DNA, 13 bp, D. melanogaster
tcagcggatccca

SEQ ID NO: 647036 - DNA, 13 bp, D. melanogaster
tcagcggccagat

SEQ ID NO: 647037 - DNA, 13 bp, D. melanogaster
tcagcggcccaac

SEQ ID NO: 647038 - DNA, 13 bp, D. melanogaster
tcagcgtttgatt

SEQ ID NO: 647039 - DNA, 13 bp, D. melanogaster
tcagctaataaat

SEQ ID NO: 647040 - DNA, 14 bp, D. melanogaster
tcagctaataattt

SEQ ID NO: 647041 - DNA, 13 bp, D. melanogaster
tcagctaattaac

SEQ ID NO: 647042 - DNA, 13 bp, D. melanogaster
tcagctaccctga

SEQ ID NO: 647043 - DNA, 13 bp, D. melanogaster
tcagctagtgaaa

SEQ ID NO: 647044 - DNA, 13 bp, D. melanogaster
tcagctagtggaa

SEQ ID NO: 647045 - DNA, 13 bp, D. melanogaster
tcagctcaacatt

SEQ ID NO: 647046 - DNA, 13 bp, D. melanogaster
tcagctcaactca

SEQ ID NO: 647047 - DNA, 13 bp, D. melanogaster
tcagctcagctca

SEQ ID NO: 647048 - DNA, 13 bp, D. melanogaster
tcagctccagctc

SEQ ID NO: 647049 - DNA, 13 bp, D. melanogaster
tcagctcctgttc

SEQ ID NO: 647050 - DNA, 13 bp, D. melanogaster
tcagctctttgta

SEQ ID NO: 647051 - DNA, 13 bp, D. melanogaster
tcagctgatttgc

SEQ ID NO: 647052 - DNA, 13 bp, D. melanogaster
tcagctgcaaaaa

SEQ ID NO: 647053 - DNA, 13 bp, D. melanogaster
tcagctgcagttg

SEQ ID NO: 647054 - DNA, 13 bp, D. melanogaster
tcagctgcagttt

SEQ ID NO: 647055 - DNA, 13 bp, D. melanogaster
tcagctgcatttt

SEQ ID NO: 647056 - DNA, 13 bp, D. melanogaster
tcagctgctgctt

SEQ ID NO: 647057 - DNA, 13 bp, D. melanogaster
tcagctgcttttg

SEQ ID NO: 647058 - DNA, 13 bp, D. melanogaster
tcagctggcaaat

SEQ ID NO: 647059 - DNA, 13 bp, D. melanogaster
tcagctgggaaat

SEQ ID NO: 647060 - DNA, 13 bp, D. melanogaster
tcagctgttcaag

SEQ ID NO: 647061 - DNA, 13 bp, D. melanogaster
tcagctgttgttt

SEQ ID NO: 647062 - DNA, 13 bp, D. melanogaster
tcagctgtttttg

SEQ ID NO: 647063 - DNA, 13 bp, D. melanogaster
tcagctgtttttt

SEQ ID NO: 647064 - DNA, 13 bp, D. melanogaster
tcagcttaagact

SEQ ID NO: 647065 - DNA, 13 bp, D. melanogaster
tcagcttcagctg

SEQ ID NO: 647066 - DNA, 14 bp, D. melanogaster
tcagcttcagcttc

SEQ ID NO: 647067 - DNA, 13 bp, D. melanogaster
tcagcttcttcca

SEQ ID NO: 647068 - DNA, 14 bp, D. melanogaster
tcagctttatttat

SEQ ID NO: 647069 - DNA, 13 bp, D. melanogaster
tcagctttggcaa

SEQ ID NO: 647070 - DNA, 13 bp, D. melanogaster
tcaggaaacaaca

SEQ ID NO: 647071 - DNA, 13 bp, D. melanogaster
tcaggaaatattt

SEQ ID NO: 647072 - DNA, 13 bp, D. melanogaster
tcaggaaatcaaa

SEQ ID NO: 647073 - DNA, 13 bp, D. melanogaster
tcaggaatagggc

SEQ ID NO: 647074 - DNA, 13 bp, D. melanogaster
tcaggaatttcta

SEQ ID NO: 647075 - DNA, 14 bp, D. melanogaster
tcaggactcaggac

SEQ ID NO: 647076 - DNA, 13 bp, D. melanogaster
tcaggactctgag

SEQ ID NO: 647077 - DNA, 14 bp, D. melanogaster
tcaggactctgagg

SEQ ID NO: 647078 - DNA, 13 bp, D. melanogaster
tcaggactttaag

SEQ ID NO: 647079 - DNA, 13 bp, D. melanogaster
tcaggatattttg

SEQ ID NO: 647080 - DNA, 14 bp, D. melanogaster
tcaggatattttgg

SEQ ID NO: 647081 - DNA, 13 bp, D. melanogaster
tcaggatcactag

SEQ ID NO: 647082 - DNA, 13 bp, D. melanogaster
tcaggatttcttc

SEQ ID NO: 647083 - DNA, 13 bp, D. melanogaster
tcaggcaaatagt

SEQ ID NO: 647084 - DNA, 13 bp, D. melanogaster
tcaggcagtcagt

SEQ ID NO: 647085 - DNA, 13 bp, D. melanogaster
tcaggccaccttt

SEQ ID NO: 647086 - DNA, 14 bp, D. melanogaster
tcaggtggctgggc

SEQ ID NO: 647087 - DNA, 13 bp, D. melanogaster
tcaggttatctat

SEQ ID NO: 647088 - DNA, 14 bp, D. melanogaster
tcaggttttcatca

SEQ ID NO: 647089 - DNA, 13 bp, D. melanogaster
tcagtatatactt

SEQ ID NO: 647090 - DNA, 13 bp, D. melanogaster
tcagtatctgtat

SEQ ID NO: 647091 - DNA, 14 bp, D. melanogaster
tcagtattatttgg

SEQ ID NO: 647092 - DNA, 13 bp, D. melanogaster
tcagtattttctc

SEQ ID NO: 647093 - DNA, 14 bp, D. melanogaster
tcagtatttttgtt

SEQ ID NO: 647094 - DNA, 13 bp, D. melanogaster
tcagtatttttta

SEQ ID NO: 647095 - DNA, 13 bp, D. melanogaster
tcagtcaatcagt

SEQ ID NO: 647096 - DNA, 13 bp, D. melanogaster
tcagtcactcaat

SEQ ID NO: 647097 - DNA, 14 bp, D. melanogaster
tcagtcactcagtc

SEQ ID NO: 647098 - DNA, 13 bp, D. melanogaster
tcagtcagccagc

SEQ ID NO: 647099 - DNA, 13 bp, D. melanogaster
tcagtcagccagt

SEQ ID NO: 647100 - DNA, 13 bp, D. melanogaster
tcagtcagtcaac

SEQ ID NO: 647101 - DNA, 13 bp, D. melanogaster
tcagtcagtcaag

SEQ ID NO: 647102 - DNA, 13 bp, D. melanogaster
tcagtcagtcagt

SEQ ID NO: 647103 - DNA, 14 bp, D. melanogaster
tcagtcagtcagtt

SEQ ID NO: 647104 - DNA, 13 bp, D. melanogaster
tcagtcagttggt

SEQ ID NO: 647105 - DNA, 13 bp, D. melanogaster
tcagtcagttttc

SEQ ID NO: 647106 - DNA, 13 bp, D. melanogaster
tcagtccaaagga

SEQ ID NO: 647107 - DNA, 13 bp, D. melanogaster
tcagtccgaaagt

SEQ ID NO: 647108 - DNA, 13 bp, D. melanogaster
tcagtcgaatgct

SEQ ID NO: 647109 - DNA, 13 bp, D. melanogaster
tcagtcgctgttg

SEQ ID NO: 647110 - DNA, 13 bp, D. melanogaster
tcagtcggtgggc

SEQ ID NO: 647111 - DNA, 13 bp, D. melanogaster
tcagtcgtattct

SEQ ID NO: 647112 - DNA, 13 bp, D. melanogaster
tcagtctgaatgg

SEQ ID NO: 647113 - DNA, 13 bp, D. melanogaster
tcagtgatggaca

SEQ ID NO: 647114 - DNA, 13 bp, D. melanogaster
tcagtgctgctga

SEQ ID NO: 647115 - DNA, 13 bp, D. melanogaster
tcagtggccaaaa

SEQ ID NO: 647116 - DNA, 13 bp, D. melanogaster
tcagtggctcagt

SEQ ID NO: 647117 - DNA, 13 bp, D. melanogaster
tcagtgggtggtg

SEQ ID NO: 647118 - DNA, 14 bp, D. melanogaster
tcagtgggtggtgg

SEQ ID NO: 647119 - DNA, 13 bp, D. melanogaster
tcagtgggttaag

SEQ ID NO: 647120 - DNA, 13 bp, D. melanogaster
tcagtggtttccc

SEQ ID NO: 647121 - DNA, 13 bp, D. melanogaster
tcagtgtagtcca

SEQ ID NO: 647122 - DNA, 13 bp, D. melanogaster
tcagtgtgtgtgc

SEQ ID NO: 647123 - DNA, 13 bp, D. melanogaster
tcagtgtgtttgt

SEQ ID NO: 647124 - DNA, 13 bp, D. melanogaster
tcagtgttgcaaa

SEQ ID NO: 647125 - DNA, 13 bp, D. melanogaster
tcagttaaatatt

SEQ ID NO: 647126 - DNA, 13 bp, D. melanogaster
tcagttagtcagt

SEQ ID NO: 647127 - DNA, 13 bp, D. melanogaster
tcagttataattt

SEQ ID NO: 647128 - DNA, 13 bp, D. melanogaster
tcagttattcgca

SEQ ID NO: 647129 - DNA, 13 bp, D. melanogaster
tcagttattgtac

SEQ ID NO: 647130 - DNA, 13 bp, D. melanogaster
tcagttcagttcc

SEQ ID NO: 647131 - DNA, 13 bp, D. melanogaster
tcagttcagttct

SEQ ID NO: 647132 - DNA, 13 bp, D. melanogaster
tcagttcagtttc

SEQ ID NO: 647133 - DNA, 13 bp, D. melanogaster
tcagttcggttcg

SEQ ID NO: 647134 - DNA, 14 bp, D. melanogaster
tcagttctcagttc

SEQ ID NO: 647135 - DNA, 13 bp, D. melanogaster
tcagttgagttca

SEQ ID NO: 647136 - DNA, 13 bp, D. melanogaster
tcagttgcattga

SEQ ID NO: 647137 - DNA, 13 bp, D. melanogaster
tcagttgccaaaa

SEQ ID NO: 647138 - DNA, 13 bp, D. melanogaster
tcagttgccagtt

SEQ ID NO: 647139 - DNA, 13 bp, D. melanogaster
tcagttgccattt

SEQ ID NO: 647140 - DNA, 13 bp, D. melanogaster
tcagttgctgctg

SEQ ID NO: 647141 - DNA, 14 bp, D. melanogaster
tcagttggccaaaa

SEQ ID NO: 647142 - DNA, 13 bp, D. melanogaster
tcagttggccaag

SEQ ID NO: 647143 - DNA, 13 bp, D. melanogaster
tcagttggctttg

SEQ ID NO: 647144 - DNA, 13 bp, D. melanogaster
tcagttggctttt

SEQ ID NO: 647145 - DNA, 13 bp, D. melanogaster
tcagttggtcagt

SEQ ID NO: 647146 - DNA, 13 bp, D. melanogaster
tcagtttacatcg

SEQ ID NO: 647147 - DNA, 13 bp, D. melanogaster
tcagtttagttca

SEQ ID NO: 647148 - DNA, 13 bp, D. melanogaster
tcagtttagttta

SEQ ID NO: 647149 - DNA, 13 bp, D. melanogaster
tcagtttatttta

SEQ ID NO: 647150 - DNA, 13 bp, D. melanogaster
tcagtttcacttt

SEQ ID NO: 647151 - DNA, 14 bp, D. melanogaster
tcagtttcagattc

SEQ ID NO: 647152 - DNA, 13 bp, D. melanogaster
tcagtttcagttc

SEQ ID NO: 647153 - DNA, 13 bp, D. melanogaster
tcagtttcgattt

SEQ ID NO: 647154 - DNA, 13 bp, D. melanogaster
tcagtttctcagt

SEQ ID NO: 647155 - DNA, 14 bp, D. melanogaster
tcagtttctgtttc

SEQ ID NO: 647156 - DNA, 13 bp, D. melanogaster
tcagtttcttaca

SEQ ID NO: 647157 - DNA, 13 bp, D. melanogaster
tcagtttgatttt

SEQ ID NO: 647158 - DNA, 13 bp, D. melanogaster
tcagtttgcattt

SEQ ID NO: 647159 - DNA, 13 bp, D. melanogaster
tcagtttggtttg

SEQ ID NO: 647160 - DNA, 13 bp, D. melanogaster
tcagtttggtttt

SEQ ID NO: 647161 - DNA, 13 bp, D. melanogaster
tcagtttgtcagt

SEQ ID NO: 647162 - DNA, 13 bp, D. melanogaster
tcagtttgtttgt

SEQ ID NO: 647163 - DNA, 13 bp, D. melanogaster
tcagtttgttttc

SEQ ID NO: 647164 - DNA, 13 bp, D. melanogaster
tcagttttaaata

SEQ ID NO: 647165 - DNA, 13 bp, D. melanogaster
tcagttttaatta

SEQ ID NO: 647166 - DNA, 13 bp, D. melanogaster
tcagttttagttt

SEQ ID NO: 647167 - DNA, 14 bp, D. melanogaster
tcagttttattatt

SEQ ID NO: 647168 - DNA, 13 bp, D. melanogaster
tcagttttattgt

SEQ ID NO: 647169 - DNA, 14 bp, D. melanogaster
tcagttttcagttt

SEQ ID NO: 647170 - DNA, 14 bp, D. melanogaster
tcagttttcatttt

SEQ ID NO: 647171 - DNA, 13 bp, D. melanogaster
tcagttttccagc

SEQ ID NO: 647172 - DNA, 13 bp, D. melanogaster
tcagttttcggtt

SEQ ID NO: 647173 - DNA, 13 bp, D. melanogaster
tcagttttcgttt

SEQ ID NO: 647174 - DNA, 13 bp, D. melanogaster
tcagttttgagtt

SEQ ID NO: 647175 - DNA, 13 bp, D. melanogaster
tcagttttgtgtg

SEQ ID NO: 647176 - DNA, 13 bp, D. melanogaster
tcagttttgttta

SEQ ID NO: 647177 - DNA, 13 bp, D. melanogaster
tcagtttttaaaa

SEQ ID NO: 647178 - DNA, 14 bp, D. melanogaster
tcagtttttaaaag

SEQ ID NO: 647179 - DNA, 13 bp, D. melanogaster
tcagtttttagtt

SEQ ID NO: 647180 - DNA, 14 bp, D. melanogaster
tcagtttttcagtt

SEQ ID NO: 647181 - DNA, 14 bp, D. melanogaster
tcagtttttgcttc

SEQ ID NO: 647182 - DNA, 13 bp, D. melanogaster
tcagtttttggcc

SEQ ID NO: 647183 - DNA, 13 bp, D. melanogaster
tcagtttttggtt

SEQ ID NO: 647184 - DNA, 14 bp, D. melanogaster
tcagtttttggttt

SEQ ID NO: 647185 - DNA, 13 bp, D. melanogaster
tcataaaaactta

SEQ ID NO: 647186 - DNA, 13 bp, D. melanogaster
tcataaaaatagt

SEQ ID NO: 647187 - DNA, 14 bp, D. melanogaster
tcataaaaatagtg

SEQ ID NO: 647188 - DNA, 14 bp, D. melanogaster
tcataaaaatgaaa

SEQ ID NO: 647189 - DNA, 13 bp, D. melanogaster
tcataaaactcaa

SEQ ID NO: 647190 - DNA, 13 bp, D. melanogaster
tcataaaatcaat

SEQ ID NO: 647191 - DNA, 13 bp, D. melanogaster
tcataaacaattt

SEQ ID NO: 647192 - DNA, 13 bp, D. melanogaster
tcataaacatttt

SEQ ID NO: 647193 - DNA, 13 bp, D. melanogaster
tcataaactttta

SEQ ID NO: 647194 - DNA, 14 bp, D. melanogaster
tcataaagaaagaa

SEQ ID NO: 647195 - DNA, 13 bp, D. melanogaster
tcataaagaccaa

SEQ ID NO: 647196 - DNA, 13 bp, D. melanogaster
tcataaagtaaat

SEQ ID NO: 647197 - DNA, 13 bp, D. melanogaster
tcataaataagtt

SEQ ID NO: 647198 - DNA, 13 bp, D. melanogaster
tcataaataatgt

SEQ ID NO: 647199 - DNA, 13 bp, D. melanogaster
tcataaatagagt

SEQ ID NO: 647200 - DNA, 13 bp, D. melanogaster
tcataaatataca

SEQ ID NO: 647201 - DNA, 13 bp, D. melanogaster
tcataaatatgta

SEQ ID NO: 647202 - DNA, 13 bp, D. melanogaster
tcataaatatttc

SEQ ID NO: 647203 - DNA, 14 bp, D. melanogaster
tcataaatattttc

SEQ ID NO: 647204 - DNA, 13 bp, D. melanogaster
tcataaatcaaca

SEQ ID NO: 647205 - DNA, 13 bp, D. melanogaster
tcataaatgccaa

SEQ ID NO: 647206 - DNA, 13 bp, D. melanogaster
tcataaatgtttt

SEQ ID NO: 647207 - DNA, 13 bp, D. melanogaster
tcataaattatgc

SEQ ID NO: 647208 - DNA, 13 bp, D. melanogaster
tcataaattattc

SEQ ID NO: 647209 - DNA, 13 bp, D. melanogaster
tcataaattcata

SEQ ID NO: 647210 - DNA, 13 bp, D. melanogaster
tcataaattccat

SEQ ID NO: 647211 - DNA, 13 bp, D. melanogaster
tcataaattgcaa

SEQ ID NO: 647212 - DNA, 13 bp, D. melanogaster
tcataaatttcat

SEQ ID NO: 647213 - DNA, 13 bp, D. melanogaster
tcataaattttgt

SEQ ID NO: 647214 - DNA, 13 bp, D. melanogaster
tcataacaataac

SEQ ID NO: 647215 - DNA, 13 bp, D. melanogaster
tcataacaataat

SEQ ID NO: 647216 - DNA, 13 bp, D. melanogaster
tcataacttcaaa

SEQ ID NO: 647217 - DNA, 13 bp, D. melanogaster
tcataacttttta

SEQ ID NO: 647218 - DNA, 14 bp, D. melanogaster
tcataataaaactt

SEQ ID NO: 647219 - DNA, 13 bp, D. melanogaster
tcataataatttc

SEQ ID NO: 647220 - DNA, 13 bp, D. melanogaster
tcataatcatcat

SEQ ID NO: 647221 - DNA, 14 bp, D. melanogaster
tcataatcatcatc

SEQ ID NO: 647222 - DNA, 13 bp, D. melanogaster
tcataatcattat

SEQ ID NO: 647223 - DNA, 13 bp, D. melanogaster
tcataatcttcac

SEQ ID NO: 647224 - DNA, 13 bp, D. melanogaster
tcataatgaaaat

SEQ ID NO: 647225 - DNA, 13 bp, D. melanogaster
tcataatgatgat

SEQ ID NO: 647226 - DNA, 13 bp, D. melanogaster
tcataattgaatt

SEQ ID NO: 647227 - DNA, 13 bp, D. melanogaster
tcataatttatgc

SEQ ID NO: 647228 - DNA, 13 bp, D. melanogaster
tcataattttcaa

SEQ ID NO: 647229 - DNA, 14 bp, D. melanogaster
tcatacacacacac

SEQ ID NO: 647230 - DNA, 13 bp, D. melanogaster
tcatacatacata

SEQ ID NO: 647231 - DNA, 14 bp, D. melanogaster
tcatacatacatat

SEQ ID NO: 647232 - DNA, 14 bp, D. melanogaster
tcatacatatatat

SEQ ID NO: 647233 - DNA, 13 bp, D. melanogaster
tcatacatatgta

SEQ ID NO: 647234 - DNA, 13 bp, D. melanogaster
tcatacgacccgt

SEQ ID NO: 647235 - DNA, 13 bp, D. melanogaster
tcatacgcaacgt

SEQ ID NO: 647236 - DNA, 13 bp, D. melanogaster
tcatacgcactgt

SEQ ID NO: 647237 - DNA, 13 bp, D. melanogaster
tcatacgcagtgt

SEQ ID NO: 647238 - DNA, 13 bp, D. melanogaster
tcatactgaaata

SEQ ID NO: 647239 - DNA, 13 bp, D. melanogaster
tcatactgatttt

SEQ ID NO: 647240 - DNA, 14 bp, D. melanogaster
tcatagaactttaa

SEQ ID NO: 647241 - DNA, 13 bp, D. melanogaster
tcatataaaatgt

SEQ ID NO: 647242 - DNA, 13 bp, D. melanogaster
tcatatacatatt

SEQ ID NO: 647243 - DNA, 13 bp, D. melanogaster
tcatatagatgta

SEQ ID NO: 647244 - DNA, 13 bp, D. melanogaster
tcatatatataca

SEQ ID NO: 647245 - DNA, 13 bp, D. melanogaster
tcatatatatgta

SEQ ID NO: 647246 - DNA, 13 bp, D. melanogaster
tcatatcaaaatt

SEQ ID NO: 647247 - DNA, 13 bp, D. melanogaster
tcatatcaaggtg

SEQ ID NO: 647248 - DNA, 13 bp, D. melanogaster
tcatatcataaat

SEQ ID NO: 647249 - DNA, 13 bp, D. melanogaster
tcatatcgtttca

SEQ ID NO: 647250 - DNA, 43 bp, D. melanogaster
tcatatcttgaggcacgaagtgcggacacaagcactcaacaat

SEQ ID NO: 647251 - DNA, 13 bp, D. melanogaster
tcatatgcatatt

SEQ ID NO: 647252 - DNA, 13 bp, D. melanogaster
tcatatgcatttt

SEQ ID NO: 647253 - DNA, 13 bp, D. melanogaster
tcatatgtacata

SEQ ID NO: 647254 - DNA, 13 bp, D. melanogaster
tcatattcaaaaa

SEQ ID NO: 647255 - DNA, 13 bp, D. melanogaster
tcatattcaaata

SEQ ID NO: 647256 - DNA, 13 bp, D. melanogaster
tcatattcaaatt

SEQ ID NO: 647257 - DNA, 13 bp, D. melanogaster
tcatattcatata

SEQ ID NO: 647258 - DNA, 13 bp, D. melanogaster
tcatattcatatc

SEQ ID NO: 647259 - DNA, 13 bp, D. melanogaster
tcatattcatatt

SEQ ID NO: 647260 - DNA, 14 bp, D. melanogaster
tcatattcatattc

SEQ ID NO: 647261 - DNA, 13 bp, D. melanogaster
tcatattcattca

SEQ ID NO: 647262 - DNA, 13 bp, D. melanogaster
tcatattcttcaa

SEQ ID NO: 647263 - DNA, 13 bp, D. melanogaster
tcatattgtacac

SEQ ID NO: 647264 - DNA, 13 bp, D. melanogaster
tcatattgtattt

SEQ ID NO: 647265 - DNA, 13 bp, D. melanogaster
tcatatttagagt

SEQ ID NO: 647266 - DNA, 13 bp, D. melanogaster
tcatatttctgtg

SEQ ID NO: 647267 - DNA, 13 bp, D. melanogaster
tcatattttaaag

SEQ ID NO: 647268 - DNA, 13 bp, D. melanogaster
tcatattttccca

SEQ ID NO: 647269 - DNA, 13 bp, D. melanogaster
tcatattttgtat

SEQ ID NO: 647270 - DNA, 14 bp, D. melanogaster
tcatatttttatga

SEQ ID NO: 647271 - DNA, 13 bp, D. melanogaster
tcatatttttctg

SEQ ID NO: 647272 - DNA, 13 bp, D. melanogaster
tcatcaaaaatta

SEQ ID NO: 647273 - DNA, 13 bp, D. melanogaster
tcatcaaatagaa

SEQ ID NO: 647274 - DNA, 13 bp, D. melanogaster
tcatcaaatatgc

SEQ ID NO: 647275 - DNA, 13 bp, D. melanogaster
tcatcaaatcgaa

SEQ ID NO: 647276 - DNA, 13 bp, D. melanogaster
tcatcaacatcaa

SEQ ID NO: 647277 - DNA, 13 bp, D. melanogaster
tcatcaactctgg

SEQ ID NO: 647278 - DNA, 13 bp, D. melanogaster
tcatcaataaatt

SEQ ID NO: 647279 - DNA, 14 bp, D. melanogaster
tcatcaataaattt

SEQ ID NO: 647280 - DNA, 13 bp, D. melanogaster
tcatcaatattca

SEQ ID NO: 647281 - DNA, 13 bp, D. melanogaster
tcatcaatcaaaa

SEQ ID NO: 647282 - DNA, 13 bp, D. melanogaster
tcatcacaatcat

SEQ ID NO: 647283 - DNA, 13 bp, D. melanogaster
tcatcaccaccac

SEQ ID NO: 647284 - DNA, 14 bp, D. melanogaster
tcatcaccatcatc

SEQ ID NO: 647285 - DNA, 13 bp, D. melanogaster
tcatcaccggctg

SEQ ID NO: 647286 - DNA, 13 bp, D. melanogaster
tcatcagcataat

SEQ ID NO: 647287 - DNA, 14 bp, D. melanogaster
tcatcagcatcagc

SEQ ID NO: 647288 - DNA, 13 bp, D. melanogaster
tcatcagcatcat

SEQ ID NO: 647289 - DNA, 13 bp, D. melanogaster
tcatcagcgaacg

SEQ ID NO: 647290 - DNA, 13 bp, D. melanogaster
tcatcagtgtccc

SEQ ID NO: 647291 - DNA, 13 bp, D. melanogaster
tcatcatatcata

SEQ ID NO: 647292 - DNA, 13 bp, D. melanogaster
tcatcatcaacat

SEQ ID NO: 647293 - DNA, 14 bp, D. melanogaster
tcatcatcaacatc

SEQ ID NO: 647294 - DNA, 13 bp, D. melanogaster
tcatcatcaattt

SEQ ID NO: 647295 - DNA, 16 bp, D. melanogaster
tcatcatcaccatcat

SEQ ID NO: 647296 - DNA, 13 bp, D. melanogaster
tcatcatcagcgg

SEQ ID NO: 647297 - DNA, 13 bp, D. melanogaster
tcatcatcagctg

SEQ ID NO: 647298 - DNA, 13 bp, D. melanogaster
tcatcatcagtgg

SEQ ID NO: 647299 - DNA, 13 bp, D. melanogaster
tcatcatcagttg

SEQ ID NO: 647300 - DNA, 13 bp, D. melanogaster
tcatcatcataaa

SEQ ID NO: 647301 - DNA, 13 bp, D. melanogaster
tcatcatcatcaa

SEQ ID NO: 647302 - DNA, 14 bp, D. melanogaster
tcatcatcatcagg

SEQ ID NO: 647303 - DNA, 14 bp, D. melanogaster
tcatcatcatcagt

SEQ ID NO: 647304 - DNA, 14 bp, D. melanogaster
tcatcatcatcata

SEQ ID NO: 647305 - DNA, 16 bp, D. melanogaster
tcatcatcatcatcat

SEQ ID NO: 647306 - DNA, 15 bp, D. melanogaster
tcatcatcatcatcg

SEQ ID NO: 647307 - DNA, 15 bp, D. melanogaster
tcatcatcatcatga

SEQ ID NO: 647308 - DNA, 14 bp, D. melanogaster
tcatcatcatccga

SEQ ID NO: 647309 - DNA, 14 bp, D. melanogaster
tcatcatcatcgca

SEQ ID NO: 647310 - DNA, 14 bp, D. melanogaster
tcatcatcatcgtg

SEQ ID NO: 647311 - DNA, 13 bp, D. melanogaster
tcatcatcatgat

SEQ ID NO: 647312 - DNA, 13 bp, D. melanogaster
tcatcatcattaa

SEQ ID NO: 647313 - DNA, 13 bp, D. melanogaster
tcatcatcattgg

SEQ ID NO: 647314 - DNA, 13 bp, D. melanogaster
tcatcatcattgt

SEQ ID NO: 647315 - DNA, 13 bp, D. melanogaster
tcatcatcatttg

SEQ ID NO: 647316 - DNA, 14 bp, D. melanogaster
tcatcatcctcatc

SEQ ID NO: 647317 - DNA, 13 bp, D. melanogaster
tcatcatcgccag

SEQ ID NO: 647318 - DNA, 13 bp, D. melanogaster
tcatcatcgccat

SEQ ID NO: 647319 - DNA, 14 bp, D. melanogaster
tcatcatcgccatc

SEQ ID NO: 647320 - DNA, 14 bp, D. melanogaster
tcatcatcggcatc

SEQ ID NO: 647321 - DNA, 14 bp, D. melanogaster
tcatcatcgtcatc

SEQ ID NO: 647322 - DNA, 13 bp, D. melanogaster
tcatcatctccat

SEQ ID NO: 647323 - DNA, 13 bp, D. melanogaster
tcatcatctgcat

SEQ ID NO: 647324 - DNA, 14 bp, D. melanogaster
tcatcatcttccat

SEQ ID NO: 647325 - DNA, 13 bp, D. melanogaster
tcatcatctttta

SEQ ID NO: 647326 - DNA, 13 bp, D. melanogaster
tcatcatgatgat

SEQ ID NO: 647327 - DNA, 13 bp, D. melanogaster
tcatcattaattt

SEQ ID NO: 647328 - DNA, 13 bp, D. melanogaster
tcatcattaccat

SEQ ID NO: 647329 - DNA, 13 bp, D. melanogaster
tcatcattatcaa

SEQ ID NO: 647330 - DNA, 14 bp, D. melanogaster
tcatcattatcatc

SEQ ID NO: 647331 - DNA, 14 bp, D. melanogaster
tcatcattcccctt

SEQ ID NO: 647332 - DNA, 13 bp, D. melanogaster
tcatcattctcac

SEQ ID NO: 647333 - DNA, 13 bp, D. melanogaster
tcatcattgattg

SEQ ID NO: 647334 - DNA, 13 bp, D. melanogaster
tcatcatttgcat

SEQ ID NO: 647335 - DNA, 13 bp, D. melanogaster
tcatcatttgttt

SEQ ID NO: 647336 - DNA, 14 bp, D. melanogaster
tcatcatttttctg

SEQ ID NO: 647337 - DNA, 13 bp, D. melanogaster
tcatccaaaatat

SEQ ID NO: 647338 - DNA, 13 bp, D. melanogaster
tcatccaaatatc

SEQ ID NO: 647339 - DNA, 13 bp, D. melanogaster
tcatccagctgaa

SEQ ID NO: 647340 - DNA, 13 bp, D. melanogaster
tcatccagttcga

SEQ ID NO: 647341 - DNA, 13 bp, D. melanogaster
tcatccatccatc

SEQ ID NO: 647342 - DNA, 13 bp, D. melanogaster
tcatccatgtaaa

SEQ ID NO: 647343 - DNA, 13 bp, D. melanogaster
tcatccatgttgt

SEQ ID NO: 647344 - DNA, 13 bp, D. melanogaster
tcatcccaaacca

SEQ ID NO: 647345 - DNA, 13 bp, D. melanogaster
tcatcctcatcca

SEQ ID NO: 647346 - DNA, 13 bp, D. melanogaster
tcatcctcatccc

SEQ ID NO: 647347 - DNA, 13 bp, D. melanogaster
tcatcctcatcgt

SEQ ID NO: 647348 - DNA, 13 bp, D. melanogaster
tcatccttttttg

SEQ ID NO: 647349 - DNA, 13 bp, D. melanogaster
tcatcgacaacaa

SEQ ID NO: 647350 - DNA, 13 bp, D. melanogaster
tcatcgatttgac

SEQ ID NO: 647351 - DNA, 13 bp, D. melanogaster
tcatcgcagcggg

SEQ ID NO: 647352 - DNA, 13 bp, D. melanogaster
tcatcgcttctaa

SEQ ID NO: 647353 - DNA, 13 bp, D. melanogaster
tcatcggacactc

SEQ ID NO: 647354 - DNA, 13 bp, D. melanogaster
tcatcggcactta

SEQ ID NO: 647355 - DNA, 13 bp, D. melanogaster
tcatcggcatcat

SEQ ID NO: 647356 - DNA, 13 bp, D. melanogaster
tcatcgtcaccat

SEQ ID NO: 647357 - DNA, 14 bp, D. melanogaster
tcatcgtcactcta

SEQ ID NO: 647358 - DNA, 14 bp, D. melanogaster
tcatcgtcatcatc

SEQ ID NO: 647359 - DNA, 13 bp, D. melanogaster
tcatcgtcatcct

SEQ ID NO: 647360 - DNA, 13 bp, D. melanogaster
tcatcgtcattat

SEQ ID NO: 647361 - DNA, 13 bp, D. melanogaster
tcatcgtcgtcaa

SEQ ID NO: 647362 - DNA, 13 bp, D. melanogaster
tcatcgtcgtcat

SEQ ID NO: 647363 - DNA, 14 bp, D. melanogaster
tcatcgtcgtcatc

SEQ ID NO: 647364 - DNA, 13 bp, D. melanogaster
tcatcgtcgtcct

SEQ ID NO: 647365 - DNA, 13 bp, D. melanogaster
tcatcgtcttctt

SEQ ID NO: 647366 - DNA, 13 bp, D. melanogaster
tcatctatacagc

SEQ ID NO: 647367 - DNA, 13 bp, D. melanogaster
tcatctatctatc

SEQ ID NO: 647368 - DNA, 14 bp, D. melanogaster
tcatctattttgtc

SEQ ID NO: 647369 - DNA, 13 bp, D. melanogaster
tcatctccatctc

SEQ ID NO: 647370 - DNA, 13 bp, D. melanogaster
tcatctcgttcat

SEQ ID NO: 647371 - DNA, 14 bp, D. melanogaster
tcatctgcacgaat

SEQ ID NO: 647372 - DNA, 13 bp, D. melanogaster
tcatcttacagac

SEQ ID NO: 647373 - DNA, 13 bp, D. melanogaster
tcatcttcatcat

SEQ ID NO: 647374 - DNA, 14 bp, D. melanogaster
tcatcttcatcatc

SEQ ID NO: 647375 - DNA, 13 bp, D. melanogaster
tcatcttcatcca

SEQ ID NO: 647376 - DNA, 13 bp, D. melanogaster
tcatcttccttta

SEQ ID NO: 647377 - DNA, 13 bp, D. melanogaster
tcatcttcgttta

SEQ ID NO: 647378 - DNA, 14 bp, D. melanogaster
tcatgaaaaaccaa

SEQ ID NO: 647379 - DNA, 14 bp, D. melanogaster
tcatgaaaaggctt

SEQ ID NO: 647380 - DNA, 13 bp, D. melanogaster
tcatgaatattgt

SEQ ID NO: 647381 - DNA, 13 bp, D. melanogaster
tcatgaatttcat

SEQ ID NO: 647382 - DNA, 14 bp, D. melanogaster
tcatgaatttcatt

SEQ ID NO: 647383 - DNA, 13 bp, D. melanogaster
tcatgacgatcgt

SEQ ID NO: 647384 - DNA, 13 bp, D. melanogaster
tcatgacgttcat

SEQ ID NO: 647385 - DNA, 13 bp, D. melanogaster
tcatgagcaaact

SEQ ID NO: 647386 - DNA, 13 bp, D. melanogaster
tcatgagggtggt

SEQ ID NO: 647387 - DNA, 13 bp, D. melanogaster
tcatgatcatgat

SEQ ID NO: 647388 - DNA, 13 bp, D. melanogaster
tcatgatcgacaa

SEQ ID NO: 647389 - DNA, 13 bp, D. melanogaster
tcatgatttttgg

SEQ ID NO: 647390 - DNA, 13 bp, D. melanogaster
tcatgcaaaatac

SEQ ID NO: 647391 - DNA, 13 bp, D. melanogaster
tcatggaattctt

SEQ ID NO: 647392 - DNA, 13 bp, D. melanogaster
tcatggccaaaaa

SEQ ID NO: 647393 - DNA, 13 bp, D. melanogaster
tcatgtggagttc

SEQ ID NO: 647394 - DNA, 13 bp, D. melanogaster
tcatgttaagtca

SEQ ID NO: 647395 - DNA, 13 bp, D. melanogaster
tcatgttcatgtt

SEQ ID NO: 647396 - DNA, 13 bp, D. melanogaster
tcatgttgctgct

SEQ ID NO: 647397 - DNA, 13 bp, D. melanogaster
tcatgtttttcat

SEQ ID NO: 647398 - DNA, 13 bp, D. melanogaster
tcattaaaaactg

SEQ ID NO: 647399 - DNA, 13 bp, D. melanogaster
tcattaaaaatgc

SEQ ID NO: 647400 - DNA, 13 bp, D. melanogaster
tcattaaaaatgt

SEQ ID NO: 647401 - DNA, 13 bp, D. melanogaster
tcattaaaatcat

SEQ ID NO: 647402 - DNA, 13 bp, D. melanogaster
tcattaaaatgca

SEQ ID NO: 647403 - DNA, 13 bp, D. melanogaster
tcattaaaatgtt

SEQ ID NO: 647404 - DNA, 13 bp, D. melanogaster
tcattaaaattca

SEQ ID NO: 647405 - DNA, 14 bp, D. melanogaster
tcattaaaattcaa

SEQ ID NO: 647406 - DNA, 13 bp, D. melanogaster
tcattaaacaaat

SEQ ID NO: 647407 - DNA, 13 bp, D. melanogaster
tcattaaagctaa

SEQ ID NO: 647408 - DNA, 13 bp, D. melanogaster
tcattaaatgcaa

SEQ ID NO: 647409 - DNA, 13 bp, D. melanogaster
tcattaaatgttt

SEQ ID NO: 647410 - DNA, 13 bp, D. melanogaster
tcattaaatttga

SEQ ID NO: 647411 - DNA, 13 bp, D. melanogaster
tcattaacaaata

SEQ ID NO: 647412 - DNA, 13 bp, D. melanogaster
tcattaacatttc

SEQ ID NO: 647413 - DNA, 13 bp, D. melanogaster
tcattaacatttg

SEQ ID NO: 647414 - DNA, 13 bp, D. melanogaster
tcattaactttta

SEQ ID NO: 647415 - DNA, 13 bp, D. melanogaster
tcattaagaatga

SEQ ID NO: 647416 - DNA, 13 bp, D. melanogaster
tcattaagacaaa

SEQ ID NO: 647417 - DNA, 13 bp, D. melanogaster
tcattaagcattt

SEQ ID NO: 647418 - DNA, 13 bp, D. melanogaster
tcattaaggcaat

SEQ ID NO: 647419 - DNA, 13 bp, D. melanogaster
tcattaagtaaat

SEQ ID NO: 647420 - DNA, 13 bp, D. melanogaster
tcattaagtgcag

SEQ ID NO: 647421 - DNA, 17 bp, D. melanogaster
tcattaagtgcagaccg

SEQ ID NO: 647422 - DNA, 13 bp, D. melanogaster
tcattaagttgat

SEQ ID NO: 647423 - DNA, 13 bp, D. melanogaster
tcattaatgtcaa

SEQ ID NO: 647424 - DNA, 13 bp, D. melanogaster
tcattaattaaac

SEQ ID NO: 647425 - DNA, 13 bp, D. melanogaster
tcattaattctgt

SEQ ID NO: 647426 - DNA, 13 bp, D. melanogaster
tcattaatttcaa

SEQ ID NO: 647427 - DNA, 13 bp, D. melanogaster
tcattaatttcat

SEQ ID NO: 647428 - DNA, 13 bp, D. melanogaster
tcattaatttggc

SEQ ID NO: 647429 - DNA, 13 bp, D. melanogaster
tcattacacacac

SEQ ID NO: 647430 - DNA, 13 bp, D. melanogaster
tcattacataaat

SEQ ID NO: 647431 - DNA, 13 bp, D. melanogaster
tcattaccatttt

SEQ ID NO: 647432 - DNA, 13 bp, D. melanogaster
tcattactattgg

SEQ ID NO: 647433 - DNA, 13 bp, D. melanogaster
tcattacttataa

SEQ ID NO: 647434 - DNA, 13 bp, D. melanogaster
tcattagcatttc

SEQ ID NO: 647435 - DNA, 13 bp, D. melanogaster
tcattagcatttt

SEQ ID NO: 647436 - DNA, 13 bp, D. melanogaster
tcattaggtattt

SEQ ID NO: 647437 - DNA, 13 bp, D. melanogaster
tcattagtattaa

SEQ ID NO: 647438 - DNA, 13 bp, D. melanogaster
tcattatattttg

SEQ ID NO: 647439 - DNA, 13 bp, D. melanogaster
tcattatcataat

SEQ ID NO: 647440 - DNA, 13 bp, D. melanogaster
tcattatcatcaa

SEQ ID NO: 647441 - DNA, 13 bp, D. melanogaster
tcattatcatctt

SEQ ID NO: 647442 - DNA, 13 bp, D. melanogaster
tcattatcattat

SEQ ID NO: 647443 - DNA, 13 bp, D. melanogaster
tcattatcgtcat

SEQ ID NO: 647444 - DNA, 13 bp, D. melanogaster
tcattatgattat

SEQ ID NO: 647445 - DNA, 13 bp, D. melanogaster
tcattatgctcat

SEQ ID NO: 647446 - DNA, 13 bp, D. melanogaster
tcattattaatct

SEQ ID NO: 647447 - DNA, 13 bp, D. melanogaster
tcattattattga

SEQ ID NO: 647448 - DNA, 13 bp, D. melanogaster
tcattattgaaat

SEQ ID NO: 647449 - DNA, 13 bp, D. melanogaster
tcattattgtttc

SEQ ID NO: 647450 - DNA, 14 bp, D. melanogaster
tcattatttatatg

SEQ ID NO: 647451 - DNA, 13 bp, D. melanogaster
tcattatttcaga

SEQ ID NO: 647452 - DNA, 13 bp, D. melanogaster
tcattcaaaaagt

SEQ ID NO: 647453 - DNA, 14 bp, D. melanogaster
tcattcaaaaagtg

SEQ ID NO: 647454 - DNA, 13 bp, D. melanogaster
tcattcaaaagtt

SEQ ID NO: 647455 - DNA, 13 bp, D. melanogaster
tcattcaaaattc

SEQ ID NO: 647456 - DNA, 13 bp, D. melanogaster
tcattcaaattca

SEQ ID NO: 647457 - DNA, 13 bp, D. melanogaster
tcattcaacattt

SEQ ID NO: 647458 - DNA, 13 bp, D. melanogaster
tcattcaacttga

SEQ ID NO: 647459 - DNA, 13 bp, D. melanogaster
tcattcaataaaa

SEQ ID NO: 647460 - DNA, 13 bp, D. melanogaster
tcattcaatcatt

SEQ ID NO: 647461 - DNA, 13 bp, D. melanogaster
tcattcaattcaa

SEQ ID NO: 647462 - DNA, 13 bp, D. melanogaster
tcattcaattcat

SEQ ID NO: 647463 - DNA, 13 bp, D. melanogaster
tcattcaattgtt

SEQ ID NO: 647464 - DNA, 13 bp, D. melanogaster
tcattcaatttgg

SEQ ID NO: 647465 - DNA, 13 bp, D. melanogaster
tcattcacacaca

SEQ ID NO: 647466 - DNA, 13 bp, D. melanogaster
tcattcagaacta

SEQ ID NO: 647467 - DNA, 14 bp, D. melanogaster
tcattcagattcac

SEQ ID NO: 647468 - DNA, 13 bp, D. melanogaster
tcattcagttttt

SEQ ID NO: 647469 - DNA, 13 bp, D. melanogaster
tcattcataatta

SEQ ID NO: 647470 - DNA, 13 bp, D. melanogaster
tcattcataattg

SEQ ID NO: 647471 - DNA, 13 bp, D. melanogaster
tcattcatattca

SEQ ID NO: 647472 - DNA, 14 bp, D. melanogaster
tcattcatattcat

SEQ ID NO: 647473 - DNA, 13 bp, D. melanogaster
tcattcatattta

SEQ ID NO: 647474 - DNA, 13 bp, D. melanogaster
tcattcatgaaaa

SEQ ID NO: 647475 - DNA, 13 bp, D. melanogaster
tcattcattaatt

SEQ ID NO: 647476 - DNA, 14 bp, D. melanogaster
tcattcattcactc

SEQ ID NO: 647477 - DNA, 13 bp, D. melanogaster
tcattcattcatc

SEQ ID NO: 647478 - DNA, 13 bp, D. melanogaster
tcattcattcatt

SEQ ID NO: 647479 - DNA, 14 bp, D. melanogaster
tcattcattcattg

SEQ ID NO: 647480 - DNA, 13 bp, D. melanogaster
tcattcattcgtt

SEQ ID NO: 647481 - DNA, 13 bp, D. melanogaster
tcattcatttaaa

SEQ ID NO: 647482 - DNA, 13 bp, D. melanogaster
tcattcatttatg

SEQ ID NO: 647483 - DNA, 13 bp, D. melanogaster
tcattcattttgc

SEQ ID NO: 647484 - DNA, 13 bp, D. melanogaster
tcattcattttgt

SEQ ID NO: 647485 - DNA, 13 bp, D. melanogaster
tcattccatcaat

SEQ ID NO: 647486 - DNA, 13 bp, D. melanogaster
tcattcccattcc

SEQ ID NO: 647487 - DNA, 13 bp, D. melanogaster
tcattcgaataaa

SEQ ID NO: 647488 - DNA, 13 bp, D. melanogaster
tcattcgattttc

SEQ ID NO: 647489 - DNA, 13 bp, D. melanogaster
tcattcgctgaat

SEQ ID NO: 647490 - DNA, 13 bp, D. melanogaster
tcattcgggaact

SEQ ID NO: 647491 - DNA, 14 bp, D. melanogaster
tcattgaaaaaaga

SEQ ID NO: 647492 - DNA, 13 bp, D. melanogaster
tcattgaaaaatt

SEQ ID NO: 647493 - DNA, 13 bp, D. melanogaster
tcattgaaaacaa

SEQ ID NO: 647494 - DNA, 13 bp, D. melanogaster
tcattgaaaataa

SEQ ID NO: 647495 - DNA, 13 bp, D. melanogaster
tcattgaaaatgt

SEQ ID NO: 647496 - DNA, 14 bp, D. melanogaster
tcattgaaattggc

SEQ ID NO: 647497 - DNA, 14 bp, D. melanogaster
tcattgaatccatt

SEQ ID NO: 647498 - DNA, 13 bp, D. melanogaster
tcattgaatctgg

SEQ ID NO: 647499 - DNA, 13 bp, D. melanogaster
tcattgactttta

SEQ ID NO: 647500 - DNA, 13 bp, D. melanogaster
tcattgataaata

SEQ ID NO: 647501 - DNA, 13 bp, D. melanogaster
tcattgattattt

SEQ ID NO: 647502 - DNA, 13 bp, D. melanogaster
tcattgattcatt

SEQ ID NO: 647503 - DNA, 13 bp, D. melanogaster
tcattgcagcagg

SEQ ID NO: 647504 - DNA, 13 bp, D. melanogaster
tcattgccagtga

SEQ ID NO: 647505 - DNA, 13 bp, D. melanogaster
tcattgccattga

SEQ ID NO: 647506 - DNA, 13 bp, D. melanogaster
tcattgccattgc

SEQ ID NO: 647507 - DNA, 13 bp, D. melanogaster
tcattgccttatt

SEQ ID NO: 647508 - DNA, 13 bp, D. melanogaster
tcattgcctttgc

SEQ ID NO: 647509 - DNA, 14 bp, D. melanogaster
tcattgctaatcat

SEQ ID NO: 647510 - DNA, 13 bp, D. melanogaster
tcattggattttc

SEQ ID NO: 647511 - DNA, 13 bp, D. melanogaster
tcattggcatttg

SEQ ID NO: 647512 - DNA, 13 bp, D. melanogaster
tcattggttttgc

SEQ ID NO: 647513 - DNA, 13 bp, D. melanogaster
tcattgtaattaa

SEQ ID NO: 647514 - DNA, 13 bp, D. melanogaster
tcattgtcaacaa

SEQ ID NO: 647515 - DNA, 13 bp, D. melanogaster
tcattgtcatcat

SEQ ID NO: 647516 - DNA, 13 bp, D. melanogaster
tcattgtcattat

SEQ ID NO: 647517 - DNA, 13 bp, D. melanogaster
tcattgtgatatt

SEQ ID NO: 647518 - DNA, 13 bp, D. melanogaster
tcattgtgtaatt

SEQ ID NO: 647519 - DNA, 13 bp, D. melanogaster
tcattgttgattt

SEQ ID NO: 647520 - DNA, 13 bp, D. melanogaster
tcattgttggcca

SEQ ID NO: 647521 - DNA, 13 bp, D. melanogaster
tcattgttgttgc

SEQ ID NO: 647522 - DNA, 13 bp, D. melanogaster
tcattgtttgtct

SEQ ID NO: 647523 - DNA, 13 bp, D. melanogaster
tcatttaaaaatg

SEQ ID NO: 647524 - DNA, 14 bp, D. melanogaster
tcatttaaaagtat

SEQ ID NO: 647525 - DNA, 13 bp, D. melanogaster
tcatttaaacatt

SEQ ID NO: 647526 - DNA, 13 bp, D. melanogaster
tcatttaaattgc

SEQ ID NO: 647527 - DNA, 13 bp, D. melanogaster
tcatttaacaaat

SEQ ID NO: 647528 - DNA, 13 bp, D. melanogaster
tcatttaatgttt

SEQ ID NO: 647529 - DNA, 13 bp, D. melanogaster
tcatttaattcat

SEQ ID NO: 647530 - DNA, 13 bp, D. melanogaster
tcatttaattgct

SEQ ID NO: 647531 - DNA, 13 bp, D. melanogaster
tcatttaatttca

SEQ ID NO: 647532 - DNA, 13 bp, D. melanogaster
tcatttaatttcg

SEQ ID NO: 647533 - DNA, 14 bp, D. melanogaster
tcatttaatttgat

SEQ ID NO: 647534 - DNA, 13 bp, D. melanogaster
tcatttaatttgt

SEQ ID NO: 647535 - DNA, 13 bp, D. melanogaster
tcatttacaaaag

SEQ ID NO: 647536 - DNA, 13 bp, D. melanogaster
tcatttacataag

SEQ ID NO: 647537 - DNA, 14 bp, D. melanogaster
tcatttacatacat

SEQ ID NO: 647538 - DNA, 13 bp, D. melanogaster
tcatttacgaaaa

SEQ ID NO: 647539 - DNA, 13 bp, D. melanogaster
tcatttactttgt

SEQ ID NO: 647540 - DNA, 13 bp, D. melanogaster
tcatttagttttc

SEQ ID NO: 647541 - DNA, 13 bp, D. melanogaster
tcatttagttttg

SEQ ID NO: 647542 - DNA, 13 bp, D. melanogaster
tcatttataattc

SEQ ID NO: 647543 - DNA, 13 bp, D. melanogaster
tcatttatcaatt

SEQ ID NO: 647544 - DNA, 13 bp, D. melanogaster
tcatttatcacaa

SEQ ID NO: 647545 - DNA, 13 bp, D. melanogaster
tcatttatgaaaa

SEQ ID NO: 647546 - DNA, 13 bp, D. melanogaster
tcatttattaaag

SEQ ID NO: 647547 - DNA, 13 bp, D. melanogaster
tcatttattgtat

SEQ ID NO: 647548 - DNA, 13 bp, D. melanogaster
tcatttatttaca

SEQ ID NO: 647549 - DNA, 13 bp, D. melanogaster
tcatttatttatg

SEQ ID NO: 647550 - DNA, 13 bp, D. melanogaster
tcatttattttcg

SEQ ID NO: 647551 - DNA, 13 bp, D. melanogaster
tcatttcaaaaac

SEQ ID NO: 647552 - DNA, 13 bp, D. melanogaster
tcatttcaaaatt

SEQ ID NO: 647553 - DNA, 13 bp, D. melanogaster
tcatttcaaacca

SEQ ID NO: 647554 - DNA, 13 bp, D. melanogaster
tcatttcaaagtt

SEQ ID NO: 647555 - DNA, 13 bp, D. melanogaster
tcatttcaaatat

SEQ ID NO: 647556 - DNA, 13 bp, D. melanogaster
tcatttcaaatgc

SEQ ID NO: 647557 - DNA, 13 bp, D. melanogaster
tcatttcaaatgt

SEQ ID NO: 647558 - DNA, 13 bp, D. melanogaster
tcatttcaaatta

SEQ ID NO: 647559 - DNA, 13 bp, D. melanogaster
tcatttcaattgc

SEQ ID NO: 647560 - DNA, 13 bp, D. melanogaster
tcatttcataatt

SEQ ID NO: 647561 - DNA, 13 bp, D. melanogaster
tcatttcatttag

SEQ ID NO: 647562 - DNA, 14 bp, D. melanogaster
tcatttcatttcac

SEQ ID NO: 647563 - DNA, 14 bp, D. melanogaster
tcatttcatttttg

SEQ ID NO: 647564 - DNA, 13 bp, D. melanogaster
tcatttccattcc

SEQ ID NO: 647565 - DNA, 13 bp, D. melanogaster
tcatttcccaatt

SEQ ID NO: 647566 - DNA, 13 bp, D. melanogaster
tcatttccgctgc

SEQ ID NO: 647567 - DNA, 13 bp, D. melanogaster
tcatttccgtttt

SEQ ID NO: 647568 - DNA, 13 bp, D. melanogaster
tcatttcgatttt

SEQ ID NO: 647569 - DNA, 13 bp, D. melanogaster
tcatttcgctttt

SEQ ID NO: 647570 - DNA, 13 bp, D. melanogaster
tcatttcgtatgc

SEQ ID NO: 647571 - DNA, 13 bp, D. melanogaster
tcatttcgtttgt

SEQ ID NO: 647572 - DNA, 13 bp, D. melanogaster
tcatttctatctg

SEQ ID NO: 647573 - DNA, 13 bp, D. melanogaster
tcatttctgctca

SEQ ID NO: 647574 - DNA, 13 bp, D. melanogaster
tcatttgaaaaat

SEQ ID NO: 647575 - DNA, 13 bp, D. melanogaster
tcatttgaaaagc

SEQ ID NO: 647576 - DNA, 13 bp, D. melanogaster
tcatttgaattat

SEQ ID NO: 647577 - DNA, 13 bp, D. melanogaster
tcatttgaattta

SEQ ID NO: 647578 - DNA, 13 bp, D. melanogaster
tcatttgacaagt

SEQ ID NO: 647579 - DNA, 14 bp, D. melanogaster
tcatttgacatttt

SEQ ID NO: 647580 - DNA, 13 bp, D. melanogaster
tcatttgatattt

SEQ ID NO: 647581 - DNA, 13 bp, D. melanogaster
tcatttgatttgt

SEQ ID NO: 647582 - DNA, 13 bp, D. melanogaster
tcatttgcaattc

SEQ ID NO: 647583 - DNA, 13 bp, D. melanogaster
tcatttgcagcaa

SEQ ID NO: 647584 - DNA, 13 bp, D. melanogaster
tcatttgcagctc

SEQ ID NO: 647585 - DNA, 13 bp, D. melanogaster
tcatttgcataaa

SEQ ID NO: 647586 - DNA, 13 bp, D. melanogaster
tcatttgcataga

SEQ ID NO: 647587 - DNA, 13 bp, D. melanogaster
tcatttgcatctg

SEQ ID NO: 647588 - DNA, 13 bp, D. melanogaster
tcatttgcatgca

SEQ ID NO: 647589 - DNA, 13 bp, D. melanogaster
tcatttgcatgcc

SEQ ID NO: 647590 - DNA, 13 bp, D. melanogaster
tcatttgcatgtg

SEQ ID NO: 647591 - DNA, 13 bp, D. melanogaster
tcatttgcatgtt

SEQ ID NO: 647592 - DNA, 13 bp, D. melanogaster
tcatttgcattta

SEQ ID NO: 647593 - DNA, 14 bp, D. melanogaster
tcatttgcattttt

SEQ ID NO: 647594 - DNA, 13 bp, D. melanogaster
tcatttgccaaaa

SEQ ID NO: 647595 - DNA, 13 bp, D. melanogaster
tcatttgccaaat

SEQ ID NO: 647596 - DNA, 13 bp, D. melanogaster
tcatttgccattc

SEQ ID NO: 647597 - DNA, 13 bp, D. melanogaster
tcatttgccattt

SEQ ID NO: 647598 - DNA, 13 bp, D. melanogaster
tcatttgcctaat

SEQ ID NO: 647599 - DNA, 13 bp, D. melanogaster
tcatttgctcaat

SEQ ID NO: 647600 - DNA, 13 bp, D. melanogaster
tcatttgctcatt

SEQ ID NO: 647601 - DNA, 13 bp, D. melanogaster
tcatttgcttgtt

SEQ ID NO: 647602 - DNA, 13 bp, D. melanogaster
tcatttgctttat

SEQ ID NO: 647603 - DNA, 13 bp, D. melanogaster
tcatttgctttgt

SEQ ID NO: 647604 - DNA, 13 bp, D. melanogaster
tcatttggaaaaa

SEQ ID NO: 647605 - DNA, 13 bp, D. melanogaster
tcatttggccaaa

SEQ ID NO: 647606 - DNA, 14 bp, D. melanogaster
tcatttggccattt

SEQ ID NO: 647607 - DNA, 13 bp, D. melanogaster
tcatttggcttat

SEQ ID NO: 647608 - DNA, 14 bp, D. melanogaster
tcatttgggatttt

SEQ ID NO: 647609 - DNA, 13 bp, D. melanogaster
tcatttgggccaa

SEQ ID NO: 647610 - DNA, 13 bp, D. melanogaster
tcatttggtactt

SEQ ID NO: 647611 - DNA, 13 bp, D. melanogaster
tcatttggttttc

SEQ ID NO: 647612 - DNA, 13 bp, D. melanogaster
tcatttgtaattt

SEQ ID NO: 647613 - DNA, 13 bp, D. melanogaster
tcatttgtatata

SEQ ID NO: 647614 - DNA, 14 bp, D. melanogaster
tcatttgtatgtaa

SEQ ID NO: 647615 - DNA, 13 bp, D. melanogaster
tcatttgtcaatt

SEQ ID NO: 647616 - DNA, 13 bp, D. melanogaster
tcatttgtggcca

SEQ ID NO: 647617 - DNA, 13 bp, D. melanogaster
tcatttgtgtttg

SEQ ID NO: 647618 - DNA, 13 bp, D. melanogaster
tcatttgttgctg

SEQ ID NO: 647619 - DNA, 13 bp, D. melanogaster
tcatttgttggaa

SEQ ID NO: 647620 - DNA, 13 bp, D. melanogaster
tcatttgttgttg

SEQ ID NO: 647621 - DNA, 13 bp, D. melanogaster
tcatttgtttaat

SEQ ID NO: 647622 - DNA, 13 bp, D. melanogaster
tcatttgtttgcc

SEQ ID NO: 647623 - DNA, 13 bp, D. melanogaster
tcatttgtttggc

SEQ ID NO: 647624 - DNA, 13 bp, D. melanogaster
tcattttaagtgc

SEQ ID NO: 647625 - DNA, 13 bp, D. melanogaster
tcattttaatttg

SEQ ID NO: 647626 - DNA, 13 bp, D. melanogaster
tcattttagaaaa

SEQ ID NO: 647627 - DNA, 13 bp, D. melanogaster
tcattttattccc

SEQ ID NO: 647628 - DNA, 13 bp, D. melanogaster
tcattttattcgc

SEQ ID NO: 647629 - DNA, 13 bp, D. melanogaster
tcattttatttga

SEQ ID NO: 647630 - DNA, 13 bp, D. melanogaster
tcattttcaaatt

SEQ ID NO: 647631 - DNA, 14 bp, D. melanogaster
tcattttcaacagc

SEQ ID NO: 647632 - DNA, 13 bp, D. melanogaster
tcattttcaatga

SEQ ID NO: 647633 - DNA, 13 bp, D. melanogaster
tcattttcagaaa

SEQ ID NO: 647634 - DNA, 13 bp, D. melanogaster
tcattttcagctt

SEQ ID NO: 647635 - DNA, 13 bp, D. melanogaster
tcattttcagtta

SEQ ID NO: 647636 - DNA, 13 bp, D. melanogaster
tcattttcagttt

SEQ ID NO: 647637 - DNA, 13 bp, D. melanogaster
tcattttcatcta

SEQ ID NO: 647638 - DNA, 13 bp, D. melanogaster
tcattttccagct

SEQ ID NO: 647639 - DNA, 13 bp, D. melanogaster
tcattttcctgct

SEQ ID NO: 647640 - DNA, 13 bp, D. melanogaster
tcattttcgcatt

SEQ ID NO: 647641 - DNA, 13 bp, D. melanogaster
tcattttcttggc

SEQ ID NO: 647642 - DNA, 13 bp, D. melanogaster
tcattttgaaaat

SEQ ID NO: 647643 - DNA, 13 bp, D. melanogaster
tcattttgaataa

SEQ ID NO: 647644 - DNA, 14 bp, D. melanogaster
tcattttgatcttt

SEQ ID NO: 647645 - DNA, 13 bp, D. melanogaster
tcattttgcaatt

SEQ ID NO: 647646 - DNA, 13 bp, D. melanogaster
tcattttgcattt

SEQ ID NO: 647647 - DNA, 13 bp, D. melanogaster
tcattttgcgttt

SEQ ID NO: 647648 - DNA, 13 bp, D. melanogaster
tcattttgctaat

SEQ ID NO: 647649 - DNA, 13 bp, D. melanogaster
tcattttggaatt

SEQ ID NO: 647650 - DNA, 13 bp, D. melanogaster
tcattttggcatt

SEQ ID NO: 647651 - DNA, 13 bp, D. melanogaster
tcattttggccat

SEQ ID NO: 647652 - DNA, 13 bp, D. melanogaster
tcattttgtcatt

SEQ ID NO: 647653 - DNA, 14 bp, D. melanogaster
tcattttgttgttg

SEQ ID NO: 647654 - DNA, 13 bp, D. melanogaster
tcattttgtttcc

SEQ ID NO: 647655 - DNA, 14 bp, D. melanogaster
tcattttgttttca

SEQ ID NO: 647656 - DNA, 13 bp, D. melanogaster
tcatttttaaaga

SEQ ID NO: 647657 - DNA, 13 bp, D. melanogaster
tcatttttaagtt

SEQ ID NO: 647658 - DNA, 13 bp, D. melanogaster
tcatttttagcca

SEQ ID NO: 647659 - DNA, 13 bp, D. melanogaster
tcatttttataca

SEQ ID NO: 647660 - DNA, 13 bp, D. melanogaster
tcatttttcaaaa

SEQ ID NO: 647661 - DNA, 14 bp, D. melanogaster
tcatttttcaccaa

SEQ ID NO: 647662 - DNA, 13 bp, D. melanogaster
tcatttttcgcat

SEQ ID NO: 647663 - DNA, 13 bp, D. melanogaster
tcatttttctcag

SEQ ID NO: 647664 - DNA, 13 bp, D. melanogaster
tcatttttctgct

SEQ ID NO: 647665 - DNA, 14 bp, D. melanogaster
tcatttttgagaac

SEQ ID NO: 647666 - DNA, 14 bp, D. melanogaster
tcatttttgcatat

SEQ ID NO: 647667 - DNA, 13 bp, D. melanogaster
tcatttttggcca

SEQ ID NO: 647668 - DNA, 13 bp, D. melanogaster
tcatttttgggat

SEQ ID NO: 647669 - DNA, 13 bp, D. melanogaster
tcatttttgtcta

SEQ ID NO: 647670 - DNA, 13 bp, D. melanogaster
tcattttttggat

SEQ ID NO: 647671 - DNA, 13 bp, D. melanogaster
tccaaaaaatgat

SEQ ID NO: 647672 - DNA, 13 bp, D. melanogaster
tccaaaaaccatt

SEQ ID NO: 647673 - DNA, 13 bp, D. melanogaster
tccaaaaatagtt

SEQ ID NO: 647674 - DNA, 13 bp, D. melanogaster
tccaaaaatgaaa

SEQ ID NO: 647675 - DNA, 13 bp, D. melanogaster
tccaaaaatggat

SEQ ID NO: 647676 - DNA, 14 bp, D. melanogaster
tccaaaaatggatt

SEQ ID NO: 647677 - DNA, 13 bp, D. melanogaster
tccaaaaatgttg

SEQ ID NO: 647678 - DNA, 13 bp, D. melanogaster
tccaaaaatgttt

SEQ ID NO: 647679 - DNA, 13 bp, D. melanogaster
tccaaaacatttt

SEQ ID NO: 647680 - DNA, 13 bp, D. melanogaster
tccaaaaccaaat

SEQ ID NO: 647681 - DNA, 13 bp, D. melanogaster
tccaaaagtgaaa

SEQ ID NO: 647682 - DNA, 13 bp, D. melanogaster
tccaaaatacaat

SEQ ID NO: 647683 - DNA, 14 bp, D. melanogaster
tccaaaatatatat

SEQ ID NO: 647684 - DNA, 13 bp, D. melanogaster
tccaaaatatcat

SEQ ID NO: 647685 - DNA, 13 bp, D. melanogaster
tccaaaatattat

SEQ ID NO: 647686 - DNA, 13 bp, D. melanogaster
tccaaaatcgact

SEQ ID NO: 647687 - DNA, 13 bp, D. melanogaster
tccaaaatgcaga

SEQ ID NO: 647688 - DNA, 14 bp, D. melanogaster
tccaaaatttcaaa

SEQ ID NO: 647689 - DNA, 13 bp, D. melanogaster
tccaaacaaaagt

SEQ ID NO: 647690 - DNA, 13 bp, D. melanogaster
tccaaacacacat

SEQ ID NO: 647691 - DNA, 13 bp, D. melanogaster
tccaaacaggtga

SEQ ID NO: 647692 - DNA, 13 bp, D. melanogaster
tccaaacagtgtc

SEQ ID NO: 647693 - DNA, 13 bp, D. melanogaster
tccaaacataaat

SEQ ID NO: 647694 - DNA, 14 bp, D. melanogaster
tccaaacataaatg

SEQ ID NO: 647695 - DNA, 13 bp, D. melanogaster
tccaaacattttt

SEQ ID NO: 647696 - DNA, 14 bp, D. melanogaster
tccaaaccaggaaa

SEQ ID NO: 647697 - DNA, 13 bp, D. melanogaster
tccaaagaaacca

SEQ ID NO: 647698 - DNA, 15 bp, D. melanogaster
tccaaagaataaagt

SEQ ID NO: 647699 - DNA, 13 bp, D. melanogaster
tccaaagaatgat

SEQ ID NO: 647700 - DNA, 13 bp, D. melanogaster
tccaaagagactt

SEQ ID NO: 647701 - DNA, 13 bp, D. melanogaster
tccaaagcaaaca

SEQ ID NO: 647702 - DNA, 13 bp, D. melanogaster
tccaaagccaaag

SEQ ID NO: 647703 - DNA, 13 bp, D. melanogaster
tccaaagccagga

SEQ ID NO: 647704 - DNA, 13 bp, D. melanogaster
tccaaagccttgt

SEQ ID NO: 647705 - DNA, 13 bp, D. melanogaster
tccaaataaaacc

SEQ ID NO: 647706 - DNA, 13 bp, D. melanogaster
tccaaataataat

SEQ ID NO: 647707 - DNA, 13 bp, D. melanogaster
tccaaatacttat

SEQ ID NO: 647708 - DNA, 13 bp, D. melanogaster
tccaaatatggaa

SEQ ID NO: 647709 - DNA, 13 bp, D. melanogaster
tccaaatatggac

SEQ ID NO: 647710 - DNA, 13 bp, D. melanogaster
tccaaatatttat

SEQ ID NO: 647711 - DNA, 14 bp, D. melanogaster
tccaaatcaaaatc

SEQ ID NO: 647712 - DNA, 13 bp, D. melanogaster
tccaaatccaaac

SEQ ID NO: 647713 - DNA, 13 bp, D. melanogaster
tccaaatccaaag

SEQ ID NO: 647714 - DNA, 13 bp, D. melanogaster
tccaaatccaaat

SEQ ID NO: 647715 - DNA, 13 bp, D. melanogaster
tccaaatccaatt

SEQ ID NO: 647716 - DNA, 13 bp, D. melanogaster
tccaaatccgaaa

SEQ ID NO: 647717 - DNA, 14 bp, D. melanogaster
tccaaatccgaatc

SEQ ID NO: 647718 - DNA, 13 bp, D. melanogaster
tccaaatcgaaat

SEQ ID NO: 647719 - DNA, 13 bp, D. melanogaster
tccaaatgccaaa

SEQ ID NO: 647720 - DNA, 13 bp, D. melanogaster
tccaaatgtggaa

SEQ ID NO: 647721 - DNA, 14 bp, D. melanogaster
tccaaatgtggaat

SEQ ID NO: 647722 - DNA, 13 bp, D. melanogaster
tccaaattcaaat

SEQ ID NO: 647723 - DNA, 13 bp, D. melanogaster
tccaaattcaatt

SEQ ID NO: 647724 - DNA, 13 bp, D. melanogaster
tccaaattcttca

SEQ ID NO: 647725 - DNA, 14 bp, D. melanogaster
tccaaattcttcat

SEQ ID NO: 647726 - DNA, 13 bp, D. melanogaster
tccaaattctttc

SEQ ID NO: 647727 - DNA, 13 bp, D. melanogaster
tccaaattggtgg

SEQ ID NO: 647728 - DNA, 13 bp, D. melanogaster
tccaaattgttca

SEQ ID NO: 647729 - DNA, 13 bp, D. melanogaster
tccaaatttaaat

SEQ ID NO: 647730 - DNA, 13 bp, D. melanogaster
tccaaatttccga

SEQ ID NO: 647731 - DNA, 13 bp, D. melanogaster
tccaaatttgaac

SEQ ID NO: 647732 - DNA, 13 bp, D. melanogaster
tccaaattttatc

SEQ ID NO: 647733 - DNA, 13 bp, D. melanogaster
tccaacaaaatag

SEQ ID NO: 647734 - DNA, 13 bp, D. melanogaster
tccaacaactgaa

SEQ ID NO: 647735 - DNA, 13 bp, D. melanogaster
tccaacaagctgc

SEQ ID NO: 647736 - DNA, 13 bp, D. melanogaster
tccaacacactct

SEQ ID NO: 647737 - DNA, 13 bp, D. melanogaster
tccaacaccaaat

SEQ ID NO: 647738 - DNA, 13 bp, D. melanogaster
tccaacatccaac

SEQ ID NO: 647739 - DNA, 13 bp, D. melanogaster
tccaaccatccat

SEQ ID NO: 647740 - DNA, 13 bp, D. melanogaster
tccaactaaaaat

SEQ ID NO: 647741 - DNA, 14 bp, D. melanogaster
tccaactacaggat

SEQ ID NO: 647742 - DNA, 13 bp, D. melanogaster
tccaactattttt

SEQ ID NO: 647743 - DNA, 13 bp, D. melanogaster
tccaactccaatt

SEQ ID NO: 647744 - DNA, 13 bp, D. melanogaster
tccaactgttttt

SEQ ID NO: 647745 - DNA, 13 bp, D. melanogaster
tccaacttccaac

SEQ ID NO: 647746 - DNA, 13 bp, D. melanogaster
tccaagaagtact

SEQ ID NO: 647747 - DNA, 13 bp, D. melanogaster
tccaagagcgaaa

SEQ ID NO: 647748 - DNA, 13 bp, D. melanogaster
tccaagaggcagg

SEQ ID NO: 647749 - DNA, 13 bp, D. melanogaster
tccaagattgtcg

SEQ ID NO: 647750 - DNA, 13 bp, D. melanogaster
tccaagcatagtt

SEQ ID NO: 647751 - DNA, 13 bp, D. melanogaster
tccaagccaatta

SEQ ID NO: 647752 - DNA, 13 bp, D. melanogaster
tccaaggaaagct

SEQ ID NO: 647753 - DNA, 14 bp, D. melanogaster
tccaagggacaaat

SEQ ID NO: 647754 - DNA, 13 bp, D. melanogaster
tccaagtccgagt

SEQ ID NO: 647755 - DNA, 13 bp, D. melanogaster
tccaagtgcattt

SEQ ID NO: 647756 - DNA, 13 bp, D. melanogaster
tccaagtggatgt

SEQ ID NO: 647757 - DNA, 13 bp, D. melanogaster
tccaagttccaag

SEQ ID NO: 647758 - DNA, 13 bp, D. melanogaster
tccaagttccttt

SEQ ID NO: 647759 - DNA, 13 bp, D. melanogaster
tccaagttgaaga

SEQ ID NO: 647760 - DNA, 13 bp, D. melanogaster
tccaataaaatta

SEQ ID NO: 647761 - DNA, 13 bp, D. melanogaster
tccaataaatatt

SEQ ID NO: 647762 - DNA, 14 bp, D. melanogaster
tccaatacaaggag

SEQ ID NO: 647763 - DNA, 13 bp, D. melanogaster
tccaatactttct

SEQ ID NO: 647764 - DNA, 14 bp, D. melanogaster
tccaatatctatcg

SEQ ID NO: 647765 - DNA, 13 bp, D. melanogaster
tccaatccaaaca

SEQ ID NO: 647766 - DNA, 13 bp, D. melanogaster
tccaatccaatcc

SEQ ID NO: 647767 - DNA, 14 bp, D. melanogaster
tccaatccaatccc

SEQ ID NO: 647768 - DNA, 13 bp, D. melanogaster
tccaatccaatcg

SEQ ID NO: 647769 - DNA, 14 bp, D. melanogaster
tccaatccactcca

SEQ ID NO: 647770 - DNA, 13 bp, D. melanogaster
tccaatccatgaa

SEQ ID NO: 647771 - DNA, 14 bp, D. melanogaster
tccaatcccaatcc

SEQ ID NO: 647772 - DNA, 13 bp, D. melanogaster
tccaatcccatcc

SEQ ID NO: 647773 - DNA, 13 bp, D. melanogaster
tccaatcgatttg

SEQ ID NO: 647774 - DNA, 13 bp, D. melanogaster
tccaatctgtaca

SEQ ID NO: 647775 - DNA, 13 bp, D. melanogaster
tccaatgaccaaa

SEQ ID NO: 647776 - DNA, 13 bp, D. melanogaster
tccaatgcttcaa

SEQ ID NO: 647777 - DNA, 13 bp, D. melanogaster
tccaattaaagtt

SEQ ID NO: 647778 - DNA, 13 bp, D. melanogaster
tccaattaaatta

SEQ ID NO: 647779 - DNA, 13 bp, D. melanogaster
tccaattaagaac

SEQ ID NO: 647780 - DNA, 13 bp, D. melanogaster
tccaattaagttt

SEQ ID NO: 647781 - DNA, 13 bp, D. melanogaster
tccaattacattt

SEQ ID NO: 647782 - DNA, 13 bp, D. melanogaster
tccaattcaagga

SEQ ID NO: 647783 - DNA, 13 bp, D. melanogaster
tccaattccaaat

SEQ ID NO: 647784 - DNA, 13 bp, D. melanogaster
tccaattccaatc

SEQ ID NO: 647785 - DNA, 14 bp, D. melanogaster
tccaattccgattc

SEQ ID NO: 647786 - DNA, 13 bp, D. melanogaster
tccaattcctatt

SEQ ID NO: 647787 - DNA, 13 bp, D. melanogaster
tccaattcgattt

SEQ ID NO: 647788 - DNA, 13 bp, D. melanogaster
tccaattgcaatt

SEQ ID NO: 647789 - DNA, 13 bp, D. melanogaster
tccaattggaaaa

SEQ ID NO: 647790 - DNA, 13 bp, D. melanogaster
tccaattggaatg

SEQ ID NO: 647791 - DNA, 13 bp, D. melanogaster
tccaattggattt

SEQ ID NO: 647792 - DNA, 13 bp, D. melanogaster
tccaattggttac

SEQ ID NO: 647793 - DNA, 13 bp, D. melanogaster
tccaatttccaat

SEQ ID NO: 647794 - DNA, 13 bp, D. melanogaster
tccaatttctttg

SEQ ID NO: 647795 - DNA, 13 bp, D. melanogaster
tccaatttttgga

SEQ ID NO: 647796 - DNA, 13 bp, D. melanogaster
tccacaaaaagcg

SEQ ID NO: 647797 - DNA, 14 bp, D. melanogaster
tccacaaatctcgc

SEQ ID NO: 647798 - DNA, 14 bp, D. melanogaster
tccacaaatctgat

SEQ ID NO: 647799 - DNA, 13 bp, D. melanogaster
tccacaacgatgg

SEQ ID NO: 647800 - DNA, 13 bp, D. melanogaster
tccacaacttcat

SEQ ID NO: 647801 - DNA, 13 bp, D. melanogaster
tccacaatccgat

SEQ ID NO: 647802 - DNA, 13 bp, D. melanogaster
tccacacactcac

SEQ ID NO: 647803 - DNA, 13 bp, D. melanogaster
tccacaccactta

SEQ ID NO: 647804 - DNA, 14 bp, D. melanogaster
tccacacgcacaca

SEQ ID NO: 647805 - DNA, 13 bp, D. melanogaster
tccacagagatat

SEQ ID NO: 647806 - DNA, 13 bp, D. melanogaster
tccacataacctt

SEQ ID NO: 647807 - DNA, 13 bp, D. melanogaster
tccacatataaca

SEQ ID NO: 647808 - DNA, 13 bp, D. melanogaster
tccacatattttt

SEQ ID NO: 647809 - DNA, 13 bp, D. melanogaster
tccacatccacac

SEQ ID NO: 647810 - DNA, 14 bp, D. melanogaster
tccacatccacatg

SEQ ID NO: 647811 - DNA, 13 bp, D. melanogaster
tccacatccacct

SEQ ID NO: 647812 - DNA, 14 bp, D. melanogaster
tccacatccacgag

SEQ ID NO: 647813 - DNA, 14 bp, D. melanogaster
tccacatccacgtc

SEQ ID NO: 647814 - DNA, 13 bp, D. melanogaster
tccacatccactt

SEQ ID NO: 647815 - DNA, 13 bp, D. melanogaster
tccacatcttctg

SEQ ID NO: 647816 - DNA, 13 bp, D. melanogaster
tccacatgatgcg

SEQ ID NO: 647817 - DNA, 13 bp, D. melanogaster
tccacattcccat

SEQ ID NO: 647818 - DNA, 13 bp, D. melanogaster
tccacatttaatt

SEQ ID NO: 647819 - DNA, 13 bp, D. melanogaster
tccacatttgaac

SEQ ID NO: 647820 - DNA, 13 bp, D. melanogaster
tccacatttggac

SEQ ID NO: 647821 - DNA, 13 bp, D. melanogaster
tccacatttgttt

SEQ ID NO: 647822 - DNA, 13 bp, D. melanogaster
tccacattttccc

SEQ ID NO: 647823 - DNA, 13 bp, D. melanogaster
tccaccaaaggca

SEQ ID NO: 647824 - DNA, 13 bp, D. melanogaster
tccaccaagacgg

SEQ ID NO: 647825 - DNA, 13 bp, D. melanogaster
tccaccacataac

SEQ ID NO: 647826 - DNA, 13 bp, D. melanogaster
tccaccaccatct

SEQ ID NO: 647827 - DNA, 13 bp, D. melanogaster
tccaccagctgtg

SEQ ID NO: 647828 - DNA, 13 bp, D. melanogaster
tccaccatccatc

SEQ ID NO: 647829 - DNA, 13 bp, D. melanogaster
tccacccactttt

SEQ ID NO: 647830 - DNA, 13 bp, D. melanogaster
tccaccgcctcca

SEQ ID NO: 647831 - DNA, 13 bp, D. melanogaster
tccaccggaattc

SEQ ID NO: 647832 - DNA, 13 bp, D. melanogaster
tccacctatccaa

SEQ ID NO: 647833 - DNA, 13 bp, D. melanogaster
tccacgacttgtg

SEQ ID NO: 647834 - DNA, 13 bp, D. melanogaster
tccacgaggatca

SEQ ID NO: 647835 - DNA, 14 bp, D. melanogaster
tccacgcccactct

SEQ ID NO: 647836 - DNA, 13 bp, D. melanogaster
tccacggtgatcc

SEQ ID NO: 647837 - DNA, 13 bp, D. melanogaster
tccacgtccacat

SEQ ID NO: 647838 - DNA, 14 bp, D. melanogaster
tccacgtccacatc

SEQ ID NO: 647839 - DNA, 13 bp, D. melanogaster
tccacgtccagac

SEQ ID NO: 647840 - DNA, 13 bp, D. melanogaster
tccactaatagaa

SEQ ID NO: 647841 - DNA, 13 bp, D. melanogaster
tccactacccaag

SEQ ID NO: 647842 - DNA, 13 bp, D. melanogaster
tccactatatcgt

SEQ ID NO: 647843 - DNA, 13 bp, D. melanogaster
tccactccaatcc

SEQ ID NO: 647844 - DNA, 13 bp, D. melanogaster
tccactccactca

SEQ ID NO: 647845 - DNA, 13 bp, D. melanogaster
tccactccactcg

SEQ ID NO: 647846 - DNA, 13 bp, D. melanogaster
tccactccactct

SEQ ID NO: 647847 - DNA, 13 bp, D. melanogaster
tccactccattcc

SEQ ID NO: 647848 - DNA, 13 bp, D. melanogaster
tccactccgctcc

SEQ ID NO: 647849 - DNA, 13 bp, D. melanogaster
tccactcgaaggt

SEQ ID NO: 647850 - DNA, 13 bp, D. melanogaster
tccactcgaatgg

SEQ ID NO: 647851 - DNA, 13 bp, D. melanogaster
tccactctaacgc

SEQ ID NO: 647852 - DNA, 13 bp, D. melanogaster
tccactctgcatt

SEQ ID NO: 647853 - DNA, 13 bp, D. melanogaster
tccactctgctga

SEQ ID NO: 647854 - DNA, 13 bp, D. melanogaster
tccactgcagcag

SEQ ID NO: 647855 - DNA, 14 bp, D. melanogaster
tccactgcagcagc

SEQ ID NO: 647856 - DNA, 14 bp, D. melanogaster
tccactgccaagat

SEQ ID NO: 647857 - DNA, 13 bp, D. melanogaster
tccactgctccac

SEQ ID NO: 647858 - DNA, 13 bp, D. melanogaster
tccactgctgcct

SEQ ID NO: 647859 - DNA, 13 bp, D. melanogaster
tccactgtccact

SEQ ID NO: 647860 - DNA, 13 bp, D. melanogaster
tccacttatttca

SEQ ID NO: 647861 - DNA, 13 bp, D. melanogaster
tccacttcaattt

SEQ ID NO: 647862 - DNA, 13 bp, D. melanogaster
tccacttcactcc

SEQ ID NO: 647863 - DNA, 14 bp, D. melanogaster
tccacttccacatc

SEQ ID NO: 647864 - DNA, 13 bp, D. melanogaster
tccacttccactt

SEQ ID NO: 647865 - DNA, 13 bp, D. melanogaster
tccacttccagtt

SEQ ID NO: 647866 - DNA, 13 bp, D. melanogaster
tccacttccattc

SEQ ID NO: 647867 - DNA, 13 bp, D. melanogaster
tccacttccattt

SEQ ID NO: 647868 - DNA, 13 bp, D. melanogaster
tccacttcccagt

SEQ ID NO: 647869 - DNA, 13 bp, D. melanogaster
tccacttccgttt

SEQ ID NO: 647870 - DNA, 14 bp, D. melanogaster
tccacttccgtttc

SEQ ID NO: 647871 - DNA, 13 bp, D. melanogaster
tccacttgaaaat

SEQ ID NO: 647872 - DNA, 13 bp, D. melanogaster
tccacttgacttt

SEQ ID NO: 647873 - DNA, 13 bp, D. melanogaster
tccacttgcagct

SEQ ID NO: 647874 - DNA, 13 bp, D. melanogaster
tccacttgttgtt

SEQ ID NO: 647875 - DNA, 13 bp, D. melanogaster
tccactttaaatg

SEQ ID NO: 647876 - DNA, 13 bp, D. melanogaster
tccactttttgtt

SEQ ID NO: 647877 - DNA, 13 bp, D. melanogaster
tccagaaaaatgt

SEQ ID NO: 647878 - DNA, 13 bp, D. melanogaster
tccagaaactatc

SEQ ID NO: 647879 - DNA, 13 bp, D. melanogaster
tccagaacaagtc

SEQ ID NO: 647880 - DNA, 13 bp, D. melanogaster
tccagaagtcaaa

SEQ ID NO: 647881 - DNA, 13 bp, D. melanogaster
tccagaagtttgt

SEQ ID NO: 647882 - DNA, 13 bp, D. melanogaster
tccagaatctata

SEQ ID NO: 647883 - DNA, 13 bp, D. melanogaster
tccagaatttgca

SEQ ID NO: 647884 - DNA, 13 bp, D. melanogaster
tccagagaaagtt

SEQ ID NO: 647885 - DNA, 13 bp, D. melanogaster
tccagagcaagtg

SEQ ID NO: 647886 - DNA, 13 bp, D. melanogaster
tccagatacagat

SEQ ID NO: 647887 - DNA, 13 bp, D. melanogaster
tccagatagaaat

SEQ ID NO: 647888 - DNA, 13 bp, D. melanogaster
tccagatccagat

SEQ ID NO: 647889 - DNA, 15 bp, D. melanogaster
tccagatccagatcc

SEQ ID NO: 647890 - DNA, 13 bp, D. melanogaster
tccagatcccaga

SEQ ID NO: 647891 - DNA, 14 bp, D. melanogaster
tccagatccccaac

SEQ ID NO: 647892 - DNA, 13 bp, D. melanogaster
tccagatcgactc

SEQ ID NO: 647893 - DNA, 13 bp, D. melanogaster
tccagatgcaccc

SEQ ID NO: 647894 - DNA, 13 bp, D. melanogaster
tccagattccaga

SEQ ID NO: 647895 - DNA, 13 bp, D. melanogaster
tccagattttttg

SEQ ID NO: 647896 - DNA, 13 bp, D. melanogaster
tccagcaattata

SEQ ID NO: 647897 - DNA, 14 bp, D. melanogaster
tccagcaattgcag

SEQ ID NO: 647898 - DNA, 13 bp, D. melanogaster
tccagcacacaca

SEQ ID NO: 647899 - DNA, 13 bp, D. melanogaster
tccagcaccagca

SEQ ID NO: 647900 - DNA, 14 bp, D. melanogaster
tccagcagaaagat

SEQ ID NO: 647901 - DNA, 14 bp, D. melanogaster
tccagcatccagca

SEQ ID NO: 647902 - DNA, 13 bp, D. melanogaster
tccagcatgtccg

SEQ ID NO: 647903 - DNA, 13 bp, D. melanogaster
tccagcattttcc

SEQ ID NO: 647904 - DNA, 13 bp, D. melanogaster
tccagccagccag

SEQ ID NO: 647905 - DNA, 14 bp, D. melanogaster
tccagccagccagc

SEQ ID NO: 647906 - DNA, 13 bp, D. melanogaster
tccagctaaaaat

SEQ ID NO: 647907 - DNA, 14 bp, D. melanogaster
tccagctccaactc

SEQ ID NO: 647908 - DNA, 13 bp, D. melanogaster
tccagctccagat

SEQ ID NO: 647909 - DNA, 13 bp, D. melanogaster
tccagctccagct

SEQ ID NO: 647910 - DNA, 13 bp, D. melanogaster
tccagctccagtt

SEQ ID NO: 647911 - DNA, 13 bp, D. melanogaster
tccagctccatct

SEQ ID NO: 647912 - DNA, 13 bp, D. melanogaster
tccagctccattt

SEQ ID NO: 647913 - DNA, 13 bp, D. melanogaster
tccagctcccagc

SEQ ID NO: 647914 - DNA, 13 bp, D. melanogaster
tccagctcctcct

SEQ ID NO: 647915 - DNA, 14 bp, D. melanogaster
tccagctcctgctc

SEQ ID NO: 647916 - DNA, 13 bp, D. melanogaster
tccagctgacgca

SEQ ID NO: 647917 - DNA, 13 bp, D. melanogaster
tccagctgcagtt

SEQ ID NO: 647918 - DNA, 13 bp, D. melanogaster
tccagcttcagga

SEQ ID NO: 647919 - DNA, 13 bp, D. melanogaster
tccagcttcgatt

SEQ ID NO: 647920 - DNA, 13 bp, D. melanogaster
tccagcttttccc

SEQ ID NO: 647921 - DNA, 13 bp, D. melanogaster
tccagcttttccg

SEQ ID NO: 647922 - DNA, 13 bp, D. melanogaster
tccagcttttcct

SEQ ID NO: 647923 - DNA, 13 bp, D. melanogaster
tccaggaattgag

SEQ ID NO: 647924 - DNA, 13 bp, D. melanogaster
tccaggagctttc

SEQ ID NO: 647925 - DNA, 13 bp, D. melanogaster
tccaggagtcatc

SEQ ID NO: 647926 - DNA, 13 bp, D. melanogaster
tccaggcaaaagc

SEQ ID NO: 647927 - DNA, 14 bp, D. melanogaster
tccagggaaatgtt

SEQ ID NO: 647928 - DNA, 14 bp, D. melanogaster
tccagggccaactt

SEQ ID NO: 647929 - DNA, 13 bp, D. melanogaster
tccaggtgtgctg

SEQ ID NO: 647930 - DNA, 13 bp, D. melanogaster
tccagtaataatg

SEQ ID NO: 647931 - DNA, 13 bp, D. melanogaster
tccagtaatgtca

SEQ ID NO: 647932 - DNA, 14 bp, D. melanogaster
tccagtactgtttt

SEQ ID NO: 647933 - DNA, 13 bp, D. melanogaster
tccagtcagtcag

SEQ ID NO: 647934 - DNA, 13 bp, D. melanogaster
tccagtccagtcc

SEQ ID NO: 647935 - DNA, 13 bp, D. melanogaster
tccagtccagtgt

SEQ ID NO: 647936 - DNA, 13 bp, D. melanogaster
tccagtcttcttc

SEQ ID NO: 647937 - DNA, 13 bp, D. melanogaster
tccagtgcctcca

SEQ ID NO: 647938 - DNA, 13 bp, D. melanogaster
tccagttactcgg

SEQ ID NO: 647939 - DNA, 13 bp, D. melanogaster
tccagttcaataa

SEQ ID NO: 647940 - DNA, 13 bp, D. melanogaster
tccagttccagct

SEQ ID NO: 647941 - DNA, 13 bp, D. melanogaster
tccagttccagtt

SEQ ID NO: 647942 - DNA, 14 bp, D. melanogaster
tccagttccagttc

SEQ ID NO: 647943 - DNA, 13 bp, D. melanogaster
tccagttccattt

SEQ ID NO: 647944 - DNA, 13 bp, D. melanogaster
tccagttcgattt

SEQ ID NO: 647945 - DNA, 13 bp, D. melanogaster
tccagttggcttt

SEQ ID NO: 647946 - DNA, 13 bp, D. melanogaster
tccagtttcagtt

SEQ ID NO: 647947 - DNA, 14 bp, D. melanogaster
tccagtttccagtt

SEQ ID NO: 647948 - DNA, 13 bp, D. melanogaster
tccagttttcccc

SEQ ID NO: 647949 - DNA, 13 bp, D. melanogaster
tccagttttcttt

SEQ ID NO: 647950 - DNA, 13 bp, D. melanogaster
tccagtttttatt

SEQ ID NO: 647951 - DNA, 13 bp, D. melanogaster
tccagtttttgag

SEQ ID NO: 647952 - DNA, 14 bp, D. melanogaster
tccagtttttgcag

SEQ ID NO: 647953 - DNA, 14 bp, D. melanogaster
tccataaacaatat

SEQ ID NO: 647954 - DNA, 13 bp, D. melanogaster
tccataaagatag

SEQ ID NO: 647955 - DNA, 13 bp, D. melanogaster
tccataaatataa

SEQ ID NO: 647956 - DNA, 14 bp, D. melanogaster
tccataaatattta

SEQ ID NO: 647957 - DNA, 13 bp, D. melanogaster
tccataaatttat

SEQ ID NO: 647958 - DNA, 13 bp, D. melanogaster
tccatacatacat

SEQ ID NO: 647959 - DNA, 14 bp, D. melanogaster
tccatacatacata

SEQ ID NO: 647960 - DNA, 13 bp, D. melanogaster
tccatacccatac

SEQ ID NO: 647961 - DNA, 13 bp, D. melanogaster
tccatataaagga

SEQ ID NO: 647962 - DNA, 15 bp, D. melanogaster
tccatatacatatat

SEQ ID NO: 647963 - DNA, 13 bp, D. melanogaster
tccatatagaaat

SEQ ID NO: 647964 - DNA, 14 bp, D. melanogaster
tccatatagaaatc

SEQ ID NO: 647965 - DNA, 13 bp, D. melanogaster
tccatatataaat

SEQ ID NO: 647966 - DNA, 14 bp, D. melanogaster
tccatatatatgta

SEQ ID NO: 647967 - DNA, 14 bp, D. melanogaster
tccatatatcccaa

SEQ ID NO: 647968 - DNA, 13 bp, D. melanogaster
tccatatatgagg

SEQ ID NO: 647969 - DNA, 14 bp, D. melanogaster
tccatatatgaggg

SEQ ID NO: 647970 - DNA, 13 bp, D. melanogaster
tccatatatgtat

SEQ ID NO: 647971 - DNA, 14 bp, D. melanogaster
tccatatatgtatg

SEQ ID NO: 647972 - DNA, 13 bp, D. melanogaster
tccatatccatat

SEQ ID NO: 647973 - DNA, 13 bp, D. melanogaster
tccatatccatcc

SEQ ID NO: 647974 - DNA, 13 bp, D. melanogaster
tccatatgcatat

SEQ ID NO: 647975 - DNA, 13 bp, D. melanogaster
tccatattattat

SEQ ID NO: 647976 - DNA, 13 bp, D. melanogaster
tccatatttgggt

SEQ ID NO: 647977 - DNA, 13 bp, D. melanogaster
tccatattttaaa

SEQ ID NO: 647978 - DNA, 14 bp, D. melanogaster
tccatcaatcaatc

SEQ ID NO: 647979 - DNA, 13 bp, D. melanogaster
tccatcaatttat

SEQ ID NO: 647980 - DNA, 13 bp, D. melanogaster
tccatcacatggt

SEQ ID NO: 647981 - DNA, 13 bp, D. melanogaster
tccatcagaagga

SEQ ID NO: 647982 - DNA, 13 bp, D. melanogaster
tccatcagataga

SEQ ID NO: 647983 - DNA, 13 bp, D. melanogaster
tccatccaaccaa

SEQ ID NO: 647984 - DNA, 14 bp, D. melanogaster
tccatccacatcca

SEQ ID NO: 647985 - DNA, 13 bp, D. melanogaster
tccatccatccaa

SEQ ID NO: 647986 - DNA, 14 bp, D. melanogaster
tccatccatccaac

SEQ ID NO: 647987 - DNA, 13 bp, D. melanogaster
tccatccatccac

SEQ ID NO: 647988 - DNA, 14 bp, D. melanogaster
tccatccatccacc

SEQ ID NO: 647989 - DNA, 13 bp, D. melanogaster
tccatccatccgt

SEQ ID NO: 647990 - DNA, 14 bp, D. melanogaster
tccatccatccgtc

SEQ ID NO: 647991 - DNA, 13 bp, D. melanogaster
tccatcccctctg

SEQ ID NO: 647992 - DNA, 13 bp, D. melanogaster
tccatcctgacac

SEQ ID NO: 647993 - DNA, 13 bp, D. melanogaster
tccatccttactg

SEQ ID NO: 647994 - DNA, 13 bp, D. melanogaster
tccatcgatttgc

SEQ ID NO: 647995 - DNA, 13 bp, D. melanogaster
tccatcgcttttc

SEQ ID NO: 647996 - DNA, 13 bp, D. melanogaster
tccatcgtatata

SEQ ID NO: 647997 - DNA, 13 bp, D. melanogaster
tccatcgttgtgg

SEQ ID NO: 647998 - DNA, 13 bp, D. melanogaster
tccatctccatcc

SEQ ID NO: 647999 - DNA, 13 bp, D. melanogaster
tccatctgaccat

SEQ ID NO: 648000 - DNA, 13 bp, D. melanogaster
tccatctgcagtc

SEQ ID NO: 648001 - DNA, 13 bp, D. melanogaster
tccatctgtctgt

SEQ ID NO: 648002 - DNA, 13 bp, D. melanogaster
tccatctttctgc

SEQ ID NO: 648003 - DNA, 13 bp, D. melanogaster
tccatgacatcag

SEQ ID NO: 648004 - DNA, 13 bp, D. melanogaster
tccatgctgtggt

SEQ ID NO: 648005 - DNA, 13 bp, D. melanogaster
tccatggatccat

SEQ ID NO: 648006 - DNA, 13 bp, D. melanogaster
tccatggcagcga

SEQ ID NO: 648007 - DNA, 14 bp, D. melanogaster
tccatggcagcgaa

SEQ ID NO: 648008 - DNA, 13 bp, D. melanogaster
tccatgtccattt

SEQ ID NO: 648009 - DNA, 13 bp, D. melanogaster
tccatgtgtgtgt

SEQ ID NO: 648010 - DNA, 14 bp, D. melanogaster
tccatgtgtgtgtg

SEQ ID NO: 648011 - DNA, 13 bp, D. melanogaster
tccatgtgttttt

SEQ ID NO: 648012 - DNA, 13 bp, D. melanogaster
tccatgttccatg

SEQ ID NO: 648013 - DNA, 13 bp, D. melanogaster
tccatgttgccgg

SEQ ID NO: 648014 - DNA, 14 bp, D. melanogaster
tccatgtttcatta

SEQ ID NO: 648015 - DNA, 13 bp, D. melanogaster
tccattacttttg

SEQ ID NO: 648016 - DNA, 13 bp, D. melanogaster
tccattataaaag

SEQ ID NO: 648017 - DNA, 13 bp, D. melanogaster
tccattcaaggag

SEQ ID NO: 648018 - DNA, 13 bp, D. melanogaster
tccattcatttca

SEQ ID NO: 648019 - DNA, 13 bp, D. melanogaster
tccattcatttgc

SEQ ID NO: 648020 - DNA, 13 bp, D. melanogaster
tccattcattttc

SEQ ID NO: 648021 - DNA, 13 bp, D. melanogaster
tccattcattttg

SEQ ID NO: 648022 - DNA, 13 bp, D. melanogaster
tccattccacttc

SEQ ID NO: 648023 - DNA, 13 bp, D. melanogaster
tccattccagtct

SEQ ID NO: 648024 - DNA, 14 bp, D. melanogaster
tccattccagtctg

SEQ ID NO: 648025 - DNA, 13 bp, D. melanogaster
tccattccatcca

SEQ ID NO: 648026 - DNA, 13 bp, D. melanogaster
tccattccattca

SEQ ID NO: 648027 - DNA, 13 bp, D. melanogaster
tccattccattct

SEQ ID NO: 648028 - DNA, 14 bp, D. melanogaster
tccattcccattcc

SEQ ID NO: 648029 - DNA, 13 bp, D. melanogaster
tccattccgattc

SEQ ID NO: 648030 - DNA, 13 bp, D. melanogaster
tccattccgttcc

SEQ ID NO: 648031 - DNA, 13 bp, D. melanogaster
tccattcgattca

SEQ ID NO: 648032 - DNA, 13 bp, D. melanogaster
tccattcgatttg

SEQ ID NO: 648033 - DNA, 13 bp, D. melanogaster
tccattcgcattt

SEQ ID NO: 648034 - DNA, 13 bp, D. melanogaster
tccattcgccatt

SEQ ID NO: 648035 - DNA, 13 bp, D. melanogaster
tccattgaccacg

SEQ ID NO: 648036 - DNA, 13 bp, D. melanogaster
tccattgataagg

SEQ ID NO: 648037 - DNA, 13 bp, D. melanogaster
tccattgattttc

SEQ ID NO: 648038 - DNA, 13 bp, D. melanogaster
tccattgccattt

SEQ ID NO: 648039 - DNA, 13 bp, D. melanogaster
tccattgcttttt

SEQ ID NO: 648040 - DNA, 13 bp, D. melanogaster
tccattgttgttg

SEQ ID NO: 648041 - DNA, 13 bp, D. melanogaster
tccatttaaaaat

SEQ ID NO: 648042 - DNA, 13 bp, D. melanogaster
tccatttaacaat

SEQ ID NO: 648043 - DNA, 13 bp, D. melanogaster
tccatttaataat

SEQ ID NO: 648044 - DNA, 13 bp, D. melanogaster
tccatttaatgtt

SEQ ID NO: 648045 - DNA, 13 bp, D. melanogaster
tccatttaattag

SEQ ID NO: 648046 - DNA, 13 bp, D. melanogaster
tccatttaattat

SEQ ID NO: 648047 - DNA, 13 bp, D. melanogaster
tccatttacaatt

SEQ ID NO: 648048 - DNA, 13 bp, D. melanogaster
tccatttatccat

SEQ ID NO: 648049 - DNA, 13 bp, D. melanogaster
tccatttcaaatt

SEQ ID NO: 648050 - DNA, 13 bp, D. melanogaster
tccatttcaagtg

SEQ ID NO: 648051 - DNA, 13 bp, D. melanogaster
tccatttcaatat

SEQ ID NO: 648052 - DNA, 13 bp, D. melanogaster
tccatttcaatta

SEQ ID NO: 648053 - DNA, 13 bp, D. melanogaster
tccatttcattca

SEQ ID NO: 648054 - DNA, 13 bp, D. melanogaster
tccatttcatttg

SEQ ID NO: 648055 - DNA, 13 bp, D. melanogaster
tccatttccaatt

SEQ ID NO: 648056 - DNA, 13 bp, D. melanogaster
tccatttccacag

SEQ ID NO: 648057 - DNA, 13 bp, D. melanogaster
tccatttccatac

SEQ ID NO: 648058 - DNA, 13 bp, D. melanogaster
tccatttccatat

SEQ ID NO: 648059 - DNA, 13 bp, D. melanogaster
tccatttccatct

SEQ ID NO: 648060 - DNA, 13 bp, D. melanogaster
tccatttccatgc

SEQ ID NO: 648061 - DNA, 13 bp, D. melanogaster
tccatttccattt

SEQ ID NO: 648062 - DNA, 14 bp, D. melanogaster
tccatttcccacac

SEQ ID NO: 648063 - DNA, 13 bp, D. melanogaster
tccatttccctgc

SEQ ID NO: 648064 - DNA, 13 bp, D. melanogaster
tccatttccgttt

SEQ ID NO: 648065 - DNA, 13 bp, D. melanogaster
tccatttccttaa

SEQ ID NO: 648066 - DNA, 13 bp, D. melanogaster
tccatttcgattc

SEQ ID NO: 648067 - DNA, 13 bp, D. melanogaster
tccatttctgttt

SEQ ID NO: 648068 - DNA, 13 bp, D. melanogaster
tccatttcttttg

SEQ ID NO: 648069 - DNA, 13 bp, D. melanogaster
tccatttgcattt

SEQ ID NO: 648070 - DNA, 14 bp, D. melanogaster
tccatttgcatttc

SEQ ID NO: 648071 - DNA, 13 bp, D. melanogaster
tccatttgccatt

SEQ ID NO: 648072 - DNA, 13 bp, D. melanogaster
tccatttggattt

SEQ ID NO: 648073 - DNA, 13 bp, D. melanogaster
tccatttgggcca

SEQ ID NO: 648074 - DNA, 13 bp, D. melanogaster
tccatttgggttt

SEQ ID NO: 648075 - DNA, 13 bp, D. melanogaster
tccatttgtccgt

SEQ ID NO: 648076 - DNA, 13 bp, D. melanogaster
tccatttgtttac

SEQ ID NO: 648077 - DNA, 13 bp, D. melanogaster
tccattttataat

SEQ ID NO: 648078 - DNA, 13 bp, D. melanogaster
tccattttcatat

SEQ ID NO: 648079 - DNA, 13 bp, D. melanogaster
tccattttccact

SEQ ID NO: 648080 - DNA, 13 bp, D. melanogaster
tccattttcccag

SEQ ID NO: 648081 - DNA, 13 bp, D. melanogaster
tccattttcccat

SEQ ID NO: 648082 - DNA, 13 bp, D. melanogaster
tccatttttaaat

SEQ ID NO: 648083 - DNA, 13 bp, D. melanogaster
tccatttttgcca

SEQ ID NO: 648084 - DNA, 13 bp, D. melanogaster
tccatttttggcc

SEQ ID NO: 648085 - DNA, 13 bp, D. melanogaster
tcccaaaaaaatg

SEQ ID NO: 648086 - DNA, 13 bp, D. melanogaster
tcccaaaacgaaa

SEQ ID NO: 648087 - DNA, 13 bp, D. melanogaster
tcccaaaagtatg

SEQ ID NO: 648088 - DNA, 13 bp, D. melanogaster
tcccaaaataaat

SEQ ID NO: 648089 - DNA, 15 bp, D. melanogaster
tcccaaaataaattc

SEQ ID NO: 648090 - DNA, 13 bp, D. melanogaster
tcccaaaataata

SEQ ID NO: 648091 - DNA, 13 bp, D. melanogaster
tcccaaacttgaa

SEQ ID NO: 648092 - DNA, 13 bp, D. melanogaster
tcccaaagaaaat

SEQ ID NO: 648093 - DNA, 13 bp, D. melanogaster
tcccaaagatcgt

SEQ ID NO: 648094 - DNA, 13 bp, D. melanogaster
tcccaaatcccaa

SEQ ID NO: 648095 - DNA, 13 bp, D. melanogaster
tcccaaattcatt

SEQ ID NO: 648096 - DNA, 13 bp, D. melanogaster
tcccaaatttcag

SEQ ID NO: 648097 - DNA, 13 bp, D. melanogaster
tcccaacaaaaat

SEQ ID NO: 648098 - DNA, 13 bp, D. melanogaster
tcccaacagaact

SEQ ID NO: 648099 - DNA, 13 bp, D. melanogaster
tcccaacatccca

SEQ ID NO: 648100 - DNA, 13 bp, D. melanogaster
tcccaaccaaatc

SEQ ID NO: 648101 - DNA, 13 bp, D. melanogaster
tcccaaccgatgt

SEQ ID NO: 648102 - DNA, 13 bp, D. melanogaster
tcccaactcccaa

SEQ ID NO: 648103 - DNA, 13 bp, D. melanogaster
tcccaactggtgg

SEQ ID NO: 648104 - DNA, 13 bp, D. melanogaster
tcccaagaagatt

SEQ ID NO: 648105 - DNA, 14 bp, D. melanogaster
tcccaagcctttgc

SEQ ID NO: 648106 - DNA, 13 bp, D. melanogaster
tcccaatcacttt

SEQ ID NO: 648107 - DNA, 14 bp, D. melanogaster
tcccaatcccaatc

SEQ ID NO: 648108 - DNA, 14 bp, D. melanogaster
tcccaatcccaatt

SEQ ID NO: 648109 - DNA, 13 bp, D. melanogaster
tcccaatcccact

SEQ ID NO: 648110 - DNA, 13 bp, D. melanogaster
tcccaatcccagt

SEQ ID NO: 648111 - DNA, 13 bp, D. melanogaster
tcccaatcccatt

SEQ ID NO: 648112 - DNA, 13 bp, D. melanogaster
tcccaatccgaaa

SEQ ID NO: 648113 - DNA, 13 bp, D. melanogaster
tcccaatcgaact

SEQ ID NO: 648114 - DNA, 13 bp, D. melanogaster
tcccaatcgattt

SEQ ID NO: 648115 - DNA, 14 bp, D. melanogaster
tcccaattccaatc

SEQ ID NO: 648116 - DNA, 13 bp, D. melanogaster
tcccaatttaatt

SEQ ID NO: 648117 - DNA, 13 bp, D. melanogaster
tcccaatttccca

SEQ ID NO: 648118 - DNA, 13 bp, D. melanogaster
tcccacacaaaat

SEQ ID NO: 648119 - DNA, 13 bp, D. melanogaster
tcccacactatat

SEQ ID NO: 648120 - DNA, 13 bp, D. melanogaster
tcccacatatgaa

SEQ ID NO: 648121 - DNA, 13 bp, D. melanogaster
tcccacattttcc

SEQ ID NO: 648122 - DNA, 13 bp, D. melanogaster
tcccaccagcact

SEQ ID NO: 648123 - DNA, 14 bp, D. melanogaster
tcccactccacggc

SEQ ID NO: 648124 - DNA, 13 bp, D. melanogaster
tcccactccattt

SEQ ID NO: 648125 - DNA, 13 bp, D. melanogaster
tcccacttccact

SEQ ID NO: 648126 - DNA, 13 bp, D. melanogaster
tcccacttttcca

SEQ ID NO: 648127 - DNA, 14 bp, D. melanogaster
tcccagaaaaataa

SEQ ID NO: 648128 - DNA, 13 bp, D. melanogaster
tcccagaaaaatg

SEQ ID NO: 648129 - DNA, 13 bp, D. melanogaster
tcccagatataaa

SEQ ID NO: 648130 - DNA, 13 bp, D. melanogaster
tcccagatcccag

SEQ ID NO: 648131 - DNA, 13 bp, D. melanogaster
tcccagcatccca

SEQ ID NO: 648132 - DNA, 13 bp, D. melanogaster
tcccagcatttcc

SEQ ID NO: 648133 - DNA, 13 bp, D. melanogaster
tcccagccaccca

SEQ ID NO: 648134 - DNA, 13 bp, D. melanogaster
tcccagctgcgca

SEQ ID NO: 648135 - DNA, 13 bp, D. melanogaster
tcccagcttttcc

SEQ ID NO: 648136 - DNA, 14 bp, D. melanogaster
tcccagtcccaatc

SEQ ID NO: 648137 - DNA, 27 bp, D. melanogaster
tcccagtcccagtcccagtcccagtcc

SEQ ID NO: 648138 - DNA, 14 bp, D. melanogaster
tcccagttcccagt

SEQ ID NO: 648139 - DNA, 13 bp, D. melanogaster
tcccagttgccag

SEQ ID NO: 648140 - DNA, 14 bp, D. melanogaster
tcccagtttcccag

SEQ ID NO: 648141 - DNA, 13 bp, D. melanogaster
tcccagttttcag

SEQ ID NO: 648142 - DNA, 13 bp, D. melanogaster
tcccagttttccc

SEQ ID NO: 648143 - DNA, 13 bp, D. melanogaster
tcccatacccata

SEQ ID NO: 648144 - DNA, 13 bp, D. melanogaster
tcccatacccatt

SEQ ID NO: 648145 - DNA, 13 bp, D. melanogaster
tcccatatatata

SEQ ID NO: 648146 - DNA, 13 bp, D. melanogaster
tcccatatcccat

SEQ ID NO: 648147 - DNA, 13 bp, D. melanogaster
tcccatccatcca

SEQ ID NO: 648148 - DNA, 13 bp, D. melanogaster
tcccatccgatcc

SEQ ID NO: 648149 - DNA, 13 bp, D. melanogaster
tcccatctataga

SEQ ID NO: 648150 - DNA, 13 bp, D. melanogaster
tcccatctcccat

SEQ ID NO: 648151 - DNA, 13 bp, D. melanogaster
tcccatgccatcc

SEQ ID NO: 648152 - DNA, 13 bp, D. melanogaster
tcccattaaaact

SEQ ID NO: 648153 - DNA, 13 bp, D. melanogaster
tcccattaccatt

SEQ ID NO: 648154 - DNA, 15 bp, D. melanogaster
tcccattcactttta

SEQ ID NO: 648155 - DNA, 13 bp, D. melanogaster
tcccattcagact

SEQ ID NO: 648156 - DNA, 13 bp, D. melanogaster
tcccattccattc

SEQ ID NO: 648157 - DNA, 13 bp, D. melanogaster
tcccattcccact

SEQ ID NO: 648158 - DNA, 13 bp, D. melanogaster
tcccattcccagc

SEQ ID NO: 648159 - DNA, 13 bp, D. melanogaster
tcccattcccatc

SEQ ID NO: 648160 - DNA, 13 bp, D. melanogaster
tcccattcccatg

SEQ ID NO: 648161 - DNA, 14 bp, D. melanogaster
tcccattcccattg

SEQ ID NO: 648162 - DNA, 14 bp, D. melanogaster
tcccattcccattt

SEQ ID NO: 648163 - DNA, 13 bp, D. melanogaster
tcccattctcatt

SEQ ID NO: 648164 - DNA, 14 bp, D. melanogaster
tcccattgccattt

SEQ ID NO: 648165 - DNA, 13 bp, D. melanogaster
tcccattgcccat

SEQ ID NO: 648166 - DNA, 13 bp, D. melanogaster
tcccattgttgtt

SEQ ID NO: 648167 - DNA, 13 bp, D. melanogaster
tcccatttcaatt

SEQ ID NO: 648168 - DNA, 13 bp, D. melanogaster
tcccatttccatt

SEQ ID NO: 648169 - DNA, 14 bp, D. melanogaster
tcccatttccattc

SEQ ID NO: 648170 - DNA, 13 bp, D. melanogaster
tcccatttcccaa

SEQ ID NO: 648171 - DNA, 13 bp, D. melanogaster
tcccatttccccg

SEQ ID NO: 648172 - DNA, 13 bp, D. melanogaster
tcccatttccgtt

SEQ ID NO: 648173 - DNA, 13 bp, D. melanogaster
tcccatttcgatt

SEQ ID NO: 648174 - DNA, 13 bp, D. melanogaster
tcccatttgccat

SEQ ID NO: 648175 - DNA, 13 bp, D. melanogaster
tcccatttggcca

SEQ ID NO: 648176 - DNA, 13 bp, D. melanogaster
tcccatttgtttt

SEQ ID NO: 648177 - DNA, 13 bp, D. melanogaster
tcccattttccag

SEQ ID NO: 648178 - DNA, 13 bp, D. melanogaster
tcccattttccca

SEQ ID NO: 648179 - DNA, 14 bp, D. melanogaster
tcccattttcccca

SEQ ID NO: 648180 - DNA, 13 bp, D. melanogaster
tcccattttcccg

SEQ ID NO: 648181 - DNA, 13 bp, D. melanogaster
tcccattttccga

SEQ ID NO: 648182 - DNA, 14 bp, D. melanogaster
tcccattttgatat

SEQ ID NO: 648183 - DNA, 13 bp, D. melanogaster
tccccaaaaaaat

SEQ ID NO: 648184 - DNA, 14 bp, D. melanogaster
tccccaactgcaaa

SEQ ID NO: 648185 - DNA, 13 bp, D. melanogaster
tccccacgctggc

SEQ ID NO: 648186 - DNA, 13 bp, D. melanogaster
tccccactcctcg

SEQ ID NO: 648187 - DNA, 13 bp, D. melanogaster
tccccagatcccc

SEQ ID NO: 648188 - DNA, 13 bp, D. melanogaster
tccccatcaccat

SEQ ID NO: 648189 - DNA, 14 bp, D. melanogaster
tccccatcaccatc

SEQ ID NO: 648190 - DNA, 13 bp, D. melanogaster
tccccatcatcat

SEQ ID NO: 648191 - DNA, 13 bp, D. melanogaster
tccccatcctcat

SEQ ID NO: 648192 - DNA, 14 bp, D. melanogaster
tccccatcgacctg

SEQ ID NO: 648193 - DNA, 13 bp, D. melanogaster
tccccatcgccat

SEQ ID NO: 648194 - DNA, 13 bp, D. melanogaster
tccccatgcccat

SEQ ID NO: 648195 - DNA, 13 bp, D. melanogaster
tccccattcccat

SEQ ID NO: 648196 - DNA, 13 bp, D. melanogaster
tccccatttccat

SEQ ID NO: 648197 - DNA, 13 bp, D. melanogaster
tcccccaccatgc

SEQ ID NO: 648198 - DNA, 13 bp, D. melanogaster
tcccccggcagga

SEQ ID NO: 648199 - DNA, 13 bp, D. melanogaster
tccccctaccaaa

SEQ ID NO: 648200 - DNA, 13 bp, D. melanogaster
tccccgactatca

SEQ ID NO: 648201 - DNA, 13 bp, D. melanogaster
tccccgccagaaa

SEQ ID NO: 648202 - DNA, 13 bp, D. melanogaster
tcccctggatgct

SEQ ID NO: 648203 - DNA, 13 bp, D. melanogaster
tcccctttttgat

SEQ ID NO: 648204 - DNA, 13 bp, D. melanogaster
tcccgaagaaacc

SEQ ID NO: 648205 - DNA, 13 bp, D. melanogaster
tcccgacttttcc

SEQ ID NO: 648206 - DNA, 13 bp, D. melanogaster
tcccgatcccaat

SEQ ID NO: 648207 - DNA, 13 bp, D. melanogaster
tcccgattttccc

SEQ ID NO: 648208 - DNA, 13 bp, D. melanogaster
tcccgcagtttgg

SEQ ID NO: 648209 - DNA, 14 bp, D. melanogaster
tcccgccgcagcta

SEQ ID NO: 648210 - DNA, 13 bp, D. melanogaster
tcccgctcccact

SEQ ID NO: 648211 - DNA, 13 bp, D. melanogaster
tcccgctgagagc

SEQ ID NO: 648212 - DNA, 14 bp, D. melanogaster
tcccgcttttccgc

SEQ ID NO: 648213 - DNA, 13 bp, D. melanogaster
tcccgttcccatt

SEQ ID NO: 648214 - DNA, 13 bp, D. melanogaster
tcccgttcccgtt

SEQ ID NO: 648215 - DNA, 13 bp, D. melanogaster
tccctaaacaatt

SEQ ID NO: 648216 - DNA, 14 bp, D. melanogaster
tccctaacaaacgg

SEQ ID NO: 648217 - DNA, 13 bp, D. melanogaster
tccctacagcaaa

SEQ ID NO: 648218 - DNA, 13 bp, D. melanogaster
tccctataatatg

SEQ ID NO: 648219 - DNA, 13 bp, D. melanogaster
tccctcactgaca

SEQ ID NO: 648220 - DNA, 13 bp, D. melanogaster
tccctcgatggtt

SEQ ID NO: 648221 - DNA, 13 bp, D. melanogaster
tccctcgctgctg

SEQ ID NO: 648222 - DNA, 14 bp, D. melanogaster
tccctcgctgctgt

SEQ ID NO: 648223 - DNA, 13 bp, D. melanogaster
tccctgaagttct

SEQ ID NO: 648224 - DNA, 13 bp, D. melanogaster
tccctgctccctg

SEQ ID NO: 648225 - DNA, 13 bp, D. melanogaster
tcccttgaatatt

SEQ ID NO: 648226 - DNA, 13 bp, D. melanogaster
tccctttcgcact

SEQ ID NO: 648227 - DNA, 13 bp, D. melanogaster
tccctttgcaagc

SEQ ID NO: 648228 - DNA, 13 bp, D. melanogaster
tcccttttggctg

SEQ ID NO: 648229 - DNA, 14 bp, D. melanogaster
tccctttttgccac

SEQ ID NO: 648230 - DNA, 14 bp, D. melanogaster
tccgaaaaaaaaag

SEQ ID NO: 648231 - DNA, 14 bp, D. melanogaster
tccgaaaaaaaaga

SEQ ID NO: 648232 - DNA, 13 bp, D. melanogaster
tccgaaaaacata

SEQ ID NO: 648233 - DNA, 13 bp, D. melanogaster
tccgaaaatgtgt

SEQ ID NO: 648234 - DNA, 13 bp, D. melanogaster
tccgaaacaaaac

SEQ ID NO: 648235 - DNA, 13 bp, D. melanogaster
tccgaaacaatcg

SEQ ID NO: 648236 - DNA, 13 bp, D. melanogaster
tccgaaacaattt

SEQ ID NO: 648237 - DNA, 13 bp, D. melanogaster
tccgaaacagttt

SEQ ID NO: 648238 - DNA, 13 bp, D. melanogaster
tccgaaacataca

SEQ ID NO: 648239 - DNA, 13 bp, D. melanogaster
tccgaaagaaacc

SEQ ID NO: 648240 - DNA, 13 bp, D. melanogaster
tccgaaagaagca

SEQ ID NO: 648241 - DNA, 13 bp, D. melanogaster
tccgaaagtgaag

SEQ ID NO: 648242 - DNA, 13 bp, D. melanogaster
tccgaaatccgaa

SEQ ID NO: 648243 - DNA, 13 bp, D. melanogaster
tccgaaattattt

SEQ ID NO: 648244 - DNA, 13 bp, D. melanogaster
tccgaatacgaat

SEQ ID NO: 648245 - DNA, 13 bp, D. melanogaster
tccgaatatgaac

SEQ ID NO: 648246 - DNA, 15 bp, D. melanogaster
tccgaatccaaatcc

SEQ ID NO: 648247 - DNA, 13 bp, D. melanogaster
tccgaatccgaat

SEQ ID NO: 648248 - DNA, 14 bp, D. melanogaster
tccgaatccgaatc

SEQ ID NO: 648249 - DNA, 13 bp, D. melanogaster
tccgaatccgatt

SEQ ID NO: 648250 - DNA, 13 bp, D. melanogaster
tccgaatcggaat

SEQ ID NO: 648251 - DNA, 14 bp, D. melanogaster
tccgaatcggaatc

SEQ ID NO: 648252 - DNA, 13 bp, D. melanogaster
tccgaatcttttt

SEQ ID NO: 648253 - DNA, 13 bp, D. melanogaster
tccgaattatggc

SEQ ID NO: 648254 - DNA, 14 bp, D. melanogaster
tccgaattcgattt

SEQ ID NO: 648255 - DNA, 13 bp, D. melanogaster
tccgaattttgta

SEQ ID NO: 648256 - DNA, 13 bp, D. melanogaster
tccgacaaaagta

SEQ ID NO: 648257 - DNA, 13 bp, D. melanogaster
tccgacaaattca

SEQ ID NO: 648258 - DNA, 13 bp, D. melanogaster
tccgacattcgct

SEQ ID NO: 648259 - DNA, 13 bp, D. melanogaster
tccgaccaaaaac

SEQ ID NO: 648260 - DNA, 13 bp, D. melanogaster
tccgaccaaatcc

SEQ ID NO: 648261 - DNA, 13 bp, D. melanogaster
tccgaccctataa

SEQ ID NO: 648262 - DNA, 13 bp, D. melanogaster
tccgactatcaga

SEQ ID NO: 648263 - DNA, 13 bp, D. melanogaster
tccgactccgact

SEQ ID NO: 648264 - DNA, 13 bp, D. melanogaster
tccgagctaaata

SEQ ID NO: 648265 - DNA, 13 bp, D. melanogaster
tccgagggtcagc

SEQ ID NO: 648266 - DNA, 13 bp, D. melanogaster
tccgatccaatcc

SEQ ID NO: 648267 - DNA, 13 bp, D. melanogaster
tccgatcccatcc

SEQ ID NO: 648268 - DNA, 13 bp, D. melanogaster
tccgatccgatcc

SEQ ID NO: 648269 - DNA, 14 bp, D. melanogaster
tccgatccgatcca

SEQ ID NO: 648270 - DNA, 13 bp, D. melanogaster
tccgatcggatcg

SEQ ID NO: 648271 - DNA, 13 bp, D. melanogaster
tccgatgatttgt

SEQ ID NO: 648272 - DNA, 13 bp, D. melanogaster
tccgatggcccag

SEQ ID NO: 648273 - DNA, 13 bp, D. melanogaster
tccgattcagatt

SEQ ID NO: 648274 - DNA, 13 bp, D. melanogaster
tccgattccgaat

SEQ ID NO: 648275 - DNA, 13 bp, D. melanogaster
tccgattccgatc

SEQ ID NO: 648276 - DNA, 14 bp, D. melanogaster
tccgattccgattt

SEQ ID NO: 648277 - DNA, 13 bp, D. melanogaster
tccgattcggatt

SEQ ID NO: 648278 - DNA, 14 bp, D. melanogaster
tccgattcggattc

SEQ ID NO: 648279 - DNA, 13 bp, D. melanogaster
tccgatttcgatt

SEQ ID NO: 648280 - DNA, 14 bp, D. melanogaster
tccgatttcgattc

SEQ ID NO: 648281 - DNA, 13 bp, D. melanogaster
tccgatttgattt

SEQ ID NO: 648282 - DNA, 13 bp, D. melanogaster
tccgattttacag

SEQ ID NO: 648283 - DNA, 13 bp, D. melanogaster
tccgcaaattctt

SEQ ID NO: 648284 - DNA, 13 bp, D. melanogaster
tccgcacaaaatc

SEQ ID NO: 648285 - DNA, 13 bp, D. melanogaster
tccgcacttcgtg

SEQ ID NO: 648286 - DNA, 13 bp, D. melanogaster
tccgcagccgcat

SEQ ID NO: 648287 - DNA, 13 bp, D. melanogaster
tccgcatcagcat

SEQ ID NO: 648288 - DNA, 14 bp, D. melanogaster
tccgcatccgaatc

SEQ ID NO: 648289 - DNA, 14 bp, D. melanogaster
tccgcatccgcatc

SEQ ID NO: 648290 - DNA, 13 bp, D. melanogaster
tccgcatccgtat

SEQ ID NO: 648291 - DNA, 13 bp, D. melanogaster
tccgcatgatcca

SEQ ID NO: 648292 - DNA, 13 bp, D. melanogaster
tccgcattcgcag

SEQ ID NO: 648293 - DNA, 13 bp, D. melanogaster
tccgcatttgcat

SEQ ID NO: 648294 - DNA, 13 bp, D. melanogaster
tccgcattttccg

SEQ ID NO: 648295 - DNA, 13 bp, D. melanogaster
tccgccaactcag

SEQ ID NO: 648296 - DNA, 14 bp, D. melanogaster
tccgccatccgcca

SEQ ID NO: 648297 - DNA, 14 bp, D. melanogaster
tccgcccaccacca

SEQ ID NO: 648298 - DNA, 13 bp, D. melanogaster
tccgcccactttt

SEQ ID NO: 648299 - DNA, 13 bp, D. melanogaster
tccgccgtgaacc

SEQ ID NO: 648300 - DNA, 13 bp, D. melanogaster
tccgcctgtccgt

SEQ ID NO: 648301 - DNA, 13 bp, D. melanogaster
tccgcgagaagag

SEQ ID NO: 648302 - DNA, 13 bp, D. melanogaster
tccgcgagattgc

SEQ ID NO: 648303 - DNA, 13 bp, D. melanogaster
tccgcgccagctg

SEQ ID NO: 648304 - DNA, 14 bp, D. melanogaster
tccgctccgctccg

SEQ ID NO: 648305 - DNA, 13 bp, D. melanogaster
tccgctcgcttac

SEQ ID NO: 648306 - DNA, 13 bp, D. melanogaster
tccgctgcaacaa

SEQ ID NO: 648307 - DNA, 13 bp, D. melanogaster
tccgctgccgaat

SEQ ID NO: 648308 - DNA, 14 bp, D. melanogaster
tccgctgccgaatc

SEQ ID NO: 648309 - DNA, 13 bp, D. melanogaster
tccgctggccaaa

SEQ ID NO: 648310 - DNA, 13 bp, D. melanogaster
tccgctggctttg

SEQ ID NO: 648311 - DNA, 13 bp, D. melanogaster
tccgctgtccgtt

SEQ ID NO: 648312 - DNA, 13 bp, D. melanogaster
tccgcttccgctt

SEQ ID NO: 648313 - DNA, 13 bp, D. melanogaster
tccgcttttccgc

SEQ ID NO: 648314 - DNA, 14 bp, D. melanogaster
tccgcttttccgct

SEQ ID NO: 648315 - DNA, 13 bp, D. melanogaster
tccgcttttgctt

SEQ ID NO: 648316 - DNA, 13 bp, D. melanogaster
tccggagtccgga

SEQ ID NO: 648317 - DNA, 13 bp, D. melanogaster
tccggatttcagc

SEQ ID NO: 648318 - DNA, 13 bp, D. melanogaster
tccggattttagg

SEQ ID NO: 648319 - DNA, 13 bp, D. melanogaster
tccggccaaatgc

SEQ ID NO: 648320 - DNA, 13 bp, D. melanogaster
tccggccgaatgc

SEQ ID NO: 648321 - DNA, 13 bp, D. melanogaster
tccggctccggtt

SEQ ID NO: 648322 - DNA, 15 bp, D. melanogaster
tccggctcgaaggac

SEQ ID NO: 648323 - DNA, 13 bp, D. melanogaster
tccgggtccgggt

SEQ ID NO: 648324 - DNA, 13 bp, D. melanogaster
tccggtgttataa

SEQ ID NO: 648325 - DNA, 13 bp, D. melanogaster
tccggtttctttg

SEQ ID NO: 648326 - DNA, 13 bp, D. melanogaster
tccgtaaactgca

SEQ ID NO: 648327 - DNA, 13 bp, D. melanogaster
tccgtatcaaaat

SEQ ID NO: 648328 - DNA, 14 bp, D. melanogaster
tccgtatccgaatc

SEQ ID NO: 648329 - DNA, 14 bp, D. melanogaster
tccgtatccgcatc

SEQ ID NO: 648330 - DNA, 14 bp, D. melanogaster
tccgtatccgtatc

SEQ ID NO: 648331 - DNA, 13 bp, D. melanogaster
tccgtatccgtgt

SEQ ID NO: 648332 - DNA, 14 bp, D. melanogaster
tccgtatccgtgtc

SEQ ID NO: 648333 - DNA, 14 bp, D. melanogaster
tccgtatctgtatc

SEQ ID NO: 648334 - DNA, 13 bp, D. melanogaster
tccgtatctgtgt

SEQ ID NO: 648335 - DNA, 14 bp, D. melanogaster
tccgtatgaacgtt

SEQ ID NO: 648336 - DNA, 13 bp, D. melanogaster
tccgtatgtgttg

SEQ ID NO: 648337 - DNA, 13 bp, D. melanogaster
tccgtattccgta

SEQ ID NO: 648338 - DNA, 13 bp, D. melanogaster
tccgtcacaattt

SEQ ID NO: 648339 - DNA, 13 bp, D. melanogaster
tccgtccgcctgt

SEQ ID NO: 648340 - DNA, 13 bp, D. melanogaster
tccgtccgtatga

SEQ ID NO: 648341 - DNA, 13 bp, D. melanogaster
tccgtccgtccgt

SEQ ID NO: 648342 - DNA, 14 bp, D. melanogaster
tccgtccgtccgtc

SEQ ID NO: 648343 - DNA, 13 bp, D. melanogaster
tccgtcgatgttt

SEQ ID NO: 648344 - DNA, 13 bp, D. melanogaster
tccgtctccatct

SEQ ID NO: 648345 - DNA, 13 bp, D. melanogaster
tccgtctcgctct

SEQ ID NO: 648346 - DNA, 13 bp, D. melanogaster
tccgtctctttcg

SEQ ID NO: 648347 - DNA, 13 bp, D. melanogaster
tccgtctgcaatg

SEQ ID NO: 648348 - DNA, 13 bp, D. melanogaster
tccgtctgttcag

SEQ ID NO: 648349 - DNA, 13 bp, D. melanogaster
tccgtgattgcgt

SEQ ID NO: 648350 - DNA, 13 bp, D. melanogaster
tccgtgctccgtg

SEQ ID NO: 648351 - DNA, 14 bp, D. melanogaster
tccgtgctgaattt

SEQ ID NO: 648352 - DNA, 13 bp, D. melanogaster
tccgtgtccatgt

SEQ ID NO: 648353 - DNA, 14 bp, D. melanogaster
tccgtgtccgtgtc

SEQ ID NO: 648354 - DNA, 14 bp, D. melanogaster
tccgtgtgtgtgtg

SEQ ID NO: 648355 - DNA, 13 bp, D. melanogaster
tccgttccgttcc

SEQ ID NO: 648356 - DNA, 14 bp, D. melanogaster
tccgttccgttccg

SEQ ID NO: 648357 - DNA, 13 bp, D. melanogaster
tccgttccgttcg

SEQ ID NO: 648358 - DNA, 13 bp, D. melanogaster
tccgttccgtttt

SEQ ID NO: 648359 - DNA, 13 bp, D. melanogaster
tccgttcgacact

SEQ ID NO: 648360 - DNA, 13 bp, D. melanogaster
tccgttctccatt

SEQ ID NO: 648361 - DNA, 13 bp, D. melanogaster
tccgttgccagta

SEQ ID NO: 648362 - DNA, 13 bp, D. melanogaster
tccgtttcagttt

SEQ ID NO: 648363 - DNA, 14 bp, D. melanogaster
tccgtttccgctgc

SEQ ID NO: 648364 - DNA, 14 bp, D. melanogaster
tccgtttccgtttc

SEQ ID NO: 648365 - DNA, 13 bp, D. melanogaster
tccgtttgccatt

SEQ ID NO: 648366 - DNA, 13 bp, D. melanogaster
tccgtttggttta

SEQ ID NO: 648367 - DNA, 13 bp, D. melanogaster
tccgtttgtccat

SEQ ID NO: 648368 - DNA, 13 bp, D. melanogaster
tccgtttgtccgt

SEQ ID NO: 648369 - DNA, 14 bp, D. melanogaster
tccgtttgtccgtc

SEQ ID NO: 648370 - DNA, 13 bp, D. melanogaster
tccgttttaatgg

SEQ ID NO: 648371 - DNA, 13 bp, D. melanogaster
tccgttttacaat

SEQ ID NO: 648372 - DNA, 14 bp, D. melanogaster
tccgttttccattt

SEQ ID NO: 648373 - DNA, 13 bp, D. melanogaster
tccgttttggcca

SEQ ID NO: 648374 - DNA, 14 bp, D. melanogaster
tccgtttttccgaa

SEQ ID NO: 648375 - DNA, 13 bp, D. melanogaster
tcctaaaaactat

SEQ ID NO: 648376 - DNA, 14 bp, D. melanogaster
tcctaaaaatgata

SEQ ID NO: 648377 - DNA, 13 bp, D. melanogaster
tcctaaagaaata

SEQ ID NO: 648378 - DNA, 13 bp, D. melanogaster
tcctaaggccaaa

SEQ ID NO: 648379 - DNA, 13 bp, D. melanogaster
tcctaataatata

SEQ ID NO: 648380 - DNA, 13 bp, D. melanogaster
tcctagaaaaaac

SEQ ID NO: 648381 - DNA, 13 bp, D. melanogaster
tcctaggctttta

SEQ ID NO: 648382 - DNA, 14 bp, D. melanogaster
tcctataaatgtat

SEQ ID NO: 648383 - DNA, 13 bp, D. melanogaster
tcctatcaccatt

SEQ ID NO: 648384 - DNA, 14 bp, D. melanogaster
tcctatcaccatta

SEQ ID NO: 648385 - DNA, 13 bp, D. melanogaster
tcctatcctatcc

SEQ ID NO: 648386 - DNA, 13 bp, D. melanogaster
tcctcaaattttc

SEQ ID NO: 648387 - DNA, 13 bp, D. melanogaster
tcctcaccgatct

SEQ ID NO: 648388 - DNA, 13 bp, D. melanogaster
tcctcagcggtat

SEQ ID NO: 648389 - DNA, 14 bp, D. melanogaster
tcctcatccgcatc

SEQ ID NO: 648390 - DNA, 14 bp, D. melanogaster
tcctcatcctcatc

SEQ ID NO: 648391 - DNA, 13 bp, D. melanogaster
tcctccaataccc

SEQ ID NO: 648392 - DNA, 13 bp, D. melanogaster
tcctccagctcca

SEQ ID NO: 648393 - DNA, 13 bp, D. melanogaster
tcctccagctcct

SEQ ID NO: 648394 - DNA, 14 bp, D. melanogaster
tcctccagctcctc

SEQ ID NO: 648395 - DNA, 13 bp, D. melanogaster
tcctccagctgct

SEQ ID NO: 648396 - DNA, 13 bp, D. melanogaster
tcctccgcagaaa

SEQ ID NO: 648397 - DNA, 13 bp, D. melanogaster
tcctccgtcttat

SEQ ID NO: 648398 - DNA, 13 bp, D. melanogaster
tcctcctccggct

SEQ ID NO: 648399 - DNA, 13 bp, D. melanogaster
tcctcctggctgg

SEQ ID NO: 648400 - DNA, 13 bp, D. melanogaster
tcctcgaagccgt

SEQ ID NO: 648401 - DNA, 14 bp, D. melanogaster
tcctcgactatcag

SEQ ID NO: 648402 - DNA, 13 bp, D. melanogaster
tcctcgattttcc

SEQ ID NO: 648403 - DNA, 13 bp, D. melanogaster
tcctcgcatttcc

SEQ ID NO: 648404 - DNA, 13 bp, D. melanogaster
tcctcgcattttc

SEQ ID NO: 648405 - DNA, 14 bp, D. melanogaster
tcctcgtcctcgtc

SEQ ID NO: 648406 - DNA, 13 bp, D. melanogaster
tcctcgtcgtcgt

SEQ ID NO: 648407 - DNA, 13 bp, D. melanogaster
tcctcgtcgttgc

SEQ ID NO: 648408 - DNA, 13 bp, D. melanogaster
tcctcgtcttgtg

SEQ ID NO: 648409 - DNA, 13 bp, D. melanogaster
tcctctatattat

SEQ ID NO: 648410 - DNA, 13 bp, D. melanogaster
tcctctgccattt

SEQ ID NO: 648411 - DNA, 13 bp, D. melanogaster
tcctctgctgctg

SEQ ID NO: 648412 - DNA, 13 bp, D. melanogaster
tcctcttcactac

SEQ ID NO: 648413 - DNA, 13 bp, D. melanogaster
tcctcttctgcac

SEQ ID NO: 648414 - DNA, 13 bp, D. melanogaster
tcctctttaaaaa

SEQ ID NO: 648415 - DNA, 13 bp, D. melanogaster
tcctgaaaaatgt

SEQ ID NO: 648416 - DNA, 13 bp, D. melanogaster
tcctgaacgcttg

SEQ ID NO: 648417 - DNA, 13 bp, D. melanogaster
tcctgaagctgga

SEQ ID NO: 648418 - DNA, 13 bp, D. melanogaster
tcctgaccaactt

SEQ ID NO: 648419 - DNA, 13 bp, D. melanogaster
tcctgatcaaaaa

SEQ ID NO: 648420 - DNA, 14 bp, D. melanogaster
tcctgatcaaaaat

SEQ ID NO: 648421 - DNA, 13 bp, D. melanogaster
tcctgatcaagaa

SEQ ID NO: 648422 - DNA, 13 bp, D. melanogaster
tcctgatcccatt

SEQ ID NO: 648423 - DNA, 13 bp, D. melanogaster
tcctgatggtcct

SEQ ID NO: 648424 - DNA, 14 bp, D. melanogaster
tcctgatggtcctc

SEQ ID NO: 648425 - DNA, 13 bp, D. melanogaster
tcctgattctgtt

SEQ ID NO: 648426 - DNA, 13 bp, D. melanogaster
tcctgattttcgc

SEQ ID NO: 648427 - DNA, 13 bp, D. melanogaster
tcctgcacacaca

SEQ ID NO: 648428 - DNA, 13 bp, D. melanogaster
tcctgcagagcca

SEQ ID NO: 648429 - DNA, 13 bp, D. melanogaster
tcctgcagatcct

SEQ ID NO: 648430 - DNA, 13 bp, D. melanogaster
tcctgcagcaata

SEQ ID NO: 648431 - DNA, 14 bp, D. melanogaster
tcctgcagcaatac

SEQ ID NO: 648432 - DNA, 13 bp, D. melanogaster
tcctgcagcagga

SEQ ID NO: 648433 - DNA, 13 bp, D. melanogaster
tcctgcagctcct

SEQ ID NO: 648434 - DNA, 14 bp, D. melanogaster
tcctgcagctcctt

SEQ ID NO: 648435 - DNA, 13 bp, D. melanogaster
tcctgcatcctgc

SEQ ID NO: 648436 - DNA, 14 bp, D. melanogaster
tcctgcatcctgca

SEQ ID NO: 648437 - DNA, 13 bp, D. melanogaster
tcctgcatcttta

SEQ ID NO: 648438 - DNA, 13 bp, D. melanogaster
tcctgcatctttc

SEQ ID NO: 648439 - DNA, 13 bp, D. melanogaster
tcctgcatgtcct

SEQ ID NO: 648440 - DNA, 13 bp, D. melanogaster
tcctgcattttcc

SEQ ID NO: 648441 - DNA, 13 bp, D. melanogaster
tcctgccattcag

SEQ ID NO: 648442 - DNA, 13 bp, D. melanogaster
tcctgccattttc

SEQ ID NO: 648443 - DNA, 13 bp, D. melanogaster
tcctgccccatcc

SEQ ID NO: 648444 - DNA, 13 bp, D. melanogaster
tcctgccgctcct

SEQ ID NO: 648445 - DNA, 13 bp, D. melanogaster
tcctgccgctgct

SEQ ID NO: 648446 - DNA, 13 bp, D. melanogaster
tcctgccgctttt

SEQ ID NO: 648447 - DNA, 13 bp, D. melanogaster
tcctgcctcctgc

SEQ ID NO: 648448 - DNA, 13 bp, D. melanogaster
tcctgcctcttgg

SEQ ID NO: 648449 - DNA, 16 bp, D. melanogaster
tcctgcgaatgcggac

SEQ ID NO: 648450 - DNA, 13 bp, D. melanogaster
tcctgcgagtcct

SEQ ID NO: 648451 - DNA, 13 bp, D. melanogaster
tcctgcgcaggat

SEQ ID NO: 648452 - DNA, 14 bp, D. melanogaster
tcctgcgcaggatt

SEQ ID NO: 648453 - DNA, 13 bp, D. melanogaster
tcctgcgtcctgc

SEQ ID NO: 648454 - DNA, 13 bp, D. melanogaster
tcctgcgtcctgg

SEQ ID NO: 648455 - DNA, 13 bp, D. melanogaster
tcctgcgtccttt

SEQ ID NO: 648456 - DNA, 13 bp, D. melanogaster
tcctgctcaccga

SEQ ID NO: 648457 - DNA, 13 bp, D. melanogaster
tcctgctcctccg

SEQ ID NO: 648458 - DNA, 13 bp, D. melanogaster
tcctgctcctgat

SEQ ID NO: 648459 - DNA, 13 bp, D. melanogaster
tcctgctcctgct

SEQ ID NO: 648460 - DNA, 13 bp, D. melanogaster
tcctgctcctggc

SEQ ID NO: 648461 - DNA, 13 bp, D. melanogaster
tcctgctcctgtt

SEQ ID NO: 648462 - DNA, 14 bp, D. melanogaster
tcctgctcctgttt

SEQ ID NO: 648463 - DNA, 13 bp, D. melanogaster
tcctgctcctttg

SEQ ID NO: 648464 - DNA, 13 bp, D. melanogaster
tcctgctcgtcct

SEQ ID NO: 648465 - DNA, 13 bp, D. melanogaster
tcctgctgatgct

SEQ ID NO: 648466 - DNA, 13 bp, D. melanogaster
tcctgctgccgct

SEQ ID NO: 648467 - DNA, 14 bp, D. melanogaster
tcctgctgctcctg

SEQ ID NO: 648468 - DNA, 13 bp, D. melanogaster
tcctgctgctgat

SEQ ID NO: 648469 - DNA, 14 bp, D. melanogaster
tcctgctgctgctg

SEQ ID NO: 648470 - DNA, 13 bp, D. melanogaster
tcctgctgctgtt

SEQ ID NO: 648471 - DNA, 14 bp, D. melanogaster
tcctgctgctgttg

SEQ ID NO: 648472 - DNA, 14 bp, D. melanogaster
tcctgctgcttctg

SEQ ID NO: 648473 - DNA, 13 bp, D. melanogaster
tcctgctgttgct

SEQ ID NO: 648474 - DNA, 13 bp, D. melanogaster
tcctgctgttgtt

SEQ ID NO: 648475 - DNA, 13 bp, D. melanogaster
tcctggaaaaagg

SEQ ID NO: 648476 - DNA, 13 bp, D. melanogaster
tcctggaaaatgt

SEQ ID NO: 648477 - DNA, 13 bp, D. melanogaster
tcctggagtcctg

SEQ ID NO: 648478 - DNA, 13 bp, D. melanogaster
tcctggatcctgg

SEQ ID NO: 648479 - DNA, 13 bp, D. melanogaster
tcctggcacatcc

SEQ ID NO: 648480 - DNA, 13 bp, D. melanogaster
tcctggcatcctg

SEQ ID NO: 648481 - DNA, 14 bp, D. melanogaster
tcctggcatcctgg

SEQ ID NO: 648482 - DNA, 13 bp, D. melanogaster
tcctggcattttg

SEQ ID NO: 648483 - DNA, 13 bp, D. melanogaster
tcctggccaaagg

SEQ ID NO: 648484 - DNA, 13 bp, D. melanogaster
tcctggccaagga

SEQ ID NO: 648485 - DNA, 13 bp, D. melanogaster
tcctggccagaaa

SEQ ID NO: 648486 - DNA, 13 bp, D. melanogaster
tcctggccagcag

SEQ ID NO: 648487 - DNA, 13 bp, D. melanogaster
tcctggccaggac

SEQ ID NO: 648488 - DNA, 13 bp, D. melanogaster
tcctggccattca

SEQ ID NO: 648489 - DNA, 13 bp, D. melanogaster
tcctggccgtcca

SEQ ID NO: 648490 - DNA, 13 bp, D. melanogaster
tcctggctcctgg

SEQ ID NO: 648491 - DNA, 14 bp, D. melanogaster
tcctggctgccact

SEQ ID NO: 648492 - DNA, 13 bp, D. melanogaster
tcctggctgctcc

SEQ ID NO: 648493 - DNA, 13 bp, D. melanogaster
tcctggctgctgc

SEQ ID NO: 648494 - DNA, 13 bp, D. melanogaster
tcctggctgctgg

SEQ ID NO: 648495 - DNA, 13 bp, D. melanogaster
tcctggctgggtg

SEQ ID NO: 648496 - DNA, 13 bp, D. melanogaster
tcctggctttgga

SEQ ID NO: 648497 - DNA, 13 bp, D. melanogaster
tcctgggcgcaat

SEQ ID NO: 648498 - DNA, 13 bp, D. melanogaster
tcctgggtcctgg

SEQ ID NO: 648499 - DNA, 13 bp, D. melanogaster
tcctggttttccc

SEQ ID NO: 648500 - DNA, 13 bp, D. melanogaster
tcctgtacaatgt

SEQ ID NO: 648501 - DNA, 13 bp, D. melanogaster
tcctgtcctgtcc

SEQ ID NO: 648502 - DNA, 13 bp, D. melanogaster
tcctgtggaagat

SEQ ID NO: 648503 - DNA, 13 bp, D. melanogaster
tcctgtggctttt

SEQ ID NO: 648504 - DNA, 14 bp, D. melanogaster
tcctgtgtgtgtgt

SEQ ID NO: 648505 - DNA, 13 bp, D. melanogaster
tcctgttcaaaat

SEQ ID NO: 648506 - DNA, 13 bp, D. melanogaster
tcctgttcctgct

SEQ ID NO: 648507 - DNA, 14 bp, D. melanogaster
tcctgttcctgctc

SEQ ID NO: 648508 - DNA, 13 bp, D. melanogaster
tcctgttcctgtt

SEQ ID NO: 648509 - DNA, 14 bp, D. melanogaster
tcctgttcctgttc

SEQ ID NO: 648510 - DNA, 13 bp, D. melanogaster
tcctgttcgtcct

SEQ ID NO: 648511 - DNA, 13 bp, D. melanogaster
tcctgttgtcctg

SEQ ID NO: 648512 - DNA, 13 bp, D. melanogaster
tcctgtttagctt

SEQ ID NO: 648513 - DNA, 13 bp, D. melanogaster
tccttaaaaatat

SEQ ID NO: 648514 - DNA, 13 bp, D. melanogaster
tccttaaaaatta

SEQ ID NO: 648515 - DNA, 15 bp, D. melanogaster
tccttaatatctatt

SEQ ID NO: 648516 - DNA, 13 bp, D. melanogaster
tccttaatcattt

SEQ ID NO: 648517 - DNA, 13 bp, D. melanogaster
tccttagtcaact

SEQ ID NO: 648518 - DNA, 13 bp, D. melanogaster
tccttagtccttg

SEQ ID NO: 648519 - DNA, 13 bp, D. melanogaster
tccttatgagcat

SEQ ID NO: 648520 - DNA, 13 bp, D. melanogaster
tccttattgtttg

SEQ ID NO: 648521 - DNA, 13 bp, D. melanogaster
tccttcaaaaagt

SEQ ID NO: 648522 - DNA, 13 bp, D. melanogaster
tccttccaaggga

SEQ ID NO: 648523 - DNA, 13 bp, D. melanogaster
tccttccatatat

SEQ ID NO: 648524 - DNA, 13 bp, D. melanogaster
tccttcgagtcct

SEQ ID NO: 648525 - DNA, 13 bp, D. melanogaster
tccttcgatgact

SEQ ID NO: 648526 - DNA, 14 bp, D. melanogaster
tccttcgtcctgcc

SEQ ID NO: 648527 - DNA, 13 bp, D. melanogaster
tccttcgtcctgg

SEQ ID NO: 648528 - DNA, 13 bp, D. melanogaster
tccttctgatgga

SEQ ID NO: 648529 - DNA, 14 bp, D. melanogaster
tccttctgatggat

SEQ ID NO: 648530 - DNA, 13 bp, D. melanogaster
tccttctgcctgc

SEQ ID NO: 648531 - DNA, 13 bp, D. melanogaster
tccttctgcctgt

SEQ ID NO: 648532 - DNA, 13 bp, D. melanogaster
tccttcttttgca

SEQ ID NO: 648533 - DNA, 13 bp, D. melanogaster
tccttgaatattt

SEQ ID NO: 648534 - DNA, 13 bp, D. melanogaster
tccttgaatggaa

SEQ ID NO: 648535 - DNA, 13 bp, D. melanogaster
tccttgaattgga

SEQ ID NO: 648536 - DNA, 14 bp, D. melanogaster
tccttgcagttggg

SEQ ID NO: 648537 - DNA, 13 bp, D. melanogaster
tccttgcgtgcgt

SEQ ID NO: 648538 - DNA, 13 bp, D. melanogaster
tccttgctccttg

SEQ ID NO: 648539 - DNA, 13 bp, D. melanogaster
tccttgctcgctc

SEQ ID NO: 648540 - DNA, 13 bp, D. melanogaster
tccttggcatttg

SEQ ID NO: 648541 - DNA, 13 bp, D. melanogaster
tccttggccaaaa

SEQ ID NO: 648542 - DNA, 13 bp, D. melanogaster
tccttggccacat

SEQ ID NO: 648543 - DNA, 13 bp, D. melanogaster
tccttggccattt

SEQ ID NO: 648544 - DNA, 13 bp, D. melanogaster
tccttggctcctt

SEQ ID NO: 648545 - DNA, 13 bp, D. melanogaster
tccttggtcctgg

SEQ ID NO: 648546 - DNA, 13 bp, D. melanogaster
tccttggtccttc

SEQ ID NO: 648547 - DNA, 13 bp, D. melanogaster
tccttggtgggcg

SEQ ID NO: 648548 - DNA, 13 bp, D. melanogaster
tccttgtccaaaa

SEQ ID NO: 648549 - DNA, 13 bp, D. melanogaster
tccttgtcgtcct

SEQ ID NO: 648550 - DNA, 13 bp, D. melanogaster
tccttgtgctcct

SEQ ID NO: 648551 - DNA, 13 bp, D. melanogaster
tccttgtgtgtgt

SEQ ID NO: 648552 - DNA, 14 bp, D. melanogaster
tccttgtgtgtgtg

SEQ ID NO: 648553 - DNA, 13 bp, D. melanogaster
tccttgttgctgt

SEQ ID NO: 648554 - DNA, 13 bp, D. melanogaster
tccttgttgtcct

SEQ ID NO: 648555 - DNA, 13 bp, D. melanogaster
tcctttaaatgtt

SEQ ID NO: 648556 - DNA, 13 bp, D. melanogaster
tcctttaagcatt

SEQ ID NO: 648557 - DNA, 13 bp, D. melanogaster
tcctttaataaaa

SEQ ID NO: 648558 - DNA, 13 bp, D. melanogaster
tcctttatatgga

SEQ ID NO: 648559 - DNA, 13 bp, D. melanogaster
tcctttccaattt

SEQ ID NO: 648560 - DNA, 13 bp, D. melanogaster
tcctttcgaattt

SEQ ID NO: 648561 - DNA, 13 bp, D. melanogaster
tcctttcgatggc

SEQ ID NO: 648562 - DNA, 13 bp, D. melanogaster
tcctttcgatttg

SEQ ID NO: 648563 - DNA, 13 bp, D. melanogaster
tcctttcgtcctg

SEQ ID NO: 648564 - DNA, 13 bp, D. melanogaster
tcctttctgcatt

SEQ ID NO: 648565 - DNA, 13 bp, D. melanogaster
tcctttgaattgt

SEQ ID NO: 648566 - DNA, 13 bp, D. melanogaster
tcctttgattttc

SEQ ID NO: 648567 - DNA, 13 bp, D. melanogaster
tcctttgccaaaa

SEQ ID NO: 648568 - DNA, 13 bp, D. melanogaster
tcctttgcctttg

SEQ ID NO: 648569 - DNA, 13 bp, D. melanogaster
tcctttgctctga

SEQ ID NO: 648570 - DNA, 13 bp, D. melanogaster
tcctttgctttgg

SEQ ID NO: 648571 - DNA, 13 bp, D. melanogaster
tcctttggactga

SEQ ID NO: 648572 - DNA, 13 bp, D. melanogaster
tcctttggatttt

SEQ ID NO: 648573 - DNA, 13 bp, D. melanogaster
tcctttggccagc

SEQ ID NO: 648574 - DNA, 13 bp, D. melanogaster
tcctttggccagg

SEQ ID NO: 648575 - DNA, 13 bp, D. melanogaster
tcctttggctcct

SEQ ID NO: 648576 - DNA, 13 bp, D. melanogaster
tcctttggctttc

SEQ ID NO: 648577 - DNA, 13 bp, D. melanogaster
tcctttggtcctt

SEQ ID NO: 648578 - DNA, 13 bp, D. melanogaster
tcctttgtaaata

SEQ ID NO: 648579 - DNA, 13 bp, D. melanogaster
tcctttgtctgtg

SEQ ID NO: 648580 - DNA, 13 bp, D. melanogaster
tcctttgtgtcct

SEQ ID NO: 648581 - DNA, 13 bp, D. melanogaster
tcctttgtttgcc

SEQ ID NO: 648582 - DNA, 13 bp, D. melanogaster
tcctttgtttggc

SEQ ID NO: 648583 - DNA, 14 bp, D. melanogaster
tccttttaaaaact

SEQ ID NO: 648584 - DNA, 13 bp, D. melanogaster
tccttttaagcca

SEQ ID NO: 648585 - DNA, 13 bp, D. melanogaster
tccttttgatcat

SEQ ID NO: 648586 - DNA, 13 bp, D. melanogaster
tccttttgccaaa

SEQ ID NO: 648587 - DNA, 13 bp, D. melanogaster
tccttttgccatt

SEQ ID NO: 648588 - DNA, 13 bp, D. melanogaster
tccttttggcatt

SEQ ID NO: 648589 - DNA, 13 bp, D. melanogaster
tccttttggccag

SEQ ID NO: 648590 - DNA, 13 bp, D. melanogaster
tccttttggccat

SEQ ID NO: 648591 - DNA, 13 bp, D. melanogaster
tccttttggccgc

SEQ ID NO: 648592 - DNA, 13 bp, D. melanogaster
tccttttggcctc

SEQ ID NO: 648593 - DNA, 13 bp, D. melanogaster
tccttttggcctt

SEQ ID NO: 648594 - DNA, 13 bp, D. melanogaster
tccttttggtcct

SEQ ID NO: 648595 - DNA, 13 bp, D. melanogaster
tccttttgtcaga

SEQ ID NO: 648596 - DNA, 13 bp, D. melanogaster
tcctttttaatgt

SEQ ID NO: 648597 - DNA, 13 bp, D. melanogaster
tcctttttagcca

SEQ ID NO: 648598 - DNA, 13 bp, D. melanogaster
tcctttttgccat

SEQ ID NO: 648599 - DNA, 13 bp, D. melanogaster
tcctttttgcctg

SEQ ID NO: 648600 - DNA, 13 bp, D. melanogaster
tcctttttggctg

SEQ ID NO: 648601 - DNA, 13 bp, D. melanogaster
tccttttttggcc

SEQ ID NO: 648602 - DNA, 14 bp, D. melanogaster
tcgaaaaaaaattt

SEQ ID NO: 648603 - DNA, 13 bp, D. melanogaster
tcgaaaaaataat

SEQ ID NO: 648604 - DNA, 13 bp, D. melanogaster
tcgaaaaaatcaa

SEQ ID NO: 648605 - DNA, 13 bp, D. melanogaster
tcgaaaaaatcga

SEQ ID NO: 648606 - DNA, 13 bp, D. melanogaster
tcgaaaaaattat

SEQ ID NO: 648607 - DNA, 13 bp, D. melanogaster
tcgaaaaacgttt

SEQ ID NO: 648608 - DNA, 13 bp, D. melanogaster
tcgaaaaacttaa

SEQ ID NO: 648609 - DNA, 14 bp, D. melanogaster
tcgaaaaacttaag

SEQ ID NO: 648610 - DNA, 13 bp, D. melanogaster
tcgaaaaagaatt

SEQ ID NO: 648611 - DNA, 14 bp, D. melanogaster
tcgaaaaagtagaa

SEQ ID NO: 648612 - DNA, 13 bp, D. melanogaster
tcgaaaaagtgtt

SEQ ID NO: 648613 - DNA, 13 bp, D. melanogaster
tcgaaaaatgatt

SEQ ID NO: 648614 - DNA, 13 bp, D. melanogaster
tcgaaaaatgcct

SEQ ID NO: 648615 - DNA, 13 bp, D. melanogaster
tcgaaaaatgtat

SEQ ID NO: 648616 - DNA, 13 bp, D. melanogaster
tcgaaaacaaaat

SEQ ID NO: 648617 - DNA, 13 bp, D. melanogaster
tcgaaaacaaaca

SEQ ID NO: 648618 - DNA, 13 bp, D. melanogaster
tcgaaaacaacaa

SEQ ID NO: 648619 - DNA, 13 bp, D. melanogaster
tcgaaaacataaa

SEQ ID NO: 648620 - DNA, 13 bp, D. melanogaster
tcgaaaacatttt

SEQ ID NO: 648621 - DNA, 13 bp, D. melanogaster
tcgaaaaccagca

SEQ ID NO: 648622 - DNA, 13 bp, D. melanogaster
tcgaaaaccgaaa

SEQ ID NO: 648623 - DNA, 13 bp, D. melanogaster
tcgaaaacgcttc

SEQ ID NO: 648624 - DNA, 14 bp, D. melanogaster
tcgaaaacgcttcc

SEQ ID NO: 648625 - DNA, 13 bp, D. melanogaster
tcgaaaagaatat

SEQ ID NO: 648626 - DNA, 14 bp, D. melanogaster
tcgaaaagaatatg

SEQ ID NO: 648627 - DNA, 13 bp, D. melanogaster
tcgaaaagcaaac

SEQ ID NO: 648628 - DNA, 13 bp, D. melanogaster
tcgaaaagcaatt

SEQ ID NO: 648629 - DNA, 13 bp, D. melanogaster
tcgaaaagcgaaa

SEQ ID NO: 648630 - DNA, 13 bp, D. melanogaster
tcgaaaaggaaat

SEQ ID NO: 648631 - DNA, 14 bp, D. melanogaster
tcgaaaaggaaatg

SEQ ID NO: 648632 - DNA, 13 bp, D. melanogaster
tcgaaaagggggc

SEQ ID NO: 648633 - DNA, 14 bp, D. melanogaster
tcgaaaagtttttg

SEQ ID NO: 648634 - DNA, 13 bp, D. melanogaster
tcgaaaataaaac

SEQ ID NO: 648635 - DNA, 13 bp, D. melanogaster
tcgaaaataaacg

SEQ ID NO: 648636 - DNA, 13 bp, D. melanogaster
tcgaaaataaagt

SEQ ID NO: 648637 - DNA, 13 bp, D. melanogaster
tcgaaaataagtt

SEQ ID NO: 648638 - DNA, 13 bp, D. melanogaster
tcgaaaatagcca

SEQ ID NO: 648639 - DNA, 13 bp, D. melanogaster
tcgaaaatagttt

SEQ ID NO: 648640 - DNA, 13 bp, D. melanogaster
tcgaaaatatcat

SEQ ID NO: 648641 - DNA, 13 bp, D. melanogaster
tcgaaaatattgt

SEQ ID NO: 648642 - DNA, 13 bp, D. melanogaster
tcgaaaatattta

SEQ ID NO: 648643 - DNA, 14 bp, D. melanogaster
tcgaaaatcaaaaa

SEQ ID NO: 648644 - DNA, 13 bp, D. melanogaster
tcgaaaatcaaat

SEQ ID NO: 648645 - DNA, 13 bp, D. melanogaster
tcgaaaatcaatt

SEQ ID NO: 648646 - DNA, 13 bp, D. melanogaster
tcgaaaatcataa

SEQ ID NO: 648647 - DNA, 13 bp, D. melanogaster
tcgaaaatgaaat

SEQ ID NO: 648648 - DNA, 13 bp, D. melanogaster
tcgaaaatgattt

SEQ ID NO: 648649 - DNA, 14 bp, D. melanogaster
tcgaaaatgtgaaa

SEQ ID NO: 648650 - DNA, 13 bp, D. melanogaster
tcgaaaattattt

SEQ ID NO: 648651 - DNA, 14 bp, D. melanogaster
tcgaaaattatttc

SEQ ID NO: 648652 - DNA, 14 bp, D. melanogaster
tcgaaaattcatat

SEQ ID NO: 648653 - DNA, 13 bp, D. melanogaster
tcgaaaattgatt

SEQ ID NO: 648654 - DNA, 13 bp, D. melanogaster
tcgaaaattgtgt

SEQ ID NO: 648655 - DNA, 13 bp, D. melanogaster
tcgaaaattgttt

SEQ ID NO: 648656 - DNA, 13 bp, D. melanogaster
tcgaaacaaaaat

SEQ ID NO: 648657 - DNA, 13 bp, D. melanogaster
tcgaaacaataaa

SEQ ID NO: 648658 - DNA, 13 bp, D. melanogaster
tcgaaacaatttt

SEQ ID NO: 648659 - DNA, 13 bp, D. melanogaster
tcgaaacgaaacg

SEQ ID NO: 648660 - DNA, 14 bp, D. melanogaster
tcgaaacgaaacga

SEQ ID NO: 648661 - DNA, 13 bp, D. melanogaster
tcgaaacgaatcg

SEQ ID NO: 648662 - DNA, 14 bp, D. melanogaster
tcgaaacgaatcga

SEQ ID NO: 648663 - DNA, 14 bp, D. melanogaster
tcgaaactattgaa

SEQ ID NO: 648664 - DNA, 13 bp, D. melanogaster
tcgaaacttggct

SEQ ID NO: 648665 - DNA, 13 bp, D. melanogaster
tcgaaacttttcc

SEQ ID NO: 648666 - DNA, 13 bp, D. melanogaster
tcgaaagagaaaa

SEQ ID NO: 648667 - DNA, 13 bp, D. melanogaster
tcgaaagcaaaag

SEQ ID NO: 648668 - DNA, 13 bp, D. melanogaster
tcgaaagcgaaag

SEQ ID NO: 648669 - DNA, 13 bp, D. melanogaster
tcgaaagttttca

SEQ ID NO: 648670 - DNA, 13 bp, D. melanogaster
tcgaaataaaaca

SEQ ID NO: 648671 - DNA, 13 bp, D. melanogaster
tcgaaataaattt

SEQ ID NO: 648672 - DNA, 13 bp, D. melanogaster
tcgaaataataaa

SEQ ID NO: 648673 - DNA, 13 bp, D. melanogaster
tcgaaatagaaaa

SEQ ID NO: 648674 - DNA, 13 bp, D. melanogaster
tcgaaatatattt

SEQ ID NO: 648675 - DNA, 13 bp, D. melanogaster
tcgaaatatgaaa

SEQ ID NO: 648676 - DNA, 13 bp, D. melanogaster
tcgaaatattcat

SEQ ID NO: 648677 - DNA, 13 bp, D. melanogaster
tcgaaatcaaaag

SEQ ID NO: 648678 - DNA, 13 bp, D. melanogaster
tcgaaatcaaaat

SEQ ID NO: 648679 - DNA, 13 bp, D. melanogaster
tcgaaatcaaatc

SEQ ID NO: 648680 - DNA, 13 bp, D. melanogaster
tcgaaatcaagaa

SEQ ID NO: 648681 - DNA, 13 bp, D. melanogaster
tcgaaatcaattt

SEQ ID NO: 648682 - DNA, 13 bp, D. melanogaster
tcgaaatccaatt

SEQ ID NO: 648683 - DNA, 13 bp, D. melanogaster
tcgaaatcgaaaa

SEQ ID NO: 648684 - DNA, 14 bp, D. melanogaster
tcgaaatcgaaaag

SEQ ID NO: 648685 - DNA, 13 bp, D. melanogaster
tcgaaatcgaatc

SEQ ID NO: 648686 - DNA, 14 bp, D. melanogaster
tcgaaatcggaatc

SEQ ID NO: 648687 - DNA, 13 bp, D. melanogaster
tcgaaatcgtttt

SEQ ID NO: 648688 - DNA, 13 bp, D. melanogaster
tcgaaatgaaaaa

SEQ ID NO: 648689 - DNA, 13 bp, D. melanogaster
tcgaaatgaaagt

SEQ ID NO: 648690 - DNA, 13 bp, D. melanogaster
tcgaaatgaagat

SEQ ID NO: 648691 - DNA, 13 bp, D. melanogaster
tcgaaatgatttt

SEQ ID NO: 648692 - DNA, 13 bp, D. melanogaster
tcgaaatgcaaat

SEQ ID NO: 648693 - DNA, 13 bp, D. melanogaster
tcgaaatgcactt

SEQ ID NO: 648694 - DNA, 13 bp, D. melanogaster
tcgaaatggattt

SEQ ID NO: 648695 - DNA, 13 bp, D. melanogaster
tcgaaatgtttaa

SEQ ID NO: 648696 - DNA, 13 bp, D. melanogaster
tcgaaattaaata

SEQ ID NO: 648697 - DNA, 13 bp, D. melanogaster
tcgaaattaattt

SEQ ID NO: 648698 - DNA, 14 bp, D. melanogaster
tcgaaattagtaat

SEQ ID NO: 648699 - DNA, 13 bp, D. melanogaster
tcgaaattagttg

SEQ ID NO: 648700 - DNA, 13 bp, D. melanogaster
tcgaaattcaaat

SEQ ID NO: 648701 - DNA, 13 bp, D. melanogaster
tcgaaattcattt

SEQ ID NO: 648702 - DNA, 13 bp, D. melanogaster
tcgaaattcgttt

SEQ ID NO: 648703 - DNA, 13 bp, D. melanogaster
tcgaaattgaaag

SEQ ID NO: 648704 - DNA, 13 bp, D. melanogaster
tcgaaattgaagt

SEQ ID NO: 648705 - DNA, 14 bp, D. melanogaster
tcgaaattgaattt

SEQ ID NO: 648706 - DNA, 13 bp, D. melanogaster
tcgaaattgattt

SEQ ID NO: 648707 - DNA, 13 bp, D. melanogaster
tcgaaattggcca

SEQ ID NO: 648708 - DNA, 13 bp, D. melanogaster
tcgaaatttataa

SEQ ID NO: 648709 - DNA, 13 bp, D. melanogaster
tcgaaatttattg

SEQ ID NO: 648710 - DNA, 13 bp, D. melanogaster
tcgaaatttttaa

SEQ ID NO: 648711 - DNA, 13 bp, D. melanogaster
tcgaacaaataaa

SEQ ID NO: 648712 - DNA, 13 bp, D. melanogaster
tcgaacaatttat

SEQ ID NO: 648713 - DNA, 13 bp, D. melanogaster
tcgaacacacaca

SEQ ID NO: 648714 - DNA, 13 bp, D. melanogaster
tcgaacattttca

SEQ ID NO: 648715 - DNA, 13 bp, D. melanogaster
tcgaacatttttg

SEQ ID NO: 648716 - DNA, 13 bp, D. melanogaster
tcgaacggacaca

SEQ ID NO: 648717 - DNA, 40 bp, D. melanogaster
tcgaacggacacataacggaaccgctagcagatcgcgaac

SEQ ID NO: 648718 - DNA, 13 bp, D. melanogaster
tcgaactaatgca

SEQ ID NO: 648719 - DNA, 13 bp, D. melanogaster
tcgaactcaaaat

SEQ ID NO: 648720 - DNA, 13 bp, D. melanogaster
tcgaactgaaaac

SEQ ID NO: 648721 - DNA, 13 bp, D. melanogaster
tcgaactgcattc

SEQ ID NO: 648722 - DNA, 13 bp, D. melanogaster
tcgaactggatga

SEQ ID NO: 648723 - DNA, 13 bp, D. melanogaster
tcgaagaagaaat

SEQ ID NO: 648724 - DNA, 13 bp, D. melanogaster
tcgaagctataaa

SEQ ID NO: 648725 - DNA, 14 bp, D. melanogaster
tcgaaggccacaaa

SEQ ID NO: 648726 - DNA, 13 bp, D. melanogaster
tcgaagtgacggc

SEQ ID NO: 648727 - DNA, 13 bp, D. melanogaster
tcgaataaataat

SEQ ID NO: 648728 - DNA, 13 bp, D. melanogaster
tcgaataaatatt

SEQ ID NO: 648729 - DNA, 13 bp, D. melanogaster
tcgaataatattt

SEQ ID NO: 648730 - DNA, 13 bp, D. melanogaster
tcgaatagtttcg

SEQ ID NO: 648731 - DNA, 13 bp, D. melanogaster
tcgaatatatttt

SEQ ID NO: 648732 - DNA, 13 bp, D. melanogaster
tcgaatatcgaat

SEQ ID NO: 648733 - DNA, 13 bp, D. melanogaster
tcgaatattttat

SEQ ID NO: 648734 - DNA, 15 bp, D. melanogaster
tcgaatcaaatcgaa

SEQ ID NO: 648735 - DNA, 13 bp, D. melanogaster
tcgaatcaagacg

SEQ ID NO: 648736 - DNA, 13 bp, D. melanogaster
tcgaatcaatcaa

SEQ ID NO: 648737 - DNA, 13 bp, D. melanogaster
tcgaatcccaagg

SEQ ID NO: 648738 - DNA, 14 bp, D. melanogaster
tcgaatccgaatcc

SEQ ID NO: 648739 - DNA, 13 bp, D. melanogaster
tcgaatcgaattg

SEQ ID NO: 648740 - DNA, 13 bp, D. melanogaster
tcgaatcgatttg

SEQ ID NO: 648741 - DNA, 13 bp, D. melanogaster
tcgaatgatcaaa

SEQ ID NO: 648742 - DNA, 13 bp, D. melanogaster
tcgaatgcaaatt

SEQ ID NO: 648743 - DNA, 14 bp, D. melanogaster
tcgaatgccatttg

SEQ ID NO: 648744 - DNA, 13 bp, D. melanogaster
tcgaatgcctttg

SEQ ID NO: 648745 - DNA, 13 bp, D. melanogaster
tcgaatgctaaag

SEQ ID NO: 648746 - DNA, 13 bp, D. melanogaster
tcgaatgctgaat

SEQ ID NO: 648747 - DNA, 13 bp, D. melanogaster
tcgaatggaatcg

SEQ ID NO: 648748 - DNA, 14 bp, D. melanogaster
tcgaatggaatgga

SEQ ID NO: 648749 - DNA, 13 bp, D. melanogaster
tcgaatggcattc

SEQ ID NO: 648750 - DNA, 13 bp, D. melanogaster
tcgaatggccaaa

SEQ ID NO: 648751 - DNA, 13 bp, D. melanogaster
tcgaatgggaaaa

SEQ ID NO: 648752 - DNA, 13 bp, D. melanogaster
tcgaatggggaaa

SEQ ID NO: 648753 - DNA, 13 bp, D. melanogaster
tcgaatgtgtgtg

SEQ ID NO: 648754 - DNA, 13 bp, D. melanogaster
tcgaattaaaatt

SEQ ID NO: 648755 - DNA, 13 bp, D. melanogaster
tcgaattaatttt

SEQ ID NO: 648756 - DNA, 13 bp, D. melanogaster
tcgaattagctac

SEQ ID NO: 648757 - DNA, 14 bp, D. melanogaster
tcgaattagctacc

SEQ ID NO: 648758 - DNA, 13 bp, D. melanogaster
tcgaattcaaatt

SEQ ID NO: 648759 - DNA, 13 bp, D. melanogaster
tcgaattcaattt

SEQ ID NO: 648760 - DNA, 13 bp, D. melanogaster
tcgaattcatttg

SEQ ID NO: 648761 - DNA, 13 bp, D. melanogaster
tcgaattcgaaaa

SEQ ID NO: 648762 - DNA, 13 bp, D. melanogaster
tcgaattgaaaac

SEQ ID NO: 648763 - DNA, 13 bp, D. melanogaster
tcgaattggaaaa

SEQ ID NO: 648764 - DNA, 13 bp, D. melanogaster
tcgaattggatga

SEQ ID NO: 648765 - DNA, 13 bp, D. melanogaster
tcgaattggcacc

SEQ ID NO: 648766 - DNA, 13 bp, D. melanogaster
tcgaattgtttac

SEQ ID NO: 648767 - DNA, 13 bp, D. melanogaster
tcgaatttaaaat

SEQ ID NO: 648768 - DNA, 13 bp, D. melanogaster
tcgaatttaaatg

SEQ ID NO: 648769 - DNA, 13 bp, D. melanogaster
tcgaatttcaaat

SEQ ID NO: 648770 - DNA, 13 bp, D. melanogaster
tcgaatttcagtt

SEQ ID NO: 648771 - DNA, 13 bp, D. melanogaster
tcgaatttccaat

SEQ ID NO: 648772 - DNA, 13 bp, D. melanogaster
tcgaatttcgaat

SEQ ID NO: 648773 - DNA, 13 bp, D. melanogaster
tcgaatttctttt

SEQ ID NO: 648774 - DNA, 13 bp, D. melanogaster
tcgaatttgaatt

SEQ ID NO: 648775 - DNA, 13 bp, D. melanogaster
tcgaatttgacaa

SEQ ID NO: 648776 - DNA, 13 bp, D. melanogaster
tcgaatttgcatt

SEQ ID NO: 648777 - DNA, 13 bp, D. melanogaster
tcgaatttgttta

SEQ ID NO: 648778 - DNA, 13 bp, D. melanogaster
tcgaattttcagc

SEQ ID NO: 648779 - DNA, 13 bp, D. melanogaster
tcgaatttttgtt

SEQ ID NO: 648780 - DNA, 13 bp, D. melanogaster
tcgacaacgccga

SEQ ID NO: 648781 - DNA, 13 bp, D. melanogaster
tcgacaatgcacg

SEQ ID NO: 648782 - DNA, 14 bp, D. melanogaster
tcgacaatgccatc

SEQ ID NO: 648783 - DNA, 13 bp, D. melanogaster
tcgacagcggcag

SEQ ID NO: 648784 - DNA, 13 bp, D. melanogaster
tcgacaggagcag

SEQ ID NO: 648785 - DNA, 13 bp, D. melanogaster
tcgacatatatat

SEQ ID NO: 648786 - DNA, 13 bp, D. melanogaster
tcgacatcgacat

SEQ ID NO: 648787 - DNA, 13 bp, D. melanogaster
tcgacatcttgca

SEQ ID NO: 648788 - DNA, 13 bp, D. melanogaster
tcgacattgagaa

SEQ ID NO: 648789 - DNA, 13 bp, D. melanogaster
tcgaccaagttgg

SEQ ID NO: 648790 - DNA, 13 bp, D. melanogaster
tcgaccaattttt

SEQ ID NO: 648791 - DNA, 13 bp, D. melanogaster
tcgaccatagtaa

SEQ ID NO: 648792 - DNA, 14 bp, D. melanogaster
tcgacgacgacgac

SEQ ID NO: 648793 - DNA, 13 bp, D. melanogaster
tcgacgatggaat

SEQ ID NO: 648794 - DNA, 13 bp, D. melanogaster
tcgacgccggcag

SEQ ID NO: 648795 - DNA, 13 bp, D. melanogaster
tcgacggacaaaa

SEQ ID NO: 648796 - DNA, 13 bp, D. melanogaster
tcgacgtcgacgc

SEQ ID NO: 648797 - DNA, 13 bp, D. melanogaster
tcgacgtcgacgt

SEQ ID NO: 648798 - DNA, 14 bp, D. melanogaster
tcgacgtcgactgc

SEQ ID NO: 648799 - DNA, 13 bp, D. melanogaster
tcgactacaacaa

SEQ ID NO: 648800 - DNA, 14 bp, D. melanogaster
tcgactacaacaac

SEQ ID NO: 648801 - DNA, 14 bp, D. melanogaster
tcgactatagcgtt

SEQ ID NO: 648802 - DNA, 14 bp, D. melanogaster
tcgactatcagata

SEQ ID NO: 648803 - DNA, 13 bp, D. melanogaster
tcgactcgactca

SEQ ID NO: 648804 - DNA, 13 bp, D. melanogaster
tcgactcgatcat

SEQ ID NO: 648805 - DNA, 13 bp, D. melanogaster
tcgactgactgac

SEQ ID NO: 648806 - DNA, 13 bp, D. melanogaster
tcgactgactgca

SEQ ID NO: 648807 - DNA, 14 bp, D. melanogaster
tcgactgcgctgcc

SEQ ID NO: 648808 - DNA, 13 bp, D. melanogaster
tcgacttctgctt

SEQ ID NO: 648809 - DNA, 13 bp, D. melanogaster
tcgacttggactt

SEQ ID NO: 648810 - DNA, 13 bp, D. melanogaster
tcgacttggctat

SEQ ID NO: 648811 - DNA, 13 bp, D. melanogaster
tcgactttgactt

SEQ ID NO: 648812 - DNA, 13 bp, D. melanogaster
tcgactttgattt

SEQ ID NO: 648813 - DNA, 13 bp, D. melanogaster
tcgacttttcttt

SEQ ID NO: 648814 - DNA, 13 bp, D. melanogaster
tcgactttttcca

SEQ ID NO: 648815 - DNA, 14 bp, D. melanogaster
tcgactttttccat

SEQ ID NO: 648816 - DNA, 13 bp, D. melanogaster
tcgagaaaatcga

SEQ ID NO: 648817 - DNA, 13 bp, D. melanogaster
tcgagaaactcga

SEQ ID NO: 648818 - DNA, 13 bp, D. melanogaster
tcgagaacctcag

SEQ ID NO: 648819 - DNA, 13 bp, D. melanogaster
tcgagacgaaaac

SEQ ID NO: 648820 - DNA, 13 bp, D. melanogaster
tcgagagcgataa

SEQ ID NO: 648821 - DNA, 13 bp, D. melanogaster
tcgagatccccaa

SEQ ID NO: 648822 - DNA, 13 bp, D. melanogaster
tcgagcaaaacaa

SEQ ID NO: 648823 - DNA, 13 bp, D. melanogaster
tcgagcaaaggga

SEQ ID NO: 648824 - DNA, 14 bp, D. melanogaster
tcgagcaactcgtc

SEQ ID NO: 648825 - DNA, 13 bp, D. melanogaster
tcgagcaagaaaa

SEQ ID NO: 648826 - DNA, 13 bp, D. melanogaster
tcgagcaattaaa

SEQ ID NO: 648827 - DNA, 13 bp, D. melanogaster
tcgagcaatttaa

SEQ ID NO: 648828 - DNA, 13 bp, D. melanogaster
tcgagcagcagca

SEQ ID NO: 648829 - DNA, 13 bp, D. melanogaster
tcgagcagtcaat

SEQ ID NO: 648830 - DNA, 14 bp, D. melanogaster
tcgagcagtcaatt

SEQ ID NO: 648831 - DNA, 13 bp, D. melanogaster
tcgagccaatgat

SEQ ID NO: 648832 - DNA, 13 bp, D. melanogaster
tcgagccacactc

SEQ ID NO: 648833 - DNA, 14 bp, D. melanogaster
tcgagcgctgcggc

SEQ ID NO: 648834 - DNA, 13 bp, D. melanogaster
tcgagcggcgatt

SEQ ID NO: 648835 - DNA, 13 bp, D. melanogaster
tcgagcggctggt

SEQ ID NO: 648836 - DNA, 13 bp, D. melanogaster
tcgagctatgtag

SEQ ID NO: 648837 - DNA, 13 bp, D. melanogaster
tcgagctgcactt

SEQ ID NO: 648838 - DNA, 13 bp, D. melanogaster
tcgagctgtgtgc

SEQ ID NO: 648839 - DNA, 13 bp, D. melanogaster
tcgaggaactcga

SEQ ID NO: 648840 - DNA, 14 bp, D. melanogaster
tcgaggaactcgac

SEQ ID NO: 648841 - DNA, 13 bp, D. melanogaster
tcgaggaggagag

SEQ ID NO: 648842 - DNA, 14 bp, D. melanogaster
tcgaggaggagagc

SEQ ID NO: 648843 - DNA, 13 bp, D. melanogaster
tcgaggcagagag

SEQ ID NO: 648844 - DNA, 13 bp, D. melanogaster
tcgaggggctaaa

SEQ ID NO: 648845 - DNA, 13 bp, D. melanogaster
tcgaggtggcaat

SEQ ID NO: 648846 - DNA, 13 bp, D. melanogaster
tcgagtactttgc

SEQ ID NO: 648847 - DNA, 13 bp, D. melanogaster
tcgagtagccact

SEQ ID NO: 648848 - DNA, 15 bp, D. melanogaster
tcgagtatatctaga

SEQ ID NO: 648849 - DNA, 13 bp, D. melanogaster
tcgagtatctgtg

SEQ ID NO: 648850 - DNA, 14 bp, D. melanogaster
tcgagtctgaaatc

SEQ ID NO: 648851 - DNA, 13 bp, D. melanogaster
tcgagtggacaga

SEQ ID NO: 648852 - DNA, 13 bp, D. melanogaster
tcgagtggagtgg

SEQ ID NO: 648853 - DNA, 13 bp, D. melanogaster
tcgagtggcaaaa

SEQ ID NO: 648854 - DNA, 13 bp, D. melanogaster
tcgagtggcaaac

SEQ ID NO: 648855 - DNA, 13 bp, D. melanogaster
tcgagtgggtgat

SEQ ID NO: 648856 - DNA, 13 bp, D. melanogaster
tcgagtgtgcgtg

SEQ ID NO: 648857 - DNA, 14 bp, D. melanogaster
tcgagtgtgtgtgt

SEQ ID NO: 648858 - DNA, 13 bp, D. melanogaster
tcgagttccccga

SEQ ID NO: 648859 - DNA, 13 bp, D. melanogaster
tcgagttcctcga

SEQ ID NO: 648860 - DNA, 14 bp, D. melanogaster
tcgagttcctcgac

SEQ ID NO: 648861 - DNA, 13 bp, D. melanogaster
tcgagttcgagtt

SEQ ID NO: 648862 - DNA, 14 bp, D. melanogaster
tcgagttcgagttc

SEQ ID NO: 648863 - DNA, 13 bp, D. melanogaster
tcgagttcgttct

SEQ ID NO: 648864 - DNA, 13 bp, D. melanogaster
tcgagttctattt

SEQ ID NO: 648865 - DNA, 13 bp, D. melanogaster
tcgagttctcagc

SEQ ID NO: 648866 - DNA, 14 bp, D. melanogaster
tcgagtttcccgac

SEQ ID NO: 648867 - DNA, 13 bp, D. melanogaster
tcgagtttgagtt

SEQ ID NO: 648868 - DNA, 13 bp, D. melanogaster
tcgagtttgggaa

SEQ ID NO: 648869 - DNA, 13 bp, D. melanogaster
tcgataagaaatt

SEQ ID NO: 648870 - DNA, 13 bp, D. melanogaster
tcgataagtttct

SEQ ID NO: 648871 - DNA, 13 bp, D. melanogaster
tcgataatattga

SEQ ID NO: 648872 - DNA, 13 bp, D. melanogaster
tcgataatatttg

SEQ ID NO: 648873 - DNA, 13 bp, D. melanogaster
tcgatagatattg

SEQ ID NO: 648874 - DNA, 14 bp, D. melanogaster
tcgatagatattgg

SEQ ID NO: 648875 - DNA, 13 bp, D. melanogaster
tcgatagtatcga

SEQ ID NO: 648876 - DNA, 13 bp, D. melanogaster
tcgatagtgtcct

SEQ ID NO: 648877 - DNA, 13 bp, D. melanogaster
tcgatatatcgat

SEQ ID NO: 648878 - DNA, 14 bp, D. melanogaster
tcgatatatcgata

SEQ ID NO: 648879 - DNA, 13 bp, D. melanogaster
tcgatatatgcac

SEQ ID NO: 648880 - DNA, 14 bp, D. melanogaster
tcgatatatgcaca

SEQ ID NO: 648881 - DNA, 13 bp, D. melanogaster
tcgatatcagcaa

SEQ ID NO: 648882 - DNA, 13 bp, D. melanogaster
tcgatatcgataa

SEQ ID NO: 648883 - DNA, 13 bp, D. melanogaster
tcgatatctaaat

SEQ ID NO: 648884 - DNA, 13 bp, D. melanogaster
tcgatatgccaaa

SEQ ID NO: 648885 - DNA, 13 bp, D. melanogaster
tcgatatgccaga

SEQ ID NO: 648886 - DNA, 14 bp, D. melanogaster
tcgatatgccagaa

SEQ ID NO: 648887 - DNA, 13 bp, D. melanogaster
tcgatatgtttat

SEQ ID NO: 648888 - DNA, 13 bp, D. melanogaster
tcgatattttcaa

SEQ ID NO: 648889 - DNA, 13 bp, D. melanogaster
tcgatcaaaaact

SEQ ID NO: 648890 - DNA, 14 bp, D. melanogaster
tcgatcaaaaactt

SEQ ID NO: 648891 - DNA, 13 bp, D. melanogaster
tcgatcaaacgct

SEQ ID NO: 648892 - DNA, 13 bp, D. melanogaster
tcgatcactttat

SEQ ID NO: 648893 - DNA, 13 bp, D. melanogaster
tcgatcccgaaat

SEQ ID NO: 648894 - DNA, 13 bp, D. melanogaster
tcgatccctcgat

SEQ ID NO: 648895 - DNA, 14 bp, D. melanogaster
tcgatccgatccga

SEQ ID NO: 648896 - DNA, 13 bp, D. melanogaster
tcgatcgatcgat

SEQ ID NO: 648897 - DNA, 14 bp, D. melanogaster
tcgatcgatcgatc

SEQ ID NO: 648898 - DNA, 13 bp, D. melanogaster
tcgatcgatggat

SEQ ID NO: 648899 - DNA, 13 bp, D. melanogaster
tcgatctcgatct

SEQ ID NO: 648900 - DNA, 13 bp, D. melanogaster
tcgatctggccat

SEQ ID NO: 648901 - DNA, 14 bp, D. melanogaster
tcgatctggccatg

SEQ ID NO: 648902 - DNA, 13 bp, D. melanogaster
tcgatcttatata

SEQ ID NO: 648903 - DNA, 13 bp, D. melanogaster
tcgatgaaaccaa

SEQ ID NO: 648904 - DNA, 13 bp, D. melanogaster
tcgatgaataaac

SEQ ID NO: 648905 - DNA, 13 bp, D. melanogaster
tcgatgacgtcat

SEQ ID NO: 648906 - DNA, 14 bp, D. melanogaster
tcgatgatgatgat

SEQ ID NO: 648907 - DNA, 13 bp, D. melanogaster
tcgatgcactgcg

SEQ ID NO: 648908 - DNA, 13 bp, D. melanogaster
tcgatgcggtttc

SEQ ID NO: 648909 - DNA, 13 bp, D. melanogaster
tcgatggatggat

SEQ ID NO: 648910 - DNA, 13 bp, D. melanogaster
tcgatggctccca

SEQ ID NO: 648911 - DNA, 13 bp, D. melanogaster
tcgatggtcgatg

SEQ ID NO: 648912 - DNA, 13 bp, D. melanogaster
tcgatggttccat

SEQ ID NO: 648913 - DNA, 13 bp, D. melanogaster
tcgatgtgtgtgc

SEQ ID NO: 648914 - DNA, 13 bp, D. melanogaster
tcgatgttgctgc

SEQ ID NO: 648915 - DNA, 13 bp, D. melanogaster
tcgattattatta

SEQ ID NO: 648916 - DNA, 13 bp, D. melanogaster
tcgattatttgaa

SEQ ID NO: 648917 - DNA, 13 bp, D. melanogaster
tcgattcatttac

SEQ ID NO: 648918 - DNA, 13 bp, D. melanogaster
tcgattccattcc

SEQ ID NO: 648919 - DNA, 13 bp, D. melanogaster
tcgattccgattc

SEQ ID NO: 648920 - DNA, 13 bp, D. melanogaster
tcgattccgattt

SEQ ID NO: 648921 - DNA, 13 bp, D. melanogaster
tcgattcctttgt

SEQ ID NO: 648922 - DNA, 13 bp, D. melanogaster
tcgattcgaaatg

SEQ ID NO: 648923 - DNA, 13 bp, D. melanogaster
tcgattcgaaatt

SEQ ID NO: 648924 - DNA, 14 bp, D. melanogaster
tcgattcgaatcga

SEQ ID NO: 648925 - DNA, 13 bp, D. melanogaster
tcgattcgattcc

SEQ ID NO: 648926 - DNA, 13 bp, D. melanogaster
tcgattcgattcg

SEQ ID NO: 648927 - DNA, 13 bp, D. melanogaster
tcgattcgattgg

SEQ ID NO: 648928 - DNA, 13 bp, D. melanogaster
tcgattcgattgt

SEQ ID NO: 648929 - DNA, 13 bp, D. melanogaster
tcgattcgatttg

SEQ ID NO: 648930 - DNA, 13 bp, D. melanogaster
tcgattcgatttt

SEQ ID NO: 648931 - DNA, 13 bp, D. melanogaster
tcgattcggtttc

SEQ ID NO: 648932 - DNA, 13 bp, D. melanogaster
tcgattcggtttt

SEQ ID NO: 648933 - DNA, 13 bp, D. melanogaster
tcgattcgtttcg

SEQ ID NO: 648934 - DNA, 14 bp, D. melanogaster
tcgattcgtttcga

SEQ ID NO: 648935 - DNA, 13 bp, D. melanogaster
tcgattgaccaaa

SEQ ID NO: 648936 - DNA, 13 bp, D. melanogaster
tcgattgattgat

SEQ ID NO: 648937 - DNA, 14 bp, D. melanogaster
tcgattgattgatt

SEQ ID NO: 648938 - DNA, 13 bp, D. melanogaster
tcgattgatttca

SEQ ID NO: 648939 - DNA, 14 bp, D. melanogaster
tcgattgatttcag

SEQ ID NO: 648940 - DNA, 13 bp, D. melanogaster
tcgattgatttgt

SEQ ID NO: 648941 - DNA, 13 bp, D. melanogaster
tcgattgcattta

SEQ ID NO: 648942 - DNA, 13 bp, D. melanogaster
tcgattgcccacc

SEQ ID NO: 648943 - DNA, 13 bp, D. melanogaster
tcgattgcgcaat

SEQ ID NO: 648944 - DNA, 13 bp, D. melanogaster
tcgattggaaatt

SEQ ID NO: 648945 - DNA, 13 bp, D. melanogaster
tcgattggcaatt

SEQ ID NO: 648946 - DNA, 13 bp, D. melanogaster
tcgattgggattt

SEQ ID NO: 648947 - DNA, 13 bp, D. melanogaster
tcgatttaaattt

SEQ ID NO: 648948 - DNA, 13 bp, D. melanogaster
tcgatttaattaa

SEQ ID NO: 648949 - DNA, 13 bp, D. melanogaster
tcgatttattttg

SEQ ID NO: 648950 - DNA, 13 bp, D. melanogaster
tcgatttcaataa

SEQ ID NO: 648951 - DNA, 13 bp, D. melanogaster
tcgatttcaattg

SEQ ID NO: 648952 - DNA, 13 bp, D. melanogaster
tcgatttcagttc

SEQ ID NO: 648953 - DNA, 13 bp, D. melanogaster
tcgatttcatttc

SEQ ID NO: 648954 - DNA, 13 bp, D. melanogaster
tcgatttccattt

SEQ ID NO: 648955 - DNA, 13 bp, D. melanogaster
tcgatttcctcga

SEQ ID NO: 648956 - DNA, 13 bp, D. melanogaster
tcgatttccttgc

SEQ ID NO: 648957 - DNA, 13 bp, D. melanogaster
tcgatttcgaaat

SEQ ID NO: 648958 - DNA, 13 bp, D. melanogaster
tcgatttcgatgc

SEQ ID NO: 648959 - DNA, 14 bp, D. melanogaster
tcgatttcgattcg

SEQ ID NO: 648960 - DNA, 13 bp, D. melanogaster
tcgatttcgattt

SEQ ID NO: 648961 - DNA, 14 bp, D. melanogaster
tcgatttcgatttg

SEQ ID NO: 648962 - DNA, 13 bp, D. melanogaster
tcgatttcggttt

SEQ ID NO: 648963 - DNA, 13 bp, D. melanogaster
tcgatttcgtgtg

SEQ ID NO: 648964 - DNA, 13 bp, D. melanogaster
tcgatttcgtttc

SEQ ID NO: 648965 - DNA, 13 bp, D. melanogaster
tcgatttcgtttg

SEQ ID NO: 648966 - DNA, 13 bp, D. melanogaster
tcgatttgacgtt

SEQ ID NO: 648967 - DNA, 13 bp, D. melanogaster
tcgatttgatgaa

SEQ ID NO: 648968 - DNA, 13 bp, D. melanogaster
tcgatttgattcg

SEQ ID NO: 648969 - DNA, 13 bp, D. melanogaster
tcgatttgatttc

SEQ ID NO: 648970 - DNA, 13 bp, D. melanogaster
tcgatttgatttg

SEQ ID NO: 648971 - DNA, 13 bp, D. melanogaster
tcgatttgcaaaa

SEQ ID NO: 648972 - DNA, 13 bp, D. melanogaster
tcgatttgcatac

SEQ ID NO: 648973 - DNA, 13 bp, D. melanogaster
tcgatttgcatgt

SEQ ID NO: 648974 - DNA, 13 bp, D. melanogaster
tcgatttgccaaa

SEQ ID NO: 648975 - DNA, 14 bp, D. melanogaster
tcgatttgccaaaa

SEQ ID NO: 648976 - DNA, 13 bp, D. melanogaster
tcgatttgccttt

SEQ ID NO: 648977 - DNA, 13 bp, D. melanogaster
tcgatttgcgagc

SEQ ID NO: 648978 - DNA, 13 bp, D. melanogaster
tcgatttgctaaa

SEQ ID NO: 648979 - DNA, 13 bp, D. melanogaster
tcgatttggcaat

SEQ ID NO: 648980 - DNA, 13 bp, D. melanogaster
tcgatttggccaa

SEQ ID NO: 648981 - DNA, 13 bp, D. melanogaster
tcgatttggctta

SEQ ID NO: 648982 - DNA, 13 bp, D. melanogaster
tcgatttgggttt

SEQ ID NO: 648983 - DNA, 13 bp, D. melanogaster
tcgatttggtttt

SEQ ID NO: 648984 - DNA, 13 bp, D. melanogaster
tcgatttgtacgt

SEQ ID NO: 648985 - DNA, 13 bp, D. melanogaster
tcgatttgtgttt

SEQ ID NO: 648986 - DNA, 13 bp, D. melanogaster
tcgatttgttttg

SEQ ID NO: 648987 - DNA, 13 bp, D. melanogaster
tcgattttattat

SEQ ID NO: 648988 - DNA, 13 bp, D. melanogaster
tcgattttcagtt

SEQ ID NO: 648989 - DNA, 13 bp, D. melanogaster
tcgattttcattt

SEQ ID NO: 648990 - DNA, 13 bp, D. melanogaster
tcgattttccact

SEQ ID NO: 648991 - DNA, 13 bp, D. melanogaster
tcgattttccagc

SEQ ID NO: 648992 - DNA, 13 bp, D. melanogaster
tcgattttcgcat

SEQ ID NO: 648993 - DNA, 13 bp, D. melanogaster
tcgattttgatat

SEQ ID NO: 648994 - DNA, 13 bp, D. melanogaster
tcgattttgattt

SEQ ID NO: 648995 - DNA, 13 bp, D. melanogaster
tcgattttgcaat

SEQ ID NO: 648996 - DNA, 13 bp, D. melanogaster
tcgattttgcaga

SEQ ID NO: 648997 - DNA, 13 bp, D. melanogaster
tcgattttggcca

SEQ ID NO: 648998 - DNA, 13 bp, D. melanogaster
tcgatttttatta

SEQ ID NO: 648999 - DNA, 13 bp, D. melanogaster
tcgatttttattg

SEQ ID NO: 649000 - DNA, 13 bp, D. melanogaster
tcgatttttctgc

SEQ ID NO: 649001 - DNA, 13 bp, D. melanogaster
tcgatttttgatt

SEQ ID NO: 649002 - DNA, 13 bp, D. melanogaster
tcgatttttgcca

SEQ ID NO: 649003 - DNA, 13 bp, D. melanogaster
tcgattttttcaa

SEQ ID NO: 649004 - DNA, 13 bp, D. melanogaster
tcgattttttcga

SEQ ID NO: 649005 - DNA, 13 bp, D. melanogaster
tcgcaaaactcct

SEQ ID NO: 649006 - DNA, 13 bp, D. melanogaster
tcgcaaaagcaac

SEQ ID NO: 649007 - DNA, 13 bp, D. melanogaster
tcgcaaaataaaa

SEQ ID NO: 649008 - DNA, 13 bp, D. melanogaster
tcgcaaacacaca

SEQ ID NO: 649009 - DNA, 13 bp, D. melanogaster
tcgcaaactttcc

SEQ ID NO: 649010 - DNA, 13 bp, D. melanogaster
tcgcaaagaattt

SEQ ID NO: 649011 - DNA, 13 bp, D. melanogaster
tcgcaaatgcaca

SEQ ID NO: 649012 - DNA, 13 bp, D. melanogaster
tcgcaaattgcaa

SEQ ID NO: 649013 - DNA, 13 bp, D. melanogaster
tcgcaacaagcga

SEQ ID NO: 649014 - DNA, 14 bp, D. melanogaster
tcgcaactggcgct

SEQ ID NO: 649015 - DNA, 13 bp, D. melanogaster
tcgcaagcatttc

SEQ ID NO: 649016 - DNA, 13 bp, D. melanogaster
tcgcaagttaatt

SEQ ID NO: 649017 - DNA, 13 bp, D. melanogaster
tcgcaataaaaat

SEQ ID NO: 649018 - DNA, 13 bp, D. melanogaster
tcgcaatattttc

SEQ ID NO: 649019 - DNA, 14 bp, D. melanogaster
tcgcaatcgcaatc

SEQ ID NO: 649020 - DNA, 13 bp, D. melanogaster
tcgcaatcggaat

SEQ ID NO: 649021 - DNA, 13 bp, D. melanogaster
tcgcaatctgcat

SEQ ID NO: 649022 - DNA, 13 bp, D. melanogaster
tcgcaatgaaaat

SEQ ID NO: 649023 - DNA, 13 bp, D. melanogaster
tcgcaattgattt

SEQ ID NO: 649024 - DNA, 13 bp, D. melanogaster
tcgcaattgcaat

SEQ ID NO: 649025 - DNA, 13 bp, D. melanogaster
tcgcaattgtttt

SEQ ID NO: 649026 - DNA, 13 bp, D. melanogaster
tcgcaatttgcat

SEQ ID NO: 649027 - DNA, 13 bp, D. melanogaster
tcgcacaagaatg

SEQ ID NO: 649028 - DNA, 13 bp, D. melanogaster
tcgcacacaaata

SEQ ID NO: 649029 - DNA, 13 bp, D. melanogaster
tcgcacacacatg

SEQ ID NO: 649030 - DNA, 13 bp, D. melanogaster
tcgcacacacgca

SEQ ID NO: 649031 - DNA, 14 bp, D. melanogaster
tcgcacacacgcac

SEQ ID NO: 649032 - DNA, 13 bp, D. melanogaster
tcgcacacactca

SEQ ID NO: 649033 - DNA, 13 bp, D. melanogaster
tcgcacacactcg

SEQ ID NO: 649034 - DNA, 14 bp, D. melanogaster
tcgcacacatacac

SEQ ID NO: 649035 - DNA, 13 bp, D. melanogaster
tcgcacacatgca

SEQ ID NO: 649036 - DNA, 14 bp, D. melanogaster
tcgcacacgcacac

SEQ ID NO: 649037 - DNA, 13 bp, D. melanogaster
tcgcacatattcc

SEQ ID NO: 649038 - DNA, 13 bp, D. melanogaster
tcgcacccacaca

SEQ ID NO: 649039 - DNA, 14 bp, D. melanogaster
tcgcactcgactcc

SEQ ID NO: 649040 - DNA, 14 bp, D. melanogaster
tcgcactcgcacac

SEQ ID NO: 649041 - DNA, 13 bp, D. melanogaster
tcgcactgaaatt

SEQ ID NO: 649042 - DNA, 13 bp, D. melanogaster
tcgcacttccact

SEQ ID NO: 649043 - DNA, 13 bp, D. melanogaster
tcgcacttggcca

SEQ ID NO: 649044 - DNA, 13 bp, D. melanogaster
tcgcagatacaga

SEQ ID NO: 649045 - DNA, 13 bp, D. melanogaster
tcgcagcaaatgc

SEQ ID NO: 649046 - DNA, 14 bp, D. melanogaster
tcgcagcaacaata

SEQ ID NO: 649047 - DNA, 13 bp, D. melanogaster
tcgcagcaatgcc

SEQ ID NO: 649048 - DNA, 13 bp, D. melanogaster
tcgcagcagcaaa

SEQ ID NO: 649049 - DNA, 14 bp, D. melanogaster
tcgcagcagcaaca

SEQ ID NO: 649050 - DNA, 13 bp, D. melanogaster
tcgcagcaggcaa

SEQ ID NO: 649051 - DNA, 13 bp, D. melanogaster
tcgcagccaaaaa

SEQ ID NO: 649052 - DNA, 13 bp, D. melanogaster
tcgcagcgggtga

SEQ ID NO: 649053 - DNA, 13 bp, D. melanogaster
tcgcaggactcgc

SEQ ID NO: 649054 - DNA, 13 bp, D. melanogaster
tcgcaggactttt

SEQ ID NO: 649055 - DNA, 14 bp, D. melanogaster
tcgcaggagaaaat

SEQ ID NO: 649056 - DNA, 13 bp, D. melanogaster
tcgcaggatgccg

SEQ ID NO: 649057 - DNA, 13 bp, D. melanogaster
tcgcagtcgacgt

SEQ ID NO: 649058 - DNA, 13 bp, D. melanogaster
tcgcagtcgcagc

SEQ ID NO: 649059 - DNA, 14 bp, D. melanogaster
tcgcagtcgcagtc

SEQ ID NO: 649060 - DNA, 13 bp, D. melanogaster
tcgcagtcgttcg

SEQ ID NO: 649061 - DNA, 13 bp, D. melanogaster
tcgcataaacaaa

SEQ ID NO: 649062 - DNA, 13 bp, D. melanogaster
tcgcataaataaa

SEQ ID NO: 649063 - DNA, 13 bp, D. melanogaster
tcgcataaatcaa

SEQ ID NO: 649064 - DNA, 13 bp, D. melanogaster
tcgcataaattta

SEQ ID NO: 649065 - DNA, 13 bp, D. melanogaster
tcgcatccttttt

SEQ ID NO: 649066 - DNA, 13 bp, D. melanogaster
tcgcatcggatcg

SEQ ID NO: 649067 - DNA, 14 bp, D. melanogaster
tcgcatcggatcgg

SEQ ID NO: 649068 - DNA, 13 bp, D. melanogaster
tcgcatgcaaatg

SEQ ID NO: 649069 - DNA, 13 bp, D. melanogaster
tcgcatgcatttt

SEQ ID NO: 649070 - DNA, 14 bp, D. melanogaster
tcgcatgcattttc

SEQ ID NO: 649071 - DNA, 13 bp, D. melanogaster
tcgcatgttctac

SEQ ID NO: 649072 - DNA, 13 bp, D. melanogaster
tcgcattcacact

SEQ ID NO: 649073 - DNA, 13 bp, D. melanogaster
tcgcattcacatt

SEQ ID NO: 649074 - DNA, 13 bp, D. melanogaster
tcgcattcgaatt

SEQ ID NO: 649075 - DNA, 13 bp, D. melanogaster
tcgcattcgattt

SEQ ID NO: 649076 - DNA, 13 bp, D. melanogaster
tcgcattcgcact

SEQ ID NO: 649077 - DNA, 13 bp, D. melanogaster
tcgcattcgcatc

SEQ ID NO: 649078 - DNA, 13 bp, D. melanogaster
tcgcattcgcatt

SEQ ID NO: 649079 - DNA, 14 bp, D. melanogaster
tcgcattcgcattc

SEQ ID NO: 649080 - DNA, 13 bp, D. melanogaster
tcgcattcggatt

SEQ ID NO: 649081 - DNA, 13 bp, D. melanogaster
tcgcattgaattt

SEQ ID NO: 649082 - DNA, 13 bp, D. melanogaster
tcgcattgcattg

SEQ ID NO: 649083 - DNA, 13 bp, D. melanogaster
tcgcattgcattt

SEQ ID NO: 649084 - DNA, 13 bp, D. melanogaster
tcgcattgccatt

SEQ ID NO: 649085 - DNA, 13 bp, D. melanogaster
tcgcatttaaaca

SEQ ID NO: 649086 - DNA, 13 bp, D. melanogaster
tcgcatttaatat

SEQ ID NO: 649087 - DNA, 13 bp, D. melanogaster
tcgcatttatcca

SEQ ID NO: 649088 - DNA, 13 bp, D. melanogaster
tcgcatttatttg

SEQ ID NO: 649089 - DNA, 13 bp, D. melanogaster
tcgcatttcaaag

SEQ ID NO: 649090 - DNA, 13 bp, D. melanogaster
tcgcatttcaatt

SEQ ID NO: 649091 - DNA, 13 bp, D. melanogaster
tcgcatttcagtt

SEQ ID NO: 649092 - DNA, 13 bp, D. melanogaster
tcgcatttccaat

SEQ ID NO: 649093 - DNA, 13 bp, D. melanogaster
tcgcatttgaact

SEQ ID NO: 649094 - DNA, 13 bp, D. melanogaster
tcgcatttgatct

SEQ ID NO: 649095 - DNA, 13 bp, D. melanogaster
tcgcatttgtttt

SEQ ID NO: 649096 - DNA, 13 bp, D. melanogaster
tcgcattttcggt

SEQ ID NO: 649097 - DNA, 13 bp, D. melanogaster
tcgcattttgcat

SEQ ID NO: 649098 - DNA, 13 bp, D. melanogaster
tcgcattttttgt

SEQ ID NO: 649099 - DNA, 13 bp, D. melanogaster
tcgccaaaaaaaa

SEQ ID NO: 649100 - DNA, 13 bp, D. melanogaster
tcgccacattttc

SEQ ID NO: 649101 - DNA, 13 bp, D. melanogaster
tcgccagcgattt

SEQ ID NO: 649102 - DNA, 13 bp, D. melanogaster
tcgccatcatcat

SEQ ID NO: 649103 - DNA, 14 bp, D. melanogaster
tcgccatcatcatc

SEQ ID NO: 649104 - DNA, 13 bp, D. melanogaster
tcgccatcgccac

SEQ ID NO: 649105 - DNA, 13 bp, D. melanogaster
tcgccatctctct

SEQ ID NO: 649106 - DNA, 13 bp, D. melanogaster
tcgccatctctgt

SEQ ID NO: 649107 - DNA, 13 bp, D. melanogaster
tcgccatcttttt

SEQ ID NO: 649108 - DNA, 13 bp, D. melanogaster
tcgccattgccat

SEQ ID NO: 649109 - DNA, 13 bp, D. melanogaster
tcgccatttgcca

SEQ ID NO: 649110 - DNA, 14 bp, D. melanogaster
tcgcccacacacac

SEQ ID NO: 649111 - DNA, 13 bp, D. melanogaster
tcgcccatcgccc

SEQ ID NO: 649112 - DNA, 13 bp, D. melanogaster
tcgcccatctgaa

SEQ ID NO: 649113 - DNA, 13 bp, D. melanogaster
tcgcccatttttt

SEQ ID NO: 649114 - DNA, 13 bp, D. melanogaster
tcgcccgatgtca

SEQ ID NO: 649115 - DNA, 13 bp, D. melanogaster
tcgccgcctgcca

SEQ ID NO: 649116 - DNA, 13 bp, D. melanogaster
tcgccgccttttg

SEQ ID NO: 649117 - DNA, 13 bp, D. melanogaster
tcgccgctgttgt

SEQ ID NO: 649118 - DNA, 13 bp, D. melanogaster
tcgccgcttttgt

SEQ ID NO: 649119 - DNA, 13 bp, D. melanogaster
tcgccggagacgg

SEQ ID NO: 649120 - DNA, 13 bp, D. melanogaster
tcgccgtcgacgt

SEQ ID NO: 649121 - DNA, 13 bp, D. melanogaster
tcgccgtcgccat

SEQ ID NO: 649122 - DNA, 14 bp, D. melanogaster
tcgccgtcgtcgtc

SEQ ID NO: 649123 - DNA, 13 bp, D. melanogaster
tcgccgtctcttt

SEQ ID NO: 649124 - DNA, 14 bp, D. melanogaster
tcgccgtctctttc

SEQ ID NO: 649125 - DNA, 14 bp, D. melanogaster
tcgccgtggctcta

SEQ ID NO: 649126 - DNA, 13 bp, D. melanogaster
tcgcctcgcctcg

SEQ ID NO: 649127 - DNA, 14 bp, D. melanogaster
tcgcctcgcctcgc

SEQ ID NO: 649128 - DNA, 13 bp, D. melanogaster
tcgcctggcattt

SEQ ID NO: 649129 - DNA, 13 bp, D. melanogaster
tcgcctggtaatt

SEQ ID NO: 649130 - DNA, 13 bp, D. melanogaster
tcgccttcgacga

SEQ ID NO: 649131 - DNA, 13 bp, D. melanogaster
tcgcctttgctgc

SEQ ID NO: 649132 - DNA, 13 bp, D. melanogaster
tcgcctttggctt

SEQ ID NO: 649133 - DNA, 13 bp, D. melanogaster
tcgcctttttggc

SEQ ID NO: 649134 - DNA, 13 bp, D. melanogaster
tcgcgaatcgagc

SEQ ID NO: 649135 - DNA, 14 bp, D. melanogaster
tcgcgaatcgagcc

SEQ ID NO: 649136 - DNA, 13 bp, D. melanogaster
tcgcgactcccac

SEQ ID NO: 649137 - DNA, 13 bp, D. melanogaster
tcgcgagcatttc

SEQ ID NO: 649138 - DNA, 14 bp, D. melanogaster
tcgcgagtgcaaaa

SEQ ID NO: 649139 - DNA, 13 bp, D. melanogaster
tcgcgctctctct

SEQ ID NO: 649140 - DNA, 13 bp, D. melanogaster
tcgcgctgacgct

SEQ ID NO: 649141 - DNA, 14 bp, D. melanogaster
tcgcggaatttaaa

SEQ ID NO: 649142 - DNA, 13 bp, D. melanogaster
tcgcggagcgtgg

SEQ ID NO: 649143 - DNA, 13 bp, D. melanogaster
tcgcgggtgccgc

SEQ ID NO: 649144 - DNA, 13 bp, D. melanogaster
tcgcgtacttctc

SEQ ID NO: 649145 - DNA, 13 bp, D. melanogaster
tcgcgtttattcg

SEQ ID NO: 649146 - DNA, 13 bp, D. melanogaster
tcgctcagcgcaa

SEQ ID NO: 649147 - DNA, 13 bp, D. melanogaster
tcgctcagtttat

SEQ ID NO: 649148 - DNA, 13 bp, D. melanogaster
tcgctccattcca

SEQ ID NO: 649149 - DNA, 13 bp, D. melanogaster
tcgctcgcacaca

SEQ ID NO: 649150 - DNA, 13 bp, D. melanogaster
tcgctcgctcgca

SEQ ID NO: 649151 - DNA, 13 bp, D. melanogaster
tcgctcgctcgct

SEQ ID NO: 649152 - DNA, 13 bp, D. melanogaster
tcgctcgctcgtt

SEQ ID NO: 649153 - DNA, 13 bp, D. melanogaster
tcgctcgctctcc

SEQ ID NO: 649154 - DNA, 13 bp, D. melanogaster
tcgctcgctctct

SEQ ID NO: 649155 - DNA, 13 bp, D. melanogaster
tcgctctcactct

SEQ ID NO: 649156 - DNA, 13 bp, D. melanogaster
tcgctctcgattc

SEQ ID NO: 649157 - DNA, 14 bp, D. melanogaster
tcgctctcgctcgc

SEQ ID NO: 649158 - DNA, 13 bp, D. melanogaster
tcgctctcgctct

SEQ ID NO: 649159 - DNA, 14 bp, D. melanogaster
tcgctctctcgctc

SEQ ID NO: 649160 - DNA, 13 bp, D. melanogaster
tcgctctgctcgc

SEQ ID NO: 649161 - DNA, 14 bp, D. melanogaster
tcgctgaatgatgt

SEQ ID NO: 649162 - DNA, 13 bp, D. melanogaster
tcgctgatcatca

SEQ ID NO: 649163 - DNA, 13 bp, D. melanogaster
tcgctgcagaaaa

SEQ ID NO: 649164 - DNA, 14 bp, D. melanogaster
tcgctgcagaaaaa

SEQ ID NO: 649165 - DNA, 13 bp, D. melanogaster
tcgctgcagtcac

SEQ ID NO: 649166 - DNA, 13 bp, D. melanogaster
tcgctgcattttc

SEQ ID NO: 649167 - DNA, 13 bp, D. melanogaster
tcgctgcattttg

SEQ ID NO: 649168 - DNA, 13 bp, D. melanogaster
tcgctgccgccgc

SEQ ID NO: 649169 - DNA, 13 bp, D. melanogaster
tcgctgcgctttt

SEQ ID NO: 649170 - DNA, 13 bp, D. melanogaster
tcgctgctgctgc

SEQ ID NO: 649171 - DNA, 13 bp, D. melanogaster
tcgctgctgttgc

SEQ ID NO: 649172 - DNA, 14 bp, D. melanogaster
tcgctgctgttgtt

SEQ ID NO: 649173 - DNA, 13 bp, D. melanogaster
tcgctggcatttc

SEQ ID NO: 649174 - DNA, 13 bp, D. melanogaster
tcgctggcatttt

SEQ ID NO: 649175 - DNA, 13 bp, D. melanogaster
tcgctggccaatt

SEQ ID NO: 649176 - DNA, 13 bp, D. melanogaster
tcgctggctgcca

SEQ ID NO: 649177 - DNA, 13 bp, D. melanogaster
tcgctggctgctg

SEQ ID NO: 649178 - DNA, 13 bp, D. melanogaster
tcgctgggaaatg

SEQ ID NO: 649179 - DNA, 13 bp, D. melanogaster
tcgctggtccctg

SEQ ID NO: 649180 - DNA, 14 bp, D. melanogaster
tcgctgtatatata

SEQ ID NO: 649181 - DNA, 13 bp, D. melanogaster
tcgctgtcgttgt

SEQ ID NO: 649182 - DNA, 15 bp, D. melanogaster
tcgctgtgccagctg

SEQ ID NO: 649183 - DNA, 13 bp, D. melanogaster
tcgctgtgtgtgt

SEQ ID NO: 649184 - DNA, 14 bp, D. melanogaster
tcgctgtgtgtgtg

SEQ ID NO: 649185 - DNA, 13 bp, D. melanogaster
tcgctgtgtttgt

SEQ ID NO: 649186 - DNA, 13 bp, D. melanogaster
tcgctgttgaacc

SEQ ID NO: 649187 - DNA, 15 bp, D. melanogaster
tcgctgttgtcatgt

SEQ ID NO: 649188 - DNA, 13 bp, D. melanogaster
tcgctgttgttgt

SEQ ID NO: 649189 - DNA, 13 bp, D. melanogaster
tcgcttaaataca

SEQ ID NO: 649190 - DNA, 14 bp, D. melanogaster
tcgcttaaatacat

SEQ ID NO: 649191 - DNA, 14 bp, D. melanogaster
tcgcttaacaagtt

SEQ ID NO: 649192 - DNA, 13 bp, D. melanogaster
tcgcttaccattt

SEQ ID NO: 649193 - DNA, 14 bp, D. melanogaster
tcgcttattaattt

SEQ ID NO: 649194 - DNA, 13 bp, D. melanogaster
tcgcttattatta

SEQ ID NO: 649195 - DNA, 13 bp, D. melanogaster
tcgcttcattttg

SEQ ID NO: 649196 - DNA, 13 bp, D. melanogaster
tcgcttccgtttc

SEQ ID NO: 649197 - DNA, 13 bp, D. melanogaster
tcgcttgacattt

SEQ ID NO: 649198 - DNA, 13 bp, D. melanogaster
tcgcttgcatttt

SEQ ID NO: 649199 - DNA, 13 bp, D. melanogaster
tcgcttgccaaaa

SEQ ID NO: 649200 - DNA, 13 bp, D. melanogaster
tcgcttgcgatct

SEQ ID NO: 649201 - DNA, 14 bp, D. melanogaster
tcgcttgcgatctt

SEQ ID NO: 649202 - DNA, 13 bp, D. melanogaster
tcgcttggcattt

SEQ ID NO: 649203 - DNA, 13 bp, D. melanogaster
tcgcttggctgca

SEQ ID NO: 649204 - DNA, 14 bp, D. melanogaster
tcgcttggctgcaa

SEQ ID NO: 649205 - DNA, 13 bp, D. melanogaster
tcgcttggctttt

SEQ ID NO: 649206 - DNA, 14 bp, D. melanogaster
tcgcttggtcaaaa

SEQ ID NO: 649207 - DNA, 13 bp, D. melanogaster
tcgctttaattaa

SEQ ID NO: 649208 - DNA, 13 bp, D. melanogaster
tcgctttaatttt

SEQ ID NO: 649209 - DNA, 13 bp, D. melanogaster
tcgctttattttc

SEQ ID NO: 649210 - DNA, 13 bp, D. melanogaster
tcgctttattttg

SEQ ID NO: 649211 - DNA, 13 bp, D. melanogaster
tcgctttcagatt

SEQ ID NO: 649212 - DNA, 13 bp, D. melanogaster
tcgctttccgttt

SEQ ID NO: 649213 - DNA, 13 bp, D. melanogaster
tcgctttcgattt

SEQ ID NO: 649214 - DNA, 13 bp, D. melanogaster
tcgctttcgcatt

SEQ ID NO: 649215 - DNA, 13 bp, D. melanogaster
tcgctttcgggtg

SEQ ID NO: 649216 - DNA, 13 bp, D. melanogaster
tcgctttcggttt

SEQ ID NO: 649217 - DNA, 13 bp, D. melanogaster
tcgctttcgtttg

SEQ ID NO: 649218 - DNA, 13 bp, D. melanogaster
tcgctttgttgac

SEQ ID NO: 649219 - DNA, 13 bp, D. melanogaster
tcgctttgtttat

SEQ ID NO: 649220 - DNA, 13 bp, D. melanogaster
tcgctttgtttgc

SEQ ID NO: 649221 - DNA, 13 bp, D. melanogaster
tcgcttttcaatt

SEQ ID NO: 649222 - DNA, 13 bp, D. melanogaster
tcgcttttccagc

SEQ ID NO: 649223 - DNA, 13 bp, D. melanogaster
tcgcttttccgcc

SEQ ID NO: 649224 - DNA, 13 bp, D. melanogaster
tcgcttttccgct

SEQ ID NO: 649225 - DNA, 13 bp, D. melanogaster
tcgcttttcctgc

SEQ ID NO: 649226 - DNA, 13 bp, D. melanogaster
tcgcttttcttgc

SEQ ID NO: 649227 - DNA, 13 bp, D. melanogaster
tcgcttttgcatt

SEQ ID NO: 649228 - DNA, 13 bp, D. melanogaster
tcgcttttgcctt

SEQ ID NO: 649229 - DNA, 13 bp, D. melanogaster
tcgcttttggccc

SEQ ID NO: 649230 - DNA, 13 bp, D. melanogaster
tcgcttttgggcc

SEQ ID NO: 649231 - DNA, 13 bp, D. melanogaster
tcgcttttgttta

SEQ ID NO: 649232 - DNA, 13 bp, D. melanogaster
tcgctttttacca

SEQ ID NO: 649233 - DNA, 14 bp, D. melanogaster
tcgctttttatatt

SEQ ID NO: 649234 - DNA, 13 bp, D. melanogaster
tcggaaaaacgga

SEQ ID NO: 649235 - DNA, 13 bp, D. melanogaster
tcggaaaaagagg

SEQ ID NO: 649236 - DNA, 13 bp, D. melanogaster
tcggaaaaatcga

SEQ ID NO: 649237 - DNA, 13 bp, D. melanogaster
tcggaaaacgaac

SEQ ID NO: 649238 - DNA, 13 bp, D. melanogaster
tcggaaaactgaa

SEQ ID NO: 649239 - DNA, 13 bp, D. melanogaster
tcggaaaagcgaa

SEQ ID NO: 649240 - DNA, 13 bp, D. melanogaster
tcggaaaagtttt

SEQ ID NO: 649241 - DNA, 13 bp, D. melanogaster
tcggaaaatggga

SEQ ID NO: 649242 - DNA, 13 bp, D. melanogaster
tcggaaaatgtgt

SEQ ID NO: 649243 - DNA, 13 bp, D. melanogaster
tcggaaacgcttc

SEQ ID NO: 649244 - DNA, 14 bp, D. melanogaster
tcggaaacgcttcc

SEQ ID NO: 649245 - DNA, 14 bp, D. melanogaster
tcggaaacgcttct

SEQ ID NO: 649246 - DNA, 13 bp, D. melanogaster
tcggaaacttgaa

SEQ ID NO: 649247 - DNA, 13 bp, D. melanogaster
tcggaaattggtc

SEQ ID NO: 649248 - DNA, 13 bp, D. melanogaster
tcggaagacggaa

SEQ ID NO: 649249 - DNA, 14 bp, D. melanogaster
tcggaagacggaaa

SEQ ID NO: 649250 - DNA, 13 bp, D. melanogaster
tcggaatacattt

SEQ ID NO: 649251 - DNA, 14 bp, D. melanogaster
tcggaatcagaatc

SEQ ID NO: 649252 - DNA, 13 bp, D. melanogaster
tcggaatccgaat

SEQ ID NO: 649253 - DNA, 14 bp, D. melanogaster
tcggaatcgaaatc

SEQ ID NO: 649254 - DNA, 13 bp, D. melanogaster
tcggaatcggaat

SEQ ID NO: 649255 - DNA, 13 bp, D. melanogaster
tcggaatcggatt

SEQ ID NO: 649256 - DNA, 14 bp, D. melanogaster
tcggaattggaatt

SEQ ID NO: 649257 - DNA, 13 bp, D. melanogaster
tcggacaaagaaa

SEQ ID NO: 649258 - DNA, 13 bp, D. melanogaster
tcggacattgtgg

SEQ ID NO: 649259 - DNA, 13 bp, D. melanogaster
tcggaccgcattg

SEQ ID NO: 649260 - DNA, 13 bp, D. melanogaster
tcggactcggact

SEQ ID NO: 649261 - DNA, 14 bp, D. melanogaster
tcggactcggattc

SEQ ID NO: 649262 - DNA, 13 bp, D. melanogaster
tcggactggaaac

SEQ ID NO: 649263 - DNA, 13 bp, D. melanogaster
tcggaggaaaaga

SEQ ID NO: 649264 - DNA, 13 bp, D. melanogaster
tcggaggcgtccg

SEQ ID NO: 649265 - DNA, 14 bp, D. melanogaster
tcggatacagatac

SEQ ID NO: 649266 - DNA, 13 bp, D. melanogaster
tcggatccttttc

SEQ ID NO: 649267 - DNA, 13 bp, D. melanogaster
tcggatcgcatcg

SEQ ID NO: 649268 - DNA, 13 bp, D. melanogaster
tcggatcggatcg

SEQ ID NO: 649269 - DNA, 13 bp, D. melanogaster
tcggatcggatgg

SEQ ID NO: 649270 - DNA, 14 bp, D. melanogaster
tcggatcggattgg

SEQ ID NO: 649271 - DNA, 13 bp, D. melanogaster
tcggatgatgatg

SEQ ID NO: 649272 - DNA, 14 bp, D. melanogaster
tcggatgatgatga

SEQ ID NO: 649273 - DNA, 13 bp, D. melanogaster
tcggattaaaaaa

SEQ ID NO: 649274 - DNA, 13 bp, D. melanogaster
tcggattcagttt

SEQ ID NO: 649275 - DNA, 13 bp, D. melanogaster
tcggattcgaatt

SEQ ID NO: 649276 - DNA, 13 bp, D. melanogaster
tcggattcggaat

SEQ ID NO: 649277 - DNA, 14 bp, D. melanogaster
tcggattcggaatc

SEQ ID NO: 649278 - DNA, 13 bp, D. melanogaster
tcggattcggatc

SEQ ID NO: 649279 - DNA, 14 bp, D. melanogaster
tcggattcggattg

SEQ ID NO: 649280 - DNA, 13 bp, D. melanogaster
tcggattcgggtt

SEQ ID NO: 649281 - DNA, 13 bp, D. melanogaster
tcggattcgtatt

SEQ ID NO: 649282 - DNA, 13 bp, D. melanogaster
tcggattggatcg

SEQ ID NO: 649283 - DNA, 13 bp, D. melanogaster
tcggattgggagt

SEQ ID NO: 649284 - DNA, 13 bp, D. melanogaster
tcggatttggatt

SEQ ID NO: 649285 - DNA, 13 bp, D. melanogaster
tcggcaaacaaat

SEQ ID NO: 649286 - DNA, 13 bp, D. melanogaster
tcggcaaatattt

SEQ ID NO: 649287 - DNA, 13 bp, D. melanogaster
tcggcaacaggac

SEQ ID NO: 649288 - DNA, 14 bp, D. melanogaster
tcggcaatggtgct

SEQ ID NO: 649289 - DNA, 13 bp, D. melanogaster
tcggcactcgctg

SEQ ID NO: 649290 - DNA, 13 bp, D. melanogaster
tcggcactcggca

SEQ ID NO: 649291 - DNA, 13 bp, D. melanogaster
tcggcactgggca

SEQ ID NO: 649292 - DNA, 13 bp, D. melanogaster
tcggcacttacat

SEQ ID NO: 649293 - DNA, 13 bp, D. melanogaster
tcggcagcaacaa

SEQ ID NO: 649294 - DNA, 13 bp, D. melanogaster
tcggcagcagcag

SEQ ID NO: 649295 - DNA, 14 bp, D. melanogaster
tcggcagcagcagc

SEQ ID NO: 649296 - DNA, 13 bp, D. melanogaster
tcggcagtgaaaa

SEQ ID NO: 649297 - DNA, 13 bp, D. melanogaster
tcggcagttaatt

SEQ ID NO: 649298 - DNA, 13 bp, D. melanogaster
tcggcatcatcat

SEQ ID NO: 649299 - DNA, 13 bp, D. melanogaster
tcggcatctgttg

SEQ ID NO: 649300 - DNA, 14 bp, D. melanogaster
tcggccacgcccac

SEQ ID NO: 649301 - DNA, 13 bp, D. melanogaster
tcggccattttgt

SEQ ID NO: 649302 - DNA, 13 bp, D. melanogaster
tcggcctggccaa

SEQ ID NO: 649303 - DNA, 13 bp, D. melanogaster
tcggcgaaatttt

SEQ ID NO: 649304 - DNA, 13 bp, D. melanogaster
tcggcgagcataa

SEQ ID NO: 649305 - DNA, 13 bp, D. melanogaster
tcggcgctgatcg

SEQ ID NO: 649306 - DNA, 14 bp, D. melanogaster
tcggctattgatcc

SEQ ID NO: 649307 - DNA, 13 bp, D. melanogaster
tcggctctggaga

SEQ ID NO: 649308 - DNA, 13 bp, D. melanogaster
tcggctgatgttt

SEQ ID NO: 649309 - DNA, 13 bp, D. melanogaster
tcggctgcggaaa

SEQ ID NO: 649310 - DNA, 14 bp, D. melanogaster
tcggctgcggaaac

SEQ ID NO: 649311 - DNA, 13 bp, D. melanogaster
tcggctgctgctg

SEQ ID NO: 649312 - DNA, 14 bp, D. melanogaster
tcggctgctgctgc

SEQ ID NO: 649313 - DNA, 13 bp, D. melanogaster
tcggctgctgttg

SEQ ID NO: 649314 - DNA, 13 bp, D. melanogaster
tcggctggccagc

SEQ ID NO: 649315 - DNA, 13 bp, D. melanogaster
tcggctggctggc

SEQ ID NO: 649316 - DNA, 13 bp, D. melanogaster
tcggcttggaaat

SEQ ID NO: 649317 - DNA, 13 bp, D. melanogaster
tcgggaatgtcca

SEQ ID NO: 649318 - DNA, 13 bp, D. melanogaster
tcgggaattctgt

SEQ ID NO: 649319 - DNA, 14 bp, D. melanogaster
tcgggatcggaatc

SEQ ID NO: 649320 - DNA, 13 bp, D. melanogaster
tcgggatcgggat

SEQ ID NO: 649321 - DNA, 14 bp, D. melanogaster
tcgggatcgggatc

SEQ ID NO: 649322 - DNA, 13 bp, D. melanogaster
tcgggcagcagag

SEQ ID NO: 649323 - DNA, 13 bp, D. melanogaster
tcgggcccacatt

SEQ ID NO: 649324 - DNA, 14 bp, D. melanogaster
tcgggccgaaatca

SEQ ID NO: 649325 - DNA, 13 bp, D. melanogaster
tcgggctctcgag

SEQ ID NO: 649326 - DNA, 14 bp, D. melanogaster
tcgggctgacatat

SEQ ID NO: 649327 - DNA, 13 bp, D. melanogaster
tcggggaacttga

SEQ ID NO: 649328 - DNA, 13 bp, D. melanogaster
tcggggaagtcga

SEQ ID NO: 649329 - DNA, 13 bp, D. melanogaster
tcggggatcgggg

SEQ ID NO: 649330 - DNA, 13 bp, D. melanogaster
tcggggtcaccaa

SEQ ID NO: 649331 - DNA, 13 bp, D. melanogaster
tcggggtcaccat

SEQ ID NO: 649332 - DNA, 13 bp, D. melanogaster
tcggggttaaatt

SEQ ID NO: 649333 - DNA, 13 bp, D. melanogaster
tcgggtggcattc

SEQ ID NO: 649334 - DNA, 13 bp, D. melanogaster
tcgggttcgggtt

SEQ ID NO: 649335 - DNA, 14 bp, D. melanogaster
tcgggttcgggttc

SEQ ID NO: 649336 - DNA, 13 bp, D. melanogaster
tcggtaaaaaaga

SEQ ID NO: 649337 - DNA, 14 bp, D. melanogaster
tcggtacttggacc

SEQ ID NO: 649338 - DNA, 13 bp, D. melanogaster
tcggtatcggtat

SEQ ID NO: 649339 - DNA, 14 bp, D. melanogaster
tcggtatcggtatc

SEQ ID NO: 649340 - DNA, 13 bp, D. melanogaster
tcggtatctgtat

SEQ ID NO: 649341 - DNA, 13 bp, D. melanogaster
tcggtattttgat

SEQ ID NO: 649342 - DNA, 13 bp, D. melanogaster
tcggtgagcagga

SEQ ID NO: 649343 - DNA, 13 bp, D. melanogaster
tcggtgaggatat

SEQ ID NO: 649344 - DNA, 14 bp, D. melanogaster
tcggtgcataactt

SEQ ID NO: 649345 - DNA, 14 bp, D. melanogaster
tcggtgctcttttg

SEQ ID NO: 649346 - DNA, 13 bp, D. melanogaster
tcggtggaaattg

SEQ ID NO: 649347 - DNA, 13 bp, D. melanogaster
tcggtggcttttg

SEQ ID NO: 649348 - DNA, 13 bp, D. melanogaster
tcggtgtttttcc

SEQ ID NO: 649349 - DNA, 14 bp, D. melanogaster
tcggtgtttttcca

SEQ ID NO: 649350 - DNA, 15 bp, D. melanogaster
tcggtgtttttccag

SEQ ID NO: 649351 - DNA, 14 bp, D. melanogaster
tcggttataatttt

SEQ ID NO: 649352 - DNA, 14 bp, D. melanogaster
tcggttcagttcag

SEQ ID NO: 649353 - DNA, 13 bp, D. melanogaster
tcggttcagttcg

SEQ ID NO: 649354 - DNA, 14 bp, D. melanogaster
tcggttcagttcgg

SEQ ID NO: 649355 - DNA, 13 bp, D. melanogaster
tcggttccaagta

SEQ ID NO: 649356 - DNA, 13 bp, D. melanogaster
tcggttcggatcg

SEQ ID NO: 649357 - DNA, 13 bp, D. melanogaster
tcggttcggttcg

SEQ ID NO: 649358 - DNA, 14 bp, D. melanogaster
tcggttcggttcgg

SEQ ID NO: 649359 - DNA, 14 bp, D. melanogaster
tcggttcggtttgg

SEQ ID NO: 649360 - DNA, 13 bp, D. melanogaster
tcggttcggtttt

SEQ ID NO: 649361 - DNA, 13 bp, D. melanogaster
tcggttcgtttcg

SEQ ID NO: 649362 - DNA, 13 bp, D. melanogaster
tcggttctgttct

SEQ ID NO: 649363 - DNA, 13 bp, D. melanogaster
tcggttgccttct

SEQ ID NO: 649364 - DNA, 13 bp, D. melanogaster
tcggttggtcggt

SEQ ID NO: 649365 - DNA, 13 bp, D. melanogaster
tcggttgtaattg

SEQ ID NO: 649366 - DNA, 14 bp, D. melanogaster
tcggttgttattat

SEQ ID NO: 649367 - DNA, 13 bp, D. melanogaster
tcggtttcggttt

SEQ ID NO: 649368 - DNA, 13 bp, D. melanogaster
tcggtttcgtttc

SEQ ID NO: 649369 - DNA, 13 bp, D. melanogaster
tcggtttcgtttg

SEQ ID NO: 649370 - DNA, 13 bp, D. melanogaster
tcggtttctggtt

SEQ ID NO: 649371 - DNA, 13 bp, D. melanogaster
tcggttttcagtt

SEQ ID NO: 649372 - DNA, 13 bp, D. melanogaster
tcggttttccact

SEQ ID NO: 649373 - DNA, 13 bp, D. melanogaster
tcggttttccatt

SEQ ID NO: 649374 - DNA, 13 bp, D. melanogaster
tcggtttttaatt

SEQ ID NO: 649375 - DNA, 13 bp, D. melanogaster
tcggtttttggtc

SEQ ID NO: 649376 - DNA, 13 bp, D. melanogaster
tcggtttttgtgc

SEQ ID NO: 649377 - DNA, 13 bp, D. melanogaster
tcgtaaaaatgtt

SEQ ID NO: 649378 - DNA, 13 bp, D. melanogaster
tcgtaaaatttta

SEQ ID NO: 649379 - DNA, 13 bp, D. melanogaster
tcgtaaatatttt

SEQ ID NO: 649380 - DNA, 14 bp, D. melanogaster
tcgtaaattttaat

SEQ ID NO: 649381 - DNA, 13 bp, D. melanogaster
tcgtaataaaatt

SEQ ID NO: 649382 - DNA, 13 bp, D. melanogaster
tcgtaatcgtaat

SEQ ID NO: 649383 - DNA, 13 bp, D. melanogaster
tcgtaatgaaatt

SEQ ID NO: 649384 - DNA, 13 bp, D. melanogaster
tcgtacacacaca

SEQ ID NO: 649385 - DNA, 13 bp, D. melanogaster
tcgtaccaaagaa

SEQ ID NO: 649386 - DNA, 13 bp, D. melanogaster
tcgtacggctcga

SEQ ID NO: 649387 - DNA, 13 bp, D. melanogaster
tcgtactcgtact

SEQ ID NO: 649388 - DNA, 13 bp, D. melanogaster
tcgtatacgtaat

SEQ ID NO: 649389 - DNA, 13 bp, D. melanogaster
tcgtatacttaat

SEQ ID NO: 649390 - DNA, 13 bp, D. melanogaster
tcgtatattttat

SEQ ID NO: 649391 - DNA, 13 bp, D. melanogaster
tcgtatcactttt

SEQ ID NO: 649392 - DNA, 13 bp, D. melanogaster
tcgtatccgtatc

SEQ ID NO: 649393 - DNA, 13 bp, D. melanogaster
tcgtatcggatcg

SEQ ID NO: 649394 - DNA, 13 bp, D. melanogaster
tcgtatcgtatcg

SEQ ID NO: 649395 - DNA, 14 bp, D. melanogaster
tcgtatcgtatcgt

SEQ ID NO: 649396 - DNA, 13 bp, D. melanogaster
tcgtatctgtatc

SEQ ID NO: 649397 - DNA, 13 bp, D. melanogaster
tcgtatctgtgcg

SEQ ID NO: 649398 - DNA, 13 bp, D. melanogaster
tcgtatgcgcaat

SEQ ID NO: 649399 - DNA, 13 bp, D. melanogaster
tcgtatgtacata

SEQ ID NO: 649400 - DNA, 13 bp, D. melanogaster
tcgtatgtatgta

SEQ ID NO: 649401 - DNA, 13 bp, D. melanogaster
tcgtattactggg

SEQ ID NO: 649402 - DNA, 13 bp, D. melanogaster
tcgtattcggatt

SEQ ID NO: 649403 - DNA, 14 bp, D. melanogaster
tcgtattcgtattt

SEQ ID NO: 649404 - DNA, 13 bp, D. melanogaster
tcgtattcgtttt

SEQ ID NO: 649405 - DNA, 13 bp, D. melanogaster
tcgtatttacttt

SEQ ID NO: 649406 - DNA, 14 bp, D. melanogaster
tcgtatttatttat

SEQ ID NO: 649407 - DNA, 13 bp, D. melanogaster
tcgtatttcgttt

SEQ ID NO: 649408 - DNA, 13 bp, D. melanogaster
tcgtcacaaaata

SEQ ID NO: 649409 - DNA, 13 bp, D. melanogaster
tcgtcactacgtg

SEQ ID NO: 649410 - DNA, 13 bp, D. melanogaster
tcgtcactttcca

SEQ ID NO: 649411 - DNA, 13 bp, D. melanogaster
tcgtcatcggctg

SEQ ID NO: 649412 - DNA, 14 bp, D. melanogaster
tcgtcatcgtcatc

SEQ ID NO: 649413 - DNA, 13 bp, D. melanogaster
tcgtcatcgtcgt

SEQ ID NO: 649414 - DNA, 14 bp, D. melanogaster
tcgtcatcgtcgtc

SEQ ID NO: 649415 - DNA, 13 bp, D. melanogaster
tcgtcatcgttgt

SEQ ID NO: 649416 - DNA, 13 bp, D. melanogaster
tcgtcatcttcat

SEQ ID NO: 649417 - DNA, 13 bp, D. melanogaster
tcgtcctcatcct

SEQ ID NO: 649418 - DNA, 14 bp, D. melanogaster
tcgtcctcatcctc

SEQ ID NO: 649419 - DNA, 14 bp, D. melanogaster
tcgtcctccgtttt

SEQ ID NO: 649420 - DNA, 13 bp, D. melanogaster
tcgtcctcgtcct

SEQ ID NO: 649421 - DNA, 13 bp, D. melanogaster
tcgtcctgccgcc

SEQ ID NO: 649422 - DNA, 13 bp, D. melanogaster
tcgtcctgcgtcc

SEQ ID NO: 649423 - DNA, 13 bp, D. melanogaster
tcgtcctgctgct

SEQ ID NO: 649424 - DNA, 13 bp, D. melanogaster
tcgtcctggccaa

SEQ ID NO: 649425 - DNA, 13 bp, D. melanogaster
tcgtcctgttcgt

SEQ ID NO: 649426 - DNA, 13 bp, D. melanogaster
tcgtccttcgtcc

SEQ ID NO: 649427 - DNA, 13 bp, D. melanogaster
tcgtccttgctgc

SEQ ID NO: 649428 - DNA, 13 bp, D. melanogaster
tcgtcctttttcg

SEQ ID NO: 649429 - DNA, 13 bp, D. melanogaster
tcgtcctttttgc

SEQ ID NO: 649430 - DNA, 13 bp, D. melanogaster
tcgtcctttttgg

SEQ ID NO: 649431 - DNA, 13 bp, D. melanogaster
tcgtcgccgtcgt

SEQ ID NO: 649432 - DNA, 13 bp, D. melanogaster
tcgtcggtgcagc

SEQ ID NO: 649433 - DNA, 13 bp, D. melanogaster
tcgtcgtcatcat

SEQ ID NO: 649434 - DNA, 14 bp, D. melanogaster
tcgtcgtcatcatc

SEQ ID NO: 649435 - DNA, 13 bp, D. melanogaster
tcgtcgtcatcgc

SEQ ID NO: 649436 - DNA, 14 bp, D. melanogaster
tcgtcgtcctcttc

SEQ ID NO: 649437 - DNA, 13 bp, D. melanogaster
tcgtcgtcgccgt

SEQ ID NO: 649438 - DNA, 14 bp, D. melanogaster
tcgtcgtcgccgtc

SEQ ID NO: 649439 - DNA, 14 bp, D. melanogaster
tcgtcgtcgtcatc

SEQ ID NO: 649440 - DNA, 13 bp, D. melanogaster
tcgtcgtcgtcct

SEQ ID NO: 649441 - DNA, 13 bp, D. melanogaster
tcgtcgtcgtcgg

SEQ ID NO: 649442 - DNA, 14 bp, D. melanogaster
tcgtcgtcgtcgtc

SEQ ID NO: 649443 - DNA, 14 bp, D. melanogaster
tcgtcgtcgtcgtg

SEQ ID NO: 649444 - DNA, 14 bp, D. melanogaster
tcgtcgtcgtcgtt

SEQ ID NO: 649445 - DNA, 13 bp, D. melanogaster
tcgtcgtcgttgt

SEQ ID NO: 649446 - DNA, 14 bp, D. melanogaster
tcgtcgtcgttgtc

SEQ ID NO: 649447 - DNA, 13 bp, D. melanogaster
tcgtcgtcgtttt

SEQ ID NO: 649448 - DNA, 13 bp, D. melanogaster
tcgtcgttgtcgt

SEQ ID NO: 649449 - DNA, 13 bp, D. melanogaster
tcgtcgttgttgt

SEQ ID NO: 649450 - DNA, 13 bp, D. melanogaster
tcgtctacctctg

SEQ ID NO: 649451 - DNA, 13 bp, D. melanogaster
tcgtctcattgtc

SEQ ID NO: 649452 - DNA, 13 bp, D. melanogaster
tcgtctcgtctcg

SEQ ID NO: 649453 - DNA, 14 bp, D. melanogaster
tcgtctcgtctcgt

SEQ ID NO: 649454 - DNA, 13 bp, D. melanogaster
tcgtctgctttcg

SEQ ID NO: 649455 - DNA, 13 bp, D. melanogaster
tcgtcttcgtctt

SEQ ID NO: 649456 - DNA, 13 bp, D. melanogaster
tcgtcttgttcac

SEQ ID NO: 649457 - DNA, 13 bp, D. melanogaster
tcgtgatcgttaa

SEQ ID NO: 649458 - DNA, 13 bp, D. melanogaster
tcgtgcatgccac

SEQ ID NO: 649459 - DNA, 13 bp, D. melanogaster
tcgtgcattgtcg

SEQ ID NO: 649460 - DNA, 13 bp, D. melanogaster
tcgtgcctctgcc

SEQ ID NO: 649461 - DNA, 13 bp, D. melanogaster
tcgtgctctttat

SEQ ID NO: 649462 - DNA, 13 bp, D. melanogaster
tcgtggaattcca

SEQ ID NO: 649463 - DNA, 13 bp, D. melanogaster
tcgtggagcgaag

SEQ ID NO: 649464 - DNA, 13 bp, D. melanogaster
tcgtggccaaaaa

SEQ ID NO: 649465 - DNA, 14 bp, D. melanogaster
tcgtggtgctggtg

SEQ ID NO: 649466 - DNA, 13 bp, D. melanogaster
tcgtgtaatttgt

SEQ ID NO: 649467 - DNA, 13 bp, D. melanogaster
tcgtgtgcctctt

SEQ ID NO: 649468 - DNA, 13 bp, D. melanogaster
tcgtgtgtgcgtg

SEQ ID NO: 649469 - DNA, 13 bp, D. melanogaster
tcgtgtgtgtgag

SEQ ID NO: 649470 - DNA, 13 bp, D. melanogaster
tcgtgttcgtgtt

SEQ ID NO: 649471 - DNA, 13 bp, D. melanogaster
tcgtgttgaaatt

SEQ ID NO: 649472 - DNA, 13 bp, D. melanogaster
tcgtgttttaatt

SEQ ID NO: 649473 - DNA, 13 bp, D. melanogaster
tcgtgttttcggg

SEQ ID NO: 649474 - DNA, 13 bp, D. melanogaster
tcgttaaatatag

SEQ ID NO: 649475 - DNA, 13 bp, D. melanogaster
tcgttaattttta

SEQ ID NO: 649476 - DNA, 13 bp, D. melanogaster
tcgttaccatttt

SEQ ID NO: 649477 - DNA, 14 bp, D. melanogaster
tcgttatcgttatc

SEQ ID NO: 649478 - DNA, 14 bp, D. melanogaster
tcgttattattatt

SEQ ID NO: 649479 - DNA, 13 bp, D. melanogaster
tcgttcatccgcc

SEQ ID NO: 649480 - DNA, 13 bp, D. melanogaster
tcgttcgttcgtt

SEQ ID NO: 649481 - DNA, 13 bp, D. melanogaster
tcgttcgtttatt

SEQ ID NO: 649482 - DNA, 13 bp, D. melanogaster
tcgttctcgtcct

SEQ ID NO: 649483 - DNA, 13 bp, D. melanogaster
tcgttctctgtct

SEQ ID NO: 649484 - DNA, 13 bp, D. melanogaster
tcgttgaaaaagt

SEQ ID NO: 649485 - DNA, 13 bp, D. melanogaster
tcgttgaaaagta

SEQ ID NO: 649486 - DNA, 13 bp, D. melanogaster
tcgttgaccaatt

SEQ ID NO: 649487 - DNA, 13 bp, D. melanogaster
tcgttgagctcgt

SEQ ID NO: 649488 - DNA, 13 bp, D. melanogaster
tcgttgagtttgt

SEQ ID NO: 649489 - DNA, 14 bp, D. melanogaster
tcgttgagtttgtt

SEQ ID NO: 649490 - DNA, 13 bp, D. melanogaster
tcgttgagttttc

SEQ ID NO: 649491 - DNA, 13 bp, D. melanogaster
tcgttgatttttg

SEQ ID NO: 649492 - DNA, 13 bp, D. melanogaster
tcgttgcatactt

SEQ ID NO: 649493 - DNA, 13 bp, D. melanogaster
tcgttgccatatt

SEQ ID NO: 649494 - DNA, 13 bp, D. melanogaster
tcgttgcctactt

SEQ ID NO: 649495 - DNA, 13 bp, D. melanogaster
tcgttggcaaaaa

SEQ ID NO: 649496 - DNA, 13 bp, D. melanogaster
tcgttggccaaaa

SEQ ID NO: 649497 - DNA, 13 bp, D. melanogaster
tcgttgtagttgt

SEQ ID NO: 649498 - DNA, 13 bp, D. melanogaster
tcgttgtcgttgc

SEQ ID NO: 649499 - DNA, 13 bp, D. melanogaster
tcgttgtcgttgt

SEQ ID NO: 649500 - DNA, 13 bp, D. melanogaster
tcgttgtggaaag

SEQ ID NO: 649501 - DNA, 14 bp, D. melanogaster
tcgttgttattgtt

SEQ ID NO: 649502 - DNA, 13 bp, D. melanogaster
tcgttgttgtcgt

SEQ ID NO: 649503 - DNA, 13 bp, D. melanogaster
tcgttgttgttgc

SEQ ID NO: 649504 - DNA, 13 bp, D. melanogaster
tcgtttaataaat

SEQ ID NO: 649505 - DNA, 13 bp, D. melanogaster
tcgtttaattgtt

SEQ ID NO: 649506 - DNA, 13 bp, D. melanogaster
tcgtttatattta

SEQ ID NO: 649507 - DNA, 13 bp, D. melanogaster
tcgtttattgtgt

SEQ ID NO: 649508 - DNA, 13 bp, D. melanogaster
tcgtttcaaattt

SEQ ID NO: 649509 - DNA, 13 bp, D. melanogaster
tcgtttcagtttt

SEQ ID NO: 649510 - DNA, 13 bp, D. melanogaster
tcgtttcattgtt

SEQ ID NO: 649511 - DNA, 13 bp, D. melanogaster
tcgtttcattttg

SEQ ID NO: 649512 - DNA, 13 bp, D. melanogaster
tcgtttccgtttc

SEQ ID NO: 649513 - DNA, 13 bp, D. melanogaster
tcgtttcgattcg

SEQ ID NO: 649514 - DNA, 13 bp, D. melanogaster
tcgtttcgctggc

SEQ ID NO: 649515 - DNA, 13 bp, D. melanogaster
tcgtttcggtttc

SEQ ID NO: 649516 - DNA, 14 bp, D. melanogaster
tcgtttcgtttatt

SEQ ID NO: 649517 - DNA, 13 bp, D. melanogaster
tcgtttcgtttca

SEQ ID NO: 649518 - DNA, 14 bp, D. melanogaster
tcgtttcgtttcgc

SEQ ID NO: 649519 - DNA, 13 bp, D. melanogaster
tcgtttgcaattt

SEQ ID NO: 649520 - DNA, 13 bp, D. melanogaster
tcgtttgcatttg

SEQ ID NO: 649521 - DNA, 14 bp, D. melanogaster
tcgtttgcccaccc

SEQ ID NO: 649522 - DNA, 13 bp, D. melanogaster
tcgtttgcccatc

SEQ ID NO: 649523 - DNA, 13 bp, D. melanogaster
tcgtttgctttgc

SEQ ID NO: 649524 - DNA, 13 bp, D. melanogaster
tcgtttggcattc

SEQ ID NO: 649525 - DNA, 13 bp, D. melanogaster
tcgtttggcgctg

SEQ ID NO: 649526 - DNA, 13 bp, D. melanogaster
tcgttttaaaatt

SEQ ID NO: 649527 - DNA, 13 bp, D. melanogaster
tcgttttacctat

SEQ ID NO: 649528 - DNA, 14 bp, D. melanogaster
tcgttttcaatttg

SEQ ID NO: 649529 - DNA, 13 bp, D. melanogaster
tcgttttcattgc

SEQ ID NO: 649530 - DNA, 13 bp, D. melanogaster
tcgttttccattt

SEQ ID NO: 649531 - DNA, 13 bp, D. melanogaster
tcgttttccgatt

SEQ ID NO: 649532 - DNA, 13 bp, D. melanogaster
tcgttttcgattt

SEQ ID NO: 649533 - DNA, 13 bp, D. melanogaster
tcgttttcttaaa

SEQ ID NO: 649534 - DNA, 15 bp, D. melanogaster
tcgttttgataaatt

SEQ ID NO: 649535 - DNA, 13 bp, D. melanogaster
tcgttttgattca

SEQ ID NO: 649536 - DNA, 13 bp, D. melanogaster
tcgttttggaaat

SEQ ID NO: 649537 - DNA, 13 bp, D. melanogaster
tcgttttggccac

SEQ ID NO: 649538 - DNA, 14 bp, D. melanogaster
tcgttttgtttgcc

SEQ ID NO: 649539 - DNA, 14 bp, D. melanogaster
tcgtttttaaattt

SEQ ID NO: 649540 - DNA, 13 bp, D. melanogaster
tcgtttttaatta

SEQ ID NO: 649541 - DNA, 13 bp, D. melanogaster
tcgtttttatggt

SEQ ID NO: 649542 - DNA, 13 bp, D. melanogaster
tcgtttttcaaaa

SEQ ID NO: 649543 - DNA, 13 bp, D. melanogaster
tcgtttttcagtt

SEQ ID NO: 649544 - DNA, 14 bp, D. melanogaster
tctaaaaagtccat

SEQ ID NO: 649545 - DNA, 13 bp, D. melanogaster
tctaaaaatagaa

SEQ ID NO: 649546 - DNA, 13 bp, D. melanogaster
tctaaaaatgtaa

SEQ ID NO: 649547 - DNA, 13 bp, D. melanogaster
tctaaaaatgtat

SEQ ID NO: 649548 - DNA, 13 bp, D. melanogaster
tctaaaaatttgt

SEQ ID NO: 649549 - DNA, 13 bp, D. melanogaster
tctaaaattgaaa

SEQ ID NO: 649550 - DNA, 13 bp, D. melanogaster
tctaaaatttgtg

SEQ ID NO: 649551 - DNA, 14 bp, D. melanogaster
tctaaaatttgtga

SEQ ID NO: 649552 - DNA, 13 bp, D. melanogaster
tctaaacattttt

SEQ ID NO: 649553 - DNA, 13 bp, D. melanogaster
tctaaagccaaat

SEQ ID NO: 649554 - DNA, 13 bp, D. melanogaster
tctaaagccagat

SEQ ID NO: 649555 - DNA, 13 bp, D. melanogaster
tctaaataaacat

SEQ ID NO: 649556 - DNA, 13 bp, D. melanogaster
tctaaatacattt

SEQ ID NO: 649557 - DNA, 13 bp, D. melanogaster
tctaaatactttt

SEQ ID NO: 649558 - DNA, 13 bp, D. melanogaster
tctaaatatacat

SEQ ID NO: 649559 - DNA, 13 bp, D. melanogaster
tctaaatattttg

SEQ ID NO: 649560 - DNA, 13 bp, D. melanogaster
tctaaatcaaaat

SEQ ID NO: 649561 - DNA, 13 bp, D. melanogaster
tctaaatcaattc

SEQ ID NO: 649562 - DNA, 13 bp, D. melanogaster
tctaaatctaaat

SEQ ID NO: 649563 - DNA, 14 bp, D. melanogaster
tctaaatctaaatc

SEQ ID NO: 649564 - DNA, 13 bp, D. melanogaster
tctaaatcttcta

SEQ ID NO: 649565 - DNA, 13 bp, D. melanogaster
tctaaattagttt

SEQ ID NO: 649566 - DNA, 13 bp, D. melanogaster
tctaaattcgcta

SEQ ID NO: 649567 - DNA, 13 bp, D. melanogaster
tctaaatttaatg

SEQ ID NO: 649568 - DNA, 14 bp, D. melanogaster
tctaaatttccaaa

SEQ ID NO: 649569 - DNA, 13 bp, D. melanogaster
tctaacaaaaatt

SEQ ID NO: 649570 - DNA, 13 bp, D. melanogaster
tctaacaataata

SEQ ID NO: 649571 - DNA, 13 bp, D. melanogaster
tctaacagatttt

SEQ ID NO: 649572 - DNA, 13 bp, D. melanogaster
tctaaccaagttt

SEQ ID NO: 649573 - DNA, 13 bp, D. melanogaster
tctaacgcccaca

SEQ ID NO: 649574 - DNA, 14 bp, D. melanogaster
tctaacgcccacaa

SEQ ID NO: 649575 - DNA, 13 bp, D. melanogaster
tctaactaactaa

SEQ ID NO: 649576 - DNA, 13 bp, D. melanogaster
tctaactatctat

SEQ ID NO: 649577 - DNA, 13 bp, D. melanogaster
tctaacttaatta

SEQ ID NO: 649578 - DNA, 13 bp, D. melanogaster
tctaagaaattga

SEQ ID NO: 649579 - DNA, 14 bp, D. melanogaster
tctaagaaattgag

SEQ ID NO: 649580 - DNA, 13 bp, D. melanogaster
tctaagaacttct

SEQ ID NO: 649581 - DNA, 13 bp, D. melanogaster
tctaagaactttt

SEQ ID NO: 649582 - DNA, 13 bp, D. melanogaster
tctaagatgaggg

SEQ ID NO: 649583 - DNA, 13 bp, D. melanogaster
tctaagcaccaaa

SEQ ID NO: 649584 - DNA, 13 bp, D. melanogaster
tctaaggaatttg

SEQ ID NO: 649585 - DNA, 13 bp, D. melanogaster
tctaataactttt

SEQ ID NO: 649586 - DNA, 13 bp, D. melanogaster
tctaatcaaattt

SEQ ID NO: 649587 - DNA, 13 bp, D. melanogaster
tctaatgaaatgt

SEQ ID NO: 649588 - DNA, 13 bp, D. melanogaster
tctaatgcaattt

SEQ ID NO: 649589 - DNA, 13 bp, D. melanogaster
tctaatggaaatt

SEQ ID NO: 649590 - DNA, 13 bp, D. melanogaster
tctaatgtctttg

SEQ ID NO: 649591 - DNA, 13 bp, D. melanogaster
tctaattaaaaac

SEQ ID NO: 649592 - DNA, 13 bp, D. melanogaster
tctaattaaatgc

SEQ ID NO: 649593 - DNA, 13 bp, D. melanogaster
tctaattatgtaa

SEQ ID NO: 649594 - DNA, 13 bp, D. melanogaster
tctaattgaaaat

SEQ ID NO: 649595 - DNA, 13 bp, D. melanogaster
tctaattgaaata

SEQ ID NO: 649596 - DNA, 13 bp, D. melanogaster
tctaattgaaatg

SEQ ID NO: 649597 - DNA, 13 bp, D. melanogaster
tctaattgaattt

SEQ ID NO: 649598 - DNA, 13 bp, D. melanogaster
tctaattggattt

SEQ ID NO: 649599 - DNA, 13 bp, D. melanogaster
tctaattgtgatt

SEQ ID NO: 649600 - DNA, 14 bp, D. melanogaster
tctaatttccaaaa

SEQ ID NO: 649601 - DNA, 13 bp, D. melanogaster
tctaatttgcatt

SEQ ID NO: 649602 - DNA, 13 bp, D. melanogaster
tctaatttgctta

SEQ ID NO: 649603 - DNA, 13 bp, D. melanogaster
tctacaaaaatct

SEQ ID NO: 649604 - DNA, 13 bp, D. melanogaster
tctacaaaatgtt

SEQ ID NO: 649605 - DNA, 13 bp, D. melanogaster
tctacaatataaa

SEQ ID NO: 649606 - DNA, 13 bp, D. melanogaster
tctacaatgattt

SEQ ID NO: 649607 - DNA, 13 bp, D. melanogaster
tctacaatgtttt

SEQ ID NO: 649608 - DNA, 13 bp, D. melanogaster
tctacaattctta

SEQ ID NO: 649609 - DNA, 13 bp, D. melanogaster
tctacacatacaa

SEQ ID NO: 649610 - DNA, 13 bp, D. melanogaster
tctacaggaatac

SEQ ID NO: 649611 - DNA, 17 bp, D. melanogaster
tctacatacatacatat

SEQ ID NO: 649612 - DNA, 14 bp, D. melanogaster
tctacatacatatg

SEQ ID NO: 649613 - DNA, 13 bp, D. melanogaster
tctacatctacat

SEQ ID NO: 649614 - DNA, 13 bp, D. melanogaster
tctacattaaaaa

SEQ ID NO: 649615 - DNA, 13 bp, D. melanogaster
tctacattctaca

SEQ ID NO: 649616 - DNA, 13 bp, D. melanogaster
tctaccaaacaaa

SEQ ID NO: 649617 - DNA, 13 bp, D. melanogaster
tctaccaacacat

SEQ ID NO: 649618 - DNA, 15 bp, D. melanogaster
tctaccagaaccctg

SEQ ID NO: 649619 - DNA, 13 bp, D. melanogaster
tctacggcctgca

SEQ ID NO: 649620 - DNA, 13 bp, D. melanogaster
tctactaaatgaa

SEQ ID NO: 649621 - DNA, 14 bp, D. melanogaster
tctactacgtcata

SEQ ID NO: 649622 - DNA, 13 bp, D. melanogaster
tctactatatgcg

SEQ ID NO: 649623 - DNA, 13 bp, D. melanogaster
tctactgggagcc

SEQ ID NO: 649624 - DNA, 13 bp, D. melanogaster
tctacttcgattt

SEQ ID NO: 649625 - DNA, 13 bp, D. melanogaster
tctacttctactt

SEQ ID NO: 649626 - DNA, 13 bp, D. melanogaster
tctactttatagt

SEQ ID NO: 649627 - DNA, 13 bp, D. melanogaster
tctacttttgcta

SEQ ID NO: 649628 - DNA, 13 bp, D. melanogaster
tctagacacagga

SEQ ID NO: 649629 - DNA, 13 bp, D. melanogaster
tctagaccaaaaa

SEQ ID NO: 649630 - DNA, 13 bp, D. melanogaster
tctagactctaga

SEQ ID NO: 649631 - DNA, 13 bp, D. melanogaster
tctagagtctaga

SEQ ID NO: 649632 - DNA, 13 bp, D. melanogaster
tctagataacttt

SEQ ID NO: 649633 - DNA, 13 bp, D. melanogaster
tctagatatcttc

SEQ ID NO: 649634 - DNA, 13 bp, D. melanogaster
tctagatctagaa

SEQ ID NO: 649635 - DNA, 13 bp, D. melanogaster
tctagattctaga

SEQ ID NO: 649636 - DNA, 13 bp, D. melanogaster
tctagcttgctat

SEQ ID NO: 649637 - DNA, 13 bp, D. melanogaster
tctagtaaacaag

SEQ ID NO: 649638 - DNA, 14 bp, D. melanogaster
tctagtaaacaaga

SEQ ID NO: 649639 - DNA, 13 bp, D. melanogaster
tctagtctgcatt

SEQ ID NO: 649640 - DNA, 14 bp, D. melanogaster
tctagtgtctttgc

SEQ ID NO: 649641 - DNA, 13 bp, D. melanogaster
tctagttctagtt

SEQ ID NO: 649642 - DNA, 13 bp, D. melanogaster
tctagttctatct

SEQ ID NO: 649643 - DNA, 13 bp, D. melanogaster
tctagttgcaatt

SEQ ID NO: 649644 - DNA, 13 bp, D. melanogaster
tctagtttcactt

SEQ ID NO: 649645 - DNA, 14 bp, D. melanogaster
tctagtttcacttg

SEQ ID NO: 649646 - DNA, 13 bp, D. melanogaster
tctataaaaagtt

SEQ ID NO: 649647 - DNA, 13 bp, D. melanogaster
tctataaatttca

SEQ ID NO: 649648 - DNA, 13 bp, D. melanogaster
tctataactataa

SEQ ID NO: 649649 - DNA, 13 bp, D. melanogaster
tctataacttcat

SEQ ID NO: 649650 - DNA, 13 bp, D. melanogaster
tctataagataca

SEQ ID NO: 649651 - DNA, 13 bp, D. melanogaster
tctataagatttt

SEQ ID NO: 649652 - DNA, 13 bp, D. melanogaster
tctatacaactcc

SEQ ID NO: 649653 - DNA, 13 bp, D. melanogaster
tctatacagccaa

SEQ ID NO: 649654 - DNA, 13 bp, D. melanogaster
tctatacatatgt

SEQ ID NO: 649655 - DNA, 13 bp, D. melanogaster
tctatacatattt

SEQ ID NO: 649656 - DNA, 13 bp, D. melanogaster
tctatactatata

SEQ ID NO: 649657 - DNA, 13 bp, D. melanogaster
tctatagctaaag

SEQ ID NO: 649658 - DNA, 13 bp, D. melanogaster
tctataggtttct

SEQ ID NO: 649659 - DNA, 13 bp, D. melanogaster
tctatagttgtta

SEQ ID NO: 649660 - DNA, 13 bp, D. melanogaster
tctatataaacat

SEQ ID NO: 649661 - DNA, 13 bp, D. melanogaster
tctatatacaata

SEQ ID NO: 649662 - DNA, 13 bp, D. melanogaster
tctatatacattt

SEQ ID NO: 649663 - DNA, 13 bp, D. melanogaster
tctatatatacat

SEQ ID NO: 649664 - DNA, 15 bp, D. melanogaster
tctatatatacatat

SEQ ID NO: 649665 - DNA, 14 bp, D. melanogaster
tctatatatatatg

SEQ ID NO: 649666 - DNA, 13 bp, D. melanogaster
tctatatatgtaa

SEQ ID NO: 649667 - DNA, 14 bp, D. melanogaster
tctatatatgtatg

SEQ ID NO: 649668 - DNA, 15 bp, D. melanogaster
tctatatatgtatgt

SEQ ID NO: 649669 - DNA, 13 bp, D. melanogaster
tctatatcaaaaa

SEQ ID NO: 649670 - DNA, 14 bp, D. melanogaster
tctatatcaaaaac

SEQ ID NO: 649671 - DNA, 13 bp, D. melanogaster
tctatatcataaa

SEQ ID NO: 649672 - DNA, 13 bp, D. melanogaster
tctatatccatat

SEQ ID NO: 649673 - DNA, 13 bp, D. melanogaster
tctatatgtacat

SEQ ID NO: 649674 - DNA, 13 bp, D. melanogaster
tctatatgtgtat

SEQ ID NO: 649675 - DNA, 13 bp, D. melanogaster
tctatatgtgtgt

SEQ ID NO: 649676 - DNA, 13 bp, D. melanogaster
tctatatttaagt

SEQ ID NO: 649677 - DNA, 13 bp, D. melanogaster
tctatattttcga

SEQ ID NO: 649678 - DNA, 14 bp, D. melanogaster
tctatcaaaacttt

SEQ ID NO: 649679 - DNA, 13 bp, D. melanogaster
tctatccatctat

SEQ ID NO: 649680 - DNA, 13 bp, D. melanogaster
tctatcgatatgc

SEQ ID NO: 649681 - DNA, 13 bp, D. melanogaster
tctatcgatattc

SEQ ID NO: 649682 - DNA, 13 bp, D. melanogaster
tctatcgatttgt

SEQ ID NO: 649683 - DNA, 13 bp, D. melanogaster
tctatctatctat

SEQ ID NO: 649684 - DNA, 13 bp, D. melanogaster
tctatctcaaaat

SEQ ID NO: 649685 - DNA, 13 bp, D. melanogaster
tctatctctatct

SEQ ID NO: 649686 - DNA, 14 bp, D. melanogaster
tctatctctatctc

SEQ ID NO: 649687 - DNA, 13 bp, D. melanogaster
tctatctgatgga

SEQ ID NO: 649688 - DNA, 13 bp, D. melanogaster
tctatctgtctat

SEQ ID NO: 649689 - DNA, 13 bp, D. melanogaster
tctatctgtctct

SEQ ID NO: 649690 - DNA, 13 bp, D. melanogaster
tctatcttggcta

SEQ ID NO: 649691 - DNA, 13 bp, D. melanogaster
tctatgaatattt

SEQ ID NO: 649692 - DNA, 13 bp, D. melanogaster
tctatgacagaaa

SEQ ID NO: 649693 - DNA, 13 bp, D. melanogaster
tctatgcaaatat

SEQ ID NO: 649694 - DNA, 13 bp, D. melanogaster
tctatgcaatcga

SEQ ID NO: 649695 - DNA, 13 bp, D. melanogaster
tctatgccatcat

SEQ ID NO: 649696 - DNA, 13 bp, D. melanogaster
tctatgctaaagt

SEQ ID NO: 649697 - DNA, 13 bp, D. melanogaster
tctatggcttaaa

SEQ ID NO: 649698 - DNA, 14 bp, D. melanogaster
tctatggcttaaat

SEQ ID NO: 649699 - DNA, 13 bp, D. melanogaster
tctatgtaaatat

SEQ ID NO: 649700 - DNA, 13 bp, D. melanogaster
tctatgtatatat

SEQ ID NO: 649701 - DNA, 13 bp, D. melanogaster
tctatgtgtgcgt

SEQ ID NO: 649702 - DNA, 13 bp, D. melanogaster
tctatgtgtgtat

SEQ ID NO: 649703 - DNA, 13 bp, D. melanogaster
tctatgttataat

SEQ ID NO: 649704 - DNA, 13 bp, D. melanogaster
tctattagatttt

SEQ ID NO: 649705 - DNA, 13 bp, D. melanogaster
tctattatgatcg

SEQ ID NO: 649706 - DNA, 13 bp, D. melanogaster
tctattctattcc

SEQ ID NO: 649707 - DNA, 13 bp, D. melanogaster
tctattctgtcta

SEQ ID NO: 649708 - DNA, 13 bp, D. melanogaster
tctattgatttat

SEQ ID NO: 649709 - DNA, 14 bp, D. melanogaster
tctattgttgtggc

SEQ ID NO: 649710 - DNA, 15 bp, D. melanogaster
tctatttaagccaat

SEQ ID NO: 649711 - DNA, 13 bp, D. melanogaster
tctatttatgtat

SEQ ID NO: 649712 - DNA, 14 bp, D. melanogaster
tctatttcttcgcc

SEQ ID NO: 649713 - DNA, 13 bp, D. melanogaster
tctatttgaaaga

SEQ ID NO: 649714 - DNA, 13 bp, D. melanogaster
tctatttgccaaa

SEQ ID NO: 649715 - DNA, 13 bp, D. melanogaster
tctatttgtactt

SEQ ID NO: 649716 - DNA, 13 bp, D. melanogaster
tctatttgttgtg

SEQ ID NO: 649717 - DNA, 13 bp, D. melanogaster
tctattttccgaa

SEQ ID NO: 649718 - DNA, 14 bp, D. melanogaster
tctattttggccag

SEQ ID NO: 649719 - DNA, 13 bp, D. melanogaster
tctattttgggtg

SEQ ID NO: 649720 - DNA, 14 bp, D. melanogaster
tctcaaaaatttca

SEQ ID NO: 649721 - DNA, 14 bp, D. melanogaster
tctcaaaatgtaat

SEQ ID NO: 649722 - DNA, 13 bp, D. melanogaster
tctcaaacacctt

SEQ ID NO: 649723 - DNA, 13 bp, D. melanogaster
tctcaaacatttt

SEQ ID NO: 649724 - DNA, 13 bp, D. melanogaster
tctcaaagagaac

SEQ ID NO: 649725 - DNA, 13 bp, D. melanogaster
tctcaaagttaaa

SEQ ID NO: 649726 - DNA, 13 bp, D. melanogaster
tctcaaatattta

SEQ ID NO: 649727 - DNA, 13 bp, D. melanogaster
tctcaaatatttt

SEQ ID NO: 649728 - DNA, 13 bp, D. melanogaster
tctcaaatttaat

SEQ ID NO: 649729 - DNA, 14 bp, D. melanogaster
tctcaacatatttt

SEQ ID NO: 649730 - DNA, 13 bp, D. melanogaster
tctcaactcaact

SEQ ID NO: 649731 - DNA, 13 bp, D. melanogaster
tctcaacttcaac

SEQ ID NO: 649732 - DNA, 13 bp, D. melanogaster
tctcaagactttc

SEQ ID NO: 649733 - DNA, 14 bp, D. melanogaster
tctcaagactttcg

SEQ ID NO: 649734 - DNA, 13 bp, D. melanogaster
tctcaataatggg

SEQ ID NO: 649735 - DNA, 13 bp, D. melanogaster
tctcaatatattt

SEQ ID NO: 649736 - DNA, 13 bp, D. melanogaster
tctcaatattttc

SEQ ID NO: 649737 - DNA, 13 bp, D. melanogaster
tctcaatctaaat

SEQ ID NO: 649738 - DNA, 14 bp, D. melanogaster
tctcaatctcaatc

SEQ ID NO: 649739 - DNA, 13 bp, D. melanogaster
tctcaatctgaat

SEQ ID NO: 649740 - DNA, 14 bp, D. melanogaster
tctcaatctgaatc

SEQ ID NO: 649741 - DNA, 13 bp, D. melanogaster
tctcaatgaaatt

SEQ ID NO: 649742 - DNA, 13 bp, D. melanogaster
tctcaatgcaata

SEQ ID NO: 649743 - DNA, 13 bp, D. melanogaster
tctcaattgtgga

SEQ ID NO: 649744 - DNA, 13 bp, D. melanogaster
tctcaattgtttt

SEQ ID NO: 649745 - DNA, 13 bp, D. melanogaster
tctcaatttgcat

SEQ ID NO: 649746 - DNA, 13 bp, D. melanogaster
tctcaattttaaa

SEQ ID NO: 649747 - DNA, 14 bp, D. melanogaster
tctcacaaccaaaa

SEQ ID NO: 649748 - DNA, 13 bp, D. melanogaster
tctcacacacaca

SEQ ID NO: 649749 - DNA, 14 bp, D. melanogaster
tctcacacacacac

SEQ ID NO: 649750 - DNA, 13 bp, D. melanogaster
tctcacacacact

SEQ ID NO: 649751 - DNA, 13 bp, D. melanogaster
tctcacccacaca

SEQ ID NO: 649752 - DNA, 13 bp, D. melanogaster
tctcacctttgat

SEQ ID NO: 649753 - DNA, 13 bp, D. melanogaster
tctcactcgcaca

SEQ ID NO: 649754 - DNA, 14 bp, D. melanogaster
tctcactcgcacac

SEQ ID NO: 649755 - DNA, 13 bp, D. melanogaster
tctcactcgcact

SEQ ID NO: 649756 - DNA, 13 bp, D. melanogaster
tctcagaaactat

SEQ ID NO: 649757 - DNA, 13 bp, D. melanogaster
tctcagctctcag

SEQ ID NO: 649758 - DNA, 13 bp, D. melanogaster
tctcaggccaaat

SEQ ID NO: 649759 - DNA, 13 bp, D. melanogaster
tctcagtgcagcg

SEQ ID NO: 649760 - DNA, 13 bp, D. melanogaster
tctcagtgtgtgt

SEQ ID NO: 649761 - DNA, 13 bp, D. melanogaster
tctcataaatatt

SEQ ID NO: 649762 - DNA, 13 bp, D. melanogaster
tctcatcctcatc

SEQ ID NO: 649763 - DNA, 13 bp, D. melanogaster
tctcatctcatct

SEQ ID NO: 649764 - DNA, 14 bp, D. melanogaster
tctcatctcatctc

SEQ ID NO: 649765 - DNA, 14 bp, D. melanogaster
tctcattctcattc

SEQ ID NO: 649766 - DNA, 13 bp, D. melanogaster
tctcattctgtct

SEQ ID NO: 649767 - DNA, 13 bp, D. melanogaster
tctcattgaaaaa

SEQ ID NO: 649768 - DNA, 14 bp, D. melanogaster
tctcattgaaaaaa

SEQ ID NO: 649769 - DNA, 14 bp, D. melanogaster
tctcatttatgttt

SEQ ID NO: 649770 - DNA, 13 bp, D. melanogaster
tctcatttgttgg

SEQ ID NO: 649771 - DNA, 13 bp, D. melanogaster
tctccaaaaacaa

SEQ ID NO: 649772 - DNA, 13 bp, D. melanogaster
tctccaaaaacac

SEQ ID NO: 649773 - DNA, 13 bp, D. melanogaster
tctccaaaaatat

SEQ ID NO: 649774 - DNA, 13 bp, D. melanogaster
tctccaactccaa

SEQ ID NO: 649775 - DNA, 14 bp, D. melanogaster
tctccacagactac

SEQ ID NO: 649776 - DNA, 13 bp, D. melanogaster
tctccacctatcc

SEQ ID NO: 649777 - DNA, 13 bp, D. melanogaster
tctccacctcttg

SEQ ID NO: 649778 - DNA, 13 bp, D. melanogaster
tctccactccact

SEQ ID NO: 649779 - DNA, 13 bp, D. melanogaster
tctccagatgctg

SEQ ID NO: 649780 - DNA, 13 bp, D. melanogaster
tctccagctctcc

SEQ ID NO: 649781 - DNA, 13 bp, D. melanogaster
tctccagtcggca

SEQ ID NO: 649782 - DNA, 13 bp, D. melanogaster
tctccatcatcat

SEQ ID NO: 649783 - DNA, 13 bp, D. melanogaster
tctccatcgccat

SEQ ID NO: 649784 - DNA, 14 bp, D. melanogaster
tctccatcgccatc

SEQ ID NO: 649785 - DNA, 14 bp, D. melanogaster
tctccatctccatc

SEQ ID NO: 649786 - DNA, 13 bp, D. melanogaster
tctccatctctat

SEQ ID NO: 649787 - DNA, 13 bp, D. melanogaster
tctccatcttcat

SEQ ID NO: 649788 - DNA, 13 bp, D. melanogaster
tctccattatatt

SEQ ID NO: 649789 - DNA, 14 bp, D. melanogaster
tctccatttaataa

SEQ ID NO: 649790 - DNA, 13 bp, D. melanogaster
tctccatttccat

SEQ ID NO: 649791 - DNA, 13 bp, D. melanogaster
tctcccaaaaaca

SEQ ID NO: 649792 - DNA, 13 bp, D. melanogaster
tctcccagtgcag

SEQ ID NO: 649793 - DNA, 14 bp, D. melanogaster
tctcccagtgcagc

SEQ ID NO: 649794 - DNA, 13 bp, D. melanogaster
tctcccgcactgg

SEQ ID NO: 649795 - DNA, 13 bp, D. melanogaster
tctccctgaagtt

SEQ ID NO: 649796 - DNA, 13 bp, D. melanogaster
tctccgacattcg

SEQ ID NO: 649797 - DNA, 14 bp, D. melanogaster
tctccgatcatttt

SEQ ID NO: 649798 - DNA, 13 bp, D. melanogaster
tctccgattctcc

SEQ ID NO: 649799 - DNA, 13 bp, D. melanogaster
tctccgctgctct

SEQ ID NO: 649800 - DNA, 13 bp, D. melanogaster
tctccggcgaaag

SEQ ID NO: 649801 - DNA, 13 bp, D. melanogaster
tctccgtctccgt

SEQ ID NO: 649802 - DNA, 13 bp, D. melanogaster
tctccgttcaaaa

SEQ ID NO: 649803 - DNA, 13 bp, D. melanogaster
tctcctctgaaga

SEQ ID NO: 649804 - DNA, 13 bp, D. melanogaster
tctcgaaagcagc

SEQ ID NO: 649805 - DNA, 13 bp, D. melanogaster
tctcgaaataaaa

SEQ ID NO: 649806 - DNA, 13 bp, D. melanogaster
tctcgaaatcaag

SEQ ID NO: 649807 - DNA, 14 bp, D. melanogaster
tctcgaatttttgt

SEQ ID NO: 649808 - DNA, 13 bp, D. melanogaster
tctcgattcattt

SEQ ID NO: 649809 - DNA, 14 bp, D. melanogaster
tctcgattcattta

SEQ ID NO: 649810 - DNA, 13 bp, D. melanogaster
tctcgatttccaa

SEQ ID NO: 649811 - DNA, 13 bp, D. melanogaster
tctcgcacacaca

SEQ ID NO: 649812 - DNA, 14 bp, D. melanogaster
tctcgcacacacac

SEQ ID NO: 649813 - DNA, 13 bp, D. melanogaster
tctcgcagcgcca

SEQ ID NO: 649814 - DNA, 13 bp, D. melanogaster
tctcgctatctgc

SEQ ID NO: 649815 - DNA, 14 bp, D. melanogaster
tctcgctatctgcc

SEQ ID NO: 649816 - DNA, 13 bp, D. melanogaster
tctcgctcgctct

SEQ ID NO: 649817 - DNA, 14 bp, D. melanogaster
tctcgctcgctctc

SEQ ID NO: 649818 - DNA, 14 bp, D. melanogaster
tctcgctcgctctt

SEQ ID NO: 649819 - DNA, 13 bp, D. melanogaster
tctcgctctcgcc

SEQ ID NO: 649820 - DNA, 14 bp, D. melanogaster
tctcgctctcgctc

SEQ ID NO: 649821 - DNA, 13 bp, D. melanogaster
tctcgctctttcg

SEQ ID NO: 649822 - DNA, 13 bp, D. melanogaster
tctcgctgtgcat

SEQ ID NO: 649823 - DNA, 13 bp, D. melanogaster
tctcgggcagcag

SEQ ID NO: 649824 - DNA, 13 bp, D. melanogaster
tctcggtgcagca

SEQ ID NO: 649825 - DNA, 13 bp, D. melanogaster
tctcgtctcgttt

SEQ ID NO: 649826 - DNA, 13 bp, D. melanogaster
tctcgttcgcact

SEQ ID NO: 649827 - DNA, 13 bp, D. melanogaster
tctcgttctcgtt

SEQ ID NO: 649828 - DNA, 13 bp, D. melanogaster
tctcgttctctgt

SEQ ID NO: 649829 - DNA, 13 bp, D. melanogaster
tctcgttttgcat

SEQ ID NO: 649830 - DNA, 13 bp, D. melanogaster
tctcgtttttggc

SEQ ID NO: 649831 - DNA, 13 bp, D. melanogaster
tctctaacaaaaa

SEQ ID NO: 649832 - DNA, 13 bp, D. melanogaster
tctctatagacat

SEQ ID NO: 649833 - DNA, 13 bp, D. melanogaster
tctctatatatac

SEQ ID NO: 649834 - DNA, 14 bp, D. melanogaster
tctctatatatata

SEQ ID NO: 649835 - DNA, 13 bp, D. melanogaster
tctctatctctat

SEQ ID NO: 649836 - DNA, 13 bp, D. melanogaster
tctctattctcaa

SEQ ID NO: 649837 - DNA, 13 bp, D. melanogaster
tctctcaaattta

SEQ ID NO: 649838 - DNA, 13 bp, D. melanogaster
tctctcagtgtgt

SEQ ID NO: 649839 - DNA, 13 bp, D. melanogaster
tctctcatctgac

SEQ ID NO: 649840 - DNA, 14 bp, D. melanogaster
tctctcgctcgcac

SEQ ID NO: 649841 - DNA, 13 bp, D. melanogaster
tctctcgctctca

SEQ ID NO: 649842 - DNA, 13 bp, D. melanogaster
tctctcgctctcg

SEQ ID NO: 649843 - DNA, 13 bp, D. melanogaster
tctctcgctcttg

SEQ ID NO: 649844 - DNA, 14 bp, D. melanogaster
tctctctatctatc

SEQ ID NO: 649845 - DNA, 13 bp, D. melanogaster
tctctctcactca

SEQ ID NO: 649846 - DNA, 13 bp, D. melanogaster
tctctctcgctca

SEQ ID NO: 649847 - DNA, 14 bp, D. melanogaster
tctctctcgctctg

SEQ ID NO: 649848 - DNA, 14 bp, D. melanogaster
tctctctctctcaa

SEQ ID NO: 649849 - DNA, 13 bp, D. melanogaster
tctctctctgtcg

SEQ ID NO: 649850 - DNA, 13 bp, D. melanogaster
tctctctgtatct

SEQ ID NO: 649851 - DNA, 13 bp, D. melanogaster
tctctctgtcgct

SEQ ID NO: 649852 - DNA, 13 bp, D. melanogaster
tctctctgtgcac

SEQ ID NO: 649853 - DNA, 13 bp, D. melanogaster
tctctctgtgtag

SEQ ID NO: 649854 - DNA, 13 bp, D. melanogaster
tctctctgtgtgc

SEQ ID NO: 649855 - DNA, 13 bp, D. melanogaster
tctctgatttcat

SEQ ID NO: 649856 - DNA, 13 bp, D. melanogaster
tctctgctctgct

SEQ ID NO: 649857 - DNA, 13 bp, D. melanogaster
tctctgctgctgc

SEQ ID NO: 649858 - DNA, 13 bp, D. melanogaster
tctctgctttgcc

SEQ ID NO: 649859 - DNA, 14 bp, D. melanogaster
tctctgctttgcct

SEQ ID NO: 649860 - DNA, 13 bp, D. melanogaster
tctctggcatttt

SEQ ID NO: 649861 - DNA, 13 bp, D. melanogaster
tctctggctctct

SEQ ID NO: 649862 - DNA, 13 bp, D. melanogaster
tctctggcttttg

SEQ ID NO: 649863 - DNA, 13 bp, D. melanogaster
tctctgtaaatta

SEQ ID NO: 649864 - DNA, 13 bp, D. melanogaster
tctctgtcgcacc

SEQ ID NO: 649865 - DNA, 13 bp, D. melanogaster
tctctgtcgctcc

SEQ ID NO: 649866 - DNA, 13 bp, D. melanogaster
tctctgtcgctct

SEQ ID NO: 649867 - DNA, 13 bp, D. melanogaster
tctctgtctctgt

SEQ ID NO: 649868 - DNA, 14 bp, D. melanogaster
tctctgtctctgtc

SEQ ID NO: 649869 - DNA, 13 bp, D. melanogaster
tctctgtgcattt

SEQ ID NO: 649870 - DNA, 13 bp, D. melanogaster
tctctgtgtgtgt

SEQ ID NO: 649871 - DNA, 13 bp, D. melanogaster
tctcttcgacttt

SEQ ID NO: 649872 - DNA, 13 bp, D. melanogaster
tctcttctggcca

SEQ ID NO: 649873 - DNA, 13 bp, D. melanogaster
tctcttggccaaa

SEQ ID NO: 649874 - DNA, 13 bp, D. melanogaster
tctctttcgcaca

SEQ ID NO: 649875 - DNA, 13 bp, D. melanogaster
tctctttcgcacc

SEQ ID NO: 649876 - DNA, 13 bp, D. melanogaster
tctctttcgctcg

SEQ ID NO: 649877 - DNA, 13 bp, D. melanogaster
tctctttcgctgg

SEQ ID NO: 649878 - DNA, 13 bp, D. melanogaster
tctctttctggcc

SEQ ID NO: 649879 - DNA, 13 bp, D. melanogaster
tctctttgcattt

SEQ ID NO: 649880 - DNA, 13 bp, D. melanogaster
tctctttgccatt

SEQ ID NO: 649881 - DNA, 13 bp, D. melanogaster
tctctttgtattc

SEQ ID NO: 649882 - DNA, 13 bp, D. melanogaster
tctcttttaattg

SEQ ID NO: 649883 - DNA, 13 bp, D. melanogaster
tctctttttggcc

SEQ ID NO: 649884 - DNA, 13 bp, D. melanogaster
tctgaaaatgtat

SEQ ID NO: 649885 - DNA, 13 bp, D. melanogaster
tctgaaaccattt

SEQ ID NO: 649886 - DNA, 13 bp, D. melanogaster
tctgaaacccaat

SEQ ID NO: 649887 - DNA, 13 bp, D. melanogaster
tctgaaactaaaa

SEQ ID NO: 649888 - DNA, 13 bp, D. melanogaster
tctgaaagaaaac

SEQ ID NO: 649889 - DNA, 13 bp, D. melanogaster
tctgaaagcgaaa

SEQ ID NO: 649890 - DNA, 14 bp, D. melanogaster
tctgaaataattgt

SEQ ID NO: 649891 - DNA, 13 bp, D. melanogaster
tctgaaatctgtg

SEQ ID NO: 649892 - DNA, 13 bp, D. melanogaster
tctgaaatgtatt

SEQ ID NO: 649893 - DNA, 13 bp, D. melanogaster
tctgaaatgtttt

SEQ ID NO: 649894 - DNA, 13 bp, D. melanogaster
tctgaaattaatt

SEQ ID NO: 649895 - DNA, 13 bp, D. melanogaster
tctgaaattttaa

SEQ ID NO: 649896 - DNA, 13 bp, D. melanogaster
tctgaagaatttt

SEQ ID NO: 649897 - DNA, 13 bp, D. melanogaster
tctgaagagaaac

SEQ ID NO: 649898 - DNA, 13 bp, D. melanogaster
tctgaagctatcg

SEQ ID NO: 649899 - DNA, 13 bp, D. melanogaster
tctgaaggccaaa

SEQ ID NO: 649900 - DNA, 13 bp, D. melanogaster
tctgaaggttttc

SEQ ID NO: 649901 - DNA, 13 bp, D. melanogaster
tctgaatccgaat

SEQ ID NO: 649902 - DNA, 13 bp, D. melanogaster
tctgaatcggaat

SEQ ID NO: 649903 - DNA, 13 bp, D. melanogaster
tctgaatctgaat

SEQ ID NO: 649904 - DNA, 14 bp, D. melanogaster
tctgaatctgaatt

SEQ ID NO: 649905 - DNA, 13 bp, D. melanogaster
tctgaatgctgct

SEQ ID NO: 649906 - DNA, 13 bp, D. melanogaster
tctgaattctgtg

SEQ ID NO: 649907 - DNA, 13 bp, D. melanogaster
tctgaattttaaa

SEQ ID NO: 649908 - DNA, 13 bp, D. melanogaster
tctgacaaaagga

SEQ ID NO: 649909 - DNA, 13 bp, D. melanogaster
tctgacaattttt

SEQ ID NO: 649910 - DNA, 13 bp, D. melanogaster
tctgacacatttt

SEQ ID NO: 649911 - DNA, 14 bp, D. melanogaster
tctgacattgattt

SEQ ID NO: 649912 - DNA, 13 bp, D. melanogaster
tctgaccgagatt

SEQ ID NO: 649913 - DNA, 13 bp, D. melanogaster
tctgactggcgaa

SEQ ID NO: 649914 - DNA, 13 bp, D. melanogaster
tctgagaaggaaa

SEQ ID NO: 649915 - DNA, 13 bp, D. melanogaster
tctgagcttcgtc

SEQ ID NO: 649916 - DNA, 13 bp, D. melanogaster
tctgagtgcactg

SEQ ID NO: 649917 - DNA, 13 bp, D. melanogaster
tctgagtgctgct

SEQ ID NO: 649918 - DNA, 13 bp, D. melanogaster
tctgagtgtttac

SEQ ID NO: 649919 - DNA, 13 bp, D. melanogaster
tctgataaaaaaa

SEQ ID NO: 649920 - DNA, 13 bp, D. melanogaster
tctgatagtcgga

SEQ ID NO: 649921 - DNA, 13 bp, D. melanogaster
tctgatcaacaag

SEQ ID NO: 649922 - DNA, 13 bp, D. melanogaster
tctgatcaacatt

SEQ ID NO: 649923 - DNA, 13 bp, D. melanogaster
tctgatcaagaat

SEQ ID NO: 649924 - DNA, 13 bp, D. melanogaster
tctgatgataaat

SEQ ID NO: 649925 - DNA, 13 bp, D. melanogaster
tctgatgatgatg

SEQ ID NO: 649926 - DNA, 14 bp, D. melanogaster
tctgatgatgatga

SEQ ID NO: 649927 - DNA, 14 bp, D. melanogaster
tctgatgatggctg

SEQ ID NO: 649928 - DNA, 13 bp, D. melanogaster
tctgatggatcat

SEQ ID NO: 649929 - DNA, 13 bp, D. melanogaster
tctgatgttgctg

SEQ ID NO: 649930 - DNA, 13 bp, D. melanogaster
tctgattccgatt

SEQ ID NO: 649931 - DNA, 13 bp, D. melanogaster
tctgattcggatt

SEQ ID NO: 649932 - DNA, 13 bp, D. melanogaster
tctgattctaatg

SEQ ID NO: 649933 - DNA, 14 bp, D. melanogaster
tctgattctgattc

SEQ ID NO: 649934 - DNA, 13 bp, D. melanogaster
tctgattctggtt

SEQ ID NO: 649935 - DNA, 13 bp, D. melanogaster
tctgattctgttt

SEQ ID NO: 649936 - DNA, 13 bp, D. melanogaster
tctgatttattca

SEQ ID NO: 649937 - DNA, 13 bp, D. melanogaster
tctgatttattta

SEQ ID NO: 649938 - DNA, 13 bp, D. melanogaster
tctgatttcggta

SEQ ID NO: 649939 - DNA, 13 bp, D. melanogaster
tctgatttgattt

SEQ ID NO: 649940 - DNA, 13 bp, D. melanogaster
tctgatttgcatt

SEQ ID NO: 649941 - DNA, 13 bp, D. melanogaster
tctgattttaatt

SEQ ID NO: 649942 - DNA, 13 bp, D. melanogaster
tctgattttgatt

SEQ ID NO: 649943 - DNA, 14 bp, D. melanogaster
tctgattttgattc

SEQ ID NO: 649944 - DNA, 14 bp, D. melanogaster
tctgcaaaaaaaaa

SEQ ID NO: 649945 - DNA, 13 bp, D. melanogaster
tctgcaaaatgga

SEQ ID NO: 649946 - DNA, 13 bp, D. melanogaster
tctgcaaatatat

SEQ ID NO: 649947 - DNA, 13 bp, D. melanogaster
tctgcaaatgtat

SEQ ID NO: 649948 - DNA, 13 bp, D. melanogaster
tctgcaacatttt

SEQ ID NO: 649949 - DNA, 13 bp, D. melanogaster
tctgcaactgcaa

SEQ ID NO: 649950 - DNA, 13 bp, D. melanogaster
tctgcaagctttg

SEQ ID NO: 649951 - DNA, 13 bp, D. melanogaster
tctgcaatatgta

SEQ ID NO: 649952 - DNA, 14 bp, D. melanogaster
tctgcaatatgtat

SEQ ID NO: 649953 - DNA, 13 bp, D. melanogaster
tctgcaatcccat

SEQ ID NO: 649954 - DNA, 13 bp, D. melanogaster
tctgcaatctgca

SEQ ID NO: 649955 - DNA, 14 bp, D. melanogaster
tctgcaatgtgatt

SEQ ID NO: 649956 - DNA, 13 bp, D. melanogaster
tctgcaattcatg

SEQ ID NO: 649957 - DNA, 14 bp, D. melanogaster
tctgcaatttgttt

SEQ ID NO: 649958 - DNA, 13 bp, D. melanogaster
tctgcacaatttt

SEQ ID NO: 649959 - DNA, 13 bp, D. melanogaster
tctgcacacacac

SEQ ID NO: 649960 - DNA, 13 bp, D. melanogaster
tctgcacgtatgt

SEQ ID NO: 649961 - DNA, 13 bp, D. melanogaster
tctgcagagagcg

SEQ ID NO: 649962 - DNA, 13 bp, D. melanogaster
tctgcagcagcga

SEQ ID NO: 649963 - DNA, 13 bp, D. melanogaster
tctgcagctgcgt

SEQ ID NO: 649964 - DNA, 13 bp, D. melanogaster
tctgcagcttttc

SEQ ID NO: 649965 - DNA, 13 bp, D. melanogaster
tctgcatctgtgt

SEQ ID NO: 649966 - DNA, 13 bp, D. melanogaster
tctgcatgcatat

SEQ ID NO: 649967 - DNA, 14 bp, D. melanogaster
tctgcattctgcat

SEQ ID NO: 649968 - DNA, 13 bp, D. melanogaster
tctgcattggaat

SEQ ID NO: 649969 - DNA, 13 bp, D. melanogaster
tctgcatttaaat

SEQ ID NO: 649970 - DNA, 13 bp, D. melanogaster
tctgcatttgcat

SEQ ID NO: 649971 - DNA, 14 bp, D. melanogaster
tctgcatttgcatt

SEQ ID NO: 649972 - DNA, 13 bp, D. melanogaster
tctgcattttatt

SEQ ID NO: 649973 - DNA, 13 bp, D. melanogaster
tctgcattttgga

SEQ ID NO: 649974 - DNA, 13 bp, D. melanogaster
tctgccaaacaaa

SEQ ID NO: 649975 - DNA, 13 bp, D. melanogaster
tctgccacagtgg

SEQ ID NO: 649976 - DNA, 13 bp, D. melanogaster
tctgccacgcccc

SEQ ID NO: 649977 - DNA, 13 bp, D. melanogaster
tctgccacttggc

SEQ ID NO: 649978 - DNA, 13 bp, D. melanogaster
tctgccagagaag

SEQ ID NO: 649979 - DNA, 13 bp, D. melanogaster
tctgccagccaga

SEQ ID NO: 649980 - DNA, 13 bp, D. melanogaster
tctgccataattc

SEQ ID NO: 649981 - DNA, 13 bp, D. melanogaster
tctgccatggtta

SEQ ID NO: 649982 - DNA, 13 bp, D. melanogaster
tctgccattattg

SEQ ID NO: 649983 - DNA, 13 bp, D. melanogaster
tctgccatttggc

SEQ ID NO: 649984 - DNA, 13 bp, D. melanogaster
tctgcccaaaccg

SEQ ID NO: 649985 - DNA, 13 bp, D. melanogaster
tctgccccttttg

SEQ ID NO: 649986 - DNA, 13 bp, D. melanogaster
tctgcccgcccca

SEQ ID NO: 649987 - DNA, 13 bp, D. melanogaster
tctgcccgcttaa

SEQ ID NO: 649988 - DNA, 13 bp, D. melanogaster
tctgccgctgccg

SEQ ID NO: 649989 - DNA, 13 bp, D. melanogaster
tctgcctactcta

SEQ ID NO: 649990 - DNA, 13 bp, D. melanogaster
tctgcctctacca

SEQ ID NO: 649991 - DNA, 13 bp, D. melanogaster
tctgcctctgcct

SEQ ID NO: 649992 - DNA, 13 bp, D. melanogaster
tctgcctctgttt

SEQ ID NO: 649993 - DNA, 13 bp, D. melanogaster
tctgccttctgcc

SEQ ID NO: 649994 - DNA, 13 bp, D. melanogaster
tctgcctttgttg

SEQ ID NO: 649995 - DNA, 13 bp, D. melanogaster
tctgcgcaaatgt

SEQ ID NO: 649996 - DNA, 14 bp, D. melanogaster
tctgcgcatgcttg

SEQ ID NO: 649997 - DNA, 13 bp, D. melanogaster
tctgcggctgctg

SEQ ID NO: 649998 - DNA, 14 bp, D. melanogaster
tctgcggctgctgc

SEQ ID NO: 649999 - DNA, 13 bp, D. melanogaster
tctgcggttttcc

SEQ ID NO: 650000 - DNA, 14 bp, D. melanogaster
tctgcgtgtgtgtg

SEQ ID NO: 650001 - DNA, 14 bp, D. melanogaster
tctgctactcgaag

SEQ ID NO: 650002 - DNA, 13 bp, D. melanogaster
tctgctattttgg

SEQ ID NO: 650003 - DNA, 13 bp, D. melanogaster
tctgctcattact

SEQ ID NO: 650004 - DNA, 13 bp, D. melanogaster
tctgctccacatt

SEQ ID NO: 650005 - DNA, 13 bp, D. melanogaster
tctgctcctctgc

SEQ ID NO: 650006 - DNA, 13 bp, D. melanogaster
tctgctcctgctg

SEQ ID NO: 650007 - DNA, 14 bp, D. melanogaster
tctgctcctgctgc

SEQ ID NO: 650008 - DNA, 13 bp, D. melanogaster
tctgctctatttg

SEQ ID NO: 650009 - DNA, 13 bp, D. melanogaster
tctgctctgctcc

SEQ ID NO: 650010 - DNA, 13 bp, D. melanogaster
tctgctctgcttt

SEQ ID NO: 650011 - DNA, 13 bp, D. melanogaster
tctgctctgtttg

SEQ ID NO: 650012 - DNA, 13 bp, D. melanogaster
tctgctgaatttt

SEQ ID NO: 650013 - DNA, 13 bp, D. melanogaster
tctgctgattttt

SEQ ID NO: 650014 - DNA, 13 bp, D. melanogaster
tctgctgcacttt

SEQ ID NO: 650015 - DNA, 13 bp, D. melanogaster
tctgctgcccgag

SEQ ID NO: 650016 - DNA, 13 bp, D. melanogaster
tctgctgcctttt

SEQ ID NO: 650017 - DNA, 13 bp, D. melanogaster
tctgctgctcttg

SEQ ID NO: 650018 - DNA, 13 bp, D. melanogaster
tctgctgctgatg

SEQ ID NO: 650019 - DNA, 14 bp, D. melanogaster
tctgctgctgctgt

SEQ ID NO: 650020 - DNA, 13 bp, D. melanogaster
tctgctgctggta

SEQ ID NO: 650021 - DNA, 14 bp, D. melanogaster
tctgctgctgttgc

SEQ ID NO: 650022 - DNA, 14 bp, D. melanogaster
tctgctgcttctgc

SEQ ID NO: 650023 - DNA, 13 bp, D. melanogaster
tctgctgcttttc

SEQ ID NO: 650024 - DNA, 13 bp, D. melanogaster
tctgctggaaatt

SEQ ID NO: 650025 - DNA, 13 bp, D. melanogaster
tctgctggaggta

SEQ ID NO: 650026 - DNA, 13 bp, D. melanogaster
tctgctggccagt

SEQ ID NO: 650027 - DNA, 13 bp, D. melanogaster
tctgctggctttt

SEQ ID NO: 650028 - DNA, 13 bp, D. melanogaster
tctgctggttttc

SEQ ID NO: 650029 - DNA, 13 bp, D. melanogaster
tctgctgttgttg

SEQ ID NO: 650030 - DNA, 13 bp, D. melanogaster
tctgctgtttctg

SEQ ID NO: 650031 - DNA, 13 bp, D. melanogaster
tctgcttaattaa

SEQ ID NO: 650032 - DNA, 13 bp, D. melanogaster
tctgcttcacttt

SEQ ID NO: 650033 - DNA, 13 bp, D. melanogaster
tctgcttctgctg

SEQ ID NO: 650034 - DNA, 14 bp, D. melanogaster
tctgcttctgctgc

SEQ ID NO: 650035 - DNA, 13 bp, D. melanogaster
tctgcttggcacg

SEQ ID NO: 650036 - DNA, 13 bp, D. melanogaster
tctgctttaaaaa

SEQ ID NO: 650037 - DNA, 13 bp, D. melanogaster
tctgcttttctgc

SEQ ID NO: 650038 - DNA, 13 bp, D. melanogaster
tctggaaaatttt

SEQ ID NO: 650039 - DNA, 14 bp, D. melanogaster
tctggaaaattttt

SEQ ID NO: 650040 - DNA, 13 bp, D. melanogaster
tctggaaactatt

SEQ ID NO: 650041 - DNA, 13 bp, D. melanogaster
tctggaaatattt

SEQ ID NO: 650042 - DNA, 13 bp, D. melanogaster
tctggaatctgga

SEQ ID NO: 650043 - DNA, 13 bp, D. melanogaster
tctggaatcttca

SEQ ID NO: 650044 - DNA, 13 bp, D. melanogaster
tctggactctgga

SEQ ID NO: 650045 - DNA, 13 bp, D. melanogaster
tctggagaacttc

SEQ ID NO: 650046 - DNA, 13 bp, D. melanogaster
tctggagactgaa

SEQ ID NO: 650047 - DNA, 14 bp, D. melanogaster
tctggaggcggtgg

SEQ ID NO: 650048 - DNA, 13 bp, D. melanogaster
tctggagtctgga

SEQ ID NO: 650049 - DNA, 13 bp, D. melanogaster
tctggatctgaat

SEQ ID NO: 650050 - DNA, 14 bp, D. melanogaster
tctggatctgaatc

SEQ ID NO: 650051 - DNA, 13 bp, D. melanogaster
tctggatctggat

SEQ ID NO: 650052 - DNA, 14 bp, D. melanogaster
tctggatctggatc

SEQ ID NO: 650053 - DNA, 13 bp, D. melanogaster
tctggatgatttg

SEQ ID NO: 650054 - DNA, 13 bp, D. melanogaster
tctggatgcgttg

SEQ ID NO: 650055 - DNA, 13 bp, D. melanogaster
tctggattccatc

SEQ ID NO: 650056 - DNA, 14 bp, D. melanogaster
tctggattctggat

SEQ ID NO: 650057 - DNA, 13 bp, D. melanogaster
tctggattgggtt

SEQ ID NO: 650058 - DNA, 13 bp, D. melanogaster
tctggcaaaacaa

SEQ ID NO: 650059 - DNA, 13 bp, D. melanogaster
tctggcaaatatt

SEQ ID NO: 650060 - DNA, 14 bp, D. melanogaster
tctggcaaatattt

SEQ ID NO: 650061 - DNA, 13 bp, D. melanogaster
tctggcaacgcca

SEQ ID NO: 650062 - DNA, 13 bp, D. melanogaster
tctggcaactctg

SEQ ID NO: 650063 - DNA, 13 bp, D. melanogaster
tctggcagaatta

SEQ ID NO: 650064 - DNA, 13 bp, D. melanogaster
tctggcagagatt

SEQ ID NO: 650065 - DNA, 13 bp, D. melanogaster
tctggcagcttat

SEQ ID NO: 650066 - DNA, 13 bp, D. melanogaster
tctggcatatcga

SEQ ID NO: 650067 - DNA, 13 bp, D. melanogaster
tctggcatttttg

SEQ ID NO: 650068 - DNA, 13 bp, D. melanogaster
tctggccaaaaag

SEQ ID NO: 650069 - DNA, 13 bp, D. melanogaster
tctggccaaaagc

SEQ ID NO: 650070 - DNA, 13 bp, D. melanogaster
tctggccaaaagg

SEQ ID NO: 650071 - DNA, 14 bp, D. melanogaster
tctggccaaaatag

SEQ ID NO: 650072 - DNA, 13 bp, D. melanogaster
tctggccaaattg

SEQ ID NO: 650073 - DNA, 13 bp, D. melanogaster
tctggccaagtgg

SEQ ID NO: 650074 - DNA, 13 bp, D. melanogaster
tctggccaagttg

SEQ ID NO: 650075 - DNA, 13 bp, D. melanogaster
tctggccatgtcc

SEQ ID NO: 650076 - DNA, 14 bp, D. melanogaster
tctggccatgtccg

SEQ ID NO: 650077 - DNA, 13 bp, D. melanogaster
tctggccgggatt

SEQ ID NO: 650078 - DNA, 13 bp, D. melanogaster
tctggcgcttgag

SEQ ID NO: 650079 - DNA, 13 bp, D. melanogaster
tctggctctggct

SEQ ID NO: 650080 - DNA, 13 bp, D. melanogaster
tctggctggcaga

SEQ ID NO: 650081 - DNA, 13 bp, D. melanogaster
tctggctggcttt

SEQ ID NO: 650082 - DNA, 13 bp, D. melanogaster
tctggcttcgtaa

SEQ ID NO: 650083 - DNA, 13 bp, D. melanogaster
tctggcttttcca

SEQ ID NO: 650084 - DNA, 13 bp, D. melanogaster
tctggcttttggc

SEQ ID NO: 650085 - DNA, 13 bp, D. melanogaster
tctggctttttgg

SEQ ID NO: 650086 - DNA, 13 bp, D. melanogaster
tctgggatagttt

SEQ ID NO: 650087 - DNA, 13 bp, D. melanogaster
tctgggatatcga

SEQ ID NO: 650088 - DNA, 13 bp, D. melanogaster
tctgggatctgga

SEQ ID NO: 650089 - DNA, 14 bp, D. melanogaster
tctgggatctggga

SEQ ID NO: 650090 - DNA, 13 bp, D. melanogaster
tctgggcaaaaaa

SEQ ID NO: 650091 - DNA, 13 bp, D. melanogaster
tctgggccaaaat

SEQ ID NO: 650092 - DNA, 14 bp, D. melanogaster
tctgggtaacataa

SEQ ID NO: 650093 - DNA, 13 bp, D. melanogaster
tctggtctggtct

SEQ ID NO: 650094 - DNA, 13 bp, D. melanogaster
tctggtctggttt

SEQ ID NO: 650095 - DNA, 14 bp, D. melanogaster
tctggtgatggtgt

SEQ ID NO: 650096 - DNA, 13 bp, D. melanogaster
tctggtgggagtc

SEQ ID NO: 650097 - DNA, 14 bp, D. melanogaster
tctggtggtaactt

SEQ ID NO: 650098 - DNA, 13 bp, D. melanogaster
tctggtgtccttt

SEQ ID NO: 650099 - DNA, 13 bp, D. melanogaster
tctggttataatt

SEQ ID NO: 650100 - DNA, 13 bp, D. melanogaster
tctggttctggct

SEQ ID NO: 650101 - DNA, 13 bp, D. melanogaster
tctggtttcggtt

SEQ ID NO: 650102 - DNA, 13 bp, D. melanogaster
tctggtttctggt

SEQ ID NO: 650103 - DNA, 13 bp, D. melanogaster
tctgtaaaatatt

SEQ ID NO: 650104 - DNA, 13 bp, D. melanogaster
tctgtaaacggcg

SEQ ID NO: 650105 - DNA, 13 bp, D. melanogaster
tctgtaaataaat

SEQ ID NO: 650106 - DNA, 13 bp, D. melanogaster
tctgtaaatctca

SEQ ID NO: 650107 - DNA, 13 bp, D. melanogaster
tctgtaataattg

SEQ ID NO: 650108 - DNA, 13 bp, D. melanogaster
tctgtaatttatt

SEQ ID NO: 650109 - DNA, 13 bp, D. melanogaster
tctgtaatttttc

SEQ ID NO: 650110 - DNA, 13 bp, D. melanogaster
tctgtacaaaata

SEQ ID NO: 650111 - DNA, 14 bp, D. melanogaster
tctgtacaaattaa

SEQ ID NO: 650112 - DNA, 13 bp, D. melanogaster
tctgtacattttt

SEQ ID NO: 650113 - DNA, 13 bp, D. melanogaster
tctgtataaatat

SEQ ID NO: 650114 - DNA, 13 bp, D. melanogaster
tctgtatacatat

SEQ ID NO: 650115 - DNA, 13 bp, D. melanogaster
tctgtatatacat

SEQ ID NO: 650116 - DNA, 13 bp, D. melanogaster
tctgtatctattt

SEQ ID NO: 650117 - DNA, 14 bp, D. melanogaster
tctgtatctgaata

SEQ ID NO: 650118 - DNA, 13 bp, D. melanogaster
tctgtatctgagt

SEQ ID NO: 650119 - DNA, 13 bp, D. melanogaster
tctgtatctgcag

SEQ ID NO: 650120 - DNA, 13 bp, D. melanogaster
tctgtatctggat

SEQ ID NO: 650121 - DNA, 13 bp, D. melanogaster
tctgtatctgtac

SEQ ID NO: 650122 - DNA, 13 bp, D. melanogaster
tctgtatctgttt

SEQ ID NO: 650123 - DNA, 13 bp, D. melanogaster
tctgtatctttat

SEQ ID NO: 650124 - DNA, 13 bp, D. melanogaster
tctgtatcttttc

SEQ ID NO: 650125 - DNA, 13 bp, D. melanogaster
tctgtatgctgaa

SEQ ID NO: 650126 - DNA, 13 bp, D. melanogaster
tctgtatgtgtgt

SEQ ID NO: 650127 - DNA, 13 bp, D. melanogaster
tctgtattttctc

SEQ ID NO: 650128 - DNA, 14 bp, D. melanogaster
tctgtattttctca

SEQ ID NO: 650129 - DNA, 13 bp, D. melanogaster
tctgtccgtccgt

SEQ ID NO: 650130 - DNA, 13 bp, D. melanogaster
tctgtcgcatttg

SEQ ID NO: 650131 - DNA, 13 bp, D. melanogaster
tctgtcgtcaggt

SEQ ID NO: 650132 - DNA, 13 bp, D. melanogaster
tctgtctcactct

SEQ ID NO: 650133 - DNA, 13 bp, D. melanogaster
tctgtctctatct

SEQ ID NO: 650134 - DNA, 13 bp, D. melanogaster
tctgtctctgtct

SEQ ID NO: 650135 - DNA, 13 bp, D. melanogaster
tctgtctgcctgc

SEQ ID NO: 650136 - DNA, 13 bp, D. melanogaster
tctgtctgccttt

SEQ ID NO: 650137 - DNA, 13 bp, D. melanogaster
tctgtctgtccat

SEQ ID NO: 650138 - DNA, 13 bp, D. melanogaster
tctgtctgtctat

SEQ ID NO: 650139 - DNA, 13 bp, D. melanogaster
tctgtctgtctct

SEQ ID NO: 650140 - DNA, 13 bp, D. melanogaster
tctgtctgtctgc

SEQ ID NO: 650141 - DNA, 14 bp, D. melanogaster
tctgtctgtctgtc

SEQ ID NO: 650142 - DNA, 14 bp, D. melanogaster
tctgtctgtctgtg

SEQ ID NO: 650143 - DNA, 14 bp, D. melanogaster
tctgtctgtgtgtg

SEQ ID NO: 650144 - DNA, 13 bp, D. melanogaster
tctgtctgttaca

SEQ ID NO: 650145 - DNA, 14 bp, D. melanogaster
tctgtctgttacat

SEQ ID NO: 650146 - DNA, 13 bp, D. melanogaster
tctgtgaaaataa

SEQ ID NO: 650147 - DNA, 14 bp, D. melanogaster
tctgtgaagaaatg

SEQ ID NO: 650148 - DNA, 13 bp, D. melanogaster
tctgtgcatgtgt

SEQ ID NO: 650149 - DNA, 13 bp, D. melanogaster
tctgtgcatttgt

SEQ ID NO: 650150 - DNA, 13 bp, D. melanogaster
tctgtgcctgtgt

SEQ ID NO: 650151 - DNA, 14 bp, D. melanogaster
tctgtgcgtgtgtg

SEQ ID NO: 650152 - DNA, 13 bp, D. melanogaster
tctgtggaacgca

SEQ ID NO: 650153 - DNA, 13 bp, D. melanogaster
tctgtggtattta

SEQ ID NO: 650154 - DNA, 13 bp, D. melanogaster
tctgtgtaatcta

SEQ ID NO: 650155 - DNA, 13 bp, D. melanogaster
tctgtgtatctgc

SEQ ID NO: 650156 - DNA, 14 bp, D. melanogaster
tctgtgtatctgtg

SEQ ID NO: 650157 - DNA, 13 bp, D. melanogaster
tctgtgtatgtgt

SEQ ID NO: 650158 - DNA, 13 bp, D. melanogaster
tctgtgtctgtgc

SEQ ID NO: 650159 - DNA, 13 bp, D. melanogaster
tctgtgtctgtgt

SEQ ID NO: 650160 - DNA, 13 bp, D. melanogaster
tctgtgtgtattt

SEQ ID NO: 650161 - DNA, 13 bp, D. melanogaster
tctgtgtgtgcga

SEQ ID NO: 650162 - DNA, 14 bp, D. melanogaster
tctgtgtgtgcgtg

SEQ ID NO: 650163 - DNA, 13 bp, D. melanogaster
tctgtgtgtgctg

SEQ ID NO: 650164 - DNA, 14 bp, D. melanogaster
tctgtgtgtgtatg

SEQ ID NO: 650165 - DNA, 13 bp, D. melanogaster
tctgtgtgtgtct

SEQ ID NO: 650166 - DNA, 13 bp, D. melanogaster
tctgtgtgtgtgc

SEQ ID NO: 650167 - DNA, 14 bp, D. melanogaster
tctgtgtgtgtgcg

SEQ ID NO: 650168 - DNA, 13 bp, D. melanogaster
tctgttaaatata

SEQ ID NO: 650169 - DNA, 13 bp, D. melanogaster
tctgttaaatttt

SEQ ID NO: 650170 - DNA, 13 bp, D. melanogaster
tctgttattgttg

SEQ ID NO: 650171 - DNA, 13 bp, D. melanogaster
tctgttcaatcaa

SEQ ID NO: 650172 - DNA, 13 bp, D. melanogaster
tctgttccgttct

SEQ ID NO: 650173 - DNA, 13 bp, D. melanogaster
tctgttcgcctgg

SEQ ID NO: 650174 - DNA, 13 bp, D. melanogaster
tctgttcgcttgg

SEQ ID NO: 650175 - DNA, 14 bp, D. melanogaster
tctgttcgggtttc

SEQ ID NO: 650176 - DNA, 13 bp, D. melanogaster
tctgttctgctct

SEQ ID NO: 650177 - DNA, 13 bp, D. melanogaster
tctgttgactttt

SEQ ID NO: 650178 - DNA, 14 bp, D. melanogaster
tctgttgattaaat

SEQ ID NO: 650179 - DNA, 13 bp, D. melanogaster
tctgttgcagttg

SEQ ID NO: 650180 - DNA, 13 bp, D. melanogaster
tctgttgcatttt

SEQ ID NO: 650181 - DNA, 13 bp, D. melanogaster
tctgttgccgact

SEQ ID NO: 650182 - DNA, 13 bp, D. melanogaster
tctgttgctgctg

SEQ ID NO: 650183 - DNA, 14 bp, D. melanogaster
tctgttgctgctgc

SEQ ID NO: 650184 - DNA, 14 bp, D. melanogaster
tctgttggccatct

SEQ ID NO: 650185 - DNA, 13 bp, D. melanogaster
tctgttggcctat

SEQ ID NO: 650186 - DNA, 13 bp, D. melanogaster
tctgttggtggca

SEQ ID NO: 650187 - DNA, 13 bp, D. melanogaster
tctgttgttatta

SEQ ID NO: 650188 - DNA, 14 bp, D. melanogaster
tctgttgttattat

SEQ ID NO: 650189 - DNA, 13 bp, D. melanogaster
tctgtttactttg

SEQ ID NO: 650190 - DNA, 13 bp, D. melanogaster
tctgtttataaat

SEQ ID NO: 650191 - DNA, 13 bp, D. melanogaster
tctgtttatttaa

SEQ ID NO: 650192 - DNA, 14 bp, D. melanogaster
tctgtttcaagacc

SEQ ID NO: 650193 - DNA, 13 bp, D. melanogaster
tctgtttccatta

SEQ ID NO: 650194 - DNA, 14 bp, D. melanogaster
tctgtttccattat

SEQ ID NO: 650195 - DNA, 13 bp, D. melanogaster
tctgtttcgattt

SEQ ID NO: 650196 - DNA, 13 bp, D. melanogaster
tctgtttctgatt

SEQ ID NO: 650197 - DNA, 14 bp, D. melanogaster
tctgtttctgattc

SEQ ID NO: 650198 - DNA, 13 bp, D. melanogaster
tctgtttctgctg

SEQ ID NO: 650199 - DNA, 13 bp, D. melanogaster
tctgtttgacttt

SEQ ID NO: 650200 - DNA, 13 bp, D. melanogaster
tctgtttgccaat

SEQ ID NO: 650201 - DNA, 13 bp, D. melanogaster
tctgtttgccatt

SEQ ID NO: 650202 - DNA, 13 bp, D. melanogaster
tctgtttgtccgt

SEQ ID NO: 650203 - DNA, 13 bp, D. melanogaster
tctgtttgtctgg

SEQ ID NO: 650204 - DNA, 13 bp, D. melanogaster
tctgttttaaatt

SEQ ID NO: 650205 - DNA, 14 bp, D. melanogaster
tctgttttaaattt

SEQ ID NO: 650206 - DNA, 13 bp, D. melanogaster
tctgttttggcca

SEQ ID NO: 650207 - DNA, 13 bp, D. melanogaster
tcttaaaaaagaa

SEQ ID NO: 650208 - DNA, 13 bp, D. melanogaster
tcttaaaaacatt

SEQ ID NO: 650209 - DNA, 13 bp, D. melanogaster
tcttaaaaactat

SEQ ID NO: 650210 - DNA, 13 bp, D. melanogaster
tcttaaaactaaa

SEQ ID NO: 650211 - DNA, 13 bp, D. melanogaster
tcttaaaataaac

SEQ ID NO: 650212 - DNA, 13 bp, D. melanogaster
tcttaaaatagca

SEQ ID NO: 650213 - DNA, 13 bp, D. melanogaster
tcttaaacttaaa

SEQ ID NO: 650214 - DNA, 13 bp, D. melanogaster
tcttaaagcttaa

SEQ ID NO: 650215 - DNA, 13 bp, D. melanogaster
tcttaaagtaaat

SEQ ID NO: 650216 - DNA, 13 bp, D. melanogaster
tcttaaagttaaa

SEQ ID NO: 650217 - DNA, 13 bp, D. melanogaster
tcttaaataaagt

SEQ ID NO: 650218 - DNA, 13 bp, D. melanogaster
tcttaaataaatg

SEQ ID NO: 650219 - DNA, 13 bp, D. melanogaster
tcttaaatacttt

SEQ ID NO: 650220 - DNA, 13 bp, D. melanogaster
tcttaaatatgag

SEQ ID NO: 650221 - DNA, 13 bp, D. melanogaster
tcttaaatcaaat

SEQ ID NO: 650222 - DNA, 13 bp, D. melanogaster
tcttaaatcatat

SEQ ID NO: 650223 - DNA, 13 bp, D. melanogaster
tcttaaatcgttt

SEQ ID NO: 650224 - DNA, 13 bp, D. melanogaster
tcttaaatttgaa

SEQ ID NO: 650225 - DNA, 13 bp, D. melanogaster
tcttaactatctt

SEQ ID NO: 650226 - DNA, 14 bp, D. melanogaster
tcttaactatcttg

SEQ ID NO: 650227 - DNA, 13 bp, D. melanogaster
tcttaagaatatt

SEQ ID NO: 650228 - DNA, 13 bp, D. melanogaster
tcttaaggaattg

SEQ ID NO: 650229 - DNA, 13 bp, D. melanogaster
tcttaagttgaaa

SEQ ID NO: 650230 - DNA, 13 bp, D. melanogaster
tcttaagttttta

SEQ ID NO: 650231 - DNA, 13 bp, D. melanogaster
tcttaataaatac

SEQ ID NO: 650232 - DNA, 14 bp, D. melanogaster
tcttaataaatacg

SEQ ID NO: 650233 - DNA, 14 bp, D. melanogaster
tcttaataaatctt

SEQ ID NO: 650234 - DNA, 13 bp, D. melanogaster
tcttaatcgtttt

SEQ ID NO: 650235 - DNA, 13 bp, D. melanogaster
tcttaatgaaaat

SEQ ID NO: 650236 - DNA, 13 bp, D. melanogaster
tcttaatgaaatt

SEQ ID NO: 650237 - DNA, 13 bp, D. melanogaster
tcttaatgaattt

SEQ ID NO: 650238 - DNA, 13 bp, D. melanogaster
tcttaatgtttgt

SEQ ID NO: 650239 - DNA, 14 bp, D. melanogaster
tcttaattcaaaat

SEQ ID NO: 650240 - DNA, 13 bp, D. melanogaster
tcttaattgaaaa

SEQ ID NO: 650241 - DNA, 13 bp, D. melanogaster
tcttaattgcatt

SEQ ID NO: 650242 - DNA, 13 bp, D. melanogaster
tcttaattgttta

SEQ ID NO: 650243 - DNA, 14 bp, D. melanogaster
tcttaattgtttta

SEQ ID NO: 650244 - DNA, 13 bp, D. melanogaster
tcttaatttgcat

SEQ ID NO: 650245 - DNA, 13 bp, D. melanogaster
tcttacaggcgaa

SEQ ID NO: 650246 - DNA, 13 bp, D. melanogaster
tcttacatttttg

SEQ ID NO: 650247 - DNA, 13 bp, D. melanogaster
tcttactttttgc

SEQ ID NO: 650248 - DNA, 13 bp, D. melanogaster
tcttagagttccg

SEQ ID NO: 650249 - DNA, 13 bp, D. melanogaster
tcttagctgtttt

SEQ ID NO: 650250 - DNA, 14 bp, D. melanogaster
tcttatacataagt

SEQ ID NO: 650251 - DNA, 13 bp, D. melanogaster
tcttatatgcaaa

SEQ ID NO: 650252 - DNA, 13 bp, D. melanogaster
tcttatcattctc

SEQ ID NO: 650253 - DNA, 13 bp, D. melanogaster
tcttatctcaatt

SEQ ID NO: 650254 - DNA, 13 bp, D. melanogaster
tcttatgcggtat

SEQ ID NO: 650255 - DNA, 13 bp, D. melanogaster
tcttattggatac

SEQ ID NO: 650256 - DNA, 13 bp, D. melanogaster
tcttattttcggc

SEQ ID NO: 650257 - DNA, 13 bp, D. melanogaster
tcttcaaatggtc

SEQ ID NO: 650258 - DNA, 14 bp, D. melanogaster
tcttcaacctgacg

SEQ ID NO: 650259 - DNA, 13 bp, D. melanogaster
tcttcaacttgga

SEQ ID NO: 650260 - DNA, 13 bp, D. melanogaster
tcttcaagagttg

SEQ ID NO: 650261 - DNA, 13 bp, D. melanogaster
tcttcaagccatc

SEQ ID NO: 650262 - DNA, 14 bp, D. melanogaster
tcttcaagccatcg

SEQ ID NO: 650263 - DNA, 13 bp, D. melanogaster
tcttcaagtaatt

SEQ ID NO: 650264 - DNA, 13 bp, D. melanogaster
tcttcaataatct

SEQ ID NO: 650265 - DNA, 13 bp, D. melanogaster
tcttcaatcaatg

SEQ ID NO: 650266 - DNA, 13 bp, D. melanogaster
tcttcaatgaaat

SEQ ID NO: 650267 - DNA, 13 bp, D. melanogaster
tcttcaattgttt

SEQ ID NO: 650268 - DNA, 13 bp, D. melanogaster
tcttcaatttgca

SEQ ID NO: 650269 - DNA, 13 bp, D. melanogaster
tcttcacaaaagg

SEQ ID NO: 650270 - DNA, 13 bp, D. melanogaster
tcttcacagactt

SEQ ID NO: 650271 - DNA, 13 bp, D. melanogaster
tcttcacttggtt

SEQ ID NO: 650272 - DNA, 14 bp, D. melanogaster
tcttcacttggttt

SEQ ID NO: 650273 - DNA, 13 bp, D. melanogaster
tcttcagaggaga

SEQ ID NO: 650274 - DNA, 13 bp, D. melanogaster
tcttcagcggcga

SEQ ID NO: 650275 - DNA, 13 bp, D. melanogaster
tcttcagtgagtt

SEQ ID NO: 650276 - DNA, 13 bp, D. melanogaster
tcttcagttaaca

SEQ ID NO: 650277 - DNA, 13 bp, D. melanogaster
tcttcatcatcag

SEQ ID NO: 650278 - DNA, 13 bp, D. melanogaster
tcttcatcatctt

SEQ ID NO: 650279 - DNA, 14 bp, D. melanogaster
tcttcatcatcttc

SEQ ID NO: 650280 - DNA, 14 bp, D. melanogaster
tcttcatctccatc

SEQ ID NO: 650281 - DNA, 13 bp, D. melanogaster
tcttcatcttcat

SEQ ID NO: 650282 - DNA, 14 bp, D. melanogaster
tcttcatcttcatc

SEQ ID NO: 650283 - DNA, 13 bp, D. melanogaster
tcttcattaaatt

SEQ ID NO: 650284 - DNA, 13 bp, D. melanogaster
tcttcattaagcc

SEQ ID NO: 650285 - DNA, 13 bp, D. melanogaster
tcttcatttcaat

SEQ ID NO: 650286 - DNA, 13 bp, D. melanogaster
tcttcatttgcat

SEQ ID NO: 650287 - DNA, 13 bp, D. melanogaster
tcttccaaaaata

SEQ ID NO: 650288 - DNA, 13 bp, D. melanogaster
tcttccagaaggg

SEQ ID NO: 650289 - DNA, 13 bp, D. melanogaster
tcttcccaagaag

SEQ ID NO: 650290 - DNA, 13 bp, D. melanogaster
tcttccgatttcg

SEQ ID NO: 650291 - DNA, 13 bp, D. melanogaster
tcttccgcatgat

SEQ ID NO: 650292 - DNA, 13 bp, D. melanogaster
tcttcctccaact

SEQ ID NO: 650293 - DNA, 13 bp, D. melanogaster
tcttcctttaaaa

SEQ ID NO: 650294 - DNA, 13 bp, D. melanogaster
tcttcgacatata

SEQ ID NO: 650295 - DNA, 13 bp, D. melanogaster
tcttcgactttag

SEQ ID NO: 650296 - DNA, 13 bp, D. melanogaster
tcttcgatgttcg

SEQ ID NO: 650297 - DNA, 13 bp, D. melanogaster
tcttcgcctgtaa

SEQ ID NO: 650298 - DNA, 13 bp, D. melanogaster
tcttcgctttcgg

SEQ ID NO: 650299 - DNA, 13 bp, D. melanogaster
tcttcggcactcc

SEQ ID NO: 650300 - DNA, 13 bp, D. melanogaster
tcttcggcgcttc

SEQ ID NO: 650301 - DNA, 13 bp, D. melanogaster
tcttcgggcttac

SEQ ID NO: 650302 - DNA, 13 bp, D. melanogaster
tcttcgtttacct

SEQ ID NO: 650303 - DNA, 13 bp, D. melanogaster
tcttctaaattgg

SEQ ID NO: 650304 - DNA, 13 bp, D. melanogaster
tcttctacaatgg

SEQ ID NO: 650305 - DNA, 13 bp, D. melanogaster
tcttctatatgct

SEQ ID NO: 650306 - DNA, 13 bp, D. melanogaster
tcttctatgtatt

SEQ ID NO: 650307 - DNA, 14 bp, D. melanogaster
tcttctatgtattc

SEQ ID NO: 650308 - DNA, 13 bp, D. melanogaster
tcttctcatttgg

SEQ ID NO: 650309 - DNA, 13 bp, D. melanogaster
tcttctcgcgaat

SEQ ID NO: 650310 - DNA, 13 bp, D. melanogaster
tcttctcttggta

SEQ ID NO: 650311 - DNA, 13 bp, D. melanogaster
tcttctgagtgct

SEQ ID NO: 650312 - DNA, 13 bp, D. melanogaster
tcttctgctctgc

SEQ ID NO: 650313 - DNA, 14 bp, D. melanogaster
tcttctgctgctgc

SEQ ID NO: 650314 - DNA, 13 bp, D. melanogaster
tcttctggaccct

SEQ ID NO: 650315 - DNA, 13 bp, D. melanogaster
tcttcttcaagta

SEQ ID NO: 650316 - DNA, 13 bp, D. melanogaster
tcttcttcgaata

SEQ ID NO: 650317 - DNA, 13 bp, D. melanogaster
tcttcttctactg

SEQ ID NO: 650318 - DNA, 13 bp, D. melanogaster
tcttcttgaatat

SEQ ID NO: 650319 - DNA, 13 bp, D. melanogaster
tcttcttgcgatc

SEQ ID NO: 650320 - DNA, 14 bp, D. melanogaster
tcttcttgggcaac

SEQ ID NO: 650321 - DNA, 14 bp, D. melanogaster
tcttcttggtttaa

SEQ ID NO: 650322 - DNA, 13 bp, D. melanogaster
tcttctttaaggc

SEQ ID NO: 650323 - DNA, 15 bp, D. melanogaster
tcttctttaaggctc

SEQ ID NO: 650324 - DNA, 14 bp, D. melanogaster
tcttctttaagtag

SEQ ID NO: 650325 - DNA, 13 bp, D. melanogaster
tcttcttttggcc

SEQ ID NO: 650326 - DNA, 14 bp, D. melanogaster
tcttctttttggaa

SEQ ID NO: 650327 - DNA, 13 bp, D. melanogaster
tcttgaaaaaaaa

SEQ ID NO: 650328 - DNA, 13 bp, D. melanogaster
tcttgaaaaataa

SEQ ID NO: 650329 - DNA, 13 bp, D. melanogaster
tcttgaaaaatca

SEQ ID NO: 650330 - DNA, 13 bp, D. melanogaster
tcttgaaaacatt

SEQ ID NO: 650331 - DNA, 14 bp, D. melanogaster
tcttgaaaacattt

SEQ ID NO: 650332 - DNA, 13 bp, D. melanogaster
tcttgaatataag

SEQ ID NO: 650333 - DNA, 13 bp, D. melanogaster
tcttgaatatatt

SEQ ID NO: 650334 - DNA, 14 bp, D. melanogaster
tcttgagcggcgag

SEQ ID NO: 650335 - DNA, 13 bp, D. melanogaster
tcttgagtggatc

SEQ ID NO: 650336 - DNA, 13 bp, D. melanogaster
tcttgataacgca

SEQ ID NO: 650337 - DNA, 13 bp, D. melanogaster
tcttgatcagaat

SEQ ID NO: 650338 - DNA, 13 bp, D. melanogaster
tcttgatcaggat

SEQ ID NO: 650339 - DNA, 14 bp, D. melanogaster
tcttgatcaggatc

SEQ ID NO: 650340 - DNA, 13 bp, D. melanogaster
tcttgattaatgc

SEQ ID NO: 650341 - DNA, 13 bp, D. melanogaster
tcttgatttagat

SEQ ID NO: 650342 - DNA, 13 bp, D. melanogaster
tcttgatttcctt

SEQ ID NO: 650343 - DNA, 13 bp, D. melanogaster
tcttgatttggat

SEQ ID NO: 650344 - DNA, 13 bp, D. melanogaster
tcttgcaaagtat

SEQ ID NO: 650345 - DNA, 13 bp, D. melanogaster
tcttgcaactttt

SEQ ID NO: 650346 - DNA, 13 bp, D. melanogaster
tcttgcaattcca

SEQ ID NO: 650347 - DNA, 13 bp, D. melanogaster
tcttgcagctaaa

SEQ ID NO: 650348 - DNA, 13 bp, D. melanogaster
tcttgcagtgcag

SEQ ID NO: 650349 - DNA, 13 bp, D. melanogaster
tcttgcataattt

SEQ ID NO: 650350 - DNA, 13 bp, D. melanogaster
tcttgcatcgcat

SEQ ID NO: 650351 - DNA, 13 bp, D. melanogaster
tcttgcatttaaa

SEQ ID NO: 650352 - DNA, 13 bp, D. melanogaster
tcttgccacgccc

SEQ ID NO: 650353 - DNA, 13 bp, D. melanogaster
tcttgccagtcca

SEQ ID NO: 650354 - DNA, 13 bp, D. melanogaster
tcttgccatcttt

SEQ ID NO: 650355 - DNA, 13 bp, D. melanogaster
tcttgcgctctct

SEQ ID NO: 650356 - DNA, 13 bp, D. melanogaster
tcttgcggccagc

SEQ ID NO: 650357 - DNA, 13 bp, D. melanogaster
tcttgctgatatt

SEQ ID NO: 650358 - DNA, 14 bp, D. melanogaster
tcttgctgatattg

SEQ ID NO: 650359 - DNA, 13 bp, D. melanogaster
tcttggaaaatat

SEQ ID NO: 650360 - DNA, 13 bp, D. melanogaster
tcttggacagtta

SEQ ID NO: 650361 - DNA, 13 bp, D. melanogaster
tcttggagttatt

SEQ ID NO: 650362 - DNA, 13 bp, D. melanogaster
tcttggattctta

SEQ ID NO: 650363 - DNA, 13 bp, D. melanogaster
tcttggcagtgga

SEQ ID NO: 650364 - DNA, 13 bp, D. melanogaster
tcttggccaactt

SEQ ID NO: 650365 - DNA, 13 bp, D. melanogaster
tcttggccaagtg

SEQ ID NO: 650366 - DNA, 13 bp, D. melanogaster
tcttggccaattg

SEQ ID NO: 650367 - DNA, 13 bp, D. melanogaster
tcttggccacatt

SEQ ID NO: 650368 - DNA, 13 bp, D. melanogaster
tcttggccagaaa

SEQ ID NO: 650369 - DNA, 13 bp, D. melanogaster
tcttggccagcca

SEQ ID NO: 650370 - DNA, 13 bp, D. melanogaster
tcttggccagctc

SEQ ID NO: 650371 - DNA, 13 bp, D. melanogaster
tcttggccatgtt

SEQ ID NO: 650372 - DNA, 13 bp, D. melanogaster
tcttggccattaa

SEQ ID NO: 650373 - DNA, 13 bp, D. melanogaster
tcttggccattgt

SEQ ID NO: 650374 - DNA, 13 bp, D. melanogaster
tcttggccatttg

SEQ ID NO: 650375 - DNA, 14 bp, D. melanogaster
tcttggcccaaccc

SEQ ID NO: 650376 - DNA, 13 bp, D. melanogaster
tcttggcccattt

SEQ ID NO: 650377 - DNA, 13 bp, D. melanogaster
tcttggcctggcc

SEQ ID NO: 650378 - DNA, 13 bp, D. melanogaster
tcttggccttctt

SEQ ID NO: 650379 - DNA, 13 bp, D. melanogaster
tcttggctgattc

SEQ ID NO: 650380 - DNA, 14 bp, D. melanogaster
tcttggctgccttt

SEQ ID NO: 650381 - DNA, 13 bp, D. melanogaster
tcttggcttattt

SEQ ID NO: 650382 - DNA, 13 bp, D. melanogaster
tcttggctttatt

SEQ ID NO: 650383 - DNA, 13 bp, D. melanogaster
tcttggcttttat

SEQ ID NO: 650384 - DNA, 13 bp, D. melanogaster
tcttgggaaaatt

SEQ ID NO: 650385 - DNA, 13 bp, D. melanogaster
tcttgggcaacag

SEQ ID NO: 650386 - DNA, 14 bp, D. melanogaster
tcttgggttcagtt

SEQ ID NO: 650387 - DNA, 14 bp, D. melanogaster
tcttggtcagcctc

SEQ ID NO: 650388 - DNA, 13 bp, D. melanogaster
tcttggtcatctg

SEQ ID NO: 650389 - DNA, 13 bp, D. melanogaster
tcttggtcgtgga

SEQ ID NO: 650390 - DNA, 13 bp, D. melanogaster
tcttgtaaatttt

SEQ ID NO: 650391 - DNA, 13 bp, D. melanogaster
tcttgtaagttta

SEQ ID NO: 650392 - DNA, 13 bp, D. melanogaster
tcttgtaattaaa

SEQ ID NO: 650393 - DNA, 14 bp, D. melanogaster
tcttgtatcttcaa

SEQ ID NO: 650394 - DNA, 13 bp, D. melanogaster
tcttgtctgttta

SEQ ID NO: 650395 - DNA, 13 bp, D. melanogaster
tcttgtgaaatta

SEQ ID NO: 650396 - DNA, 14 bp, D. melanogaster
tcttgtgcaacatc

SEQ ID NO: 650397 - DNA, 13 bp, D. melanogaster
tcttgtgcaattt

SEQ ID NO: 650398 - DNA, 13 bp, D. melanogaster
tcttgtgttccga

SEQ ID NO: 650399 - DNA, 13 bp, D. melanogaster
tcttgttattcta

SEQ ID NO: 650400 - DNA, 14 bp, D. melanogaster
tcttgttattgttg

SEQ ID NO: 650401 - DNA, 13 bp, D. melanogaster
tcttgttccgttg

SEQ ID NO: 650402 - DNA, 13 bp, D. melanogaster
tcttgttcggctt

SEQ ID NO: 650403 - DNA, 13 bp, D. melanogaster
tcttgttctcata

SEQ ID NO: 650404 - DNA, 13 bp, D. melanogaster
tcttgttgcactt

SEQ ID NO: 650405 - DNA, 13 bp, D. melanogaster
tcttgtttttaaa

SEQ ID NO: 650406 - DNA, 13 bp, D. melanogaster
tctttaaaaatgc

SEQ ID NO: 650407 - DNA, 13 bp, D. melanogaster
tctttaaaaattc

SEQ ID NO: 650408 - DNA, 14 bp, D. melanogaster
tctttaaaaattct

SEQ ID NO: 650409 - DNA, 13 bp, D. melanogaster
tctttaaaataac

SEQ ID NO: 650410 - DNA, 13 bp, D. melanogaster
tctttaaacatcg

SEQ ID NO: 650411 - DNA, 13 bp, D. melanogaster
tctttaaattcaa

SEQ ID NO: 650412 - DNA, 13 bp, D. melanogaster
tctttaaattgat

SEQ ID NO: 650413 - DNA, 13 bp, D. melanogaster
tctttaaattgct

SEQ ID NO: 650414 - DNA, 13 bp, D. melanogaster
tctttaacaaatt

SEQ ID NO: 650415 - DNA, 13 bp, D. melanogaster
tctttaacttttg

SEQ ID NO: 650416 - DNA, 13 bp, D. melanogaster
tctttaagataaa

SEQ ID NO: 650417 - DNA, 13 bp, D. melanogaster
tctttaagatact

SEQ ID NO: 650418 - DNA, 13 bp, D. melanogaster
tctttaagatatt

SEQ ID NO: 650419 - DNA, 13 bp, D. melanogaster
tctttaagcaagc

SEQ ID NO: 650420 - DNA, 13 bp, D. melanogaster
tctttaagctcgt

SEQ ID NO: 650421 - DNA, 13 bp, D. melanogaster
tctttaagctgcc

SEQ ID NO: 650422 - DNA, 13 bp, D. melanogaster
tctttaagcttta

SEQ ID NO: 650423 - DNA, 13 bp, D. melanogaster
tctttaatcgaca

SEQ ID NO: 650424 - DNA, 13 bp, D. melanogaster
tctttaattgaga

SEQ ID NO: 650425 - DNA, 13 bp, D. melanogaster
tctttaatttcaa

SEQ ID NO: 650426 - DNA, 13 bp, D. melanogaster
tctttaatttgca

SEQ ID NO: 650427 - DNA, 13 bp, D. melanogaster
tctttacacaaaa

SEQ ID NO: 650428 - DNA, 13 bp, D. melanogaster
tctttacatactt

SEQ ID NO: 650429 - DNA, 13 bp, D. melanogaster
tctttagtttaaa

SEQ ID NO: 650430 - DNA, 13 bp, D. melanogaster
tctttataaatgt

SEQ ID NO: 650431 - DNA, 13 bp, D. melanogaster
tctttataacaat

SEQ ID NO: 650432 - DNA, 13 bp, D. melanogaster
tctttatatatgt

SEQ ID NO: 650433 - DNA, 13 bp, D. melanogaster
tctttatgaacta

SEQ ID NO: 650434 - DNA, 13 bp, D. melanogaster
tctttatgagctg

SEQ ID NO: 650435 - DNA, 13 bp, D. melanogaster
tctttatggccat

SEQ ID NO: 650436 - DNA, 13 bp, D. melanogaster
tctttattcaact

SEQ ID NO: 650437 - DNA, 13 bp, D. melanogaster
tctttattggaaa

SEQ ID NO: 650438 - DNA, 14 bp, D. melanogaster
tctttattggaaat

SEQ ID NO: 650439 - DNA, 14 bp, D. melanogaster
tctttcaaagctgt

SEQ ID NO: 650440 - DNA, 13 bp, D. melanogaster
tctttcaatgctt

SEQ ID NO: 650441 - DNA, 13 bp, D. melanogaster
tctttcactcatt

SEQ ID NO: 650442 - DNA, 13 bp, D. melanogaster
tctttcactttgc

SEQ ID NO: 650443 - DNA, 13 bp, D. melanogaster
tctttcagatact

SEQ ID NO: 650444 - DNA, 13 bp, D. melanogaster
tctttcataaaga

SEQ ID NO: 650445 - DNA, 13 bp, D. melanogaster
tctttccgctcac

SEQ ID NO: 650446 - DNA, 13 bp, D. melanogaster
tctttcgaaagaa

SEQ ID NO: 650447 - DNA, 13 bp, D. melanogaster
tctttcgacgtct

SEQ ID NO: 650448 - DNA, 13 bp, D. melanogaster
tctttcgctcgct

SEQ ID NO: 650449 - DNA, 13 bp, D. melanogaster
tctttcgctctcg

SEQ ID NO: 650450 - DNA, 13 bp, D. melanogaster
tctttcggaaact

SEQ ID NO: 650451 - DNA, 13 bp, D. melanogaster
tctttcgtctcac

SEQ ID NO: 650452 - DNA, 13 bp, D. melanogaster
tctttctaaaaat

SEQ ID NO: 650453 - DNA, 13 bp, D. melanogaster
tctttctgctgct

SEQ ID NO: 650454 - DNA, 13 bp, D. melanogaster
tctttctgctgga

SEQ ID NO: 650455 - DNA, 14 bp, D. melanogaster
tctttcttgatttg

SEQ ID NO: 650456 - DNA, 13 bp, D. melanogaster
tctttgaaaactt

SEQ ID NO: 650457 - DNA, 14 bp, D. melanogaster
tctttgaaaacttt

SEQ ID NO: 650458 - DNA, 13 bp, D. melanogaster
tctttgaaataat

SEQ ID NO: 650459 - DNA, 14 bp, D. melanogaster
tctttgaaataatg

SEQ ID NO: 650460 - DNA, 13 bp, D. melanogaster
tctttgaaattat

SEQ ID NO: 650461 - DNA, 14 bp, D. melanogaster
tctttgaactatca

SEQ ID NO: 650462 - DNA, 13 bp, D. melanogaster
tctttgaattcgg

SEQ ID NO: 650463 - DNA, 13 bp, D. melanogaster
tctttgacattgt

SEQ ID NO: 650464 - DNA, 13 bp, D. melanogaster
tctttgactttaa

SEQ ID NO: 650465 - DNA, 13 bp, D. melanogaster
tctttgactttgc

SEQ ID NO: 650466 - DNA, 13 bp, D. melanogaster
tctttgataacct

SEQ ID NO: 650467 - DNA, 13 bp, D. melanogaster
tctttgatatgac

SEQ ID NO: 650468 - DNA, 13 bp, D. melanogaster
tctttgatttgat

SEQ ID NO: 650469 - DNA, 13 bp, D. melanogaster
tctttgcagaaaa

SEQ ID NO: 650470 - DNA, 13 bp, D. melanogaster
tctttgccatttt

SEQ ID NO: 650471 - DNA, 14 bp, D. melanogaster
tctttgcctttgtg

SEQ ID NO: 650472 - DNA, 13 bp, D. melanogaster
tctttgcgaaaat

SEQ ID NO: 650473 - DNA, 13 bp, D. melanogaster
tctttgctgaagt

SEQ ID NO: 650474 - DNA, 13 bp, D. melanogaster
tctttggaaatca

SEQ ID NO: 650475 - DNA, 13 bp, D. melanogaster
tctttggaatcac

SEQ ID NO: 650476 - DNA, 13 bp, D. melanogaster
tctttggaatttt

SEQ ID NO: 650477 - DNA, 13 bp, D. melanogaster
tctttggagtgct

SEQ ID NO: 650478 - DNA, 14 bp, D. melanogaster
tctttggatgtttt

SEQ ID NO: 650479 - DNA, 13 bp, D. melanogaster
tctttggcagcgc

SEQ ID NO: 650480 - DNA, 13 bp, D. melanogaster
tctttggcttggg

SEQ ID NO: 650481 - DNA, 13 bp, D. melanogaster
tctttggtaataa

SEQ ID NO: 650482 - DNA, 13 bp, D. melanogaster
tctttgtaaatgg

SEQ ID NO: 650483 - DNA, 13 bp, D. melanogaster
tctttgtatgtgt

SEQ ID NO: 650484 - DNA, 13 bp, D. melanogaster
tctttgtgtcatt

SEQ ID NO: 650485 - DNA, 14 bp, D. melanogaster
tctttgtttacgtt

SEQ ID NO: 650486 - DNA, 13 bp, D. melanogaster
tcttttaacgtgc

SEQ ID NO: 650487 - DNA, 13 bp, D. melanogaster
tcttttaatatgg

SEQ ID NO: 650488 - DNA, 13 bp, D. melanogaster
tcttttactctac

SEQ ID NO: 650489 - DNA, 13 bp, D. melanogaster
tcttttatataca

SEQ ID NO: 650490 - DNA, 13 bp, D. melanogaster
tcttttcaacgat

SEQ ID NO: 650491 - DNA, 13 bp, D. melanogaster
tcttttcaatgtc

SEQ ID NO: 650492 - DNA, 13 bp, D. melanogaster
tcttttcctgcgc

SEQ ID NO: 650493 - DNA, 13 bp, D. melanogaster
tcttttcctggct

SEQ ID NO: 650494 - DNA, 13 bp, D. melanogaster
tcttttcgaactc

SEQ ID NO: 650495 - DNA, 13 bp, D. melanogaster
tcttttcggcttg

SEQ ID NO: 650496 - DNA, 13 bp, D. melanogaster
tcttttcttgaaa

SEQ ID NO: 650497 - DNA, 14 bp, D. melanogaster
tcttttcttgaaaa

SEQ ID NO: 650498 - DNA, 13 bp, D. melanogaster
tcttttgaaaaat

SEQ ID NO: 650499 - DNA, 13 bp, D. melanogaster
tcttttgaaataa

SEQ ID NO: 650500 - DNA, 13 bp, D. melanogaster
tcttttgaaatat

SEQ ID NO: 650501 - DNA, 13 bp, D. melanogaster
tcttttgaatgaa

SEQ ID NO: 650502 - DNA, 13 bp, D. melanogaster
tcttttgaggttg

SEQ ID NO: 650503 - DNA, 13 bp, D. melanogaster
tcttttgatgata

SEQ ID NO: 650504 - DNA, 13 bp, D. melanogaster
tcttttgatttga

SEQ ID NO: 650505 - DNA, 13 bp, D. melanogaster
tcttttgcactcg

SEQ ID NO: 650506 - DNA, 13 bp, D. melanogaster
tcttttgcataat

SEQ ID NO: 650507 - DNA, 13 bp, D. melanogaster
tcttttgccaaaa

SEQ ID NO: 650508 - DNA, 13 bp, D. melanogaster
tcttttgctgctg

SEQ ID NO: 650509 - DNA, 14 bp, D. melanogaster
tcttttggccaaaa

SEQ ID NO: 650510 - DNA, 13 bp, D. melanogaster
tcttttggccaac

SEQ ID NO: 650511 - DNA, 13 bp, D. melanogaster
tcttttggccaag

SEQ ID NO: 650512 - DNA, 13 bp, D. melanogaster
tcttttggccata

SEQ ID NO: 650513 - DNA, 13 bp, D. melanogaster
tcttttggccatc

SEQ ID NO: 650514 - DNA, 14 bp, D. melanogaster
tcttttgtctgact

SEQ ID NO: 650515 - DNA, 13 bp, D. melanogaster
tcttttgtggcca

SEQ ID NO: 650516 - DNA, 13 bp, D. melanogaster
tcttttgtggctg

SEQ ID NO: 650517 - DNA, 13 bp, D. melanogaster
tcttttgttcgaa

SEQ ID NO: 650518 - DNA, 13 bp, D. melanogaster
tcttttgtttaca

SEQ ID NO: 650519 - DNA, 13 bp, D. melanogaster
tctttttaaaatg

SEQ ID NO: 650520 - DNA, 13 bp, D. melanogaster
tctttttaactcc

SEQ ID NO: 650521 - DNA, 13 bp, D. melanogaster
tctttttacaaag

SEQ ID NO: 650522 - DNA, 14 bp, D. melanogaster
tctttttacaaagc

SEQ ID NO: 650523 - DNA, 13 bp, D. melanogaster
tctttttatcaga

SEQ ID NO: 650524 - DNA, 13 bp, D. melanogaster
tctttttgaaaaa

SEQ ID NO: 650525 - DNA, 13 bp, D. melanogaster
tctttttgaaata

SEQ ID NO: 650526 - DNA, 13 bp, D. melanogaster
tctttttgaaatt

SEQ ID NO: 650527 - DNA, 14 bp, D. melanogaster
tctttttggaaaat

SEQ ID NO: 650528 - DNA, 13 bp, D. melanogaster
tctttttggccag

SEQ ID NO: 650529 - DNA, 13 bp, D. melanogaster
tctttttgggcca

SEQ ID NO: 650530 - DNA, 13 bp, D. melanogaster
tcttttttaagct

SEQ ID NO: 650531 - DNA, 13 bp, D. melanogaster
tcttttttagctg

SEQ ID NO: 650532 - DNA, 13 bp, D. melanogaster
tcttttttcaaaa

SEQ ID NO: 650533 - DNA, 13 bp, D. melanogaster
tcttttttggcat

SEQ ID NO: 650534 - DNA, 13 bp, D. melanogaster
tcttttttggcca

SEQ ID NO: 650535 - DNA, 14 bp, D. melanogaster
tcttttttggccaa

SEQ ID NO: 650536 - DNA, 13 bp, D. melanogaster
tcttttttgtgca

SEQ ID NO: 650537 - DNA, 13 bp, D. melanogaster
tctttttttagaa

SEQ ID NO: 650538 - DNA, 13 bp, D. melanogaster
tgaaaaaacaatt

SEQ ID NO: 650539 - DNA, 13 bp, D. melanogaster
tgaaaaaacatat

SEQ ID NO: 650540 - DNA, 13 bp, D. melanogaster
tgaaaaaagcgaa

SEQ ID NO: 650541 - DNA, 14 bp, D. melanogaster
tgaaaaaagcgaaa

SEQ ID NO: 650542 - DNA, 13 bp, D. melanogaster
tgaaaaaatacat

SEQ ID NO: 650543 - DNA, 14 bp, D. melanogaster
tgaaaaaatatcaa

SEQ ID NO: 650544 - DNA, 14 bp, D. melanogaster
tgaaaaaatatcga

SEQ ID NO: 650545 - DNA, 13 bp, D. melanogaster
tgaaaaaatatgt

SEQ ID NO: 650546 - DNA, 13 bp, D. melanogaster
tgaaaaaatcgaa

SEQ ID NO: 650547 - DNA, 13 bp, D. melanogaster
tgaaaaaatcgga

SEQ ID NO: 650548 - DNA, 13 bp, D. melanogaster
tgaaaaaatcttt

SEQ ID NO: 650549 - DNA, 13 bp, D. melanogaster
tgaaaaaatgatg

SEQ ID NO: 650550 - DNA, 13 bp, D. melanogaster
tgaaaaaatgcta

SEQ ID NO: 650551 - DNA, 13 bp, D. melanogaster
tgaaaaaatgtat

SEQ ID NO: 650552 - DNA, 13 bp, D. melanogaster
tgaaaaaatgtca

SEQ ID NO: 650553 - DNA, 13 bp, D. melanogaster
tgaaaaaattcca

SEQ ID NO: 650554 - DNA, 13 bp, D. melanogaster
tgaaaaaattcgt

SEQ ID NO: 650555 - DNA, 13 bp, D. melanogaster
tgaaaaaatttca

SEQ ID NO: 650556 - DNA, 13 bp, D. melanogaster
tgaaaaaatttcg

SEQ ID NO: 650557 - DNA, 13 bp, D. melanogaster
tgaaaaacaaatt

SEQ ID NO: 650558 - DNA, 13 bp, D. melanogaster
tgaaaaacaagtt

SEQ ID NO: 650559 - DNA, 13 bp, D. melanogaster
tgaaaaacaatta

SEQ ID NO: 650560 - DNA, 13 bp, D. melanogaster
tgaaaaacaattt

SEQ ID NO: 650561 - DNA, 13 bp, D. melanogaster
tgaaaaacacaca

SEQ ID NO: 650562 - DNA, 13 bp, D. melanogaster
tgaaaaacacatt

SEQ ID NO: 650563 - DNA, 13 bp, D. melanogaster
tgaaaaacagttt

SEQ ID NO: 650564 - DNA, 13 bp, D. melanogaster
tgaaaaacatttg

SEQ ID NO: 650565 - DNA, 13 bp, D. melanogaster
tgaaaaacatttt

SEQ ID NO: 650566 - DNA, 14 bp, D. melanogaster
tgaaaaaccagaat

SEQ ID NO: 650567 - DNA, 13 bp, D. melanogaster
tgaaaaaccgaaa

SEQ ID NO: 650568 - DNA, 13 bp, D. melanogaster
tgaaaaacgaaat

SEQ ID NO: 650569 - DNA, 13 bp, D. melanogaster
tgaaaaacgtttt

SEQ ID NO: 650570 - DNA, 13 bp, D. melanogaster
tgaaaaactaaat

SEQ ID NO: 650571 - DNA, 13 bp, D. melanogaster
tgaaaaactaatt

SEQ ID NO: 650572 - DNA, 13 bp, D. melanogaster
tgaaaaactagtt

SEQ ID NO: 650573 - DNA, 13 bp, D. melanogaster
tgaaaaactattt

SEQ ID NO: 650574 - DNA, 13 bp, D. melanogaster
tgaaaaactcatt

SEQ ID NO: 650575 - DNA, 14 bp, D. melanogaster
tgaaaaactgaaaa

SEQ ID NO: 650576 - DNA, 13 bp, D. melanogaster
tgaaaaactgaat

SEQ ID NO: 650577 - DNA, 13 bp, D. melanogaster
tgaaaaactgcag

SEQ ID NO: 650578 - DNA, 13 bp, D. melanogaster
tgaaaaactgttt

SEQ ID NO: 650579 - DNA, 14 bp, D. melanogaster
tgaaaaacttaagg

SEQ ID NO: 650580 - DNA, 13 bp, D. melanogaster
tgaaaaactttaa

SEQ ID NO: 650581 - DNA, 13 bp, D. melanogaster
tgaaaaactttta

SEQ ID NO: 650582 - DNA, 13 bp, D. melanogaster
tgaaaaagaattt

SEQ ID NO: 650583 - DNA, 13 bp, D. melanogaster
tgaaaaagatgtt

SEQ ID NO: 650584 - DNA, 13 bp, D. melanogaster
tgaaaaagcaatt

SEQ ID NO: 650585 - DNA, 13 bp, D. melanogaster
tgaaaaagctttt

SEQ ID NO: 650586 - DNA, 13 bp, D. melanogaster
tgaaaaagtatta

SEQ ID NO: 650587 - DNA, 13 bp, D. melanogaster
tgaaaaagtgcag

SEQ ID NO: 650588 - DNA, 13 bp, D. melanogaster
tgaaaaagttcag

SEQ ID NO: 650589 - DNA, 13 bp, D. melanogaster
tgaaaaagtttca

SEQ ID NO: 650590 - DNA, 13 bp, D. melanogaster
tgaaaaataagca

SEQ ID NO: 650591 - DNA, 13 bp, D. melanogaster
tgaaaaatacaat

SEQ ID NO: 650592 - DNA, 13 bp, D. melanogaster
tgaaaaatacttt

SEQ ID NO: 650593 - DNA, 14 bp, D. melanogaster
tgaaaaatactttg

SEQ ID NO: 650594 - DNA, 13 bp, D. melanogaster
tgaaaaatagatt

SEQ ID NO: 650595 - DNA, 13 bp, D. melanogaster
tgaaaaatatgca

SEQ ID NO: 650596 - DNA, 13 bp, D. melanogaster
tgaaaaatcaaca

SEQ ID NO: 650597 - DNA, 13 bp, D. melanogaster
tgaaaaatcaatt

SEQ ID NO: 650598 - DNA, 13 bp, D. melanogaster
tgaaaaatcataa

SEQ ID NO: 650599 - DNA, 13 bp, D. melanogaster
tgaaaaatcatat

SEQ ID NO: 650600 - DNA, 13 bp, D. melanogaster
tgaaaaatcggtt

SEQ ID NO: 650601 - DNA, 13 bp, D. melanogaster
tgaaaaatcgtaa

SEQ ID NO: 650602 - DNA, 13 bp, D. melanogaster
tgaaaaatgaaca

SEQ ID NO: 650603 - DNA, 13 bp, D. melanogaster
tgaaaaatgattt

SEQ ID NO: 650604 - DNA, 14 bp, D. melanogaster
tgaaaaatgatttt

SEQ ID NO: 650605 - DNA, 14 bp, D. melanogaster
tgaaaaatgcaaat

SEQ ID NO: 650606 - DNA, 13 bp, D. melanogaster
tgaaaaatgcaat

SEQ ID NO: 650607 - DNA, 13 bp, D. melanogaster
tgaaaaatgcact

SEQ ID NO: 650608 - DNA, 13 bp, D. melanogaster
tgaaaaatgcata

SEQ ID NO: 650609 - DNA, 13 bp, D. melanogaster
tgaaaaatgcatt

SEQ ID NO: 650610 - DNA, 13 bp, D. melanogaster
tgaaaaatgcccc

SEQ ID NO: 650611 - DNA, 13 bp, D. melanogaster
tgaaaaatgtaca

SEQ ID NO: 650612 - DNA, 13 bp, D. melanogaster
tgaaaaatgtata

SEQ ID NO: 650613 - DNA, 13 bp, D. melanogaster
tgaaaaatgtatt

SEQ ID NO: 650614 - DNA, 14 bp, D. melanogaster
tgaaaaatgtattt

SEQ ID NO: 650615 - DNA, 14 bp, D. melanogaster
tgaaaaatgtgaaa

SEQ ID NO: 650616 - DNA, 13 bp, D. melanogaster
tgaaaaatgtgtt

SEQ ID NO: 650617 - DNA, 13 bp, D. melanogaster
tgaaaaatgttaa

SEQ ID NO: 650618 - DNA, 13 bp, D. melanogaster
tgaaaaatgttca

SEQ ID NO: 650619 - DNA, 14 bp, D. melanogaster
tgaaaaatgttcat

SEQ ID NO: 650620 - DNA, 13 bp, D. melanogaster
tgaaaaatgttgc

SEQ ID NO: 650621 - DNA, 13 bp, D. melanogaster
tgaaaaatgtttc

SEQ ID NO: 650622 - DNA, 13 bp, D. melanogaster
tgaaaaatgtttg

SEQ ID NO: 650623 - DNA, 13 bp, D. melanogaster
tgaaaaatgtttt

SEQ ID NO: 650624 - DNA, 14 bp, D. melanogaster
tgaaaaatgttttg

SEQ ID NO: 650625 - DNA, 14 bp, D. melanogaster
tgaaaaattaacaa

SEQ ID NO: 650626 - DNA, 13 bp, D. melanogaster
tgaaaaattaact

SEQ ID NO: 650627 - DNA, 13 bp, D. melanogaster
tgaaaaattatac

SEQ ID NO: 650628 - DNA, 13 bp, D. melanogaster
tgaaaaattatca

SEQ ID NO: 650629 - DNA, 13 bp, D. melanogaster
tgaaaaattcata

SEQ ID NO: 650630 - DNA, 13 bp, D. melanogaster
tgaaaaattcatt

SEQ ID NO: 650631 - DNA, 13 bp, D. melanogaster
tgaaaaattgcat

SEQ ID NO: 650632 - DNA, 13 bp, D. melanogaster
tgaaaaattggca

SEQ ID NO: 650633 - DNA, 13 bp, D. melanogaster
tgaaaaattgtat

SEQ ID NO: 650634 - DNA, 13 bp, D. melanogaster
tgaaaaatttctt

SEQ ID NO: 650635 - DNA, 13 bp, D. melanogaster
tgaaaaatttgat

SEQ ID NO: 650636 - DNA, 13 bp, D. melanogaster
tgaaaaatttgta

SEQ ID NO: 650637 - DNA, 13 bp, D. melanogaster
tgaaaaatttgtc

SEQ ID NO: 650638 - DNA, 13 bp, D. melanogaster
tgaaaacaaaacc

SEQ ID NO: 650639 - DNA, 13 bp, D. melanogaster
tgaaaacaaaacg

SEQ ID NO: 650640 - DNA, 14 bp, D. melanogaster
tgaaaacaaaatta

SEQ ID NO: 650641 - DNA, 14 bp, D. melanogaster
tgaaaacaaaggaa

SEQ ID NO: 650642 - DNA, 13 bp, D. melanogaster
tgaaaacaacaat

SEQ ID NO: 650643 - DNA, 13 bp, D. melanogaster
tgaaaacaacatt

SEQ ID NO: 650644 - DNA, 13 bp, D. melanogaster
tgaaaacaatata

SEQ ID NO: 650645 - DNA, 14 bp, D. melanogaster
tgaaaacaatcaac

SEQ ID NO: 650646 - DNA, 14 bp, D. melanogaster
tgaaaacaatttaa

SEQ ID NO: 650647 - DNA, 13 bp, D. melanogaster
tgaaaacacacaa

SEQ ID NO: 650648 - DNA, 14 bp, D. melanogaster
tgaaaacacattaa

SEQ ID NO: 650649 - DNA, 13 bp, D. melanogaster
tgaaaacataaat

SEQ ID NO: 650650 - DNA, 13 bp, D. melanogaster
tgaaaacatattg

SEQ ID NO: 650651 - DNA, 13 bp, D. melanogaster
tgaaaacatattt

SEQ ID NO: 650652 - DNA, 14 bp, D. melanogaster
tgaaaacatatttt

SEQ ID NO: 650653 - DNA, 13 bp, D. melanogaster
tgaaaacatgaaa

SEQ ID NO: 650654 - DNA, 14 bp, D. melanogaster
tgaaaacatgaaaa

SEQ ID NO: 650655 - DNA, 13 bp, D. melanogaster
tgaaaacattaat

SEQ ID NO: 650656 - DNA, 13 bp, D. melanogaster
tgaaaacattgaa

SEQ ID NO: 650657 - DNA, 13 bp, D. melanogaster
tgaaaacatttgc

SEQ ID NO: 650658 - DNA, 13 bp, D. melanogaster
tgaaaacattttt

SEQ ID NO: 650659 - DNA, 14 bp, D. melanogaster
tgaaaacattttta

SEQ ID NO: 650660 - DNA, 14 bp, D. melanogaster
tgaaaacatttttc

SEQ ID NO: 650661 - DNA, 14 bp, D. melanogaster
tgaaaacatttttt

SEQ ID NO: 650662 - DNA, 13 bp, D. melanogaster
tgaaaaccacttt

SEQ ID NO: 650663 - DNA, 13 bp, D. melanogaster
tgaaaaccagaaa

SEQ ID NO: 650664 - DNA, 13 bp, D. melanogaster
tgaaaaccagttt

SEQ ID NO: 650665 - DNA, 13 bp, D. melanogaster
tgaaaaccatttg

SEQ ID NO: 650666 - DNA, 13 bp, D. melanogaster
tgaaaaccccaaa

SEQ ID NO: 650667 - DNA, 13 bp, D. melanogaster
tgaaaaccgaaaa

SEQ ID NO: 650668 - DNA, 14 bp, D. melanogaster
tgaaaaccgaaaac

SEQ ID NO: 650669 - DNA, 13 bp, D. melanogaster
tgaaaaccgaaag

SEQ ID NO: 650670 - DNA, 13 bp, D. melanogaster
tgaaaacctgaca

SEQ ID NO: 650671 - DNA, 13 bp, D. melanogaster
tgaaaacgaaaac

SEQ ID NO: 650672 - DNA, 14 bp, D. melanogaster
tgaaaacgaaaaca

SEQ ID NO: 650673 - DNA, 13 bp, D. melanogaster
tgaaaacgaaaat

SEQ ID NO: 650674 - DNA, 13 bp, D. melanogaster
tgaaaacgaaacg

SEQ ID NO: 650675 - DNA, 13 bp, D. melanogaster
tgaaaacgaaaga

SEQ ID NO: 650676 - DNA, 13 bp, D. melanogaster
tgaaaacgaaagt

SEQ ID NO: 650677 - DNA, 13 bp, D. melanogaster
tgaaaacgaaatc

SEQ ID NO: 650678 - DNA, 13 bp, D. melanogaster
tgaaaacgagaaa

SEQ ID NO: 650679 - DNA, 13 bp, D. melanogaster
tgaaaacgatttg

SEQ ID NO: 650680 - DNA, 13 bp, D. melanogaster
tgaaaacggaaaa

SEQ ID NO: 650681 - DNA, 13 bp, D. melanogaster
tgaaaactaatta

SEQ ID NO: 650682 - DNA, 13 bp, D. melanogaster
tgaaaactagttt

SEQ ID NO: 650683 - DNA, 13 bp, D. melanogaster
tgaaaactatatt

SEQ ID NO: 650684 - DNA, 13 bp, D. melanogaster
tgaaaactatgta

SEQ ID NO: 650685 - DNA, 13 bp, D. melanogaster
tgaaaactattca

SEQ ID NO: 650686 - DNA, 13 bp, D. melanogaster
tgaaaactatttt

SEQ ID NO: 650687 - DNA, 13 bp, D. melanogaster
tgaaaactcaaaa

SEQ ID NO: 650688 - DNA, 13 bp, D. melanogaster
tgaaaactcattt

SEQ ID NO: 650689 - DNA, 13 bp, D. melanogaster
tgaaaactcgaaa

SEQ ID NO: 650690 - DNA, 13 bp, D. melanogaster
tgaaaactctgca

SEQ ID NO: 650691 - DNA, 13 bp, D. melanogaster
tgaaaactctttt

SEQ ID NO: 650692 - DNA, 13 bp, D. melanogaster
tgaaaactgaaaa

SEQ ID NO: 650693 - DNA, 14 bp, D. melanogaster
tgaaaactgaaaaa

SEQ ID NO: 650694 - DNA, 13 bp, D. melanogaster
tgaaaactgaaac

SEQ ID NO: 650695 - DNA, 13 bp, D. melanogaster
tgaaaactgcaaa

SEQ ID NO: 650696 - DNA, 13 bp, D. melanogaster
tgaaaactggaaa

SEQ ID NO: 650697 - DNA, 13 bp, D. melanogaster
tgaaaactgtttg

SEQ ID NO: 650698 - DNA, 13 bp, D. melanogaster
tgaaaacttaaag

SEQ ID NO: 650699 - DNA, 14 bp, D. melanogaster
tgaaaacttgaaaa

SEQ ID NO: 650700 - DNA, 13 bp, D. melanogaster
tgaaaacttggcc

SEQ ID NO: 650701 - DNA, 13 bp, D. melanogaster
tgaaaactttcga

SEQ ID NO: 650702 - DNA, 13 bp, D. melanogaster
tgaaaactttgct

SEQ ID NO: 650703 - DNA, 13 bp, D. melanogaster
tgaaaactttgtt

SEQ ID NO: 650704 - DNA, 13 bp, D. melanogaster
tgaaaacttttcg

SEQ ID NO: 650705 - DNA, 13 bp, D. melanogaster
tgaaaagaaaact

SEQ ID NO: 650706 - DNA, 13 bp, D. melanogaster
tgaaaagaaaatc

SEQ ID NO: 650707 - DNA, 13 bp, D. melanogaster
tgaaaagaaagca

SEQ ID NO: 650708 - DNA, 14 bp, D. melanogaster
tgaaaagaccatta

SEQ ID NO: 650709 - DNA, 13 bp, D. melanogaster
tgaaaagagcaaa

SEQ ID NO: 650710 - DNA, 13 bp, D. melanogaster
tgaaaagatttat

SEQ ID NO: 650711 - DNA, 13 bp, D. melanogaster
tgaaaagatttta

SEQ ID NO: 650712 - DNA, 13 bp, D. melanogaster
tgaaaagattttc

SEQ ID NO: 650713 - DNA, 13 bp, D. melanogaster
tgaaaagcaaatt

SEQ ID NO: 650714 - DNA, 13 bp, D. melanogaster
tgaaaagcacaaa

SEQ ID NO: 650715 - DNA, 13 bp, D. melanogaster
tgaaaagcacatg

SEQ ID NO: 650716 - DNA, 13 bp, D. melanogaster
tgaaaagcagaaa

SEQ ID NO: 650717 - DNA, 13 bp, D. melanogaster
tgaaaagcagcaa

SEQ ID NO: 650718 - DNA, 13 bp, D. melanogaster
tgaaaagcagcca

SEQ ID NO: 650719 - DNA, 13 bp, D. melanogaster
tgaaaagcataaa

SEQ ID NO: 650720 - DNA, 13 bp, D. melanogaster
tgaaaagcatttg

SEQ ID NO: 650721 - DNA, 13 bp, D. melanogaster
tgaaaagcatttt

SEQ ID NO: 650722 - DNA, 13 bp, D. melanogaster
tgaaaagccaaaa

SEQ ID NO: 650723 - DNA, 13 bp, D. melanogaster
tgaaaagccattt

SEQ ID NO: 650724 - DNA, 13 bp, D. melanogaster
tgaaaagcgaaat

SEQ ID NO: 650725 - DNA, 13 bp, D. melanogaster
tgaaaagcggaaa

SEQ ID NO: 650726 - DNA, 13 bp, D. melanogaster
tgaaaagctgaaa

SEQ ID NO: 650727 - DNA, 14 bp, D. melanogaster
tgaaaagctgaaaa

SEQ ID NO: 650728 - DNA, 13 bp, D. melanogaster
tgaaaagcttttg

SEQ ID NO: 650729 - DNA, 13 bp, D. melanogaster
tgaaaaggacttg

SEQ ID NO: 650730 - DNA, 13 bp, D. melanogaster
tgaaaaggcattt

SEQ ID NO: 650731 - DNA, 13 bp, D. melanogaster
tgaaaagtaaaca

SEQ ID NO: 650732 - DNA, 14 bp, D. melanogaster
tgaaaagtaaacaa

SEQ ID NO: 650733 - DNA, 13 bp, D. melanogaster
tgaaaagtatata

SEQ ID NO: 650734 - DNA, 13 bp, D. melanogaster
tgaaaagtatgaa

SEQ ID NO: 650735 - DNA, 13 bp, D. melanogaster
tgaaaagtatgta

SEQ ID NO: 650736 - DNA, 14 bp, D. melanogaster
tgaaaagtatgtaa

SEQ ID NO: 650737 - DNA, 13 bp, D. melanogaster
tgaaaagtattaa

SEQ ID NO: 650738 - DNA, 13 bp, D. melanogaster
tgaaaagtattta

SEQ ID NO: 650739 - DNA, 15 bp, D. melanogaster
tgaaaagtatttagc

SEQ ID NO: 650740 - DNA, 13 bp, D. melanogaster
tgaaaagtatttg

SEQ ID NO: 650741 - DNA, 13 bp, D. melanogaster
tgaaaagtgaaac

SEQ ID NO: 650742 - DNA, 13 bp, D. melanogaster
tgaaaagtgaaag

SEQ ID NO: 650743 - DNA, 13 bp, D. melanogaster
tgaaaagtgaaat

SEQ ID NO: 650744 - DNA, 14 bp, D. melanogaster
tgaaaagtgaaatg

SEQ ID NO: 650745 - DNA, 13 bp, D. melanogaster
tgaaaagtgattt

SEQ ID NO: 650746 - DNA, 13 bp, D. melanogaster
tgaaaagtgcaat

SEQ ID NO: 650747 - DNA, 13 bp, D. melanogaster
tgaaaagtggcca

SEQ ID NO: 650748 - DNA, 13 bp, D. melanogaster
tgaaaagtgggaa

SEQ ID NO: 650749 - DNA, 13 bp, D. melanogaster
tgaaaagtgtgta

SEQ ID NO: 650750 - DNA, 13 bp, D. melanogaster
tgaaaagtgtttt

SEQ ID NO: 650751 - DNA, 13 bp, D. melanogaster
tgaaaagttaaat

SEQ ID NO: 650752 - DNA, 13 bp, D. melanogaster
tgaaaagttcaat

SEQ ID NO: 650753 - DNA, 13 bp, D. melanogaster
tgaaaagttcatt

SEQ ID NO: 650754 - DNA, 13 bp, D. melanogaster
tgaaaagttccag

SEQ ID NO: 650755 - DNA, 13 bp, D. melanogaster
tgaaaagttgaaa

SEQ ID NO: 650756 - DNA, 13 bp, D. melanogaster
tgaaaagttgttg

SEQ ID NO: 650757 - DNA, 13 bp, D. melanogaster
tgaaaagttttaa

SEQ ID NO: 650758 - DNA, 13 bp, D. melanogaster
tgaaaagttttat

SEQ ID NO: 650759 - DNA, 13 bp, D. melanogaster
tgaaaagttttct

SEQ ID NO: 650760 - DNA, 13 bp, D. melanogaster
tgaaaataaaacg

SEQ ID NO: 650761 - DNA, 13 bp, D. melanogaster
tgaaaataaacga

SEQ ID NO: 650762 - DNA, 13 bp, D. melanogaster
tgaaaataaagtg

SEQ ID NO: 650763 - DNA, 13 bp, D. melanogaster
tgaaaataaatca

SEQ ID NO: 650764 - DNA, 13 bp, D. melanogaster
tgaaaataaatgc

SEQ ID NO: 650765 - DNA, 13 bp, D. melanogaster
tgaaaataaatgt

SEQ ID NO: 650766 - DNA, 14 bp, D. melanogaster
tgaaaataaattgt

SEQ ID NO: 650767 - DNA, 13 bp, D. melanogaster
tgaaaataataca

SEQ ID NO: 650768 - DNA, 13 bp, D. melanogaster
tgaaaataatagt

SEQ ID NO: 650769 - DNA, 13 bp, D. melanogaster
tgaaaataatgac

SEQ ID NO: 650770 - DNA, 13 bp, D. melanogaster
tgaaaataatgat

SEQ ID NO: 650771 - DNA, 14 bp, D. melanogaster
tgaaaatacatttt

SEQ ID NO: 650772 - DNA, 13 bp, D. melanogaster
tgaaaatactaaa

SEQ ID NO: 650773 - DNA, 13 bp, D. melanogaster
tgaaaatactcag

SEQ ID NO: 650774 - DNA, 13 bp, D. melanogaster
tgaaaatactttt

SEQ ID NO: 650775 - DNA, 14 bp, D. melanogaster
tgaaaatagattag

SEQ ID NO: 650776 - DNA, 13 bp, D. melanogaster
tgaaaatagtttg

SEQ ID NO: 650777 - DNA, 13 bp, D. melanogaster
tgaaaatataact

SEQ ID NO: 650778 - DNA, 14 bp, D. melanogaster
tgaaaatatatgta

SEQ ID NO: 650779 - DNA, 13 bp, D. melanogaster
tgaaaatatcaat

SEQ ID NO: 650780 - DNA, 13 bp, D. melanogaster
tgaaaatatcttt

SEQ ID NO: 650781 - DNA, 13 bp, D. melanogaster
tgaaaatattgca

SEQ ID NO: 650782 - DNA, 13 bp, D. melanogaster
tgaaaatattgct

SEQ ID NO: 650783 - DNA, 13 bp, D. melanogaster
tgaaaatattgtt

SEQ ID NO: 650784 - DNA, 13 bp, D. melanogaster
tgaaaatatttca

SEQ ID NO: 650785 - DNA, 13 bp, D. melanogaster
tgaaaatattttc

SEQ ID NO: 650786 - DNA, 13 bp, D. melanogaster
tgaaaatattttg

SEQ ID NO: 650787 - DNA, 14 bp, D. melanogaster
tgaaaatatttttg

SEQ ID NO: 650788 - DNA, 13 bp, D. melanogaster
tgaaaatcaaata

SEQ ID NO: 650789 - DNA, 13 bp, D. melanogaster
tgaaaatcaaatg

SEQ ID NO: 650790 - DNA, 14 bp, D. melanogaster
tgaaaatcaaatga

SEQ ID NO: 650791 - DNA, 13 bp, D. melanogaster
tgaaaatcaaatt

SEQ ID NO: 650792 - DNA, 13 bp, D. melanogaster
tgaaaatcaataa

SEQ ID NO: 650793 - DNA, 13 bp, D. melanogaster
tgaaaatcataaa

SEQ ID NO: 650794 - DNA, 13 bp, D. melanogaster
tgaaaatcatatt

SEQ ID NO: 650795 - DNA, 13 bp, D. melanogaster
tgaaaatcattca

SEQ ID NO: 650796 - DNA, 13 bp, D. melanogaster
tgaaaatcctttt

SEQ ID NO: 650797 - DNA, 14 bp, D. melanogaster
tgaaaatcgaaaaa

SEQ ID NO: 650798 - DNA, 13 bp, D. melanogaster
tgaaaatcgaatt

SEQ ID NO: 650799 - DNA, 13 bp, D. melanogaster
tgaaaatcgatat

SEQ ID NO: 650800 - DNA, 13 bp, D. melanogaster
tgaaaatcgtttg

SEQ ID NO: 650801 - DNA, 13 bp, D. melanogaster
tgaaaatctaaaa

SEQ ID NO: 650802 - DNA, 13 bp, D. melanogaster
tgaaaatctataa

SEQ ID NO: 650803 - DNA, 13 bp, D. melanogaster
tgaaaatctcttt

SEQ ID NO: 650804 - DNA, 13 bp, D. melanogaster
tgaaaatctgaaa

SEQ ID NO: 650805 - DNA, 13 bp, D. melanogaster
tgaaaatctgaag

SEQ ID NO: 650806 - DNA, 13 bp, D. melanogaster
tgaaaatctgtta

SEQ ID NO: 650807 - DNA, 13 bp, D. melanogaster
tgaaaatcttaaa

SEQ ID NO: 650808 - DNA, 13 bp, D. melanogaster
tgaaaatctttac

SEQ ID NO: 650809 - DNA, 13 bp, D. melanogaster
tgaaaatcttttc

SEQ ID NO: 650810 - DNA, 13 bp, D. melanogaster
tgaaaatgaaaca

SEQ ID NO: 650811 - DNA, 14 bp, D. melanogaster
tgaaaatgaaacaa

SEQ ID NO: 650812 - DNA, 13 bp, D. melanogaster
tgaaaatgaaact

SEQ ID NO: 650813 - DNA, 14 bp, D. melanogaster
tgaaaatgaaactg

SEQ ID NO: 650814 - DNA, 13 bp, D. melanogaster
tgaaaatgaagat

SEQ ID NO: 650815 - DNA, 13 bp, D. melanogaster
tgaaaatgaatgc

SEQ ID NO: 650816 - DNA, 13 bp, D. melanogaster
tgaaaatgaattt

SEQ ID NO: 650817 - DNA, 13 bp, D. melanogaster
tgaaaatgacttt

SEQ ID NO: 650818 - DNA, 13 bp, D. melanogaster
tgaaaatgaggag

SEQ ID NO: 650819 - DNA, 13 bp, D. melanogaster
tgaaaatgatcga

SEQ ID NO: 650820 - DNA, 13 bp, D. melanogaster
tgaaaatgatgaa

SEQ ID NO: 650821 - DNA, 13 bp, D. melanogaster
tgaaaatgattat

SEQ ID NO: 650822 - DNA, 13 bp, D. melanogaster
tgaaaatgattga

SEQ ID NO: 650823 - DNA, 14 bp, D. melanogaster
tgaaaatgatttaa

SEQ ID NO: 650824 - DNA, 13 bp, D. melanogaster
tgaaaatgatttt

SEQ ID NO: 650825 - DNA, 14 bp, D. melanogaster
tgaaaatgcaaatg

SEQ ID NO: 650826 - DNA, 13 bp, D. melanogaster
tgaaaatgcagca

SEQ ID NO: 650827 - DNA, 13 bp, D. melanogaster
tgaaaatgcattt

SEQ ID NO: 650828 - DNA, 13 bp, D. melanogaster
tgaaaatgccaaa

SEQ ID NO: 650829 - DNA, 13 bp, D. melanogaster
tgaaaatgccgcc

SEQ ID NO: 650830 - DNA, 13 bp, D. melanogaster
tgaaaatgcgcaa

SEQ ID NO: 650831 - DNA, 13 bp, D. melanogaster
tgaaaatgctaaa

SEQ ID NO: 650832 - DNA, 13 bp, D. melanogaster
tgaaaatgctttt

SEQ ID NO: 650833 - DNA, 14 bp, D. melanogaster
tgaaaatggaaaat

SEQ ID NO: 650834 - DNA, 13 bp, D. melanogaster
tgaaaatggaata

SEQ ID NO: 650835 - DNA, 13 bp, D. melanogaster
tgaaaatggaatg

SEQ ID NO: 650836 - DNA, 13 bp, D. melanogaster
tgaaaatggaatt

SEQ ID NO: 650837 - DNA, 13 bp, D. melanogaster
tgaaaatggatgg

SEQ ID NO: 650838 - DNA, 13 bp, D. melanogaster
tgaaaatggcatc

SEQ ID NO: 650839 - DNA, 13 bp, D. melanogaster
tgaaaatggggaa

SEQ ID NO: 650840 - DNA, 13 bp, D. melanogaster
tgaaaatgggttt

SEQ ID NO: 650841 - DNA, 13 bp, D. melanogaster
tgaaaatggtttt

SEQ ID NO: 650842 - DNA, 13 bp, D. melanogaster
tgaaaatgtaaat

SEQ ID NO: 650843 - DNA, 13 bp, D. melanogaster
tgaaaatgtaatt

SEQ ID NO: 650844 - DNA, 14 bp, D. melanogaster
tgaaaatgtaattt

SEQ ID NO: 650845 - DNA, 13 bp, D. melanogaster
tgaaaatgtacaa

SEQ ID NO: 650846 - DNA, 13 bp, D. melanogaster
tgaaaatgtatct

SEQ ID NO: 650847 - DNA, 13 bp, D. melanogaster
tgaaaatgtattt

SEQ ID NO: 650848 - DNA, 13 bp, D. melanogaster
tgaaaatgtcatt

SEQ ID NO: 650849 - DNA, 13 bp, D. melanogaster
tgaaaatgtggaa

SEQ ID NO: 650850 - DNA, 13 bp, D. melanogaster
tgaaaatgtgttt

SEQ ID NO: 650851 - DNA, 13 bp, D. melanogaster
tgaaaatgttcaa

SEQ ID NO: 650852 - DNA, 13 bp, D. melanogaster
tgaaaatgttgat

SEQ ID NO: 650853 - DNA, 13 bp, D. melanogaster
tgaaaatgttgta

SEQ ID NO: 650854 - DNA, 13 bp, D. melanogaster
tgaaaatgttgtg

SEQ ID NO: 650855 - DNA, 13 bp, D. melanogaster
tgaaaatgtttct

SEQ ID NO: 650856 - DNA, 13 bp, D. melanogaster
tgaaaattaacaa

SEQ ID NO: 650857 - DNA, 13 bp, D. melanogaster
tgaaaattaagca

SEQ ID NO: 650858 - DNA, 13 bp, D. melanogaster
tgaaaattaatga

SEQ ID NO: 650859 - DNA, 13 bp, D. melanogaster
tgaaaattacaaa

SEQ ID NO: 650860 - DNA, 13 bp, D. melanogaster
tgaaaattatcaa

SEQ ID NO: 650861 - DNA, 13 bp, D. melanogaster
tgaaaattatgta

SEQ ID NO: 650862 - DNA, 13 bp, D. melanogaster
tgaaaattatgtg

SEQ ID NO: 650863 - DNA, 13 bp, D. melanogaster
tgaaaattattgt

SEQ ID NO: 650864 - DNA, 13 bp, D. melanogaster
tgaaaattatttg

SEQ ID NO: 650865 - DNA, 13 bp, D. melanogaster
tgaaaattcaaaa

SEQ ID NO: 650866 - DNA, 13 bp, D. melanogaster
tgaaaattcaaat

SEQ ID NO: 650867 - DNA, 13 bp, D. melanogaster
tgaaaattcaatt

SEQ ID NO: 650868 - DNA, 13 bp, D. melanogaster
tgaaaattcatta

SEQ ID NO: 650869 - DNA, 13 bp, D. melanogaster
tgaaaattccaaa

SEQ ID NO: 650870 - DNA, 13 bp, D. melanogaster
tgaaaattccaat

SEQ ID NO: 650871 - DNA, 13 bp, D. melanogaster
tgaaaattccttt

SEQ ID NO: 650872 - DNA, 13 bp, D. melanogaster
tgaaaattcgaat

SEQ ID NO: 650873 - DNA, 13 bp, D. melanogaster
tgaaaattctaaa

SEQ ID NO: 650874 - DNA, 13 bp, D. melanogaster
tgaaaattgagtt

SEQ ID NO: 650875 - DNA, 14 bp, D. melanogaster
tgaaaattgagttt

SEQ ID NO: 650876 - DNA, 13 bp, D. melanogaster
tgaaaattgattg

SEQ ID NO: 650877 - DNA, 14 bp, D. melanogaster
tgaaaattgatttt

SEQ ID NO: 650878 - DNA, 13 bp, D. melanogaster
tgaaaattgcaaa

SEQ ID NO: 650879 - DNA, 14 bp, D. melanogaster
tgaaaattgcaaaa

SEQ ID NO: 650880 - DNA, 13 bp, D. melanogaster
tgaaaattgcaat

SEQ ID NO: 650881 - DNA, 14 bp, D. melanogaster
tgaaaattgcattt

SEQ ID NO: 650882 - DNA, 13 bp, D. melanogaster
tgaaaattgccaa

SEQ ID NO: 650883 - DNA, 13 bp, D. melanogaster
tgaaaattgcggg

SEQ ID NO: 650884 - DNA, 13 bp, D. melanogaster
tgaaaattggaaa

SEQ ID NO: 650885 - DNA, 13 bp, D. melanogaster
tgaaaattggcaa

SEQ ID NO: 650886 - DNA, 13 bp, D. melanogaster
tgaaaattggtgg

SEQ ID NO: 650887 - DNA, 13 bp, D. melanogaster
tgaaaattgtatt

SEQ ID NO: 650888 - DNA, 13 bp, D. melanogaster
tgaaaattgtgca

SEQ ID NO: 650889 - DNA, 13 bp, D. melanogaster
tgaaaattgttga

SEQ ID NO: 650890 - DNA, 13 bp, D. melanogaster
tgaaaattgtttt

SEQ ID NO: 650891 - DNA, 14 bp, D. melanogaster
tgaaaattgttttg

SEQ ID NO: 650892 - DNA, 13 bp, D. melanogaster
tgaaaatttaaca

SEQ ID NO: 650893 - DNA, 13 bp, D. melanogaster
tgaaaatttacaa

SEQ ID NO: 650894 - DNA, 14 bp, D. melanogaster
tgaaaatttcaaaa

SEQ ID NO: 650895 - DNA, 13 bp, D. melanogaster
tgaaaatttccaa

SEQ ID NO: 650896 - DNA, 14 bp, D. melanogaster
tgaaaatttcgaaa

SEQ ID NO: 650897 - DNA, 13 bp, D. melanogaster
tgaaaatttcgca

SEQ ID NO: 650898 - DNA, 13 bp, D. melanogaster
tgaaaatttctgt

SEQ ID NO: 650899 - DNA, 14 bp, D. melanogaster
tgaaaatttgaaat

SEQ ID NO: 650900 - DNA, 13 bp, D. melanogaster
tgaaaatttggca

SEQ ID NO: 650901 - DNA, 13 bp, D. melanogaster
tgaaaattttcca

SEQ ID NO: 650902 - DNA, 13 bp, D. melanogaster
tgaaacaaaaagt

SEQ ID NO: 650903 - DNA, 13 bp, D. melanogaster
tgaaacaaaacta

SEQ ID NO: 650904 - DNA, 13 bp, D. melanogaster
tgaaacaaaagta

SEQ ID NO: 650905 - DNA, 13 bp, D. melanogaster
tgaaacaaaatta

SEQ ID NO: 650906 - DNA, 13 bp, D. melanogaster
tgaaacaaatgaa

SEQ ID NO: 650907 - DNA, 14 bp, D. melanogaster
tgaaacaaattaaa

SEQ ID NO: 650908 - DNA, 13 bp, D. melanogaster
tgaaacaaattga

SEQ ID NO: 650909 - DNA, 13 bp, D. melanogaster
tgaaacaaattgt

SEQ ID NO: 650910 - DNA, 14 bp, D. melanogaster
tgaaacaaatttta

SEQ ID NO: 650911 - DNA, 13 bp, D. melanogaster
tgaaacaacaaac

SEQ ID NO: 650912 - DNA, 13 bp, D. melanogaster
tgaaacaataaat

SEQ ID NO: 650913 - DNA, 13 bp, D. melanogaster
tgaaacaataata

SEQ ID NO: 650914 - DNA, 13 bp, D. melanogaster
tgaaacaattgca

SEQ ID NO: 650915 - DNA, 13 bp, D. melanogaster
tgaaacaatttaa

SEQ ID NO: 650916 - DNA, 13 bp, D. melanogaster
tgaaacaatttgt

SEQ ID NO: 650917 - DNA, 13 bp, D. melanogaster
tgaaacacacaaa

SEQ ID NO: 650918 - DNA, 13 bp, D. melanogaster
tgaaacaccagaa

SEQ ID NO: 650919 - DNA, 13 bp, D. melanogaster
tgaaacagaaaca

SEQ ID NO: 650920 - DNA, 14 bp, D. melanogaster
tgaaacagaaacag

SEQ ID NO: 650921 - DNA, 13 bp, D. melanogaster
tgaaacagaaacc

SEQ ID NO: 650922 - DNA, 13 bp, D. melanogaster
tgaaacagaaatt

SEQ ID NO: 650923 - DNA, 13 bp, D. melanogaster
tgaaacagcagca

SEQ ID NO: 650924 - DNA, 13 bp, D. melanogaster
tgaaacataaaat

SEQ ID NO: 650925 - DNA, 13 bp, D. melanogaster
tgaaacatatatt

SEQ ID NO: 650926 - DNA, 13 bp, D. melanogaster
tgaaacatgaaac

SEQ ID NO: 650927 - DNA, 13 bp, D. melanogaster
tgaaacatttata

SEQ ID NO: 650928 - DNA, 13 bp, D. melanogaster
tgaaacatttatt

SEQ ID NO: 650929 - DNA, 13 bp, D. melanogaster
tgaaacatttgat

SEQ ID NO: 650930 - DNA, 13 bp, D. melanogaster
tgaaaccaaaaat

SEQ ID NO: 650931 - DNA, 13 bp, D. melanogaster
tgaaaccaaacca

SEQ ID NO: 650932 - DNA, 13 bp, D. melanogaster
tgaaaccaacatt

SEQ ID NO: 650933 - DNA, 13 bp, D. melanogaster
tgaaaccaatctg

SEQ ID NO: 650934 - DNA, 13 bp, D. melanogaster
tgaaaccaccaac

SEQ ID NO: 650935 - DNA, 13 bp, D. melanogaster
tgaaaccattttt

SEQ ID NO: 650936 - DNA, 13 bp, D. melanogaster
tgaaaccgaaagc

SEQ ID NO: 650937 - DNA, 13 bp, D. melanogaster
tgaaacgaaacga

SEQ ID NO: 650938 - DNA, 14 bp, D. melanogaster
tgaaacgaaacgaa

SEQ ID NO: 650939 - DNA, 13 bp, D. melanogaster
tgaaacgaaattg

SEQ ID NO: 650940 - DNA, 13 bp, D. melanogaster
tgaaacgaaattt

SEQ ID NO: 650941 - DNA, 14 bp, D. melanogaster
tgaaacgaaatttc

SEQ ID NO: 650942 - DNA, 13 bp, D. melanogaster
tgaaacgagttgg

SEQ ID NO: 650943 - DNA, 13 bp, D. melanogaster
tgaaacgatatga

SEQ ID NO: 650944 - DNA, 13 bp, D. melanogaster
tgaaacggaaaac

SEQ ID NO: 650945 - DNA, 13 bp, D. melanogaster
tgaaacggaaatt

SEQ ID NO: 650946 - DNA, 13 bp, D. melanogaster
tgaaactaaagct

SEQ ID NO: 650947 - DNA, 13 bp, D. melanogaster
tgaaactaaatat

SEQ ID NO: 650948 - DNA, 13 bp, D. melanogaster
tgaaactaaatct

SEQ ID NO: 650949 - DNA, 13 bp, D. melanogaster
tgaaactaattaa

SEQ ID NO: 650950 - DNA, 13 bp, D. melanogaster
tgaaactaatttg

SEQ ID NO: 650951 - DNA, 13 bp, D. melanogaster
tgaaactagaaaa

SEQ ID NO: 650952 - DNA, 13 bp, D. melanogaster
tgaaactattaat

SEQ ID NO: 650953 - DNA, 13 bp, D. melanogaster
tgaaactatttaa

SEQ ID NO: 650954 - DNA, 13 bp, D. melanogaster
tgaaactattttt

SEQ ID NO: 650955 - DNA, 13 bp, D. melanogaster
tgaaactcaaaca

SEQ ID NO: 650956 - DNA, 13 bp, D. melanogaster
tgaaactcaattt

SEQ ID NO: 650957 - DNA, 13 bp, D. melanogaster
tgaaactgaaaaa

SEQ ID NO: 650958 - DNA, 13 bp, D. melanogaster
tgaaactgaaaac

SEQ ID NO: 650959 - DNA, 13 bp, D. melanogaster
tgaaactgaaaag

SEQ ID NO: 650960 - DNA, 14 bp, D. melanogaster
tgaaactgaaacag

SEQ ID NO: 650961 - DNA, 13 bp, D. melanogaster
tgaaactgaaatt

SEQ ID NO: 650962 - DNA, 13 bp, D. melanogaster
tgaaactgaactg

SEQ ID NO: 650963 - DNA, 14 bp, D. melanogaster
tgaaactgataaag

SEQ ID NO: 650964 - DNA, 13 bp, D. melanogaster
tgaaactgatggt

SEQ ID NO: 650965 - DNA, 13 bp, D. melanogaster
tgaaactgcaatt

SEQ ID NO: 650966 - DNA, 13 bp, D. melanogaster
tgaaactggaact

SEQ ID NO: 650967 - DNA, 13 bp, D. melanogaster
tgaaactgtttac

SEQ ID NO: 650968 - DNA, 13 bp, D. melanogaster
tgaaacttaaaaa

SEQ ID NO: 650969 - DNA, 13 bp, D. melanogaster
tgaaacttattta

SEQ ID NO: 650970 - DNA, 13 bp, D. melanogaster
tgaaacttttaaa

SEQ ID NO: 650971 - DNA, 13 bp, D. melanogaster
tgaaagaaacacg

SEQ ID NO: 650972 - DNA, 13 bp, D. melanogaster
tgaaagaaattca

SEQ ID NO: 650973 - DNA, 13 bp, D. melanogaster
tgaaagaattgat

SEQ ID NO: 650974 - DNA, 13 bp, D. melanogaster
tgaaagactatga

SEQ ID NO: 650975 - DNA, 13 bp, D. melanogaster
tgaaagagcgaaa

SEQ ID NO: 650976 - DNA, 13 bp, D. melanogaster
tgaaagagtacga

SEQ ID NO: 650977 - DNA, 13 bp, D. melanogaster
tgaaagagtgtga

SEQ ID NO: 650978 - DNA, 13 bp, D. melanogaster
tgaaagatatata

SEQ ID NO: 650979 - DNA, 13 bp, D. melanogaster
tgaaagatgttga

SEQ ID NO: 650980 - DNA, 13 bp, D. melanogaster
tgaaagatttttt

SEQ ID NO: 650981 - DNA, 13 bp, D. melanogaster
tgaaagcaaaaac

SEQ ID NO: 650982 - DNA, 14 bp, D. melanogaster
tgaaagcaaataaa

SEQ ID NO: 650983 - DNA, 13 bp, D. melanogaster
tgaaagcaatttg

SEQ ID NO: 650984 - DNA, 13 bp, D. melanogaster
tgaaagccaaaac

SEQ ID NO: 650985 - DNA, 13 bp, D. melanogaster
tgaaagccaaaca

SEQ ID NO: 650986 - DNA, 14 bp, D. melanogaster
tgaaagccaaacaa

SEQ ID NO: 650987 - DNA, 13 bp, D. melanogaster
tgaaagccaaatg

SEQ ID NO: 650988 - DNA, 13 bp, D. melanogaster
tgaaagccacaaa

SEQ ID NO: 650989 - DNA, 13 bp, D. melanogaster
tgaaagccatttg

SEQ ID NO: 650990 - DNA, 13 bp, D. melanogaster
tgaaagcgaaaaa

SEQ ID NO: 650991 - DNA, 13 bp, D. melanogaster
tgaaagcggaaat

SEQ ID NO: 650992 - DNA, 13 bp, D. melanogaster
tgaaagcttcctg

SEQ ID NO: 650993 - DNA, 13 bp, D. melanogaster
tgaaagctttatt

SEQ ID NO: 650994 - DNA, 13 bp, D. melanogaster
tgaaaggaaaaca

SEQ ID NO: 650995 - DNA, 13 bp, D. melanogaster
tgaaaggaaaatg

SEQ ID NO: 650996 - DNA, 13 bp, D. melanogaster
tgaaaggaaactt

SEQ ID NO: 650997 - DNA, 13 bp, D. melanogaster
tgaaaggaaatta

SEQ ID NO: 650998 - DNA, 13 bp, D. melanogaster
tgaaaggcaagaa

SEQ ID NO: 650999 - DNA, 13 bp, D. melanogaster
tgaaagtaaaaac

SEQ ID NO: 651000 - DNA, 13 bp, D. melanogaster
tgaaagtaaaagt

SEQ ID NO: 651001 - DNA, 13 bp, D. melanogaster
tgaaagtatgcaa

SEQ ID NO: 651002 - DNA, 13 bp, D. melanogaster
tgaaagtatttta

SEQ ID NO: 651003 - DNA, 13 bp, D. melanogaster
tgaaagtcaattt

SEQ ID NO: 651004 - DNA, 13 bp, D. melanogaster
tgaaagtcattaa

SEQ ID NO: 651005 - DNA, 13 bp, D. melanogaster
tgaaagtgaaaag

SEQ ID NO: 651006 - DNA, 13 bp, D. melanogaster
tgaaagtgaaaca

SEQ ID NO: 651007 - DNA, 13 bp, D. melanogaster
tgaaagtgaaaga

SEQ ID NO: 651008 - DNA, 13 bp, D. melanogaster
tgaaagtgaaagc

SEQ ID NO: 651009 - DNA, 13 bp, D. melanogaster
tgaaagtgaaagt

SEQ ID NO: 651010 - DNA, 13 bp, D. melanogaster
tgaaagtgaaatg

SEQ ID NO: 651011 - DNA, 13 bp, D. melanogaster
tgaaagtgaaatt

SEQ ID NO: 651012 - DNA, 13 bp, D. melanogaster
tgaaagtgaagtg

SEQ ID NO: 651013 - DNA, 13 bp, D. melanogaster
tgaaagtgaattt

SEQ ID NO: 651014 - DNA, 13 bp, D. melanogaster
tgaaagtgggtgg

SEQ ID NO: 651015 - DNA, 13 bp, D. melanogaster
tgaaagtgtgtgt

SEQ ID NO: 651016 - DNA, 13 bp, D. melanogaster
tgaaagttaagct

SEQ ID NO: 651017 - DNA, 13 bp, D. melanogaster
tgaaagttgctgg

SEQ ID NO: 651018 - DNA, 13 bp, D. melanogaster
tgaaagttgtaaa

SEQ ID NO: 651019 - DNA, 13 bp, D. melanogaster
tgaaagtttaaat

SEQ ID NO: 651020 - DNA, 13 bp, D. melanogaster
tgaaagttttgat

SEQ ID NO: 651021 - DNA, 13 bp, D. melanogaster
tgaaagttttgtt

SEQ ID NO: 651022 - DNA, 13 bp, D. melanogaster
tgaaagtttttct

SEQ ID NO: 651023 - DNA, 14 bp, D. melanogaster
tgaaataaaaatgc

SEQ ID NO: 651024 - DNA, 13 bp, D. melanogaster
tgaaataaaacta

SEQ ID NO: 651025 - DNA, 13 bp, D. melanogaster
tgaaataaactaa

SEQ ID NO: 651026 - DNA, 13 bp, D. melanogaster
tgaaataaatgat

SEQ ID NO: 651027 - DNA, 13 bp, D. melanogaster
tgaaataaatgca

SEQ ID NO: 651028 - DNA, 13 bp, D. melanogaster
tgaaataaatttg

SEQ ID NO: 651029 - DNA, 13 bp, D. melanogaster
tgaaataacttaa

SEQ ID NO: 651030 - DNA, 14 bp, D. melanogaster
tgaaataacttaaa

SEQ ID NO: 651031 - DNA, 13 bp, D. melanogaster
tgaaataatcgat

SEQ ID NO: 651032 - DNA, 13 bp, D. melanogaster
tgaaataattgca

SEQ ID NO: 651033 - DNA, 14 bp, D. melanogaster
tgaaataattgtgc

SEQ ID NO: 651034 - DNA, 13 bp, D. melanogaster
tgaaatacaaata

SEQ ID NO: 651035 - DNA, 13 bp, D. melanogaster
tgaaatacataaa

SEQ ID NO: 651036 - DNA, 13 bp, D. melanogaster
tgaaatacattga

SEQ ID NO: 651037 - DNA, 13 bp, D. melanogaster
tgaaatacatttg

SEQ ID NO: 651038 - DNA, 13 bp, D. melanogaster
tgaaatacatttt

SEQ ID NO: 651039 - DNA, 13 bp, D. melanogaster
tgaaataccaaaa

SEQ ID NO: 651040 - DNA, 13 bp, D. melanogaster
tgaaataccattt

SEQ ID NO: 651041 - DNA, 13 bp, D. melanogaster
tgaaatactttaa

SEQ ID NO: 651042 - DNA, 13 bp, D. melanogaster
tgaaatacttttg

SEQ ID NO: 651043 - DNA, 13 bp, D. melanogaster
tgaaatagaaatt

SEQ ID NO: 651044 - DNA, 13 bp, D. melanogaster
tgaaatagatttt

SEQ ID NO: 651045 - DNA, 13 bp, D. melanogaster
tgaaatagcagtg

SEQ ID NO: 651046 - DNA, 13 bp, D. melanogaster
tgaaatagtttaa

SEQ ID NO: 651047 - DNA, 13 bp, D. melanogaster
tgaaatagtttta

SEQ ID NO: 651048 - DNA, 13 bp, D. melanogaster
tgaaatatataca

SEQ ID NO: 651049 - DNA, 14 bp, D. melanogaster
tgaaatatatatgt

SEQ ID NO: 651050 - DNA, 13 bp, D. melanogaster
tgaaatatatgaa

SEQ ID NO: 651051 - DNA, 13 bp, D. melanogaster
tgaaatatattgc

SEQ ID NO: 651052 - DNA, 13 bp, D. melanogaster
tgaaatatcattt

SEQ ID NO: 651053 - DNA, 13 bp, D. melanogaster
tgaaatatgattt

SEQ ID NO: 651054 - DNA, 13 bp, D. melanogaster
tgaaatatgcaaa

SEQ ID NO: 651055 - DNA, 13 bp, D. melanogaster
tgaaatatgcaat

SEQ ID NO: 651056 - DNA, 13 bp, D. melanogaster
tgaaatatgcaca

SEQ ID NO: 651057 - DNA, 13 bp, D. melanogaster
tgaaatatgcatg

SEQ ID NO: 651058 - DNA, 13 bp, D. melanogaster
tgaaatatgccaa

SEQ ID NO: 651059 - DNA, 13 bp, D. melanogaster
tgaaatatgtgtg

SEQ ID NO: 651060 - DNA, 13 bp, D. melanogaster
tgaaatattaatg

SEQ ID NO: 651061 - DNA, 13 bp, D. melanogaster
tgaaatattcttt

SEQ ID NO: 651062 - DNA, 13 bp, D. melanogaster
tgaaatattgttt

SEQ ID NO: 651063 - DNA, 14 bp, D. melanogaster
tgaaatatttaaga

SEQ ID NO: 651064 - DNA, 13 bp, D. melanogaster
tgaaatatttatg

SEQ ID NO: 651065 - DNA, 13 bp, D. melanogaster
tgaaatatttcaa

SEQ ID NO: 651066 - DNA, 14 bp, D. melanogaster
tgaaatatttcaaa

SEQ ID NO: 651067 - DNA, 14 bp, D. melanogaster
tgaaatatttcatt

SEQ ID NO: 651068 - DNA, 13 bp, D. melanogaster
tgaaatatttcca

SEQ ID NO: 651069 - DNA, 13 bp, D. melanogaster
tgaaatatttgat

SEQ ID NO: 651070 - DNA, 14 bp, D. melanogaster
tgaaatatttgcaa

SEQ ID NO: 651071 - DNA, 13 bp, D. melanogaster
tgaaatcaaaaac

SEQ ID NO: 651072 - DNA, 13 bp, D. melanogaster
tgaaatcaaaaat

SEQ ID NO: 651073 - DNA, 13 bp, D. melanogaster
tgaaatcaaaaga

SEQ ID NO: 651074 - DNA, 13 bp, D. melanogaster
tgaaatcaaaagt

SEQ ID NO: 651075 - DNA, 13 bp, D. melanogaster
tgaaatcaaaata

SEQ ID NO: 651076 - DNA, 14 bp, D. melanogaster
tgaaatcaaataaa

SEQ ID NO: 651077 - DNA, 13 bp, D. melanogaster
tgaaatcaaatat

SEQ ID NO: 651078 - DNA, 14 bp, D. melanogaster
tgaaatcaaatcaa

SEQ ID NO: 651079 - DNA, 13 bp, D. melanogaster
tgaaatcaaatga

SEQ ID NO: 651080 - DNA, 14 bp, D. melanogaster
tgaaatcaataaaa

SEQ ID NO: 651081 - DNA, 14 bp, D. melanogaster
tgaaatcaataaat

SEQ ID NO: 651082 - DNA, 13 bp, D. melanogaster
tgaaatcaatata

SEQ ID NO: 651083 - DNA, 13 bp, D. melanogaster
tgaaatcaatcga

SEQ ID NO: 651084 - DNA, 13 bp, D. melanogaster
tgaaatcaattca

SEQ ID NO: 651085 - DNA, 13 bp, D. melanogaster
tgaaatcagtttt

SEQ ID NO: 651086 - DNA, 13 bp, D. melanogaster
tgaaatcatatat

SEQ ID NO: 651087 - DNA, 13 bp, D. melanogaster
tgaaatcattaaa

SEQ ID NO: 651088 - DNA, 13 bp, D. melanogaster
tgaaatcatttca

SEQ ID NO: 651089 - DNA, 14 bp, D. melanogaster
tgaaatccctttgc

SEQ ID NO: 651090 - DNA, 13 bp, D. melanogaster
tgaaatcgaaaaa

SEQ ID NO: 651091 - DNA, 13 bp, D. melanogaster
tgaaatcgaaaac

SEQ ID NO: 651092 - DNA, 13 bp, D. melanogaster
tgaaatcgaaaat

SEQ ID NO: 651093 - DNA, 13 bp, D. melanogaster
tgaaatcgaaact

SEQ ID NO: 651094 - DNA, 13 bp, D. melanogaster
tgaaatcgaaatc

SEQ ID NO: 651095 - DNA, 14 bp, D. melanogaster
tgaaatcgaaatcg

SEQ ID NO: 651096 - DNA, 13 bp, D. melanogaster
tgaaatcggaaaa

SEQ ID NO: 651097 - DNA, 13 bp, D. melanogaster
tgaaatctaaaat

SEQ ID NO: 651098 - DNA, 13 bp, D. melanogaster
tgaaatctcattt

SEQ ID NO: 651099 - DNA, 13 bp, D. melanogaster
tgaaatctgaaat

SEQ ID NO: 651100 - DNA, 14 bp, D. melanogaster
tgaaatctgtgaaa

SEQ ID NO: 651101 - DNA, 13 bp, D. melanogaster
tgaaatcttaatt

SEQ ID NO: 651102 - DNA, 13 bp, D. melanogaster
tgaaatcttgtag

SEQ ID NO: 651103 - DNA, 13 bp, D. melanogaster
tgaaatctttgaa

SEQ ID NO: 651104 - DNA, 14 bp, D. melanogaster
tgaaatctttgaat

SEQ ID NO: 651105 - DNA, 14 bp, D. melanogaster
tgaaatgaaaacaa

SEQ ID NO: 651106 - DNA, 13 bp, D. melanogaster
tgaaatgaaaacc

SEQ ID NO: 651107 - DNA, 13 bp, D. melanogaster
tgaaatgaaaagc

SEQ ID NO: 651108 - DNA, 13 bp, D. melanogaster
tgaaatgaaaatt

SEQ ID NO: 651109 - DNA, 13 bp, D. melanogaster
tgaaatgaaacaa

SEQ ID NO: 651110 - DNA, 13 bp, D. melanogaster
tgaaatgaaatac

SEQ ID NO: 651111 - DNA, 13 bp, D. melanogaster
tgaaatgaaattg

SEQ ID NO: 651112 - DNA, 13 bp, D. melanogaster
tgaaatgaaattt

SEQ ID NO: 651113 - DNA, 14 bp, D. melanogaster
tgaaatgaaatttg

SEQ ID NO: 651114 - DNA, 13 bp, D. melanogaster
tgaaatgaagtga

SEQ ID NO: 651115 - DNA, 13 bp, D. melanogaster
tgaaatgaatgat

SEQ ID NO: 651116 - DNA, 13 bp, D. melanogaster
tgaaatgaatgca

SEQ ID NO: 651117 - DNA, 13 bp, D. melanogaster
tgaaatgaatgga

SEQ ID NO: 651118 - DNA, 13 bp, D. melanogaster
tgaaatgaatttg

SEQ ID NO: 651119 - DNA, 14 bp, D. melanogaster
tgaaatgaattttt

SEQ ID NO: 651120 - DNA, 13 bp, D. melanogaster
tgaaatgatttat

SEQ ID NO: 651121 - DNA, 13 bp, D. melanogaster
tgaaatgattttt

SEQ ID NO: 651122 - DNA, 14 bp, D. melanogaster
tgaaatgatttttg

SEQ ID NO: 651123 - DNA, 13 bp, D. melanogaster
tgaaatgcaaaaa

SEQ ID NO: 651124 - DNA, 14 bp, D. melanogaster
tgaaatgcaaaaaa

SEQ ID NO: 651125 - DNA, 13 bp, D. melanogaster
tgaaatgcaaaag

SEQ ID NO: 651126 - DNA, 13 bp, D. melanogaster
tgaaatgcaaatg

SEQ ID NO: 651127 - DNA, 14 bp, D. melanogaster
tgaaatgcaaatga

SEQ ID NO: 651128 - DNA, 14 bp, D. melanogaster
tgaaatgcaaatgt

SEQ ID NO: 651129 - DNA, 13 bp, D. melanogaster
tgaaatgcaaatt

SEQ ID NO: 651130 - DNA, 14 bp, D. melanogaster
tgaaatgcaaattt

SEQ ID NO: 651131 - DNA, 13 bp, D. melanogaster
tgaaatgcaattt

SEQ ID NO: 651132 - DNA, 13 bp, D. melanogaster
tgaaatgcagcaa

SEQ ID NO: 651133 - DNA, 13 bp, D. melanogaster
tgaaatgcataca

SEQ ID NO: 651134 - DNA, 14 bp, D. melanogaster
tgaaatgcatttaa

SEQ ID NO: 651135 - DNA, 13 bp, D. melanogaster
tgaaatgcatttg

SEQ ID NO: 651136 - DNA, 13 bp, D. melanogaster
tgaaatgcatttt

SEQ ID NO: 651137 - DNA, 13 bp, D. melanogaster
tgaaatgccaaaa

SEQ ID NO: 651138 - DNA, 13 bp, D. melanogaster
tgaaatgccaaac

SEQ ID NO: 651139 - DNA, 13 bp, D. melanogaster
tgaaatgccattt

SEQ ID NO: 651140 - DNA, 13 bp, D. melanogaster
tgaaatgcgaaat

SEQ ID NO: 651141 - DNA, 13 bp, D. melanogaster
tgaaatgctaaaa

SEQ ID NO: 651142 - DNA, 13 bp, D. melanogaster
tgaaatgctgctg

SEQ ID NO: 651143 - DNA, 13 bp, D. melanogaster
tgaaatgcttgaa

SEQ ID NO: 651144 - DNA, 13 bp, D. melanogaster
tgaaatgctttta

SEQ ID NO: 651145 - DNA, 13 bp, D. melanogaster
tgaaatgcttttg

SEQ ID NO: 651146 - DNA, 14 bp, D. melanogaster
tgaaatggaaaaca

SEQ ID NO: 651147 - DNA, 13 bp, D. melanogaster
tgaaatggaaaat

SEQ ID NO: 651148 - DNA, 13 bp, D. melanogaster
tgaaatggaaact

SEQ ID NO: 651149 - DNA, 13 bp, D. melanogaster
tgaaatggaaatt

SEQ ID NO: 651150 - DNA, 13 bp, D. melanogaster
tgaaatggaatca

SEQ ID NO: 651151 - DNA, 13 bp, D. melanogaster
tgaaatggaattt

SEQ ID NO: 651152 - DNA, 13 bp, D. melanogaster
tgaaatggataat

SEQ ID NO: 651153 - DNA, 14 bp, D. melanogaster
tgaaatggcaaaca

SEQ ID NO: 651154 - DNA, 14 bp, D. melanogaster
tgaaatggccaaaa

SEQ ID NO: 651155 - DNA, 13 bp, D. melanogaster
tgaaatgggaatt

SEQ ID NO: 651156 - DNA, 13 bp, D. melanogaster
tgaaatgggaggc

SEQ ID NO: 651157 - DNA, 13 bp, D. melanogaster
tgaaatgtaaaac

SEQ ID NO: 651158 - DNA, 13 bp, D. melanogaster
tgaaatgtaattt

SEQ ID NO: 651159 - DNA, 14 bp, D. melanogaster
tgaaatgtattatt

SEQ ID NO: 651160 - DNA, 13 bp, D. melanogaster
tgaaatgtatttt

SEQ ID NO: 651161 - DNA, 13 bp, D. melanogaster
tgaaatgtgaaaa

SEQ ID NO: 651162 - DNA, 13 bp, D. melanogaster
tgaaatgtgaaat

SEQ ID NO: 651163 - DNA, 14 bp, D. melanogaster
tgaaatgtgaaatg

SEQ ID NO: 651164 - DNA, 13 bp, D. melanogaster
tgaaatgtgtgaa

SEQ ID NO: 651165 - DNA, 13 bp, D. melanogaster
tgaaatgtttgca

SEQ ID NO: 651166 - DNA, 13 bp, D. melanogaster
tgaaatgtttttg

SEQ ID NO: 651167 - DNA, 13 bp, D. melanogaster
tgaaattaaacca

SEQ ID NO: 651168 - DNA, 13 bp, D. melanogaster
tgaaattaaagca

SEQ ID NO: 651169 - DNA, 13 bp, D. melanogaster
tgaaattaaagtg

SEQ ID NO: 651170 - DNA, 13 bp, D. melanogaster
tgaaattaaatga

SEQ ID NO: 651171 - DNA, 13 bp, D. melanogaster
tgaaattaaatgt

SEQ ID NO: 651172 - DNA, 13 bp, D. melanogaster
tgaaattaaattg

SEQ ID NO: 651173 - DNA, 13 bp, D. melanogaster
tgaaattaagcaa

SEQ ID NO: 651174 - DNA, 13 bp, D. melanogaster
tgaaattaaggag

SEQ ID NO: 651175 - DNA, 13 bp, D. melanogaster
tgaaattaagttt

SEQ ID NO: 651176 - DNA, 13 bp, D. melanogaster
tgaaattaatcaa

SEQ ID NO: 651177 - DNA, 13 bp, D. melanogaster
tgaaattaatgtt

SEQ ID NO: 651178 - DNA, 13 bp, D. melanogaster
tgaaattaattgg

SEQ ID NO: 651179 - DNA, 13 bp, D. melanogaster
tgaaattaatttg

SEQ ID NO: 651180 - DNA, 14 bp, D. melanogaster
tgaaattaatttgc

SEQ ID NO: 651181 - DNA, 13 bp, D. melanogaster
tgaaattacaaaa

SEQ ID NO: 651182 - DNA, 13 bp, D. melanogaster
tgaaattacaaat

SEQ ID NO: 651183 - DNA, 13 bp, D. melanogaster
tgaaattacagta

SEQ ID NO: 651184 - DNA, 13 bp, D. melanogaster
tgaaattagaatt

SEQ ID NO: 651185 - DNA, 13 bp, D. melanogaster
tgaaattagtttt

SEQ ID NO: 651186 - DNA, 14 bp, D. melanogaster
tgaaattagttttc

SEQ ID NO: 651187 - DNA, 13 bp, D. melanogaster
tgaaattatgaaa

SEQ ID NO: 651188 - DNA, 13 bp, D. melanogaster
tgaaattatgttt

SEQ ID NO: 651189 - DNA, 13 bp, D. melanogaster
tgaaattattcaa

SEQ ID NO: 651190 - DNA, 13 bp, D. melanogaster
tgaaattattcca

SEQ ID NO: 651191 - DNA, 13 bp, D. melanogaster
tgaaattatttga

SEQ ID NO: 651192 - DNA, 13 bp, D. melanogaster
tgaaattattttc

SEQ ID NO: 651193 - DNA, 14 bp, D. melanogaster
tgaaattcaaattt

SEQ ID NO: 651194 - DNA, 13 bp, D. melanogaster
tgaaattcaatat

SEQ ID NO: 651195 - DNA, 14 bp, D. melanogaster
tgaaattcaatata

SEQ ID NO: 651196 - DNA, 13 bp, D. melanogaster
tgaaattcaatta

SEQ ID NO: 651197 - DNA, 14 bp, D. melanogaster
tgaaattcaattat

SEQ ID NO: 651198 - DNA, 13 bp, D. melanogaster
tgaaattcaattt

SEQ ID NO: 651199 - DNA, 14 bp, D. melanogaster
tgaaattcaatttg

SEQ ID NO: 651200 - DNA, 13 bp, D. melanogaster
tgaaattcatgtg

SEQ ID NO: 651201 - DNA, 13 bp, D. melanogaster
tgaaattcattaa

SEQ ID NO: 651202 - DNA, 13 bp, D. melanogaster
tgaaattcatttt

SEQ ID NO: 651203 - DNA, 14 bp, D. melanogaster
tgaaattcattttt

SEQ ID NO: 651204 - DNA, 13 bp, D. melanogaster
tgaaattcgaaat

SEQ ID NO: 651205 - DNA, 13 bp, D. melanogaster
tgaaattcgattt

SEQ ID NO: 651206 - DNA, 13 bp, D. melanogaster
tgaaattcgtcgc

SEQ ID NO: 651207 - DNA, 13 bp, D. melanogaster
tgaaattgaaaat

SEQ ID NO: 651208 - DNA, 13 bp, D. melanogaster
tgaaattgaaaga

SEQ ID NO: 651209 - DNA, 13 bp, D. melanogaster
tgaaattgaaagt

SEQ ID NO: 651210 - DNA, 14 bp, D. melanogaster
tgaaattgaaatat

SEQ ID NO: 651211 - DNA, 13 bp, D. melanogaster
tgaaattgaaatt

SEQ ID NO: 651212 - DNA, 14 bp, D. melanogaster
tgaaattgaaattt

SEQ ID NO: 651213 - DNA, 13 bp, D. melanogaster
tgaaattgaagca

SEQ ID NO: 651214 - DNA, 13 bp, D. melanogaster
tgaaattgaataa

SEQ ID NO: 651215 - DNA, 13 bp, D. melanogaster
tgaaattgaatta

SEQ ID NO: 651216 - DNA, 14 bp, D. melanogaster
tgaaattgaattaa

SEQ ID NO: 651217 - DNA, 13 bp, D. melanogaster
tgaaattgaattt

SEQ ID NO: 651218 - DNA, 13 bp, D. melanogaster
tgaaattgagagt

SEQ ID NO: 651219 - DNA, 13 bp, D. melanogaster
tgaaattgagttt

SEQ ID NO: 651220 - DNA, 13 bp, D. melanogaster
tgaaattgataaa

SEQ ID NO: 651221 - DNA, 13 bp, D. melanogaster
tgaaattgatatt

SEQ ID NO: 651222 - DNA, 13 bp, D. melanogaster
tgaaattgattga

SEQ ID NO: 651223 - DNA, 13 bp, D. melanogaster
tgaaattgcaaat

SEQ ID NO: 651224 - DNA, 13 bp, D. melanogaster
tgaaattgcacaa

SEQ ID NO: 651225 - DNA, 13 bp, D. melanogaster
tgaaattgcagca

SEQ ID NO: 651226 - DNA, 13 bp, D. melanogaster
tgaaattgcattg

SEQ ID NO: 651227 - DNA, 13 bp, D. melanogaster
tgaaattgcattt

SEQ ID NO: 651228 - DNA, 13 bp, D. melanogaster
tgaaattgccatt

SEQ ID NO: 651229 - DNA, 13 bp, D. melanogaster
tgaaattgcttga

SEQ ID NO: 651230 - DNA, 13 bp, D. melanogaster
tgaaattgctttc

SEQ ID NO: 651231 - DNA, 13 bp, D. melanogaster
tgaaattgctttg

SEQ ID NO: 651232 - DNA, 13 bp, D. melanogaster
tgaaattgctttt

SEQ ID NO: 651233 - DNA, 13 bp, D. melanogaster
tgaaattggaatt

SEQ ID NO: 651234 - DNA, 14 bp, D. melanogaster
tgaaattggcaaaa

SEQ ID NO: 651235 - DNA, 13 bp, D. melanogaster
tgaaattggccaa

SEQ ID NO: 651236 - DNA, 13 bp, D. melanogaster
tgaaattggtttt

SEQ ID NO: 651237 - DNA, 13 bp, D. melanogaster
tgaaattgtaaat

SEQ ID NO: 651238 - DNA, 13 bp, D. melanogaster
tgaaattgtattt

SEQ ID NO: 651239 - DNA, 13 bp, D. melanogaster
tgaaattgtgatt

SEQ ID NO: 651240 - DNA, 13 bp, D. melanogaster
tgaaattgtgcaa

SEQ ID NO: 651241 - DNA, 13 bp, D. melanogaster
tgaaattgttaac

SEQ ID NO: 651242 - DNA, 13 bp, D. melanogaster
tgaaattgttgaa

SEQ ID NO: 651243 - DNA, 13 bp, D. melanogaster
tgaaattgttgtt

SEQ ID NO: 651244 - DNA, 13 bp, D. melanogaster
tgaaattgtttac

SEQ ID NO: 651245 - DNA, 13 bp, D. melanogaster
tgaaattgtttta

SEQ ID NO: 651246 - DNA, 13 bp, D. melanogaster
tgaaattgttttc

SEQ ID NO: 651247 - DNA, 13 bp, D. melanogaster
tgaaattgttttg

SEQ ID NO: 651248 - DNA, 13 bp, D. melanogaster
tgaaatttaaaac

SEQ ID NO: 651249 - DNA, 13 bp, D. melanogaster
tgaaatttaaaca

SEQ ID NO: 651250 - DNA, 13 bp, D. melanogaster
tgaaatttaaagt

SEQ ID NO: 651251 - DNA, 14 bp, D. melanogaster
tgaaatttaatttc

SEQ ID NO: 651252 - DNA, 13 bp, D. melanogaster
tgaaatttactta

SEQ ID NO: 651253 - DNA, 13 bp, D. melanogaster
tgaaatttatgaa

SEQ ID NO: 651254 - DNA, 13 bp, D. melanogaster
tgaaatttatgag

SEQ ID NO: 651255 - DNA, 13 bp, D. melanogaster
tgaaatttatgcg

SEQ ID NO: 651256 - DNA, 13 bp, D. melanogaster
tgaaatttatgga

SEQ ID NO: 651257 - DNA, 13 bp, D. melanogaster
tgaaatttattac

SEQ ID NO: 651258 - DNA, 13 bp, D. melanogaster
tgaaatttattgt

SEQ ID NO: 651259 - DNA, 13 bp, D. melanogaster
tgaaatttcaaat

SEQ ID NO: 651260 - DNA, 13 bp, D. melanogaster
tgaaatttcaatt

SEQ ID NO: 651261 - DNA, 13 bp, D. melanogaster
tgaaatttcattg

SEQ ID NO: 651262 - DNA, 13 bp, D. melanogaster
tgaaatttcattt

SEQ ID NO: 651263 - DNA, 13 bp, D. melanogaster
tgaaatttccaat

SEQ ID NO: 651264 - DNA, 13 bp, D. melanogaster
tgaaatttccttt

SEQ ID NO: 651265 - DNA, 14 bp, D. melanogaster
tgaaatttcttatt

SEQ ID NO: 651266 - DNA, 13 bp, D. melanogaster
tgaaatttgaaag

SEQ ID NO: 651267 - DNA, 14 bp, D. melanogaster
tgaaatttgaaagc

SEQ ID NO: 651268 - DNA, 13 bp, D. melanogaster
tgaaatttgaaat

SEQ ID NO: 651269 - DNA, 13 bp, D. melanogaster
tgaaatttgatat

SEQ ID NO: 651270 - DNA, 13 bp, D. melanogaster
tgaaatttgattt

SEQ ID NO: 651271 - DNA, 14 bp, D. melanogaster
tgaaatttgcattt

SEQ ID NO: 651272 - DNA, 13 bp, D. melanogaster
tgaaatttggaaa

SEQ ID NO: 651273 - DNA, 13 bp, D. melanogaster
tgaaatttgttgt

SEQ ID NO: 651274 - DNA, 13 bp, D. melanogaster
tgaaattttaaac

SEQ ID NO: 651275 - DNA, 13 bp, D. melanogaster
tgaaattttcaat

SEQ ID NO: 651276 - DNA, 13 bp, D. melanogaster
tgaaattttccaa

SEQ ID NO: 651277 - DNA, 13 bp, D. melanogaster
tgaaattttgaaa

SEQ ID NO: 651278 - DNA, 13 bp, D. melanogaster
tgaaattttgctt

SEQ ID NO: 651279 - DNA, 13 bp, D. melanogaster
tgaaattttggaa

SEQ ID NO: 651280 - DNA, 14 bp, D. melanogaster
tgaaatttttcatt

SEQ ID NO: 651281 - DNA, 13 bp, D. melanogaster
tgaaatttttgag

SEQ ID NO: 651282 - DNA, 14 bp, D. melanogaster
tgaaatttttgaga

SEQ ID NO: 651283 - DNA, 13 bp, D. melanogaster
tgaaatttttgca

SEQ ID NO: 651284 - DNA, 13 bp, D. melanogaster
tgaacaaaaaact

SEQ ID NO: 651285 - DNA, 13 bp, D. melanogaster
tgaacaaaatgaa

SEQ ID NO: 651286 - DNA, 13 bp, D. melanogaster
tgaacaaactaaa

SEQ ID NO: 651287 - DNA, 14 bp, D. melanogaster
tgaacaaactaaaa

SEQ ID NO: 651288 - DNA, 13 bp, D. melanogaster
tgaacaaagcaaa

SEQ ID NO: 651289 - DNA, 13 bp, D. melanogaster
tgaacaaagtttt

SEQ ID NO: 651290 - DNA, 13 bp, D. melanogaster
tgaacaaataaac

SEQ ID NO: 651291 - DNA, 13 bp, D. melanogaster
tgaacaaatgttt

SEQ ID NO: 651292 - DNA, 13 bp, D. melanogaster
tgaacaaatttca

SEQ ID NO: 651293 - DNA, 13 bp, D. melanogaster
tgaacaaatttct

SEQ ID NO: 651294 - DNA, 13 bp, D. melanogaster
tgaacaaattttg

SEQ ID NO: 651295 - DNA, 13 bp, D. melanogaster
tgaacaaattttt

SEQ ID NO: 651296 - DNA, 13 bp, D. melanogaster
tgaacaacaaata

SEQ ID NO: 651297 - DNA, 13 bp, D. melanogaster
tgaacaacaaatt

SEQ ID NO: 651298 - DNA, 13 bp, D. melanogaster
tgaacaacaatag

SEQ ID NO: 651299 - DNA, 13 bp, D. melanogaster
tgaacaacaggca

SEQ ID NO: 651300 - DNA, 13 bp, D. melanogaster
tgaacaacatttt

SEQ ID NO: 651301 - DNA, 13 bp, D. melanogaster
tgaacaagacgag

SEQ ID NO: 651302 - DNA, 13 bp, D. melanogaster
tgaacaatataaa

SEQ ID NO: 651303 - DNA, 13 bp, D. melanogaster
tgaacaatatttg

SEQ ID NO: 651304 - DNA, 13 bp, D. melanogaster
tgaacaatggcca

SEQ ID NO: 651305 - DNA, 13 bp, D. melanogaster
tgaacaattaaga

SEQ ID NO: 651306 - DNA, 13 bp, D. melanogaster
tgaacaatttaat

SEQ ID NO: 651307 - DNA, 14 bp, D. melanogaster
tgaacaatttggat

SEQ ID NO: 651308 - DNA, 13 bp, D. melanogaster
tgaacaattttat

SEQ ID NO: 651309 - DNA, 13 bp, D. melanogaster
tgaacaattttta

SEQ ID NO: 651310 - DNA, 13 bp, D. melanogaster
tgaacacacacac

SEQ ID NO: 651311 - DNA, 13 bp, D. melanogaster
tgaacacagctgt

SEQ ID NO: 651312 - DNA, 14 bp, D. melanogaster
tgaacacagctgta

SEQ ID NO: 651313 - DNA, 13 bp, D. melanogaster
tgaacacagtttg

SEQ ID NO: 651314 - DNA, 14 bp, D. melanogaster
tgaacacagtttga

SEQ ID NO: 651315 - DNA, 13 bp, D. melanogaster
tgaacacgaatat

SEQ ID NO: 651316 - DNA, 13 bp, D. melanogaster
tgaacacgtttca

SEQ ID NO: 651317 - DNA, 14 bp, D. melanogaster
tgaacagcatacca

SEQ ID NO: 651318 - DNA, 13 bp, D. melanogaster
tgaacagcctaaa

SEQ ID NO: 651319 - DNA, 13 bp, D. melanogaster
tgaacagttttaa

SEQ ID NO: 651320 - DNA, 14 bp, D. melanogaster
tgaacagttttaaa

SEQ ID NO: 651321 - DNA, 13 bp, D. melanogaster
tgaacatatttta

SEQ ID NO: 651322 - DNA, 13 bp, D. melanogaster
tgaacatgaaaat

SEQ ID NO: 651323 - DNA, 13 bp, D. melanogaster
tgaacattaaaac

SEQ ID NO: 651324 - DNA, 13 bp, D. melanogaster
tgaacattaaaat

SEQ ID NO: 651325 - DNA, 13 bp, D. melanogaster
tgaacattaccca

SEQ ID NO: 651326 - DNA, 13 bp, D. melanogaster
tgaacattctgcc

SEQ ID NO: 651327 - DNA, 13 bp, D. melanogaster
tgaacattttaaa

SEQ ID NO: 651328 - DNA, 13 bp, D. melanogaster
tgaacattttaat

SEQ ID NO: 651329 - DNA, 13 bp, D. melanogaster
tgaacattttcat

SEQ ID NO: 651330 - DNA, 13 bp, D. melanogaster
tgaacatttttat

SEQ ID NO: 651331 - DNA, 13 bp, D. melanogaster
tgaacattttttt

SEQ ID NO: 651332 - DNA, 13 bp, D. melanogaster
tgaaccaaatgag

SEQ ID NO: 651333 - DNA, 13 bp, D. melanogaster
tgaaccaccacca

SEQ ID NO: 651334 - DNA, 13 bp, D. melanogaster
tgaaccactgtgc

SEQ ID NO: 651335 - DNA, 14 bp, D. melanogaster
tgaaccagaaaaca

SEQ ID NO: 651336 - DNA, 14 bp, D. melanogaster
tgaaccagtctttg

SEQ ID NO: 651337 - DNA, 13 bp, D. melanogaster
tgaaccatcagtt

SEQ ID NO: 651338 - DNA, 13 bp, D. melanogaster
tgaaccatttttc

SEQ ID NO: 651339 - DNA, 13 bp, D. melanogaster
tgaacccaaaaac

SEQ ID NO: 651340 - DNA, 13 bp, D. melanogaster
tgaacccacaatg

SEQ ID NO: 651341 - DNA, 13 bp, D. melanogaster
tgaaccccattga

SEQ ID NO: 651342 - DNA, 13 bp, D. melanogaster
tgaacctactggt

SEQ ID NO: 651343 - DNA, 13 bp, D. melanogaster
tgaaccttaaaca

SEQ ID NO: 651344 - DNA, 13 bp, D. melanogaster
tgaaccttttttt

SEQ ID NO: 651345 - DNA, 13 bp, D. melanogaster
tgaacgaaaaatg

SEQ ID NO: 651346 - DNA, 14 bp, D. melanogaster
tgaacgaatgaatg

SEQ ID NO: 651347 - DNA, 14 bp, D. melanogaster
tgaacgacataatg

SEQ ID NO: 651348 - DNA, 13 bp, D. melanogaster
tgaacgccaaata

SEQ ID NO: 651349 - DNA, 13 bp, D. melanogaster
tgaacgtagttga

SEQ ID NO: 651350 - DNA, 13 bp, D. melanogaster
tgaactaaaaata

SEQ ID NO: 651351 - DNA, 13 bp, D. melanogaster
tgaactaaacgaa

SEQ ID NO: 651352 - DNA, 13 bp, D. melanogaster
tgaactaaataaa

SEQ ID NO: 651353 - DNA, 13 bp, D. melanogaster
tgaactaactaag

SEQ ID NO: 651354 - DNA, 14 bp, D. melanogaster
tgaactaagtgaaa

SEQ ID NO: 651355 - DNA, 13 bp, D. melanogaster
tgaactacagaaa

SEQ ID NO: 651356 - DNA, 13 bp, D. melanogaster
tgaactacatttt

SEQ ID NO: 651357 - DNA, 14 bp, D. melanogaster
tgaactagaggaat

SEQ ID NO: 651358 - DNA, 13 bp, D. melanogaster
tgaactataaaaa

SEQ ID NO: 651359 - DNA, 13 bp, D. melanogaster
tgaactatttgtt

SEQ ID NO: 651360 - DNA, 13 bp, D. melanogaster
tgaactcaactga

SEQ ID NO: 651361 - DNA, 13 bp, D. melanogaster
tgaactccaatta

SEQ ID NO: 651362 - DNA, 13 bp, D. melanogaster
tgaactctgaact

SEQ ID NO: 651363 - DNA, 13 bp, D. melanogaster
tgaactgaaatta

SEQ ID NO: 651364 - DNA, 13 bp, D. melanogaster
tgaactgaaccga

SEQ ID NO: 651365 - DNA, 13 bp, D. melanogaster
tgaactgaactgc

SEQ ID NO: 651366 - DNA, 13 bp, D. melanogaster
tgaactgagctga

SEQ ID NO: 651367 - DNA, 13 bp, D. melanogaster
tgaactgcatttt

SEQ ID NO: 651368 - DNA, 13 bp, D. melanogaster
tgaactgttgcta

SEQ ID NO: 651369 - DNA, 13 bp, D. melanogaster
tgaacttaaaatt

SEQ ID NO: 651370 - DNA, 13 bp, D. melanogaster
tgaacttaaataa

SEQ ID NO: 651371 - DNA, 13 bp, D. melanogaster
tgaacttaataat

SEQ ID NO: 651372 - DNA, 13 bp, D. melanogaster
tgaacttaatttg

SEQ ID NO: 651373 - DNA, 14 bp, D. melanogaster
tgaacttcaagaaa

SEQ ID NO: 651374 - DNA, 13 bp, D. melanogaster
tgaacttgaaaat

SEQ ID NO: 651375 - DNA, 13 bp, D. melanogaster
tgaactttaaaat

SEQ ID NO: 651376 - DNA, 13 bp, D. melanogaster
tgaactttaaact

SEQ ID NO: 651377 - DNA, 13 bp, D. melanogaster
tgaactttaaata

SEQ ID NO: 651378 - DNA, 13 bp, D. melanogaster
tgaactttaatta

SEQ ID NO: 651379 - DNA, 13 bp, D. melanogaster
tgaactttattta

SEQ ID NO: 651380 - DNA, 13 bp, D. melanogaster
tgaactttgaact

SEQ ID NO: 651381 - DNA, 13 bp, D. melanogaster
tgaactttgattt

SEQ ID NO: 651382 - DNA, 13 bp, D. melanogaster
tgaactttgctct

SEQ ID NO: 651383 - DNA, 14 bp, D. melanogaster
tgaactttgctctg

SEQ ID NO: 651384 - DNA, 13 bp, D. melanogaster
tgaactttggcca

SEQ ID NO: 651385 - DNA, 13 bp, D. melanogaster
tgaacttttcttt

SEQ ID NO: 651386 - DNA, 13 bp, D. melanogaster
tgaacttttgcat

SEQ ID NO: 651387 - DNA, 13 bp, D. melanogaster
tgaacttttgcca

SEQ ID NO: 651388 - DNA, 13 bp, D. melanogaster
tgaacttttggca

SEQ ID NO: 651389 - DNA, 13 bp, D. melanogaster
tgaacttttttaa

SEQ ID NO: 651390 - DNA, 13 bp, D. melanogaster
tgaagaaaaattt

SEQ ID NO: 651391 - DNA, 13 bp, D. melanogaster
tgaagaaaacaat

SEQ ID NO: 651392 - DNA, 14 bp, D. melanogaster
tgaagaaaacaata

SEQ ID NO: 651393 - DNA, 14 bp, D. melanogaster
tgaagaaaatagca

SEQ ID NO: 651394 - DNA, 13 bp, D. melanogaster
tgaagaaaatgtt

SEQ ID NO: 651395 - DNA, 13 bp, D. melanogaster
tgaagaaaattta

SEQ ID NO: 651396 - DNA, 13 bp, D. melanogaster
tgaagaaaatttg

SEQ ID NO: 651397 - DNA, 13 bp, D. melanogaster
tgaagaaacagca

SEQ ID NO: 651398 - DNA, 13 bp, D. melanogaster
tgaagaaacctat

SEQ ID NO: 651399 - DNA, 13 bp, D. melanogaster
tgaagaaagagcc

SEQ ID NO: 651400 - DNA, 13 bp, D. melanogaster
tgaagaaataact

SEQ ID NO: 651401 - DNA, 14 bp, D. melanogaster
tgaagaaataactg

SEQ ID NO: 651402 - DNA, 13 bp, D. melanogaster
tgaagaaatttat

SEQ ID NO: 651403 - DNA, 13 bp, D. melanogaster
tgaagaacaacaa

SEQ ID NO: 651404 - DNA, 13 bp, D. melanogaster
tgaagaacacatt

SEQ ID NO: 651405 - DNA, 13 bp, D. melanogaster
tgaagaacataaa

SEQ ID NO: 651406 - DNA, 14 bp, D. melanogaster
tgaagaacataaag

SEQ ID NO: 651407 - DNA, 13 bp, D. melanogaster
tgaagaacgacga

SEQ ID NO: 651408 - DNA, 13 bp, D. melanogaster
tgaagaagaactt

SEQ ID NO: 651409 - DNA, 13 bp, D. melanogaster
tgaagaagaagct

SEQ ID NO: 651410 - DNA, 13 bp, D. melanogaster
tgaagaagcagca

SEQ ID NO: 651411 - DNA, 13 bp, D. melanogaster
tgaagaagcccca

SEQ ID NO: 651412 - DNA, 14 bp, D. melanogaster
tgaagaagtaaaat

SEQ ID NO: 651413 - DNA, 13 bp, D. melanogaster
tgaagaatatata

SEQ ID NO: 651414 - DNA, 13 bp, D. melanogaster
tgaagaatatgag

SEQ ID NO: 651415 - DNA, 13 bp, D. melanogaster
tgaagaatatttt

SEQ ID NO: 651416 - DNA, 13 bp, D. melanogaster
tgaagaatgcacc

SEQ ID NO: 651417 - DNA, 13 bp, D. melanogaster
tgaagaattcaat

SEQ ID NO: 651418 - DNA, 13 bp, D. melanogaster
tgaagaatttgtt

SEQ ID NO: 651419 - DNA, 13 bp, D. melanogaster
tgaagacaaatca

SEQ ID NO: 651420 - DNA, 13 bp, D. melanogaster
tgaagacagacag

SEQ ID NO: 651421 - DNA, 13 bp, D. melanogaster
tgaagacagcact

SEQ ID NO: 651422 - DNA, 13 bp, D. melanogaster
tgaagaccaccat

SEQ ID NO: 651423 - DNA, 13 bp, D. melanogaster
tgaagacggattt

SEQ ID NO: 651424 - DNA, 13 bp, D. melanogaster
tgaagacgttcat

SEQ ID NO: 651425 - DNA, 14 bp, D. melanogaster
tgaagacgttcatt

SEQ ID NO: 651426 - DNA, 13 bp, D. melanogaster
tgaagacgttttt

SEQ ID NO: 651427 - DNA, 13 bp, D. melanogaster
tgaagactgcaat

SEQ ID NO: 651428 - DNA, 13 bp, D. melanogaster
tgaagactgtttt

SEQ ID NO: 651429 - DNA, 13 bp, D. melanogaster
tgaagaggaagac

SEQ ID NO: 651430 - DNA, 13 bp, D. melanogaster
tgaagatacatat

SEQ ID NO: 651431 - DNA, 13 bp, D. melanogaster
tgaagatattaaa

SEQ ID NO: 651432 - DNA, 13 bp, D. melanogaster
tgaagatcataat

SEQ ID NO: 651433 - DNA, 13 bp, D. melanogaster
tgaagatccatat

SEQ ID NO: 651434 - DNA, 13 bp, D. melanogaster
tgaagatcgttaa

SEQ ID NO: 651435 - DNA, 14 bp, D. melanogaster
tgaagatgaagatg

SEQ ID NO: 651436 - DNA, 14 bp, D. melanogaster
tgaagatgatgatg

SEQ ID NO: 651437 - DNA, 13 bp, D. melanogaster
tgaagatgatttt

SEQ ID NO: 651438 - DNA, 14 bp, D. melanogaster
tgaagatggagatg

SEQ ID NO: 651439 - DNA, 13 bp, D. melanogaster
tgaagatttttaa

SEQ ID NO: 651440 - DNA, 13 bp, D. melanogaster
tgaagcacacaaa

SEQ ID NO: 651441 - DNA, 13 bp, D. melanogaster
tgaagcatatttt

SEQ ID NO: 651442 - DNA, 13 bp, D. melanogaster
tgaagcatcaaaa

SEQ ID NO: 651443 - DNA, 13 bp, D. melanogaster
tgaagcatttaaa

SEQ ID NO: 651444 - DNA, 13 bp, D. melanogaster
tgaagcattttaa

SEQ ID NO: 651445 - DNA, 13 bp, D. melanogaster
tgaagccaaaaaa

SEQ ID NO: 651446 - DNA, 14 bp, D. melanogaster
tgaagccaaaaaaa

SEQ ID NO: 651447 - DNA, 13 bp, D. melanogaster
tgaagccacttgg

SEQ ID NO: 651448 - DNA, 13 bp, D. melanogaster
tgaagccattaaa

SEQ ID NO: 651449 - DNA, 13 bp, D. melanogaster
tgaagccgtgaga

SEQ ID NO: 651450 - DNA, 13 bp, D. melanogaster
tgaagcctttttt

SEQ ID NO: 651451 - DNA, 13 bp, D. melanogaster
tgaagcgcaataa

SEQ ID NO: 651452 - DNA, 13 bp, D. melanogaster
tgaagcgccgaag

SEQ ID NO: 651453 - DNA, 13 bp, D. melanogaster
tgaagcggaaata

SEQ ID NO: 651454 - DNA, 14 bp, D. melanogaster
tgaagcgtatgcca

SEQ ID NO: 651455 - DNA, 13 bp, D. melanogaster
tgaagctactcaa

SEQ ID NO: 651456 - DNA, 13 bp, D. melanogaster
tgaagctgaagct

SEQ ID NO: 651457 - DNA, 13 bp, D. melanogaster
tgaaggagagaat

SEQ ID NO: 651458 - DNA, 15 bp, D. melanogaster
tgaaggcagccgtcg

SEQ ID NO: 651459 - DNA, 14 bp, D. melanogaster
tgaaggccaaaaac

SEQ ID NO: 651460 - DNA, 13 bp, D. melanogaster
tgaaggctggcaa

SEQ ID NO: 651461 - DNA, 13 bp, D. melanogaster
tgaagggacagtg

SEQ ID NO: 651462 - DNA, 13 bp, D. melanogaster
tgaagggcaacaa

SEQ ID NO: 651463 - DNA, 13 bp, D. melanogaster
tgaaggtgctcga

SEQ ID NO: 651464 - DNA, 13 bp, D. melanogaster
tgaagtaaataat

SEQ ID NO: 651465 - DNA, 13 bp, D. melanogaster
tgaagtaaccaac

SEQ ID NO: 651466 - DNA, 13 bp, D. melanogaster
tgaagtaattaaa

SEQ ID NO: 651467 - DNA, 13 bp, D. melanogaster
tgaagtatttaat

SEQ ID NO: 651468 - DNA, 13 bp, D. melanogaster
tgaagtatttgag

SEQ ID NO: 651469 - DNA, 13 bp, D. melanogaster
tgaagtcatctac

SEQ ID NO: 651470 - DNA, 13 bp, D. melanogaster
tgaagtgaaaatg

SEQ ID NO: 651471 - DNA, 13 bp, D. melanogaster
tgaagtgaaaatt

SEQ ID NO: 651472 - DNA, 13 bp, D. melanogaster
tgaagtgaagtaa

SEQ ID NO: 651473 - DNA, 13 bp, D. melanogaster
tgaagtgaagtgt

SEQ ID NO: 651474 - DNA, 13 bp, D. melanogaster
tgaagtgcaaaaa

SEQ ID NO: 651475 - DNA, 13 bp, D. melanogaster
tgaagtgcaattt

SEQ ID NO: 651476 - DNA, 13 bp, D. melanogaster
tgaagtgcacttt

SEQ ID NO: 651477 - DNA, 13 bp, D. melanogaster
tgaagtgcataaa

SEQ ID NO: 651478 - DNA, 13 bp, D. melanogaster
tgaagtgcatttt

SEQ ID NO: 651479 - DNA, 13 bp, D. melanogaster
tgaagtgcttgta

SEQ ID NO: 651480 - DNA, 14 bp, D. melanogaster
tgaagtgcttgtat

SEQ ID NO: 651481 - DNA, 13 bp, D. melanogaster
tgaagttacccaa

SEQ ID NO: 651482 - DNA, 13 bp, D. melanogaster
tgaagttatgagt

SEQ ID NO: 651483 - DNA, 13 bp, D. melanogaster
tgaagttattcat

SEQ ID NO: 651484 - DNA, 13 bp, D. melanogaster
tgaagttcaaaat

SEQ ID NO: 651485 - DNA, 13 bp, D. melanogaster
tgaagttgaagct

SEQ ID NO: 651486 - DNA, 13 bp, D. melanogaster
tgaagttgcagtt

SEQ ID NO: 651487 - DNA, 13 bp, D. melanogaster
tgaagttgcattt

SEQ ID NO: 651488 - DNA, 13 bp, D. melanogaster
tgaagttgctgct

SEQ ID NO: 651489 - DNA, 13 bp, D. melanogaster
tgaagttgggttc

SEQ ID NO: 651490 - DNA, 13 bp, D. melanogaster
tgaagttggtcag

SEQ ID NO: 651491 - DNA, 13 bp, D. melanogaster
tgaagtttaaaaa

SEQ ID NO: 651492 - DNA, 13 bp, D. melanogaster
tgaagtttaattt

SEQ ID NO: 651493 - DNA, 13 bp, D. melanogaster
tgaagtttattta

SEQ ID NO: 651494 - DNA, 13 bp, D. melanogaster
tgaagttttaaca

SEQ ID NO: 651495 - DNA, 13 bp, D. melanogaster
tgaagtttttaaa

SEQ ID NO: 651496 - DNA, 13 bp, D. melanogaster
tgaagtttttgat

SEQ ID NO: 651497 - DNA, 13 bp, D. melanogaster
tgaagtttttggt

SEQ ID NO: 651498 - DNA, 13 bp, D. melanogaster
tgaataaaaattc

SEQ ID NO: 651499 - DNA, 13 bp, D. melanogaster
tgaataaaatgag

SEQ ID NO: 651500 - DNA, 13 bp, D. melanogaster
tgaataaaatgta

SEQ ID NO: 651501 - DNA, 13 bp, D. melanogaster
tgaataaacgtat

SEQ ID NO: 651502 - DNA, 13 bp, D. melanogaster
tgaataaactgaa

SEQ ID NO: 651503 - DNA, 13 bp, D. melanogaster
tgaataaagtgaa

SEQ ID NO: 651504 - DNA, 13 bp, D. melanogaster
tgaataaagtttt

SEQ ID NO: 651505 - DNA, 13 bp, D. melanogaster
tgaataaataatc

SEQ ID NO: 651506 - DNA, 13 bp, D. melanogaster
tgaataaatgaat

SEQ ID NO: 651507 - DNA, 13 bp, D. melanogaster
tgaataaattaag

SEQ ID NO: 651508 - DNA, 13 bp, D. melanogaster
tgaataaattcaa

SEQ ID NO: 651509 - DNA, 13 bp, D. melanogaster
tgaataacaaaca

SEQ ID NO: 651510 - DNA, 13 bp, D. melanogaster
tgaataaccaaaa

SEQ ID NO: 651511 - DNA, 13 bp, D. melanogaster
tgaataacgatgg

SEQ ID NO: 651512 - DNA, 13 bp, D. melanogaster
tgaataactaatt

SEQ ID NO: 651513 - DNA, 13 bp, D. melanogaster
tgaataacttaaa

SEQ ID NO: 651514 - DNA, 13 bp, D. melanogaster
tgaataacttcaa

SEQ ID NO: 651515 - DNA, 13 bp, D. melanogaster
tgaataacttttt

SEQ ID NO: 651516 - DNA, 13 bp, D. melanogaster
tgaataagctgaa

SEQ ID NO: 651517 - DNA, 13 bp, D. melanogaster
tgaataataaatg

SEQ ID NO: 651518 - DNA, 13 bp, D. melanogaster
tgaataatacttc

SEQ ID NO: 651519 - DNA, 13 bp, D. melanogaster
tgaataatatgaa

SEQ ID NO: 651520 - DNA, 13 bp, D. melanogaster
tgaataatatttg

SEQ ID NO: 651521 - DNA, 13 bp, D. melanogaster
tgaataatgtttt

SEQ ID NO: 651522 - DNA, 13 bp, D. melanogaster
tgaataattaatg

SEQ ID NO: 651523 - DNA, 13 bp, D. melanogaster
tgaataattcaaa

SEQ ID NO: 651524 - DNA, 13 bp, D. melanogaster
tgaataattcaat

SEQ ID NO: 651525 - DNA, 13 bp, D. melanogaster
tgaataattccct

SEQ ID NO: 651526 - DNA, 13 bp, D. melanogaster
tgaataattgtaa

SEQ ID NO: 651527 - DNA, 14 bp, D. melanogaster
tgaataattgtatt

SEQ ID NO: 651528 - DNA, 13 bp, D. melanogaster
tgaataatttaag

SEQ ID NO: 651529 - DNA, 13 bp, D. melanogaster
tgaataatttgaa

SEQ ID NO: 651530 - DNA, 13 bp, D. melanogaster
tgaatacaaaaga

SEQ ID NO: 651531 - DNA, 14 bp, D. melanogaster
tgaatacaaataca

SEQ ID NO: 651532 - DNA, 13 bp, D. melanogaster
tgaatacaaattt

SEQ ID NO: 651533 - DNA, 13 bp, D. melanogaster
tgaatacactaaa

SEQ ID NO: 651534 - DNA, 14 bp, D. melanogaster
tgaatacactaaat

SEQ ID NO: 651535 - DNA, 13 bp, D. melanogaster
tgaatacatttaa

SEQ ID NO: 651536 - DNA, 13 bp, D. melanogaster
tgaatacgaatac

SEQ ID NO: 651537 - DNA, 15 bp, D. melanogaster
tgaatactctaatga

SEQ ID NO: 651538 - DNA, 18 bp, D. melanogaster
tgaatactctaatgacaa

SEQ ID NO: 651539 - DNA, 13 bp, D. melanogaster
tgaatactgaata

SEQ ID NO: 651540 - DNA, 13 bp, D. melanogaster
tgaatactttttt

SEQ ID NO: 651541 - DNA, 13 bp, D. melanogaster
tgaatagcaataa

SEQ ID NO: 651542 - DNA, 13 bp, D. melanogaster
tgaatagtatatt

SEQ ID NO: 651543 - DNA, 13 bp, D. melanogaster
tgaatagtgaata

SEQ ID NO: 651544 - DNA, 13 bp, D. melanogaster
tgaatagtttaaa

SEQ ID NO: 651545 - DNA, 13 bp, D. melanogaster
tgaatagttttta

SEQ ID NO: 651546 - DNA, 13 bp, D. melanogaster
tgaatataaggag

SEQ ID NO: 651547 - DNA, 13 bp, D. melanogaster
tgaatataatttc

SEQ ID NO: 651548 - DNA, 13 bp, D. melanogaster
tgaatataatttg

SEQ ID NO: 651549 - DNA, 14 bp, D. melanogaster
tgaatatacaaaaa

SEQ ID NO: 651550 - DNA, 13 bp, D. melanogaster
tgaatatacaata

SEQ ID NO: 651551 - DNA, 13 bp, D. melanogaster
tgaatatataaca

SEQ ID NO: 651552 - DNA, 13 bp, D. melanogaster
tgaatatatatac

SEQ ID NO: 651553 - DNA, 13 bp, D. melanogaster
tgaatatatcttt

SEQ ID NO: 651554 - DNA, 13 bp, D. melanogaster
tgaatatatgtac

SEQ ID NO: 651555 - DNA, 13 bp, D. melanogaster
tgaatatatgtat

SEQ ID NO: 651556 - DNA, 13 bp, D. melanogaster
tgaatatattgta

SEQ ID NO: 651557 - DNA, 13 bp, D. melanogaster
tgaatatatttgt

SEQ ID NO: 651558 - DNA, 13 bp, D. melanogaster
tgaatatcagagt

SEQ ID NO: 651559 - DNA, 13 bp, D. melanogaster
tgaatatcatcaa

SEQ ID NO: 651560 - DNA, 14 bp, D. melanogaster
tgaatatgaaatat

SEQ ID NO: 651561 - DNA, 13 bp, D. melanogaster
tgaatatgaaatt

SEQ ID NO: 651562 - DNA, 14 bp, D. melanogaster
tgaatatgaaattg

SEQ ID NO: 651563 - DNA, 14 bp, D. melanogaster
tgaatatgaatata

SEQ ID NO: 651564 - DNA, 13 bp, D. melanogaster
tgaatatgaatgt

SEQ ID NO: 651565 - DNA, 14 bp, D. melanogaster
tgaatatgaatgtg

SEQ ID NO: 651566 - DNA, 13 bp, D. melanogaster
tgaatatgaatta

SEQ ID NO: 651567 - DNA, 16 bp, D. melanogaster
tgaatatgacctgcaa

SEQ ID NO: 651568 - DNA, 13 bp, D. melanogaster
tgaatatgataaa

SEQ ID NO: 651569 - DNA, 13 bp, D. melanogaster
tgaatatgcaaca

SEQ ID NO: 651570 - DNA, 14 bp, D. melanogaster
tgaatatggaatgc

SEQ ID NO: 651571 - DNA, 13 bp, D. melanogaster
tgaatatggatat

SEQ ID NO: 651572 - DNA, 13 bp, D. melanogaster
tgaatatgttctt

SEQ ID NO: 651573 - DNA, 13 bp, D. melanogaster
tgaatatgtttat

SEQ ID NO: 651574 - DNA, 13 bp, D. melanogaster
tgaatattagaaa

SEQ ID NO: 651575 - DNA, 13 bp, D. melanogaster
tgaatattattgt

SEQ ID NO: 651576 - DNA, 13 bp, D. melanogaster
tgaatattatttg

SEQ ID NO: 651577 - DNA, 13 bp, D. melanogaster
tgaatattcttct

SEQ ID NO: 651578 - DNA, 13 bp, D. melanogaster
tgaatattgaata

SEQ ID NO: 651579 - DNA, 14 bp, D. melanogaster
tgaatattgaatat

SEQ ID NO: 651580 - DNA, 13 bp, D. melanogaster
tgaatattgtcca

SEQ ID NO: 651581 - DNA, 13 bp, D. melanogaster
tgaatattgttga

SEQ ID NO: 651582 - DNA, 13 bp, D. melanogaster
tgaatattgttta

SEQ ID NO: 651583 - DNA, 13 bp, D. melanogaster
tgaatatttaact

SEQ ID NO: 651584 - DNA, 13 bp, D. melanogaster
tgaatatttcaat

SEQ ID NO: 651585 - DNA, 13 bp, D. melanogaster
tgaatatttcatt

SEQ ID NO: 651586 - DNA, 13 bp, D. melanogaster
tgaatatttgaaa

SEQ ID NO: 651587 - DNA, 14 bp, D. melanogaster
tgaatatttgcata

SEQ ID NO: 651588 - DNA, 13 bp, D. melanogaster
tgaatattttaac

SEQ ID NO: 651589 - DNA, 14 bp, D. melanogaster
tgaatattttaacg

SEQ ID NO: 651590 - DNA, 13 bp, D. melanogaster
tgaatattttcta

SEQ ID NO: 651591 - DNA, 14 bp, D. melanogaster
tgaatattttcttt

SEQ ID NO: 651592 - DNA, 13 bp, D. melanogaster
tgaatatttttgg

SEQ ID NO: 651593 - DNA, 13 bp, D. melanogaster
tgaatcaaaaaat

SEQ ID NO: 651594 - DNA, 13 bp, D. melanogaster
tgaatcaaaacga

SEQ ID NO: 651595 - DNA, 13 bp, D. melanogaster
tgaatcaaatcga

SEQ ID NO: 651596 - DNA, 13 bp, D. melanogaster
tgaatcaaattga

SEQ ID NO: 651597 - DNA, 13 bp, D. melanogaster
tgaatcaaattta

SEQ ID NO: 651598 - DNA, 13 bp, D. melanogaster
tgaatcaaatttt

SEQ ID NO: 651599 - DNA, 13 bp, D. melanogaster
tgaatcaaccaca

SEQ ID NO: 651600 - DNA, 13 bp, D. melanogaster
tgaatcataataa

SEQ ID NO: 651601 - DNA, 13 bp, D. melanogaster
tgaatccattttt

SEQ ID NO: 651602 - DNA, 13 bp, D. melanogaster
tgaatccgaatcc

SEQ ID NO: 651603 - DNA, 13 bp, D. melanogaster
tgaatccgaatct

SEQ ID NO: 651604 - DNA, 13 bp, D. melanogaster
tgaatcgaaaacc

SEQ ID NO: 651605 - DNA, 13 bp, D. melanogaster
tgaatcgaatcga

SEQ ID NO: 651606 - DNA, 14 bp, D. melanogaster
tgaatcgaatcgaa

SEQ ID NO: 651607 - DNA, 13 bp, D. melanogaster
tgaatcgttttat

SEQ ID NO: 651608 - DNA, 14 bp, D. melanogaster
tgaatctcaacctt

SEQ ID NO: 651609 - DNA, 13 bp, D. melanogaster
tgaatctcttttt

SEQ ID NO: 651610 - DNA, 13 bp, D. melanogaster
tgaatctgaaagt

SEQ ID NO: 651611 - DNA, 13 bp, D. melanogaster
tgaatctgaatcc

SEQ ID NO: 651612 - DNA, 13 bp, D. melanogaster
tgaatctgaatcg

SEQ ID NO: 651613 - DNA, 13 bp, D. melanogaster
tgaatctgaatct

SEQ ID NO: 651614 - DNA, 13 bp, D. melanogaster
tgaatctgatata

SEQ ID NO: 651615 - DNA, 13 bp, D. melanogaster
tgaatctggagaa

SEQ ID NO: 651616 - DNA, 14 bp, D. melanogaster
tgaatctgtatctg

SEQ ID NO: 651617 - DNA, 13 bp, D. melanogaster
tgaatcttaaaat

SEQ ID NO: 651618 - DNA, 13 bp, D. melanogaster
tgaatctttcgaa

SEQ ID NO: 651619 - DNA, 13 bp, D. melanogaster
tgaatgaaaaacg

SEQ ID NO: 651620 - DNA, 13 bp, D. melanogaster
tgaatgaaaaatg

SEQ ID NO: 651621 - DNA, 13 bp, D. melanogaster
tgaatgaaaaatt

SEQ ID NO: 651622 - DNA, 13 bp, D. melanogaster
tgaatgaaaatat

SEQ ID NO: 651623 - DNA, 14 bp, D. melanogaster
tgaatgaaaatatg

SEQ ID NO: 651624 - DNA, 13 bp, D. melanogaster
tgaatgaaaatgg

SEQ ID NO: 651625 - DNA, 13 bp, D. melanogaster
tgaatgaaaatgt

SEQ ID NO: 651626 - DNA, 13 bp, D. melanogaster
tgaatgaaacttt

SEQ ID NO: 651627 - DNA, 13 bp, D. melanogaster
tgaatgaaagtaa

SEQ ID NO: 651628 - DNA, 13 bp, D. melanogaster
tgaatgaaataat

SEQ ID NO: 651629 - DNA, 13 bp, D. melanogaster
tgaatgaaatatt

SEQ ID NO: 651630 - DNA, 13 bp, D. melanogaster
tgaatgaaatgaa

SEQ ID NO: 651631 - DNA, 13 bp, D. melanogaster
tgaatgaacaaat

SEQ ID NO: 651632 - DNA, 13 bp, D. melanogaster
tgaatgaacttta

SEQ ID NO: 651633 - DNA, 13 bp, D. melanogaster
tgaatgaagtgaa

SEQ ID NO: 651634 - DNA, 13 bp, D. melanogaster
tgaatgaatgaac

SEQ ID NO: 651635 - DNA, 14 bp, D. melanogaster
tgaatgaatgaatg

SEQ ID NO: 651636 - DNA, 14 bp, D. melanogaster
tgaatgaatgaatt

SEQ ID NO: 651637 - DNA, 13 bp, D. melanogaster
tgaatgaatggaa

SEQ ID NO: 651638 - DNA, 13 bp, D. melanogaster
tgaatgaattaat

SEQ ID NO: 651639 - DNA, 13 bp, D. melanogaster
tgaatgaatttcg

SEQ ID NO: 651640 - DNA, 13 bp, D. melanogaster
tgaatgaatttga

SEQ ID NO: 651641 - DNA, 13 bp, D. melanogaster
tgaatgaattttc

SEQ ID NO: 651642 - DNA, 13 bp, D. melanogaster
tgaatgacatcat

SEQ ID NO: 651643 - DNA, 13 bp, D. melanogaster
tgaatgagtgaat

SEQ ID NO: 651644 - DNA, 14 bp, D. melanogaster
tgaatgagtgagtg

SEQ ID NO: 651645 - DNA, 13 bp, D. melanogaster
tgaatgatcagaa

SEQ ID NO: 651646 - DNA, 13 bp, D. melanogaster
tgaatgatgctat

SEQ ID NO: 651647 - DNA, 13 bp, D. melanogaster
tgaatgatgtcaa

SEQ ID NO: 651648 - DNA, 13 bp, D. melanogaster
tgaatgattgatt

SEQ ID NO: 651649 - DNA, 13 bp, D. melanogaster
tgaatgcaaaaca

SEQ ID NO: 651650 - DNA, 13 bp, D. melanogaster
tgaatgcaaaact

SEQ ID NO: 651651 - DNA, 13 bp, D. melanogaster
tgaatgcaacaaa

SEQ ID NO: 651652 - DNA, 13 bp, D. melanogaster
tgaatgcaattaa

SEQ ID NO: 651653 - DNA, 14 bp, D. melanogaster
tgaatgcaattaaa

SEQ ID NO: 651654 - DNA, 13 bp, D. melanogaster
tgaatgcagtttt

SEQ ID NO: 651655 - DNA, 13 bp, D. melanogaster
tgaatgcatttca

SEQ ID NO: 651656 - DNA, 13 bp, D. melanogaster
tgaatgcatttct

SEQ ID NO: 651657 - DNA, 13 bp, D. melanogaster
tgaatgcattttt

SEQ ID NO: 651658 - DNA, 13 bp, D. melanogaster
tgaatgccaatcg

SEQ ID NO: 651659 - DNA, 13 bp, D. melanogaster
tgaatgccataaa

SEQ ID NO: 651660 - DNA, 13 bp, D. melanogaster
tgaatgccattcg

SEQ ID NO: 651661 - DNA, 13 bp, D. melanogaster
tgaatgcgaacgc

SEQ ID NO: 651662 - DNA, 13 bp, D. melanogaster
tgaatgcgaagat

SEQ ID NO: 651663 - DNA, 13 bp, D. melanogaster
tgaatgcgaatgc

SEQ ID NO: 651664 - DNA, 13 bp, D. melanogaster
tgaatgcgaatgt

SEQ ID NO: 651665 - DNA, 13 bp, D. melanogaster
tgaatgctgacca

SEQ ID NO: 651666 - DNA, 13 bp, D. melanogaster
tgaatgctgcttt

SEQ ID NO: 651667 - DNA, 13 bp, D. melanogaster
tgaatgcttaaaa

SEQ ID NO: 651668 - DNA, 13 bp, D. melanogaster
tgaatggaaaaca

SEQ ID NO: 651669 - DNA, 13 bp, D. melanogaster
tgaatggaaaatg

SEQ ID NO: 651670 - DNA, 13 bp, D. melanogaster
tgaatggaaaatt

SEQ ID NO: 651671 - DNA, 13 bp, D. melanogaster
tgaatggaatatt

SEQ ID NO: 651672 - DNA, 13 bp, D. melanogaster
tgaatggaatgca

SEQ ID NO: 651673 - DNA, 13 bp, D. melanogaster
tgaatggaattga

SEQ ID NO: 651674 - DNA, 13 bp, D. melanogaster
tgaatggaatttg

SEQ ID NO: 651675 - DNA, 13 bp, D. melanogaster
tgaatggcaaaca

SEQ ID NO: 651676 - DNA, 13 bp, D. melanogaster
tgaatggcaaatg

SEQ ID NO: 651677 - DNA, 13 bp, D. melanogaster
tgaatggcctcct

SEQ ID NO: 651678 - DNA, 13 bp, D. melanogaster
tgaatggctggca

SEQ ID NO: 651679 - DNA, 13 bp, D. melanogaster
tgaatgggatcag

SEQ ID NO: 651680 - DNA, 13 bp, D. melanogaster
tgaatgtagaaaa

SEQ ID NO: 651681 - DNA, 13 bp, D. melanogaster
tgaatgtatgtac

SEQ ID NO: 651682 - DNA, 13 bp, D. melanogaster
tgaatgtatttaa

SEQ ID NO: 651683 - DNA, 13 bp, D. melanogaster
tgaatgtatttat

SEQ ID NO: 651684 - DNA, 13 bp, D. melanogaster
tgaatgtgaaaat

SEQ ID NO: 651685 - DNA, 13 bp, D. melanogaster
tgaatgtgaatat

SEQ ID NO: 651686 - DNA, 13 bp, D. melanogaster
tgaatgtgaattt

SEQ ID NO: 651687 - DNA, 13 bp, D. melanogaster
tgaatgtgagtgt

SEQ ID NO: 651688 - DNA, 13 bp, D. melanogaster
tgaatgtgcaata

SEQ ID NO: 651689 - DNA, 13 bp, D. melanogaster
tgaatgtgtcacc

SEQ ID NO: 651690 - DNA, 13 bp, D. melanogaster
tgaatgtgtgcgt

SEQ ID NO: 651691 - DNA, 13 bp, D. melanogaster
tgaatgtgtgtgt

SEQ ID NO: 651692 - DNA, 14 bp, D. melanogaster
tgaatgtgttaaaa

SEQ ID NO: 651693 - DNA, 13 bp, D. melanogaster
tgaatgtgtttgc

SEQ ID NO: 651694 - DNA, 13 bp, D. melanogaster
tgaatgttgaatg

SEQ ID NO: 651695 - DNA, 13 bp, D. melanogaster
tgaatgtttaata

SEQ ID NO: 651696 - DNA, 13 bp, D. melanogaster
tgaatgttttaaa

SEQ ID NO: 651697 - DNA, 13 bp, D. melanogaster
tgaatgttttgaa

SEQ ID NO: 651698 - DNA, 13 bp, D. melanogaster
tgaatgtttttaa

SEQ ID NO: 651699 - DNA, 13 bp, D. melanogaster
tgaattaaaagtt

SEQ ID NO: 651700 - DNA, 13 bp, D. melanogaster
tgaattaaagatt

SEQ ID NO: 651701 - DNA, 13 bp, D. melanogaster
tgaattaaatgaa

SEQ ID NO: 651702 - DNA, 13 bp, D. melanogaster
tgaattaatcaaa

SEQ ID NO: 651703 - DNA, 13 bp, D. melanogaster
tgaattaatccaa

SEQ ID NO: 651704 - DNA, 13 bp, D. melanogaster
tgaattacaaaat

SEQ ID NO: 651705 - DNA, 13 bp, D. melanogaster
tgaattagttaaa

SEQ ID NO: 651706 - DNA, 13 bp, D. melanogaster
tgaattatacaaa

SEQ ID NO: 651707 - DNA, 13 bp, D. melanogaster
tgaattatgaaaa

SEQ ID NO: 651708 - DNA, 13 bp, D. melanogaster
tgaattatgttta

SEQ ID NO: 651709 - DNA, 13 bp, D. melanogaster
tgaattattgtaa

SEQ ID NO: 651710 - DNA, 13 bp, D. melanogaster
tgaattatttaca

SEQ ID NO: 651711 - DNA, 13 bp, D. melanogaster
tgaattatttatg

SEQ ID NO: 651712 - DNA, 13 bp, D. melanogaster
tgaattatttgaa

SEQ ID NO: 651713 - DNA, 13 bp, D. melanogaster
tgaattattttga

SEQ ID NO: 651714 - DNA, 13 bp, D. melanogaster
tgaattcaaaaag

SEQ ID NO: 651715 - DNA, 14 bp, D. melanogaster
tgaattcaaaaagg

SEQ ID NO: 651716 - DNA, 13 bp, D. melanogaster
tgaattcaaaaat

SEQ ID NO: 651717 - DNA, 13 bp, D. melanogaster
tgaattcaaaatt

SEQ ID NO: 651718 - DNA, 13 bp, D. melanogaster
tgaattcaaactc

SEQ ID NO: 651719 - DNA, 13 bp, D. melanogaster
tgaattcaaataa

SEQ ID NO: 651720 - DNA, 13 bp, D. melanogaster
tgaattcaatgaa

SEQ ID NO: 651721 - DNA, 13 bp, D. melanogaster
tgaattcatcatc

SEQ ID NO: 651722 - DNA, 14 bp, D. melanogaster
tgaattcatcatct

SEQ ID NO: 651723 - DNA, 13 bp, D. melanogaster
tgaattcattata

SEQ ID NO: 651724 - DNA, 13 bp, D. melanogaster
tgaattcatttaa

SEQ ID NO: 651725 - DNA, 14 bp, D. melanogaster
tgaattcatttaaa

SEQ ID NO: 651726 - DNA, 13 bp, D. melanogaster
tgaattcattttt

SEQ ID NO: 651727 - DNA, 13 bp, D. melanogaster
tgaattccttttt

SEQ ID NO: 651728 - DNA, 13 bp, D. melanogaster
tgaattcgaattt

SEQ ID NO: 651729 - DNA, 13 bp, D. melanogaster
tgaattcgatggt

SEQ ID NO: 651730 - DNA, 13 bp, D. melanogaster
tgaattcgatttc

SEQ ID NO: 651731 - DNA, 13 bp, D. melanogaster
tgaattcgatttg

SEQ ID NO: 651732 - DNA, 13 bp, D. melanogaster
tgaattcgatttt

SEQ ID NO: 651733 - DNA, 13 bp, D. melanogaster
tgaattcgtaatt

SEQ ID NO: 651734 - DNA, 13 bp, D. melanogaster
tgaattgaaaaat

SEQ ID NO: 651735 - DNA, 13 bp, D. melanogaster
tgaattgaaaact

SEQ ID NO: 651736 - DNA, 13 bp, D. melanogaster
tgaattgaaaatc

SEQ ID NO: 651737 - DNA, 13 bp, D. melanogaster
tgaattgaacttt

SEQ ID NO: 651738 - DNA, 13 bp, D. melanogaster
tgaattgaataaa

SEQ ID NO: 651739 - DNA, 13 bp, D. melanogaster
tgaattgaatcta

SEQ ID NO: 651740 - DNA, 13 bp, D. melanogaster
tgaattgaatgaa

SEQ ID NO: 651741 - DNA, 13 bp, D. melanogaster
tgaattgaatgca

SEQ ID NO: 651742 - DNA, 14 bp, D. melanogaster
tgaattgaattgaa

SEQ ID NO: 651743 - DNA, 13 bp, D. melanogaster
tgaattgaatttc

SEQ ID NO: 651744 - DNA, 14 bp, D. melanogaster
tgaattgaatttgt

SEQ ID NO: 651745 - DNA, 13 bp, D. melanogaster
tgaattgattaaa

SEQ ID NO: 651746 - DNA, 13 bp, D. melanogaster
tgaattgatttat

SEQ ID NO: 651747 - DNA, 13 bp, D. melanogaster
tgaattgcaaatg

SEQ ID NO: 651748 - DNA, 13 bp, D. melanogaster
tgaattgcaactg

SEQ ID NO: 651749 - DNA, 13 bp, D. melanogaster
tgaattgcaattt

SEQ ID NO: 651750 - DNA, 13 bp, D. melanogaster
tgaattgcagaaa

SEQ ID NO: 651751 - DNA, 14 bp, D. melanogaster
tgaattgctgctaa

SEQ ID NO: 651752 - DNA, 13 bp, D. melanogaster
tgaattgcttaaa

SEQ ID NO: 651753 - DNA, 13 bp, D. melanogaster
tgaattggaattg

SEQ ID NO: 651754 - DNA, 13 bp, D. melanogaster
tgaattggatcgt

SEQ ID NO: 651755 - DNA, 13 bp, D. melanogaster
tgaattggcaaaa

SEQ ID NO: 651756 - DNA, 13 bp, D. melanogaster
tgaattgtaaatt

SEQ ID NO: 651757 - DNA, 13 bp, D. melanogaster
tgaattgtaattg

SEQ ID NO: 651758 - DNA, 13 bp, D. melanogaster
tgaattgtaattt

SEQ ID NO: 651759 - DNA, 13 bp, D. melanogaster
tgaattgttttca

SEQ ID NO: 651760 - DNA, 13 bp, D. melanogaster
tgaatttaaaatc

SEQ ID NO: 651761 - DNA, 14 bp, D. melanogaster
tgaatttaaactta

SEQ ID NO: 651762 - DNA, 13 bp, D. melanogaster
tgaatttaattga

SEQ ID NO: 651763 - DNA, 13 bp, D. melanogaster
tgaatttaatttc

SEQ ID NO: 651764 - DNA, 13 bp, D. melanogaster
tgaatttacaaaa

SEQ ID NO: 651765 - DNA, 13 bp, D. melanogaster
tgaatttatattc

SEQ ID NO: 651766 - DNA, 14 bp, D. melanogaster
tgaatttatctaca

SEQ ID NO: 651767 - DNA, 14 bp, D. melanogaster
tgaatttatgaatt

SEQ ID NO: 651768 - DNA, 13 bp, D. melanogaster
tgaatttatggcc

SEQ ID NO: 651769 - DNA, 13 bp, D. melanogaster
tgaatttattaca

SEQ ID NO: 651770 - DNA, 13 bp, D. melanogaster
tgaatttattatc

SEQ ID NO: 651771 - DNA, 13 bp, D. melanogaster
tgaatttattcat

SEQ ID NO: 651772 - DNA, 13 bp, D. melanogaster
tgaatttattgtg

SEQ ID NO: 651773 - DNA, 13 bp, D. melanogaster
tgaatttcaaaaa

SEQ ID NO: 651774 - DNA, 14 bp, D. melanogaster
tgaatttcaaacaa

SEQ ID NO: 651775 - DNA, 13 bp, D. melanogaster
tgaatttcaaatc

SEQ ID NO: 651776 - DNA, 13 bp, D. melanogaster
tgaatttcaaatt

SEQ ID NO: 651777 - DNA, 13 bp, D. melanogaster
tgaatttcaataa

SEQ ID NO: 651778 - DNA, 13 bp, D. melanogaster
tgaatttcaatat

SEQ ID NO: 651779 - DNA, 13 bp, D. melanogaster
tgaatttcaattg

SEQ ID NO: 651780 - DNA, 13 bp, D. melanogaster
tgaatttcaattt

SEQ ID NO: 651781 - DNA, 13 bp, D. melanogaster
tgaatttcatttg

SEQ ID NO: 651782 - DNA, 14 bp, D. melanogaster
tgaatttcatttgg

SEQ ID NO: 651783 - DNA, 13 bp, D. melanogaster
tgaatttctaaaa

SEQ ID NO: 651784 - DNA, 14 bp, D. melanogaster
tgaatttctggttt

SEQ ID NO: 651785 - DNA, 13 bp, D. melanogaster
tgaatttctttct

SEQ ID NO: 651786 - DNA, 13 bp, D. melanogaster
tgaatttgaaata

SEQ ID NO: 651787 - DNA, 13 bp, D. melanogaster
tgaatttgaactt

SEQ ID NO: 651788 - DNA, 13 bp, D. melanogaster
tgaatttgaatat

SEQ ID NO: 651789 - DNA, 13 bp, D. melanogaster
tgaatttgaattc

SEQ ID NO: 651790 - DNA, 13 bp, D. melanogaster
tgaatttgacaaa

SEQ ID NO: 651791 - DNA, 15 bp, D. melanogaster
tgaatttgacaaaca

SEQ ID NO: 651792 - DNA, 13 bp, D. melanogaster
tgaatttgataga

SEQ ID NO: 651793 - DNA, 14 bp, D. melanogaster
tgaatttgattttg

SEQ ID NO: 651794 - DNA, 13 bp, D. melanogaster
tgaatttgcaaat

SEQ ID NO: 651795 - DNA, 13 bp, D. melanogaster
tgaatttgcatac

SEQ ID NO: 651796 - DNA, 13 bp, D. melanogaster
tgaatttgcattt

SEQ ID NO: 651797 - DNA, 13 bp, D. melanogaster
tgaatttgccatt

SEQ ID NO: 651798 - DNA, 13 bp, D. melanogaster
tgaatttggattt

SEQ ID NO: 651799 - DNA, 13 bp, D. melanogaster
tgaatttggccaa

SEQ ID NO: 651800 - DNA, 13 bp, D. melanogaster
tgaatttggtatt

SEQ ID NO: 651801 - DNA, 13 bp, D. melanogaster
tgaatttgtattc

SEQ ID NO: 651802 - DNA, 13 bp, D. melanogaster
tgaattttaaact

SEQ ID NO: 651803 - DNA, 13 bp, D. melanogaster
tgaattttaatac

SEQ ID NO: 651804 - DNA, 13 bp, D. melanogaster
tgaattttaattg

SEQ ID NO: 651805 - DNA, 14 bp, D. melanogaster
tgaattttaattga

SEQ ID NO: 651806 - DNA, 13 bp, D. melanogaster
tgaattttacata

SEQ ID NO: 651807 - DNA, 13 bp, D. melanogaster
tgaattttataca

SEQ ID NO: 651808 - DNA, 13 bp, D. melanogaster
tgaattttatatg

SEQ ID NO: 651809 - DNA, 13 bp, D. melanogaster
tgaattttattga

SEQ ID NO: 651810 - DNA, 13 bp, D. melanogaster
tgaattttcaata

SEQ ID NO: 651811 - DNA, 13 bp, D. melanogaster
tgaattttcataa

SEQ ID NO: 651812 - DNA, 13 bp, D. melanogaster
tgaattttgcatt

SEQ ID NO: 651813 - DNA, 13 bp, D. melanogaster
tgaattttggcaa

SEQ ID NO: 651814 - DNA, 13 bp, D. melanogaster
tgaattttgtatc

SEQ ID NO: 651815 - DNA, 13 bp, D. melanogaster
tgaattttgttct

SEQ ID NO: 651816 - DNA, 13 bp, D. melanogaster
tgaatttttcatt

SEQ ID NO: 651817 - DNA, 14 bp, D. melanogaster
tgaatttttcattt

SEQ ID NO: 651818 - DNA, 13 bp, D. melanogaster
tgaatttttcgca

SEQ ID NO: 651819 - DNA, 13 bp, D. melanogaster
tgaatttttgaaa

SEQ ID NO: 651820 - DNA, 14 bp, D. melanogaster
tgaatttttgacaa

SEQ ID NO: 651821 - DNA, 13 bp, D. melanogaster
tgaattttttcgc

SEQ ID NO: 651822 - DNA, 14 bp, D. melanogaster
tgaattttttcgcc

SEQ ID NO: 651823 - DNA, 13 bp, D. melanogaster
tgaattttttgaa

SEQ ID NO: 651824 - DNA, 13 bp, D. melanogaster
tgacaaaaaatat

SEQ ID NO: 651825 - DNA, 13 bp, D. melanogaster
tgacaaaaaattt

SEQ ID NO: 651826 - DNA, 13 bp, D. melanogaster
tgacaaaaactac

SEQ ID NO: 651827 - DNA, 13 bp, D. melanogaster
tgacaaaaagtta

SEQ ID NO: 651828 - DNA, 13 bp, D. melanogaster
tgacaaaacaaat

SEQ ID NO: 651829 - DNA, 13 bp, D. melanogaster
tgacaaaacattt

SEQ ID NO: 651830 - DNA, 13 bp, D. melanogaster
tgacaaaagtttt

SEQ ID NO: 651831 - DNA, 13 bp, D. melanogaster
tgacaaaataaat

SEQ ID NO: 651832 - DNA, 13 bp, D. melanogaster
tgacaaaatcaaa

SEQ ID NO: 651833 - DNA, 13 bp, D. melanogaster
tgacaaaattaaa

SEQ ID NO: 651834 - DNA, 13 bp, D. melanogaster
tgacaaacaaaat

SEQ ID NO: 651835 - DNA, 14 bp, D. melanogaster
tgacaaacaaaata

SEQ ID NO: 651836 - DNA, 13 bp, D. melanogaster
tgacaaacaacaa

SEQ ID NO: 651837 - DNA, 13 bp, D. melanogaster
tgacaaagaagaa

SEQ ID NO: 651838 - DNA, 13 bp, D. melanogaster
tgacaaagcaatt

SEQ ID NO: 651839 - DNA, 13 bp, D. melanogaster
tgacaaatattct

SEQ ID NO: 651840 - DNA, 13 bp, D. melanogaster
tgacaaatcaaaa

SEQ ID NO: 651841 - DNA, 13 bp, D. melanogaster
tgacaaatgaaaa

SEQ ID NO: 651842 - DNA, 13 bp, D. melanogaster
tgacaaatgattt

SEQ ID NO: 651843 - DNA, 13 bp, D. melanogaster
tgacaaatgcaat

SEQ ID NO: 651844 - DNA, 13 bp, D. melanogaster
tgacaaatgccaa

SEQ ID NO: 651845 - DNA, 13 bp, D. melanogaster
tgacaaatggcaa

SEQ ID NO: 651846 - DNA, 13 bp, D. melanogaster
tgacaaatgtttt

SEQ ID NO: 651847 - DNA, 13 bp, D. melanogaster
tgacaaattcgcg

SEQ ID NO: 651848 - DNA, 13 bp, D. melanogaster
tgacaaattgaat

SEQ ID NO: 651849 - DNA, 13 bp, D. melanogaster
tgacaaattgttg

SEQ ID NO: 651850 - DNA, 13 bp, D. melanogaster
tgacaaattgttt

SEQ ID NO: 651851 - DNA, 13 bp, D. melanogaster
tgacaaatttaat

SEQ ID NO: 651852 - DNA, 13 bp, D. melanogaster
tgacaaatttagc

SEQ ID NO: 651853 - DNA, 13 bp, D. melanogaster
tgacaaatttatt

SEQ ID NO: 651854 - DNA, 13 bp, D. melanogaster
tgacaaatttcca

SEQ ID NO: 651855 - DNA, 13 bp, D. melanogaster
tgacaacaaattt

SEQ ID NO: 651856 - DNA, 13 bp, D. melanogaster
tgacaacaacaac

SEQ ID NO: 651857 - DNA, 14 bp, D. melanogaster
tgacaacaacaaca

SEQ ID NO: 651858 - DNA, 13 bp, D. melanogaster
tgacaaccaacat

SEQ ID NO: 651859 - DNA, 13 bp, D. melanogaster
tgacaacttcata

SEQ ID NO: 651860 - DNA, 13 bp, D. melanogaster
tgacaagtttatt

SEQ ID NO: 651861 - DNA, 13 bp, D. melanogaster
tgacaatcagcag

SEQ ID NO: 651862 - DNA, 13 bp, D. melanogaster
tgacaatgaaaat

SEQ ID NO: 651863 - DNA, 13 bp, D. melanogaster
tgacaatgaaacg

SEQ ID NO: 651864 - DNA, 13 bp, D. melanogaster
tgacaatgaaaga

SEQ ID NO: 651865 - DNA, 13 bp, D. melanogaster
tgacaatgacaaa

SEQ ID NO: 651866 - DNA, 14 bp, D. melanogaster
tgacaatgatgatg

SEQ ID NO: 651867 - DNA, 13 bp, D. melanogaster
tgacaatgcaaat

SEQ ID NO: 651868 - DNA, 13 bp, D. melanogaster
tgacaatgcaatt

SEQ ID NO: 651869 - DNA, 13 bp, D. melanogaster
tgacaattgacaa

SEQ ID NO: 651870 - DNA, 13 bp, D. melanogaster
tgacaatttaaat

SEQ ID NO: 651871 - DNA, 13 bp, D. melanogaster
tgacaatttattg

SEQ ID NO: 651872 - DNA, 13 bp, D. melanogaster
tgacaatttattt

SEQ ID NO: 651873 - DNA, 13 bp, D. melanogaster
tgacaatttctat

SEQ ID NO: 651874 - DNA, 13 bp, D. melanogaster
tgacaatttgttg

SEQ ID NO: 651875 - DNA, 13 bp, D. melanogaster
tgacaattttatt

SEQ ID NO: 651876 - DNA, 13 bp, D. melanogaster
tgacaattttgtt

SEQ ID NO: 651877 - DNA, 14 bp, D. melanogaster
tgacacaaaaatta

SEQ ID NO: 651878 - DNA, 13 bp, D. melanogaster
tgacacaattttc

SEQ ID NO: 651879 - DNA, 13 bp, D. melanogaster
tgacacacatttg

SEQ ID NO: 651880 - DNA, 13 bp, D. melanogaster
tgacacatttcgc

SEQ ID NO: 651881 - DNA, 13 bp, D. melanogaster
tgacaccaaccac

SEQ ID NO: 651882 - DNA, 13 bp, D. melanogaster
tgacaccagctga

SEQ ID NO: 651883 - DNA, 13 bp, D. melanogaster
tgacaccatgctc

SEQ ID NO: 651884 - DNA, 14 bp, D. melanogaster
tgacacggcattaa

SEQ ID NO: 651885 - DNA, 13 bp, D. melanogaster
tgacactaattac

SEQ ID NO: 651886 - DNA, 14 bp, D. melanogaster
tgacactaattaca

SEQ ID NO: 651887 - DNA, 15 bp, D. melanogaster
tgacactttgtcata

SEQ ID NO: 651888 - DNA, 13 bp, D. melanogaster
tgacacttttttc

SEQ ID NO: 651889 - DNA, 13 bp, D. melanogaster
tgacagacagaca

SEQ ID NO: 651890 - DNA, 14 bp, D. melanogaster
tgacagcagcaaca

SEQ ID NO: 651891 - DNA, 13 bp, D. melanogaster
tgacagcagcagc

SEQ ID NO: 651892 - DNA, 14 bp, D. melanogaster
tgacagcagcagca

SEQ ID NO: 651893 - DNA, 13 bp, D. melanogaster
tgacagccaacaa

SEQ ID NO: 651894 - DNA, 13 bp, D. melanogaster
tgacagccaagtg

SEQ ID NO: 651895 - DNA, 13 bp, D. melanogaster
tgacagccacaaa

SEQ ID NO: 651896 - DNA, 13 bp, D. melanogaster
tgacagctgaaaa

SEQ ID NO: 651897 - DNA, 13 bp, D. melanogaster
tgacagctgtcaa

SEQ ID NO: 651898 - DNA, 13 bp, D. melanogaster
tgacaggcagata

SEQ ID NO: 651899 - DNA, 13 bp, D. melanogaster
tgacagtgaaaat

SEQ ID NO: 651900 - DNA, 13 bp, D. melanogaster
tgacagttgattt

SEQ ID NO: 651901 - DNA, 13 bp, D. melanogaster
tgacagttttcca

SEQ ID NO: 651902 - DNA, 13 bp, D. melanogaster
tgacagttttgtg

SEQ ID NO: 651903 - DNA, 13 bp, D. melanogaster
tgacagttttttg

SEQ ID NO: 651904 - DNA, 13 bp, D. melanogaster
tgacatatttaca

SEQ ID NO: 651905 - DNA, 13 bp, D. melanogaster
tgacatatttttt

SEQ ID NO: 651906 - DNA, 13 bp, D. melanogaster
tgacatcaagtca

SEQ ID NO: 651907 - DNA, 13 bp, D. melanogaster
tgacatcattttg

SEQ ID NO: 651908 - DNA, 13 bp, D. melanogaster
tgacatgaaacgt

SEQ ID NO: 651909 - DNA, 13 bp, D. melanogaster
tgacatgtgtgtg

SEQ ID NO: 651910 - DNA, 13 bp, D. melanogaster
tgacattaaatca

SEQ ID NO: 651911 - DNA, 14 bp, D. melanogaster
tgacattaaatcaa

SEQ ID NO: 651912 - DNA, 13 bp, D. melanogaster
tgacattactgga

SEQ ID NO: 651913 - DNA, 15 bp, D. melanogaster
tgacattcccgtttc

SEQ ID NO: 651914 - DNA, 13 bp, D. melanogaster
tgacattcctagg

SEQ ID NO: 651915 - DNA, 13 bp, D. melanogaster
tgacattgatgtg

SEQ ID NO: 651916 - DNA, 13 bp, D. melanogaster
tgacattgcaatt

SEQ ID NO: 651917 - DNA, 14 bp, D. melanogaster
tgacattgcaattg

SEQ ID NO: 651918 - DNA, 13 bp, D. melanogaster
tgacattggcatt

SEQ ID NO: 651919 - DNA, 13 bp, D. melanogaster
tgacatttaaaaa

SEQ ID NO: 651920 - DNA, 13 bp, D. melanogaster
tgacatttaaatt

SEQ ID NO: 651921 - DNA, 13 bp, D. melanogaster
tgacatttattaa

SEQ ID NO: 651922 - DNA, 13 bp, D. melanogaster
tgacatttatttg

SEQ ID NO: 651923 - DNA, 13 bp, D. melanogaster
tgacatttcaatg

SEQ ID NO: 651924 - DNA, 13 bp, D. melanogaster
tgacatttggcat

SEQ ID NO: 651925 - DNA, 13 bp, D. melanogaster
tgacattttaatg

SEQ ID NO: 651926 - DNA, 13 bp, D. melanogaster
tgacattttctta

SEQ ID NO: 651927 - DNA, 13 bp, D. melanogaster
tgacatttttaat

SEQ ID NO: 651928 - DNA, 13 bp, D. melanogaster
tgacatttttatt

SEQ ID NO: 651929 - DNA, 14 bp, D. melanogaster
tgacatttttattg

SEQ ID NO: 651930 - DNA, 13 bp, D. melanogaster
tgacatttttgca

SEQ ID NO: 651931 - DNA, 13 bp, D. melanogaster
tgacatttttgtg

SEQ ID NO: 651932 - DNA, 13 bp, D. melanogaster
tgaccaaaaactg

SEQ ID NO: 651933 - DNA, 13 bp, D. melanogaster
tgaccaaaagaaa

SEQ ID NO: 651934 - DNA, 13 bp, D. melanogaster
tgaccaaaatcaa

SEQ ID NO: 651935 - DNA, 13 bp, D. melanogaster
tgaccaaacaaaa

SEQ ID NO: 651936 - DNA, 13 bp, D. melanogaster
tgaccaaagcaaa

SEQ ID NO: 651937 - DNA, 14 bp, D. melanogaster
tgaccaaagctggt

SEQ ID NO: 651938 - DNA, 13 bp, D. melanogaster
tgaccaactcgca

SEQ ID NO: 651939 - DNA, 15 bp, D. melanogaster
tgaccaactgcgttt

SEQ ID NO: 651940 - DNA, 13 bp, D. melanogaster
tgaccaacttcaa

SEQ ID NO: 651941 - DNA, 13 bp, D. melanogaster
tgaccaagaaagt

SEQ ID NO: 651942 - DNA, 13 bp, D. melanogaster
tgaccaagagcca

SEQ ID NO: 651943 - DNA, 13 bp, D. melanogaster
tgaccaatttccg

SEQ ID NO: 651944 - DNA, 13 bp, D. melanogaster
tgaccacaaaaaa

SEQ ID NO: 651945 - DNA, 13 bp, D. melanogaster
tgaccacaaaatg

SEQ ID NO: 651946 - DNA, 13 bp, D. melanogaster
tgaccacaacaaa

SEQ ID NO: 651947 - DNA, 13 bp, D. melanogaster
tgaccacaacgat

SEQ ID NO: 651948 - DNA, 13 bp, D. melanogaster
tgaccacagctgc

SEQ ID NO: 651949 - DNA, 13 bp, D. melanogaster
tgaccacattggc

SEQ ID NO: 651950 - DNA, 13 bp, D. melanogaster
tgaccacctctgt

SEQ ID NO: 651951 - DNA, 13 bp, D. melanogaster
tgaccacgcccac

SEQ ID NO: 651952 - DNA, 13 bp, D. melanogaster
tgaccacgccccc

SEQ ID NO: 651953 - DNA, 13 bp, D. melanogaster
tgaccagatcgac

SEQ ID NO: 651954 - DNA, 13 bp, D. melanogaster
tgaccagctgctt

SEQ ID NO: 651955 - DNA, 13 bp, D. melanogaster
tgaccataaaaaa

SEQ ID NO: 651956 - DNA, 13 bp, D. melanogaster
tgaccatgtccgt

SEQ ID NO: 651957 - DNA, 13 bp, D. melanogaster
tgaccatgtttcc

SEQ ID NO: 651958 - DNA, 13 bp, D. melanogaster
tgaccattacaaa

SEQ ID NO: 651959 - DNA, 13 bp, D. melanogaster
tgaccattttcat

SEQ ID NO: 651960 - DNA, 13 bp, D. melanogaster
tgaccatttttag

SEQ ID NO: 651961 - DNA, 13 bp, D. melanogaster
tgacccaaaaatt

SEQ ID NO: 651962 - DNA, 13 bp, D. melanogaster
tgacccaaataaa

SEQ ID NO: 651963 - DNA, 14 bp, D. melanogaster
tgacccaaataaat

SEQ ID NO: 651964 - DNA, 13 bp, D. melanogaster
tgacccacacaca

SEQ ID NO: 651965 - DNA, 13 bp, D. melanogaster
tgacccactgtgc

SEQ ID NO: 651966 - DNA, 13 bp, D. melanogaster
tgacccagttggc

SEQ ID NO: 651967 - DNA, 13 bp, D. melanogaster
tgaccccaaaaaa

SEQ ID NO: 651968 - DNA, 13 bp, D. melanogaster
tgacccccaaaaa

SEQ ID NO: 651969 - DNA, 13 bp, D. melanogaster
tgacccctgaccc

SEQ ID NO: 651970 - DNA, 14 bp, D. melanogaster
tgacccctgacccc

SEQ ID NO: 651971 - DNA, 13 bp, D. melanogaster
tgaccctcggact

SEQ ID NO: 651972 - DNA, 13 bp, D. melanogaster
tgaccgaccgacc

SEQ ID NO: 651973 - DNA, 13 bp, D. melanogaster
tgaccgctgctgt

SEQ ID NO: 651974 - DNA, 13 bp, D. melanogaster
tgacctaaatgaa

SEQ ID NO: 651975 - DNA, 13 bp, D. melanogaster
tgacctcctcttt

SEQ ID NO: 651976 - DNA, 13 bp, D. melanogaster
tgacctctgaccc

SEQ ID NO: 651977 - DNA, 13 bp, D. melanogaster
tgaccttgcagcc

SEQ ID NO: 651978 - DNA, 13 bp, D. melanogaster
tgacctttgtcgt

SEQ ID NO: 651979 - DNA, 13 bp, D. melanogaster
tgaccttttggcc

SEQ ID NO: 651980 - DNA, 13 bp, D. melanogaster
tgacgaacgccga

SEQ ID NO: 651981 - DNA, 13 bp, D. melanogaster
tgacgaagatcgc

SEQ ID NO: 651982 - DNA, 13 bp, D. melanogaster
tgacgacgacaac

SEQ ID NO: 651983 - DNA, 13 bp, D. melanogaster
tgacgaggaagat

SEQ ID NO: 651984 - DNA, 13 bp, D. melanogaster
tgacgaggcagag

SEQ ID NO: 651985 - DNA, 14 bp, D. melanogaster
tgacgatgacgatg

SEQ ID NO: 651986 - DNA, 13 bp, D. melanogaster
tgacgatgacgtt

SEQ ID NO: 651987 - DNA, 13 bp, D. melanogaster
tgacgatgatgac

SEQ ID NO: 651988 - DNA, 13 bp, D. melanogaster
tgacgatgatgag

SEQ ID NO: 651989 - DNA, 13 bp, D. melanogaster
tgacgatgatggc

SEQ ID NO: 651990 - DNA, 13 bp, D. melanogaster
tgacgatgtggca

SEQ ID NO: 651991 - DNA, 13 bp, D. melanogaster
tgacgctttcgct

SEQ ID NO: 651992 - DNA, 13 bp, D. melanogaster
tgacgcttttcaa

SEQ ID NO: 651993 - DNA, 13 bp, D. melanogaster
tgacggaaccgga

SEQ ID NO: 651994 - DNA, 13 bp, D. melanogaster
tgacggaagccac

SEQ ID NO: 651995 - DNA, 13 bp, D. melanogaster
tgacggcaatatt

SEQ ID NO: 651996 - DNA, 14 bp, D. melanogaster
tgacggccaaaatt

SEQ ID NO: 651997 - DNA, 13 bp, D. melanogaster
tgacgtatttggg

SEQ ID NO: 651998 - DNA, 13 bp, D. melanogaster
tgacgtggaatct

SEQ ID NO: 651999 - DNA, 14 bp, D. melanogaster
tgacgtttaacaag

SEQ ID NO: 652000 - DNA, 13 bp, D. melanogaster
tgactaaataaat

SEQ ID NO: 652001 - DNA, 16 bp, D. melanogaster
tgactaaatacctaaa

SEQ ID NO: 652002 - DNA, 13 bp, D. melanogaster
tgactataacgcc

SEQ ID NO: 652003 - DNA, 13 bp, D. melanogaster
tgactatcagata

SEQ ID NO: 652004 - DNA, 14 bp, D. melanogaster
tgactatcagatac

SEQ ID NO: 652005 - DNA, 13 bp, D. melanogaster
tgactatgactat

SEQ ID NO: 652006 - DNA, 13 bp, D. melanogaster
tgactattataat

SEQ ID NO: 652007 - DNA, 13 bp, D. melanogaster
tgactattttaaa

SEQ ID NO: 652008 - DNA, 13 bp, D. melanogaster
tgactattttgag

SEQ ID NO: 652009 - DNA, 13 bp, D. melanogaster
tgactcggagaat

SEQ ID NO: 652010 - DNA, 13 bp, D. melanogaster
tgactctactttt

SEQ ID NO: 652011 - DNA, 13 bp, D. melanogaster
tgactctgactct

SEQ ID NO: 652012 - DNA, 13 bp, D. melanogaster
tgactctggacgt

SEQ ID NO: 652013 - DNA, 13 bp, D. melanogaster
tgactctgtgctg

SEQ ID NO: 652014 - DNA, 13 bp, D. melanogaster
tgactcttgtttc

SEQ ID NO: 652015 - DNA, 13 bp, D. melanogaster
tgactgactgaca

SEQ ID NO: 652016 - DNA, 13 bp, D. melanogaster
tgactgactggca

SEQ ID NO: 652017 - DNA, 13 bp, D. melanogaster
tgactgattgatt

SEQ ID NO: 652018 - DNA, 13 bp, D. melanogaster
tgactgcatttaa

SEQ ID NO: 652019 - DNA, 13 bp, D. melanogaster
tgactgcctctca

SEQ ID NO: 652020 - DNA, 13 bp, D. melanogaster
tgactggagctga

SEQ ID NO: 652021 - DNA, 14 bp, D. melanogaster
tgactggtcgtggt

SEQ ID NO: 652022 - DNA, 13 bp, D. melanogaster
tgactgtgatatt

SEQ ID NO: 652023 - DNA, 13 bp, D. melanogaster
tgacttatatcct

SEQ ID NO: 652024 - DNA, 13 bp, D. melanogaster
tgacttatgaaga

SEQ ID NO: 652025 - DNA, 14 bp, D. melanogaster
tgacttccttctct

SEQ ID NO: 652026 - DNA, 13 bp, D. melanogaster
tgacttcttgcaa

SEQ ID NO: 652027 - DNA, 13 bp, D. melanogaster
tgacttggccaaa

SEQ ID NO: 652028 - DNA, 13 bp, D. melanogaster
tgacttggccaag

SEQ ID NO: 652029 - DNA, 13 bp, D. melanogaster
tgacttggctggc

SEQ ID NO: 652030 - DNA, 13 bp, D. melanogaster
tgactttaattgt

SEQ ID NO: 652031 - DNA, 13 bp, D. melanogaster
tgactttaatttg

SEQ ID NO: 652032 - DNA, 13 bp, D. melanogaster
tgactttataaaa

SEQ ID NO: 652033 - DNA, 13 bp, D. melanogaster
tgactttatactt

SEQ ID NO: 652034 - DNA, 13 bp, D. melanogaster
tgactttcatttg

SEQ ID NO: 652035 - DNA, 14 bp, D. melanogaster
tgactttcttgaag

SEQ ID NO: 652036 - DNA, 13 bp, D. melanogaster
tgactttgaactt

SEQ ID NO: 652037 - DNA, 13 bp, D. melanogaster
tgactttgacatt

SEQ ID NO: 652038 - DNA, 13 bp, D. melanogaster
tgactttgacttg

SEQ ID NO: 652039 - DNA, 14 bp, D. melanogaster
tgactttgactttg

SEQ ID NO: 652040 - DNA, 13 bp, D. melanogaster
tgactttgatttt

SEQ ID NO: 652041 - DNA, 13 bp, D. melanogaster
tgactttgccagc

SEQ ID NO: 652042 - DNA, 13 bp, D. melanogaster
tgactttgttgtt

SEQ ID NO: 652043 - DNA, 13 bp, D. melanogaster
tgactttgtttgg

SEQ ID NO: 652044 - DNA, 13 bp, D. melanogaster
tgacttttaaaat

SEQ ID NO: 652045 - DNA, 13 bp, D. melanogaster
tgacttttaatat

SEQ ID NO: 652046 - DNA, 14 bp, D. melanogaster
tgacttttaatata

SEQ ID NO: 652047 - DNA, 13 bp, D. melanogaster
tgacttttaatta

SEQ ID NO: 652048 - DNA, 13 bp, D. melanogaster
tgacttttgactt

SEQ ID NO: 652049 - DNA, 13 bp, D. melanogaster
tgacttttggttt

SEQ ID NO: 652050 - DNA, 13 bp, D. melanogaster
tgactttttaatg

SEQ ID NO: 652051 - DNA, 13 bp, D. melanogaster
tgagaaaaaaacg

SEQ ID NO: 652052 - DNA, 13 bp, D. melanogaster
tgagaaaaaactt

SEQ ID NO: 652053 - DNA, 13 bp, D. melanogaster
tgagaaaaaagtt

SEQ ID NO: 652054 - DNA, 13 bp, D. melanogaster
tgagaaaaaccaa

SEQ ID NO: 652055 - DNA, 13 bp, D. melanogaster
tgagaaaaactaa

SEQ ID NO: 652056 - DNA, 13 bp, D. melanogaster
tgagaaaaatatt

SEQ ID NO: 652057 - DNA, 13 bp, D. melanogaster
tgagaaaaatcaa

SEQ ID NO: 652058 - DNA, 13 bp, D. melanogaster
tgagaaaactttt

SEQ ID NO: 652059 - DNA, 13 bp, D. melanogaster
tgagaaaatatta

SEQ ID NO: 652060 - DNA, 13 bp, D. melanogaster
tgagaaaatgagg

SEQ ID NO: 652061 - DNA, 13 bp, D. melanogaster
tgagaaactgaga

SEQ ID NO: 652062 - DNA, 13 bp, D. melanogaster
tgagaaaggacag

SEQ ID NO: 652063 - DNA, 13 bp, D. melanogaster
tgagaaagttttt

SEQ ID NO: 652064 - DNA, 13 bp, D. melanogaster
tgagaaatatgaa

SEQ ID NO: 652065 - DNA, 13 bp, D. melanogaster
tgagaaatgagaa

SEQ ID NO: 652066 - DNA, 13 bp, D. melanogaster
tgagaaatgcatt

SEQ ID NO: 652067 - DNA, 13 bp, D. melanogaster
tgagaaattaaat

SEQ ID NO: 652068 - DNA, 13 bp, D. melanogaster
tgagaacaagaga

SEQ ID NO: 652069 - DNA, 13 bp, D. melanogaster
tgagaacaatttt

SEQ ID NO: 652070 - DNA, 14 bp, D. melanogaster
tgagaacacttttt

SEQ ID NO: 652071 - DNA, 13 bp, D. melanogaster
tgagaactgaaat

SEQ ID NO: 652072 - DNA, 14 bp, D. melanogaster
tgagaactggaatg

SEQ ID NO: 652073 - DNA, 13 bp, D. melanogaster
tgagaactttgct

SEQ ID NO: 652074 - DNA, 13 bp, D. melanogaster
tgagaagccaact

SEQ ID NO: 652075 - DNA, 13 bp, D. melanogaster
tgagaagtcgcat

SEQ ID NO: 652076 - DNA, 13 bp, D. melanogaster
tgagaatatttgt

SEQ ID NO: 652077 - DNA, 13 bp, D. melanogaster
tgagaatatttta

SEQ ID NO: 652078 - DNA, 13 bp, D. melanogaster
tgagaatcgagga

SEQ ID NO: 652079 - DNA, 14 bp, D. melanogaster
tgagaatgagaatg

SEQ ID NO: 652080 - DNA, 13 bp, D. melanogaster
tgagaatgatgat

SEQ ID NO: 652081 - DNA, 14 bp, D. melanogaster
tgagaatgggaatg

SEQ ID NO: 652082 - DNA, 13 bp, D. melanogaster
tgagaattgagaa

SEQ ID NO: 652083 - DNA, 13 bp, D. melanogaster
tgagaatttatgt

SEQ ID NO: 652084 - DNA, 13 bp, D. melanogaster
tgagaatttattt

SEQ ID NO: 652085 - DNA, 13 bp, D. melanogaster
tgagaatttggac

SEQ ID NO: 652086 - DNA, 13 bp, D. melanogaster
tgagaccgaaatt

SEQ ID NO: 652087 - DNA, 13 bp, D. melanogaster
tgagactgtcaag

SEQ ID NO: 652088 - DNA, 13 bp, D. melanogaster
tgagactttatta

SEQ ID NO: 652089 - DNA, 13 bp, D. melanogaster
tgagagaaatatt

SEQ ID NO: 652090 - DNA, 13 bp, D. melanogaster
tgagagagagagt

SEQ ID NO: 652091 - DNA, 13 bp, D. melanogaster
tgagagagcgaga

SEQ ID NO: 652092 - DNA, 13 bp, D. melanogaster
tgagagatccggc

SEQ ID NO: 652093 - DNA, 14 bp, D. melanogaster
tgagagcatcagca

SEQ ID NO: 652094 - DNA, 13 bp, D. melanogaster
tgagagccagtac

SEQ ID NO: 652095 - DNA, 14 bp, D. melanogaster
tgagagctcggagc

SEQ ID NO: 652096 - DNA, 14 bp, D. melanogaster
tgagagtcccgact

SEQ ID NO: 652097 - DNA, 14 bp, D. melanogaster
tgagagtgtgtgtg

SEQ ID NO: 652098 - DNA, 13 bp, D. melanogaster
tgagagtgtttgg

SEQ ID NO: 652099 - DNA, 13 bp, D. melanogaster
tgagataagcaca

SEQ ID NO: 652100 - DNA, 13 bp, D. melanogaster
tgagataattgag

SEQ ID NO: 652101 - DNA, 13 bp, D. melanogaster
tgagatacaaatt

SEQ ID NO: 652102 - DNA, 14 bp, D. melanogaster
tgagatacagatac

SEQ ID NO: 652103 - DNA, 13 bp, D. melanogaster
tgagatacattta

SEQ ID NO: 652104 - DNA, 13 bp, D. melanogaster
tgagatacatttt

SEQ ID NO: 652105 - DNA, 13 bp, D. melanogaster
tgagatattcgaa

SEQ ID NO: 652106 - DNA, 13 bp, D. melanogaster
tgagatattctac

SEQ ID NO: 652107 - DNA, 14 bp, D. melanogaster
tgagatattctact

SEQ ID NO: 652108 - DNA, 13 bp, D. melanogaster
tgagatctcagga

SEQ ID NO: 652109 - DNA, 13 bp, D. melanogaster
tgagatgagacag

SEQ ID NO: 652110 - DNA, 13 bp, D. melanogaster
tgagatgagtttc

SEQ ID NO: 652111 - DNA, 13 bp, D. melanogaster
tgagatgatgatg

SEQ ID NO: 652112 - DNA, 13 bp, D. melanogaster
tgagatggccaag

SEQ ID NO: 652113 - DNA, 13 bp, D. melanogaster
tgagattaaaatc

SEQ ID NO: 652114 - DNA, 13 bp, D. melanogaster
tgagattcagcct

SEQ ID NO: 652115 - DNA, 13 bp, D. melanogaster
tgagattgagatt

SEQ ID NO: 652116 - DNA, 13 bp, D. melanogaster
tgagatttattta

SEQ ID NO: 652117 - DNA, 13 bp, D. melanogaster
tgagattttaaat

SEQ ID NO: 652118 - DNA, 14 bp, D. melanogaster
tgagattttaaatg

SEQ ID NO: 652119 - DNA, 13 bp, D. melanogaster
tgagcaaaaaata

SEQ ID NO: 652120 - DNA, 13 bp, D. melanogaster
tgagcaaaaaatt

SEQ ID NO: 652121 - DNA, 13 bp, D. melanogaster
tgagcaaaaacaa

SEQ ID NO: 652122 - DNA, 13 bp, D. melanogaster
tgagcaaaacaaa

SEQ ID NO: 652123 - DNA, 13 bp, D. melanogaster
tgagcaaaacttt

SEQ ID NO: 652124 - DNA, 13 bp, D. melanogaster
tgagcaaaatgga

SEQ ID NO: 652125 - DNA, 13 bp, D. melanogaster
tgagcaaacaaaa

SEQ ID NO: 652126 - DNA, 14 bp, D. melanogaster
tgagcaaacaaaaa

SEQ ID NO: 652127 - DNA, 13 bp, D. melanogaster
tgagcaaacaatt

SEQ ID NO: 652128 - DNA, 13 bp, D. melanogaster
tgagcaaacattt

SEQ ID NO: 652129 - DNA, 13 bp, D. melanogaster
tgagcaaagaaaa

SEQ ID NO: 652130 - DNA, 13 bp, D. melanogaster
tgagcaaataaaa

SEQ ID NO: 652131 - DNA, 13 bp, D. melanogaster
tgagcaacagaaa

SEQ ID NO: 652132 - DNA, 13 bp, D. melanogaster
tgagcaacgtttt

SEQ ID NO: 652133 - DNA, 13 bp, D. melanogaster
tgagcaactacat

SEQ ID NO: 652134 - DNA, 13 bp, D. melanogaster
tgagcaacttaat

SEQ ID NO: 652135 - DNA, 13 bp, D. melanogaster
tgagcaagaaaaa

SEQ ID NO: 652136 - DNA, 13 bp, D. melanogaster
tgagcaagaaatt

SEQ ID NO: 652137 - DNA, 13 bp, D. melanogaster
tgagcaataaaaa

SEQ ID NO: 652138 - DNA, 13 bp, D. melanogaster
tgagcaattaata

SEQ ID NO: 652139 - DNA, 13 bp, D. melanogaster
tgagcaatttgca

SEQ ID NO: 652140 - DNA, 13 bp, D. melanogaster
tgagcaattttca

SEQ ID NO: 652141 - DNA, 13 bp, D. melanogaster
tgagcaattttta

SEQ ID NO: 652142 - DNA, 13 bp, D. melanogaster
tgagcagaaaaaa

SEQ ID NO: 652143 - DNA, 13 bp, D. melanogaster
tgagcagcaacat

SEQ ID NO: 652144 - DNA, 13 bp, D. melanogaster
tgagcagcagaaa

SEQ ID NO: 652145 - DNA, 14 bp, D. melanogaster
tgagcagcagcagc

SEQ ID NO: 652146 - DNA, 13 bp, D. melanogaster
tgagcagccaaaa

SEQ ID NO: 652147 - DNA, 13 bp, D. melanogaster
tgagcagcctcac

SEQ ID NO: 652148 - DNA, 13 bp, D. melanogaster
tgagcagctaatt

SEQ ID NO: 652149 - DNA, 14 bp, D. melanogaster
tgagcagctaatta

SEQ ID NO: 652150 - DNA, 13 bp, D. melanogaster
tgagcagctattt

SEQ ID NO: 652151 - DNA, 13 bp, D. melanogaster
tgagcaggatgtg

SEQ ID NO: 652152 - DNA, 15 bp, D. melanogaster
tgagcataatgaaca

SEQ ID NO: 652153 - DNA, 13 bp, D. melanogaster
tgagcatatgttt

SEQ ID NO: 652154 - DNA, 13 bp, D. melanogaster
tgagcatcaggat

SEQ ID NO: 652155 - DNA, 13 bp, D. melanogaster
tgagcatcgaagt

SEQ ID NO: 652156 - DNA, 13 bp, D. melanogaster
tgagcattttaat

SEQ ID NO: 652157 - DNA, 13 bp, D. melanogaster
tgagccattggct

SEQ ID NO: 652158 - DNA, 13 bp, D. melanogaster
tgagccgaaagag

SEQ ID NO: 652159 - DNA, 14 bp, D. melanogaster
tgagccgaaagaga

SEQ ID NO: 652160 - DNA, 13 bp, D. melanogaster
tgagccgcctgtc

SEQ ID NO: 652161 - DNA, 13 bp, D. melanogaster
tgagcctttgctc

SEQ ID NO: 652162 - DNA, 13 bp, D. melanogaster
tgagcgaaaaact

SEQ ID NO: 652163 - DNA, 14 bp, D. melanogaster
tgagcgaaaattgc

SEQ ID NO: 652164 - DNA, 13 bp, D. melanogaster
tgagcgaaagaga

SEQ ID NO: 652165 - DNA, 13 bp, D. melanogaster
tgagcgagcgaga

SEQ ID NO: 652166 - DNA, 14 bp, D. melanogaster
tgagcgagtgtgtg

SEQ ID NO: 652167 - DNA, 13 bp, D. melanogaster
tgagcgggacttt

SEQ ID NO: 652168 - DNA, 13 bp, D. melanogaster
tgagcgtgtgtgc

SEQ ID NO: 652169 - DNA, 13 bp, D. melanogaster
tgagctattcaat

SEQ ID NO: 652170 - DNA, 13 bp, D. melanogaster
tgagctcgtaatt

SEQ ID NO: 652171 - DNA, 13 bp, D. melanogaster
tgagctcttgtgt

SEQ ID NO: 652172 - DNA, 13 bp, D. melanogaster
tgagctgacagaa

SEQ ID NO: 652173 - DNA, 13 bp, D. melanogaster
tgagctgcaaaaa

SEQ ID NO: 652174 - DNA, 13 bp, D. melanogaster
tgagctggaaaag

SEQ ID NO: 652175 - DNA, 13 bp, D. melanogaster
tgagctgtaattc

SEQ ID NO: 652176 - DNA, 13 bp, D. melanogaster
tgagcttagcttt

SEQ ID NO: 652177 - DNA, 13 bp, D. melanogaster
tgagcttatttac

SEQ ID NO: 652178 - DNA, 13 bp, D. melanogaster
tgagcttcaaaaa

SEQ ID NO: 652179 - DNA, 13 bp, D. melanogaster
tgagcttctaatg

SEQ ID NO: 652180 - DNA, 13 bp, D. melanogaster
tgagcttgcaatt

SEQ ID NO: 652181 - DNA, 13 bp, D. melanogaster
tgagctttatttt

SEQ ID NO: 652182 - DNA, 13 bp, D. melanogaster
tgaggaaaaacaa

SEQ ID NO: 652183 - DNA, 13 bp, D. melanogaster
tgaggaaaagtat

SEQ ID NO: 652184 - DNA, 13 bp, D. melanogaster
tgaggaactccag

SEQ ID NO: 652185 - DNA, 13 bp, D. melanogaster
tgaggagcttcgg

SEQ ID NO: 652186 - DNA, 13 bp, D. melanogaster
tgaggaggcctct

SEQ ID NO: 652187 - DNA, 13 bp, D. melanogaster
tgaggatatcgaa

SEQ ID NO: 652188 - DNA, 14 bp, D. melanogaster
tgaggatatcgaaa

SEQ ID NO: 652189 - DNA, 14 bp, D. melanogaster
tgaggatggggatg

SEQ ID NO: 652190 - DNA, 13 bp, D. melanogaster
tgaggatgtggat

SEQ ID NO: 652191 - DNA, 13 bp, D. melanogaster
tgaggcaaataaa

SEQ ID NO: 652192 - DNA, 14 bp, D. melanogaster
tgaggcaaatcaaa

SEQ ID NO: 652193 - DNA, 13 bp, D. melanogaster
tgaggcacacaca

SEQ ID NO: 652194 - DNA, 13 bp, D. melanogaster
tgaggcccaaaaa

SEQ ID NO: 652195 - DNA, 15 bp, D. melanogaster
tgaggctgctcagct

SEQ ID NO: 652196 - DNA, 13 bp, D. melanogaster
tgagggaatttat

SEQ ID NO: 652197 - DNA, 13 bp, D. melanogaster
tgagggactcgct

SEQ ID NO: 652198 - DNA, 13 bp, D. melanogaster
tgagggcgtggca

SEQ ID NO: 652199 - DNA, 13 bp, D. melanogaster
tgagggtggtgtc

SEQ ID NO: 652200 - DNA, 13 bp, D. melanogaster
tgaggtaatcaag

SEQ ID NO: 652201 - DNA, 15 bp, D. melanogaster
tgaggtcctgccggg

SEQ ID NO: 652202 - DNA, 13 bp, D. melanogaster
tgagtaaatacat

SEQ ID NO: 652203 - DNA, 13 bp, D. melanogaster
tgagtaatttttg

SEQ ID NO: 652204 - DNA, 13 bp, D. melanogaster
tgagtacaacaaa

SEQ ID NO: 652205 - DNA, 13 bp, D. melanogaster
tgagtagagtgtc

SEQ ID NO: 652206 - DNA, 13 bp, D. melanogaster
tgagtaggcatgt

SEQ ID NO: 652207 - DNA, 13 bp, D. melanogaster
tgagtatatatat

SEQ ID NO: 652208 - DNA, 14 bp, D. melanogaster
tgagtatatatata

SEQ ID NO: 652209 - DNA, 13 bp, D. melanogaster
tgagtatctgata

SEQ ID NO: 652210 - DNA, 13 bp, D. melanogaster
tgagtatgcaaat

SEQ ID NO: 652211 - DNA, 13 bp, D. melanogaster
tgagtatgttcca

SEQ ID NO: 652212 - DNA, 13 bp, D. melanogaster
tgagtccagatat

SEQ ID NO: 652213 - DNA, 13 bp, D. melanogaster
tgagtcgagccaa

SEQ ID NO: 652214 - DNA, 14 bp, D. melanogaster
tgagtcgagccaat

SEQ ID NO: 652215 - DNA, 13 bp, D. melanogaster
tgagtgaaagaca

SEQ ID NO: 652216 - DNA, 14 bp, D. melanogaster
tgagtgaatgagtg

SEQ ID NO: 652217 - DNA, 13 bp, D. melanogaster
tgagtgactgact

SEQ ID NO: 652218 - DNA, 14 bp, D. melanogaster
tgagtgactgactg

SEQ ID NO: 652219 - DNA, 13 bp, D. melanogaster
tgagtgagagaga

SEQ ID NO: 652220 - DNA, 14 bp, D. melanogaster
tgagtgagagagag

SEQ ID NO: 652221 - DNA, 14 bp, D. melanogaster
tgagtgagtgagtg

SEQ ID NO: 652222 - DNA, 13 bp, D. melanogaster
tgagtgagtgatt

SEQ ID NO: 652223 - DNA, 13 bp, D. melanogaster
tgagtgagttgtg

SEQ ID NO: 652224 - DNA, 13 bp, D. melanogaster
tgagtgagttttc

SEQ ID NO: 652225 - DNA, 14 bp, D. melanogaster
tgagtgagttttct

SEQ ID NO: 652226 - DNA, 13 bp, D. melanogaster
tgagtgcaagtgc

SEQ ID NO: 652227 - DNA, 13 bp, D. melanogaster
tgagtgcataaat

SEQ ID NO: 652228 - DNA, 13 bp, D. melanogaster
tgagtgcctctcg

SEQ ID NO: 652229 - DNA, 13 bp, D. melanogaster
tgagtgcgagtgc

SEQ ID NO: 652230 - DNA, 13 bp, D. melanogaster
tgagtggaaaaaa

SEQ ID NO: 652231 - DNA, 13 bp, D. melanogaster
tgagtggaaaact

SEQ ID NO: 652232 - DNA, 13 bp, D. melanogaster
tgagtggagtgga

SEQ ID NO: 652233 - DNA, 13 bp, D. melanogaster
tgagtgggcgtgg

SEQ ID NO: 652234 - DNA, 14 bp, D. melanogaster
tgagtgggcgtggc

SEQ ID NO: 652235 - DNA, 13 bp, D. melanogaster
tgagtggtgagtg

SEQ ID NO: 652236 - DNA, 13 bp, D. melanogaster
tgagtgtatgtgt

SEQ ID NO: 652237 - DNA, 14 bp, D. melanogaster
tgagtgtatgtgtg

SEQ ID NO: 652238 - DNA, 13 bp, D. melanogaster
tgagtgtgaaaat

SEQ ID NO: 652239 - DNA, 13 bp, D. melanogaster
tgagtgtgagtgg

SEQ ID NO: 652240 - DNA, 15 bp, D. melanogaster
tgagtgtgagtgtgt

SEQ ID NO: 652241 - DNA, 13 bp, D. melanogaster
tgagtgtgcgttt

SEQ ID NO: 652242 - DNA, 14 bp, D. melanogaster
tgagtgtgtgagtg

SEQ ID NO: 652243 - DNA, 13 bp, D. melanogaster
tgagtgtgtgcat

SEQ ID NO: 652244 - DNA, 13 bp, D. melanogaster
tgagtgtgtggca

SEQ ID NO: 652245 - DNA, 13 bp, D. melanogaster
tgagtgtgtgtgc

SEQ ID NO: 652246 - DNA, 13 bp, D. melanogaster
tgagtgtgtgtta

SEQ ID NO: 652247 - DNA, 13 bp, D. melanogaster
tgagttatggcca

SEQ ID NO: 652248 - DNA, 13 bp, D. melanogaster
tgagttgaaaatg

SEQ ID NO: 652249 - DNA, 13 bp, D. melanogaster
tgagttgaaactt

SEQ ID NO: 652250 - DNA, 14 bp, D. melanogaster
tgagttgagttgag

SEQ ID NO: 652251 - DNA, 13 bp, D. melanogaster
tgagttgagttgc

SEQ ID NO: 652252 - DNA, 13 bp, D. melanogaster
tgagttgagtttt

SEQ ID NO: 652253 - DNA, 13 bp, D. melanogaster
tgagttggacttt

SEQ ID NO: 652254 - DNA, 13 bp, D. melanogaster
tgagtttaatata

SEQ ID NO: 652255 - DNA, 13 bp, D. melanogaster
tgagtttaatgaa

SEQ ID NO: 652256 - DNA, 13 bp, D. melanogaster
tgagtttcagttc

SEQ ID NO: 652257 - DNA, 13 bp, D. melanogaster
tgagtttcgattt

SEQ ID NO: 652258 - DNA, 13 bp, D. melanogaster
tgagtttcgtttt

SEQ ID NO: 652259 - DNA, 13 bp, D. melanogaster
tgagtttctgttg

SEQ ID NO: 652260 - DNA, 13 bp, D. melanogaster
tgagtttgaacat

SEQ ID NO: 652261 - DNA, 13 bp, D. melanogaster
tgagtttgacggc

SEQ ID NO: 652262 - DNA, 13 bp, D. melanogaster
tgagtttgtaaac

SEQ ID NO: 652263 - DNA, 14 bp, D. melanogaster
tgagttttcaattt

SEQ ID NO: 652264 - DNA, 14 bp, D. melanogaster
tgagttttgaactt

SEQ ID NO: 652265 - DNA, 13 bp, D. melanogaster
tgagtttttgaaa

SEQ ID NO: 652266 - DNA, 13 bp, D. melanogaster
tgagtttttgtaa

SEQ ID NO: 652267 - DNA, 13 bp, D. melanogaster
tgagttttttgcc

SEQ ID NO: 652268 - DNA, 13 bp, D. melanogaster
tgataaaaagtta

SEQ ID NO: 652269 - DNA, 13 bp, D. melanogaster
tgataaaacgtct

SEQ ID NO: 652270 - DNA, 14 bp, D. melanogaster
tgataaaatagcaa

SEQ ID NO: 652271 - DNA, 13 bp, D. melanogaster
tgataaacaaatt

SEQ ID NO: 652272 - DNA, 13 bp, D. melanogaster
tgataaacataaa

SEQ ID NO: 652273 - DNA, 13 bp, D. melanogaster
tgataaacttttt

SEQ ID NO: 652274 - DNA, 13 bp, D. melanogaster
tgataaatacaaa

SEQ ID NO: 652275 - DNA, 13 bp, D. melanogaster
tgataaatatgta

SEQ ID NO: 652276 - DNA, 13 bp, D. melanogaster
tgataaatcattt

SEQ ID NO: 652277 - DNA, 13 bp, D. melanogaster
tgataaatctgct

SEQ ID NO: 652278 - DNA, 13 bp, D. melanogaster
tgataaatgaaat

SEQ ID NO: 652279 - DNA, 13 bp, D. melanogaster
tgataaatgattt

SEQ ID NO: 652280 - DNA, 13 bp, D. melanogaster
tgataaatgcaat

SEQ ID NO: 652281 - DNA, 13 bp, D. melanogaster
tgataaatgccaa

SEQ ID NO: 652282 - DNA, 13 bp, D. melanogaster
tgataaatgttaa

SEQ ID NO: 652283 - DNA, 13 bp, D. melanogaster
tgataaattaaac

SEQ ID NO: 652284 - DNA, 13 bp, D. melanogaster
tgataaattctat

SEQ ID NO: 652285 - DNA, 13 bp, D. melanogaster
tgataaattgaaa

SEQ ID NO: 652286 - DNA, 13 bp, D. melanogaster
tgataacaataat

SEQ ID NO: 652287 - DNA, 13 bp, D. melanogaster
tgataacacaata

SEQ ID NO: 652288 - DNA, 14 bp, D. melanogaster
tgataacattttaa

SEQ ID NO: 652289 - DNA, 13 bp, D. melanogaster
tgataacattttg

SEQ ID NO: 652290 - DNA, 13 bp, D. melanogaster
tgataaccaagta

SEQ ID NO: 652291 - DNA, 13 bp, D. melanogaster
tgataacgcccct

SEQ ID NO: 652292 - DNA, 13 bp, D. melanogaster
tgataactgttta

SEQ ID NO: 652293 - DNA, 13 bp, D. melanogaster
tgataagaaatgt

SEQ ID NO: 652294 - DNA, 13 bp, D. melanogaster
tgataagcaaaag

SEQ ID NO: 652295 - DNA, 13 bp, D. melanogaster
tgataagcaaaat

SEQ ID NO: 652296 - DNA, 13 bp, D. melanogaster
tgataagcaaaca

SEQ ID NO: 652297 - DNA, 13 bp, D. melanogaster
tgataataataag

SEQ ID NO: 652298 - DNA, 14 bp, D. melanogaster
tgataatagaacca

SEQ ID NO: 652299 - DNA, 13 bp, D. melanogaster
tgataatagtttc

SEQ ID NO: 652300 - DNA, 13 bp, D. melanogaster
tgataatatgtac

SEQ ID NO: 652301 - DNA, 13 bp, D. melanogaster
tgataatatttgg

SEQ ID NO: 652302 - DNA, 13 bp, D. melanogaster
tgataatgacgat

SEQ ID NO: 652303 - DNA, 13 bp, D. melanogaster
tgataatgataat

SEQ ID NO: 652304 - DNA, 13 bp, D. melanogaster
tgataatgatgat

SEQ ID NO: 652305 - DNA, 13 bp, D. melanogaster
tgataatgattat

SEQ ID NO: 652306 - DNA, 13 bp, D. melanogaster
tgataatgatttt

SEQ ID NO: 652307 - DNA, 13 bp, D. melanogaster
tgataatggccaa

SEQ ID NO: 652308 - DNA, 13 bp, D. melanogaster
tgataattgaaaa

SEQ ID NO: 652309 - DNA, 13 bp, D. melanogaster
tgataattgataa

SEQ ID NO: 652310 - DNA, 13 bp, D. melanogaster
tgataattgcaaa

SEQ ID NO: 652311 - DNA, 13 bp, D. melanogaster
tgataatttcatt

SEQ ID NO: 652312 - DNA, 13 bp, D. melanogaster
tgatacaaatgct

SEQ ID NO: 652313 - DNA, 13 bp, D. melanogaster
tgatacatatata

SEQ ID NO: 652314 - DNA, 13 bp, D. melanogaster
tgatacgaaaaaa

SEQ ID NO: 652315 - DNA, 13 bp, D. melanogaster
tgatacggattgt

SEQ ID NO: 652316 - DNA, 13 bp, D. melanogaster
tgatactgatcaa

SEQ ID NO: 652317 - DNA, 13 bp, D. melanogaster
tgatagaaatatt

SEQ ID NO: 652318 - DNA, 13 bp, D. melanogaster
tgatagcagacat

SEQ ID NO: 652319 - DNA, 13 bp, D. melanogaster
tgataggaatgga

SEQ ID NO: 652320 - DNA, 13 bp, D. melanogaster
tgatagtcgggga

SEQ ID NO: 652321 - DNA, 13 bp, D. melanogaster
tgatagtggccta

SEQ ID NO: 652322 - DNA, 13 bp, D. melanogaster
tgatagtggctct

SEQ ID NO: 652323 - DNA, 13 bp, D. melanogaster
tgatataatgttt

SEQ ID NO: 652324 - DNA, 13 bp, D. melanogaster
tgatatacaaata

SEQ ID NO: 652325 - DNA, 14 bp, D. melanogaster
tgatatacaaataa

SEQ ID NO: 652326 - DNA, 13 bp, D. melanogaster
tgatatacataca

SEQ ID NO: 652327 - DNA, 13 bp, D. melanogaster
tgatatagtcatc

SEQ ID NO: 652328 - DNA, 14 bp, D. melanogaster
tgatatatacatat

SEQ ID NO: 652329 - DNA, 13 bp, D. melanogaster
tgatatatatatg

SEQ ID NO: 652330 - DNA, 13 bp, D. melanogaster
tgatatatatgat

SEQ ID NO: 652331 - DNA, 13 bp, D. melanogaster
tgatatatgaaat

SEQ ID NO: 652332 - DNA, 13 bp, D. melanogaster
tgatatatgatat

SEQ ID NO: 652333 - DNA, 13 bp, D. melanogaster
tgatatatgtaaa

SEQ ID NO: 652334 - DNA, 13 bp, D. melanogaster
tgatatatgtaca

SEQ ID NO: 652335 - DNA, 13 bp, D. melanogaster
tgatatcattcaa

SEQ ID NO: 652336 - DNA, 13 bp, D. melanogaster
tgatatgaatggc

SEQ ID NO: 652337 - DNA, 13 bp, D. melanogaster
tgatatgatattt

SEQ ID NO: 652338 - DNA, 14 bp, D. melanogaster
tgatatgatgatat

SEQ ID NO: 652339 - DNA, 13 bp, D. melanogaster
tgatatgatgcac

SEQ ID NO: 652340 - DNA, 13 bp, D. melanogaster
tgatatgcaaata

SEQ ID NO: 652341 - DNA, 13 bp, D. melanogaster
tgatattaaaatg

SEQ ID NO: 652342 - DNA, 13 bp, D. melanogaster
tgatattaatttc

SEQ ID NO: 652343 - DNA, 13 bp, D. melanogaster
tgatattcaaata

SEQ ID NO: 652344 - DNA, 13 bp, D. melanogaster
tgatattcaaatt

SEQ ID NO: 652345 - DNA, 13 bp, D. melanogaster
tgatattcagtta

SEQ ID NO: 652346 - DNA, 13 bp, D. melanogaster
tgatattgaataa

SEQ ID NO: 652347 - DNA, 13 bp, D. melanogaster
tgatattgatata

SEQ ID NO: 652348 - DNA, 13 bp, D. melanogaster
tgatattgattga

SEQ ID NO: 652349 - DNA, 13 bp, D. melanogaster
tgatattgcaatt

SEQ ID NO: 652350 - DNA, 13 bp, D. melanogaster
tgatattgtatgc

SEQ ID NO: 652351 - DNA, 13 bp, D. melanogaster
tgatatttatagt

SEQ ID NO: 652352 - DNA, 13 bp, D. melanogaster
tgatatttgatat

SEQ ID NO: 652353 - DNA, 13 bp, D. melanogaster
tgatatttgcttt

SEQ ID NO: 652354 - DNA, 13 bp, D. melanogaster
tgatattttcgaa

SEQ ID NO: 652355 - DNA, 14 bp, D. melanogaster
tgatattttcgaac

SEQ ID NO: 652356 - DNA, 13 bp, D. melanogaster
tgatattttggac

SEQ ID NO: 652357 - DNA, 13 bp, D. melanogaster
tgatatttttaga

SEQ ID NO: 652358 - DNA, 13 bp, D. melanogaster
tgatatttttcat

SEQ ID NO: 652359 - DNA, 13 bp, D. melanogaster
tgatatttttcca

SEQ ID NO: 652360 - DNA, 13 bp, D. melanogaster
tgatcaaaaactt

SEQ ID NO: 652361 - DNA, 14 bp, D. melanogaster
tgatcaaaaactta

SEQ ID NO: 652362 - DNA, 13 bp, D. melanogaster
tgatcaaaaaggg

SEQ ID NO: 652363 - DNA, 14 bp, D. melanogaster
tgatcaaaactcag

SEQ ID NO: 652364 - DNA, 13 bp, D. melanogaster
tgatcaaaatacc

SEQ ID NO: 652365 - DNA, 13 bp, D. melanogaster
tgatcaaaatatt

SEQ ID NO: 652366 - DNA, 13 bp, D. melanogaster
tgatcaaattaaa

SEQ ID NO: 652367 - DNA, 13 bp, D. melanogaster
tgatcaacaaaga

SEQ ID NO: 652368 - DNA, 13 bp, D. melanogaster
tgatcaacaagct

SEQ ID NO: 652369 - DNA, 13 bp, D. melanogaster
tgatcaacattaa

SEQ ID NO: 652370 - DNA, 13 bp, D. melanogaster
tgatcaactgtga

SEQ ID NO: 652371 - DNA, 13 bp, D. melanogaster
tgatcaagaatat

SEQ ID NO: 652372 - DNA, 14 bp, D. melanogaster
tgatcaagaatata

SEQ ID NO: 652373 - DNA, 14 bp, D. melanogaster
tgatcaagaatatg

SEQ ID NO: 652374 - DNA, 13 bp, D. melanogaster
tgatcaagaattt

SEQ ID NO: 652375 - DNA, 13 bp, D. melanogaster
tgatcaataatat

SEQ ID NO: 652376 - DNA, 14 bp, D. melanogaster
tgatcaatgaaaat

SEQ ID NO: 652377 - DNA, 13 bp, D. melanogaster
tgatcaattttaa

SEQ ID NO: 652378 - DNA, 13 bp, D. melanogaster
tgatcaccaccac

SEQ ID NO: 652379 - DNA, 13 bp, D. melanogaster
tgatcaccatgcc

SEQ ID NO: 652380 - DNA, 13 bp, D. melanogaster
tgatcagaaaaaa

SEQ ID NO: 652381 - DNA, 15 bp, D. melanogaster
tgatcagataaaaga

SEQ ID NO: 652382 - DNA, 13 bp, D. melanogaster
tgatcagcgtttg

SEQ ID NO: 652383 - DNA, 13 bp, D. melanogaster
tgatcaggaatat

SEQ ID NO: 652384 - DNA, 13 bp, D. melanogaster
tgatcaggatcaa

SEQ ID NO: 652385 - DNA, 14 bp, D. melanogaster
tgatcaggatcaat

SEQ ID NO: 652386 - DNA, 13 bp, D. melanogaster
tgatcaggatcac

SEQ ID NO: 652387 - DNA, 13 bp, D. melanogaster
tgatcagtgatca

SEQ ID NO: 652388 - DNA, 13 bp, D. melanogaster
tgatcatattaat

SEQ ID NO: 652389 - DNA, 13 bp, D. melanogaster
tgatcatccagct

SEQ ID NO: 652390 - DNA, 14 bp, D. melanogaster
tgatcatccagctg

SEQ ID NO: 652391 - DNA, 13 bp, D. melanogaster
tgatcatgtctcg

SEQ ID NO: 652392 - DNA, 13 bp, D. melanogaster
tgatcatttccgg

SEQ ID NO: 652393 - DNA, 13 bp, D. melanogaster
tgatccagaaacc

SEQ ID NO: 652394 - DNA, 13 bp, D. melanogaster
tgatccagcattt

SEQ ID NO: 652395 - DNA, 13 bp, D. melanogaster
tgatcctgatcaa

SEQ ID NO: 652396 - DNA, 14 bp, D. melanogaster
tgatcctgatcaaa

SEQ ID NO: 652397 - DNA, 14 bp, D. melanogaster
tgatcctgatcaag

SEQ ID NO: 652398 - DNA, 13 bp, D. melanogaster
tgatcctgatcag

SEQ ID NO: 652399 - DNA, 13 bp, D. melanogaster
tgatcctgatcat

SEQ ID NO: 652400 - DNA, 13 bp, D. melanogaster
tgatcgagataac

SEQ ID NO: 652401 - DNA, 13 bp, D. melanogaster
tgatcgagggtgg

SEQ ID NO: 652402 - DNA, 13 bp, D. melanogaster
tgatcgatgtgta

SEQ ID NO: 652403 - DNA, 14 bp, D. melanogaster
tgatcgatttattg

SEQ ID NO: 652404 - DNA, 13 bp, D. melanogaster
tgatcgctgatcg

SEQ ID NO: 652405 - DNA, 13 bp, D. melanogaster
tgatcgtcgtcct

SEQ ID NO: 652406 - DNA, 13 bp, D. melanogaster
tgatcgtgatttt

SEQ ID NO: 652407 - DNA, 13 bp, D. melanogaster
tgatctaatcgaa

SEQ ID NO: 652408 - DNA, 13 bp, D. melanogaster
tgatctacaaagg

SEQ ID NO: 652409 - DNA, 13 bp, D. melanogaster
tgatctatgatca

SEQ ID NO: 652410 - DNA, 13 bp, D. melanogaster
tgatctccagatc

SEQ ID NO: 652411 - DNA, 13 bp, D. melanogaster
tgatctcctttag

SEQ ID NO: 652412 - DNA, 13 bp, D. melanogaster
tgatctgagcttg

SEQ ID NO: 652413 - DNA, 13 bp, D. melanogaster
tgatctgcgtttc

SEQ ID NO: 652414 - DNA, 13 bp, D. melanogaster
tgatctggcaacg

SEQ ID NO: 652415 - DNA, 14 bp, D. melanogaster
tgatctggcaacgc

SEQ ID NO: 652416 - DNA, 13 bp, D. melanogaster
tgatctgtaatga

SEQ ID NO: 652417 - DNA, 13 bp, D. melanogaster
tgatctttgatct

SEQ ID NO: 652418 - DNA, 13 bp, D. melanogaster
tgatgaaaaatta

SEQ ID NO: 652419 - DNA, 13 bp, D. melanogaster
tgatgaaataata

SEQ ID NO: 652420 - DNA, 13 bp, D. melanogaster
tgatgaaattcaa

SEQ ID NO: 652421 - DNA, 13 bp, D. melanogaster
tgatgaaccgcca

SEQ ID NO: 652422 - DNA, 13 bp, D. melanogaster
tgatgaactccaa

SEQ ID NO: 652423 - DNA, 13 bp, D. melanogaster
tgatgaagaaaga

SEQ ID NO: 652424 - DNA, 13 bp, D. melanogaster
tgatgaagatcat

SEQ ID NO: 652425 - DNA, 13 bp, D. melanogaster
tgatgaaggcaaa

SEQ ID NO: 652426 - DNA, 13 bp, D. melanogaster
tgatgaattcctt

SEQ ID NO: 652427 - DNA, 13 bp, D. melanogaster
tgatgacatttta

SEQ ID NO: 652428 - DNA, 13 bp, D. melanogaster
tgatgacgatgat

SEQ ID NO: 652429 - DNA, 14 bp, D. melanogaster
tgatgacgatgatg

SEQ ID NO: 652430 - DNA, 13 bp, D. melanogaster
tgatgacgatgct

SEQ ID NO: 652431 - DNA, 13 bp, D. melanogaster
tgatgacggcaat

SEQ ID NO: 652432 - DNA, 13 bp, D. melanogaster
tgatgactcttcg

SEQ ID NO: 652433 - DNA, 14 bp, D. melanogaster
tgatgaggatgatg

SEQ ID NO: 652434 - DNA, 14 bp, D. melanogaster
tgatgaggctgcta

SEQ ID NO: 652435 - DNA, 13 bp, D. melanogaster
tgatgataaatca

SEQ ID NO: 652436 - DNA, 13 bp, D. melanogaster
tgatgataaatga

SEQ ID NO: 652437 - DNA, 13 bp, D. melanogaster
tgatgataataat

SEQ ID NO: 652438 - DNA, 13 bp, D. melanogaster
tgatgatattcat

SEQ ID NO: 652439 - DNA, 13 bp, D. melanogaster
tgatgatcatgat

SEQ ID NO: 652440 - DNA, 13 bp, D. melanogaster
tgatgatccaata

SEQ ID NO: 652441 - DNA, 13 bp, D. melanogaster
tgatgatgaagat

SEQ ID NO: 652442 - DNA, 13 bp, D. melanogaster
tgatgatgaagct

SEQ ID NO: 652443 - DNA, 13 bp, D. melanogaster
tgatgatgacaaa

SEQ ID NO: 652444 - DNA, 13 bp, D. melanogaster
tgatgatgacggc

SEQ ID NO: 652445 - DNA, 13 bp, D. melanogaster
tgatgatgaggag

SEQ ID NO: 652446 - DNA, 13 bp, D. melanogaster
tgatgatgataaa

SEQ ID NO: 652447 - DNA, 13 bp, D. melanogaster
tgatgatgatata

SEQ ID NO: 652448 - DNA, 14 bp, D. melanogaster
tgatgatgatgaag

SEQ ID NO: 652449 - DNA, 14 bp, D. melanogaster
tgatgatgatgaat

SEQ ID NO: 652450 - DNA, 13 bp, D. melanogaster
tgatgatgatgag

SEQ ID NO: 652451 - DNA, 14 bp, D. melanogaster
tgatgatgatgatc

SEQ ID NO: 652452 - DNA, 14 bp, D. melanogaster
tgatgatgatgatg

SEQ ID NO: 652453 - DNA, 13 bp, D. melanogaster
tgatgatgatgga

SEQ ID NO: 652454 - DNA, 14 bp, D. melanogaster
tgatgatgatggag

SEQ ID NO: 652455 - DNA, 14 bp, D. melanogaster
tgatgatgatggct

SEQ ID NO: 652456 - DNA, 13 bp, D. melanogaster
tgatgatgatggg

SEQ ID NO: 652457 - DNA, 14 bp, D. melanogaster
tgatgatgatgggg

SEQ ID NO: 652458 - DNA, 13 bp, D. melanogaster
tgatgatgatgta

SEQ ID NO: 652459 - DNA, 13 bp, D. melanogaster
tgatgatgatgtt

SEQ ID NO: 652460 - DNA, 13 bp, D. melanogaster
tgatgatgattgg

SEQ ID NO: 652461 - DNA, 13 bp, D. melanogaster
tgatgatgatttt

SEQ ID NO: 652462 - DNA, 13 bp, D. melanogaster
tgatgatgctgat

SEQ ID NO: 652463 - DNA, 13 bp, D. melanogaster
tgatgatggccaa

SEQ ID NO: 652464 - DNA, 14 bp, D. melanogaster
tgatgatggcgatg

SEQ ID NO: 652465 - DNA, 13 bp, D. melanogaster
tgatgatggctgc

SEQ ID NO: 652466 - DNA, 13 bp, D. melanogaster
tgatgatggtacc

SEQ ID NO: 652467 - DNA, 13 bp, D. melanogaster
tgatgatggtgag

SEQ ID NO: 652468 - DNA, 14 bp, D. melanogaster
tgatgatggtgatg

SEQ ID NO: 652469 - DNA, 13 bp, D. melanogaster
tgatgatgttgcc

SEQ ID NO: 652470 - DNA, 13 bp, D. melanogaster
tgatgatgttgtt

SEQ ID NO: 652471 - DNA, 13 bp, D. melanogaster
tgatgattatgat

SEQ ID NO: 652472 - DNA, 13 bp, D. melanogaster
tgatgatttaaaa

SEQ ID NO: 652473 - DNA, 13 bp, D. melanogaster
tgatgatttaatt

SEQ ID NO: 652474 - DNA, 13 bp, D. melanogaster
tgatgatttgatt

SEQ ID NO: 652475 - DNA, 14 bp, D. melanogaster
tgatgattttcttc

SEQ ID NO: 652476 - DNA, 13 bp, D. melanogaster
tgatgcaagtgga

SEQ ID NO: 652477 - DNA, 13 bp, D. melanogaster
tgatgcaattaaa

SEQ ID NO: 652478 - DNA, 13 bp, D. melanogaster
tgatgccaaaaaa

SEQ ID NO: 652479 - DNA, 13 bp, D. melanogaster
tgatgccagaatt

SEQ ID NO: 652480 - DNA, 13 bp, D. melanogaster
tgatgctatttat

SEQ ID NO: 652481 - DNA, 13 bp, D. melanogaster
tgatgctcatcag

SEQ ID NO: 652482 - DNA, 13 bp, D. melanogaster
tgatgctgatgat

SEQ ID NO: 652483 - DNA, 13 bp, D. melanogaster
tgatgctgatgca

SEQ ID NO: 652484 - DNA, 14 bp, D. melanogaster
tgatgctgatgctg

SEQ ID NO: 652485 - DNA, 13 bp, D. melanogaster
tgatgctgatgtt

SEQ ID NO: 652486 - DNA, 13 bp, D. melanogaster
tgatgctgctgat

SEQ ID NO: 652487 - DNA, 13 bp, D. melanogaster
tgatgctggtaaa

SEQ ID NO: 652488 - DNA, 13 bp, D. melanogaster
tgatgctgtatgc

SEQ ID NO: 652489 - DNA, 13 bp, D. melanogaster
tgatggaaaatta

SEQ ID NO: 652490 - DNA, 13 bp, D. melanogaster
tgatggaaatgta

SEQ ID NO: 652491 - DNA, 13 bp, D. melanogaster
tgatggacaatat

SEQ ID NO: 652492 - DNA, 13 bp, D. melanogaster
tgatggactcaat

SEQ ID NO: 652493 - DNA, 13 bp, D. melanogaster
tgatggagatgga

SEQ ID NO: 652494 - DNA, 13 bp, D. melanogaster
tgatggatatagt

SEQ ID NO: 652495 - DNA, 13 bp, D. melanogaster
tgatggatcacaa

SEQ ID NO: 652496 - DNA, 14 bp, D. melanogaster
tgatggatcacaat

SEQ ID NO: 652497 - DNA, 14 bp, D. melanogaster
tgatggatcatcat

SEQ ID NO: 652498 - DNA, 14 bp, D. melanogaster
tgatggatggatgg

SEQ ID NO: 652499 - DNA, 13 bp, D. melanogaster
tgatggcaatttg

SEQ ID NO: 652500 - DNA, 14 bp, D. melanogaster
tgatggcagcggag

SEQ ID NO: 652501 - DNA, 13 bp, D. melanogaster
tgatggcattaaa

SEQ ID NO: 652502 - DNA, 13 bp, D. melanogaster
tgatggccaaaaa

SEQ ID NO: 652503 - DNA, 13 bp, D. melanogaster
tgatggcgagaag

SEQ ID NO: 652504 - DNA, 13 bp, D. melanogaster
tgatggcgatggc

SEQ ID NO: 652505 - DNA, 14 bp, D. melanogaster
tgatggcgatggcg

SEQ ID NO: 652506 - DNA, 13 bp, D. melanogaster
tgatggcgatggt

SEQ ID NO: 652507 - DNA, 13 bp, D. melanogaster
tgatggggatttt

SEQ ID NO: 652508 - DNA, 14 bp, D. melanogaster
tgatggtgatggtg

SEQ ID NO: 652509 - DNA, 14 bp, D. melanogaster
tgatggtggtgatg

SEQ ID NO: 652510 - DNA, 13 bp, D. melanogaster
tgatggtgtatac

SEQ ID NO: 652511 - DNA, 13 bp, D. melanogaster
tgatgtacatttt

SEQ ID NO: 652512 - DNA, 13 bp, D. melanogaster
tgatgtatatata

SEQ ID NO: 652513 - DNA, 13 bp, D. melanogaster
tgatgtcaaagca

SEQ ID NO: 652514 - DNA, 13 bp, D. melanogaster
tgatgtcaccggt

SEQ ID NO: 652515 - DNA, 13 bp, D. melanogaster
tgatgtcagaaaa

SEQ ID NO: 652516 - DNA, 13 bp, D. melanogaster
tgatgtcagtagc

SEQ ID NO: 652517 - DNA, 14 bp, D. melanogaster
tgatgtgcctgctg

SEQ ID NO: 652518 - DNA, 13 bp, D. melanogaster
tgatgtggctgct

SEQ ID NO: 652519 - DNA, 13 bp, D. melanogaster
tgatgtgttggaa

SEQ ID NO: 652520 - DNA, 13 bp, D. melanogaster
tgatgttaaaact

SEQ ID NO: 652521 - DNA, 13 bp, D. melanogaster
tgatgttaccttt

SEQ ID NO: 652522 - DNA, 13 bp, D. melanogaster
tgatgttcttctg

SEQ ID NO: 652523 - DNA, 13 bp, D. melanogaster
tgatgttgatatg

SEQ ID NO: 652524 - DNA, 13 bp, D. melanogaster
tgatgttgatgtt

SEQ ID NO: 652525 - DNA, 13 bp, D. melanogaster
tgatgttgcacaa

SEQ ID NO: 652526 - DNA, 13 bp, D. melanogaster
tgatgttgcagtt

SEQ ID NO: 652527 - DNA, 13 bp, D. melanogaster
tgatgttgccaca

SEQ ID NO: 652528 - DNA, 14 bp, D. melanogaster
tgatgttgccgctg

SEQ ID NO: 652529 - DNA, 13 bp, D. melanogaster
tgatgttgctgct

SEQ ID NO: 652530 - DNA, 13 bp, D. melanogaster
tgatgttgctgtt

SEQ ID NO: 652531 - DNA, 14 bp, D. melanogaster
tgatgttggctact

SEQ ID NO: 652532 - DNA, 13 bp, D. melanogaster
tgatgttgttgat

SEQ ID NO: 652533 - DNA, 13 bp, D. melanogaster
tgatgttgttgct

SEQ ID NO: 652534 - DNA, 14 bp, D. melanogaster
tgatgttgttgctg

SEQ ID NO: 652535 - DNA, 13 bp, D. melanogaster
tgatgtttattaa

SEQ ID NO: 652536 - DNA, 13 bp, D. melanogaster
tgatgttttcatt

SEQ ID NO: 652537 - DNA, 13 bp, D. melanogaster
tgattaaaaaatg

SEQ ID NO: 652538 - DNA, 13 bp, D. melanogaster
tgattaaaaagtt

SEQ ID NO: 652539 - DNA, 13 bp, D. melanogaster
tgattaaaaatgc

SEQ ID NO: 652540 - DNA, 13 bp, D. melanogaster
tgattaaaacaaa

SEQ ID NO: 652541 - DNA, 13 bp, D. melanogaster
tgattaaaacttt

SEQ ID NO: 652542 - DNA, 13 bp, D. melanogaster
tgattaaaatgta

SEQ ID NO: 652543 - DNA, 13 bp, D. melanogaster
tgattaaatcaat

SEQ ID NO: 652544 - DNA, 13 bp, D. melanogaster
tgattaaatgttt

SEQ ID NO: 652545 - DNA, 13 bp, D. melanogaster
tgattaaattcaa

SEQ ID NO: 652546 - DNA, 13 bp, D. melanogaster
tgattaaatttcg

SEQ ID NO: 652547 - DNA, 13 bp, D. melanogaster
tgattaactattt

SEQ ID NO: 652548 - DNA, 13 bp, D. melanogaster
tgattaagtcgga

SEQ ID NO: 652549 - DNA, 13 bp, D. melanogaster
tgattaatgaatg

SEQ ID NO: 652550 - DNA, 13 bp, D. melanogaster
tgattaatgatta

SEQ ID NO: 652551 - DNA, 13 bp, D. melanogaster
tgattaatgctct

SEQ ID NO: 652552 - DNA, 13 bp, D. melanogaster
tgattaatgttta

SEQ ID NO: 652553 - DNA, 13 bp, D. melanogaster
tgattaattgcaa

SEQ ID NO: 652554 - DNA, 13 bp, D. melanogaster
tgattaatttgaa

SEQ ID NO: 652555 - DNA, 13 bp, D. melanogaster
tgattaattttca

SEQ ID NO: 652556 - DNA, 13 bp, D. melanogaster
tgattacctgcct

SEQ ID NO: 652557 - DNA, 13 bp, D. melanogaster
tgattacgaaaca

SEQ ID NO: 652558 - DNA, 13 bp, D. melanogaster
tgattacttcaat

SEQ ID NO: 652559 - DNA, 13 bp, D. melanogaster
tgattagcataat

SEQ ID NO: 652560 - DNA, 13 bp, D. melanogaster
tgattaggaacaa

SEQ ID NO: 652561 - DNA, 13 bp, D. melanogaster
tgattagttttaa

SEQ ID NO: 652562 - DNA, 13 bp, D. melanogaster
tgattatacatat

SEQ ID NO: 652563 - DNA, 13 bp, D. melanogaster
tgattatagtgaa

SEQ ID NO: 652564 - DNA, 13 bp, D. melanogaster
tgattatgataat

SEQ ID NO: 652565 - DNA, 13 bp, D. melanogaster
tgattatgattat

SEQ ID NO: 652566 - DNA, 13 bp, D. melanogaster
tgattatgctgat

SEQ ID NO: 652567 - DNA, 13 bp, D. melanogaster
tgattatggccaa

SEQ ID NO: 652568 - DNA, 13 bp, D. melanogaster
tgattattatgat

SEQ ID NO: 652569 - DNA, 13 bp, D. melanogaster
tgattatttgaaa

SEQ ID NO: 652570 - DNA, 13 bp, D. melanogaster
tgattcaatttta

SEQ ID NO: 652571 - DNA, 13 bp, D. melanogaster
tgattcatttgca

SEQ ID NO: 652572 - DNA, 13 bp, D. melanogaster
tgattccaaagcc

SEQ ID NO: 652573 - DNA, 14 bp, D. melanogaster
tgattcctcttcat

SEQ ID NO: 652574 - DNA, 13 bp, D. melanogaster
tgattcgaatttt

SEQ ID NO: 652575 - DNA, 14 bp, D. melanogaster
tgattcgattcgat

SEQ ID NO: 652576 - DNA, 13 bp, D. melanogaster
tgattcgattttt

SEQ ID NO: 652577 - DNA, 13 bp, D. melanogaster
tgattcggattcg

SEQ ID NO: 652578 - DNA, 13 bp, D. melanogaster
tgattcgggtgcg

SEQ ID NO: 652579 - DNA, 13 bp, D. melanogaster
tgattctattgat

SEQ ID NO: 652580 - DNA, 13 bp, D. melanogaster
tgattctgatcaa

SEQ ID NO: 652581 - DNA, 13 bp, D. melanogaster
tgattctgattca

SEQ ID NO: 652582 - DNA, 13 bp, D. melanogaster
tgattctgcgacc

SEQ ID NO: 652583 - DNA, 13 bp, D. melanogaster
tgattcttatttg

SEQ ID NO: 652584 - DNA, 13 bp, D. melanogaster
tgattcttcgtcc

SEQ ID NO: 652585 - DNA, 13 bp, D. melanogaster
tgattctttattg

SEQ ID NO: 652586 - DNA, 13 bp, D. melanogaster
tgattgaaaatgc

SEQ ID NO: 652587 - DNA, 13 bp, D. melanogaster
tgattgaaatatg

SEQ ID NO: 652588 - DNA, 13 bp, D. melanogaster
tgattgaaatcaa

SEQ ID NO: 652589 - DNA, 13 bp, D. melanogaster
tgattgaaattaa

SEQ ID NO: 652590 - DNA, 13 bp, D. melanogaster
tgattgacatttg

SEQ ID NO: 652591 - DNA, 13 bp, D. melanogaster
tgattgacgattt

SEQ ID NO: 652592 - DNA, 13 bp, D. melanogaster
tgattgatgattt

SEQ ID NO: 652593 - DNA, 13 bp, D. melanogaster
tgattgatggcca

SEQ ID NO: 652594 - DNA, 13 bp, D. melanogaster
tgattgatggctg

SEQ ID NO: 652595 - DNA, 13 bp, D. melanogaster
tgattgattgact

SEQ ID NO: 652596 - DNA, 14 bp, D. melanogaster
tgattgattgactg

SEQ ID NO: 652597 - DNA, 13 bp, D. melanogaster
tgattgattgatg

SEQ ID NO: 652598 - DNA, 13 bp, D. melanogaster
tgattgattgatt

SEQ ID NO: 652599 - DNA, 14 bp, D. melanogaster
tgattgattgattg

SEQ ID NO: 652600 - DNA, 13 bp, D. melanogaster
tgattgatttata

SEQ ID NO: 652601 - DNA, 13 bp, D. melanogaster
tgattgatttcga

SEQ ID NO: 652602 - DNA, 14 bp, D. melanogaster
tgattgatttgatt

SEQ ID NO: 652603 - DNA, 13 bp, D. melanogaster
tgattgatttgcc

SEQ ID NO: 652604 - DNA, 13 bp, D. melanogaster
tgattgattttaa

SEQ ID NO: 652605 - DNA, 13 bp, D. melanogaster
tgattgattttca

SEQ ID NO: 652606 - DNA, 13 bp, D. melanogaster
tgattgcaaaatg

SEQ ID NO: 652607 - DNA, 13 bp, D. melanogaster
tgattgcaaattt

SEQ ID NO: 652608 - DNA, 13 bp, D. melanogaster
tgattgcaatttc

SEQ ID NO: 652609 - DNA, 13 bp, D. melanogaster
tgattgcactttt

SEQ ID NO: 652610 - DNA, 13 bp, D. melanogaster
tgattgccaattt

SEQ ID NO: 652611 - DNA, 14 bp, D. melanogaster
tgattgcgattgtg

SEQ ID NO: 652612 - DNA, 13 bp, D. melanogaster
tgattgcgttggt

SEQ ID NO: 652613 - DNA, 13 bp, D. melanogaster
tgattgctttatt

SEQ ID NO: 652614 - DNA, 13 bp, D. melanogaster
tgattggaaaata

SEQ ID NO: 652615 - DNA, 13 bp, D. melanogaster
tgattggaaattt

SEQ ID NO: 652616 - DNA, 13 bp, D. melanogaster
tgattggcatttt

SEQ ID NO: 652617 - DNA, 13 bp, D. melanogaster
tgattgtcggaaa

SEQ ID NO: 652618 - DNA, 13 bp, D. melanogaster
tgattgtcttcgt

SEQ ID NO: 652619 - DNA, 13 bp, D. melanogaster
tgattgtgaagac

SEQ ID NO: 652620 - DNA, 13 bp, D. melanogaster
tgattgtgtgcgt

SEQ ID NO: 652621 - DNA, 13 bp, D. melanogaster
tgattgttattaa

SEQ ID NO: 652622 - DNA, 13 bp, D. melanogaster
tgattgttgagtt

SEQ ID NO: 652623 - DNA, 13 bp, D. melanogaster
tgatttaaaagtt

SEQ ID NO: 652624 - DNA, 13 bp, D. melanogaster
tgatttaaagtaa

SEQ ID NO: 652625 - DNA, 13 bp, D. melanogaster
tgatttaaatcaa

SEQ ID NO: 652626 - DNA, 13 bp, D. melanogaster
tgatttaacattg

SEQ ID NO: 652627 - DNA, 13 bp, D. melanogaster
tgatttaactaaa

SEQ ID NO: 652628 - DNA, 13 bp, D. melanogaster
tgatttaagttca

SEQ ID NO: 652629 - DNA, 13 bp, D. melanogaster
tgatttaagttta

SEQ ID NO: 652630 - DNA, 13 bp, D. melanogaster
tgatttaatattg

SEQ ID NO: 652631 - DNA, 13 bp, D. melanogaster
tgatttaatcatt

SEQ ID NO: 652632 - DNA, 13 bp, D. melanogaster
tgatttaattgaa

SEQ ID NO: 652633 - DNA, 13 bp, D. melanogaster
tgatttaattgcc

SEQ ID NO: 652634 - DNA, 13 bp, D. melanogaster
tgatttacaaaat

SEQ ID NO: 652635 - DNA, 13 bp, D. melanogaster
tgatttacacaca

SEQ ID NO: 652636 - DNA, 13 bp, D. melanogaster
tgatttacgattt

SEQ ID NO: 652637 - DNA, 13 bp, D. melanogaster
tgatttactaatt

SEQ ID NO: 652638 - DNA, 13 bp, D. melanogaster
tgatttagattta

SEQ ID NO: 652639 - DNA, 13 bp, D. melanogaster
tgatttagcatat

SEQ ID NO: 652640 - DNA, 13 bp, D. melanogaster
tgatttagttgct

SEQ ID NO: 652641 - DNA, 13 bp, D. melanogaster
tgatttatgactt

SEQ ID NO: 652642 - DNA, 13 bp, D. melanogaster
tgatttatgcagc

SEQ ID NO: 652643 - DNA, 13 bp, D. melanogaster
tgatttatgcagt

SEQ ID NO: 652644 - DNA, 13 bp, D. melanogaster
tgatttatgcccg

SEQ ID NO: 652645 - DNA, 13 bp, D. melanogaster
tgatttatgcctg

SEQ ID NO: 652646 - DNA, 13 bp, D. melanogaster
tgatttatgcgct

SEQ ID NO: 652647 - DNA, 13 bp, D. melanogaster
tgatttatgcgtt

SEQ ID NO: 652648 - DNA, 13 bp, D. melanogaster
tgatttatgctgc

SEQ ID NO: 652649 - DNA, 13 bp, D. melanogaster
tgatttatggccc

SEQ ID NO: 652650 - DNA, 14 bp, D. melanogaster
tgatttatggccca

SEQ ID NO: 652651 - DNA, 13 bp, D. melanogaster
tgatttatgtatg

SEQ ID NO: 652652 - DNA, 13 bp, D. melanogaster
tgatttatgtgcg

SEQ ID NO: 652653 - DNA, 13 bp, D. melanogaster
tgatttatgttcg

SEQ ID NO: 652654 - DNA, 13 bp, D. melanogaster
tgatttattcaaa

SEQ ID NO: 652655 - DNA, 13 bp, D. melanogaster
tgatttattgccc

SEQ ID NO: 652656 - DNA, 13 bp, D. melanogaster
tgatttattggca

SEQ ID NO: 652657 - DNA, 13 bp, D. melanogaster
tgatttatttgcc

SEQ ID NO: 652658 - DNA, 13 bp, D. melanogaster
tgatttcaaaaaa

SEQ ID NO: 652659 - DNA, 13 bp, D. melanogaster
tgatttcaaattg

SEQ ID NO: 652660 - DNA, 13 bp, D. melanogaster
tgatttcaatttg

SEQ ID NO: 652661 - DNA, 13 bp, D. melanogaster
tgatttcagaaca

SEQ ID NO: 652662 - DNA, 13 bp, D. melanogaster
tgatttcatattt

SEQ ID NO: 652663 - DNA, 13 bp, D. melanogaster
tgatttcatgatt

SEQ ID NO: 652664 - DNA, 13 bp, D. melanogaster
tgatttcattgtt

SEQ ID NO: 652665 - DNA, 13 bp, D. melanogaster
tgatttcatttcg

SEQ ID NO: 652666 - DNA, 13 bp, D. melanogaster
tgatttcatttga

SEQ ID NO: 652667 - DNA, 14 bp, D. melanogaster
tgatttcatttgat

SEQ ID NO: 652668 - DNA, 13 bp, D. melanogaster
tgatttcatttta

SEQ ID NO: 652669 - DNA, 13 bp, D. melanogaster
tgatttccaaaga

SEQ ID NO: 652670 - DNA, 13 bp, D. melanogaster
tgatttccataat

SEQ ID NO: 652671 - DNA, 13 bp, D. melanogaster
tgatttccattca

SEQ ID NO: 652672 - DNA, 13 bp, D. melanogaster
tgatttccatttc

SEQ ID NO: 652673 - DNA, 13 bp, D. melanogaster
tgatttccgattt

SEQ ID NO: 652674 - DNA, 13 bp, D. melanogaster
tgatttccgtttg

SEQ ID NO: 652675 - DNA, 13 bp, D. melanogaster
tgatttcgatttc

SEQ ID NO: 652676 - DNA, 13 bp, D. melanogaster
tgatttcgatttg

SEQ ID NO: 652677 - DNA, 13 bp, D. melanogaster
tgatttcgatttt

SEQ ID NO: 652678 - DNA, 14 bp, D. melanogaster
tgatttcgattttg

SEQ ID NO: 652679 - DNA, 13 bp, D. melanogaster
tgatttcgggtgg

SEQ ID NO: 652680 - DNA, 13 bp, D. melanogaster
tgatttcgttaaa

SEQ ID NO: 652681 - DNA, 13 bp, D. melanogaster
tgatttctcagaa

SEQ ID NO: 652682 - DNA, 13 bp, D. melanogaster
tgatttctttgaa

SEQ ID NO: 652683 - DNA, 14 bp, D. melanogaster
tgatttctttgaaa

SEQ ID NO: 652684 - DNA, 13 bp, D. melanogaster
tgatttgaaaact

SEQ ID NO: 652685 - DNA, 13 bp, D. melanogaster
tgatttgaaaagt

SEQ ID NO: 652686 - DNA, 13 bp, D. melanogaster
tgatttgaaaata

SEQ ID NO: 652687 - DNA, 13 bp, D. melanogaster
tgatttgaaaatt

SEQ ID NO: 652688 - DNA, 13 bp, D. melanogaster
tgatttgaaatca

SEQ ID NO: 652689 - DNA, 13 bp, D. melanogaster
tgatttgattgac

SEQ ID NO: 652690 - DNA, 13 bp, D. melanogaster
tgatttgatttaa

SEQ ID NO: 652691 - DNA, 13 bp, D. melanogaster
tgatttgattttc

SEQ ID NO: 652692 - DNA, 14 bp, D. melanogaster
tgatttgattttca

SEQ ID NO: 652693 - DNA, 13 bp, D. melanogaster
tgatttgcattaa

SEQ ID NO: 652694 - DNA, 13 bp, D. melanogaster
tgatttgcattga

SEQ ID NO: 652695 - DNA, 13 bp, D. melanogaster
tgatttgccaaaa

SEQ ID NO: 652696 - DNA, 13 bp, D. melanogaster
tgatttgccatca

SEQ ID NO: 652697 - DNA, 13 bp, D. melanogaster
tgatttgctgctg

SEQ ID NO: 652698 - DNA, 13 bp, D. melanogaster
tgatttgctttga

SEQ ID NO: 652699 - DNA, 13 bp, D. melanogaster
tgatttgcttttg

SEQ ID NO: 652700 - DNA, 13 bp, D. melanogaster
tgatttggctttt

SEQ ID NO: 652701 - DNA, 13 bp, D. melanogaster
tgatttgtaaata

SEQ ID NO: 652702 - DNA, 13 bp, D. melanogaster
tgatttgtgtagt

SEQ ID NO: 652703 - DNA, 13 bp, D. melanogaster
tgatttgtgtgct

SEQ ID NO: 652704 - DNA, 13 bp, D. melanogaster
tgatttgttgctg

SEQ ID NO: 652705 - DNA, 13 bp, D. melanogaster
tgatttgtttaca

SEQ ID NO: 652706 - DNA, 13 bp, D. melanogaster
tgatttgtttaga

SEQ ID NO: 652707 - DNA, 14 bp, D. melanogaster
tgatttgtttagag

SEQ ID NO: 652708 - DNA, 13 bp, D. melanogaster
tgattttaaacat

SEQ ID NO: 652709 - DNA, 13 bp, D. melanogaster
tgattttaaagaa

SEQ ID NO: 652710 - DNA, 13 bp, D. melanogaster
tgattttaaggca

SEQ ID NO: 652711 - DNA, 13 bp, D. melanogaster
tgattttaatcaa

SEQ ID NO: 652712 - DNA, 13 bp, D. melanogaster
tgattttaatggc

SEQ ID NO: 652713 - DNA, 13 bp, D. melanogaster
tgattttaattca

SEQ ID NO: 652714 - DNA, 13 bp, D. melanogaster
tgattttacaaaa

SEQ ID NO: 652715 - DNA, 13 bp, D. melanogaster
tgattttagtaaa

SEQ ID NO: 652716 - DNA, 13 bp, D. melanogaster
tgattttatgcaa

SEQ ID NO: 652717 - DNA, 13 bp, D. melanogaster
tgattttattagc

SEQ ID NO: 652718 - DNA, 13 bp, D. melanogaster
tgattttattgaa

SEQ ID NO: 652719 - DNA, 13 bp, D. melanogaster
tgattttcaaatt

SEQ ID NO: 652720 - DNA, 13 bp, D. melanogaster
tgattttcacaca

SEQ ID NO: 652721 - DNA, 13 bp, D. melanogaster
tgattttcagttg

SEQ ID NO: 652722 - DNA, 13 bp, D. melanogaster
tgattttcataaa

SEQ ID NO: 652723 - DNA, 13 bp, D. melanogaster
tgattttcattat

SEQ ID NO: 652724 - DNA, 13 bp, D. melanogaster
tgattttcattca

SEQ ID NO: 652725 - DNA, 13 bp, D. melanogaster
tgattttcattgt

SEQ ID NO: 652726 - DNA, 13 bp, D. melanogaster
tgattttccattg

SEQ ID NO: 652727 - DNA, 13 bp, D. melanogaster
tgattttccgcaa

SEQ ID NO: 652728 - DNA, 13 bp, D. melanogaster
tgattttcctatt

SEQ ID NO: 652729 - DNA, 13 bp, D. melanogaster
tgattttcctctt

SEQ ID NO: 652730 - DNA, 13 bp, D. melanogaster
tgattttcctttg

SEQ ID NO: 652731 - DNA, 13 bp, D. melanogaster
tgattttcgattt

SEQ ID NO: 652732 - DNA, 13 bp, D. melanogaster
tgattttcgcatt

SEQ ID NO: 652733 - DNA, 13 bp, D. melanogaster
tgattttcggttt

SEQ ID NO: 652734 - DNA, 13 bp, D. melanogaster
tgattttcgtttg

SEQ ID NO: 652735 - DNA, 13 bp, D. melanogaster
tgattttctaaaa

SEQ ID NO: 652736 - DNA, 13 bp, D. melanogaster
tgattttctaatt

SEQ ID NO: 652737 - DNA, 13 bp, D. melanogaster
tgattttctgagt

SEQ ID NO: 652738 - DNA, 13 bp, D. melanogaster
tgattttcttggc

SEQ ID NO: 652739 - DNA, 13 bp, D. melanogaster
tgattttgaaaac

SEQ ID NO: 652740 - DNA, 13 bp, D. melanogaster
tgattttgaaaag

SEQ ID NO: 652741 - DNA, 13 bp, D. melanogaster
tgattttgaaatt

SEQ ID NO: 652742 - DNA, 13 bp, D. melanogaster
tgattttgaactt

SEQ ID NO: 652743 - DNA, 13 bp, D. melanogaster
tgattttgacttt

SEQ ID NO: 652744 - DNA, 13 bp, D. melanogaster
tgattttgattgc

SEQ ID NO: 652745 - DNA, 13 bp, D. melanogaster
tgattttgatttc

SEQ ID NO: 652746 - DNA, 14 bp, D. melanogaster
tgattttgatttca

SEQ ID NO: 652747 - DNA, 13 bp, D. melanogaster
tgattttgcattg

SEQ ID NO: 652748 - DNA, 13 bp, D. melanogaster
tgattttgcattt

SEQ ID NO: 652749 - DNA, 13 bp, D. melanogaster
tgattttgctgct

SEQ ID NO: 652750 - DNA, 14 bp, D. melanogaster
tgattttgctgctg

SEQ ID NO: 652751 - DNA, 14 bp, D. melanogaster
tgattttggttaaa

SEQ ID NO: 652752 - DNA, 13 bp, D. melanogaster
tgattttgtaaaa

SEQ ID NO: 652753 - DNA, 14 bp, D. melanogaster
tgattttgtaaaat

SEQ ID NO: 652754 - DNA, 13 bp, D. melanogaster
tgatttttaaagg

SEQ ID NO: 652755 - DNA, 13 bp, D. melanogaster
tgatttttattgc

SEQ ID NO: 652756 - DNA, 13 bp, D. melanogaster
tgatttttcactg

SEQ ID NO: 652757 - DNA, 13 bp, D. melanogaster
tgatttttcagtt

SEQ ID NO: 652758 - DNA, 13 bp, D. melanogaster
tgatttttccatt

SEQ ID NO: 652759 - DNA, 13 bp, D. melanogaster
tgatttttcgcaa

SEQ ID NO: 652760 - DNA, 13 bp, D. melanogaster
tgatttttgcatt

SEQ ID NO: 652761 - DNA, 13 bp, D. melanogaster
tgattttttcgca

SEQ ID NO: 652762 - DNA, 13 bp, D. melanogaster
tgcaaaaaaaagg

SEQ ID NO: 652763 - DNA, 13 bp, D. melanogaster
tgcaaaaaaatcg

SEQ ID NO: 652764 - DNA, 13 bp, D. melanogaster
tgcaaaaaaatta

SEQ ID NO: 652765 - DNA, 13 bp, D. melanogaster
tgcaaaaaaattg

SEQ ID NO: 652766 - DNA, 13 bp, D. melanogaster
tgcaaaaaacagt

SEQ ID NO: 652767 - DNA, 13 bp, D. melanogaster
tgcaaaaaatgca

SEQ ID NO: 652768 - DNA, 13 bp, D. melanogaster
tgcaaaaaatggc

SEQ ID NO: 652769 - DNA, 14 bp, D. melanogaster
tgcaaaaaatggcc

SEQ ID NO: 652770 - DNA, 13 bp, D. melanogaster
tgcaaaaaatggt

SEQ ID NO: 652771 - DNA, 13 bp, D. melanogaster
tgcaaaaaattgc

SEQ ID NO: 652772 - DNA, 14 bp, D. melanogaster
tgcaaaaaattgca

SEQ ID NO: 652773 - DNA, 13 bp, D. melanogaster
tgcaaaaacaata

SEQ ID NO: 652774 - DNA, 13 bp, D. melanogaster
tgcaaaaacattt

SEQ ID NO: 652775 - DNA, 13 bp, D. melanogaster
tgcaaaaacgaaa

SEQ ID NO: 652776 - DNA, 13 bp, D. melanogaster
tgcaaaaactaaa

SEQ ID NO: 652777 - DNA, 13 bp, D. melanogaster
tgcaaaaactgca

SEQ ID NO: 652778 - DNA, 13 bp, D. melanogaster
tgcaaaaactttt

SEQ ID NO: 652779 - DNA, 13 bp, D. melanogaster
tgcaaaaagaaac

SEQ ID NO: 652780 - DNA, 13 bp, D. melanogaster
tgcaaaaaggcaa

SEQ ID NO: 652781 - DNA, 13 bp, D. melanogaster
tgcaaaaaggcca

SEQ ID NO: 652782 - DNA, 13 bp, D. melanogaster
tgcaaaaagtgca

SEQ ID NO: 652783 - DNA, 13 bp, D. melanogaster
tgcaaaaagtttg

SEQ ID NO: 652784 - DNA, 14 bp, D. melanogaster
tgcaaaaataaaat

SEQ ID NO: 652785 - DNA, 14 bp, D. melanogaster
tgcaaaaataaaca

SEQ ID NO: 652786 - DNA, 13 bp, D. melanogaster
tgcaaaaataatt

SEQ ID NO: 652787 - DNA, 13 bp, D. melanogaster
tgcaaaaatacaa

SEQ ID NO: 652788 - DNA, 13 bp, D. melanogaster
tgcaaaaatattt

SEQ ID NO: 652789 - DNA, 13 bp, D. melanogaster
tgcaaaaatgatt

SEQ ID NO: 652790 - DNA, 13 bp, D. melanogaster
tgcaaaaatgcca

SEQ ID NO: 652791 - DNA, 13 bp, D. melanogaster
tgcaaaaatgcga

SEQ ID NO: 652792 - DNA, 13 bp, D. melanogaster
tgcaaaaatggca

SEQ ID NO: 652793 - DNA, 13 bp, D. melanogaster
tgcaaaaatggtt

SEQ ID NO: 652794 - DNA, 13 bp, D. melanogaster
tgcaaaaatgttg

SEQ ID NO: 652795 - DNA, 13 bp, D. melanogaster
tgcaaaaattaaa

SEQ ID NO: 652796 - DNA, 13 bp, D. melanogaster
tgcaaaaattcca

SEQ ID NO: 652797 - DNA, 13 bp, D. melanogaster
tgcaaaaattgaa

SEQ ID NO: 652798 - DNA, 13 bp, D. melanogaster
tgcaaaaattgta

SEQ ID NO: 652799 - DNA, 13 bp, D. melanogaster
tgcaaaaatttgc

SEQ ID NO: 652800 - DNA, 14 bp, D. melanogaster
tgcaaaacaaacaa

SEQ ID NO: 652801 - DNA, 13 bp, D. melanogaster
tgcaaaacaaata

SEQ ID NO: 652802 - DNA, 13 bp, D. melanogaster
tgcaaaacaagaa

SEQ ID NO: 652803 - DNA, 13 bp, D. melanogaster
tgcaaaacaataa

SEQ ID NO: 652804 - DNA, 13 bp, D. melanogaster
tgcaaaacaattg

SEQ ID NO: 652805 - DNA, 13 bp, D. melanogaster
tgcaaaacacaaa

SEQ ID NO: 652806 - DNA, 13 bp, D. melanogaster
tgcaaaacacttt

SEQ ID NO: 652807 - DNA, 13 bp, D. melanogaster
tgcaaaacatttt

SEQ ID NO: 652808 - DNA, 13 bp, D. melanogaster
tgcaaaaccaaac

SEQ ID NO: 652809 - DNA, 15 bp, D. melanogaster
tgcaaaaccaaacta

SEQ ID NO: 652810 - DNA, 13 bp, D. melanogaster
tgcaaaacgattt

SEQ ID NO: 652811 - DNA, 13 bp, D. melanogaster
tgcaaaacgcatt

SEQ ID NO: 652812 - DNA, 13 bp, D. melanogaster
tgcaaaacggaaa

SEQ ID NO: 652813 - DNA, 13 bp, D. melanogaster
tgcaaaactaaac

SEQ ID NO: 652814 - DNA, 13 bp, D. melanogaster
tgcaaaactattt

SEQ ID NO: 652815 - DNA, 13 bp, D. melanogaster
tgcaaaactgttt

SEQ ID NO: 652816 - DNA, 13 bp, D. melanogaster
tgcaaaacttaaa

SEQ ID NO: 652817 - DNA, 14 bp, D. melanogaster
tgcaaaacttaaaa

SEQ ID NO: 652818 - DNA, 13 bp, D. melanogaster
tgcaaaactttaa

SEQ ID NO: 652819 - DNA, 13 bp, D. melanogaster
tgcaaaactttcg

SEQ ID NO: 652820 - DNA, 14 bp, D. melanogaster
tgcaaaacttttgc

SEQ ID NO: 652821 - DNA, 13 bp, D. melanogaster
tgcaaaagagttt

SEQ ID NO: 652822 - DNA, 13 bp, D. melanogaster
tgcaaaagcaaaa

SEQ ID NO: 652823 - DNA, 13 bp, D. melanogaster
tgcaaaagcaaac

SEQ ID NO: 652824 - DNA, 13 bp, D. melanogaster
tgcaaaaggcaaa

SEQ ID NO: 652825 - DNA, 13 bp, D. melanogaster
tgcaaaagtaata

SEQ ID NO: 652826 - DNA, 14 bp, D. melanogaster
tgcaaaagtaatat

SEQ ID NO: 652827 - DNA, 13 bp, D. melanogaster
tgcaaaagtatct

SEQ ID NO: 652828 - DNA, 13 bp, D. melanogaster
tgcaaaagtgcct

SEQ ID NO: 652829 - DNA, 13 bp, D. melanogaster
tgcaaaagtggaa

SEQ ID NO: 652830 - DNA, 13 bp, D. melanogaster
tgcaaaagttgtt

SEQ ID NO: 652831 - DNA, 13 bp, D. melanogaster
tgcaaaagtttgt

SEQ ID NO: 652832 - DNA, 13 bp, D. melanogaster
tgcaaaataaaat

SEQ ID NO: 652833 - DNA, 13 bp, D. melanogaster
tgcaaaataataa

SEQ ID NO: 652834 - DNA, 13 bp, D. melanogaster
tgcaaaataatgt

SEQ ID NO: 652835 - DNA, 13 bp, D. melanogaster
tgcaaaatacttt

SEQ ID NO: 652836 - DNA, 13 bp, D. melanogaster
tgcaaaatagttt

SEQ ID NO: 652837 - DNA, 13 bp, D. melanogaster
tgcaaaatataaa

SEQ ID NO: 652838 - DNA, 13 bp, D. melanogaster
tgcaaaatatgca

SEQ ID NO: 652839 - DNA, 13 bp, D. melanogaster
tgcaaaatattca

SEQ ID NO: 652840 - DNA, 14 bp, D. melanogaster
tgcaaaatatttaa

SEQ ID NO: 652841 - DNA, 14 bp, D. melanogaster
tgcaaaatatttgc

SEQ ID NO: 652842 - DNA, 13 bp, D. melanogaster
tgcaaaatcaaaa

SEQ ID NO: 652843 - DNA, 13 bp, D. melanogaster
tgcaaaatcagtt

SEQ ID NO: 652844 - DNA, 13 bp, D. melanogaster
tgcaaaatccaaa

SEQ ID NO: 652845 - DNA, 13 bp, D. melanogaster
tgcaaaatcgatc

SEQ ID NO: 652846 - DNA, 13 bp, D. melanogaster
tgcaaaatgaaat

SEQ ID NO: 652847 - DNA, 13 bp, D. melanogaster
tgcaaaatgaaca

SEQ ID NO: 652848 - DNA, 13 bp, D. melanogaster
tgcaaaatgcaaa

SEQ ID NO: 652849 - DNA, 14 bp, D. melanogaster
tgcaaaatgcaaaa

SEQ ID NO: 652850 - DNA, 13 bp, D. melanogaster
tgcaaaatgcagc

SEQ ID NO: 652851 - DNA, 14 bp, D. melanogaster
tgcaaaatgcattt

SEQ ID NO: 652852 - DNA, 13 bp, D. melanogaster
tgcaaaatgccac

SEQ ID NO: 652853 - DNA, 13 bp, D. melanogaster
tgcaaaatgcgaa

SEQ ID NO: 652854 - DNA, 13 bp, D. melanogaster
tgcaaaatgctaa

SEQ ID NO: 652855 - DNA, 13 bp, D. melanogaster
tgcaaaatggaaa

SEQ ID NO: 652856 - DNA, 14 bp, D. melanogaster
tgcaaaatggcaaa

SEQ ID NO: 652857 - DNA, 13 bp, D. melanogaster
tgcaaaatggcca

SEQ ID NO: 652858 - DNA, 13 bp, D. melanogaster
tgcaaaatgtaaa

SEQ ID NO: 652859 - DNA, 13 bp, D. melanogaster
tgcaaaatgtatt

SEQ ID NO: 652860 - DNA, 13 bp, D. melanogaster
tgcaaaatgtgtg

SEQ ID NO: 652861 - DNA, 13 bp, D. melanogaster
tgcaaaatgtttg

SEQ ID NO: 652862 - DNA, 13 bp, D. melanogaster
tgcaaaatgtttt

SEQ ID NO: 652863 - DNA, 14 bp, D. melanogaster
tgcaaaatgttttt

SEQ ID NO: 652864 - DNA, 13 bp, D. melanogaster
tgcaaaattaaaa

SEQ ID NO: 652865 - DNA, 13 bp, D. melanogaster
tgcaaaattaatt

SEQ ID NO: 652866 - DNA, 13 bp, D. melanogaster
tgcaaaattccaa

SEQ ID NO: 652867 - DNA, 13 bp, D. melanogaster
tgcaaaattcttt

SEQ ID NO: 652868 - DNA, 13 bp, D. melanogaster
tgcaaaattgatt

SEQ ID NO: 652869 - DNA, 13 bp, D. melanogaster
tgcaaaattgttt

SEQ ID NO: 652870 - DNA, 13 bp, D. melanogaster
tgcaaacaaaaac

SEQ ID NO: 652871 - DNA, 14 bp, D. melanogaster
tgcaaacaaaacaa

SEQ ID NO: 652872 - DNA, 13 bp, D. melanogaster
tgcaaacaaaaga

SEQ ID NO: 652873 - DNA, 13 bp, D. melanogaster
tgcaaacaaatta

SEQ ID NO: 652874 - DNA, 13 bp, D. melanogaster
tgcaaacaacaaa

SEQ ID NO: 652875 - DNA, 13 bp, D. melanogaster
tgcaaacaagttt

SEQ ID NO: 652876 - DNA, 13 bp, D. melanogaster
tgcaaacaataaa

SEQ ID NO: 652877 - DNA, 13 bp, D. melanogaster
tgcaaacaatggc

SEQ ID NO: 652878 - DNA, 13 bp, D. melanogaster
tgcaaacacaaac

SEQ ID NO: 652879 - DNA, 14 bp, D. melanogaster
tgcaaacacaaaca

SEQ ID NO: 652880 - DNA, 14 bp, D. melanogaster
tgcaaacacaaata

SEQ ID NO: 652881 - DNA, 13 bp, D. melanogaster
tgcaaacacaaca

SEQ ID NO: 652882 - DNA, 13 bp, D. melanogaster
tgcaaacacacac

SEQ ID NO: 652883 - DNA, 14 bp, D. melanogaster
tgcaaacacacaca

SEQ ID NO: 652884 - DNA, 13 bp, D. melanogaster
tgcaaacactttg

SEQ ID NO: 652885 - DNA, 13 bp, D. melanogaster
tgcaaacagaaaa

SEQ ID NO: 652886 - DNA, 13 bp, D. melanogaster
tgcaaacagaaat

SEQ ID NO: 652887 - DNA, 13 bp, D. melanogaster
tgcaaacagcaac

SEQ ID NO: 652888 - DNA, 13 bp, D. melanogaster
tgcaaacagctac

SEQ ID NO: 652889 - DNA, 13 bp, D. melanogaster
tgcaaacataaaa

SEQ ID NO: 652890 - DNA, 13 bp, D. melanogaster
tgcaaacatacat

SEQ ID NO: 652891 - DNA, 13 bp, D. melanogaster
tgcaaacatattt

SEQ ID NO: 652892 - DNA, 13 bp, D. melanogaster
tgcaaacatcggt

SEQ ID NO: 652893 - DNA, 13 bp, D. melanogaster
tgcaaacatgaaa

SEQ ID NO: 652894 - DNA, 13 bp, D. melanogaster
tgcaaacatgcaa

SEQ ID NO: 652895 - DNA, 13 bp, D. melanogaster
tgcaaacatgttt

SEQ ID NO: 652896 - DNA, 13 bp, D. melanogaster
tgcaaacatttaa

SEQ ID NO: 652897 - DNA, 13 bp, D. melanogaster
tgcaaacatttca

SEQ ID NO: 652898 - DNA, 13 bp, D. melanogaster
tgcaaacatttta

SEQ ID NO: 652899 - DNA, 13 bp, D. melanogaster
tgcaaacattttc

SEQ ID NO: 652900 - DNA, 13 bp, D. melanogaster
tgcaaacattttt

SEQ ID NO: 652901 - DNA, 13 bp, D. melanogaster
tgcaaaccaaaaa

SEQ ID NO: 652902 - DNA, 13 bp, D. melanogaster
tgcaaacgaaaac

SEQ ID NO: 652903 - DNA, 13 bp, D. melanogaster
tgcaaacgaaaag

SEQ ID NO: 652904 - DNA, 13 bp, D. melanogaster
tgcaaacgaaatg

SEQ ID NO: 652905 - DNA, 14 bp, D. melanogaster
tgcaaacgaataca

SEQ ID NO: 652906 - DNA, 13 bp, D. melanogaster
tgcaaacgaatcg

SEQ ID NO: 652907 - DNA, 13 bp, D. melanogaster
tgcaaacgagaaa

SEQ ID NO: 652908 - DNA, 13 bp, D. melanogaster
tgcaaactaccag

SEQ ID NO: 652909 - DNA, 13 bp, D. melanogaster
tgcaaactcaatt

SEQ ID NO: 652910 - DNA, 13 bp, D. melanogaster
tgcaaactgcaaa

SEQ ID NO: 652911 - DNA, 13 bp, D. melanogaster
tgcaaactgcatt

SEQ ID NO: 652912 - DNA, 13 bp, D. melanogaster
tgcaaactggttt

SEQ ID NO: 652913 - DNA, 13 bp, D. melanogaster
tgcaaactgtttt

SEQ ID NO: 652914 - DNA, 13 bp, D. melanogaster
tgcaaactttgca

SEQ ID NO: 652915 - DNA, 13 bp, D. melanogaster
tgcaaacttttgg

SEQ ID NO: 652916 - DNA, 13 bp, D. melanogaster
tgcaaactttttg

SEQ ID NO: 652917 - DNA, 13 bp, D. melanogaster
tgcaaagaaatta

SEQ ID NO: 652918 - DNA, 13 bp, D. melanogaster
tgcaaagaaattg

SEQ ID NO: 652919 - DNA, 13 bp, D. melanogaster
tgcaaagacagct

SEQ ID NO: 652920 - DNA, 13 bp, D. melanogaster
tgcaaagagtatt

SEQ ID NO: 652921 - DNA, 13 bp, D. melanogaster
tgcaaagcaattt

SEQ ID NO: 652922 - DNA, 13 bp, D. melanogaster
tgcaaagcatttt

SEQ ID NO: 652923 - DNA, 13 bp, D. melanogaster
tgcaaagccaaaa

SEQ ID NO: 652924 - DNA, 13 bp, D. melanogaster
tgcaaagcgaaaa

SEQ ID NO: 652925 - DNA, 13 bp, D. melanogaster
tgcaaaggaattt

SEQ ID NO: 652926 - DNA, 13 bp, D. melanogaster
tgcaaaggcattt

SEQ ID NO: 652927 - DNA, 13 bp, D. melanogaster
tgcaaaggtggtg

SEQ ID NO: 652928 - DNA, 13 bp, D. melanogaster
tgcaaaggttatt

SEQ ID NO: 652929 - DNA, 13 bp, D. melanogaster
tgcaaagtaaaca

SEQ ID NO: 652930 - DNA, 13 bp, D. melanogaster
tgcaaagtaaata

SEQ ID NO: 652931 - DNA, 13 bp, D. melanogaster
tgcaaagtatgca

SEQ ID NO: 652932 - DNA, 13 bp, D. melanogaster
tgcaaagtcaaag

SEQ ID NO: 652933 - DNA, 13 bp, D. melanogaster
tgcaaagtcagtt

SEQ ID NO: 652934 - DNA, 13 bp, D. melanogaster
tgcaaagtgcagc

SEQ ID NO: 652935 - DNA, 13 bp, D. melanogaster
tgcaaagtggaaa

SEQ ID NO: 652936 - DNA, 13 bp, D. melanogaster
tgcaaagtgtgtg

SEQ ID NO: 652937 - DNA, 13 bp, D. melanogaster
tgcaaagtgtttt

SEQ ID NO: 652938 - DNA, 13 bp, D. melanogaster
tgcaaagttaatt

SEQ ID NO: 652939 - DNA, 13 bp, D. melanogaster
tgcaaagtttgga

SEQ ID NO: 652940 - DNA, 13 bp, D. melanogaster
tgcaaagtttgtt

SEQ ID NO: 652941 - DNA, 13 bp, D. melanogaster
tgcaaagttttgt

SEQ ID NO: 652942 - DNA, 14 bp, D. melanogaster
tgcaaataaaacaa

SEQ ID NO: 652943 - DNA, 13 bp, D. melanogaster
tgcaaataaaact

SEQ ID NO: 652944 - DNA, 13 bp, D. melanogaster
tgcaaataaaagt

SEQ ID NO: 652945 - DNA, 14 bp, D. melanogaster
tgcaaataaaataa

SEQ ID NO: 652946 - DNA, 13 bp, D. melanogaster
tgcaaataaaatg

SEQ ID NO: 652947 - DNA, 14 bp, D. melanogaster
tgcaaataaaatgc

SEQ ID NO: 652948 - DNA, 13 bp, D. melanogaster
tgcaaataaacca

SEQ ID NO: 652949 - DNA, 13 bp, D. melanogaster
tgcaaataaagta

SEQ ID NO: 652950 - DNA, 13 bp, D. melanogaster
tgcaaataaagtt

SEQ ID NO: 652951 - DNA, 13 bp, D. melanogaster
tgcaaataaatac

SEQ ID NO: 652952 - DNA, 14 bp, D. melanogaster
tgcaaataaatgaa

SEQ ID NO: 652953 - DNA, 13 bp, D. melanogaster
tgcaaataaatgc

SEQ ID NO: 652954 - DNA, 13 bp, D. melanogaster
tgcaaataaatgt

SEQ ID NO: 652955 - DNA, 14 bp, D. melanogaster
tgcaaataaatttc

SEQ ID NO: 652956 - DNA, 13 bp, D. melanogaster
tgcaaataacaaa

SEQ ID NO: 652957 - DNA, 14 bp, D. melanogaster
tgcaaataagcaaa

SEQ ID NO: 652958 - DNA, 13 bp, D. melanogaster
tgcaaataataaa

SEQ ID NO: 652959 - DNA, 14 bp, D. melanogaster
tgcaaataataaaa

SEQ ID NO: 652960 - DNA, 13 bp, D. melanogaster
tgcaaataataat

SEQ ID NO: 652961 - DNA, 13 bp, D. melanogaster
tgcaaataatatg

SEQ ID NO: 652962 - DNA, 13 bp, D. melanogaster
tgcaaataattcg

SEQ ID NO: 652963 - DNA, 13 bp, D. melanogaster
tgcaaataatttg

SEQ ID NO: 652964 - DNA, 13 bp, D. melanogaster
tgcaaataatttt

SEQ ID NO: 652965 - DNA, 13 bp, D. melanogaster
tgcaaatacaaat

SEQ ID NO: 652966 - DNA, 14 bp, D. melanogaster
tgcaaatacaaata

SEQ ID NO: 652967 - DNA, 13 bp, D. melanogaster
tgcaaatacattt

SEQ ID NO: 652968 - DNA, 13 bp, D. melanogaster
tgcaaataccaac

SEQ ID NO: 652969 - DNA, 13 bp, D. melanogaster
tgcaaatactgca

SEQ ID NO: 652970 - DNA, 13 bp, D. melanogaster
tgcaaatactttg

SEQ ID NO: 652971 - DNA, 13 bp, D. melanogaster
tgcaaatagtttt

SEQ ID NO: 652972 - DNA, 13 bp, D. melanogaster
tgcaaatataaat

SEQ ID NO: 652973 - DNA, 13 bp, D. melanogaster
tgcaaatataata

SEQ ID NO: 652974 - DNA, 14 bp, D. melanogaster
tgcaaatataattt

SEQ ID NO: 652975 - DNA, 13 bp, D. melanogaster
tgcaaatatattc

SEQ ID NO: 652976 - DNA, 13 bp, D. melanogaster
tgcaaatatattt

SEQ ID NO: 652977 - DNA, 13 bp, D. melanogaster
tgcaaatatcaaa

SEQ ID NO: 652978 - DNA, 13 bp, D. melanogaster
tgcaaatatcttt

SEQ ID NO: 652979 - DNA, 13 bp, D. melanogaster
tgcaaatatgaaa

SEQ ID NO: 652980 - DNA, 13 bp, D. melanogaster
tgcaaatatgcaa

SEQ ID NO: 652981 - DNA, 13 bp, D. melanogaster
tgcaaatatgcag

SEQ ID NO: 652982 - DNA, 13 bp, D. melanogaster
tgcaaatatgtat

SEQ ID NO: 652983 - DNA, 13 bp, D. melanogaster
tgcaaatatgttg

SEQ ID NO: 652984 - DNA, 13 bp, D. melanogaster
tgcaaatattatg

SEQ ID NO: 652985 - DNA, 13 bp, D. melanogaster
tgcaaatattatt

SEQ ID NO: 652986 - DNA, 14 bp, D. melanogaster
tgcaaatattattt

SEQ ID NO: 652987 - DNA, 13 bp, D. melanogaster
tgcaaatattcac

SEQ ID NO: 652988 - DNA, 13 bp, D. melanogaster
tgcaaatattgca

SEQ ID NO: 652989 - DNA, 13 bp, D. melanogaster
tgcaaatatttaa

SEQ ID NO: 652990 - DNA, 14 bp, D. melanogaster
tgcaaatatttaaa

SEQ ID NO: 652991 - DNA, 14 bp, D. melanogaster
tgcaaatatttaca

SEQ ID NO: 652992 - DNA, 13 bp, D. melanogaster
tgcaaatatttca

SEQ ID NO: 652993 - DNA, 13 bp, D. melanogaster
tgcaaatatttgc

SEQ ID NO: 652994 - DNA, 14 bp, D. melanogaster
tgcaaatatttgtg

SEQ ID NO: 652995 - DNA, 13 bp, D. melanogaster
tgcaaatatttta

SEQ ID NO: 652996 - DNA, 13 bp, D. melanogaster
tgcaaatattttg

SEQ ID NO: 652997 - DNA, 14 bp, D. melanogaster
tgcaaatattttgc

SEQ ID NO: 652998 - DNA, 13 bp, D. melanogaster
tgcaaatcaaagc

SEQ ID NO: 652999 - DNA, 13 bp, D. melanogaster
tgcaaatcaaagt

SEQ ID NO: 653000 - DNA, 13 bp, D. melanogaster
tgcaaatcaaatt

SEQ ID NO: 653001 - DNA, 13 bp, D. melanogaster
tgcaaatcaatta

SEQ ID NO: 653002 - DNA, 13 bp, D. melanogaster
tgcaaatcaattt

SEQ ID NO: 653003 - DNA, 13 bp, D. melanogaster
tgcaaatcagctg

SEQ ID NO: 653004 - DNA, 13 bp, D. melanogaster
tgcaaatcattaa

SEQ ID NO: 653005 - DNA, 13 bp, D. melanogaster
tgcaaatccaatt

SEQ ID NO: 653006 - DNA, 13 bp, D. melanogaster
tgcaaatcgaaaa

SEQ ID NO: 653007 - DNA, 13 bp, D. melanogaster
tgcaaatcgatgg

SEQ ID NO: 653008 - DNA, 13 bp, D. melanogaster
tgcaaatgaaaaa

SEQ ID NO: 653009 - DNA, 14 bp, D. melanogaster
tgcaaatgaaaaat

SEQ ID NO: 653010 - DNA, 13 bp, D. melanogaster
tgcaaatgaaaat

SEQ ID NO: 653011 - DNA, 13 bp, D. melanogaster
tgcaaatgaaacg

SEQ ID NO: 653012 - DNA, 13 bp, D. melanogaster
tgcaaatgaaatt

SEQ ID NO: 653013 - DNA, 13 bp, D. melanogaster
tgcaaatgaagct

SEQ ID NO: 653014 - DNA, 13 bp, D. melanogaster
tgcaaatgaagtt

SEQ ID NO: 653015 - DNA, 13 bp, D. melanogaster
tgcaaatgaatga

SEQ ID NO: 653016 - DNA, 13 bp, D. melanogaster
tgcaaatgaatgg

SEQ ID NO: 653017 - DNA, 13 bp, D. melanogaster
tgcaaatgacaaa

SEQ ID NO: 653018 - DNA, 13 bp, D. melanogaster
tgcaaatgagttg

SEQ ID NO: 653019 - DNA, 13 bp, D. melanogaster
tgcaaatgagttt

SEQ ID NO: 653020 - DNA, 13 bp, D. melanogaster
tgcaaatgatttt

SEQ ID NO: 653021 - DNA, 14 bp, D. melanogaster
tgcaaatgcaaaaa

SEQ ID NO: 653022 - DNA, 14 bp, D. melanogaster
tgcaaatgcaaata

SEQ ID NO: 653023 - DNA, 13 bp, D. melanogaster
tgcaaatgcaagt

SEQ ID NO: 653024 - DNA, 13 bp, D. melanogaster
tgcaaatgcaatt

SEQ ID NO: 653025 - DNA, 14 bp, D. melanogaster
tgcaaatgcaatta

SEQ ID NO: 653026 - DNA, 14 bp, D. melanogaster
tgcaaatgcaattg

SEQ ID NO: 653027 - DNA, 14 bp, D. melanogaster
tgcaaatgcaattt

SEQ ID NO: 653028 - DNA, 13 bp, D. melanogaster
tgcaaatgcacaa

SEQ ID NO: 653029 - DNA, 13 bp, D. melanogaster
tgcaaatgcagaa

SEQ ID NO: 653030 - DNA, 13 bp, D. melanogaster
tgcaaatgcagca

SEQ ID NO: 653031 - DNA, 13 bp, D. melanogaster
tgcaaatgcataa

SEQ ID NO: 653032 - DNA, 13 bp, D. melanogaster
tgcaaatgcatat

SEQ ID NO: 653033 - DNA, 13 bp, D. melanogaster
tgcaaatgcatta

SEQ ID NO: 653034 - DNA, 13 bp, D. melanogaster
tgcaaatgccaaa

SEQ ID NO: 653035 - DNA, 13 bp, D. melanogaster
tgcaaatgccaag

SEQ ID NO: 653036 - DNA, 13 bp, D. melanogaster
tgcaaatgccatt

SEQ ID NO: 653037 - DNA, 13 bp, D. melanogaster
tgcaaatgctaat

SEQ ID NO: 653038 - DNA, 13 bp, D. melanogaster
tgcaaatgctggc

SEQ ID NO: 653039 - DNA, 13 bp, D. melanogaster
tgcaaatgctgtt

SEQ ID NO: 653040 - DNA, 13 bp, D. melanogaster
tgcaaatggaaaa

SEQ ID NO: 653041 - DNA, 13 bp, D. melanogaster
tgcaaatggaatg

SEQ ID NO: 653042 - DNA, 13 bp, D. melanogaster
tgcaaatggaatt

SEQ ID NO: 653043 - DNA, 13 bp, D. melanogaster
tgcaaatggccaa

SEQ ID NO: 653044 - DNA, 13 bp, D. melanogaster
tgcaaatgggcaa

SEQ ID NO: 653045 - DNA, 13 bp, D. melanogaster
tgcaaatgtatct

SEQ ID NO: 653046 - DNA, 14 bp, D. melanogaster
tgcaaatgtatctg

SEQ ID NO: 653047 - DNA, 13 bp, D. melanogaster
tgcaaatgtcagc

SEQ ID NO: 653048 - DNA, 13 bp, D. melanogaster
tgcaaatgtcatt

SEQ ID NO: 653049 - DNA, 13 bp, D. melanogaster
tgcaaatgtcctt

SEQ ID NO: 653050 - DNA, 13 bp, D. melanogaster
tgcaaatgtgctt

SEQ ID NO: 653051 - DNA, 13 bp, D. melanogaster
tgcaaatgtttat

SEQ ID NO: 653052 - DNA, 13 bp, D. melanogaster
tgcaaatgtttgt

SEQ ID NO: 653053 - DNA, 13 bp, D. melanogaster
tgcaaatgttttt

SEQ ID NO: 653054 - DNA, 14 bp, D. melanogaster
tgcaaatgtttttt

SEQ ID NO: 653055 - DNA, 14 bp, D. melanogaster
tgcaaattaaattt

SEQ ID NO: 653056 - DNA, 13 bp, D. melanogaster
tgcaaattaactt

SEQ ID NO: 653057 - DNA, 13 bp, D. melanogaster
tgcaaattaatat

SEQ ID NO: 653058 - DNA, 13 bp, D. melanogaster
tgcaaattaatca

SEQ ID NO: 653059 - DNA, 13 bp, D. melanogaster
tgcaaattacaaa

SEQ ID NO: 653060 - DNA, 13 bp, D. melanogaster
tgcaaattagatt

SEQ ID NO: 653061 - DNA, 13 bp, D. melanogaster
tgcaaattataaa

SEQ ID NO: 653062 - DNA, 13 bp, D. melanogaster
tgcaaattattgc

SEQ ID NO: 653063 - DNA, 13 bp, D. melanogaster
tgcaaattatttt

SEQ ID NO: 653064 - DNA, 14 bp, D. melanogaster
tgcaaattatttta

SEQ ID NO: 653065 - DNA, 13 bp, D. melanogaster
tgcaaattcaaaa

SEQ ID NO: 653066 - DNA, 13 bp, D. melanogaster
tgcaaattcaatg

SEQ ID NO: 653067 - DNA, 13 bp, D. melanogaster
tgcaaattcaatt

SEQ ID NO: 653068 - DNA, 14 bp, D. melanogaster
tgcaaattcaatta

SEQ ID NO: 653069 - DNA, 13 bp, D. melanogaster
tgcaaattcattt

SEQ ID NO: 653070 - DNA, 13 bp, D. melanogaster
tgcaaattccaat

SEQ ID NO: 653071 - DNA, 13 bp, D. melanogaster
tgcaaattctatt

SEQ ID NO: 653072 - DNA, 14 bp, D. melanogaster
tgcaaattctggag

SEQ ID NO: 653073 - DNA, 13 bp, D. melanogaster
tgcaaattgaaag

SEQ ID NO: 653074 - DNA, 13 bp, D. melanogaster
tgcaaattgattg

SEQ ID NO: 653075 - DNA, 13 bp, D. melanogaster
tgcaaattgattt

SEQ ID NO: 653076 - DNA, 13 bp, D. melanogaster
tgcaaattgcaac

SEQ ID NO: 653077 - DNA, 14 bp, D. melanogaster
tgcaaattgcattt

SEQ ID NO: 653078 - DNA, 13 bp, D. melanogaster
tgcaaattgccag

SEQ ID NO: 653079 - DNA, 13 bp, D. melanogaster
tgcaaattgctcg

SEQ ID NO: 653080 - DNA, 13 bp, D. melanogaster
tgcaaattgctgt

SEQ ID NO: 653081 - DNA, 13 bp, D. melanogaster
tgcaaattggaaa

SEQ ID NO: 653082 - DNA, 13 bp, D. melanogaster
tgcaaattggcaa

SEQ ID NO: 653083 - DNA, 13 bp, D. melanogaster
tgcaaattggcca

SEQ ID NO: 653084 - DNA, 13 bp, D. melanogaster
tgcaaattgtaat

SEQ ID NO: 653085 - DNA, 13 bp, D. melanogaster
tgcaaattgtgca

SEQ ID NO: 653086 - DNA, 13 bp, D. melanogaster
tgcaaattgtgcg

SEQ ID NO: 653087 - DNA, 13 bp, D. melanogaster
tgcaaattgttgc

SEQ ID NO: 653088 - DNA, 13 bp, D. melanogaster
tgcaaattgttta

SEQ ID NO: 653089 - DNA, 13 bp, D. melanogaster
tgcaaattgtttg

SEQ ID NO: 653090 - DNA, 13 bp, D. melanogaster
tgcaaattgtttt

SEQ ID NO: 653091 - DNA, 14 bp, D. melanogaster
tgcaaattgttttc

SEQ ID NO: 653092 - DNA, 14 bp, D. melanogaster
tgcaaattgttttt

SEQ ID NO: 653093 - DNA, 13 bp, D. melanogaster
tgcaaatttaaaa

SEQ ID NO: 653094 - DNA, 13 bp, D. melanogaster
tgcaaatttaatc

SEQ ID NO: 653095 - DNA, 13 bp, D. melanogaster
tgcaaatttattg

SEQ ID NO: 653096 - DNA, 13 bp, D. melanogaster
tgcaaatttattt

SEQ ID NO: 653097 - DNA, 14 bp, D. melanogaster
tgcaaatttatttg

SEQ ID NO: 653098 - DNA, 13 bp, D. melanogaster
tgcaaatttccca

SEQ ID NO: 653099 - DNA, 13 bp, D. melanogaster
tgcaaatttcgca

SEQ ID NO: 653100 - DNA, 13 bp, D. melanogaster
tgcaaatttgatt

SEQ ID NO: 653101 - DNA, 14 bp, D. melanogaster
tgcaaatttgattt

SEQ ID NO: 653102 - DNA, 13 bp, D. melanogaster
tgcaaatttgcat

SEQ ID NO: 653103 - DNA, 13 bp, D. melanogaster
tgcaaattttaat

SEQ ID NO: 653104 - DNA, 13 bp, D. melanogaster
tgcaaattttata

SEQ ID NO: 653105 - DNA, 13 bp, D. melanogaster
tgcaaattttatt

SEQ ID NO: 653106 - DNA, 13 bp, D. melanogaster
tgcaaattttgtg

SEQ ID NO: 653107 - DNA, 13 bp, D. melanogaster
tgcaaattttgtt

SEQ ID NO: 653108 - DNA, 13 bp, D. melanogaster
tgcaaatttttat

SEQ ID NO: 653109 - DNA, 13 bp, D. melanogaster
tgcaaatttttga

SEQ ID NO: 653110 - DNA, 14 bp, D. melanogaster
tgcaaatttttttt

SEQ ID NO: 653111 - DNA, 13 bp, D. melanogaster
tgcaacaaaaaat

SEQ ID NO: 653112 - DNA, 13 bp, D. melanogaster
tgcaacaaaaaca

SEQ ID NO: 653113 - DNA, 13 bp, D. melanogaster
tgcaacaaaaact

SEQ ID NO: 653114 - DNA, 13 bp, D. melanogaster
tgcaacaaaaata

SEQ ID NO: 653115 - DNA, 13 bp, D. melanogaster
tgcaacaaaagca

SEQ ID NO: 653116 - DNA, 13 bp, D. melanogaster
tgcaacaaaagcg

SEQ ID NO: 653117 - DNA, 13 bp, D. melanogaster
tgcaacaaaatgt

SEQ ID NO: 653118 - DNA, 13 bp, D. melanogaster
tgcaacaaagaaa

SEQ ID NO: 653119 - DNA, 13 bp, D. melanogaster
tgcaacaaataaa

SEQ ID NO: 653120 - DNA, 13 bp, D. melanogaster
tgcaacaaatatg

SEQ ID NO: 653121 - DNA, 13 bp, D. melanogaster
tgcaacaaatgca

SEQ ID NO: 653122 - DNA, 13 bp, D. melanogaster
tgcaacaaatggc

SEQ ID NO: 653123 - DNA, 13 bp, D. melanogaster
tgcaacaaattaa

SEQ ID NO: 653124 - DNA, 13 bp, D. melanogaster
tgcaacaaattca

SEQ ID NO: 653125 - DNA, 13 bp, D. melanogaster
tgcaacaaattgc

SEQ ID NO: 653126 - DNA, 14 bp, D. melanogaster
tgcaacaaattgca

SEQ ID NO: 653127 - DNA, 13 bp, D. melanogaster
tgcaacaaattgt

SEQ ID NO: 653128 - DNA, 13 bp, D. melanogaster
tgcaacaacaaac

SEQ ID NO: 653129 - DNA, 13 bp, D. melanogaster
tgcaacaacaaat

SEQ ID NO: 653130 - DNA, 13 bp, D. melanogaster
tgcaacaacaaca

SEQ ID NO: 653131 - DNA, 14 bp, D. melanogaster
tgcaacaacaacaa

SEQ ID NO: 653132 - DNA, 14 bp, D. melanogaster
tgcaacaacaacag

SEQ ID NO: 653133 - DNA, 13 bp, D. melanogaster
tgcaacaacaact

SEQ ID NO: 653134 - DNA, 13 bp, D. melanogaster
tgcaacaacaaga

SEQ ID NO: 653135 - DNA, 14 bp, D. melanogaster
tgcaacaacaataa

SEQ ID NO: 653136 - DNA, 13 bp, D. melanogaster
tgcaacaacagca

SEQ ID NO: 653137 - DNA, 14 bp, D. melanogaster
tgcaacaacagcaa

SEQ ID NO: 653138 - DNA, 14 bp, D. melanogaster
tgcaacaacagcag

SEQ ID NO: 653139 - DNA, 14 bp, D. melanogaster
tgcaacaactgcaa

SEQ ID NO: 653140 - DNA, 13 bp, D. melanogaster
tgcaacaagtgca

SEQ ID NO: 653141 - DNA, 13 bp, D. melanogaster
tgcaacaagtggt

SEQ ID NO: 653142 - DNA, 13 bp, D. melanogaster
tgcaacaataaat

SEQ ID NO: 653143 - DNA, 13 bp, D. melanogaster
tgcaacaataata

SEQ ID NO: 653144 - DNA, 13 bp, D. melanogaster
tgcaacaatattt

SEQ ID NO: 653145 - DNA, 13 bp, D. melanogaster
tgcaacaatgcaa

SEQ ID NO: 653146 - DNA, 13 bp, D. melanogaster
tgcaacaatgttg

SEQ ID NO: 653147 - DNA, 13 bp, D. melanogaster
tgcaacaattgca

SEQ ID NO: 653148 - DNA, 13 bp, D. melanogaster
tgcaacaatttgc

SEQ ID NO: 653149 - DNA, 13 bp, D. melanogaster
tgcaacacaaaaa

SEQ ID NO: 653150 - DNA, 13 bp, D. melanogaster
tgcaacacacaaa

SEQ ID NO: 653151 - DNA, 13 bp, D. melanogaster
tgcaacacatttt

SEQ ID NO: 653152 - DNA, 13 bp, D. melanogaster
tgcaacaccagca

SEQ ID NO: 653153 - DNA, 13 bp, D. melanogaster
tgcaacacttgca

SEQ ID NO: 653154 - DNA, 13 bp, D. melanogaster
tgcaacagcaaca

SEQ ID NO: 653155 - DNA, 14 bp, D. melanogaster
tgcaacagcaacaa

SEQ ID NO: 653156 - DNA, 14 bp, D. melanogaster
tgcaacagcaacac

SEQ ID NO: 653157 - DNA, 14 bp, D. melanogaster
tgcaacagcaacag

SEQ ID NO: 653158 - DNA, 14 bp, D. melanogaster
tgcaacagcaactg

SEQ ID NO: 653159 - DNA, 17 bp, D. melanogaster
tgcaacagcagcagcaa

SEQ ID NO: 653160 - DNA, 13 bp, D. melanogaster
tgcaacagcggca

SEQ ID NO: 653161 - DNA, 13 bp, D. melanogaster
tgcaacagctgct

SEQ ID NO: 653162 - DNA, 13 bp, D. melanogaster
tgcaacagtgcgt

SEQ ID NO: 653163 - DNA, 13 bp, D. melanogaster
tgcaacagttgca

SEQ ID NO: 653164 - DNA, 13 bp, D. melanogaster
tgcaacagttgct

SEQ ID NO: 653165 - DNA, 13 bp, D. melanogaster
tgcaacataaata

SEQ ID NO: 653166 - DNA, 13 bp, D. melanogaster
tgcaacatatgca

SEQ ID NO: 653167 - DNA, 14 bp, D. melanogaster
tgcaacatatgcaa

SEQ ID NO: 653168 - DNA, 13 bp, D. melanogaster
tgcaacatatttg

SEQ ID NO: 653169 - DNA, 13 bp, D. melanogaster
tgcaacatcaaca

SEQ ID NO: 653170 - DNA, 13 bp, D. melanogaster
tgcaacatcagaa

SEQ ID NO: 653171 - DNA, 13 bp, D. melanogaster
tgcaacatgaaaa

SEQ ID NO: 653172 - DNA, 13 bp, D. melanogaster
tgcaacatgcaaa

SEQ ID NO: 653173 - DNA, 14 bp, D. melanogaster
tgcaacatgcaaca

SEQ ID NO: 653174 - DNA, 14 bp, D. melanogaster
tgcaacatgcaact

SEQ ID NO: 653175 - DNA, 13 bp, D. melanogaster
tgcaacatgccac

SEQ ID NO: 653176 - DNA, 13 bp, D. melanogaster
tgcaacatgcggc

SEQ ID NO: 653177 - DNA, 13 bp, D. melanogaster
tgcaacatgtggc

SEQ ID NO: 653178 - DNA, 13 bp, D. melanogaster
tgcaacatgttgc

SEQ ID NO: 653179 - DNA, 13 bp, D. melanogaster
tgcaacattgcaa

SEQ ID NO: 653180 - DNA, 14 bp, D. melanogaster
tgcaacattgttgc

SEQ ID NO: 653181 - DNA, 13 bp, D. melanogaster
tgcaacatttaat

SEQ ID NO: 653182 - DNA, 13 bp, D. melanogaster
tgcaacatttatg

SEQ ID NO: 653183 - DNA, 13 bp, D. melanogaster
tgcaacatttatt

SEQ ID NO: 653184 - DNA, 13 bp, D. melanogaster
tgcaacatttgct

SEQ ID NO: 653185 - DNA, 13 bp, D. melanogaster
tgcaacatttgtg

SEQ ID NO: 653186 - DNA, 13 bp, D. melanogaster
tgcaacatttgtt

SEQ ID NO: 653187 - DNA, 13 bp, D. melanogaster
tgcaacattttaa

SEQ ID NO: 653188 - DNA, 13 bp, D. melanogaster
tgcaacattttgt

SEQ ID NO: 653189 - DNA, 13 bp, D. melanogaster
tgcaacccaaaaa

SEQ ID NO: 653190 - DNA, 13 bp, D. melanogaster
tgcaaccgcaaaa

SEQ ID NO: 653191 - DNA, 13 bp, D. melanogaster
tgcaacctgcaac

SEQ ID NO: 653192 - DNA, 13 bp, D. melanogaster
tgcaacgaaaatg

SEQ ID NO: 653193 - DNA, 13 bp, D. melanogaster
tgcaacgcaattt

SEQ ID NO: 653194 - DNA, 13 bp, D. melanogaster
tgcaacgctttca

SEQ ID NO: 653195 - DNA, 13 bp, D. melanogaster
tgcaacggaaatg

SEQ ID NO: 653196 - DNA, 13 bp, D. melanogaster
tgcaacggcaaca

SEQ ID NO: 653197 - DNA, 13 bp, D. melanogaster
tgcaacgtgcaac

SEQ ID NO: 653198 - DNA, 13 bp, D. melanogaster
tgcaactaagatt

SEQ ID NO: 653199 - DNA, 13 bp, D. melanogaster
tgcaactaattag

SEQ ID NO: 653200 - DNA, 13 bp, D. melanogaster
tgcaactacaaca

SEQ ID NO: 653201 - DNA, 13 bp, D. melanogaster
tgcaactacaact

SEQ ID NO: 653202 - DNA, 13 bp, D. melanogaster
tgcaactatttat

SEQ ID NO: 653203 - DNA, 13 bp, D. melanogaster
tgcaactcaattt

SEQ ID NO: 653204 - DNA, 14 bp, D. melanogaster
tgcaactgaaactg

SEQ ID NO: 653205 - DNA, 13 bp, D. melanogaster
tgcaactgaaatg

SEQ ID NO: 653206 - DNA, 13 bp, D. melanogaster
tgcaactgcaaat

SEQ ID NO: 653207 - DNA, 13 bp, D. melanogaster
tgcaactgcaaca

SEQ ID NO: 653208 - DNA, 14 bp, D. melanogaster
tgcaactgcaacaa

SEQ ID NO: 653209 - DNA, 14 bp, D. melanogaster
tgcaactgcaaccg

SEQ ID NO: 653210 - DNA, 13 bp, D. melanogaster
tgcaactgcaact

SEQ ID NO: 653211 - DNA, 14 bp, D. melanogaster
tgcaactgcaactg

SEQ ID NO: 653212 - DNA, 13 bp, D. melanogaster
tgcaactgcaagt

SEQ ID NO: 653213 - DNA, 13 bp, D. melanogaster
tgcaactgcaatc

SEQ ID NO: 653214 - DNA, 13 bp, D. melanogaster
tgcaactgcaatt

SEQ ID NO: 653215 - DNA, 14 bp, D. melanogaster
tgcaactgcaattg

SEQ ID NO: 653216 - DNA, 13 bp, D. melanogaster
tgcaactgcagcg

SEQ ID NO: 653217 - DNA, 13 bp, D. melanogaster
tgcaactgcagct

SEQ ID NO: 653218 - DNA, 14 bp, D. melanogaster
tgcaactgcagctg

SEQ ID NO: 653219 - DNA, 13 bp, D. melanogaster
tgcaactgcagtc

SEQ ID NO: 653220 - DNA, 13 bp, D. melanogaster
tgcaactgcagtt

SEQ ID NO: 653221 - DNA, 14 bp, D. melanogaster
tgcaactgcagttg

SEQ ID NO: 653222 - DNA, 13 bp, D. melanogaster
tgcaactgcatct

SEQ ID NO: 653223 - DNA, 14 bp, D. melanogaster
tgcaactgcatctg

SEQ ID NO: 653224 - DNA, 13 bp, D. melanogaster
tgcaactgccaac

SEQ ID NO: 653225 - DNA, 13 bp, D. melanogaster
tgcaactgccact

SEQ ID NO: 653226 - DNA, 14 bp, D. melanogaster
tgcaactgccactg

SEQ ID NO: 653227 - DNA, 13 bp, D. melanogaster
tgcaactgctgca

SEQ ID NO: 653228 - DNA, 14 bp, D. melanogaster
tgcaactgctgcaa

SEQ ID NO: 653229 - DNA, 13 bp, D. melanogaster
tgcaactgctgcc

SEQ ID NO: 653230 - DNA, 14 bp, D. melanogaster
tgcaactgctgctg

SEQ ID NO: 653231 - DNA, 13 bp, D. melanogaster
tgcaactggcaac

SEQ ID NO: 653232 - DNA, 14 bp, D. melanogaster
tgcaactggcaact

SEQ ID NO: 653233 - DNA, 13 bp, D. melanogaster
tgcaactggccat

SEQ ID NO: 653234 - DNA, 13 bp, D. melanogaster
tgcaactgttgca

SEQ ID NO: 653235 - DNA, 13 bp, D. melanogaster
tgcaactgtttta

SEQ ID NO: 653236 - DNA, 13 bp, D. melanogaster
tgcaacttaatta

SEQ ID NO: 653237 - DNA, 13 bp, D. melanogaster
tgcaacttgcaac

SEQ ID NO: 653238 - DNA, 14 bp, D. melanogaster
tgcaacttgcaaca

SEQ ID NO: 653239 - DNA, 13 bp, D. melanogaster
tgcaactttaaat

SEQ ID NO: 653240 - DNA, 13 bp, D. melanogaster
tgcaactttaatg

SEQ ID NO: 653241 - DNA, 13 bp, D. melanogaster
tgcaactttatta

SEQ ID NO: 653242 - DNA, 13 bp, D. melanogaster
tgcaactttattt

SEQ ID NO: 653243 - DNA, 13 bp, D. melanogaster
tgcaacttttgcg

SEQ ID NO: 653244 - DNA, 13 bp, D. melanogaster
tgcaacttttgct

SEQ ID NO: 653245 - DNA, 13 bp, D. melanogaster
tgcaacttttggc

SEQ ID NO: 653246 - DNA, 13 bp, D. melanogaster
tgcaacttttgtg

SEQ ID NO: 653247 - DNA, 13 bp, D. melanogaster
tgcaactttttgc

SEQ ID NO: 653248 - DNA, 13 bp, D. melanogaster
tgcaactttttgt

SEQ ID NO: 653249 - DNA, 13 bp, D. melanogaster
tgcaagaaaaaag

SEQ ID NO: 653250 - DNA, 13 bp, D. melanogaster
tgcaagaaaaaca

SEQ ID NO: 653251 - DNA, 13 bp, D. melanogaster
tgcaagaaaatat

SEQ ID NO: 653252 - DNA, 13 bp, D. melanogaster
tgcaagaaaatgt

SEQ ID NO: 653253 - DNA, 13 bp, D. melanogaster
tgcaagaaaatta

SEQ ID NO: 653254 - DNA, 14 bp, D. melanogaster
tgcaagaaaattag

SEQ ID NO: 653255 - DNA, 13 bp, D. melanogaster
tgcaagaagaaaa

SEQ ID NO: 653256 - DNA, 13 bp, D. melanogaster
tgcaagacaaaca

SEQ ID NO: 653257 - DNA, 13 bp, D. melanogaster
tgcaagagaaaaa

SEQ ID NO: 653258 - DNA, 13 bp, D. melanogaster
tgcaagatacaca

SEQ ID NO: 653259 - DNA, 13 bp, D. melanogaster
tgcaagatttatg

SEQ ID NO: 653260 - DNA, 13 bp, D. melanogaster
tgcaagcaagcaa

SEQ ID NO: 653261 - DNA, 14 bp, D. melanogaster
tgcaagcaggcaca

SEQ ID NO: 653262 - DNA, 13 bp, D. melanogaster
tgcaagcaggcca

SEQ ID NO: 653263 - DNA, 14 bp, D. melanogaster
tgcaagcaggccac

SEQ ID NO: 653264 - DNA, 13 bp, D. melanogaster
tgcaagcagtgca

SEQ ID NO: 653265 - DNA, 13 bp, D. melanogaster
tgcaagccataaa

SEQ ID NO: 653266 - DNA, 13 bp, D. melanogaster
tgcaagctgcact

SEQ ID NO: 653267 - DNA, 13 bp, D. melanogaster
tgcaaggatattt

SEQ ID NO: 653268 - DNA, 13 bp, D. melanogaster
tgcaaggcaaaca

SEQ ID NO: 653269 - DNA, 13 bp, D. melanogaster
tgcaagtgaaaat

SEQ ID NO: 653270 - DNA, 13 bp, D. melanogaster
tgcaagtgcaact

SEQ ID NO: 653271 - DNA, 13 bp, D. melanogaster
tgcaagtgcaagt

SEQ ID NO: 653272 - DNA, 13 bp, D. melanogaster
tgcaagtgcagca

SEQ ID NO: 653273 - DNA, 13 bp, D. melanogaster
tgcaagtgcagtt

SEQ ID NO: 653274 - DNA, 13 bp, D. melanogaster
tgcaagtggaact

SEQ ID NO: 653275 - DNA, 13 bp, D. melanogaster
tgcaagtggccaa

SEQ ID NO: 653276 - DNA, 13 bp, D. melanogaster
tgcaagtgtgagt

SEQ ID NO: 653277 - DNA, 14 bp, D. melanogaster
tgcaagtgtgtgtg

SEQ ID NO: 653278 - DNA, 13 bp, D. melanogaster
tgcaagtgttgca

SEQ ID NO: 653279 - DNA, 13 bp, D. melanogaster
tgcaagtgtttgc

SEQ ID NO: 653280 - DNA, 13 bp, D. melanogaster
tgcaagttaatgc

SEQ ID NO: 653281 - DNA, 13 bp, D. melanogaster
tgcaagttgcaac

SEQ ID NO: 653282 - DNA, 14 bp, D. melanogaster
tgcaagttgcaact

SEQ ID NO: 653283 - DNA, 13 bp, D. melanogaster
tgcaagtttattt

SEQ ID NO: 653284 - DNA, 13 bp, D. melanogaster
tgcaagttttttt

SEQ ID NO: 653285 - DNA, 14 bp, D. melanogaster
tgcaataaaaacaa

SEQ ID NO: 653286 - DNA, 13 bp, D. melanogaster
tgcaataaaagcg

SEQ ID NO: 653287 - DNA, 13 bp, D. melanogaster
tgcaataaaatgt

SEQ ID NO: 653288 - DNA, 13 bp, D. melanogaster
tgcaataaaattt

SEQ ID NO: 653289 - DNA, 14 bp, D. melanogaster
tgcaataaaattta

SEQ ID NO: 653290 - DNA, 13 bp, D. melanogaster
tgcaataaaccaa

SEQ ID NO: 653291 - DNA, 13 bp, D. melanogaster
tgcaataaacttg

SEQ ID NO: 653292 - DNA, 13 bp, D. melanogaster
tgcaataaacttt

SEQ ID NO: 653293 - DNA, 14 bp, D. melanogaster
tgcaataaatacaa

SEQ ID NO: 653294 - DNA, 13 bp, D. melanogaster
tgcaataaatata

SEQ ID NO: 653295 - DNA, 13 bp, D. melanogaster
tgcaataaatatt

SEQ ID NO: 653296 - DNA, 13 bp, D. melanogaster
tgcaataaatcaa

SEQ ID NO: 653297 - DNA, 14 bp, D. melanogaster
tgcaataaatcaaa

SEQ ID NO: 653298 - DNA, 13 bp, D. melanogaster
tgcaataaattta

SEQ ID NO: 653299 - DNA, 13 bp, D. melanogaster
tgcaataacaaca

SEQ ID NO: 653300 - DNA, 14 bp, D. melanogaster
tgcaataacaacaa

SEQ ID NO: 653301 - DNA, 13 bp, D. melanogaster
tgcaataacaatt

SEQ ID NO: 653302 - DNA, 13 bp, D. melanogaster
tgcaataacttta

SEQ ID NO: 653303 - DNA, 13 bp, D. melanogaster
tgcaatacaaata

SEQ ID NO: 653304 - DNA, 13 bp, D. melanogaster
tgcaatagaattt

SEQ ID NO: 653305 - DNA, 13 bp, D. melanogaster
tgcaatagcaaca

SEQ ID NO: 653306 - DNA, 13 bp, D. melanogaster
tgcaatatacata

SEQ ID NO: 653307 - DNA, 13 bp, D. melanogaster
tgcaatatataca

SEQ ID NO: 653308 - DNA, 13 bp, D. melanogaster
tgcaatatattta

SEQ ID NO: 653309 - DNA, 13 bp, D. melanogaster
tgcaatatatttt

SEQ ID NO: 653310 - DNA, 13 bp, D. melanogaster
tgcaatatgaaaa

SEQ ID NO: 653311 - DNA, 13 bp, D. melanogaster
tgcaatatgcaca

SEQ ID NO: 653312 - DNA, 13 bp, D. melanogaster
tgcaatatgcatt

SEQ ID NO: 653313 - DNA, 13 bp, D. melanogaster
tgcaatatggtaa

SEQ ID NO: 653314 - DNA, 13 bp, D. melanogaster
tgcaatattcaaa

SEQ ID NO: 653315 - DNA, 13 bp, D. melanogaster
tgcaatatttaca

SEQ ID NO: 653316 - DNA, 13 bp, D. melanogaster
tgcaatatttatt

SEQ ID NO: 653317 - DNA, 14 bp, D. melanogaster
tgcaatatttattt

SEQ ID NO: 653318 - DNA, 13 bp, D. melanogaster
tgcaatattttaa

SEQ ID NO: 653319 - DNA, 13 bp, D. melanogaster
tgcaatattttat

SEQ ID NO: 653320 - DNA, 13 bp, D. melanogaster
tgcaatattttca

SEQ ID NO: 653321 - DNA, 13 bp, D. melanogaster
tgcaatatttttc

SEQ ID NO: 653322 - DNA, 13 bp, D. melanogaster
tgcaatatttttt

SEQ ID NO: 653323 - DNA, 13 bp, D. melanogaster
tgcaatcaaataa

SEQ ID NO: 653324 - DNA, 13 bp, D. melanogaster
tgcaatcaaatta

SEQ ID NO: 653325 - DNA, 13 bp, D. melanogaster
tgcaatcaataat

SEQ ID NO: 653326 - DNA, 13 bp, D. melanogaster
tgcaatcaattta

SEQ ID NO: 653327 - DNA, 13 bp, D. melanogaster
tgcaatcagcaaa

SEQ ID NO: 653328 - DNA, 13 bp, D. melanogaster
tgcaatcgaaaaa

SEQ ID NO: 653329 - DNA, 13 bp, D. melanogaster
tgcaatcgaaaat

SEQ ID NO: 653330 - DNA, 13 bp, D. melanogaster
tgcaatcgcaatt

SEQ ID NO: 653331 - DNA, 14 bp, D. melanogaster
tgcaatcgttatat

SEQ ID NO: 653332 - DNA, 13 bp, D. melanogaster
tgcaatctgcaat

SEQ ID NO: 653333 - DNA, 13 bp, D. melanogaster
tgcaatgaaaata

SEQ ID NO: 653334 - DNA, 13 bp, D. melanogaster
tgcaatgaaagtg

SEQ ID NO: 653335 - DNA, 13 bp, D. melanogaster
tgcaatgaaatat

SEQ ID NO: 653336 - DNA, 13 bp, D. melanogaster
tgcaatgaaatta

SEQ ID NO: 653337 - DNA, 13 bp, D. melanogaster
tgcaatgaatgca

SEQ ID NO: 653338 - DNA, 13 bp, D. melanogaster
tgcaatgaattta

SEQ ID NO: 653339 - DNA, 14 bp, D. melanogaster
tgcaatgaatttat

SEQ ID NO: 653340 - DNA, 14 bp, D. melanogaster
tgcaatgagccaag

SEQ ID NO: 653341 - DNA, 13 bp, D. melanogaster
tgcaatgattttt

SEQ ID NO: 653342 - DNA, 13 bp, D. melanogaster
tgcaatgcaaaaa

SEQ ID NO: 653343 - DNA, 13 bp, D. melanogaster
tgcaatgcaaaat

SEQ ID NO: 653344 - DNA, 13 bp, D. melanogaster
tgcaatgcaataa

SEQ ID NO: 653345 - DNA, 13 bp, D. melanogaster
tgcaatgcagcaa

SEQ ID NO: 653346 - DNA, 13 bp, D. melanogaster
tgcaatgcatttt

SEQ ID NO: 653347 - DNA, 13 bp, D. melanogaster
tgcaatgccaaaa

SEQ ID NO: 653348 - DNA, 13 bp, D. melanogaster
tgcaatgccattt

SEQ ID NO: 653349 - DNA, 13 bp, D. melanogaster
tgcaatggaaaat

SEQ ID NO: 653350 - DNA, 13 bp, D. melanogaster
tgcaatggaaatg

SEQ ID NO: 653351 - DNA, 13 bp, D. melanogaster
tgcaatggcaaaa

SEQ ID NO: 653352 - DNA, 13 bp, D. melanogaster
tgcaatggcaatt

SEQ ID NO: 653353 - DNA, 13 bp, D. melanogaster
tgcaatggccaaa

SEQ ID NO: 653354 - DNA, 13 bp, D. melanogaster
tgcaatgggaaaa

SEQ ID NO: 653355 - DNA, 13 bp, D. melanogaster
tgcaatgggaaat

SEQ ID NO: 653356 - DNA, 13 bp, D. melanogaster
tgcaatgtgaaaa

SEQ ID NO: 653357 - DNA, 13 bp, D. melanogaster
tgcaatgtgcaat

SEQ ID NO: 653358 - DNA, 13 bp, D. melanogaster
tgcaatgttgcaa

SEQ ID NO: 653359 - DNA, 14 bp, D. melanogaster
tgcaattaaaaaat

SEQ ID NO: 653360 - DNA, 14 bp, D. melanogaster
tgcaattaaaaatg

SEQ ID NO: 653361 - DNA, 13 bp, D. melanogaster
tgcaattaaaagc

SEQ ID NO: 653362 - DNA, 14 bp, D. melanogaster
tgcaattaaaataa

SEQ ID NO: 653363 - DNA, 14 bp, D. melanogaster
tgcaattaaacaaa

SEQ ID NO: 653364 - DNA, 13 bp, D. melanogaster
tgcaattaaagtg

SEQ ID NO: 653365 - DNA, 13 bp, D. melanogaster
tgcaattaaatca

SEQ ID NO: 653366 - DNA, 13 bp, D. melanogaster
tgcaattaaatgc

SEQ ID NO: 653367 - DNA, 14 bp, D. melanogaster
tgcaattaaattaa

SEQ ID NO: 653368 - DNA, 13 bp, D. melanogaster
tgcaattaacaaa

SEQ ID NO: 653369 - DNA, 13 bp, D. melanogaster
tgcaattaacttt

SEQ ID NO: 653370 - DNA, 13 bp, D. melanogaster
tgcaattaatcaa

SEQ ID NO: 653371 - DNA, 13 bp, D. melanogaster
tgcaattaattaa

SEQ ID NO: 653372 - DNA, 13 bp, D. melanogaster
tgcaattaattga

SEQ ID NO: 653373 - DNA, 13 bp, D. melanogaster
tgcaattacaatg

SEQ ID NO: 653374 - DNA, 13 bp, D. melanogaster
tgcaattacattt

SEQ ID NO: 653375 - DNA, 14 bp, D. melanogaster
tgcaattactaaac

SEQ ID NO: 653376 - DNA, 13 bp, D. melanogaster
tgcaattacttaa

SEQ ID NO: 653377 - DNA, 13 bp, D. melanogaster
tgcaattactttt

SEQ ID NO: 653378 - DNA, 13 bp, D. melanogaster
tgcaattagtttt

SEQ ID NO: 653379 - DNA, 13 bp, D. melanogaster
tgcaattataaat

SEQ ID NO: 653380 - DNA, 13 bp, D. melanogaster
tgcaattatacaa

SEQ ID NO: 653381 - DNA, 13 bp, D. melanogaster
tgcaattatgcaa

SEQ ID NO: 653382 - DNA, 13 bp, D. melanogaster
tgcaattatgtaa

SEQ ID NO: 653383 - DNA, 13 bp, D. melanogaster
tgcaattattata

SEQ ID NO: 653384 - DNA, 13 bp, D. melanogaster
tgcaattattcaa

SEQ ID NO: 653385 - DNA, 13 bp, D. melanogaster
tgcaattatttat

SEQ ID NO: 653386 - DNA, 13 bp, D. melanogaster
tgcaattcaaagt

SEQ ID NO: 653387 - DNA, 14 bp, D. melanogaster
tgcaattcaattaa

SEQ ID NO: 653388 - DNA, 13 bp, D. melanogaster
tgcaattcattaa

SEQ ID NO: 653389 - DNA, 13 bp, D. melanogaster
tgcaattcattta

SEQ ID NO: 653390 - DNA, 13 bp, D. melanogaster
tgcaattcgattg

SEQ ID NO: 653391 - DNA, 13 bp, D. melanogaster
tgcaattgaaaag

SEQ ID NO: 653392 - DNA, 13 bp, D. melanogaster
tgcaattgaaatg

SEQ ID NO: 653393 - DNA, 13 bp, D. melanogaster
tgcaattgaatga

SEQ ID NO: 653394 - DNA, 13 bp, D. melanogaster
tgcaattgaatgg

SEQ ID NO: 653395 - DNA, 13 bp, D. melanogaster
tgcaattgacatt

SEQ ID NO: 653396 - DNA, 13 bp, D. melanogaster
tgcaattgataat

SEQ ID NO: 653397 - DNA, 13 bp, D. melanogaster
tgcaattgatatt

SEQ ID NO: 653398 - DNA, 13 bp, D. melanogaster
tgcaattgcaaat

SEQ ID NO: 653399 - DNA, 14 bp, D. melanogaster
tgcaattgcaaatt

SEQ ID NO: 653400 - DNA, 13 bp, D. melanogaster
tgcaattgcaacg

SEQ ID NO: 653401 - DNA, 13 bp, D. melanogaster
tgcaattgcaata

SEQ ID NO: 653402 - DNA, 13 bp, D. melanogaster
tgcaattgcaatc

SEQ ID NO: 653403 - DNA, 13 bp, D. melanogaster
tgcaattgcaatt

SEQ ID NO: 653404 - DNA, 13 bp, D. melanogaster
tgcaattgcagct

SEQ ID NO: 653405 - DNA, 13 bp, D. melanogaster
tgcaattgcagtt

SEQ ID NO: 653406 - DNA, 13 bp, D. melanogaster
tgcaattgcattt

SEQ ID NO: 653407 - DNA, 14 bp, D. melanogaster
tgcaattgcatttt

SEQ ID NO: 653408 - DNA, 13 bp, D. melanogaster
tgcaattgccaaa

SEQ ID NO: 653409 - DNA, 13 bp, D. melanogaster
tgcaattgccatt

SEQ ID NO: 653410 - DNA, 13 bp, D. melanogaster
tgcaattgcgatt

SEQ ID NO: 653411 - DNA, 13 bp, D. melanogaster
tgcaattgctatt

SEQ ID NO: 653412 - DNA, 13 bp, D. melanogaster
tgcaattgctgcc

SEQ ID NO: 653413 - DNA, 13 bp, D. melanogaster
tgcaattgctgga

SEQ ID NO: 653414 - DNA, 13 bp, D. melanogaster
tgcaattgctgtt

SEQ ID NO: 653415 - DNA, 13 bp, D. melanogaster
tgcaattgctttg

SEQ ID NO: 653416 - DNA, 13 bp, D. melanogaster
tgcaattggaatt

SEQ ID NO: 653417 - DNA, 13 bp, D. melanogaster
tgcaattggattt

SEQ ID NO: 653418 - DNA, 13 bp, D. melanogaster
tgcaattggccaa

SEQ ID NO: 653419 - DNA, 13 bp, D. melanogaster
tgcaattggctgc

SEQ ID NO: 653420 - DNA, 13 bp, D. melanogaster
tgcaattggcttg

SEQ ID NO: 653421 - DNA, 14 bp, D. melanogaster
tgcaattggcttga

SEQ ID NO: 653422 - DNA, 13 bp, D. melanogaster
tgcaattgtggca

SEQ ID NO: 653423 - DNA, 13 bp, D. melanogaster
tgcaattgtgtgt

SEQ ID NO: 653424 - DNA, 14 bp, D. melanogaster
tgcaattgttgctg

SEQ ID NO: 653425 - DNA, 13 bp, D. melanogaster
tgcaattgttgtt

SEQ ID NO: 653426 - DNA, 14 bp, D. melanogaster
tgcaattgttgttg

SEQ ID NO: 653427 - DNA, 13 bp, D. melanogaster
tgcaattgtttaa

SEQ ID NO: 653428 - DNA, 13 bp, D. melanogaster
tgcaattgtttat

SEQ ID NO: 653429 - DNA, 13 bp, D. melanogaster
tgcaatttaaata

SEQ ID NO: 653430 - DNA, 14 bp, D. melanogaster
tgcaatttaaataa

SEQ ID NO: 653431 - DNA, 14 bp, D. melanogaster
tgcaatttaaatgc

SEQ ID NO: 653432 - DNA, 13 bp, D. melanogaster
tgcaatttaataa

SEQ ID NO: 653433 - DNA, 13 bp, D. melanogaster
tgcaatttaatgt

SEQ ID NO: 653434 - DNA, 14 bp, D. melanogaster
tgcaatttaatttt

SEQ ID NO: 653435 - DNA, 13 bp, D. melanogaster
tgcaatttagttt

SEQ ID NO: 653436 - DNA, 13 bp, D. melanogaster
tgcaatttataaa

SEQ ID NO: 653437 - DNA, 13 bp, D. melanogaster
tgcaatttatgaa

SEQ ID NO: 653438 - DNA, 13 bp, D. melanogaster
tgcaatttatgat

SEQ ID NO: 653439 - DNA, 13 bp, D. melanogaster
tgcaatttatgca

SEQ ID NO: 653440 - DNA, 13 bp, D. melanogaster
tgcaatttatgtt

SEQ ID NO: 653441 - DNA, 13 bp, D. melanogaster
tgcaatttattat

SEQ ID NO: 653442 - DNA, 13 bp, D. melanogaster
tgcaatttatttg

SEQ ID NO: 653443 - DNA, 13 bp, D. melanogaster
tgcaatttatttt

SEQ ID NO: 653444 - DNA, 13 bp, D. melanogaster
tgcaatttcaaca

SEQ ID NO: 653445 - DNA, 13 bp, D. melanogaster
tgcaatttcaatt

SEQ ID NO: 653446 - DNA, 13 bp, D. melanogaster
tgcaatttcattt

SEQ ID NO: 653447 - DNA, 14 bp, D. melanogaster
tgcaatttcatttt

SEQ ID NO: 653448 - DNA, 13 bp, D. melanogaster
tgcaatttccaaa

SEQ ID NO: 653449 - DNA, 13 bp, D. melanogaster
tgcaatttccata

SEQ ID NO: 653450 - DNA, 13 bp, D. melanogaster
tgcaatttccatg

SEQ ID NO: 653451 - DNA, 14 bp, D. melanogaster
tgcaatttccattt

SEQ ID NO: 653452 - DNA, 13 bp, D. melanogaster
tgcaatttctggc

SEQ ID NO: 653453 - DNA, 14 bp, D. melanogaster
tgcaatttgaattt

SEQ ID NO: 653454 - DNA, 13 bp, D. melanogaster
tgcaatttgattt

SEQ ID NO: 653455 - DNA, 13 bp, D. melanogaster
tgcaatttgcaat

SEQ ID NO: 653456 - DNA, 13 bp, D. melanogaster
tgcaatttgcatt

SEQ ID NO: 653457 - DNA, 13 bp, D. melanogaster
tgcaatttgccaa

SEQ ID NO: 653458 - DNA, 13 bp, D. melanogaster
tgcaatttgctgc

SEQ ID NO: 653459 - DNA, 13 bp, D. melanogaster
tgcaatttggcaa

SEQ ID NO: 653460 - DNA, 13 bp, D. melanogaster
tgcaatttggcca

SEQ ID NO: 653461 - DNA, 13 bp, D. melanogaster
tgcaatttgtgca

SEQ ID NO: 653462 - DNA, 13 bp, D. melanogaster
tgcaatttgtggc

SEQ ID NO: 653463 - DNA, 13 bp, D. melanogaster
tgcaatttgtgtg

SEQ ID NO: 653464 - DNA, 14 bp, D. melanogaster
tgcaatttgtttat

SEQ ID NO: 653465 - DNA, 13 bp, D. melanogaster
tgcaatttgtttc

SEQ ID NO: 653466 - DNA, 13 bp, D. melanogaster
tgcaattttaaaa

SEQ ID NO: 653467 - DNA, 13 bp, D. melanogaster
tgcaattttaata

SEQ ID NO: 653468 - DNA, 13 bp, D. melanogaster
tgcaattttaatg

SEQ ID NO: 653469 - DNA, 14 bp, D. melanogaster
tgcaattttaatgc

SEQ ID NO: 653470 - DNA, 13 bp, D. melanogaster
tgcaattttaatt

SEQ ID NO: 653471 - DNA, 14 bp, D. melanogaster
tgcaattttaattt

SEQ ID NO: 653472 - DNA, 13 bp, D. melanogaster
tgcaattttatga

SEQ ID NO: 653473 - DNA, 13 bp, D. melanogaster
tgcaattttattt

SEQ ID NO: 653474 - DNA, 13 bp, D. melanogaster
tgcaattttcaag

SEQ ID NO: 653475 - DNA, 13 bp, D. melanogaster
tgcaattttcagt

SEQ ID NO: 653476 - DNA, 13 bp, D. melanogaster
tgcaattttcatt

SEQ ID NO: 653477 - DNA, 13 bp, D. melanogaster
tgcaattttccac

SEQ ID NO: 653478 - DNA, 13 bp, D. melanogaster
tgcaattttccca

SEQ ID NO: 653479 - DNA, 13 bp, D. melanogaster
tgcaattttctca

SEQ ID NO: 653480 - DNA, 13 bp, D. melanogaster
tgcaattttcttt

SEQ ID NO: 653481 - DNA, 13 bp, D. melanogaster
tgcaattttgcaa

SEQ ID NO: 653482 - DNA, 13 bp, D. melanogaster
tgcaattttgtgc

SEQ ID NO: 653483 - DNA, 13 bp, D. melanogaster
tgcaattttgtgt

SEQ ID NO: 653484 - DNA, 13 bp, D. melanogaster
tgcaattttgttg

SEQ ID NO: 653485 - DNA, 13 bp, D. melanogaster
tgcaattttgttt

SEQ ID NO: 653486 - DNA, 13 bp, D. melanogaster
tgcaatttttgca

SEQ ID NO: 653487 - DNA, 13 bp, D. melanogaster
tgcaatttttgtt

SEQ ID NO: 653488 - DNA, 14 bp, D. melanogaster
tgcaatttttttta

SEQ ID NO: 653489 - DNA, 13 bp, D. melanogaster
tgcacaaaaaaga

SEQ ID NO: 653490 - DNA, 13 bp, D. melanogaster
tgcacaaaaagaa

SEQ ID NO: 653491 - DNA, 13 bp, D. melanogaster
tgcacaaaacaca

SEQ ID NO: 653492 - DNA, 13 bp, D. melanogaster
tgcacaaaaggca

SEQ ID NO: 653493 - DNA, 13 bp, D. melanogaster
tgcacaaaagtgc

SEQ ID NO: 653494 - DNA, 13 bp, D. melanogaster
tgcacaaaagttg

SEQ ID NO: 653495 - DNA, 13 bp, D. melanogaster
tgcacaaaagttt

SEQ ID NO: 653496 - DNA, 13 bp, D. melanogaster
tgcacaaaatatg

SEQ ID NO: 653497 - DNA, 13 bp, D. melanogaster
tgcacaaaatgca

SEQ ID NO: 653498 - DNA, 13 bp, D. melanogaster
tgcacaaacaaaa

SEQ ID NO: 653499 - DNA, 13 bp, D. melanogaster
tgcacaaacacaa

SEQ ID NO: 653500 - DNA, 13 bp, D. melanogaster
tgcacaaacacac

SEQ ID NO: 653501 - DNA, 13 bp, D. melanogaster
tgcacaaacattt

SEQ ID NO: 653502 - DNA, 13 bp, D. melanogaster
tgcacaaagaaaa

SEQ ID NO: 653503 - DNA, 13 bp, D. melanogaster
tgcacaaagcaaa

SEQ ID NO: 653504 - DNA, 13 bp, D. melanogaster
tgcacaaataaat

SEQ ID NO: 653505 - DNA, 13 bp, D. melanogaster
tgcacaaatacaa

SEQ ID NO: 653506 - DNA, 13 bp, D. melanogaster
tgcacaaatattt

SEQ ID NO: 653507 - DNA, 13 bp, D. melanogaster
tgcacaaatcaca

SEQ ID NO: 653508 - DNA, 13 bp, D. melanogaster
tgcacaaatgcag

SEQ ID NO: 653509 - DNA, 13 bp, D. melanogaster
tgcacaaattata

SEQ ID NO: 653510 - DNA, 13 bp, D. melanogaster
tgcacaaattgca

SEQ ID NO: 653511 - DNA, 13 bp, D. melanogaster
tgcacaaatttgc

SEQ ID NO: 653512 - DNA, 13 bp, D. melanogaster
tgcacaacaaaaa

SEQ ID NO: 653513 - DNA, 13 bp, D. melanogaster
tgcacaacaaaca

SEQ ID NO: 653514 - DNA, 14 bp, D. melanogaster
tgcacaacaacaac

SEQ ID NO: 653515 - DNA, 13 bp, D. melanogaster
tgcacaacaataa

SEQ ID NO: 653516 - DNA, 13 bp, D. melanogaster
tgcacaacaccac

SEQ ID NO: 653517 - DNA, 13 bp, D. melanogaster
tgcacaacagcaa

SEQ ID NO: 653518 - DNA, 13 bp, D. melanogaster
tgcacaacatttt

SEQ ID NO: 653519 - DNA, 13 bp, D. melanogaster
tgcacaacgaaaa

SEQ ID NO: 653520 - DNA, 13 bp, D. melanogaster
tgcacaagaaaaa

SEQ ID NO: 653521 - DNA, 13 bp, D. melanogaster
tgcacaataaaat

SEQ ID NO: 653522 - DNA, 13 bp, D. melanogaster
tgcacaatatttt

SEQ ID NO: 653523 - DNA, 13 bp, D. melanogaster
tgcacaatgcaca

SEQ ID NO: 653524 - DNA, 13 bp, D. melanogaster
tgcacaattaaaa

SEQ ID NO: 653525 - DNA, 13 bp, D. melanogaster
tgcacaattaatt

SEQ ID NO: 653526 - DNA, 13 bp, D. melanogaster
tgcacaattgcaa

SEQ ID NO: 653527 - DNA, 14 bp, D. melanogaster
tgcacaattgtcac

SEQ ID NO: 653528 - DNA, 13 bp, D. melanogaster
tgcacaatttatg

SEQ ID NO: 653529 - DNA, 13 bp, D. melanogaster
tgcacaatttgca

SEQ ID NO: 653530 - DNA, 13 bp, D. melanogaster
tgcacaatttgct

SEQ ID NO: 653531 - DNA, 13 bp, D. melanogaster
tgcacaattttaa

SEQ ID NO: 653532 - DNA, 13 bp, D. melanogaster
tgcacacaaaaat

SEQ ID NO: 653533 - DNA, 13 bp, D. melanogaster
tgcacacaaaatt

SEQ ID NO: 653534 - DNA, 13 bp, D. melanogaster
tgcacacaaacaa

SEQ ID NO: 653535 - DNA, 13 bp, D. melanogaster
tgcacacacaaaa

SEQ ID NO: 653536 - DNA, 14 bp, D. melanogaster
tgcacacacaaaca

SEQ ID NO: 653537 - DNA, 13 bp, D. melanogaster
tgcacacacaaca

SEQ ID NO: 653538 - DNA, 13 bp, D. melanogaster
tgcacacacacgc

SEQ ID NO: 653539 - DNA, 13 bp, D. melanogaster
tgcacacacactc

SEQ ID NO: 653540 - DNA, 13 bp, D. melanogaster
tgcacacacatat

SEQ ID NO: 653541 - DNA, 14 bp, D. melanogaster
tgcacacacgcaca

SEQ ID NO: 653542 - DNA, 13 bp, D. melanogaster
tgcacacactcac

SEQ ID NO: 653543 - DNA, 13 bp, D. melanogaster
tgcacacagaaaa

SEQ ID NO: 653544 - DNA, 13 bp, D. melanogaster
tgcacacagaaat

SEQ ID NO: 653545 - DNA, 13 bp, D. melanogaster
tgcacacagagaa

SEQ ID NO: 653546 - DNA, 14 bp, D. melanogaster
tgcacacatacaga

SEQ ID NO: 653547 - DNA, 13 bp, D. melanogaster
tgcacacatatat

SEQ ID NO: 653548 - DNA, 13 bp, D. melanogaster
tgcacacatattt

SEQ ID NO: 653549 - DNA, 14 bp, D. melanogaster
tgcacaccacccac

SEQ ID NO: 653550 - DNA, 13 bp, D. melanogaster
tgcacacgcacac

SEQ ID NO: 653551 - DNA, 13 bp, D. melanogaster
tgcacacttttaa

SEQ ID NO: 653552 - DNA, 13 bp, D. melanogaster
tgcacagaaaaaa

SEQ ID NO: 653553 - DNA, 13 bp, D. melanogaster
tgcacagaaaata

SEQ ID NO: 653554 - DNA, 14 bp, D. melanogaster
tgcacagagagaaa

SEQ ID NO: 653555 - DNA, 13 bp, D. melanogaster
tgcacagatttat

SEQ ID NO: 653556 - DNA, 13 bp, D. melanogaster
tgcacagcaaaaa

SEQ ID NO: 653557 - DNA, 13 bp, D. melanogaster
tgcacagcacatt

SEQ ID NO: 653558 - DNA, 14 bp, D. melanogaster
tgcacagcgaaaaa

SEQ ID NO: 653559 - DNA, 14 bp, D. melanogaster
tgcacagcgagaaa

SEQ ID NO: 653560 - DNA, 13 bp, D. melanogaster
tgcacagctggcg

SEQ ID NO: 653561 - DNA, 13 bp, D. melanogaster
tgcacaggaaaaa

SEQ ID NO: 653562 - DNA, 13 bp, D. melanogaster
tgcacaggaagaa

SEQ ID NO: 653563 - DNA, 14 bp, D. melanogaster
tgcacaggaagaaa

SEQ ID NO: 653564 - DNA, 14 bp, D. melanogaster
tgcacagtgaaaaa

SEQ ID NO: 653565 - DNA, 13 bp, D. melanogaster
tgcacagtgagaa

SEQ ID NO: 653566 - DNA, 13 bp, D. melanogaster
tgcacagtgggtc

SEQ ID NO: 653567 - DNA, 13 bp, D. melanogaster
tgcacagtggttc

SEQ ID NO: 653568 - DNA, 13 bp, D. melanogaster
tgcacataaaaaa

SEQ ID NO: 653569 - DNA, 14 bp, D. melanogaster
tgcacataaaaaaa

SEQ ID NO: 653570 - DNA, 13 bp, D. melanogaster
tgcacataaataa

SEQ ID NO: 653571 - DNA, 13 bp, D. melanogaster
tgcacataaatat

SEQ ID NO: 653572 - DNA, 13 bp, D. melanogaster
tgcacataaattt

SEQ ID NO: 653573 - DNA, 13 bp, D. melanogaster
tgcacataattca

SEQ ID NO: 653574 - DNA, 13 bp, D. melanogaster
tgcacatagaaaa

SEQ ID NO: 653575 - DNA, 14 bp, D. melanogaster
tgcacatatacata

SEQ ID NO: 653576 - DNA, 13 bp, D. melanogaster
tgcacatatatct

SEQ ID NO: 653577 - DNA, 13 bp, D. melanogaster
tgcacatatgcaa

SEQ ID NO: 653578 - DNA, 13 bp, D. melanogaster
tgcacatatgtac

SEQ ID NO: 653579 - DNA, 13 bp, D. melanogaster
tgcacatatgtat

SEQ ID NO: 653580 - DNA, 13 bp, D. melanogaster
tgcacatatttaa

SEQ ID NO: 653581 - DNA, 13 bp, D. melanogaster
tgcacatatttat

SEQ ID NO: 653582 - DNA, 13 bp, D. melanogaster
tgcacatattttt

SEQ ID NO: 653583 - DNA, 13 bp, D. melanogaster
tgcacatccacat

SEQ ID NO: 653584 - DNA, 13 bp, D. melanogaster
tgcacatgcaaat

SEQ ID NO: 653585 - DNA, 13 bp, D. melanogaster
tgcacatgcacac

SEQ ID NO: 653586 - DNA, 13 bp, D. melanogaster
tgcacatgcacat

SEQ ID NO: 653587 - DNA, 14 bp, D. melanogaster
tgcacatgcacatg

SEQ ID NO: 653588 - DNA, 13 bp, D. melanogaster
tgcacatgcattt

SEQ ID NO: 653589 - DNA, 13 bp, D. melanogaster
tgcacatggaaaa

SEQ ID NO: 653590 - DNA, 13 bp, D. melanogaster
tgcacatggaaat

SEQ ID NO: 653591 - DNA, 13 bp, D. melanogaster
tgcacatgggcaa

SEQ ID NO: 653592 - DNA, 13 bp, D. melanogaster
tgcacatgtacat

SEQ ID NO: 653593 - DNA, 13 bp, D. melanogaster
tgcacatgtatgt

SEQ ID NO: 653594 - DNA, 13 bp, D. melanogaster
tgcacatgtgtgt

SEQ ID NO: 653595 - DNA, 13 bp, D. melanogaster
tgcacattaaatt

SEQ ID NO: 653596 - DNA, 13 bp, D. melanogaster
tgcacattaattt

SEQ ID NO: 653597 - DNA, 14 bp, D. melanogaster
tgcacattcaaaat

SEQ ID NO: 653598 - DNA, 13 bp, D. melanogaster
tgcacatttaatt

SEQ ID NO: 653599 - DNA, 13 bp, D. melanogaster
tgcacatttatat

SEQ ID NO: 653600 - DNA, 13 bp, D. melanogaster
tgcacatttattt

SEQ ID NO: 653601 - DNA, 13 bp, D. melanogaster
tgcacatttcgca

SEQ ID NO: 653602 - DNA, 13 bp, D. melanogaster
tgcacattttaat

SEQ ID NO: 653603 - DNA, 13 bp, D. melanogaster
tgcacattttcca

SEQ ID NO: 653604 - DNA, 13 bp, D. melanogaster
tgcacatttttaa

SEQ ID NO: 653605 - DNA, 13 bp, D. melanogaster
tgcacatttttgt

SEQ ID NO: 653606 - DNA, 13 bp, D. melanogaster
tgcacattttttg

SEQ ID NO: 653607 - DNA, 14 bp, D. melanogaster
tgcacatttttttt

SEQ ID NO: 653608 - DNA, 13 bp, D. melanogaster
tgcaccaccacca

SEQ ID NO: 653609 - DNA, 14 bp, D. melanogaster
tgcaccaccaccac

SEQ ID NO: 653610 - DNA, 13 bp, D. melanogaster
tgcaccacccact

SEQ ID NO: 653611 - DNA, 13 bp, D. melanogaster
tgcaccacgcaac

SEQ ID NO: 653612 - DNA, 13 bp, D. melanogaster
tgcaccactgtgc

SEQ ID NO: 653613 - DNA, 13 bp, D. melanogaster
tgcaccagctgcc

SEQ ID NO: 653614 - DNA, 13 bp, D. melanogaster
tgcaccataaaaa

SEQ ID NO: 653615 - DNA, 13 bp, D. melanogaster
tgcacccaaaaaa

SEQ ID NO: 653616 - DNA, 14 bp, D. melanogaster
tgcacccaaaaaaa

SEQ ID NO: 653617 - DNA, 13 bp, D. melanogaster
tgcacccaatata

SEQ ID NO: 653618 - DNA, 13 bp, D. melanogaster
tgcacccaatggg

SEQ ID NO: 653619 - DNA, 13 bp, D. melanogaster
tgcaccgaaagaa

SEQ ID NO: 653620 - DNA, 13 bp, D. melanogaster
tgcaccgcactgc

SEQ ID NO: 653621 - DNA, 14 bp, D. melanogaster
tgcaccggaaaaaa

SEQ ID NO: 653622 - DNA, 13 bp, D. melanogaster
tgcacctgcaaac

SEQ ID NO: 653623 - DNA, 13 bp, D. melanogaster
tgcacctgcaatc

SEQ ID NO: 653624 - DNA, 13 bp, D. melanogaster
tgcaccttttcca

SEQ ID NO: 653625 - DNA, 13 bp, D. melanogaster
tgcacgcacacac

SEQ ID NO: 653626 - DNA, 14 bp, D. melanogaster
tgcacggaaagaaa

SEQ ID NO: 653627 - DNA, 13 bp, D. melanogaster
tgcacggcgagaa

SEQ ID NO: 653628 - DNA, 13 bp, D. melanogaster
tgcacgtatgttc

SEQ ID NO: 653629 - DNA, 13 bp, D. melanogaster
tgcacgtggaaaa

SEQ ID NO: 653630 - DNA, 13 bp, D. melanogaster
tgcacgtgtgcat

SEQ ID NO: 653631 - DNA, 13 bp, D. melanogaster
tgcacgtgtgtgt

SEQ ID NO: 653632 - DNA, 14 bp, D. melanogaster
tgcactcaaagaaa

SEQ ID NO: 653633 - DNA, 13 bp, D. melanogaster
tgcactcacacat

SEQ ID NO: 653634 - DNA, 13 bp, D. melanogaster
tgcactcagagaa

SEQ ID NO: 653635 - DNA, 14 bp, D. melanogaster
tgcactcagagaaa

SEQ ID NO: 653636 - DNA, 13 bp, D. melanogaster
tgcactcgaaaaa

SEQ ID NO: 653637 - DNA, 13 bp, D. melanogaster
tgcactcgaaatt

SEQ ID NO: 653638 - DNA, 13 bp, D. melanogaster
tgcactcgaagaa

SEQ ID NO: 653639 - DNA, 13 bp, D. melanogaster
tgcactcgcattc

SEQ ID NO: 653640 - DNA, 13 bp, D. melanogaster
tgcactcgcattt

SEQ ID NO: 653641 - DNA, 13 bp, D. melanogaster
tgcactcggaaaa

SEQ ID NO: 653642 - DNA, 13 bp, D. melanogaster
tgcactcggagaa

SEQ ID NO: 653643 - DNA, 13 bp, D. melanogaster
tgcactctattta

SEQ ID NO: 653644 - DNA, 14 bp, D. melanogaster
tgcactgaaaaaaa

SEQ ID NO: 653645 - DNA, 13 bp, D. melanogaster
tgcactgaaaaat

SEQ ID NO: 653646 - DNA, 14 bp, D. melanogaster
tgcactgaaaacaa

SEQ ID NO: 653647 - DNA, 14 bp, D. melanogaster
tgcactgaaagaaa

SEQ ID NO: 653648 - DNA, 13 bp, D. melanogaster
tgcactgaacaaa

SEQ ID NO: 653649 - DNA, 14 bp, D. melanogaster
tgcactgaacaaaa

SEQ ID NO: 653650 - DNA, 13 bp, D. melanogaster
tgcactgacaaaa

SEQ ID NO: 653651 - DNA, 13 bp, D. melanogaster
tgcactgagaaaa

SEQ ID NO: 653652 - DNA, 14 bp, D. melanogaster
tgcactgagaaaaa

SEQ ID NO: 653653 - DNA, 14 bp, D. melanogaster
tgcactgagagaaa

SEQ ID NO: 653654 - DNA, 14 bp, D. melanogaster
tgcactgagcaaaa

SEQ ID NO: 653655 - DNA, 13 bp, D. melanogaster
tgcactgagcgaa

SEQ ID NO: 653656 - DNA, 14 bp, D. melanogaster
tgcactgagcgaaa

SEQ ID NO: 653657 - DNA, 14 bp, D. melanogaster
tgcactgcaaaaaa

SEQ ID NO: 653658 - DNA, 13 bp, D. melanogaster
tgcactgcaaatg

SEQ ID NO: 653659 - DNA, 13 bp, D. melanogaster
tgcactgcaagaa

SEQ ID NO: 653660 - DNA, 14 bp, D. melanogaster
tgcactgcaagaaa

SEQ ID NO: 653661 - DNA, 13 bp, D. melanogaster
tgcactgcacaaa

SEQ ID NO: 653662 - DNA, 13 bp, D. melanogaster
tgcactgcactgc

SEQ ID NO: 653663 - DNA, 14 bp, D. melanogaster
tgcactgcactgca

SEQ ID NO: 653664 - DNA, 13 bp, D. melanogaster
tgcactgcacttt

SEQ ID NO: 653665 - DNA, 13 bp, D. melanogaster
tgcactgcagttt

SEQ ID NO: 653666 - DNA, 13 bp, D. melanogaster
tgcactgcatttg

SEQ ID NO: 653667 - DNA, 13 bp, D. melanogaster
tgcactgcatttt

SEQ ID NO: 653668 - DNA, 13 bp, D. melanogaster
tgcactgccagca

SEQ ID NO: 653669 - DNA, 14 bp, D. melanogaster
tgcactgcgagaaa

SEQ ID NO: 653670 - DNA, 14 bp, D. melanogaster
tgcactgcgcgaaa

SEQ ID NO: 653671 - DNA, 13 bp, D. melanogaster
tgcactgcgctgc

SEQ ID NO: 653672 - DNA, 13 bp, D. melanogaster
tgcactgcggaaa

SEQ ID NO: 653673 - DNA, 13 bp, D. melanogaster
tgcactgcttgca

SEQ ID NO: 653674 - DNA, 13 bp, D. melanogaster
tgcactggaaaaa

SEQ ID NO: 653675 - DNA, 14 bp, D. melanogaster
tgcactggaaaaaa

SEQ ID NO: 653676 - DNA, 13 bp, D. melanogaster
tgcactggaaaat

SEQ ID NO: 653677 - DNA, 13 bp, D. melanogaster
tgcactggaaaca

SEQ ID NO: 653678 - DNA, 14 bp, D. melanogaster
tgcactggaagaaa

SEQ ID NO: 653679 - DNA, 13 bp, D. melanogaster
tgcactggcaaaa

SEQ ID NO: 653680 - DNA, 14 bp, D. melanogaster
tgcactggcagaaa

SEQ ID NO: 653681 - DNA, 14 bp, D. melanogaster
tgcactgggagaaa

SEQ ID NO: 653682 - DNA, 14 bp, D. melanogaster
tgcactgggcgaaa

SEQ ID NO: 653683 - DNA, 13 bp, D. melanogaster
tgcactgtaaaaa

SEQ ID NO: 653684 - DNA, 14 bp, D. melanogaster
tgcactgtaaaaaa

SEQ ID NO: 653685 - DNA, 13 bp, D. melanogaster
tgcactgtgagaa

SEQ ID NO: 653686 - DNA, 13 bp, D. melanogaster
tgcactgtggaaa

SEQ ID NO: 653687 - DNA, 13 bp, D. melanogaster
tgcactgttttgc

SEQ ID NO: 653688 - DNA, 13 bp, D. melanogaster
tgcacttaaaaaa

SEQ ID NO: 653689 - DNA, 13 bp, D. melanogaster
tgcacttaaaatt

SEQ ID NO: 653690 - DNA, 13 bp, D. melanogaster
tgcacttaatgca

SEQ ID NO: 653691 - DNA, 13 bp, D. melanogaster
tgcacttacaaaa

SEQ ID NO: 653692 - DNA, 14 bp, D. melanogaster
tgcacttagagaaa

SEQ ID NO: 653693 - DNA, 13 bp, D. melanogaster
tgcacttatactt

SEQ ID NO: 653694 - DNA, 13 bp, D. melanogaster
tgcacttcaaagt

SEQ ID NO: 653695 - DNA, 13 bp, D. melanogaster
tgcacttcaagtt

SEQ ID NO: 653696 - DNA, 13 bp, D. melanogaster
tgcacttccactt

SEQ ID NO: 653697 - DNA, 13 bp, D. melanogaster
tgcacttcctttt

SEQ ID NO: 653698 - DNA, 13 bp, D. melanogaster
tgcacttcgtttt

SEQ ID NO: 653699 - DNA, 13 bp, D. melanogaster
tgcacttctctat

SEQ ID NO: 653700 - DNA, 13 bp, D. melanogaster
tgcacttcttttg

SEQ ID NO: 653701 - DNA, 13 bp, D. melanogaster
tgcacttgaaaaa

SEQ ID NO: 653702 - DNA, 13 bp, D. melanogaster
tgcacttgaaatt

SEQ ID NO: 653703 - DNA, 13 bp, D. melanogaster
tgcacttgaactt

SEQ ID NO: 653704 - DNA, 13 bp, D. melanogaster
tgcacttgaagaa

SEQ ID NO: 653705 - DNA, 13 bp, D. melanogaster
tgcacttgacttg

SEQ ID NO: 653706 - DNA, 13 bp, D. melanogaster
tgcacttgcaaaa

SEQ ID NO: 653707 - DNA, 13 bp, D. melanogaster
tgcacttgcaatt

SEQ ID NO: 653708 - DNA, 13 bp, D. melanogaster
tgcacttgcactt

SEQ ID NO: 653709 - DNA, 13 bp, D. melanogaster
tgcacttgcagct

SEQ ID NO: 653710 - DNA, 13 bp, D. melanogaster
tgcacttgccttt

SEQ ID NO: 653711 - DNA, 13 bp, D. melanogaster
tgcacttgctgca

SEQ ID NO: 653712 - DNA, 13 bp, D. melanogaster
tgcacttggaaaa

SEQ ID NO: 653713 - DNA, 13 bp, D. melanogaster
tgcacttggagaa

SEQ ID NO: 653714 - DNA, 13 bp, D. melanogaster
tgcacttggcaaa

SEQ ID NO: 653715 - DNA, 13 bp, D. melanogaster
tgcacttggccaa

SEQ ID NO: 653716 - DNA, 13 bp, D. melanogaster
tgcacttggccag

SEQ ID NO: 653717 - DNA, 13 bp, D. melanogaster
tgcacttggctgc

SEQ ID NO: 653718 - DNA, 13 bp, D. melanogaster
tgcacttgtgtgt

SEQ ID NO: 653719 - DNA, 13 bp, D. melanogaster
tgcacttgttgca

SEQ ID NO: 653720 - DNA, 13 bp, D. melanogaster
tgcactttaaaat

SEQ ID NO: 653721 - DNA, 13 bp, D. melanogaster
tgcactttaagca

SEQ ID NO: 653722 - DNA, 13 bp, D. melanogaster
tgcactttacact

SEQ ID NO: 653723 - DNA, 13 bp, D. melanogaster
tgcactttatatt

SEQ ID NO: 653724 - DNA, 13 bp, D. melanogaster
tgcactttgcatt

SEQ ID NO: 653725 - DNA, 13 bp, D. melanogaster
tgcactttgccat

SEQ ID NO: 653726 - DNA, 13 bp, D. melanogaster
tgcactttgctgc

SEQ ID NO: 653727 - DNA, 13 bp, D. melanogaster
tgcactttggcca

SEQ ID NO: 653728 - DNA, 13 bp, D. melanogaster
tgcactttgtgtg

SEQ ID NO: 653729 - DNA, 13 bp, D. melanogaster
tgcactttgtttg

SEQ ID NO: 653730 - DNA, 13 bp, D. melanogaster
tgcactttgtttt

SEQ ID NO: 653731 - DNA, 13 bp, D. melanogaster
tgcacttttaatt

SEQ ID NO: 653732 - DNA, 13 bp, D. melanogaster
tgcacttttccat

SEQ ID NO: 653733 - DNA, 13 bp, D. melanogaster
tgcacttttccgc

SEQ ID NO: 653734 - DNA, 13 bp, D. melanogaster
tgcacttttcttg

SEQ ID NO: 653735 - DNA, 13 bp, D. melanogaster
tgcacttttcttt

SEQ ID NO: 653736 - DNA, 13 bp, D. melanogaster
tgcacttttgcct

SEQ ID NO: 653737 - DNA, 13 bp, D. melanogaster
tgcactttttaat

SEQ ID NO: 653738 - DNA, 13 bp, D. melanogaster
tgcactttttatt

SEQ ID NO: 653739 - DNA, 13 bp, D. melanogaster
tgcactttttgca

SEQ ID NO: 653740 - DNA, 13 bp, D. melanogaster
tgcacttttttat

SEQ ID NO: 653741 - DNA, 13 bp, D. melanogaster
tgcacttttttgc

SEQ ID NO: 653742 - DNA, 14 bp, D. melanogaster
tgcagaaaaaaata

SEQ ID NO: 653743 - DNA, 13 bp, D. melanogaster
tgcagaaaaaata

SEQ ID NO: 653744 - DNA, 13 bp, D. melanogaster
tgcagaaaacatt

SEQ ID NO: 653745 - DNA, 13 bp, D. melanogaster
tgcagaaaacggc

SEQ ID NO: 653746 - DNA, 13 bp, D. melanogaster
tgcagaaaagttt

SEQ ID NO: 653747 - DNA, 13 bp, D. melanogaster
tgcagaaacaaaa

SEQ ID NO: 653748 - DNA, 13 bp, D. melanogaster
tgcagaaacgcat

SEQ ID NO: 653749 - DNA, 14 bp, D. melanogaster
tgcagaaacgcatt

SEQ ID NO: 653750 - DNA, 13 bp, D. melanogaster
tgcagaaaggaaa

SEQ ID NO: 653751 - DNA, 13 bp, D. melanogaster
tgcagaaatcctt

SEQ ID NO: 653752 - DNA, 13 bp, D. melanogaster
tgcagaaatgaaa

SEQ ID NO: 653753 - DNA, 13 bp, D. melanogaster
tgcagaaatttat

SEQ ID NO: 653754 - DNA, 13 bp, D. melanogaster
tgcagaaatttca

SEQ ID NO: 653755 - DNA, 13 bp, D. melanogaster
tgcagaaggcatt

SEQ ID NO: 653756 - DNA, 13 bp, D. melanogaster
tgcagaatgaata

SEQ ID NO: 653757 - DNA, 14 bp, D. melanogaster
tgcagaatgtaatg

SEQ ID NO: 653758 - DNA, 13 bp, D. melanogaster
tgcagaatgtgag

SEQ ID NO: 653759 - DNA, 13 bp, D. melanogaster
tgcagacaacaaa

SEQ ID NO: 653760 - DNA, 13 bp, D. melanogaster
tgcagacacacac

SEQ ID NO: 653761 - DNA, 13 bp, D. melanogaster
tgcagacgcctct

SEQ ID NO: 653762 - DNA, 13 bp, D. melanogaster
tgcagacggcgcc

SEQ ID NO: 653763 - DNA, 13 bp, D. melanogaster
tgcagagaaaaaa

SEQ ID NO: 653764 - DNA, 13 bp, D. melanogaster
tgcagagaaagaa

SEQ ID NO: 653765 - DNA, 13 bp, D. melanogaster
tgcagagccacct

SEQ ID NO: 653766 - DNA, 13 bp, D. melanogaster
tgcagaggaaaaa

SEQ ID NO: 653767 - DNA, 13 bp, D. melanogaster
tgcagagggtata

SEQ ID NO: 653768 - DNA, 13 bp, D. melanogaster
tgcagagtggcga

SEQ ID NO: 653769 - DNA, 13 bp, D. melanogaster
tgcagagttttca

SEQ ID NO: 653770 - DNA, 13 bp, D. melanogaster
tgcagataaataa

SEQ ID NO: 653771 - DNA, 13 bp, D. melanogaster
tgcagatacaaag

SEQ ID NO: 653772 - DNA, 13 bp, D. melanogaster
tgcagatacaaat

SEQ ID NO: 653773 - DNA, 13 bp, D. melanogaster
tgcagatacagat

SEQ ID NO: 653774 - DNA, 13 bp, D. melanogaster
tgcagatacattt

SEQ ID NO: 653775 - DNA, 13 bp, D. melanogaster
tgcagatacggat

SEQ ID NO: 653776 - DNA, 13 bp, D. melanogaster
tgcagatactttt

SEQ ID NO: 653777 - DNA, 13 bp, D. melanogaster
tgcagatatatat

SEQ ID NO: 653778 - DNA, 13 bp, D. melanogaster
tgcagatcaggca

SEQ ID NO: 653779 - DNA, 13 bp, D. melanogaster
tgcagatgcaaat

SEQ ID NO: 653780 - DNA, 14 bp, D. melanogaster
tgcagatgcaaatg

SEQ ID NO: 653781 - DNA, 14 bp, D. melanogaster
tgcagatgcaaatt

SEQ ID NO: 653782 - DNA, 13 bp, D. melanogaster
tgcagatgcagat

SEQ ID NO: 653783 - DNA, 15 bp, D. melanogaster
tgcagatgcagttcc

SEQ ID NO: 653784 - DNA, 14 bp, D. melanogaster
tgcagatggagatg

SEQ ID NO: 653785 - DNA, 13 bp, D. melanogaster
tgcagattcagat

SEQ ID NO: 653786 - DNA, 13 bp, D. melanogaster
tgcagattgcgag

SEQ ID NO: 653787 - DNA, 13 bp, D. melanogaster
tgcagattttttt

SEQ ID NO: 653788 - DNA, 13 bp, D. melanogaster
tgcagcaaaaagt

SEQ ID NO: 653789 - DNA, 13 bp, D. melanogaster
tgcagcaaaagca

SEQ ID NO: 653790 - DNA, 14 bp, D. melanogaster
tgcagcaaaagcaa

SEQ ID NO: 653791 - DNA, 13 bp, D. melanogaster
tgcagcaaacaaa

SEQ ID NO: 653792 - DNA, 13 bp, D. melanogaster
tgcagcaaacaat

SEQ ID NO: 653793 - DNA, 13 bp, D. melanogaster
tgcagcaaaccca

SEQ ID NO: 653794 - DNA, 13 bp, D. melanogaster
tgcagcaaacgta

SEQ ID NO: 653795 - DNA, 13 bp, D. melanogaster
tgcagcaaatgaa

SEQ ID NO: 653796 - DNA, 14 bp, D. melanogaster
tgcagcaaatgcaa

SEQ ID NO: 653797 - DNA, 13 bp, D. melanogaster
tgcagcaaattga

SEQ ID NO: 653798 - DNA, 13 bp, D. melanogaster
tgcagcaaattgc

SEQ ID NO: 653799 - DNA, 13 bp, D. melanogaster
tgcagcaacaaag

SEQ ID NO: 653800 - DNA, 15 bp, D. melanogaster
tgcagcaacaacaac

SEQ ID NO: 653801 - DNA, 13 bp, D. melanogaster
tgcagcaacaata

SEQ ID NO: 653802 - DNA, 14 bp, D. melanogaster
tgcagcaacagcaa

SEQ ID NO: 653803 - DNA, 13 bp, D. melanogaster
tgcagcaacattt

SEQ ID NO: 653804 - DNA, 13 bp, D. melanogaster
tgcagcaactttt

SEQ ID NO: 653805 - DNA, 13 bp, D. melanogaster
tgcagcaagcagc

SEQ ID NO: 653806 - DNA, 13 bp, D. melanogaster
tgcagcaagtgcc

SEQ ID NO: 653807 - DNA, 13 bp, D. melanogaster
tgcagcaataaat

SEQ ID NO: 653808 - DNA, 13 bp, D. melanogaster
tgcagcaatacca

SEQ ID NO: 653809 - DNA, 13 bp, D. melanogaster
tgcagcaatattt

SEQ ID NO: 653810 - DNA, 13 bp, D. melanogaster
tgcagcaatttca

SEQ ID NO: 653811 - DNA, 13 bp, D. melanogaster
tgcagcaatttgt

SEQ ID NO: 653812 - DNA, 13 bp, D. melanogaster
tgcagcacaattt

SEQ ID NO: 653813 - DNA, 13 bp, D. melanogaster
tgcagcacagcca

SEQ ID NO: 653814 - DNA, 13 bp, D. melanogaster
tgcagcacagtgg

SEQ ID NO: 653815 - DNA, 13 bp, D. melanogaster
tgcagcacatttt

SEQ ID NO: 653816 - DNA, 13 bp, D. melanogaster
tgcagcaccaaaa

SEQ ID NO: 653817 - DNA, 13 bp, D. melanogaster
tgcagcacggtac

SEQ ID NO: 653818 - DNA, 13 bp, D. melanogaster
tgcagcagaagca

SEQ ID NO: 653819 - DNA, 13 bp, D. melanogaster
tgcagcagcaaaa

SEQ ID NO: 653820 - DNA, 13 bp, D. melanogaster
tgcagcagcaaca

SEQ ID NO: 653821 - DNA, 14 bp, D. melanogaster
tgcagcagcaacaa

SEQ ID NO: 653822 - DNA, 14 bp, D. melanogaster
tgcagcagcaacac

SEQ ID NO: 653823 - DNA, 14 bp, D. melanogaster
tgcagcagcaacat

SEQ ID NO: 653824 - DNA, 13 bp, D. melanogaster
tgcagcagcaact

SEQ ID NO: 653825 - DNA, 14 bp, D. melanogaster
tgcagcagcaactg

SEQ ID NO: 653826 - DNA, 14 bp, D. melanogaster
tgcagcagcagcaa

SEQ ID NO: 653827 - DNA, 14 bp, D. melanogaster
tgcagcagcagcac

SEQ ID NO: 653828 - DNA, 14 bp, D. melanogaster
tgcagcagcagcgg

SEQ ID NO: 653829 - DNA, 13 bp, D. melanogaster
tgcagcagcagtt

SEQ ID NO: 653830 - DNA, 13 bp, D. melanogaster
tgcagcagcatca

SEQ ID NO: 653831 - DNA, 14 bp, D. melanogaster
tgcagcagcatcag

SEQ ID NO: 653832 - DNA, 15 bp, D. melanogaster
tgcagcagcatcagc

SEQ ID NO: 653833 - DNA, 13 bp, D. melanogaster
tgcagcagcatta

SEQ ID NO: 653834 - DNA, 13 bp, D. melanogaster
tgcagcagcattt

SEQ ID NO: 653835 - DNA, 13 bp, D. melanogaster
tgcagcagccaca

SEQ ID NO: 653836 - DNA, 13 bp, D. melanogaster
tgcagcagcggca

SEQ ID NO: 653837 - DNA, 14 bp, D. melanogaster
tgcagcagcggcag

SEQ ID NO: 653838 - DNA, 13 bp, D. melanogaster
tgcagcagctctt

SEQ ID NO: 653839 - DNA, 13 bp, D. melanogaster
tgcagcagctgcc

SEQ ID NO: 653840 - DNA, 13 bp, D. melanogaster
tgcagcagctgtt

SEQ ID NO: 653841 - DNA, 13 bp, D. melanogaster
tgcagcaggaaaa

SEQ ID NO: 653842 - DNA, 13 bp, D. melanogaster
tgcagcaggagca

SEQ ID NO: 653843 - DNA, 13 bp, D. melanogaster
tgcagcaggcagc

SEQ ID NO: 653844 - DNA, 13 bp, D. melanogaster
tgcagcagtagca

SEQ ID NO: 653845 - DNA, 13 bp, D. melanogaster
tgcagcagttcat

SEQ ID NO: 653846 - DNA, 13 bp, D. melanogaster
tgcagcagttgca

SEQ ID NO: 653847 - DNA, 14 bp, D. melanogaster
tgcagcagttgcag

SEQ ID NO: 653848 - DNA, 13 bp, D. melanogaster
tgcagcagttgct

SEQ ID NO: 653849 - DNA, 13 bp, D. melanogaster
tgcagcagtttac

SEQ ID NO: 653850 - DNA, 13 bp, D. melanogaster
tgcagcagttttc

SEQ ID NO: 653851 - DNA, 13 bp, D. melanogaster
tgcagcataaaat

SEQ ID NO: 653852 - DNA, 13 bp, D. melanogaster
tgcagcataattt

SEQ ID NO: 653853 - DNA, 13 bp, D. melanogaster
tgcagcatatttt

SEQ ID NO: 653854 - DNA, 13 bp, D. melanogaster
tgcagcatcagca

SEQ ID NO: 653855 - DNA, 13 bp, D. melanogaster
tgcagcatcatca

SEQ ID NO: 653856 - DNA, 13 bp, D. melanogaster
tgcagcatgcaac

SEQ ID NO: 653857 - DNA, 14 bp, D. melanogaster
tgcagcatgcagca

SEQ ID NO: 653858 - DNA, 13 bp, D. melanogaster
tgcagcatggaaa

SEQ ID NO: 653859 - DNA, 13 bp, D. melanogaster
tgcagcatttgca

SEQ ID NO: 653860 - DNA, 13 bp, D. melanogaster
tgcagcatttgct

SEQ ID NO: 653861 - DNA, 13 bp, D. melanogaster
tgcagccaaagaa

SEQ ID NO: 653862 - DNA, 13 bp, D. melanogaster
tgcagccaacaaa

SEQ ID NO: 653863 - DNA, 13 bp, D. melanogaster
tgcagccacaaaa

SEQ ID NO: 653864 - DNA, 13 bp, D. melanogaster
tgcagccactttt

SEQ ID NO: 653865 - DNA, 13 bp, D. melanogaster
tgcagccagcagc

SEQ ID NO: 653866 - DNA, 13 bp, D. melanogaster
tgcagccattaaa

SEQ ID NO: 653867 - DNA, 13 bp, D. melanogaster
tgcagccgcaaaa

SEQ ID NO: 653868 - DNA, 13 bp, D. melanogaster
tgcagccgcagca

SEQ ID NO: 653869 - DNA, 13 bp, D. melanogaster
tgcagccggaaaa

SEQ ID NO: 653870 - DNA, 13 bp, D. melanogaster
tgcagccggcttt

SEQ ID NO: 653871 - DNA, 14 bp, D. melanogaster
tgcagccggctttg

SEQ ID NO: 653872 - DNA, 13 bp, D. melanogaster
tgcagcgataagc

SEQ ID NO: 653873 - DNA, 13 bp, D. melanogaster
tgcagcgcaatat

SEQ ID NO: 653874 - DNA, 13 bp, D. melanogaster
tgcagcgcataaa

SEQ ID NO: 653875 - DNA, 13 bp, D. melanogaster
tgcagcgcatttt

SEQ ID NO: 653876 - DNA, 13 bp, D. melanogaster
tgcagcggaaaat

SEQ ID NO: 653877 - DNA, 13 bp, D. melanogaster
tgcagcggaaatt

SEQ ID NO: 653878 - DNA, 13 bp, D. melanogaster
tgcagcggcaaca

SEQ ID NO: 653879 - DNA, 14 bp, D. melanogaster
tgcagcggcaacaa

SEQ ID NO: 653880 - DNA, 13 bp, D. melanogaster
tgcagcggcaact

SEQ ID NO: 653881 - DNA, 13 bp, D. melanogaster
tgcagcgtgcaac

SEQ ID NO: 653882 - DNA, 13 bp, D. melanogaster
tgcagctaagcga

SEQ ID NO: 653883 - DNA, 14 bp, D. melanogaster
tgcagctaagcgaa

SEQ ID NO: 653884 - DNA, 13 bp, D. melanogaster
tgcagctaataaa

SEQ ID NO: 653885 - DNA, 13 bp, D. melanogaster
tgcagctaattaa

SEQ ID NO: 653886 - DNA, 13 bp, D. melanogaster
tgcagctataaaa

SEQ ID NO: 653887 - DNA, 13 bp, D. melanogaster
tgcagctatatat

SEQ ID NO: 653888 - DNA, 14 bp, D. melanogaster
tgcagctcaagtgg

SEQ ID NO: 653889 - DNA, 13 bp, D. melanogaster
tgcagctcatttt

SEQ ID NO: 653890 - DNA, 13 bp, D. melanogaster
tgcagctccacca

SEQ ID NO: 653891 - DNA, 13 bp, D. melanogaster
tgcagctctctat

SEQ ID NO: 653892 - DNA, 13 bp, D. melanogaster
tgcagctgcaacg

SEQ ID NO: 653893 - DNA, 13 bp, D. melanogaster
tgcagctgcaact

SEQ ID NO: 653894 - DNA, 14 bp, D. melanogaster
tgcagctgcaactg

SEQ ID NO: 653895 - DNA, 13 bp, D. melanogaster
tgcagctgcaatc

SEQ ID NO: 653896 - DNA, 13 bp, D. melanogaster
tgcagctgcaatt

SEQ ID NO: 653897 - DNA, 13 bp, D. melanogaster
tgcagctgcactg

SEQ ID NO: 653898 - DNA, 13 bp, D. melanogaster
tgcagctgcactt

SEQ ID NO: 653899 - DNA, 13 bp, D. melanogaster
tgcagctgcagat

SEQ ID NO: 653900 - DNA, 14 bp, D. melanogaster
tgcagctgcagcaa

SEQ ID NO: 653901 - DNA, 13 bp, D. melanogaster
tgcagctgcagcg

SEQ ID NO: 653902 - DNA, 14 bp, D. melanogaster
tgcagctgcagctt

SEQ ID NO: 653903 - DNA, 13 bp, D. melanogaster
tgcagctgcagga

SEQ ID NO: 653904 - DNA, 13 bp, D. melanogaster
tgcagctgcaggt

SEQ ID NO: 653905 - DNA, 13 bp, D. melanogaster
tgcagctgcatat

SEQ ID NO: 653906 - DNA, 13 bp, D. melanogaster
tgcagctgcattg

SEQ ID NO: 653907 - DNA, 13 bp, D. melanogaster
tgcagctgccaaa

SEQ ID NO: 653908 - DNA, 13 bp, D. melanogaster
tgcagctgccaac

SEQ ID NO: 653909 - DNA, 13 bp, D. melanogaster
tgcagctgccaca

SEQ ID NO: 653910 - DNA, 13 bp, D. melanogaster
tgcagctgcggca

SEQ ID NO: 653911 - DNA, 13 bp, D. melanogaster
tgcagctgctcca

SEQ ID NO: 653912 - DNA, 13 bp, D. melanogaster
tgcagctgctgcc

SEQ ID NO: 653913 - DNA, 13 bp, D. melanogaster
tgcagctgctgtt

SEQ ID NO: 653914 - DNA, 13 bp, D. melanogaster
tgcagctgctttt

SEQ ID NO: 653915 - DNA, 13 bp, D. melanogaster
tgcagctggaaat

SEQ ID NO: 653916 - DNA, 13 bp, D. melanogaster
tgcagctggcaaa

SEQ ID NO: 653917 - DNA, 13 bp, D. melanogaster
tgcagctggccaa

SEQ ID NO: 653918 - DNA, 13 bp, D. melanogaster
tgcagctgggaaa

SEQ ID NO: 653919 - DNA, 13 bp, D. melanogaster
tgcagctgtgtgc

SEQ ID NO: 653920 - DNA, 13 bp, D. melanogaster
tgcagctgttgtt

SEQ ID NO: 653921 - DNA, 13 bp, D. melanogaster
tgcagcttatctt

SEQ ID NO: 653922 - DNA, 13 bp, D. melanogaster
tgcagcttattaa

SEQ ID NO: 653923 - DNA, 13 bp, D. melanogaster
tgcagcttcagct

SEQ ID NO: 653924 - DNA, 14 bp, D. melanogaster
tgcagcttgcagct

SEQ ID NO: 653925 - DNA, 13 bp, D. melanogaster
tgcagcttgtttt

SEQ ID NO: 653926 - DNA, 13 bp, D. melanogaster
tgcagctttttgt

SEQ ID NO: 653927 - DNA, 13 bp, D. melanogaster
tgcaggaaaaaaa

SEQ ID NO: 653928 - DNA, 13 bp, D. melanogaster
tgcaggaaaacaa

SEQ ID NO: 653929 - DNA, 13 bp, D. melanogaster
tgcaggagaaaga

SEQ ID NO: 653930 - DNA, 13 bp, D. melanogaster
tgcaggagctgcc

SEQ ID NO: 653931 - DNA, 14 bp, D. melanogaster
tgcaggagctgcct

SEQ ID NO: 653932 - DNA, 13 bp, D. melanogaster
tgcaggaggagca

SEQ ID NO: 653933 - DNA, 13 bp, D. melanogaster
tgcaggatgacaa

SEQ ID NO: 653934 - DNA, 14 bp, D. melanogaster
tgcaggatgcagga

SEQ ID NO: 653935 - DNA, 13 bp, D. melanogaster
tgcaggcaaaaaa

SEQ ID NO: 653936 - DNA, 13 bp, D. melanogaster
tgcaggcaataaa

SEQ ID NO: 653937 - DNA, 13 bp, D. melanogaster
tgcaggcgaaaaa

SEQ ID NO: 653938 - DNA, 13 bp, D. melanogaster
tgcaggcggaaaa

SEQ ID NO: 653939 - DNA, 13 bp, D. melanogaster
tgcaggcgttcga

SEQ ID NO: 653940 - DNA, 13 bp, D. melanogaster
tgcaggctgaagt

SEQ ID NO: 653941 - DNA, 13 bp, D. melanogaster
tgcagggcaataa

SEQ ID NO: 653942 - DNA, 13 bp, D. melanogaster
tgcaggtgcactc

SEQ ID NO: 653943 - DNA, 13 bp, D. melanogaster
tgcaggtggaaaa

SEQ ID NO: 653944 - DNA, 13 bp, D. melanogaster
tgcagtaaaagga

SEQ ID NO: 653945 - DNA, 13 bp, D. melanogaster
tgcagtaactgcg

SEQ ID NO: 653946 - DNA, 13 bp, D. melanogaster
tgcagtagttaaa

SEQ ID NO: 653947 - DNA, 13 bp, D. melanogaster
tgcagtatttggt

SEQ ID NO: 653948 - DNA, 13 bp, D. melanogaster
tgcagtcgaaaaa

SEQ ID NO: 653949 - DNA, 14 bp, D. melanogaster
tgcagtcgacgtcg

SEQ ID NO: 653950 - DNA, 13 bp, D. melanogaster
tgcagtcggcaaa

SEQ ID NO: 653951 - DNA, 13 bp, D. melanogaster
tgcagtctgcagt

SEQ ID NO: 653952 - DNA, 13 bp, D. melanogaster
tgcagtgaagaaa

SEQ ID NO: 653953 - DNA, 13 bp, D. melanogaster
tgcagtgcaaaaa

SEQ ID NO: 653954 - DNA, 13 bp, D. melanogaster
tgcagtgcaaaag

SEQ ID NO: 653955 - DNA, 13 bp, D. melanogaster
tgcagtgcaaata

SEQ ID NO: 653956 - DNA, 13 bp, D. melanogaster
tgcagtgcagcca

SEQ ID NO: 653957 - DNA, 13 bp, D. melanogaster
tgcagtgcagctg

SEQ ID NO: 653958 - DNA, 13 bp, D. melanogaster
tgcagtgcagttt

SEQ ID NO: 653959 - DNA, 13 bp, D. melanogaster
tgcagtgcatttg

SEQ ID NO: 653960 - DNA, 13 bp, D. melanogaster
tgcagtgcatttt

SEQ ID NO: 653961 - DNA, 13 bp, D. melanogaster
tgcagtgccaaaa

SEQ ID NO: 653962 - DNA, 13 bp, D. melanogaster
tgcagtgcgactt

SEQ ID NO: 653963 - DNA, 13 bp, D. melanogaster
tgcagtgcggtgc

SEQ ID NO: 653964 - DNA, 13 bp, D. melanogaster
tgcagtggaaaac

SEQ ID NO: 653965 - DNA, 13 bp, D. melanogaster
tgcagtgtgtgtg

SEQ ID NO: 653966 - DNA, 13 bp, D. melanogaster
tgcagttattatt

SEQ ID NO: 653967 - DNA, 13 bp, D. melanogaster
tgcagttccattt

SEQ ID NO: 653968 - DNA, 13 bp, D. melanogaster
tgcagttcgattg

SEQ ID NO: 653969 - DNA, 13 bp, D. melanogaster
tgcagttcgccgc

SEQ ID NO: 653970 - DNA, 13 bp, D. melanogaster
tgcagttctttga

SEQ ID NO: 653971 - DNA, 13 bp, D. melanogaster
tgcagttgaaata

SEQ ID NO: 653972 - DNA, 13 bp, D. melanogaster
tgcagttgaagtt

SEQ ID NO: 653973 - DNA, 13 bp, D. melanogaster
tgcagttgaattt

SEQ ID NO: 653974 - DNA, 13 bp, D. melanogaster
tgcagttgcaact

SEQ ID NO: 653975 - DNA, 14 bp, D. melanogaster
tgcagttgcaactt

SEQ ID NO: 653976 - DNA, 13 bp, D. melanogaster
tgcagttgcaagt

SEQ ID NO: 653977 - DNA, 14 bp, D. melanogaster
tgcagttgcaattg

SEQ ID NO: 653978 - DNA, 13 bp, D. melanogaster
tgcagttgcacaa

SEQ ID NO: 653979 - DNA, 13 bp, D. melanogaster
tgcagttgcactg

SEQ ID NO: 653980 - DNA, 13 bp, D. melanogaster
tgcagttgcagct

SEQ ID NO: 653981 - DNA, 14 bp, D. melanogaster
tgcagttgcagctg

SEQ ID NO: 653982 - DNA, 13 bp, D. melanogaster
tgcagttgcagtc

SEQ ID NO: 653983 - DNA, 14 bp, D. melanogaster
tgcagttgcagtcg

SEQ ID NO: 653984 - DNA, 13 bp, D. melanogaster
tgcagttgcagtt

SEQ ID NO: 653985 - DNA, 14 bp, D. melanogaster
tgcagttgcagttg

SEQ ID NO: 653986 - DNA, 14 bp, D. melanogaster
tgcagttgcagttt

SEQ ID NO: 653987 - DNA, 13 bp, D. melanogaster
tgcagttgcataa

SEQ ID NO: 653988 - DNA, 13 bp, D. melanogaster
tgcagttgcatct

SEQ ID NO: 653989 - DNA, 13 bp, D. melanogaster
tgcagttgcattc

SEQ ID NO: 653990 - DNA, 13 bp, D. melanogaster
tgcagttgcattt

SEQ ID NO: 653991 - DNA, 14 bp, D. melanogaster
tgcagttgcatttg

SEQ ID NO: 653992 - DNA, 13 bp, D. melanogaster
tgcagttgccaca

SEQ ID NO: 653993 - DNA, 13 bp, D. melanogaster
tgcagttgccatt

SEQ ID NO: 653994 - DNA, 13 bp, D. melanogaster
tgcagttgccgtt

SEQ ID NO: 653995 - DNA, 13 bp, D. melanogaster
tgcagttgctcat

SEQ ID NO: 653996 - DNA, 13 bp, D. melanogaster
tgcagttgctgca

SEQ ID NO: 653997 - DNA, 14 bp, D. melanogaster
tgcagttgctgcag

SEQ ID NO: 653998 - DNA, 13 bp, D. melanogaster
tgcagttgctgtt

SEQ ID NO: 653999 - DNA, 14 bp, D. melanogaster
tgcagttgctgttg

SEQ ID NO: 654000 - DNA, 13 bp, D. melanogaster
tgcagttggaaaa

SEQ ID NO: 654001 - DNA, 13 bp, D. melanogaster
tgcagttggcagc

SEQ ID NO: 654002 - DNA, 13 bp, D. melanogaster
tgcagttggccat

SEQ ID NO: 654003 - DNA, 13 bp, D. melanogaster
tgcagttgggaaa

SEQ ID NO: 654004 - DNA, 13 bp, D. melanogaster
tgcagttgggtgc

SEQ ID NO: 654005 - DNA, 13 bp, D. melanogaster
tgcagttgttgct

SEQ ID NO: 654006 - DNA, 14 bp, D. melanogaster
tgcagttgttgctg

SEQ ID NO: 654007 - DNA, 13 bp, D. melanogaster
tgcagttgttgtt

SEQ ID NO: 654008 - DNA, 14 bp, D. melanogaster
tgcagttgttgttg

SEQ ID NO: 654009 - DNA, 13 bp, D. melanogaster
tgcagttgtttaa

SEQ ID NO: 654010 - DNA, 14 bp, D. melanogaster
tgcagttgtttaaa

SEQ ID NO: 654011 - DNA, 13 bp, D. melanogaster
tgcagttgttttg

SEQ ID NO: 654012 - DNA, 13 bp, D. melanogaster
tgcagtttattat

SEQ ID NO: 654013 - DNA, 13 bp, D. melanogaster
tgcagtttcagtt

SEQ ID NO: 654014 - DNA, 13 bp, D. melanogaster
tgcagtttccccc

SEQ ID NO: 654015 - DNA, 14 bp, D. melanogaster
tgcagtttgcagtt

SEQ ID NO: 654016 - DNA, 13 bp, D. melanogaster
tgcagtttgtttt

SEQ ID NO: 654017 - DNA, 13 bp, D. melanogaster
tgcagttttagtt

SEQ ID NO: 654018 - DNA, 13 bp, D. melanogaster
tgcagttttataa

SEQ ID NO: 654019 - DNA, 13 bp, D. melanogaster
tgcagttttcaat

SEQ ID NO: 654020 - DNA, 13 bp, D. melanogaster
tgcagttttcagt

SEQ ID NO: 654021 - DNA, 13 bp, D. melanogaster
tgcagttttgaaa

SEQ ID NO: 654022 - DNA, 13 bp, D. melanogaster
tgcagttttgcag

SEQ ID NO: 654023 - DNA, 13 bp, D. melanogaster
tgcagttttgccg

SEQ ID NO: 654024 - DNA, 13 bp, D. melanogaster
tgcagtttttcaa

SEQ ID NO: 654025 - DNA, 13 bp, D. melanogaster
tgcagtttttccc

SEQ ID NO: 654026 - DNA, 13 bp, D. melanogaster
tgcagtttttgca

SEQ ID NO: 654027 - DNA, 13 bp, D. melanogaster
tgcagtttttgtg

SEQ ID NO: 654028 - DNA, 13 bp, D. melanogaster
tgcagttttttgt

SEQ ID NO: 654029 - DNA, 13 bp, D. melanogaster
tgcataaaaaaat

SEQ ID NO: 654030 - DNA, 13 bp, D. melanogaster
tgcataaaaaagt

SEQ ID NO: 654031 - DNA, 13 bp, D. melanogaster
tgcataaaaaatt

SEQ ID NO: 654032 - DNA, 13 bp, D. melanogaster
tgcataaaaatca

SEQ ID NO: 654033 - DNA, 13 bp, D. melanogaster
tgcataaaaatgc

SEQ ID NO: 654034 - DNA, 13 bp, D. melanogaster
tgcataaaagcca

SEQ ID NO: 654035 - DNA, 13 bp, D. melanogaster
tgcataaaatcaa

SEQ ID NO: 654036 - DNA, 13 bp, D. melanogaster
tgcataaaatgta

SEQ ID NO: 654037 - DNA, 13 bp, D. melanogaster
tgcataaaatgtg

SEQ ID NO: 654038 - DNA, 13 bp, D. melanogaster
tgcataaaattaa

SEQ ID NO: 654039 - DNA, 13 bp, D. melanogaster
tgcataaaattat

SEQ ID NO: 654040 - DNA, 13 bp, D. melanogaster
tgcataaaatttg

SEQ ID NO: 654041 - DNA, 13 bp, D. melanogaster
tgcataaacaaaa

SEQ ID NO: 654042 - DNA, 13 bp, D. melanogaster
tgcataaacaaat

SEQ ID NO: 654043 - DNA, 13 bp, D. melanogaster
tgcataaacaatt

SEQ ID NO: 654044 - DNA, 13 bp, D. melanogaster
tgcataaacagca

SEQ ID NO: 654045 - DNA, 13 bp, D. melanogaster
tgcataaacattt

SEQ ID NO: 654046 - DNA, 13 bp, D. melanogaster
tgcataaactttg

SEQ ID NO: 654047 - DNA, 14 bp, D. melanogaster
tgcataaataaaca

SEQ ID NO: 654048 - DNA, 13 bp, D. melanogaster
tgcataaataaat

SEQ ID NO: 654049 - DNA, 14 bp, D. melanogaster
tgcataaataaata

SEQ ID NO: 654050 - DNA, 13 bp, D. melanogaster
tgcataaataaca

SEQ ID NO: 654051 - DNA, 13 bp, D. melanogaster
tgcataaatacaa

SEQ ID NO: 654052 - DNA, 13 bp, D. melanogaster
tgcataaatgcca

SEQ ID NO: 654053 - DNA, 13 bp, D. melanogaster
tgcataaattaaa

SEQ ID NO: 654054 - DNA, 13 bp, D. melanogaster
tgcataaattgaa

SEQ ID NO: 654055 - DNA, 13 bp, D. melanogaster
tgcataaatttgc

SEQ ID NO: 654056 - DNA, 13 bp, D. melanogaster
tgcataacaacag

SEQ ID NO: 654057 - DNA, 13 bp, D. melanogaster
tgcataacatttt

SEQ ID NO: 654058 - DNA, 13 bp, D. melanogaster
tgcataactaatt

SEQ ID NO: 654059 - DNA, 13 bp, D. melanogaster
tgcataagcaact

SEQ ID NO: 654060 - DNA, 13 bp, D. melanogaster
tgcataagccaaa

SEQ ID NO: 654061 - DNA, 13 bp, D. melanogaster
tgcataataataa

SEQ ID NO: 654062 - DNA, 13 bp, D. melanogaster
tgcataatattta

SEQ ID NO: 654063 - DNA, 13 bp, D. melanogaster
tgcataatgaatg

SEQ ID NO: 654064 - DNA, 13 bp, D. melanogaster
tgcataattatgt

SEQ ID NO: 654065 - DNA, 13 bp, D. melanogaster
tgcataattcata

SEQ ID NO: 654066 - DNA, 13 bp, D. melanogaster
tgcataattcatt

SEQ ID NO: 654067 - DNA, 13 bp, D. melanogaster
tgcataattgaat

SEQ ID NO: 654068 - DNA, 13 bp, D. melanogaster
tgcataatttaaa

SEQ ID NO: 654069 - DNA, 13 bp, D. melanogaster
tgcataatttatg

SEQ ID NO: 654070 - DNA, 14 bp, D. melanogaster
tgcataatttatga

SEQ ID NO: 654071 - DNA, 14 bp, D. melanogaster
tgcataattttgtt

SEQ ID NO: 654072 - DNA, 13 bp, D. melanogaster
tgcatacaaatta

SEQ ID NO: 654073 - DNA, 13 bp, D. melanogaster
tgcatacaaattc

SEQ ID NO: 654074 - DNA, 13 bp, D. melanogaster
tgcatacacaaat

SEQ ID NO: 654075 - DNA, 13 bp, D. melanogaster
tgcatacacacat

SEQ ID NO: 654076 - DNA, 13 bp, D. melanogaster
tgcatacacattt

SEQ ID NO: 654077 - DNA, 13 bp, D. melanogaster
tgcatacataaat

SEQ ID NO: 654078 - DNA, 14 bp, D. melanogaster
tgcatacatacata

SEQ ID NO: 654079 - DNA, 14 bp, D. melanogaster
tgcatacatatgta

SEQ ID NO: 654080 - DNA, 13 bp, D. melanogaster
tgcatacattaaa

SEQ ID NO: 654081 - DNA, 13 bp, D. melanogaster
tgcatacattttg

SEQ ID NO: 654082 - DNA, 13 bp, D. melanogaster
tgcataccaaatg

SEQ ID NO: 654083 - DNA, 13 bp, D. melanogaster
tgcataccctata

SEQ ID NO: 654084 - DNA, 14 bp, D. melanogaster
tgcataccctatat

SEQ ID NO: 654085 - DNA, 13 bp, D. melanogaster
tgcatacgatatt

SEQ ID NO: 654086 - DNA, 13 bp, D. melanogaster
tgcatacgtatgt

SEQ ID NO: 654087 - DNA, 13 bp, D. melanogaster
tgcatactttgca

SEQ ID NO: 654088 - DNA, 14 bp, D. melanogaster
tgcatactttgggg

SEQ ID NO: 654089 - DNA, 13 bp, D. melanogaster
tgcatacttttca

SEQ ID NO: 654090 - DNA, 14 bp, D. melanogaster
tgcatacttttcgg

SEQ ID NO: 654091 - DNA, 14 bp, D. melanogaster
tgcatacttttggg

SEQ ID NO: 654092 - DNA, 14 bp, D. melanogaster
tgcatactttttgg

SEQ ID NO: 654093 - DNA, 13 bp, D. melanogaster
tgcatagaaaatg

SEQ ID NO: 654094 - DNA, 13 bp, D. melanogaster
tgcatataaaaaa

SEQ ID NO: 654095 - DNA, 13 bp, D. melanogaster
tgcatataaatga

SEQ ID NO: 654096 - DNA, 13 bp, D. melanogaster
tgcatataattta

SEQ ID NO: 654097 - DNA, 13 bp, D. melanogaster
tgcatataatttc

SEQ ID NO: 654098 - DNA, 13 bp, D. melanogaster
tgcatatacatac

SEQ ID NO: 654099 - DNA, 13 bp, D. melanogaster
tgcatatacatat

SEQ ID NO: 654100 - DNA, 14 bp, D. melanogaster
tgcatatacatatg

SEQ ID NO: 654101 - DNA, 13 bp, D. melanogaster
tgcatatatacat

SEQ ID NO: 654102 - DNA, 14 bp, D. melanogaster
tgcatatatacata

SEQ ID NO: 654103 - DNA, 13 bp, D. melanogaster
tgcatatatagat

SEQ ID NO: 654104 - DNA, 13 bp, D. melanogaster
tgcatatatatag

SEQ ID NO: 654105 - DNA, 14 bp, D. melanogaster
tgcatatatattta

SEQ ID NO: 654106 - DNA, 14 bp, D. melanogaster
tgcatatatgcaaa

SEQ ID NO: 654107 - DNA, 14 bp, D. melanogaster
tgcatatatgtaca

SEQ ID NO: 654108 - DNA, 14 bp, D. melanogaster
tgcatatatgtata

SEQ ID NO: 654109 - DNA, 14 bp, D. melanogaster
tgcatatatgtatt

SEQ ID NO: 654110 - DNA, 13 bp, D. melanogaster
tgcatatattaaa

SEQ ID NO: 654111 - DNA, 13 bp, D. melanogaster
tgcatatattatg

SEQ ID NO: 654112 - DNA, 13 bp, D. melanogaster
tgcatatattatt

SEQ ID NO: 654113 - DNA, 13 bp, D. melanogaster
tgcatatatttat

SEQ ID NO: 654114 - DNA, 13 bp, D. melanogaster
tgcatatattttg

SEQ ID NO: 654115 - DNA, 13 bp, D. melanogaster
tgcatatattttt

SEQ ID NO: 654116 - DNA, 13 bp, D. melanogaster
tgcatatcattaa

SEQ ID NO: 654117 - DNA, 13 bp, D. melanogaster
tgcatatctatat

SEQ ID NO: 654118 - DNA, 13 bp, D. melanogaster
tgcatatgaataa

SEQ ID NO: 654119 - DNA, 13 bp, D. melanogaster
tgcatatgaatga

SEQ ID NO: 654120 - DNA, 13 bp, D. melanogaster
tgcatatgcacat

SEQ ID NO: 654121 - DNA, 14 bp, D. melanogaster
tgcatatgcatata

SEQ ID NO: 654122 - DNA, 13 bp, D. melanogaster
tgcatatgcattt

SEQ ID NO: 654123 - DNA, 13 bp, D. melanogaster
tgcatatggcaaa

SEQ ID NO: 654124 - DNA, 13 bp, D. melanogaster
tgcatatgtaaaa

SEQ ID NO: 654125 - DNA, 13 bp, D. melanogaster
tgcatatgtatat

SEQ ID NO: 654126 - DNA, 14 bp, D. melanogaster
tgcatatgtatatg

SEQ ID NO: 654127 - DNA, 13 bp, D. melanogaster
tgcatatgtgcat

SEQ ID NO: 654128 - DNA, 13 bp, D. melanogaster
tgcatatgtgtat

SEQ ID NO: 654129 - DNA, 13 bp, D. melanogaster
tgcatatgtgtgt

SEQ ID NO: 654130 - DNA, 13 bp, D. melanogaster
tgcatatgttgca

SEQ ID NO: 654131 - DNA, 13 bp, D. melanogaster
tgcatatgttttt

SEQ ID NO: 654132 - DNA, 14 bp, D. melanogaster
tgcatattaaatat

SEQ ID NO: 654133 - DNA, 13 bp, D. melanogaster
tgcatattaaatt

SEQ ID NO: 654134 - DNA, 14 bp, D. melanogaster
tgcatattaaatta

SEQ ID NO: 654135 - DNA, 13 bp, D. melanogaster
tgcatattaatga

SEQ ID NO: 654136 - DNA, 13 bp, D. melanogaster
tgcatattaatta

SEQ ID NO: 654137 - DNA, 13 bp, D. melanogaster
tgcatattaattt

SEQ ID NO: 654138 - DNA, 13 bp, D. melanogaster
tgcatattatttt

SEQ ID NO: 654139 - DNA, 13 bp, D. melanogaster
tgcatattcatga

SEQ ID NO: 654140 - DNA, 13 bp, D. melanogaster
tgcatattgaaat

SEQ ID NO: 654141 - DNA, 13 bp, D. melanogaster
tgcatattgatat

SEQ ID NO: 654142 - DNA, 13 bp, D. melanogaster
tgcatatttaaac

SEQ ID NO: 654143 - DNA, 13 bp, D. melanogaster
tgcatatttgaat

SEQ ID NO: 654144 - DNA, 14 bp, D. melanogaster
tgcatatttgattt

SEQ ID NO: 654145 - DNA, 13 bp, D. melanogaster
tgcatatttgcac

SEQ ID NO: 654146 - DNA, 13 bp, D. melanogaster
tgcatatttgttt

SEQ ID NO: 654147 - DNA, 13 bp, D. melanogaster
tgcatattttata

SEQ ID NO: 654148 - DNA, 13 bp, D. melanogaster
tgcatattttatg

SEQ ID NO: 654149 - DNA, 13 bp, D. melanogaster
tgcatattttatt

SEQ ID NO: 654150 - DNA, 13 bp, D. melanogaster
tgcatattttcac

SEQ ID NO: 654151 - DNA, 13 bp, D. melanogaster
tgcatattttgca

SEQ ID NO: 654152 - DNA, 13 bp, D. melanogaster
tgcatattttgtg

SEQ ID NO: 654153 - DNA, 13 bp, D. melanogaster
tgcatatttttcg

SEQ ID NO: 654154 - DNA, 13 bp, D. melanogaster
tgcatcaacattg

SEQ ID NO: 654155 - DNA, 13 bp, D. melanogaster
tgcatcaataaaa

SEQ ID NO: 654156 - DNA, 14 bp, D. melanogaster
tgcatcagcatcag

SEQ ID NO: 654157 - DNA, 15 bp, D. melanogaster
tgcatcatagcttca

SEQ ID NO: 654158 - DNA, 13 bp, D. melanogaster
tgcatcatcatca

SEQ ID NO: 654159 - DNA, 13 bp, D. melanogaster
tgcatccacatcc

SEQ ID NO: 654160 - DNA, 13 bp, D. melanogaster
tgcatcccaattt

SEQ ID NO: 654161 - DNA, 13 bp, D. melanogaster
tgcatcctgcaca

SEQ ID NO: 654162 - DNA, 13 bp, D. melanogaster
tgcatcctgcagc

SEQ ID NO: 654163 - DNA, 13 bp, D. melanogaster
tgcatcgcataga

SEQ ID NO: 654164 - DNA, 14 bp, D. melanogaster
tgcatctacaacag

SEQ ID NO: 654165 - DNA, 13 bp, D. melanogaster
tgcatctataaaa

SEQ ID NO: 654166 - DNA, 13 bp, D. melanogaster
tgcatctccaagc

SEQ ID NO: 654167 - DNA, 13 bp, D. melanogaster
tgcatctgaatct

SEQ ID NO: 654168 - DNA, 13 bp, D. melanogaster
tgcatctgcaact

SEQ ID NO: 654169 - DNA, 14 bp, D. melanogaster
tgcatctgcaactg

SEQ ID NO: 654170 - DNA, 13 bp, D. melanogaster
tgcatctgcacca

SEQ ID NO: 654171 - DNA, 13 bp, D. melanogaster
tgcatctgcatcc

SEQ ID NO: 654172 - DNA, 13 bp, D. melanogaster
tgcatctgcatct

SEQ ID NO: 654173 - DNA, 14 bp, D. melanogaster
tgcatctgcatctc

SEQ ID NO: 654174 - DNA, 13 bp, D. melanogaster
tgcatctgcattt

SEQ ID NO: 654175 - DNA, 14 bp, D. melanogaster
tgcatctgtatctg

SEQ ID NO: 654176 - DNA, 13 bp, D. melanogaster
tgcatctgtggtt

SEQ ID NO: 654177 - DNA, 13 bp, D. melanogaster
tgcatctgtgtgc

SEQ ID NO: 654178 - DNA, 14 bp, D. melanogaster
tgcatctgtgtgcg

SEQ ID NO: 654179 - DNA, 13 bp, D. melanogaster
tgcatctgtgtgt

SEQ ID NO: 654180 - DNA, 13 bp, D. melanogaster
tgcatctttccaa

SEQ ID NO: 654181 - DNA, 13 bp, D. melanogaster
tgcatgaaaaatg

SEQ ID NO: 654182 - DNA, 13 bp, D. melanogaster
tgcatgaaaatgc

SEQ ID NO: 654183 - DNA, 13 bp, D. melanogaster
tgcatgaaccaaa

SEQ ID NO: 654184 - DNA, 13 bp, D. melanogaster
tgcatgaatattt

SEQ ID NO: 654185 - DNA, 13 bp, D. melanogaster
tgcatgacaccaa

SEQ ID NO: 654186 - DNA, 13 bp, D. melanogaster
tgcatgagtgtgt

SEQ ID NO: 654187 - DNA, 13 bp, D. melanogaster
tgcatgataagtt

SEQ ID NO: 654188 - DNA, 13 bp, D. melanogaster
tgcatgcaaaaca

SEQ ID NO: 654189 - DNA, 13 bp, D. melanogaster
tgcatgcaaaatt

SEQ ID NO: 654190 - DNA, 13 bp, D. melanogaster
tgcatgcaaacaa

SEQ ID NO: 654191 - DNA, 13 bp, D. melanogaster
tgcatgcaaatgt

SEQ ID NO: 654192 - DNA, 13 bp, D. melanogaster
tgcatgcaaattg

SEQ ID NO: 654193 - DNA, 14 bp, D. melanogaster
tgcatgcaaattgt

SEQ ID NO: 654194 - DNA, 13 bp, D. melanogaster
tgcatgcaacaaa

SEQ ID NO: 654195 - DNA, 13 bp, D. melanogaster
tgcatgcaattta

SEQ ID NO: 654196 - DNA, 13 bp, D. melanogaster
tgcatgcacatat

SEQ ID NO: 654197 - DNA, 13 bp, D. melanogaster
tgcatgcatacat

SEQ ID NO: 654198 - DNA, 13 bp, D. melanogaster
tgcatgcatgtat

SEQ ID NO: 654199 - DNA, 13 bp, D. melanogaster
tgcatgcatttat

SEQ ID NO: 654200 - DNA, 13 bp, D. melanogaster
tgcatgcatttta

SEQ ID NO: 654201 - DNA, 13 bp, D. melanogaster
tgcatgcgaaatt

SEQ ID NO: 654202 - DNA, 13 bp, D. melanogaster
tgcatgcgagaaa

SEQ ID NO: 654203 - DNA, 13 bp, D. melanogaster
tgcatgcggcgca

SEQ ID NO: 654204 - DNA, 13 bp, D. melanogaster
tgcatggcaaaca

SEQ ID NO: 654205 - DNA, 13 bp, D. melanogaster
tgcatggccacca

SEQ ID NO: 654206 - DNA, 14 bp, D. melanogaster
tgcatggccaccaa

SEQ ID NO: 654207 - DNA, 13 bp, D. melanogaster
tgcatgggaaaat

SEQ ID NO: 654208 - DNA, 13 bp, D. melanogaster
tgcatgtacatat

SEQ ID NO: 654209 - DNA, 14 bp, D. melanogaster
tgcatgtacatata

SEQ ID NO: 654210 - DNA, 13 bp, D. melanogaster
tgcatgtatgtgt

SEQ ID NO: 654211 - DNA, 14 bp, D. melanogaster
tgcatgtgagtgtg

SEQ ID NO: 654212 - DNA, 13 bp, D. melanogaster
tgcatgtgcatgc

SEQ ID NO: 654213 - DNA, 13 bp, D. melanogaster
tgcatgtgcatgt

SEQ ID NO: 654214 - DNA, 14 bp, D. melanogaster
tgcatgtgcatgtg

SEQ ID NO: 654215 - DNA, 13 bp, D. melanogaster
tgcatgtgcattt

SEQ ID NO: 654216 - DNA, 13 bp, D. melanogaster
tgcatgtgcgtgt

SEQ ID NO: 654217 - DNA, 14 bp, D. melanogaster
tgcatgtggatgtg

SEQ ID NO: 654218 - DNA, 13 bp, D. melanogaster
tgcatgtggcaca

SEQ ID NO: 654219 - DNA, 13 bp, D. melanogaster
tgcatgtgtacat

SEQ ID NO: 654220 - DNA, 13 bp, D. melanogaster
tgcatgtgtagtg

SEQ ID NO: 654221 - DNA, 13 bp, D. melanogaster
tgcatgtgtatct

SEQ ID NO: 654222 - DNA, 13 bp, D. melanogaster
tgcatgtgtattt

SEQ ID NO: 654223 - DNA, 13 bp, D. melanogaster
tgcatgtgtgcaa

SEQ ID NO: 654224 - DNA, 14 bp, D. melanogaster
tgcatgtgtgcgtg

SEQ ID NO: 654225 - DNA, 13 bp, D. melanogaster
tgcatgtgtgtgc

SEQ ID NO: 654226 - DNA, 13 bp, D. melanogaster
tgcatgtgtgtgt

SEQ ID NO: 654227 - DNA, 14 bp, D. melanogaster
tgcatgtgtgtgtg

SEQ ID NO: 654228 - DNA, 13 bp, D. melanogaster
tgcatgtgtttat

SEQ ID NO: 654229 - DNA, 13 bp, D. melanogaster
tgcatgtgtttgc

SEQ ID NO: 654230 - DNA, 13 bp, D. melanogaster
tgcatgtgtttgt

SEQ ID NO: 654231 - DNA, 13 bp, D. melanogaster
tgcatgtgttttt

SEQ ID NO: 654232 - DNA, 13 bp, D. melanogaster
tgcatgtttaatg

SEQ ID NO: 654233 - DNA, 13 bp, D. melanogaster
tgcatgttttatg

SEQ ID NO: 654234 - DNA, 13 bp, D. melanogaster
tgcattaaaaaat

SEQ ID NO: 654235 - DNA, 13 bp, D. melanogaster
tgcattaaaacaa

SEQ ID NO: 654236 - DNA, 13 bp, D. melanogaster
tgcattaaaagcg

SEQ ID NO: 654237 - DNA, 13 bp, D. melanogaster
tgcattaaaattg

SEQ ID NO: 654238 - DNA, 13 bp, D. melanogaster
tgcattaaacaaa

SEQ ID NO: 654239 - DNA, 13 bp, D. melanogaster
tgcattaaatgtg

SEQ ID NO: 654240 - DNA, 13 bp, D. melanogaster
tgcattaaattgt

SEQ ID NO: 654241 - DNA, 13 bp, D. melanogaster
tgcattaataaaa

SEQ ID NO: 654242 - DNA, 13 bp, D. melanogaster
tgcattaataaat

SEQ ID NO: 654243 - DNA, 13 bp, D. melanogaster
tgcattaattaaa

SEQ ID NO: 654244 - DNA, 14 bp, D. melanogaster
tgcattaattaatt

SEQ ID NO: 654245 - DNA, 13 bp, D. melanogaster
tgcattaattttg

SEQ ID NO: 654246 - DNA, 13 bp, D. melanogaster
tgcattacttttt

SEQ ID NO: 654247 - DNA, 13 bp, D. melanogaster
tgcattagcaata

SEQ ID NO: 654248 - DNA, 13 bp, D. melanogaster
tgcattatgcatg

SEQ ID NO: 654249 - DNA, 13 bp, D. melanogaster
tgcattatgtatt

SEQ ID NO: 654250 - DNA, 13 bp, D. melanogaster
tgcattattaaaa

SEQ ID NO: 654251 - DNA, 13 bp, D. melanogaster
tgcattattcatg

SEQ ID NO: 654252 - DNA, 13 bp, D. melanogaster
tgcattattgttg

SEQ ID NO: 654253 - DNA, 13 bp, D. melanogaster
tgcattatttata

SEQ ID NO: 654254 - DNA, 13 bp, D. melanogaster
tgcattatttatt

SEQ ID NO: 654255 - DNA, 13 bp, D. melanogaster
tgcattatttgca

SEQ ID NO: 654256 - DNA, 13 bp, D. melanogaster
tgcattcaaaaca

SEQ ID NO: 654257 - DNA, 13 bp, D. melanogaster
tgcattcaaaatt

SEQ ID NO: 654258 - DNA, 13 bp, D. melanogaster
tgcattcaaatat

SEQ ID NO: 654259 - DNA, 13 bp, D. melanogaster
tgcattcaaatta

SEQ ID NO: 654260 - DNA, 13 bp, D. melanogaster
tgcattcaacttg

SEQ ID NO: 654261 - DNA, 15 bp, D. melanogaster
tgcattcaagtttgg

SEQ ID NO: 654262 - DNA, 13 bp, D. melanogaster
tgcattcaatttc

SEQ ID NO: 654263 - DNA, 13 bp, D. melanogaster
tgcattcataatt

SEQ ID NO: 654264 - DNA, 13 bp, D. melanogaster
tgcattcatttga

SEQ ID NO: 654265 - DNA, 13 bp, D. melanogaster
tgcattcattttc

SEQ ID NO: 654266 - DNA, 13 bp, D. melanogaster
tgcattccaaatg

SEQ ID NO: 654267 - DNA, 13 bp, D. melanogaster
tgcattccacaag

SEQ ID NO: 654268 - DNA, 13 bp, D. melanogaster
tgcattccagcaa

SEQ ID NO: 654269 - DNA, 13 bp, D. melanogaster
tgcattcgcattg

SEQ ID NO: 654270 - DNA, 13 bp, D. melanogaster
tgcattcgcattt

SEQ ID NO: 654271 - DNA, 13 bp, D. melanogaster
tgcattcggtttg

SEQ ID NO: 654272 - DNA, 13 bp, D. melanogaster
tgcattcgtattt

SEQ ID NO: 654273 - DNA, 13 bp, D. melanogaster
tgcattcgtttat

SEQ ID NO: 654274 - DNA, 13 bp, D. melanogaster
tgcattctatcca

SEQ ID NO: 654275 - DNA, 14 bp, D. melanogaster
tgcattctatccaa

SEQ ID NO: 654276 - DNA, 14 bp, D. melanogaster
tgcattctccacaa

SEQ ID NO: 654277 - DNA, 13 bp, D. melanogaster
tgcattctgcatt

SEQ ID NO: 654278 - DNA, 13 bp, D. melanogaster
tgcattctgggaa

SEQ ID NO: 654279 - DNA, 13 bp, D. melanogaster
tgcattgaaatgg

SEQ ID NO: 654280 - DNA, 13 bp, D. melanogaster
tgcattgattaaa

SEQ ID NO: 654281 - DNA, 13 bp, D. melanogaster
tgcattgattgaa

SEQ ID NO: 654282 - DNA, 13 bp, D. melanogaster
tgcattgcaaatg

SEQ ID NO: 654283 - DNA, 13 bp, D. melanogaster
tgcattgcaattg

SEQ ID NO: 654284 - DNA, 13 bp, D. melanogaster
tgcattgcataaa

SEQ ID NO: 654285 - DNA, 13 bp, D. melanogaster
tgcattgcatgca

SEQ ID NO: 654286 - DNA, 13 bp, D. melanogaster
tgcattgcattta

SEQ ID NO: 654287 - DNA, 14 bp, D. melanogaster
tgcattgcatttaa

SEQ ID NO: 654288 - DNA, 13 bp, D. melanogaster
tgcattgcatttt

SEQ ID NO: 654289 - DNA, 13 bp, D. melanogaster
tgcattgcttttg

SEQ ID NO: 654290 - DNA, 13 bp, D. melanogaster
tgcattggaaaat

SEQ ID NO: 654291 - DNA, 13 bp, D. melanogaster
tgcattgtaaatt

SEQ ID NO: 654292 - DNA, 13 bp, D. melanogaster
tgcattgtaatta

SEQ ID NO: 654293 - DNA, 13 bp, D. melanogaster
tgcattgtgcatt

SEQ ID NO: 654294 - DNA, 13 bp, D. melanogaster
tgcattgttaaat

SEQ ID NO: 654295 - DNA, 13 bp, D. melanogaster
tgcattgttattg

SEQ ID NO: 654296 - DNA, 13 bp, D. melanogaster
tgcattgttgcgt

SEQ ID NO: 654297 - DNA, 13 bp, D. melanogaster
tgcattgttggaa

SEQ ID NO: 654298 - DNA, 13 bp, D. melanogaster
tgcattgtttata

SEQ ID NO: 654299 - DNA, 13 bp, D. melanogaster
tgcattgtttatg

SEQ ID NO: 654300 - DNA, 13 bp, D. melanogaster
tgcatttaaaact

SEQ ID NO: 654301 - DNA, 13 bp, D. melanogaster
tgcatttaaaagt

SEQ ID NO: 654302 - DNA, 13 bp, D. melanogaster
tgcatttaaagtg

SEQ ID NO: 654303 - DNA, 13 bp, D. melanogaster
tgcatttaaagtt

SEQ ID NO: 654304 - DNA, 14 bp, D. melanogaster
tgcatttaaattaa

SEQ ID NO: 654305 - DNA, 13 bp, D. melanogaster
tgcatttaaattg

SEQ ID NO: 654306 - DNA, 14 bp, D. melanogaster
tgcatttaaattga

SEQ ID NO: 654307 - DNA, 14 bp, D. melanogaster
tgcatttaaatttg

SEQ ID NO: 654308 - DNA, 13 bp, D. melanogaster
tgcatttaacaaa

SEQ ID NO: 654309 - DNA, 13 bp, D. melanogaster
tgcatttaagcca

SEQ ID NO: 654310 - DNA, 13 bp, D. melanogaster
tgcatttaataat

SEQ ID NO: 654311 - DNA, 13 bp, D. melanogaster
tgcatttaatatc

SEQ ID NO: 654312 - DNA, 13 bp, D. melanogaster
tgcatttaatatt

SEQ ID NO: 654313 - DNA, 13 bp, D. melanogaster
tgcatttaatggc

SEQ ID NO: 654314 - DNA, 13 bp, D. melanogaster
tgcatttaatgtg

SEQ ID NO: 654315 - DNA, 13 bp, D. melanogaster
tgcatttaattaa

SEQ ID NO: 654316 - DNA, 14 bp, D. melanogaster
tgcatttaattaat

SEQ ID NO: 654317 - DNA, 14 bp, D. melanogaster
tgcatttaatttaa

SEQ ID NO: 654318 - DNA, 13 bp, D. melanogaster
tgcatttaatttc

SEQ ID NO: 654319 - DNA, 13 bp, D. melanogaster
tgcatttaatttg

SEQ ID NO: 654320 - DNA, 14 bp, D. melanogaster
tgcatttaatttga

SEQ ID NO: 654321 - DNA, 14 bp, D. melanogaster
tgcatttaatttgc

SEQ ID NO: 654322 - DNA, 13 bp, D. melanogaster
tgcatttacaatt

SEQ ID NO: 654323 - DNA, 13 bp, D. melanogaster
tgcatttacattt

SEQ ID NO: 654324 - DNA, 13 bp, D. melanogaster
tgcatttagcatt

SEQ ID NO: 654325 - DNA, 13 bp, D. melanogaster
tgcatttagtttt

SEQ ID NO: 654326 - DNA, 13 bp, D. melanogaster
tgcatttataaga

SEQ ID NO: 654327 - DNA, 13 bp, D. melanogaster
tgcatttataatg

SEQ ID NO: 654328 - DNA, 13 bp, D. melanogaster
tgcatttatatgt

SEQ ID NO: 654329 - DNA, 13 bp, D. melanogaster
tgcatttatatta

SEQ ID NO: 654330 - DNA, 13 bp, D. melanogaster
tgcatttatattt

SEQ ID NO: 654331 - DNA, 13 bp, D. melanogaster
tgcatttatcgca

SEQ ID NO: 654332 - DNA, 13 bp, D. melanogaster
tgcatttattgca

SEQ ID NO: 654333 - DNA, 13 bp, D. melanogaster
tgcatttatttaa

SEQ ID NO: 654334 - DNA, 14 bp, D. melanogaster
tgcatttatttaat

SEQ ID NO: 654335 - DNA, 14 bp, D. melanogaster
tgcatttatttata

SEQ ID NO: 654336 - DNA, 13 bp, D. melanogaster
tgcatttatttga

SEQ ID NO: 654337 - DNA, 13 bp, D. melanogaster
tgcatttattttc

SEQ ID NO: 654338 - DNA, 13 bp, D. melanogaster
tgcatttcaaaaa

SEQ ID NO: 654339 - DNA, 13 bp, D. melanogaster
tgcatttcaaatg

SEQ ID NO: 654340 - DNA, 14 bp, D. melanogaster
tgcatttcaaatgc

SEQ ID NO: 654341 - DNA, 13 bp, D. melanogaster
tgcatttcaactt

SEQ ID NO: 654342 - DNA, 13 bp, D. melanogaster
tgcatttcaatat

SEQ ID NO: 654343 - DNA, 13 bp, D. melanogaster
tgcatttcaatgc

SEQ ID NO: 654344 - DNA, 13 bp, D. melanogaster
tgcatttcaattg

SEQ ID NO: 654345 - DNA, 13 bp, D. melanogaster
tgcatttcacact

SEQ ID NO: 654346 - DNA, 13 bp, D. melanogaster
tgcatttcacttg

SEQ ID NO: 654347 - DNA, 13 bp, D. melanogaster
tgcatttcatatt

SEQ ID NO: 654348 - DNA, 13 bp, D. melanogaster
tgcatttcattat

SEQ ID NO: 654349 - DNA, 13 bp, D. melanogaster
tgcatttcatttg

SEQ ID NO: 654350 - DNA, 14 bp, D. melanogaster
tgcatttcatttgc

SEQ ID NO: 654351 - DNA, 13 bp, D. melanogaster
tgcatttcatttt

SEQ ID NO: 654352 - DNA, 13 bp, D. melanogaster
tgcatttccattg

SEQ ID NO: 654353 - DNA, 13 bp, D. melanogaster
tgcatttccattt

SEQ ID NO: 654354 - DNA, 13 bp, D. melanogaster
tgcatttccgttt

SEQ ID NO: 654355 - DNA, 13 bp, D. melanogaster
tgcatttcctgca

SEQ ID NO: 654356 - DNA, 13 bp, D. melanogaster
tgcatttcgaaaa

SEQ ID NO: 654357 - DNA, 13 bp, D. melanogaster
tgcatttcgattt

SEQ ID NO: 654358 - DNA, 13 bp, D. melanogaster
tgcatttcgcatg

SEQ ID NO: 654359 - DNA, 13 bp, D. melanogaster
tgcatttcgtttc

SEQ ID NO: 654360 - DNA, 13 bp, D. melanogaster
tgcatttctcttt

SEQ ID NO: 654361 - DNA, 13 bp, D. melanogaster
tgcatttctgatt

SEQ ID NO: 654362 - DNA, 13 bp, D. melanogaster
tgcatttcttttc

SEQ ID NO: 654363 - DNA, 13 bp, D. melanogaster
tgcatttgaaaag

SEQ ID NO: 654364 - DNA, 13 bp, D. melanogaster
tgcatttgaaaca

SEQ ID NO: 654365 - DNA, 13 bp, D. melanogaster
tgcatttgaatat

SEQ ID NO: 654366 - DNA, 14 bp, D. melanogaster
tgcatttgaatggc

SEQ ID NO: 654367 - DNA, 13 bp, D. melanogaster
tgcatttgaatta

SEQ ID NO: 654368 - DNA, 13 bp, D. melanogaster
tgcatttgacatt

SEQ ID NO: 654369 - DNA, 13 bp, D. melanogaster
tgcatttgacttt

SEQ ID NO: 654370 - DNA, 13 bp, D. melanogaster
tgcatttgattaa

SEQ ID NO: 654371 - DNA, 13 bp, D. melanogaster
tgcatttgattgc

SEQ ID NO: 654372 - DNA, 13 bp, D. melanogaster
tgcatttgatttg

SEQ ID NO: 654373 - DNA, 13 bp, D. melanogaster
tgcatttgcaatg

SEQ ID NO: 654374 - DNA, 13 bp, D. melanogaster
tgcatttgcaatt

SEQ ID NO: 654375 - DNA, 13 bp, D. melanogaster
tgcatttgcactt

SEQ ID NO: 654376 - DNA, 13 bp, D. melanogaster
tgcatttgcagtt

SEQ ID NO: 654377 - DNA, 14 bp, D. melanogaster
tgcatttgcatatg

SEQ ID NO: 654378 - DNA, 13 bp, D. melanogaster
tgcatttgcatcg

SEQ ID NO: 654379 - DNA, 13 bp, D. melanogaster
tgcatttgcatct

SEQ ID NO: 654380 - DNA, 14 bp, D. melanogaster
tgcatttgcatctg

SEQ ID NO: 654381 - DNA, 14 bp, D. melanogaster
tgcatttgcatgca

SEQ ID NO: 654382 - DNA, 13 bp, D. melanogaster
tgcatttgcatta

SEQ ID NO: 654383 - DNA, 13 bp, D. melanogaster
tgcatttgcattc

SEQ ID NO: 654384 - DNA, 13 bp, D. melanogaster
tgcatttgcattg

SEQ ID NO: 654385 - DNA, 13 bp, D. melanogaster
tgcatttgcattt

SEQ ID NO: 654386 - DNA, 14 bp, D. melanogaster
tgcatttgcattta

SEQ ID NO: 654387 - DNA, 14 bp, D. melanogaster
tgcatttgcatttt

SEQ ID NO: 654388 - DNA, 13 bp, D. melanogaster
tgcatttgccact

SEQ ID NO: 654389 - DNA, 13 bp, D. melanogaster
tgcatttgcctgc

SEQ ID NO: 654390 - DNA, 13 bp, D. melanogaster
tgcatttgccttt

SEQ ID NO: 654391 - DNA, 13 bp, D. melanogaster
tgcatttgcgttt

SEQ ID NO: 654392 - DNA, 13 bp, D. melanogaster
tgcatttgctgcc

SEQ ID NO: 654393 - DNA, 13 bp, D. melanogaster
tgcatttgctgct

SEQ ID NO: 654394 - DNA, 13 bp, D. melanogaster
tgcatttgctttt

SEQ ID NO: 654395 - DNA, 13 bp, D. melanogaster
tgcatttggaaaa

SEQ ID NO: 654396 - DNA, 13 bp, D. melanogaster
tgcatttggaaat

SEQ ID NO: 654397 - DNA, 13 bp, D. melanogaster
tgcatttggcatt

SEQ ID NO: 654398 - DNA, 13 bp, D. melanogaster
tgcatttggccaa

SEQ ID NO: 654399 - DNA, 14 bp, D. melanogaster
tgcatttggccaaa

SEQ ID NO: 654400 - DNA, 13 bp, D. melanogaster
tgcatttggccat

SEQ ID NO: 654401 - DNA, 13 bp, D. melanogaster
tgcatttggcttg

SEQ ID NO: 654402 - DNA, 13 bp, D. melanogaster
tgcatttggcttt

SEQ ID NO: 654403 - DNA, 13 bp, D. melanogaster
tgcatttggtatt

SEQ ID NO: 654404 - DNA, 13 bp, D. melanogaster
tgcatttggtttt

SEQ ID NO: 654405 - DNA, 13 bp, D. melanogaster
tgcatttgtatat

SEQ ID NO: 654406 - DNA, 14 bp, D. melanogaster
tgcatttgtatctg

SEQ ID NO: 654407 - DNA, 13 bp, D. melanogaster
tgcatttgtcaat

SEQ ID NO: 654408 - DNA, 13 bp, D. melanogaster
tgcatttgtgtat

SEQ ID NO: 654409 - DNA, 13 bp, D. melanogaster
tgcatttgtgtgt

SEQ ID NO: 654410 - DNA, 13 bp, D. melanogaster
tgcatttgttatt

SEQ ID NO: 654411 - DNA, 14 bp, D. melanogaster
tgcatttgtttgtt

SEQ ID NO: 654412 - DNA, 13 bp, D. melanogaster
tgcatttgttttg

SEQ ID NO: 654413 - DNA, 14 bp, D. melanogaster
tgcatttgtttttg

SEQ ID NO: 654414 - DNA, 13 bp, D. melanogaster
tgcattttaaaaa

SEQ ID NO: 654415 - DNA, 14 bp, D. melanogaster
tgcattttaaataa

SEQ ID NO: 654416 - DNA, 13 bp, D. melanogaster
tgcattttaaatt

SEQ ID NO: 654417 - DNA, 13 bp, D. melanogaster
tgcattttaacaa

SEQ ID NO: 654418 - DNA, 13 bp, D. melanogaster
tgcattttaagtg

SEQ ID NO: 654419 - DNA, 13 bp, D. melanogaster
tgcattttaagtt

SEQ ID NO: 654420 - DNA, 13 bp, D. melanogaster
tgcattttaatta

SEQ ID NO: 654421 - DNA, 14 bp, D. melanogaster
tgcattttaattac

SEQ ID NO: 654422 - DNA, 14 bp, D. melanogaster
tgcattttaattgc

SEQ ID NO: 654423 - DNA, 13 bp, D. melanogaster
tgcattttacatt

SEQ ID NO: 654424 - DNA, 13 bp, D. melanogaster
tgcattttacttt

SEQ ID NO: 654425 - DNA, 13 bp, D. melanogaster
tgcattttattga

SEQ ID NO: 654426 - DNA, 13 bp, D. melanogaster
tgcattttattgt

SEQ ID NO: 654427 - DNA, 13 bp, D. melanogaster
tgcattttatttg

SEQ ID NO: 654428 - DNA, 14 bp, D. melanogaster
tgcattttatttta

SEQ ID NO: 654429 - DNA, 13 bp, D. melanogaster
tgcattttcaaat

SEQ ID NO: 654430 - DNA, 13 bp, D. melanogaster
tgcattttcaaca

SEQ ID NO: 654431 - DNA, 13 bp, D. melanogaster
tgcattttcaatt

SEQ ID NO: 654432 - DNA, 13 bp, D. melanogaster
tgcattttcatgc

SEQ ID NO: 654433 - DNA, 13 bp, D. melanogaster
tgcattttccaaa

SEQ ID NO: 654434 - DNA, 13 bp, D. melanogaster
tgcattttccatt

SEQ ID NO: 654435 - DNA, 13 bp, D. melanogaster
tgcattttccgct

SEQ ID NO: 654436 - DNA, 13 bp, D. melanogaster
tgcattttcctgc

SEQ ID NO: 654437 - DNA, 13 bp, D. melanogaster
tgcattttcctgg

SEQ ID NO: 654438 - DNA, 13 bp, D. melanogaster
tgcattttccttg

SEQ ID NO: 654439 - DNA, 13 bp, D. melanogaster
tgcattttctatt

SEQ ID NO: 654440 - DNA, 13 bp, D. melanogaster
tgcattttctggt

SEQ ID NO: 654441 - DNA, 13 bp, D. melanogaster
tgcattttcttaa

SEQ ID NO: 654442 - DNA, 13 bp, D. melanogaster
tgcattttctttg

SEQ ID NO: 654443 - DNA, 14 bp, D. melanogaster
tgcattttctttgt

SEQ ID NO: 654444 - DNA, 13 bp, D. melanogaster
tgcattttgaaaa

SEQ ID NO: 654445 - DNA, 13 bp, D. melanogaster
tgcattttgaaat

SEQ ID NO: 654446 - DNA, 13 bp, D. melanogaster
tgcattttgaata

SEQ ID NO: 654447 - DNA, 13 bp, D. melanogaster
tgcattttgacac

SEQ ID NO: 654448 - DNA, 13 bp, D. melanogaster
tgcattttgatgt

SEQ ID NO: 654449 - DNA, 13 bp, D. melanogaster
tgcattttgatta

SEQ ID NO: 654450 - DNA, 14 bp, D. melanogaster
tgcattttgcactt

SEQ ID NO: 654451 - DNA, 13 bp, D. melanogaster
tgcattttgcatc

SEQ ID NO: 654452 - DNA, 14 bp, D. melanogaster
tgcattttgcattt

SEQ ID NO: 654453 - DNA, 13 bp, D. melanogaster
tgcattttgcttt

SEQ ID NO: 654454 - DNA, 13 bp, D. melanogaster
tgcattttggcca

SEQ ID NO: 654455 - DNA, 13 bp, D. melanogaster
tgcattttggctt

SEQ ID NO: 654456 - DNA, 13 bp, D. melanogaster
tgcattttgtaat

SEQ ID NO: 654457 - DNA, 13 bp, D. melanogaster
tgcattttgtatt

SEQ ID NO: 654458 - DNA, 13 bp, D. melanogaster
tgcattttgttta

SEQ ID NO: 654459 - DNA, 13 bp, D. melanogaster
tgcattttgtttg

SEQ ID NO: 654460 - DNA, 13 bp, D. melanogaster
tgcatttttaaca

SEQ ID NO: 654461 - DNA, 14 bp, D. melanogaster
tgcatttttaataa

SEQ ID NO: 654462 - DNA, 13 bp, D. melanogaster
tgcatttttaatg

SEQ ID NO: 654463 - DNA, 13 bp, D. melanogaster
tgcatttttaatt

SEQ ID NO: 654464 - DNA, 13 bp, D. melanogaster
tgcatttttctgg

SEQ ID NO: 654465 - DNA, 13 bp, D. melanogaster
tgcatttttgaac

SEQ ID NO: 654466 - DNA, 13 bp, D. melanogaster
tgcatttttgaat

SEQ ID NO: 654467 - DNA, 13 bp, D. melanogaster
tgcatttttgcaa

SEQ ID NO: 654468 - DNA, 13 bp, D. melanogaster
tgcatttttgcac

SEQ ID NO: 654469 - DNA, 13 bp, D. melanogaster
tgcatttttggcc

SEQ ID NO: 654470 - DNA, 13 bp, D. melanogaster
tgcatttttgtgg

SEQ ID NO: 654471 - DNA, 13 bp, D. melanogaster
tgcattttttcac

SEQ ID NO: 654472 - DNA, 13 bp, D. melanogaster
tgcattttttctc

SEQ ID NO: 654473 - DNA, 13 bp, D. melanogaster
tgcattttttgta

SEQ ID NO: 654474 - DNA, 13 bp, D. melanogaster
tgcattttttgtg

SEQ ID NO: 654475 - DNA, 14 bp, D. melanogaster
tgccaaaaaaaaag

SEQ ID NO: 654476 - DNA, 13 bp, D. melanogaster
tgccaaaaaaaca

SEQ ID NO: 654477 - DNA, 13 bp, D. melanogaster
tgccaaaaaagaa

SEQ ID NO: 654478 - DNA, 14 bp, D. melanogaster
tgccaaaaaataaa

SEQ ID NO: 654479 - DNA, 14 bp, D. melanogaster
tgccaaaaaatatg

SEQ ID NO: 654480 - DNA, 13 bp, D. melanogaster
tgccaaaaaatga

SEQ ID NO: 654481 - DNA, 13 bp, D. melanogaster
tgccaaaaacaaa

SEQ ID NO: 654482 - DNA, 13 bp, D. melanogaster
tgccaaaaacaag

SEQ ID NO: 654483 - DNA, 13 bp, D. melanogaster
tgccaaaaacaca

SEQ ID NO: 654484 - DNA, 14 bp, D. melanogaster
tgccaaaaacattt

SEQ ID NO: 654485 - DNA, 13 bp, D. melanogaster
tgccaaaaacgaa

SEQ ID NO: 654486 - DNA, 13 bp, D. melanogaster
tgccaaaaactaa

SEQ ID NO: 654487 - DNA, 13 bp, D. melanogaster
tgccaaaaagcaa

SEQ ID NO: 654488 - DNA, 14 bp, D. melanogaster
tgccaaaaagcaaa

SEQ ID NO: 654489 - DNA, 13 bp, D. melanogaster
tgccaaaaagcca

SEQ ID NO: 654490 - DNA, 13 bp, D. melanogaster
tgccaaaaagtaa

SEQ ID NO: 654491 - DNA, 13 bp, D. melanogaster
tgccaaaaataaa

SEQ ID NO: 654492 - DNA, 13 bp, D. melanogaster
tgccaaaaatatt

SEQ ID NO: 654493 - DNA, 13 bp, D. melanogaster
tgccaaaaatgaa

SEQ ID NO: 654494 - DNA, 13 bp, D. melanogaster
tgccaaaaatgct

SEQ ID NO: 654495 - DNA, 13 bp, D. melanogaster
tgccaaaaatgtg

SEQ ID NO: 654496 - DNA, 13 bp, D. melanogaster
tgccaaaaatgtt

SEQ ID NO: 654497 - DNA, 13 bp, D. melanogaster
tgccaaaaattca

SEQ ID NO: 654498 - DNA, 14 bp, D. melanogaster
tgccaaaaatttaa

SEQ ID NO: 654499 - DNA, 14 bp, D. melanogaster
tgccaaaacaaaaa

SEQ ID NO: 654500 - DNA, 13 bp, D. melanogaster
tgccaaaacgaaa

SEQ ID NO: 654501 - DNA, 13 bp, D. melanogaster
tgccaaaagagca

SEQ ID NO: 654502 - DNA, 13 bp, D. melanogaster
tgccaaaagcaaa

SEQ ID NO: 654503 - DNA, 13 bp, D. melanogaster
tgccaaaaggcga

SEQ ID NO: 654504 - DNA, 13 bp, D. melanogaster
tgccaaaagtttg

SEQ ID NO: 654505 - DNA, 13 bp, D. melanogaster
tgccaaaagtttt

SEQ ID NO: 654506 - DNA, 13 bp, D. melanogaster
tgccaaaataaaa

SEQ ID NO: 654507 - DNA, 13 bp, D. melanogaster
tgccaaaataaag

SEQ ID NO: 654508 - DNA, 13 bp, D. melanogaster
tgccaaaataatt

SEQ ID NO: 654509 - DNA, 13 bp, D. melanogaster
tgccaaaatatat

SEQ ID NO: 654510 - DNA, 13 bp, D. melanogaster
tgccaaaatattc

SEQ ID NO: 654511 - DNA, 14 bp, D. melanogaster
tgccaaaatatttg

SEQ ID NO: 654512 - DNA, 13 bp, D. melanogaster
tgccaaaatgaaa

SEQ ID NO: 654513 - DNA, 13 bp, D. melanogaster
tgccaaaatgtca

SEQ ID NO: 654514 - DNA, 13 bp, D. melanogaster
tgccaaaatgtga

SEQ ID NO: 654515 - DNA, 13 bp, D. melanogaster
tgccaaaatgttt

SEQ ID NO: 654516 - DNA, 13 bp, D. melanogaster
tgccaaacaaaca

SEQ ID NO: 654517 - DNA, 13 bp, D. melanogaster
tgccaaacaaagg

SEQ ID NO: 654518 - DNA, 13 bp, D. melanogaster
tgccaaacaaatt

SEQ ID NO: 654519 - DNA, 13 bp, D. melanogaster
tgccaaacaatta

SEQ ID NO: 654520 - DNA, 13 bp, D. melanogaster
tgccaaacatttg

SEQ ID NO: 654521 - DNA, 13 bp, D. melanogaster
tgccaaaccaaat

SEQ ID NO: 654522 - DNA, 13 bp, D. melanogaster
tgccaaacgaaat

SEQ ID NO: 654523 - DNA, 13 bp, D. melanogaster
tgccaaacttttc

SEQ ID NO: 654524 - DNA, 13 bp, D. melanogaster
tgccaaagaaatt

SEQ ID NO: 654525 - DNA, 13 bp, D. melanogaster
tgccaaagaattt

SEQ ID NO: 654526 - DNA, 13 bp, D. melanogaster
tgccaaagacaaa

SEQ ID NO: 654527 - DNA, 13 bp, D. melanogaster
tgccaaagagaaa

SEQ ID NO: 654528 - DNA, 13 bp, D. melanogaster
tgccaaagataaa

SEQ ID NO: 654529 - DNA, 13 bp, D. melanogaster
tgccaaagcaaac

SEQ ID NO: 654530 - DNA, 13 bp, D. melanogaster
tgccaaagcgaaa

SEQ ID NO: 654531 - DNA, 13 bp, D. melanogaster
tgccaaagctttt

SEQ ID NO: 654532 - DNA, 13 bp, D. melanogaster
tgccaaaggaaaa

SEQ ID NO: 654533 - DNA, 13 bp, D. melanogaster
tgccaaagtaaaa

SEQ ID NO: 654534 - DNA, 13 bp, D. melanogaster
tgccaaagtcaaa

SEQ ID NO: 654535 - DNA, 13 bp, D. melanogaster
tgccaaagttgtt

SEQ ID NO: 654536 - DNA, 13 bp, D. melanogaster
tgccaaataaata

SEQ ID NO: 654537 - DNA, 13 bp, D. melanogaster
tgccaaataaatc

SEQ ID NO: 654538 - DNA, 13 bp, D. melanogaster
tgccaaataattt

SEQ ID NO: 654539 - DNA, 13 bp, D. melanogaster
tgccaaatacaaa

SEQ ID NO: 654540 - DNA, 13 bp, D. melanogaster
tgccaaatataaa

SEQ ID NO: 654541 - DNA, 13 bp, D. melanogaster
tgccaaatattta

SEQ ID NO: 654542 - DNA, 14 bp, D. melanogaster
tgccaaatatttgc

SEQ ID NO: 654543 - DNA, 13 bp, D. melanogaster
tgccaaatatttt

SEQ ID NO: 654544 - DNA, 13 bp, D. melanogaster
tgccaaatcaaaa

SEQ ID NO: 654545 - DNA, 14 bp, D. melanogaster
tgccaaatgaaaat

SEQ ID NO: 654546 - DNA, 13 bp, D. melanogaster
tgccaaatgaatg

SEQ ID NO: 654547 - DNA, 13 bp, D. melanogaster
tgccaaatgcaaa

SEQ ID NO: 654548 - DNA, 13 bp, D. melanogaster
tgccaaatgcaat

SEQ ID NO: 654549 - DNA, 14 bp, D. melanogaster
tgccaaatgcaatt

SEQ ID NO: 654550 - DNA, 14 bp, D. melanogaster
tgccaaatgcattt

SEQ ID NO: 654551 - DNA, 13 bp, D. melanogaster
tgccaaatgccag

SEQ ID NO: 654552 - DNA, 13 bp, D. melanogaster
tgccaaatggcaa

SEQ ID NO: 654553 - DNA, 13 bp, D. melanogaster
tgccaaatggcca

SEQ ID NO: 654554 - DNA, 13 bp, D. melanogaster
tgccaaatgggaa

SEQ ID NO: 654555 - DNA, 13 bp, D. melanogaster
tgccaaatggttt

SEQ ID NO: 654556 - DNA, 13 bp, D. melanogaster
tgccaaatgtcaa

SEQ ID NO: 654557 - DNA, 14 bp, D. melanogaster
tgccaaatgtcaaa

SEQ ID NO: 654558 - DNA, 13 bp, D. melanogaster
tgccaaatgtttg

SEQ ID NO: 654559 - DNA, 13 bp, D. melanogaster
tgccaaattaaaa

SEQ ID NO: 654560 - DNA, 13 bp, D. melanogaster
tgccaaattattt

SEQ ID NO: 654561 - DNA, 13 bp, D. melanogaster
tgccaaattgatt

SEQ ID NO: 654562 - DNA, 13 bp, D. melanogaster
tgccaaattgcca

SEQ ID NO: 654563 - DNA, 13 bp, D. melanogaster
tgccaaattgctt

SEQ ID NO: 654564 - DNA, 13 bp, D. melanogaster
tgccaaattggca

SEQ ID NO: 654565 - DNA, 13 bp, D. melanogaster
tgccaaattgttg

SEQ ID NO: 654566 - DNA, 13 bp, D. melanogaster
tgccaaattgttt

SEQ ID NO: 654567 - DNA, 13 bp, D. melanogaster
tgccaaatttaaa

SEQ ID NO: 654568 - DNA, 13 bp, D. melanogaster
tgccaaatttatg

SEQ ID NO: 654569 - DNA, 13 bp, D. melanogaster
tgccaaatttatt

SEQ ID NO: 654570 - DNA, 13 bp, D. melanogaster
tgccaaatttttt

SEQ ID NO: 654571 - DNA, 13 bp, D. melanogaster
tgccaacaaaaaa

SEQ ID NO: 654572 - DNA, 13 bp, D. melanogaster
tgccaacaaaaat

SEQ ID NO: 654573 - DNA, 13 bp, D. melanogaster
tgccaacaaaagg

SEQ ID NO: 654574 - DNA, 13 bp, D. melanogaster
tgccaacaaacaa

SEQ ID NO: 654575 - DNA, 13 bp, D. melanogaster
tgccaacaaattg

SEQ ID NO: 654576 - DNA, 13 bp, D. melanogaster
tgccaacaacaac

SEQ ID NO: 654577 - DNA, 14 bp, D. melanogaster
tgccaacaacaaca

SEQ ID NO: 654578 - DNA, 13 bp, D. melanogaster
tgccaacaacaat

SEQ ID NO: 654579 - DNA, 13 bp, D. melanogaster
tgccaacaatttg

SEQ ID NO: 654580 - DNA, 13 bp, D. melanogaster
tgccaacacaaat

SEQ ID NO: 654581 - DNA, 13 bp, D. melanogaster
tgccaacagcaac

SEQ ID NO: 654582 - DNA, 13 bp, D. melanogaster
tgccaacatattt

SEQ ID NO: 654583 - DNA, 14 bp, D. melanogaster
tgccaaccatccta

SEQ ID NO: 654584 - DNA, 13 bp, D. melanogaster
tgccaaccgaaaa

SEQ ID NO: 654585 - DNA, 13 bp, D. melanogaster
tgccaacgaaaat

SEQ ID NO: 654586 - DNA, 13 bp, D. melanogaster
tgccaacgacaat

SEQ ID NO: 654587 - DNA, 13 bp, D. melanogaster
tgccaacgccagc

SEQ ID NO: 654588 - DNA, 13 bp, D. melanogaster
tgccaactaaaaa

SEQ ID NO: 654589 - DNA, 13 bp, D. melanogaster
tgccaactaattg

SEQ ID NO: 654590 - DNA, 13 bp, D. melanogaster
tgccaactatttt

SEQ ID NO: 654591 - DNA, 13 bp, D. melanogaster
tgccaactcgttt

SEQ ID NO: 654592 - DNA, 13 bp, D. melanogaster
tgccaactgattg

SEQ ID NO: 654593 - DNA, 13 bp, D. melanogaster
tgccaactgcaac

SEQ ID NO: 654594 - DNA, 13 bp, D. melanogaster
tgccaactggcag

SEQ ID NO: 654595 - DNA, 13 bp, D. melanogaster
tgccaactgtttt

SEQ ID NO: 654596 - DNA, 13 bp, D. melanogaster
tgccaacttattt

SEQ ID NO: 654597 - DNA, 13 bp, D. melanogaster
tgccaacttgcaa

SEQ ID NO: 654598 - DNA, 13 bp, D. melanogaster
tgccaacttgttt

SEQ ID NO: 654599 - DNA, 13 bp, D. melanogaster
tgccaactttatt

SEQ ID NO: 654600 - DNA, 13 bp, D. melanogaster
tgccaacttttgt

SEQ ID NO: 654601 - DNA, 13 bp, D. melanogaster
tgccaagaaaaat

SEQ ID NO: 654602 - DNA, 13 bp, D. melanogaster
tgccaagaaaact

SEQ ID NO: 654603 - DNA, 14 bp, D. melanogaster
tgccaagaaggaaa

SEQ ID NO: 654604 - DNA, 13 bp, D. melanogaster
tgccaagcaaaat

SEQ ID NO: 654605 - DNA, 13 bp, D. melanogaster
tgccaagcaaatt

SEQ ID NO: 654606 - DNA, 13 bp, D. melanogaster
tgccaagcagaaa

SEQ ID NO: 654607 - DNA, 13 bp, D. melanogaster
tgccaaggaaaaa

SEQ ID NO: 654608 - DNA, 13 bp, D. melanogaster
tgccaaggcaaaa

SEQ ID NO: 654609 - DNA, 13 bp, D. melanogaster
tgccaagtatcaa

SEQ ID NO: 654610 - DNA, 13 bp, D. melanogaster
tgccaagtgaaaa

SEQ ID NO: 654611 - DNA, 13 bp, D. melanogaster
tgccaagtgcagc

SEQ ID NO: 654612 - DNA, 13 bp, D. melanogaster
tgccaagtgcctg

SEQ ID NO: 654613 - DNA, 13 bp, D. melanogaster
tgccaagtggcaa

SEQ ID NO: 654614 - DNA, 13 bp, D. melanogaster
tgccaagttcaaa

SEQ ID NO: 654615 - DNA, 14 bp, D. melanogaster
tgccaagttctttt

SEQ ID NO: 654616 - DNA, 13 bp, D. melanogaster
tgccaagtttttc

SEQ ID NO: 654617 - DNA, 13 bp, D. melanogaster
tgccaagtttttt

SEQ ID NO: 654618 - DNA, 13 bp, D. melanogaster
tgccaataaaatt

SEQ ID NO: 654619 - DNA, 13 bp, D. melanogaster
tgccaataaacat

SEQ ID NO: 654620 - DNA, 13 bp, D. melanogaster
tgccaataaactt

SEQ ID NO: 654621 - DNA, 13 bp, D. melanogaster
tgccaataaataa

SEQ ID NO: 654622 - DNA, 13 bp, D. melanogaster
tgccaataaatat

SEQ ID NO: 654623 - DNA, 13 bp, D. melanogaster
tgccaatatatat

SEQ ID NO: 654624 - DNA, 13 bp, D. melanogaster
tgccaatatgctc

SEQ ID NO: 654625 - DNA, 13 bp, D. melanogaster
tgccaatatttta

SEQ ID NO: 654626 - DNA, 13 bp, D. melanogaster
tgccaatattttg

SEQ ID NO: 654627 - DNA, 13 bp, D. melanogaster
tgccaatcaatcc

SEQ ID NO: 654628 - DNA, 13 bp, D. melanogaster
tgccaatcaattg

SEQ ID NO: 654629 - DNA, 13 bp, D. melanogaster
tgccaatcgaaag

SEQ ID NO: 654630 - DNA, 13 bp, D. melanogaster
tgccaatgccaaa

SEQ ID NO: 654631 - DNA, 13 bp, D. melanogaster
tgccaatgcccca

SEQ ID NO: 654632 - DNA, 13 bp, D. melanogaster
tgccaatggccaa

SEQ ID NO: 654633 - DNA, 13 bp, D. melanogaster
tgccaatgtaaat

SEQ ID NO: 654634 - DNA, 13 bp, D. melanogaster
tgccaatgttgtt

SEQ ID NO: 654635 - DNA, 13 bp, D. melanogaster
tgccaattagcat

SEQ ID NO: 654636 - DNA, 13 bp, D. melanogaster
tgccaattcaatt

SEQ ID NO: 654637 - DNA, 13 bp, D. melanogaster
tgccaattggcat

SEQ ID NO: 654638 - DNA, 13 bp, D. melanogaster
tgccaattgtaaa

SEQ ID NO: 654639 - DNA, 13 bp, D. melanogaster
tgccaattgtttt

SEQ ID NO: 654640 - DNA, 13 bp, D. melanogaster
tgccaatttatat

SEQ ID NO: 654641 - DNA, 13 bp, D. melanogaster
tgccaatttattg

SEQ ID NO: 654642 - DNA, 13 bp, D. melanogaster
tgccaatttcaaa

SEQ ID NO: 654643 - DNA, 13 bp, D. melanogaster
tgccaatttcgat

SEQ ID NO: 654644 - DNA, 14 bp, D. melanogaster
tgccaatttctatc

SEQ ID NO: 654645 - DNA, 13 bp, D. melanogaster
tgccaatttgaat

SEQ ID NO: 654646 - DNA, 13 bp, D. melanogaster
tgccaatttgcat

SEQ ID NO: 654647 - DNA, 13 bp, D. melanogaster
tgccaatttggct

SEQ ID NO: 654648 - DNA, 13 bp, D. melanogaster
tgccaattttgat

SEQ ID NO: 654649 - DNA, 13 bp, D. melanogaster
tgccaatttttgc

SEQ ID NO: 654650 - DNA, 13 bp, D. melanogaster
tgccaatttttta

SEQ ID NO: 654651 - DNA, 13 bp, D. melanogaster
tgccaattttttt

SEQ ID NO: 654652 - DNA, 13 bp, D. melanogaster
tgccacaaaaaaa

SEQ ID NO: 654653 - DNA, 13 bp, D. melanogaster
tgccacaaaaaca

SEQ ID NO: 654654 - DNA, 13 bp, D. melanogaster
tgccacaaaactt

SEQ ID NO: 654655 - DNA, 13 bp, D. melanogaster
tgccacaaaagtt

SEQ ID NO: 654656 - DNA, 13 bp, D. melanogaster
tgccacaaaatgt

SEQ ID NO: 654657 - DNA, 14 bp, D. melanogaster
tgccacaaaatgtt

SEQ ID NO: 654658 - DNA, 13 bp, D. melanogaster
tgccacaaaattc

SEQ ID NO: 654659 - DNA, 13 bp, D. melanogaster
tgccacaaacaaa

SEQ ID NO: 654660 - DNA, 13 bp, D. melanogaster
tgccacaaagttg

SEQ ID NO: 654661 - DNA, 13 bp, D. melanogaster
tgccacaaatcaa

SEQ ID NO: 654662 - DNA, 13 bp, D. melanogaster
tgccacaaattta

SEQ ID NO: 654663 - DNA, 13 bp, D. melanogaster
tgccacaacaaca

SEQ ID NO: 654664 - DNA, 13 bp, D. melanogaster
tgccacaattgca

SEQ ID NO: 654665 - DNA, 13 bp, D. melanogaster
tgccacaatttgt

SEQ ID NO: 654666 - DNA, 13 bp, D. melanogaster
tgccacacacaca

SEQ ID NO: 654667 - DNA, 13 bp, D. melanogaster
tgccacacaccac

SEQ ID NO: 654668 - DNA, 14 bp, D. melanogaster
tgccacacaccacc

SEQ ID NO: 654669 - DNA, 13 bp, D. melanogaster
tgccacacagcca

SEQ ID NO: 654670 - DNA, 13 bp, D. melanogaster
tgccacacccact

SEQ ID NO: 654671 - DNA, 14 bp, D. melanogaster
tgccacacccactc

SEQ ID NO: 654672 - DNA, 13 bp, D. melanogaster
tgccacaccccct

SEQ ID NO: 654673 - DNA, 14 bp, D. melanogaster
tgccacactcaaac

SEQ ID NO: 654674 - DNA, 13 bp, D. melanogaster
tgccacactcaca

SEQ ID NO: 654675 - DNA, 13 bp, D. melanogaster
tgccacactgcca

SEQ ID NO: 654676 - DNA, 13 bp, D. melanogaster
tgccacagcaaca

SEQ ID NO: 654677 - DNA, 14 bp, D. melanogaster
tgccacagcacata

SEQ ID NO: 654678 - DNA, 13 bp, D. melanogaster
tgccacatacacc

SEQ ID NO: 654679 - DNA, 13 bp, D. melanogaster
tgccacatatgca

SEQ ID NO: 654680 - DNA, 13 bp, D. melanogaster
tgccacatgaaaa

SEQ ID NO: 654681 - DNA, 13 bp, D. melanogaster
tgccacatgcaac

SEQ ID NO: 654682 - DNA, 14 bp, D. melanogaster
tgccacatgcaaca

SEQ ID NO: 654683 - DNA, 13 bp, D. melanogaster
tgccacatgcccc

SEQ ID NO: 654684 - DNA, 13 bp, D. melanogaster
tgccacatgttgc

SEQ ID NO: 654685 - DNA, 13 bp, D. melanogaster
tgccacattaatt

SEQ ID NO: 654686 - DNA, 13 bp, D. melanogaster
tgccacattgcca

SEQ ID NO: 654687 - DNA, 13 bp, D. melanogaster
tgccacatttgca

SEQ ID NO: 654688 - DNA, 13 bp, D. melanogaster
tgccacattttcg

SEQ ID NO: 654689 - DNA, 13 bp, D. melanogaster
tgccacattttct

SEQ ID NO: 654690 - DNA, 13 bp, D. melanogaster
tgccacatttttt

SEQ ID NO: 654691 - DNA, 13 bp, D. melanogaster
tgccaccaaattg

SEQ ID NO: 654692 - DNA, 13 bp, D. melanogaster
tgccaccaacaga

SEQ ID NO: 654693 - DNA, 13 bp, D. melanogaster
tgccaccaattga

SEQ ID NO: 654694 - DNA, 14 bp, D. melanogaster
tgccaccaattgag

SEQ ID NO: 654695 - DNA, 13 bp, D. melanogaster
tgccaccaccacc

SEQ ID NO: 654696 - DNA, 14 bp, D. melanogaster
tgccaccaccacca

SEQ ID NO: 654697 - DNA, 13 bp, D. melanogaster
tgccaccactgcc

SEQ ID NO: 654698 - DNA, 13 bp, D. melanogaster
tgccaccatgcca

SEQ ID NO: 654699 - DNA, 13 bp, D. melanogaster
tgccacccaccac

SEQ ID NO: 654700 - DNA, 14 bp, D. melanogaster
tgccacccaccacc

SEQ ID NO: 654701 - DNA, 13 bp, D. melanogaster
tgccacccactca

SEQ ID NO: 654702 - DNA, 13 bp, D. melanogaster
tgccacccacttt

SEQ ID NO: 654703 - DNA, 13 bp, D. melanogaster
tgccacccatttt

SEQ ID NO: 654704 - DNA, 13 bp, D. melanogaster
tgccaccgcaaaa

SEQ ID NO: 654705 - DNA, 13 bp, D. melanogaster
tgccaccgtgtgc

SEQ ID NO: 654706 - DNA, 13 bp, D. melanogaster
tgccaccttcttc

SEQ ID NO: 654707 - DNA, 13 bp, D. melanogaster
tgccaccttttcc

SEQ ID NO: 654708 - DNA, 13 bp, D. melanogaster
tgccacctttttt

SEQ ID NO: 654709 - DNA, 13 bp, D. melanogaster
tgccacgaagcgt

SEQ ID NO: 654710 - DNA, 13 bp, D. melanogaster
tgccacgcccaat

SEQ ID NO: 654711 - DNA, 13 bp, D. melanogaster
tgccacgcccaca

SEQ ID NO: 654712 - DNA, 13 bp, D. melanogaster
tgccacgcccacc

SEQ ID NO: 654713 - DNA, 13 bp, D. melanogaster
tgccacgcccacg

SEQ ID NO: 654714 - DNA, 13 bp, D. melanogaster
tgccacgcccact

SEQ ID NO: 654715 - DNA, 14 bp, D. melanogaster
tgccacgcccactc

SEQ ID NO: 654716 - DNA, 13 bp, D. melanogaster
tgccacgcccagt

SEQ ID NO: 654717 - DNA, 13 bp, D. melanogaster
tgccacgcccata

SEQ ID NO: 654718 - DNA, 13 bp, D. melanogaster
tgccacgcccatc

SEQ ID NO: 654719 - DNA, 14 bp, D. melanogaster
tgccacgcccatcg

SEQ ID NO: 654720 - DNA, 13 bp, D. melanogaster
tgccacgcccatt

SEQ ID NO: 654721 - DNA, 14 bp, D. melanogaster
tgccacgcccattt

SEQ ID NO: 654722 - DNA, 13 bp, D. melanogaster
tgccacgccccaa

SEQ ID NO: 654723 - DNA, 13 bp, D. melanogaster
tgccacgccccat

SEQ ID NO: 654724 - DNA, 14 bp, D. melanogaster
tgccacgccccatt

SEQ ID NO: 654725 - DNA, 13 bp, D. melanogaster
tgccacgccccca

SEQ ID NO: 654726 - DNA, 14 bp, D. melanogaster
tgccacgcccccaa

SEQ ID NO: 654727 - DNA, 14 bp, D. melanogaster
tgccacgccccccg

SEQ ID NO: 654728 - DNA, 13 bp, D. melanogaster
tgccacgccccct

SEQ ID NO: 654729 - DNA, 14 bp, D. melanogaster
tgccacgccccctc

SEQ ID NO: 654730 - DNA, 13 bp, D. melanogaster
tgccacgccctca

SEQ ID NO: 654731 - DNA, 13 bp, D. melanogaster
tgccacgccctcc

SEQ ID NO: 654732 - DNA, 13 bp, D. melanogaster
tgccacgccctcg

SEQ ID NO: 654733 - DNA, 13 bp, D. melanogaster
tgccacgcctact

SEQ ID NO: 654734 - DNA, 13 bp, D. melanogaster
tgccacgcctccc

SEQ ID NO: 654735 - DNA, 13 bp, D. melanogaster
tgccacgcctcct

SEQ ID NO: 654736 - DNA, 13 bp, D. melanogaster
tgccactaattga

SEQ ID NO: 654737 - DNA, 13 bp, D. melanogaster
tgccactaccagt

SEQ ID NO: 654738 - DNA, 13 bp, D. melanogaster
tgccactcccact

SEQ ID NO: 654739 - DNA, 14 bp, D. melanogaster
tgccactcccactc

SEQ ID NO: 654740 - DNA, 14 bp, D. melanogaster
tgccactccccctt

SEQ ID NO: 654741 - DNA, 13 bp, D. melanogaster
tgccactgcaact

SEQ ID NO: 654742 - DNA, 13 bp, D. melanogaster
tgccactgcaatt

SEQ ID NO: 654743 - DNA, 13 bp, D. melanogaster
tgccactgcagca

SEQ ID NO: 654744 - DNA, 13 bp, D. melanogaster
tgccactgcagct

SEQ ID NO: 654745 - DNA, 13 bp, D. melanogaster
tgccactgcattt

SEQ ID NO: 654746 - DNA, 14 bp, D. melanogaster
tgccactgccaccg

SEQ ID NO: 654747 - DNA, 13 bp, D. melanogaster
tgccactgccact

SEQ ID NO: 654748 - DNA, 14 bp, D. melanogaster
tgccactgccactg

SEQ ID NO: 654749 - DNA, 13 bp, D. melanogaster
tgccactgccatt

SEQ ID NO: 654750 - DNA, 14 bp, D. melanogaster
tgccactgccattg

SEQ ID NO: 654751 - DNA, 13 bp, D. melanogaster
tgccactgctgcc

SEQ ID NO: 654752 - DNA, 13 bp, D. melanogaster
tgccactgctgtt

SEQ ID NO: 654753 - DNA, 13 bp, D. melanogaster
tgccactggcaat

SEQ ID NO: 654754 - DNA, 14 bp, D. melanogaster
tgccactggtagct

SEQ ID NO: 654755 - DNA, 13 bp, D. melanogaster
tgccactggtcta

SEQ ID NO: 654756 - DNA, 13 bp, D. melanogaster
tgccacttaaatg

SEQ ID NO: 654757 - DNA, 13 bp, D. melanogaster
tgccacttaatta

SEQ ID NO: 654758 - DNA, 13 bp, D. melanogaster
tgccacttccact

SEQ ID NO: 654759 - DNA, 13 bp, D. melanogaster
tgccacttgccac

SEQ ID NO: 654760 - DNA, 13 bp, D. melanogaster
tgccacttgctgc

SEQ ID NO: 654761 - DNA, 13 bp, D. melanogaster
tgccacttggcag

SEQ ID NO: 654762 - DNA, 13 bp, D. melanogaster
tgccacttggcat

SEQ ID NO: 654763 - DNA, 13 bp, D. melanogaster
tgccactttccac

SEQ ID NO: 654764 - DNA, 13 bp, D. melanogaster
tgccactttgaaa

SEQ ID NO: 654765 - DNA, 13 bp, D. melanogaster
tgccactttgcca

SEQ ID NO: 654766 - DNA, 13 bp, D. melanogaster
tgccactttggct

SEQ ID NO: 654767 - DNA, 13 bp, D. melanogaster
tgccacttttcca

SEQ ID NO: 654768 - DNA, 13 bp, D. melanogaster
tgccactttttgt

SEQ ID NO: 654769 - DNA, 13 bp, D. melanogaster
tgccagaaaaaaa

SEQ ID NO: 654770 - DNA, 13 bp, D. melanogaster
tgccagaaaattg

SEQ ID NO: 654771 - DNA, 13 bp, D. melanogaster
tgccagaaattaa

SEQ ID NO: 654772 - DNA, 13 bp, D. melanogaster
tgccagaatgcca

SEQ ID NO: 654773 - DNA, 13 bp, D. melanogaster
tgccagaatttta

SEQ ID NO: 654774 - DNA, 13 bp, D. melanogaster
tgccagagttgcc

SEQ ID NO: 654775 - DNA, 15 bp, D. melanogaster
tgccagatcaagtgt

SEQ ID NO: 654776 - DNA, 13 bp, D. melanogaster
tgccagatgacaa

SEQ ID NO: 654777 - DNA, 13 bp, D. melanogaster
tgccagatgactc

SEQ ID NO: 654778 - DNA, 13 bp, D. melanogaster
tgccagcaaaaaa

SEQ ID NO: 654779 - DNA, 13 bp, D. melanogaster
tgccagcaaaaac

SEQ ID NO: 654780 - DNA, 14 bp, D. melanogaster
tgccagcaaaacaa

SEQ ID NO: 654781 - DNA, 13 bp, D. melanogaster
tgccagcaaaagt

SEQ ID NO: 654782 - DNA, 13 bp, D. melanogaster
tgccagcaaataa

SEQ ID NO: 654783 - DNA, 13 bp, D. melanogaster
tgccagcaaatgg

SEQ ID NO: 654784 - DNA, 13 bp, D. melanogaster
tgccagcaacaaa

SEQ ID NO: 654785 - DNA, 14 bp, D. melanogaster
tgccagcaacaaca

SEQ ID NO: 654786 - DNA, 13 bp, D. melanogaster
tgccagcaatttg

SEQ ID NO: 654787 - DNA, 13 bp, D. melanogaster
tgccagcagatcc

SEQ ID NO: 654788 - DNA, 13 bp, D. melanogaster
tgccagcagcagc

SEQ ID NO: 654789 - DNA, 14 bp, D. melanogaster
tgccagcagcagca

SEQ ID NO: 654790 - DNA, 13 bp, D. melanogaster
tgccagcattttg

SEQ ID NO: 654791 - DNA, 13 bp, D. melanogaster
tgccagccaaaaa

SEQ ID NO: 654792 - DNA, 13 bp, D. melanogaster
tgccagccaaagt

SEQ ID NO: 654793 - DNA, 13 bp, D. melanogaster
tgccagccaaatg

SEQ ID NO: 654794 - DNA, 13 bp, D. melanogaster
tgccagccaactc

SEQ ID NO: 654795 - DNA, 13 bp, D. melanogaster
tgccagccaagtg

SEQ ID NO: 654796 - DNA, 13 bp, D. melanogaster
tgccagccaattt

SEQ ID NO: 654797 - DNA, 13 bp, D. melanogaster
tgccagccaccca

SEQ ID NO: 654798 - DNA, 13 bp, D. melanogaster
tgccagccacttg

SEQ ID NO: 654799 - DNA, 13 bp, D. melanogaster
tgccagccagcag

SEQ ID NO: 654800 - DNA, 13 bp, D. melanogaster
tgccagccagcca

SEQ ID NO: 654801 - DNA, 14 bp, D. melanogaster
tgccagccagccag

SEQ ID NO: 654802 - DNA, 13 bp, D. melanogaster
tgccagccagcta

SEQ ID NO: 654803 - DNA, 13 bp, D. melanogaster
tgccagccataaa

SEQ ID NO: 654804 - DNA, 13 bp, D. melanogaster
tgccagccatttg

SEQ ID NO: 654805 - DNA, 13 bp, D. melanogaster
tgccagcgacatt

SEQ ID NO: 654806 - DNA, 13 bp, D. melanogaster
tgccagcgatttg

SEQ ID NO: 654807 - DNA, 13 bp, D. melanogaster
tgccagcgatttt

SEQ ID NO: 654808 - DNA, 13 bp, D. melanogaster
tgccagcggcaaa

SEQ ID NO: 654809 - DNA, 13 bp, D. melanogaster
tgccagctaattt

SEQ ID NO: 654810 - DNA, 13 bp, D. melanogaster
tgccagctagatc

SEQ ID NO: 654811 - DNA, 13 bp, D. melanogaster
tgccagctgaaaa

SEQ ID NO: 654812 - DNA, 13 bp, D. melanogaster
tgccagctgctgc

SEQ ID NO: 654813 - DNA, 13 bp, D. melanogaster
tgccagctgctgt

SEQ ID NO: 654814 - DNA, 13 bp, D. melanogaster
tgccaggacctgg

SEQ ID NO: 654815 - DNA, 13 bp, D. melanogaster
tgccaggacgaaa

SEQ ID NO: 654816 - DNA, 13 bp, D. melanogaster
tgccaggagcagg

SEQ ID NO: 654817 - DNA, 13 bp, D. melanogaster
tgccaggcaaaaa

SEQ ID NO: 654818 - DNA, 13 bp, D. melanogaster
tgccaggcagcca

SEQ ID NO: 654819 - DNA, 13 bp, D. melanogaster
tgccagtgcaatt

SEQ ID NO: 654820 - DNA, 13 bp, D. melanogaster
tgccagtgcattt

SEQ ID NO: 654821 - DNA, 13 bp, D. melanogaster
tgccagtgccagt

SEQ ID NO: 654822 - DNA, 13 bp, D. melanogaster
tgccagtggcaac

SEQ ID NO: 654823 - DNA, 13 bp, D. melanogaster
tgccagtgtgttt

SEQ ID NO: 654824 - DNA, 13 bp, D. melanogaster
tgccagtgtttgt

SEQ ID NO: 654825 - DNA, 13 bp, D. melanogaster
tgccagttaatta

SEQ ID NO: 654826 - DNA, 13 bp, D. melanogaster
tgccagttgccag

SEQ ID NO: 654827 - DNA, 13 bp, D. melanogaster
tgccagttggcaa

SEQ ID NO: 654828 - DNA, 13 bp, D. melanogaster
tgccagttggcca

SEQ ID NO: 654829 - DNA, 13 bp, D. melanogaster
tgccagttggctg

SEQ ID NO: 654830 - DNA, 13 bp, D. melanogaster
tgccagttgttgt

SEQ ID NO: 654831 - DNA, 13 bp, D. melanogaster
tgccagtttgcca

SEQ ID NO: 654832 - DNA, 14 bp, D. melanogaster
tgccagtttgccag

SEQ ID NO: 654833 - DNA, 13 bp, D. melanogaster
tgccagttttatt

SEQ ID NO: 654834 - DNA, 13 bp, D. melanogaster
tgccataaaaata

SEQ ID NO: 654835 - DNA, 13 bp, D. melanogaster
tgccataaaatat

SEQ ID NO: 654836 - DNA, 13 bp, D. melanogaster
tgccataaacaaa

SEQ ID NO: 654837 - DNA, 13 bp, D. melanogaster
tgccataaacaac

SEQ ID NO: 654838 - DNA, 13 bp, D. melanogaster
tgccataaacata

SEQ ID NO: 654839 - DNA, 13 bp, D. melanogaster
tgccataaatata

SEQ ID NO: 654840 - DNA, 14 bp, D. melanogaster
tgccataaatattt

SEQ ID NO: 654841 - DNA, 13 bp, D. melanogaster
tgccataaatcaa

SEQ ID NO: 654842 - DNA, 13 bp, D. melanogaster
tgccataataaaa

SEQ ID NO: 654843 - DNA, 13 bp, D. melanogaster
tgccataattaaa

SEQ ID NO: 654844 - DNA, 14 bp, D. melanogaster
tgccataccaatag

SEQ ID NO: 654845 - DNA, 13 bp, D. melanogaster
tgccatataaata

SEQ ID NO: 654846 - DNA, 14 bp, D. melanogaster
tgccatatatgtat

SEQ ID NO: 654847 - DNA, 13 bp, D. melanogaster
tgccatatgccat

SEQ ID NO: 654848 - DNA, 13 bp, D. melanogaster
tgccatatttgct

SEQ ID NO: 654849 - DNA, 13 bp, D. melanogaster
tgccatcaaaatc

SEQ ID NO: 654850 - DNA, 13 bp, D. melanogaster
tgccatcaaaatt

SEQ ID NO: 654851 - DNA, 13 bp, D. melanogaster
tgccatcaaattg

SEQ ID NO: 654852 - DNA, 13 bp, D. melanogaster
tgccatcaacgcc

SEQ ID NO: 654853 - DNA, 13 bp, D. melanogaster
tgccatcaattaa

SEQ ID NO: 654854 - DNA, 13 bp, D. melanogaster
tgccatcatcatc

SEQ ID NO: 654855 - DNA, 13 bp, D. melanogaster
tgccatcattttt

SEQ ID NO: 654856 - DNA, 13 bp, D. melanogaster
tgccatccaaaaa

SEQ ID NO: 654857 - DNA, 13 bp, D. melanogaster
tgccatcccatcc

SEQ ID NO: 654858 - DNA, 13 bp, D. melanogaster
tgccatcctgcca

SEQ ID NO: 654859 - DNA, 13 bp, D. melanogaster
tgccatcgcaaaa

SEQ ID NO: 654860 - DNA, 13 bp, D. melanogaster
tgccatcgccatc

SEQ ID NO: 654861 - DNA, 14 bp, D. melanogaster
tgccatcgccatcg

SEQ ID NO: 654862 - DNA, 13 bp, D. melanogaster
tgccatcgcttat

SEQ ID NO: 654863 - DNA, 13 bp, D. melanogaster
tgccatcgtcatc

SEQ ID NO: 654864 - DNA, 13 bp, D. melanogaster
tgccatgaaaaat

SEQ ID NO: 654865 - DNA, 13 bp, D. melanogaster
tgccatgaaaatg

SEQ ID NO: 654866 - DNA, 13 bp, D. melanogaster
tgccatgatatct

SEQ ID NO: 654867 - DNA, 13 bp, D. melanogaster
tgccatgcatttt

SEQ ID NO: 654868 - DNA, 13 bp, D. melanogaster
tgccatgcgatag

SEQ ID NO: 654869 - DNA, 13 bp, D. melanogaster
tgccatggcaaat

SEQ ID NO: 654870 - DNA, 13 bp, D. melanogaster
tgccatggcaatt

SEQ ID NO: 654871 - DNA, 13 bp, D. melanogaster
tgccatgtgccat

SEQ ID NO: 654872 - DNA, 13 bp, D. melanogaster
tgccatgtgtgtg

SEQ ID NO: 654873 - DNA, 13 bp, D. melanogaster
tgccattaaaaat

SEQ ID NO: 654874 - DNA, 13 bp, D. melanogaster
tgccattaaaaca

SEQ ID NO: 654875 - DNA, 13 bp, D. melanogaster
tgccattaaaata

SEQ ID NO: 654876 - DNA, 13 bp, D. melanogaster
tgccattaaagcc

SEQ ID NO: 654877 - DNA, 13 bp, D. melanogaster
tgccattaatcaa

SEQ ID NO: 654878 - DNA, 13 bp, D. melanogaster
tgccattataaat

SEQ ID NO: 654879 - DNA, 13 bp, D. melanogaster
tgccattcaaatt

SEQ ID NO: 654880 - DNA, 13 bp, D. melanogaster
tgccattcaattc

SEQ ID NO: 654881 - DNA, 13 bp, D. melanogaster
tgccattcagata

SEQ ID NO: 654882 - DNA, 13 bp, D. melanogaster
tgccattcatttg

SEQ ID NO: 654883 - DNA, 13 bp, D. melanogaster
tgccattccattc

SEQ ID NO: 654884 - DNA, 13 bp, D. melanogaster
tgccattccattt

SEQ ID NO: 654885 - DNA, 13 bp, D. melanogaster
tgccattcccatt

SEQ ID NO: 654886 - DNA, 13 bp, D. melanogaster
tgccattcgattt

SEQ ID NO: 654887 - DNA, 13 bp, D. melanogaster
tgccattcgccat

SEQ ID NO: 654888 - DNA, 13 bp, D. melanogaster
tgccattcgcttt

SEQ ID NO: 654889 - DNA, 13 bp, D. melanogaster
tgccattcggtgg

SEQ ID NO: 654890 - DNA, 14 bp, D. melanogaster
tgccattcggtggc

SEQ ID NO: 654891 - DNA, 13 bp, D. melanogaster
tgccattctgcca

SEQ ID NO: 654892 - DNA, 13 bp, D. melanogaster
tgccattgaaagt

SEQ ID NO: 654893 - DNA, 13 bp, D. melanogaster
tgccattgaaatc

SEQ ID NO: 654894 - DNA, 13 bp, D. melanogaster
tgccattgacatt

SEQ ID NO: 654895 - DNA, 13 bp, D. melanogaster
tgccattgacttt

SEQ ID NO: 654896 - DNA, 13 bp, D. melanogaster
tgccattgatttc

SEQ ID NO: 654897 - DNA, 13 bp, D. melanogaster
tgccattgcaaaa

SEQ ID NO: 654898 - DNA, 13 bp, D. melanogaster
tgccattgcagtt

SEQ ID NO: 654899 - DNA, 13 bp, D. melanogaster
tgccattgccatt

SEQ ID NO: 654900 - DNA, 14 bp, D. melanogaster
tgccattgccattc

SEQ ID NO: 654901 - DNA, 13 bp, D. melanogaster
tgccattgctgct

SEQ ID NO: 654902 - DNA, 13 bp, D. melanogaster
tgccattggcaat

SEQ ID NO: 654903 - DNA, 13 bp, D. melanogaster
tgccattgtcctt

SEQ ID NO: 654904 - DNA, 14 bp, D. melanogaster
tgccattgtctttg

SEQ ID NO: 654905 - DNA, 13 bp, D. melanogaster
tgccattgtgttt

SEQ ID NO: 654906 - DNA, 13 bp, D. melanogaster
tgccattgttatt

SEQ ID NO: 654907 - DNA, 13 bp, D. melanogaster
tgccattgttgca

SEQ ID NO: 654908 - DNA, 13 bp, D. melanogaster
tgccattgttgcc

SEQ ID NO: 654909 - DNA, 13 bp, D. melanogaster
tgccattgttgct

SEQ ID NO: 654910 - DNA, 14 bp, D. melanogaster
tgccattgttgttg

SEQ ID NO: 654911 - DNA, 13 bp, D. melanogaster
tgccatttaccat

SEQ ID NO: 654912 - DNA, 13 bp, D. melanogaster
tgccatttatcaa

SEQ ID NO: 654913 - DNA, 13 bp, D. melanogaster
tgccatttattta

SEQ ID NO: 654914 - DNA, 13 bp, D. melanogaster
tgccatttatttt

SEQ ID NO: 654915 - DNA, 14 bp, D. melanogaster
tgccatttattttt

SEQ ID NO: 654916 - DNA, 13 bp, D. melanogaster
tgccatttcaatg

SEQ ID NO: 654917 - DNA, 13 bp, D. melanogaster
tgccatttcactt

SEQ ID NO: 654918 - DNA, 13 bp, D. melanogaster
tgccatttccgct

SEQ ID NO: 654919 - DNA, 13 bp, D. melanogaster
tgccatttccgtt

SEQ ID NO: 654920 - DNA, 13 bp, D. melanogaster
tgccatttcgcat

SEQ ID NO: 654921 - DNA, 13 bp, D. melanogaster
tgccatttctcat

SEQ ID NO: 654922 - DNA, 13 bp, D. melanogaster
tgccatttgaatt

SEQ ID NO: 654923 - DNA, 13 bp, D. melanogaster
tgccatttgcaat

SEQ ID NO: 654924 - DNA, 14 bp, D. melanogaster
tgccatttgcattt

SEQ ID NO: 654925 - DNA, 13 bp, D. melanogaster
tgccatttgccac

SEQ ID NO: 654926 - DNA, 14 bp, D. melanogaster
tgccatttgccatt

SEQ ID NO: 654927 - DNA, 13 bp, D. melanogaster
tgccatttgccca

SEQ ID NO: 654928 - DNA, 13 bp, D. melanogaster
tgccatttgccgc

SEQ ID NO: 654929 - DNA, 13 bp, D. melanogaster
tgccatttgcctt

SEQ ID NO: 654930 - DNA, 13 bp, D. melanogaster
tgccatttgctgt

SEQ ID NO: 654931 - DNA, 13 bp, D. melanogaster
tgccatttgcttt

SEQ ID NO: 654932 - DNA, 13 bp, D. melanogaster
tgccatttggcct

SEQ ID NO: 654933 - DNA, 13 bp, D. melanogaster
tgccatttggctt

SEQ ID NO: 654934 - DNA, 13 bp, D. melanogaster
tgccatttgtcag

SEQ ID NO: 654935 - DNA, 13 bp, D. melanogaster
tgccatttgtggc

SEQ ID NO: 654936 - DNA, 13 bp, D. melanogaster
tgccatttgttaa

SEQ ID NO: 654937 - DNA, 13 bp, D. melanogaster
tgccatttgttgt

SEQ ID NO: 654938 - DNA, 13 bp, D. melanogaster
tgccatttgtttt

SEQ ID NO: 654939 - DNA, 13 bp, D. melanogaster
tgccattttaaat

SEQ ID NO: 654940 - DNA, 13 bp, D. melanogaster
tgccattttaagt

SEQ ID NO: 654941 - DNA, 13 bp, D. melanogaster
tgccattttattt

SEQ ID NO: 654942 - DNA, 13 bp, D. melanogaster
tgccattttcatt

SEQ ID NO: 654943 - DNA, 13 bp, D. melanogaster
tgccattttccac

SEQ ID NO: 654944 - DNA, 13 bp, D. melanogaster
tgccattttcttt

SEQ ID NO: 654945 - DNA, 14 bp, D. melanogaster
tgccattttgattt

SEQ ID NO: 654946 - DNA, 13 bp, D. melanogaster
tgccattttgcag

SEQ ID NO: 654947 - DNA, 14 bp, D. melanogaster
tgccattttgccat

SEQ ID NO: 654948 - DNA, 13 bp, D. melanogaster
tgccattttgccg

SEQ ID NO: 654949 - DNA, 13 bp, D. melanogaster
tgccattttgtgg

SEQ ID NO: 654950 - DNA, 13 bp, D. melanogaster
tgccatttttatg

SEQ ID NO: 654951 - DNA, 14 bp, D. melanogaster
tgccatttttattt

SEQ ID NO: 654952 - DNA, 13 bp, D. melanogaster
tgccatttttcgc

SEQ ID NO: 654953 - DNA, 13 bp, D. melanogaster
tgccatttttctt

SEQ ID NO: 654954 - DNA, 13 bp, D. melanogaster
tgccatttttgcc

SEQ ID NO: 654955 - DNA, 13 bp, D. melanogaster
tgccatttttggg

SEQ ID NO: 654956 - DNA, 13 bp, D. melanogaster
tgccattttttgc

SEQ ID NO: 654957 - DNA, 13 bp, D. melanogaster
tgccattttttgt

SEQ ID NO: 654958 - DNA, 13 bp, D. melanogaster
tgcccaaaaaaaa

SEQ ID NO: 654959 - DNA, 14 bp, D. melanogaster
tgcccaaaaaaaaa

SEQ ID NO: 654960 - DNA, 13 bp, D. melanogaster
tgcccaaaaatgc

SEQ ID NO: 654961 - DNA, 13 bp, D. melanogaster
tgcccaaaaatgg

SEQ ID NO: 654962 - DNA, 13 bp, D. melanogaster
tgcccaaaatgct

SEQ ID NO: 654963 - DNA, 13 bp, D. melanogaster
tgcccaaagacat

SEQ ID NO: 654964 - DNA, 13 bp, D. melanogaster
tgcccaacaaatt

SEQ ID NO: 654965 - DNA, 13 bp, D. melanogaster
tgcccaacgtcgg

SEQ ID NO: 654966 - DNA, 13 bp, D. melanogaster
tgcccaatttaat

SEQ ID NO: 654967 - DNA, 13 bp, D. melanogaster
tgcccaattttcc

SEQ ID NO: 654968 - DNA, 13 bp, D. melanogaster
tgcccacatttaa

SEQ ID NO: 654969 - DNA, 13 bp, D. melanogaster
tgcccacattttt

SEQ ID NO: 654970 - DNA, 13 bp, D. melanogaster
tgcccaccataac

SEQ ID NO: 654971 - DNA, 13 bp, D. melanogaster
tgcccaccgccca

SEQ ID NO: 654972 - DNA, 13 bp, D. melanogaster
tgcccactcttaa

SEQ ID NO: 654973 - DNA, 13 bp, D. melanogaster
tgcccactgataa

SEQ ID NO: 654974 - DNA, 13 bp, D. melanogaster
tgcccactgtgca

SEQ ID NO: 654975 - DNA, 13 bp, D. melanogaster
tgcccagcaattt

SEQ ID NO: 654976 - DNA, 13 bp, D. melanogaster
tgcccagcagcag

SEQ ID NO: 654977 - DNA, 13 bp, D. melanogaster
tgcccagtgccca

SEQ ID NO: 654978 - DNA, 13 bp, D. melanogaster
tgcccatactcaa

SEQ ID NO: 654979 - DNA, 14 bp, D. melanogaster
tgcccatactcaat

SEQ ID NO: 654980 - DNA, 13 bp, D. melanogaster
tgcccatccagta

SEQ ID NO: 654981 - DNA, 13 bp, D. melanogaster
tgcccatctctta

SEQ ID NO: 654982 - DNA, 13 bp, D. melanogaster
tgcccatgcccat

SEQ ID NO: 654983 - DNA, 14 bp, D. melanogaster
tgcccatgcccatg

SEQ ID NO: 654984 - DNA, 13 bp, D. melanogaster
tgcccattaccac

SEQ ID NO: 654985 - DNA, 14 bp, D. melanogaster
tgcccattcccatt

SEQ ID NO: 654986 - DNA, 13 bp, D. melanogaster
tgcccattgttgt

SEQ ID NO: 654987 - DNA, 13 bp, D. melanogaster
tgcccattgtttg

SEQ ID NO: 654988 - DNA, 13 bp, D. melanogaster
tgcccatttattt

SEQ ID NO: 654989 - DNA, 13 bp, D. melanogaster
tgcccatttccca

SEQ ID NO: 654990 - DNA, 13 bp, D. melanogaster
tgcccattttggc

SEQ ID NO: 654991 - DNA, 13 bp, D. melanogaster
tgccccaaaatgc

SEQ ID NO: 654992 - DNA, 13 bp, D. melanogaster
tgccccaaactgg

SEQ ID NO: 654993 - DNA, 13 bp, D. melanogaster
tgccccaagattc

SEQ ID NO: 654994 - DNA, 13 bp, D. melanogaster
tgccccacagctc

SEQ ID NO: 654995 - DNA, 13 bp, D. melanogaster
tgccccactgtgc

SEQ ID NO: 654996 - DNA, 13 bp, D. melanogaster
tgccccagccaca

SEQ ID NO: 654997 - DNA, 13 bp, D. melanogaster
tgcccccaaaaat

SEQ ID NO: 654998 - DNA, 13 bp, D. melanogaster
tgccccgcccaca

SEQ ID NO: 654999 - DNA, 14 bp, D. melanogaster
tgccccgcccaccg

SEQ ID NO: 655000 - DNA, 13 bp, D. melanogaster
tgcccctcttgtt

SEQ ID NO: 655001 - DNA, 13 bp, D. melanogaster
tgcccctgcccca

SEQ ID NO: 655002 - DNA, 13 bp, D. melanogaster
tgcccgtgtgtgt

SEQ ID NO: 655003 - DNA, 13 bp, D. melanogaster
tgccctgaccaac

SEQ ID NO: 655004 - DNA, 13 bp, D. melanogaster
tgccctgcaattg

SEQ ID NO: 655005 - DNA, 13 bp, D. melanogaster
tgcccttcacctc

SEQ ID NO: 655006 - DNA, 13 bp, D. melanogaster
tgcccttcttcta

SEQ ID NO: 655007 - DNA, 13 bp, D. melanogaster
tgccctttgaccc

SEQ ID NO: 655008 - DNA, 14 bp, D. melanogaster
tgcccttttcttta

SEQ ID NO: 655009 - DNA, 13 bp, D. melanogaster
tgccgaaaaaaaa

SEQ ID NO: 655010 - DNA, 13 bp, D. melanogaster
tgccgaaaaactt

SEQ ID NO: 655011 - DNA, 13 bp, D. melanogaster
tgccgaaacaaaa

SEQ ID NO: 655012 - DNA, 13 bp, D. melanogaster
tgccgaaataaat

SEQ ID NO: 655013 - DNA, 13 bp, D. melanogaster
tgccgaagcccgt

SEQ ID NO: 655014 - DNA, 13 bp, D. melanogaster
tgccgacgacttc

SEQ ID NO: 655015 - DNA, 14 bp, D. melanogaster
tgccgacgtcgacg

SEQ ID NO: 655016 - DNA, 13 bp, D. melanogaster
tgccgactggaga

SEQ ID NO: 655017 - DNA, 13 bp, D. melanogaster
tgccgagaaaaat

SEQ ID NO: 655018 - DNA, 14 bp, D. melanogaster
tgccgaggccaaag

SEQ ID NO: 655019 - DNA, 13 bp, D. melanogaster
tgccgagtgccga

SEQ ID NO: 655020 - DNA, 13 bp, D. melanogaster
tgccgatgcagct

SEQ ID NO: 655021 - DNA, 13 bp, D. melanogaster
tgccgatgcatta

SEQ ID NO: 655022 - DNA, 14 bp, D. melanogaster
tgccgatgccgatg

SEQ ID NO: 655023 - DNA, 13 bp, D. melanogaster
tgccgcaaaatgc

SEQ ID NO: 655024 - DNA, 13 bp, D. melanogaster
tgccgcaaattgc

SEQ ID NO: 655025 - DNA, 14 bp, D. melanogaster
tgccgcaacagcaa

SEQ ID NO: 655026 - DNA, 13 bp, D. melanogaster
tgccgcaatggaa

SEQ ID NO: 655027 - DNA, 13 bp, D. melanogaster
tgccgcaatttgc

SEQ ID NO: 655028 - DNA, 13 bp, D. melanogaster
tgccgcagttgca

SEQ ID NO: 655029 - DNA, 13 bp, D. melanogaster
tgccgcataaatc

SEQ ID NO: 655030 - DNA, 13 bp, D. melanogaster
tgccgcatccttg

SEQ ID NO: 655031 - DNA, 13 bp, D. melanogaster
tgccgccaaaaca

SEQ ID NO: 655032 - DNA, 13 bp, D. melanogaster
tgccgcccaaaaa

SEQ ID NO: 655033 - DNA, 13 bp, D. melanogaster
tgccgcccacttg

SEQ ID NO: 655034 - DNA, 13 bp, D. melanogaster
tgccgcccacttt

SEQ ID NO: 655035 - DNA, 14 bp, D. melanogaster
tgccgccccctttt

SEQ ID NO: 655036 - DNA, 13 bp, D. melanogaster
tgccgccgccgct

SEQ ID NO: 655037 - DNA, 13 bp, D. melanogaster
tgccgccgctgca

SEQ ID NO: 655038 - DNA, 13 bp, D. melanogaster
tgccgccgctgcc

SEQ ID NO: 655039 - DNA, 13 bp, D. melanogaster
tgccgccggaaat

SEQ ID NO: 655040 - DNA, 13 bp, D. melanogaster
tgccgcctctttt

SEQ ID NO: 655041 - DNA, 13 bp, D. melanogaster
tgccgcctgctgc

SEQ ID NO: 655042 - DNA, 13 bp, D. melanogaster
tgccgcctttttt

SEQ ID NO: 655043 - DNA, 13 bp, D. melanogaster
tgccgctaatcag

SEQ ID NO: 655044 - DNA, 13 bp, D. melanogaster
tgccgctcacaca

SEQ ID NO: 655045 - DNA, 13 bp, D. melanogaster
tgccgctgatgtt

SEQ ID NO: 655046 - DNA, 13 bp, D. melanogaster
tgccgctgcagct

SEQ ID NO: 655047 - DNA, 13 bp, D. melanogaster
tgccgctgcagtt

SEQ ID NO: 655048 - DNA, 13 bp, D. melanogaster
tgccgctgcattt

SEQ ID NO: 655049 - DNA, 13 bp, D. melanogaster
tgccgctgccact

SEQ ID NO: 655050 - DNA, 13 bp, D. melanogaster
tgccgctgccatt

SEQ ID NO: 655051 - DNA, 13 bp, D. melanogaster
tgccgctgctgca

SEQ ID NO: 655052 - DNA, 14 bp, D. melanogaster
tgccgctgctgcag

SEQ ID NO: 655053 - DNA, 13 bp, D. melanogaster
tgccgctgctgcc

SEQ ID NO: 655054 - DNA, 13 bp, D. melanogaster
tgccgctgctgcg

SEQ ID NO: 655055 - DNA, 14 bp, D. melanogaster
tgccgctgctgctg

SEQ ID NO: 655056 - DNA, 13 bp, D. melanogaster
tgccgctgctggc

SEQ ID NO: 655057 - DNA, 13 bp, D. melanogaster
tgccgctgctgtc

SEQ ID NO: 655058 - DNA, 13 bp, D. melanogaster
tgccgctgctttt

SEQ ID NO: 655059 - DNA, 13 bp, D. melanogaster
tgccgctggcatt

SEQ ID NO: 655060 - DNA, 13 bp, D. melanogaster
tgccgctggccag

SEQ ID NO: 655061 - DNA, 13 bp, D. melanogaster
tgccgctgtcaaa

SEQ ID NO: 655062 - DNA, 13 bp, D. melanogaster
tgccgctgtcatt

SEQ ID NO: 655063 - DNA, 13 bp, D. melanogaster
tgccgctgttgct

SEQ ID NO: 655064 - DNA, 14 bp, D. melanogaster
tgccgctgttgctg

SEQ ID NO: 655065 - DNA, 13 bp, D. melanogaster
tgccgctgttgtt

SEQ ID NO: 655066 - DNA, 13 bp, D. melanogaster
tgccgcttctgct

SEQ ID NO: 655067 - DNA, 13 bp, D. melanogaster
tgccgcttcttct

SEQ ID NO: 655068 - DNA, 13 bp, D. melanogaster
tgccgcttgtttg

SEQ ID NO: 655069 - DNA, 13 bp, D. melanogaster
tgccgctttgatt

SEQ ID NO: 655070 - DNA, 13 bp, D. melanogaster
tgccgcttttgct

SEQ ID NO: 655071 - DNA, 13 bp, D. melanogaster
tgccggcaattaa

SEQ ID NO: 655072 - DNA, 13 bp, D. melanogaster
tgccggcaatttg

SEQ ID NO: 655073 - DNA, 13 bp, D. melanogaster
tgccggccataaa

SEQ ID NO: 655074 - DNA, 13 bp, D. melanogaster
tgccggccgtgtt

SEQ ID NO: 655075 - DNA, 13 bp, D. melanogaster
tgccgggccaaaa

SEQ ID NO: 655076 - DNA, 13 bp, D. melanogaster
tgccggtcttcct

SEQ ID NO: 655077 - DNA, 13 bp, D. melanogaster
tgccgtcaaactc

SEQ ID NO: 655078 - DNA, 13 bp, D. melanogaster
tgccgtcttcagt

SEQ ID NO: 655079 - DNA, 13 bp, D. melanogaster
tgccgtgtgatgt

SEQ ID NO: 655080 - DNA, 13 bp, D. melanogaster
tgccgttgccatt

SEQ ID NO: 655081 - DNA, 14 bp, D. melanogaster
tgccgttgccattg

SEQ ID NO: 655082 - DNA, 13 bp, D. melanogaster
tgccgttgcccat

SEQ ID NO: 655083 - DNA, 14 bp, D. melanogaster
tgccgttgctgctg

SEQ ID NO: 655084 - DNA, 13 bp, D. melanogaster
tgccgttgctgtt

SEQ ID NO: 655085 - DNA, 14 bp, D. melanogaster
tgccgttgctgttg

SEQ ID NO: 655086 - DNA, 14 bp, D. melanogaster
tgccgttgttgttg

SEQ ID NO: 655087 - DNA, 13 bp, D. melanogaster
tgccgttttggcc

SEQ ID NO: 655088 - DNA, 13 bp, D. melanogaster
tgcctaaaataca

SEQ ID NO: 655089 - DNA, 13 bp, D. melanogaster
tgcctaagtcttt

SEQ ID NO: 655090 - DNA, 13 bp, D. melanogaster
tgcctaataaaat

SEQ ID NO: 655091 - DNA, 13 bp, D. melanogaster
tgcctacgtacta

SEQ ID NO: 655092 - DNA, 14 bp, D. melanogaster
tgcctacttttggg

SEQ ID NO: 655093 - DNA, 13 bp, D. melanogaster
tgcctataaattt

SEQ ID NO: 655094 - DNA, 13 bp, D. melanogaster
tgcctatgcaaat

SEQ ID NO: 655095 - DNA, 13 bp, D. melanogaster
tgcctattatgtt

SEQ ID NO: 655096 - DNA, 13 bp, D. melanogaster
tgcctattttaat

SEQ ID NO: 655097 - DNA, 13 bp, D. melanogaster
tgcctccgaaaac

SEQ ID NO: 655098 - DNA, 13 bp, D. melanogaster
tgcctcggcattt

SEQ ID NO: 655099 - DNA, 14 bp, D. melanogaster
tgcctcggcatttt

SEQ ID NO: 655100 - DNA, 13 bp, D. melanogaster
tgcctctcattct

SEQ ID NO: 655101 - DNA, 13 bp, D. melanogaster
tgcctctctttcg

SEQ ID NO: 655102 - DNA, 14 bp, D. melanogaster
tgcctctgccgcag

SEQ ID NO: 655103 - DNA, 13 bp, D. melanogaster
tgcctctgcctct

SEQ ID NO: 655104 - DNA, 14 bp, D. melanogaster
tgcctctgcctctg

SEQ ID NO: 655105 - DNA, 13 bp, D. melanogaster
tgcctctgctgct

SEQ ID NO: 655106 - DNA, 14 bp, D. melanogaster
tgcctgaaaacagt

SEQ ID NO: 655107 - DNA, 13 bp, D. melanogaster
tgcctgatctgca

SEQ ID NO: 655108 - DNA, 13 bp, D. melanogaster
tgcctgcattttt

SEQ ID NO: 655109 - DNA, 13 bp, D. melanogaster
tgcctgccaaatg

SEQ ID NO: 655110 - DNA, 13 bp, D. melanogaster
tgcctgccacatt

SEQ ID NO: 655111 - DNA, 13 bp, D. melanogaster
tgcctgccacttg

SEQ ID NO: 655112 - DNA, 13 bp, D. melanogaster
tgcctgccgcctg

SEQ ID NO: 655113 - DNA, 13 bp, D. melanogaster
tgcctgcctgcca

SEQ ID NO: 655114 - DNA, 13 bp, D. melanogaster
tgcctgcctgcct

SEQ ID NO: 655115 - DNA, 14 bp, D. melanogaster
tgcctgcctgcctt

SEQ ID NO: 655116 - DNA, 13 bp, D. melanogaster
tgcctgcgccatg

SEQ ID NO: 655117 - DNA, 13 bp, D. melanogaster
tgcctgctctact

SEQ ID NO: 655118 - DNA, 13 bp, D. melanogaster
tgcctgctgaagg

SEQ ID NO: 655119 - DNA, 13 bp, D. melanogaster
tgcctgctgatcc

SEQ ID NO: 655120 - DNA, 13 bp, D. melanogaster
tgcctgctgcctg

SEQ ID NO: 655121 - DNA, 14 bp, D. melanogaster
tgcctgctgcctgc

SEQ ID NO: 655122 - DNA, 13 bp, D. melanogaster
tgcctggaaaaaa

SEQ ID NO: 655123 - DNA, 13 bp, D. melanogaster
tgcctggcatttt

SEQ ID NO: 655124 - DNA, 13 bp, D. melanogaster
tgcctggccaaaa

SEQ ID NO: 655125 - DNA, 13 bp, D. melanogaster
tgcctggctgcct

SEQ ID NO: 655126 - DNA, 14 bp, D. melanogaster
tgcctggctggctg

SEQ ID NO: 655127 - DNA, 13 bp, D. melanogaster
tgcctgggaaaat

SEQ ID NO: 655128 - DNA, 13 bp, D. melanogaster
tgcctggggactt

SEQ ID NO: 655129 - DNA, 13 bp, D. melanogaster
tgcctgtgaaatt

SEQ ID NO: 655130 - DNA, 14 bp, D. melanogaster
tgcctgtgaaattg

SEQ ID NO: 655131 - DNA, 14 bp, D. melanogaster
tgcctgtgcctgtg

SEQ ID NO: 655132 - DNA, 13 bp, D. melanogaster
tgcctgtgtgcgt

SEQ ID NO: 655133 - DNA, 14 bp, D. melanogaster
tgcctgtgtgcgtg

SEQ ID NO: 655134 - DNA, 14 bp, D. melanogaster
tgcctgtgtgtgtg

SEQ ID NO: 655135 - DNA, 13 bp, D. melanogaster
tgcctgtgtttca

SEQ ID NO: 655136 - DNA, 13 bp, D. melanogaster
tgcctgttgttca

SEQ ID NO: 655137 - DNA, 13 bp, D. melanogaster
tgcctgtttacca

SEQ ID NO: 655138 - DNA, 13 bp, D. melanogaster
tgccttattcaat

SEQ ID NO: 655139 - DNA, 13 bp, D. melanogaster
tgccttcaatttg

SEQ ID NO: 655140 - DNA, 13 bp, D. melanogaster
tgccttcatcact

SEQ ID NO: 655141 - DNA, 13 bp, D. melanogaster
tgccttcgaactt

SEQ ID NO: 655142 - DNA, 13 bp, D. melanogaster
tgccttctgcata

SEQ ID NO: 655143 - DNA, 15 bp, D. melanogaster
tgccttctgcataca

SEQ ID NO: 655144 - DNA, 13 bp, D. melanogaster
tgccttctgcatg

SEQ ID NO: 655145 - DNA, 13 bp, D. melanogaster
tgccttgaaagct

SEQ ID NO: 655146 - DNA, 13 bp, D. melanogaster
tgccttgcatttt

SEQ ID NO: 655147 - DNA, 13 bp, D. melanogaster
tgccttgcgaaaa

SEQ ID NO: 655148 - DNA, 13 bp, D. melanogaster
tgccttgcgatcg

SEQ ID NO: 655149 - DNA, 15 bp, D. melanogaster
tgccttgcggcactc

SEQ ID NO: 655150 - DNA, 13 bp, D. melanogaster
tgccttggctttt

SEQ ID NO: 655151 - DNA, 13 bp, D. melanogaster
tgccttgtggttg

SEQ ID NO: 655152 - DNA, 13 bp, D. melanogaster
tgcctttcaattg

SEQ ID NO: 655153 - DNA, 13 bp, D. melanogaster
tgcctttcggcaa

SEQ ID NO: 655154 - DNA, 13 bp, D. melanogaster
tgcctttgacttt

SEQ ID NO: 655155 - DNA, 13 bp, D. melanogaster
tgcctttgcattt

SEQ ID NO: 655156 - DNA, 13 bp, D. melanogaster
tgcctttgccatt

SEQ ID NO: 655157 - DNA, 13 bp, D. melanogaster
tgcctttgcctct

SEQ ID NO: 655158 - DNA, 13 bp, D. melanogaster
tgcctttgccttg

SEQ ID NO: 655159 - DNA, 13 bp, D. melanogaster
tgcctttgccttt

SEQ ID NO: 655160 - DNA, 13 bp, D. melanogaster
tgcctttggcctg

SEQ ID NO: 655161 - DNA, 13 bp, D. melanogaster
tgcctttggcttc

SEQ ID NO: 655162 - DNA, 13 bp, D. melanogaster
tgcctttggcttt

SEQ ID NO: 655163 - DNA, 14 bp, D. melanogaster
tgcctttggctttg

SEQ ID NO: 655164 - DNA, 13 bp, D. melanogaster
tgcctttggtttg

SEQ ID NO: 655165 - DNA, 13 bp, D. melanogaster
tgcctttgtcatt

SEQ ID NO: 655166 - DNA, 14 bp, D. melanogaster
tgcctttgtcattt

SEQ ID NO: 655167 - DNA, 13 bp, D. melanogaster
tgcctttgtgcca

SEQ ID NO: 655168 - DNA, 14 bp, D. melanogaster
tgccttttagtttt

SEQ ID NO: 655169 - DNA, 13 bp, D. melanogaster
tgccttttatcgg

SEQ ID NO: 655170 - DNA, 14 bp, D. melanogaster
tgccttttatttat

SEQ ID NO: 655171 - DNA, 13 bp, D. melanogaster
tgccttttgcatt

SEQ ID NO: 655172 - DNA, 13 bp, D. melanogaster
tgccttttgccat

SEQ ID NO: 655173 - DNA, 13 bp, D. melanogaster
tgccttttgcctt

SEQ ID NO: 655174 - DNA, 13 bp, D. melanogaster
tgccttttggcca

SEQ ID NO: 655175 - DNA, 13 bp, D. melanogaster
tgcctttttggct

SEQ ID NO: 655176 - DNA, 13 bp, D. melanogaster
tgcgaaaaaaaat

SEQ ID NO: 655177 - DNA, 13 bp, D. melanogaster
tgcgaaaaaagaa

SEQ ID NO: 655178 - DNA, 14 bp, D. melanogaster
tgcgaaaaaataaa

SEQ ID NO: 655179 - DNA, 13 bp, D. melanogaster
tgcgaaaaacttt

SEQ ID NO: 655180 - DNA, 13 bp, D. melanogaster
tgcgaaaaataaa

SEQ ID NO: 655181 - DNA, 13 bp, D. melanogaster
tgcgaaaaatata

SEQ ID NO: 655182 - DNA, 13 bp, D. melanogaster
tgcgaaaaatcaa

SEQ ID NO: 655183 - DNA, 13 bp, D. melanogaster
tgcgaaaaatgat

SEQ ID NO: 655184 - DNA, 13 bp, D. melanogaster
tgcgaaaaattca

SEQ ID NO: 655185 - DNA, 13 bp, D. melanogaster
tgcgaaaacaatg

SEQ ID NO: 655186 - DNA, 13 bp, D. melanogaster
tgcgaaaacgaaa

SEQ ID NO: 655187 - DNA, 13 bp, D. melanogaster
tgcgaaaactttg

SEQ ID NO: 655188 - DNA, 13 bp, D. melanogaster
tgcgaaaagcgaa

SEQ ID NO: 655189 - DNA, 13 bp, D. melanogaster
tgcgaaaagtaaa

SEQ ID NO: 655190 - DNA, 13 bp, D. melanogaster
tgcgaaaagtttg

SEQ ID NO: 655191 - DNA, 13 bp, D. melanogaster
tgcgaaaagtttt

SEQ ID NO: 655192 - DNA, 13 bp, D. melanogaster
tgcgaaaatattt

SEQ ID NO: 655193 - DNA, 14 bp, D. melanogaster
tgcgaaaatattta

SEQ ID NO: 655194 - DNA, 13 bp, D. melanogaster
tgcgaaaatcagg

SEQ ID NO: 655195 - DNA, 13 bp, D. melanogaster
tgcgaaaatctgc

SEQ ID NO: 655196 - DNA, 13 bp, D. melanogaster
tgcgaaaatgtgt

SEQ ID NO: 655197 - DNA, 13 bp, D. melanogaster
tgcgaaaatgttg

SEQ ID NO: 655198 - DNA, 13 bp, D. melanogaster
tgcgaaaatgttt

SEQ ID NO: 655199 - DNA, 13 bp, D. melanogaster
tgcgaaaattaaa

SEQ ID NO: 655200 - DNA, 13 bp, D. melanogaster
tgcgaaaattcaa

SEQ ID NO: 655201 - DNA, 13 bp, D. melanogaster
tgcgaaaattgaa

SEQ ID NO: 655202 - DNA, 13 bp, D. melanogaster
tgcgaaaattgac

SEQ ID NO: 655203 - DNA, 13 bp, D. melanogaster
tgcgaaaattgca

SEQ ID NO: 655204 - DNA, 13 bp, D. melanogaster
tgcgaaaattgtt

SEQ ID NO: 655205 - DNA, 13 bp, D. melanogaster
tgcgaaacaataa

SEQ ID NO: 655206 - DNA, 13 bp, D. melanogaster
tgcgaaagagatg

SEQ ID NO: 655207 - DNA, 14 bp, D. melanogaster
tgcgaaagagatgg

SEQ ID NO: 655208 - DNA, 13 bp, D. melanogaster
tgcgaaagcgaaa

SEQ ID NO: 655209 - DNA, 13 bp, D. melanogaster
tgcgaaataaaat

SEQ ID NO: 655210 - DNA, 13 bp, D. melanogaster
tgcgaaataattg

SEQ ID NO: 655211 - DNA, 13 bp, D. melanogaster
tgcgaaatatttt

SEQ ID NO: 655212 - DNA, 13 bp, D. melanogaster
tgcgaaatcaaaa

SEQ ID NO: 655213 - DNA, 13 bp, D. melanogaster
tgcgaaatgaaaa

SEQ ID NO: 655214 - DNA, 13 bp, D. melanogaster
tgcgaaatgaaat

SEQ ID NO: 655215 - DNA, 13 bp, D. melanogaster
tgcgaaatgagtt

SEQ ID NO: 655216 - DNA, 13 bp, D. melanogaster
tgcgaaatgattt

SEQ ID NO: 655217 - DNA, 14 bp, D. melanogaster
tgcgaaatgcgaaa

SEQ ID NO: 655218 - DNA, 13 bp, D. melanogaster
tgcgaaatggaaa

SEQ ID NO: 655219 - DNA, 13 bp, D. melanogaster
tgcgaaatgtgca

SEQ ID NO: 655220 - DNA, 13 bp, D. melanogaster
tgcgaaatgtttt

SEQ ID NO: 655221 - DNA, 13 bp, D. melanogaster
tgcgaaattgaaa

SEQ ID NO: 655222 - DNA, 13 bp, D. melanogaster
tgcgaaattggaa

SEQ ID NO: 655223 - DNA, 13 bp, D. melanogaster
tgcgaaatttaaa

SEQ ID NO: 655224 - DNA, 13 bp, D. melanogaster
tgcgaacattttt

SEQ ID NO: 655225 - DNA, 13 bp, D. melanogaster
tgcgaacgagatg

SEQ ID NO: 655226 - DNA, 13 bp, D. melanogaster
tgcgaacgcgaaa

SEQ ID NO: 655227 - DNA, 14 bp, D. melanogaster
tgcgaacgcgaaat

SEQ ID NO: 655228 - DNA, 13 bp, D. melanogaster
tgcgaagtaaagc

SEQ ID NO: 655229 - DNA, 13 bp, D. melanogaster
tgcgaagtaatca

SEQ ID NO: 655230 - DNA, 13 bp, D. melanogaster
tgcgaagttacaa

SEQ ID NO: 655231 - DNA, 13 bp, D. melanogaster
tgcgaatcaatgc

SEQ ID NO: 655232 - DNA, 13 bp, D. melanogaster
tgcgaatgaaaag

SEQ ID NO: 655233 - DNA, 13 bp, D. melanogaster
tgcgaatgcaaat

SEQ ID NO: 655234 - DNA, 14 bp, D. melanogaster
tgcgaatgcaaatg

SEQ ID NO: 655235 - DNA, 13 bp, D. melanogaster
tgcgaatgcattt

SEQ ID NO: 655236 - DNA, 13 bp, D. melanogaster
tgcgaatgcgaaa

SEQ ID NO: 655237 - DNA, 14 bp, D. melanogaster
tgcgaatgcgaatg

SEQ ID NO: 655238 - DNA, 14 bp, D. melanogaster
tgcgaatgcgagtg

SEQ ID NO: 655239 - DNA, 13 bp, D. melanogaster
tgcgaatgcgatt

SEQ ID NO: 655240 - DNA, 13 bp, D. melanogaster
tgcgaatgcggat

SEQ ID NO: 655241 - DNA, 13 bp, D. melanogaster
tgcgaatggaaat

SEQ ID NO: 655242 - DNA, 13 bp, D. melanogaster
tgcgaatgggaat

SEQ ID NO: 655243 - DNA, 13 bp, D. melanogaster
tgcgaattcaaaa

SEQ ID NO: 655244 - DNA, 14 bp, D. melanogaster
tgcgaattcaaaag

SEQ ID NO: 655245 - DNA, 13 bp, D. melanogaster
tgcgaattcaatt

SEQ ID NO: 655246 - DNA, 13 bp, D. melanogaster
tgcgaattgattt

SEQ ID NO: 655247 - DNA, 13 bp, D. melanogaster
tgcgaattgtttt

SEQ ID NO: 655248 - DNA, 13 bp, D. melanogaster
tgcgaatttattt

SEQ ID NO: 655249 - DNA, 13 bp, D. melanogaster
tgcgaatttgttt

SEQ ID NO: 655250 - DNA, 13 bp, D. melanogaster
tgcgacaacaaca

SEQ ID NO: 655251 - DNA, 13 bp, D. melanogaster
tgcgacaataaat

SEQ ID NO: 655252 - DNA, 13 bp, D. melanogaster
tgcgacgagaact

SEQ ID NO: 655253 - DNA, 13 bp, D. melanogaster
tgcgactgcaact

SEQ ID NO: 655254 - DNA, 14 bp, D. melanogaster
tgcgactgcaactg

SEQ ID NO: 655255 - DNA, 14 bp, D. melanogaster
tgcgactgcgactg

SEQ ID NO: 655256 - DNA, 13 bp, D. melanogaster
tgcgactgcgatt

SEQ ID NO: 655257 - DNA, 14 bp, D. melanogaster
tgcgactgctgctg

SEQ ID NO: 655258 - DNA, 13 bp, D. melanogaster
tgcgactggcaac

SEQ ID NO: 655259 - DNA, 13 bp, D. melanogaster
tgcgactgggact

SEQ ID NO: 655260 - DNA, 13 bp, D. melanogaster
tgcgactttttaa

SEQ ID NO: 655261 - DNA, 13 bp, D. melanogaster
tgcgagaaaaaaa

SEQ ID NO: 655262 - DNA, 13 bp, D. melanogaster
tgcgagaaaaaat

SEQ ID NO: 655263 - DNA, 13 bp, D. melanogaster
tgcgagaaagaga

SEQ ID NO: 655264 - DNA, 13 bp, D. melanogaster
tgcgagagagaga

SEQ ID NO: 655265 - DNA, 14 bp, D. melanogaster
tgcgagagagagag

SEQ ID NO: 655266 - DNA, 13 bp, D. melanogaster
tgcgagcaggcca

SEQ ID NO: 655267 - DNA, 13 bp, D. melanogaster
tgcgagcgagagg

SEQ ID NO: 655268 - DNA, 13 bp, D. melanogaster
tgcgagcggcctt

SEQ ID NO: 655269 - DNA, 13 bp, D. melanogaster
tgcgagcgggatg

SEQ ID NO: 655270 - DNA, 13 bp, D. melanogaster
tgcgagtacgagt

SEQ ID NO: 655271 - DNA, 13 bp, D. melanogaster
tgcgagtatgtgt

SEQ ID NO: 655272 - DNA, 13 bp, D. melanogaster
tgcgagtcctgcg

SEQ ID NO: 655273 - DNA, 13 bp, D. melanogaster
tgcgagtgagtga

SEQ ID NO: 655274 - DNA, 13 bp, D. melanogaster
tgcgagtgccgcc

SEQ ID NO: 655275 - DNA, 14 bp, D. melanogaster
tgcgagtgccgcct

SEQ ID NO: 655276 - DNA, 13 bp, D. melanogaster
tgcgagtgcgagt

SEQ ID NO: 655277 - DNA, 14 bp, D. melanogaster
tgcgagtgcgagtg

SEQ ID NO: 655278 - DNA, 13 bp, D. melanogaster
tgcgagtggcaaa

SEQ ID NO: 655279 - DNA, 13 bp, D. melanogaster
tgcgagtgggtgg

SEQ ID NO: 655280 - DNA, 14 bp, D. melanogaster
tgcgagtgtgagtg

SEQ ID NO: 655281 - DNA, 13 bp, D. melanogaster
tgcgagtgtgtgc

SEQ ID NO: 655282 - DNA, 14 bp, D. melanogaster
tgcgagtgtgtgcg

SEQ ID NO: 655283 - DNA, 14 bp, D. melanogaster
tgcgagtgtgtttg

SEQ ID NO: 655284 - DNA, 13 bp, D. melanogaster
tgcgagtttccct

SEQ ID NO: 655285 - DNA, 13 bp, D. melanogaster
tgcgataaatatt

SEQ ID NO: 655286 - DNA, 13 bp, D. melanogaster
tgcgataaatttg

SEQ ID NO: 655287 - DNA, 13 bp, D. melanogaster
tgcgataagataa

SEQ ID NO: 655288 - DNA, 13 bp, D. melanogaster
tgcgataagcaaa

SEQ ID NO: 655289 - DNA, 13 bp, D. melanogaster
tgcgatacaagca

SEQ ID NO: 655290 - DNA, 13 bp, D. melanogaster
tgcgatagttttt

SEQ ID NO: 655291 - DNA, 13 bp, D. melanogaster
tgcgatctgcctc

SEQ ID NO: 655292 - DNA, 13 bp, D. melanogaster
tgcgatctgcgat

SEQ ID NO: 655293 - DNA, 13 bp, D. melanogaster
tgcgatcttcgtc

SEQ ID NO: 655294 - DNA, 13 bp, D. melanogaster
tgcgatgatgatg

SEQ ID NO: 655295 - DNA, 13 bp, D. melanogaster
tgcgatgcgatgc

SEQ ID NO: 655296 - DNA, 13 bp, D. melanogaster
tgcgattattatg

SEQ ID NO: 655297 - DNA, 13 bp, D. melanogaster
tgcgattccgatt

SEQ ID NO: 655298 - DNA, 13 bp, D. melanogaster
tgcgattcgattc

SEQ ID NO: 655299 - DNA, 13 bp, D. melanogaster
tgcgattgcaaat

SEQ ID NO: 655300 - DNA, 13 bp, D. melanogaster
tgcgattgcaatt

SEQ ID NO: 655301 - DNA, 13 bp, D. melanogaster
tgcgattgcgatt

SEQ ID NO: 655302 - DNA, 14 bp, D. melanogaster
tgcgattgcgattg

SEQ ID NO: 655303 - DNA, 13 bp, D. melanogaster
tgcgattgtattt

SEQ ID NO: 655304 - DNA, 14 bp, D. melanogaster
tgcgattgtgtgtg

SEQ ID NO: 655305 - DNA, 14 bp, D. melanogaster
tgcgattgtttaaa

SEQ ID NO: 655306 - DNA, 13 bp, D. melanogaster
tgcgattgttttc

SEQ ID NO: 655307 - DNA, 13 bp, D. melanogaster
tgcgatttaaaaa

SEQ ID NO: 655308 - DNA, 14 bp, D. melanogaster
tgcgatttaaaaaa

SEQ ID NO: 655309 - DNA, 13 bp, D. melanogaster
tgcgatttaacaa

SEQ ID NO: 655310 - DNA, 13 bp, D. melanogaster
tgcgatttaatta

SEQ ID NO: 655311 - DNA, 13 bp, D. melanogaster
tgcgatttcaatg

SEQ ID NO: 655312 - DNA, 13 bp, D. melanogaster
tgcgatttgattt

SEQ ID NO: 655313 - DNA, 13 bp, D. melanogaster
tgcgattttatat

SEQ ID NO: 655314 - DNA, 13 bp, D. melanogaster
tgcgattttcctc

SEQ ID NO: 655315 - DNA, 13 bp, D. melanogaster
tgcgatttttcat

SEQ ID NO: 655316 - DNA, 13 bp, D. melanogaster
tgcgatttttggc

SEQ ID NO: 655317 - DNA, 13 bp, D. melanogaster
tgcgcaaaataat

SEQ ID NO: 655318 - DNA, 13 bp, D. melanogaster
tgcgcaaacacac

SEQ ID NO: 655319 - DNA, 14 bp, D. melanogaster
tgcgcaaacacacg

SEQ ID NO: 655320 - DNA, 13 bp, D. melanogaster
tgcgcaaatgttt

SEQ ID NO: 655321 - DNA, 13 bp, D. melanogaster
tgcgcaaattgaa

SEQ ID NO: 655322 - DNA, 13 bp, D. melanogaster
tgcgcaaattgca

SEQ ID NO: 655323 - DNA, 13 bp, D. melanogaster
tgcgcaacaacaa

SEQ ID NO: 655324 - DNA, 13 bp, D. melanogaster
tgcgcaacatttt

SEQ ID NO: 655325 - DNA, 13 bp, D. melanogaster
tgcgcaagtgggt

SEQ ID NO: 655326 - DNA, 13 bp, D. melanogaster
tgcgcaatccact

SEQ ID NO: 655327 - DNA, 15 bp, D. melanogaster
tgcgcaatcgaagct

SEQ ID NO: 655328 - DNA, 13 bp, D. melanogaster
tgcgcaatttatg

SEQ ID NO: 655329 - DNA, 13 bp, D. melanogaster
tgcgcacacaaaa

SEQ ID NO: 655330 - DNA, 13 bp, D. melanogaster
tgcgcacagtggg

SEQ ID NO: 655331 - DNA, 13 bp, D. melanogaster
tgcgcacattttt

SEQ ID NO: 655332 - DNA, 13 bp, D. melanogaster
tgcgcagcattcg

SEQ ID NO: 655333 - DNA, 13 bp, D. melanogaster
tgcgcaggcgcag

SEQ ID NO: 655334 - DNA, 13 bp, D. melanogaster
tgcgcaggtgaaa

SEQ ID NO: 655335 - DNA, 13 bp, D. melanogaster
tgcgcataaaaaa

SEQ ID NO: 655336 - DNA, 13 bp, D. melanogaster
tgcgcataaatat

SEQ ID NO: 655337 - DNA, 13 bp, D. melanogaster
tgcgcataaatta

SEQ ID NO: 655338 - DNA, 13 bp, D. melanogaster
tgcgcataaattt

SEQ ID NO: 655339 - DNA, 14 bp, D. melanogaster
tgcgcataaatttc

SEQ ID NO: 655340 - DNA, 13 bp, D. melanogaster
tgcgcatacgaca

SEQ ID NO: 655341 - DNA, 13 bp, D. melanogaster
tgcgcatacgcac

SEQ ID NO: 655342 - DNA, 13 bp, D. melanogaster
tgcgcatgcgcaa

SEQ ID NO: 655343 - DNA, 14 bp, D. melanogaster
tgcgcatgcgcaaa

SEQ ID NO: 655344 - DNA, 13 bp, D. melanogaster
tgcgcatgcgcac

SEQ ID NO: 655345 - DNA, 13 bp, D. melanogaster
tgcgcatgcgcag

SEQ ID NO: 655346 - DNA, 13 bp, D. melanogaster
tgcgcatgcgccg

SEQ ID NO: 655347 - DNA, 13 bp, D. melanogaster
tgcgcatgcgcgc

SEQ ID NO: 655348 - DNA, 13 bp, D. melanogaster
tgcgcattcagtt

SEQ ID NO: 655349 - DNA, 13 bp, D. melanogaster
tgcgcatttcaaa

SEQ ID NO: 655350 - DNA, 14 bp, D. melanogaster
tgcgcatttttaat

SEQ ID NO: 655351 - DNA, 13 bp, D. melanogaster
tgcgccaagacct

SEQ ID NO: 655352 - DNA, 13 bp, D. melanogaster
tgcgccaagtcat

SEQ ID NO: 655353 - DNA, 14 bp, D. melanogaster
tgcgccaagtcatc

SEQ ID NO: 655354 - DNA, 13 bp, D. melanogaster
tgcgccacgcccc

SEQ ID NO: 655355 - DNA, 13 bp, D. melanogaster
tgcgccagacacg

SEQ ID NO: 655356 - DNA, 15 bp, D. melanogaster
tgcgccagtaaaatt

SEQ ID NO: 655357 - DNA, 13 bp, D. melanogaster
tgcgccgcatgca

SEQ ID NO: 655358 - DNA, 13 bp, D. melanogaster
tgcgcctgcgcag

SEQ ID NO: 655359 - DNA, 14 bp, D. melanogaster
tgcgcctgtgtgcg

SEQ ID NO: 655360 - DNA, 13 bp, D. melanogaster
tgcgctccttttc

SEQ ID NO: 655361 - DNA, 13 bp, D. melanogaster
tgcgctcgaaaaa

SEQ ID NO: 655362 - DNA, 13 bp, D. melanogaster
tgcgctctcgctc

SEQ ID NO: 655363 - DNA, 13 bp, D. melanogaster
tgcgctcttcgtc

SEQ ID NO: 655364 - DNA, 13 bp, D. melanogaster
tgcgctctttatt

SEQ ID NO: 655365 - DNA, 13 bp, D. melanogaster
tgcgctgcaatcg

SEQ ID NO: 655366 - DNA, 14 bp, D. melanogaster
tgcgctgcagtttt

SEQ ID NO: 655367 - DNA, 14 bp, D. melanogaster
tgcgctgctgctgc

SEQ ID NO: 655368 - DNA, 13 bp, D. melanogaster
tgcgcttcatttg

SEQ ID NO: 655369 - DNA, 13 bp, D. melanogaster
tgcgcttttattt

SEQ ID NO: 655370 - DNA, 13 bp, D. melanogaster
tgcggaaaatgaa

SEQ ID NO: 655371 - DNA, 13 bp, D. melanogaster
tgcggaaaatgga

SEQ ID NO: 655372 - DNA, 13 bp, D. melanogaster
tgcggaaacggaa

SEQ ID NO: 655373 - DNA, 14 bp, D. melanogaster
tgcggaaacggaaa

SEQ ID NO: 655374 - DNA, 13 bp, D. melanogaster
tgcggaaatattt

SEQ ID NO: 655375 - DNA, 13 bp, D. melanogaster
tgcggaatatttt

SEQ ID NO: 655376 - DNA, 13 bp, D. melanogaster
tgcggagcggtac

SEQ ID NO: 655377 - DNA, 14 bp, D. melanogaster
tgcggatgaggatg

SEQ ID NO: 655378 - DNA, 13 bp, D. melanogaster
tgcggatgcagat

SEQ ID NO: 655379 - DNA, 13 bp, D. melanogaster
tgcggatgcgaat

SEQ ID NO: 655380 - DNA, 14 bp, D. melanogaster
tgcggatgcgaatg

SEQ ID NO: 655381 - DNA, 13 bp, D. melanogaster
tgcggatgcggat

SEQ ID NO: 655382 - DNA, 14 bp, D. melanogaster
tgcggatgcggatg

SEQ ID NO: 655383 - DNA, 13 bp, D. melanogaster
tgcggatggccag

SEQ ID NO: 655384 - DNA, 14 bp, D. melanogaster
tgcggatgtggatg

SEQ ID NO: 655385 - DNA, 13 bp, D. melanogaster
tgcggattcggat

SEQ ID NO: 655386 - DNA, 13 bp, D. melanogaster
tgcggcaaaatgt

SEQ ID NO: 655387 - DNA, 13 bp, D. melanogaster
tgcggcaaataaa

SEQ ID NO: 655388 - DNA, 13 bp, D. melanogaster
tgcggcaacaaca

SEQ ID NO: 655389 - DNA, 13 bp, D. melanogaster
tgcggcaacacaa

SEQ ID NO: 655390 - DNA, 13 bp, D. melanogaster
tgcggcaataaaa

SEQ ID NO: 655391 - DNA, 14 bp, D. melanogaster
tgcggcaattaaaa

SEQ ID NO: 655392 - DNA, 13 bp, D. melanogaster
tgcggcaatttat

SEQ ID NO: 655393 - DNA, 13 bp, D. melanogaster
tgcggcagaggca

SEQ ID NO: 655394 - DNA, 13 bp, D. melanogaster
tgcggcagcagca

SEQ ID NO: 655395 - DNA, 13 bp, D. melanogaster
tgcggcagctgtt

SEQ ID NO: 655396 - DNA, 13 bp, D. melanogaster
tgcggcatgcaac

SEQ ID NO: 655397 - DNA, 13 bp, D. melanogaster
tgcggcatgtgtg

SEQ ID NO: 655398 - DNA, 13 bp, D. melanogaster
tgcggccataaat

SEQ ID NO: 655399 - DNA, 13 bp, D. melanogaster
tgcggcgggcttc

SEQ ID NO: 655400 - DNA, 13 bp, D. melanogaster
tgcggctcattaa

SEQ ID NO: 655401 - DNA, 13 bp, D. melanogaster
tgcggctcctcca

SEQ ID NO: 655402 - DNA, 14 bp, D. melanogaster
tgcggctcttctac

SEQ ID NO: 655403 - DNA, 13 bp, D. melanogaster
tgcggctgatgaa

SEQ ID NO: 655404 - DNA, 13 bp, D. melanogaster
tgcggctgccaca

SEQ ID NO: 655405 - DNA, 13 bp, D. melanogaster
tgcggctgcctac

SEQ ID NO: 655406 - DNA, 13 bp, D. melanogaster
tgcggctgccttt

SEQ ID NO: 655407 - DNA, 13 bp, D. melanogaster
tgcggctgcggct

SEQ ID NO: 655408 - DNA, 13 bp, D. melanogaster
tgcggctgctgct

SEQ ID NO: 655409 - DNA, 13 bp, D. melanogaster
tgcggctgctgtg

SEQ ID NO: 655410 - DNA, 13 bp, D. melanogaster
tgcggctgctgtt

SEQ ID NO: 655411 - DNA, 13 bp, D. melanogaster
tgcggctgtgtgc

SEQ ID NO: 655412 - DNA, 13 bp, D. melanogaster
tgcggcttttcaa

SEQ ID NO: 655413 - DNA, 14 bp, D. melanogaster
tgcgggggacatgt

SEQ ID NO: 655414 - DNA, 13 bp, D. melanogaster
tgcgggtgctact

SEQ ID NO: 655415 - DNA, 13 bp, D. melanogaster
tgcggtcaaaata

SEQ ID NO: 655416 - DNA, 13 bp, D. melanogaster
tgcggtgcggtgc

SEQ ID NO: 655417 - DNA, 14 bp, D. melanogaster
tgcggttaaaataa

SEQ ID NO: 655418 - DNA, 13 bp, D. melanogaster
tgcggttgactgt

SEQ ID NO: 655419 - DNA, 13 bp, D. melanogaster
tgcggttgcagtg

SEQ ID NO: 655420 - DNA, 13 bp, D. melanogaster
tgcggttgctttg

SEQ ID NO: 655421 - DNA, 13 bp, D. melanogaster
tgcggtttccgct

SEQ ID NO: 655422 - DNA, 13 bp, D. melanogaster
tgcgtaatgaaaa

SEQ ID NO: 655423 - DNA, 13 bp, D. melanogaster
tgcgtaatttatt

SEQ ID NO: 655424 - DNA, 13 bp, D. melanogaster
tgcgtacatatgt

SEQ ID NO: 655425 - DNA, 14 bp, D. melanogaster
tgcgtatacgcaat

SEQ ID NO: 655426 - DNA, 13 bp, D. melanogaster
tgcgtatacgcca

SEQ ID NO: 655427 - DNA, 14 bp, D. melanogaster
tgcgtatacgccac

SEQ ID NO: 655428 - DNA, 14 bp, D. melanogaster
tgcgtatacgtaat

SEQ ID NO: 655429 - DNA, 14 bp, D. melanogaster
tgcgtatacgtgat

SEQ ID NO: 655430 - DNA, 14 bp, D. melanogaster
tgcgtatacttaat

SEQ ID NO: 655431 - DNA, 14 bp, D. melanogaster
tgcgtatacttgat

SEQ ID NO: 655432 - DNA, 13 bp, D. melanogaster
tgcgtatctgtgt

SEQ ID NO: 655433 - DNA, 14 bp, D. melanogaster
tgcgtatgagcaat

SEQ ID NO: 655434 - DNA, 13 bp, D. melanogaster
tgcgtatgagtga

SEQ ID NO: 655435 - DNA, 13 bp, D. melanogaster
tgcgtatgagtta

SEQ ID NO: 655436 - DNA, 14 bp, D. melanogaster
tgcgtatgattgat

SEQ ID NO: 655437 - DNA, 13 bp, D. melanogaster
tgcgtatgcgcaa

SEQ ID NO: 655438 - DNA, 13 bp, D. melanogaster
tgcgtatgcgtaa

SEQ ID NO: 655439 - DNA, 13 bp, D. melanogaster
tgcgtatgcgtga

SEQ ID NO: 655440 - DNA, 13 bp, D. melanogaster
tgcgtatgcttga

SEQ ID NO: 655441 - DNA, 13 bp, D. melanogaster
tgcgtatgtgtgc

SEQ ID NO: 655442 - DNA, 13 bp, D. melanogaster
tgcgtatgtgtgt

SEQ ID NO: 655443 - DNA, 14 bp, D. melanogaster
tgcgtatgtgtgtg

SEQ ID NO: 655444 - DNA, 13 bp, D. melanogaster
tgcgtcagctgga

SEQ ID NO: 655445 - DNA, 13 bp, D. melanogaster
tgcgtcgttgaat

SEQ ID NO: 655446 - DNA, 13 bp, D. melanogaster
tgcgtctatgtct

SEQ ID NO: 655447 - DNA, 13 bp, D. melanogaster
tgcgtctgtgtct

SEQ ID NO: 655448 - DNA, 13 bp, D. melanogaster
tgcgtctgtgtgc

SEQ ID NO: 655449 - DNA, 14 bp, D. melanogaster
tgcgtctgtgtgcg

SEQ ID NO: 655450 - DNA, 13 bp, D. melanogaster
tgcgtctgtgtgg

SEQ ID NO: 655451 - DNA, 13 bp, D. melanogaster
tgcgtctgtgttt

SEQ ID NO: 655452 - DNA, 14 bp, D. melanogaster
tgcgtgaaatcgct

SEQ ID NO: 655453 - DNA, 13 bp, D. melanogaster
tgcgtgaaattcg

SEQ ID NO: 655454 - DNA, 13 bp, D. melanogaster
tgcgtgagctgtg

SEQ ID NO: 655455 - DNA, 13 bp, D. melanogaster
tgcgtgagtgtgt

SEQ ID NO: 655456 - DNA, 14 bp, D. melanogaster
tgcgtgagtgtgtg

SEQ ID NO: 655457 - DNA, 13 bp, D. melanogaster
tgcgtgcgtgcgt

SEQ ID NO: 655458 - DNA, 13 bp, D. melanogaster
tgcgtgcgtgtgt

SEQ ID NO: 655459 - DNA, 14 bp, D. melanogaster
tgcgtgcgtgtgtg

SEQ ID NO: 655460 - DNA, 13 bp, D. melanogaster
tgcgtgcgttcga

SEQ ID NO: 655461 - DNA, 13 bp, D. melanogaster
tgcgtggaaaatg

SEQ ID NO: 655462 - DNA, 14 bp, D. melanogaster
tgcgtgggcgtggc

SEQ ID NO: 655463 - DNA, 13 bp, D. melanogaster
tgcgtgtatctgt

SEQ ID NO: 655464 - DNA, 14 bp, D. melanogaster
tgcgtgtatgtgtg

SEQ ID NO: 655465 - DNA, 14 bp, D. melanogaster
tgcgtgtgagtgtg

SEQ ID NO: 655466 - DNA, 13 bp, D. melanogaster
tgcgtgtgcgtgc

SEQ ID NO: 655467 - DNA, 15 bp, D. melanogaster
tgcgtgtgcgtgtgc

SEQ ID NO: 655468 - DNA, 13 bp, D. melanogaster
tgcgtgtgcgttt

SEQ ID NO: 655469 - DNA, 13 bp, D. melanogaster
tgcgtgtgtattt

SEQ ID NO: 655470 - DNA, 13 bp, D. melanogaster
tgcgtgtgtgcca

SEQ ID NO: 655471 - DNA, 14 bp, D. melanogaster
tgcgtgtgtgcgag

SEQ ID NO: 655472 - DNA, 13 bp, D. melanogaster
tgcgtgtgtgcgc

SEQ ID NO: 655473 - DNA, 13 bp, D. melanogaster
tgcgtgtgtgctt

SEQ ID NO: 655474 - DNA, 13 bp, D. melanogaster
tgcgtgtgtgtaa

SEQ ID NO: 655475 - DNA, 14 bp, D. melanogaster
tgcgtgtgtgtctg

SEQ ID NO: 655476 - DNA, 13 bp, D. melanogaster
tgcgtgtgtgtgc

SEQ ID NO: 655477 - DNA, 14 bp, D. melanogaster
tgcgtgtgtgtgca

SEQ ID NO: 655478 - DNA, 14 bp, D. melanogaster
tgcgtgtgtgtgta

SEQ ID NO: 655479 - DNA, 13 bp, D. melanogaster
tgcgtgtgtttgc

SEQ ID NO: 655480 - DNA, 13 bp, D. melanogaster
tgcgtgttgtgct

SEQ ID NO: 655481 - DNA, 14 bp, D. melanogaster
tgcgttaagcactt

SEQ ID NO: 655482 - DNA, 13 bp, D. melanogaster
tgcgttatttgtt

SEQ ID NO: 655483 - DNA, 14 bp, D. melanogaster
tgcgttatttgttt

SEQ ID NO: 655484 - DNA, 13 bp, D. melanogaster
tgcgttcaatttg

SEQ ID NO: 655485 - DNA, 13 bp, D. melanogaster
tgcgttccacaga

SEQ ID NO: 655486 - DNA, 13 bp, D. melanogaster
tgcgttcgcattt

SEQ ID NO: 655487 - DNA, 13 bp, D. melanogaster
tgcgttgcagttt

SEQ ID NO: 655488 - DNA, 13 bp, D. melanogaster
tgcgttgcgttgc

SEQ ID NO: 655489 - DNA, 14 bp, D. melanogaster
tgcgttgcgttgcg

SEQ ID NO: 655490 - DNA, 13 bp, D. melanogaster
tgcgttggccaaa

SEQ ID NO: 655491 - DNA, 13 bp, D. melanogaster
tgcgttggccatg

SEQ ID NO: 655492 - DNA, 13 bp, D. melanogaster
tgcgttggcgttg

SEQ ID NO: 655493 - DNA, 13 bp, D. melanogaster
tgcgtttaattaa

SEQ ID NO: 655494 - DNA, 13 bp, D. melanogaster
tgcgtttatttca

SEQ ID NO: 655495 - DNA, 13 bp, D. melanogaster
tgcgtttcataaa

SEQ ID NO: 655496 - DNA, 13 bp, D. melanogaster
tgcgtttcatttc

SEQ ID NO: 655497 - DNA, 13 bp, D. melanogaster
tgcgtttcatttg

SEQ ID NO: 655498 - DNA, 13 bp, D. melanogaster
tgcgtttctgcat

SEQ ID NO: 655499 - DNA, 13 bp, D. melanogaster
tgcgtttgcaaat

SEQ ID NO: 655500 - DNA, 13 bp, D. melanogaster
tgcgtttgcattt

SEQ ID NO: 655501 - DNA, 13 bp, D. melanogaster
tgcgtttgccatt

SEQ ID NO: 655502 - DNA, 13 bp, D. melanogaster
tgcgtttgcgttt

SEQ ID NO: 655503 - DNA, 14 bp, D. melanogaster
tgcgtttgcgtttg

SEQ ID NO: 655504 - DNA, 13 bp, D. melanogaster
tgcgtttgtgcgg

SEQ ID NO: 655505 - DNA, 13 bp, D. melanogaster
tgcgttttaaatt

SEQ ID NO: 655506 - DNA, 13 bp, D. melanogaster
tgcgttttagttg

SEQ ID NO: 655507 - DNA, 13 bp, D. melanogaster
tgcgttttattat

SEQ ID NO: 655508 - DNA, 13 bp, D. melanogaster
tgcgttttcaatt

SEQ ID NO: 655509 - DNA, 13 bp, D. melanogaster
tgcgttttgcatt

SEQ ID NO: 655510 - DNA, 13 bp, D. melanogaster
tgcgttttggtct

SEQ ID NO: 655511 - DNA, 13 bp, D. melanogaster
tgcgttttttatg

SEQ ID NO: 655512 - DNA, 13 bp, D. melanogaster
tgctaaaaaatat

SEQ ID NO: 655513 - DNA, 13 bp, D. melanogaster
tgctaaaaagttt

SEQ ID NO: 655514 - DNA, 13 bp, D. melanogaster
tgctaaaaatatt

SEQ ID NO: 655515 - DNA, 13 bp, D. melanogaster
tgctaaaaatgcg

SEQ ID NO: 655516 - DNA, 13 bp, D. melanogaster
tgctaaaaattaa

SEQ ID NO: 655517 - DNA, 13 bp, D. melanogaster
tgctaaaaatttg

SEQ ID NO: 655518 - DNA, 13 bp, D. melanogaster
tgctaaaacagtt

SEQ ID NO: 655519 - DNA, 13 bp, D. melanogaster
tgctaaaactaaa

SEQ ID NO: 655520 - DNA, 13 bp, D. melanogaster
tgctaaaataaaa

SEQ ID NO: 655521 - DNA, 14 bp, D. melanogaster
tgctaaaataaaaa

SEQ ID NO: 655522 - DNA, 14 bp, D. melanogaster
tgctaaagtttctt

SEQ ID NO: 655523 - DNA, 13 bp, D. melanogaster
tgctaaataaatt

SEQ ID NO: 655524 - DNA, 14 bp, D. melanogaster
tgctaaatctgctg

SEQ ID NO: 655525 - DNA, 13 bp, D. melanogaster
tgctaaatgcaaa

SEQ ID NO: 655526 - DNA, 13 bp, D. melanogaster
tgctaaatgctaa

SEQ ID NO: 655527 - DNA, 13 bp, D. melanogaster
tgctaaatgtaca

SEQ ID NO: 655528 - DNA, 13 bp, D. melanogaster
tgctaaattaaaa

SEQ ID NO: 655529 - DNA, 13 bp, D. melanogaster
tgctaaattattt

SEQ ID NO: 655530 - DNA, 13 bp, D. melanogaster
tgctaaatttgtt

SEQ ID NO: 655531 - DNA, 13 bp, D. melanogaster
tgctaagcaaaca

SEQ ID NO: 655532 - DNA, 13 bp, D. melanogaster
tgctaagcaaata

SEQ ID NO: 655533 - DNA, 13 bp, D. melanogaster
tgctaagcaattt

SEQ ID NO: 655534 - DNA, 13 bp, D. melanogaster
tgctaagttagaa

SEQ ID NO: 655535 - DNA, 13 bp, D. melanogaster
tgctaataaacat

SEQ ID NO: 655536 - DNA, 13 bp, D. melanogaster
tgctaataataat

SEQ ID NO: 655537 - DNA, 13 bp, D. melanogaster
tgctaatcaaatt

SEQ ID NO: 655538 - DNA, 13 bp, D. melanogaster
tgctaatcgccat

SEQ ID NO: 655539 - DNA, 13 bp, D. melanogaster
tgctaatgcagca

SEQ ID NO: 655540 - DNA, 13 bp, D. melanogaster
tgctaatgctaat

SEQ ID NO: 655541 - DNA, 13 bp, D. melanogaster
tgctaatggaaaa

SEQ ID NO: 655542 - DNA, 13 bp, D. melanogaster
tgctaatggaaat

SEQ ID NO: 655543 - DNA, 13 bp, D. melanogaster
tgctaattaaatt

SEQ ID NO: 655544 - DNA, 13 bp, D. melanogaster
tgctaattaataa

SEQ ID NO: 655545 - DNA, 13 bp, D. melanogaster
tgctaattaattg

SEQ ID NO: 655546 - DNA, 13 bp, D. melanogaster
tgctaattaattt

SEQ ID NO: 655547 - DNA, 13 bp, D. melanogaster
tgctaattacatt

SEQ ID NO: 655548 - DNA, 13 bp, D. melanogaster
tgctaattatgat

SEQ ID NO: 655549 - DNA, 13 bp, D. melanogaster
tgctaattgaaat

SEQ ID NO: 655550 - DNA, 13 bp, D. melanogaster
tgctaattgccaa

SEQ ID NO: 655551 - DNA, 14 bp, D. melanogaster
tgctaatttaatta

SEQ ID NO: 655552 - DNA, 13 bp, D. melanogaster
tgctaatttatat

SEQ ID NO: 655553 - DNA, 13 bp, D. melanogaster
tgctaatttattt

SEQ ID NO: 655554 - DNA, 13 bp, D. melanogaster
tgctaatttcaat

SEQ ID NO: 655555 - DNA, 13 bp, D. melanogaster
tgctaatttcgtt

SEQ ID NO: 655556 - DNA, 13 bp, D. melanogaster
tgctaatttgcat

SEQ ID NO: 655557 - DNA, 13 bp, D. melanogaster
tgctaattttatt

SEQ ID NO: 655558 - DNA, 13 bp, D. melanogaster
tgctaattttgtt

SEQ ID NO: 655559 - DNA, 13 bp, D. melanogaster
tgctaatttttcg

SEQ ID NO: 655560 - DNA, 13 bp, D. melanogaster
tgctacaaaaata

SEQ ID NO: 655561 - DNA, 13 bp, D. melanogaster
tgctacaaaaatt

SEQ ID NO: 655562 - DNA, 13 bp, D. melanogaster
tgctacaaaacgt

SEQ ID NO: 655563 - DNA, 14 bp, D. melanogaster
tgctacaaaacgtc

SEQ ID NO: 655564 - DNA, 13 bp, D. melanogaster
tgctacaaaatta

SEQ ID NO: 655565 - DNA, 13 bp, D. melanogaster
tgctacaatatat

SEQ ID NO: 655566 - DNA, 13 bp, D. melanogaster
tgctacattttat

SEQ ID NO: 655567 - DNA, 13 bp, D. melanogaster
tgctacgcccaca

SEQ ID NO: 655568 - DNA, 13 bp, D. melanogaster
tgctactactgct

SEQ ID NO: 655569 - DNA, 13 bp, D. melanogaster
tgctactatatct

SEQ ID NO: 655570 - DNA, 13 bp, D. melanogaster
tgctactattata

SEQ ID NO: 655571 - DNA, 14 bp, D. melanogaster
tgctactccttcgg

SEQ ID NO: 655572 - DNA, 13 bp, D. melanogaster
tgctactgctact

SEQ ID NO: 655573 - DNA, 14 bp, D. melanogaster
tgctactgctactg

SEQ ID NO: 655574 - DNA, 13 bp, D. melanogaster
tgctactgctgct

SEQ ID NO: 655575 - DNA, 14 bp, D. melanogaster
tgctactgctgctg

SEQ ID NO: 655576 - DNA, 13 bp, D. melanogaster
tgctactgctgtt

SEQ ID NO: 655577 - DNA, 13 bp, D. melanogaster
tgctactgtgcag

SEQ ID NO: 655578 - DNA, 13 bp, D. melanogaster
tgctactgttgct

SEQ ID NO: 655579 - DNA, 13 bp, D. melanogaster
tgctagcagataa

SEQ ID NO: 655580 - DNA, 14 bp, D. melanogaster
tgctagcagataaa

SEQ ID NO: 655581 - DNA, 13 bp, D. melanogaster
tgctataaaaatt

SEQ ID NO: 655582 - DNA, 13 bp, D. melanogaster
tgctataacaaat

SEQ ID NO: 655583 - DNA, 13 bp, D. melanogaster
tgctataatttat

SEQ ID NO: 655584 - DNA, 14 bp, D. melanogaster
tgctatatatatat

SEQ ID NO: 655585 - DNA, 13 bp, D. melanogaster
tgctatatcttta

SEQ ID NO: 655586 - DNA, 13 bp, D. melanogaster
tgctatatggtat

SEQ ID NO: 655587 - DNA, 13 bp, D. melanogaster
tgctatgcatttt

SEQ ID NO: 655588 - DNA, 13 bp, D. melanogaster
tgctattaaaaaa

SEQ ID NO: 655589 - DNA, 13 bp, D. melanogaster
tgctattaaaata

SEQ ID NO: 655590 - DNA, 13 bp, D. melanogaster
tgctattaaaatt

SEQ ID NO: 655591 - DNA, 13 bp, D. melanogaster
tgctattaaagga

SEQ ID NO: 655592 - DNA, 13 bp, D. melanogaster
tgctattaaatat

SEQ ID NO: 655593 - DNA, 13 bp, D. melanogaster
tgctattattgtt

SEQ ID NO: 655594 - DNA, 14 bp, D. melanogaster
tgctattattgtta

SEQ ID NO: 655595 - DNA, 13 bp, D. melanogaster
tgctattattttg

SEQ ID NO: 655596 - DNA, 14 bp, D. melanogaster
tgctattattttga

SEQ ID NO: 655597 - DNA, 13 bp, D. melanogaster
tgctattgccatt

SEQ ID NO: 655598 - DNA, 13 bp, D. melanogaster
tgctattgctatt

SEQ ID NO: 655599 - DNA, 14 bp, D. melanogaster
tgctattgctgctg

SEQ ID NO: 655600 - DNA, 13 bp, D. melanogaster
tgctattgctgtt

SEQ ID NO: 655601 - DNA, 13 bp, D. melanogaster
tgctatttataaa

SEQ ID NO: 655602 - DNA, 14 bp, D. melanogaster
tgctatttattctt

SEQ ID NO: 655603 - DNA, 13 bp, D. melanogaster
tgctatttgctgt

SEQ ID NO: 655604 - DNA, 13 bp, D. melanogaster
tgctatttgttgc

SEQ ID NO: 655605 - DNA, 13 bp, D. melanogaster
tgctattttggtt

SEQ ID NO: 655606 - DNA, 13 bp, D. melanogaster
tgctatttttgct

SEQ ID NO: 655607 - DNA, 14 bp, D. melanogaster
tgctatttttgtta

SEQ ID NO: 655608 - DNA, 14 bp, D. melanogaster
tgctcaaaaaaaaa

SEQ ID NO: 655609 - DNA, 13 bp, D. melanogaster
tgctcaaaaacat

SEQ ID NO: 655610 - DNA, 13 bp, D. melanogaster
tgctcaaaataat

SEQ ID NO: 655611 - DNA, 13 bp, D. melanogaster
tgctcaaatactt

SEQ ID NO: 655612 - DNA, 13 bp, D. melanogaster
tgctcaaatatat

SEQ ID NO: 655613 - DNA, 13 bp, D. melanogaster
tgctcaaatattt

SEQ ID NO: 655614 - DNA, 14 bp, D. melanogaster
tgctcaaatattta

SEQ ID NO: 655615 - DNA, 13 bp, D. melanogaster
tgctcaaattatt

SEQ ID NO: 655616 - DNA, 13 bp, D. melanogaster
tgctcaaattttc

SEQ ID NO: 655617 - DNA, 13 bp, D. melanogaster
tgctcaacaaatg

SEQ ID NO: 655618 - DNA, 13 bp, D. melanogaster
tgctcaacagcgc

SEQ ID NO: 655619 - DNA, 13 bp, D. melanogaster
tgctcaacatttt

SEQ ID NO: 655620 - DNA, 13 bp, D. melanogaster
tgctcaagatatt

SEQ ID NO: 655621 - DNA, 14 bp, D. melanogaster
tgctcaagatattt

SEQ ID NO: 655622 - DNA, 13 bp, D. melanogaster
tgctcaagcgtac

SEQ ID NO: 655623 - DNA, 13 bp, D. melanogaster
tgctcaagtgtag

SEQ ID NO: 655624 - DNA, 15 bp, D. melanogaster
tgctcaagtgtagcg

SEQ ID NO: 655625 - DNA, 13 bp, D. melanogaster
tgctcaataaaaa

SEQ ID NO: 655626 - DNA, 13 bp, D. melanogaster
tgctcaatatttt

SEQ ID NO: 655627 - DNA, 13 bp, D. melanogaster
tgctcaatcagtt

SEQ ID NO: 655628 - DNA, 13 bp, D. melanogaster
tgctcaatttaaa

SEQ ID NO: 655629 - DNA, 13 bp, D. melanogaster
tgctcacacacac

SEQ ID NO: 655630 - DNA, 13 bp, D. melanogaster
tgctcacatgcaa

SEQ ID NO: 655631 - DNA, 13 bp, D. melanogaster
tgctcacgaaaag

SEQ ID NO: 655632 - DNA, 13 bp, D. melanogaster
tgctcactcactc

SEQ ID NO: 655633 - DNA, 13 bp, D. melanogaster
tgctcactttttg

SEQ ID NO: 655634 - DNA, 13 bp, D. melanogaster
tgctcagcattcc

SEQ ID NO: 655635 - DNA, 13 bp, D. melanogaster
tgctcatacgccc

SEQ ID NO: 655636 - DNA, 14 bp, D. melanogaster
tgctcatgcattgt

SEQ ID NO: 655637 - DNA, 13 bp, D. melanogaster
tgctcatgttgct

SEQ ID NO: 655638 - DNA, 13 bp, D. melanogaster
tgctcattcaatt

SEQ ID NO: 655639 - DNA, 13 bp, D. melanogaster
tgctcattgaact

SEQ ID NO: 655640 - DNA, 13 bp, D. melanogaster
tgctcattttatg

SEQ ID NO: 655641 - DNA, 13 bp, D. melanogaster
tgctccaaaaaaa

SEQ ID NO: 655642 - DNA, 13 bp, D. melanogaster
tgctccaaaagca

SEQ ID NO: 655643 - DNA, 13 bp, D. melanogaster
tgctccaatgatt

SEQ ID NO: 655644 - DNA, 13 bp, D. melanogaster
tgctccacataac

SEQ ID NO: 655645 - DNA, 13 bp, D. melanogaster
tgctccacatttc

SEQ ID NO: 655646 - DNA, 13 bp, D. melanogaster
tgctccacatttt

SEQ ID NO: 655647 - DNA, 13 bp, D. melanogaster
tgctccactgtgc

SEQ ID NO: 655648 - DNA, 13 bp, D. melanogaster
tgctccagccacc

SEQ ID NO: 655649 - DNA, 14 bp, D. melanogaster
tgctccagccaccg

SEQ ID NO: 655650 - DNA, 13 bp, D. melanogaster
tgctccagctgca

SEQ ID NO: 655651 - DNA, 13 bp, D. melanogaster
tgctccatgctcc

SEQ ID NO: 655652 - DNA, 14 bp, D. melanogaster
tgctccatgctcca

SEQ ID NO: 655653 - DNA, 13 bp, D. melanogaster
tgctccatttgca

SEQ ID NO: 655654 - DNA, 13 bp, D. melanogaster
tgctccctgctcc

SEQ ID NO: 655655 - DNA, 13 bp, D. melanogaster
tgctccctttttg

SEQ ID NO: 655656 - DNA, 13 bp, D. melanogaster
tgctccgccattc

SEQ ID NO: 655657 - DNA, 13 bp, D. melanogaster
tgctccggctgct

SEQ ID NO: 655658 - DNA, 13 bp, D. melanogaster
tgctcctccagct

SEQ ID NO: 655659 - DNA, 13 bp, D. melanogaster
tgctcctccattt

SEQ ID NO: 655660 - DNA, 13 bp, D. melanogaster
tgctcctcctcca

SEQ ID NO: 655661 - DNA, 14 bp, D. melanogaster
tgctcctcctcctg

SEQ ID NO: 655662 - DNA, 13 bp, D. melanogaster
tgctcctgatcct

SEQ ID NO: 655663 - DNA, 13 bp, D. melanogaster
tgctcctgcagct

SEQ ID NO: 655664 - DNA, 13 bp, D. melanogaster
tgctcctgctccg

SEQ ID NO: 655665 - DNA, 14 bp, D. melanogaster
tgctcctgctcctg

SEQ ID NO: 655666 - DNA, 15 bp, D. melanogaster
tgctcctgctcctgt

SEQ ID NO: 655667 - DNA, 13 bp, D. melanogaster
tgctcctgctgat

SEQ ID NO: 655668 - DNA, 15 bp, D. melanogaster
tgctcctgctgctgc

SEQ ID NO: 655669 - DNA, 16 bp, D. melanogaster
tgctcctgctgctgct

SEQ ID NO: 655670 - DNA, 13 bp, D. melanogaster
tgctcctgctgtt

SEQ ID NO: 655671 - DNA, 14 bp, D. melanogaster
tgctcctgctgttg

SEQ ID NO: 655672 - DNA, 13 bp, D. melanogaster
tgctcctgttcct

SEQ ID NO: 655673 - DNA, 14 bp, D. melanogaster
tgctcctgttcctg

SEQ ID NO: 655674 - DNA, 14 bp, D. melanogaster
tgctccttctgctg

SEQ ID NO: 655675 - DNA, 13 bp, D. melanogaster
tgctccttgctcc

SEQ ID NO: 655676 - DNA, 13 bp, D. melanogaster
tgctccttttgct

SEQ ID NO: 655677 - DNA, 13 bp, D. melanogaster
tgctcctttttta

SEQ ID NO: 655678 - DNA, 14 bp, D. melanogaster
tgctccttttttta

SEQ ID NO: 655679 - DNA, 13 bp, D. melanogaster
tgctcgaaacatc

SEQ ID NO: 655680 - DNA, 13 bp, D. melanogaster
tgctcgagcatat

SEQ ID NO: 655681 - DNA, 13 bp, D. melanogaster
tgctcgagtgctt

SEQ ID NO: 655682 - DNA, 13 bp, D. melanogaster
tgctcgctgaatg

SEQ ID NO: 655683 - DNA, 13 bp, D. melanogaster
tgctcgctttttg

SEQ ID NO: 655684 - DNA, 13 bp, D. melanogaster
tgctcggaaaatg

SEQ ID NO: 655685 - DNA, 13 bp, D. melanogaster
tgctcggctaaaa

SEQ ID NO: 655686 - DNA, 14 bp, D. melanogaster
tgctctaaaaagtc

SEQ ID NO: 655687 - DNA, 13 bp, D. melanogaster
tgctctactttat

SEQ ID NO: 655688 - DNA, 13 bp, D. melanogaster
tgctctactttta

SEQ ID NO: 655689 - DNA, 13 bp, D. melanogaster
tgctctcaaacaa

SEQ ID NO: 655690 - DNA, 14 bp, D. melanogaster
tgctctcaaacaag

SEQ ID NO: 655691 - DNA, 13 bp, D. melanogaster
tgctctcccgctc

SEQ ID NO: 655692 - DNA, 13 bp, D. melanogaster
tgctctctcgctc

SEQ ID NO: 655693 - DNA, 13 bp, D. melanogaster
tgctctctttccg

SEQ ID NO: 655694 - DNA, 13 bp, D. melanogaster
tgctctgctccgc

SEQ ID NO: 655695 - DNA, 13 bp, D. melanogaster
tgctctgctgttt

SEQ ID NO: 655696 - DNA, 13 bp, D. melanogaster
tgctctggaagct

SEQ ID NO: 655697 - DNA, 13 bp, D. melanogaster
tgctctgtgacca

SEQ ID NO: 655698 - DNA, 13 bp, D. melanogaster
tgctctgtttgaa

SEQ ID NO: 655699 - DNA, 13 bp, D. melanogaster
tgctcttcctaat

SEQ ID NO: 655700 - DNA, 13 bp, D. melanogaster
tgctcttgctgct

SEQ ID NO: 655701 - DNA, 14 bp, D. melanogaster
tgctcttgctgctg

SEQ ID NO: 655702 - DNA, 13 bp, D. melanogaster
tgctcttgctgtt

SEQ ID NO: 655703 - DNA, 14 bp, D. melanogaster
tgctcttgctgttg

SEQ ID NO: 655704 - DNA, 13 bp, D. melanogaster
tgctcttggccaa

SEQ ID NO: 655705 - DNA, 13 bp, D. melanogaster
tgctcttggccag

SEQ ID NO: 655706 - DNA, 13 bp, D. melanogaster
tgctctttatgtg

SEQ ID NO: 655707 - DNA, 14 bp, D. melanogaster
tgctctttgaataa

SEQ ID NO: 655708 - DNA, 13 bp, D. melanogaster
tgctctttgataa

SEQ ID NO: 655709 - DNA, 13 bp, D. melanogaster
tgctctttgatgg

SEQ ID NO: 655710 - DNA, 14 bp, D. melanogaster
tgctctttgatgga

SEQ ID NO: 655711 - DNA, 13 bp, D. melanogaster
tgctcttttcatt

SEQ ID NO: 655712 - DNA, 13 bp, D. melanogaster
tgctcttttggca

SEQ ID NO: 655713 - DNA, 13 bp, D. melanogaster
tgctcttttggct

SEQ ID NO: 655714 - DNA, 13 bp, D. melanogaster
tgctgaaaatgaa

SEQ ID NO: 655715 - DNA, 13 bp, D. melanogaster
tgctgaaaattaa

SEQ ID NO: 655716 - DNA, 13 bp, D. melanogaster
tgctgaaatattt

SEQ ID NO: 655717 - DNA, 13 bp, D. melanogaster
tgctgaaatcaaa

SEQ ID NO: 655718 - DNA, 13 bp, D. melanogaster
tgctgaaatgctg

SEQ ID NO: 655719 - DNA, 13 bp, D. melanogaster
tgctgaaattatt

SEQ ID NO: 655720 - DNA, 13 bp, D. melanogaster
tgctgaaattgct

SEQ ID NO: 655721 - DNA, 13 bp, D. melanogaster
tgctgaaattgtt

SEQ ID NO: 655722 - DNA, 13 bp, D. melanogaster
tgctgaagaacga

SEQ ID NO: 655723 - DNA, 13 bp, D. melanogaster
tgctgaagcggag

SEQ ID NO: 655724 - DNA, 13 bp, D. melanogaster
tgctgaagtctgg

SEQ ID NO: 655725 - DNA, 13 bp, D. melanogaster
tgctgaataaaat

SEQ ID NO: 655726 - DNA, 13 bp, D. melanogaster
tgctgaatattta

SEQ ID NO: 655727 - DNA, 13 bp, D. melanogaster
tgctgaatatttg

SEQ ID NO: 655728 - DNA, 13 bp, D. melanogaster
tgctgaatctcaa

SEQ ID NO: 655729 - DNA, 14 bp, D. melanogaster
tgctgaatgaaatt

SEQ ID NO: 655730 - DNA, 13 bp, D. melanogaster
tgctgaattattt

SEQ ID NO: 655731 - DNA, 13 bp, D. melanogaster
tgctgaatttatg

SEQ ID NO: 655732 - DNA, 13 bp, D. melanogaster
tgctgaattttac

SEQ ID NO: 655733 - DNA, 13 bp, D. melanogaster
tgctgacattaca

SEQ ID NO: 655734 - DNA, 13 bp, D. melanogaster
tgctgacttagct

SEQ ID NO: 655735 - DNA, 14 bp, D. melanogaster
tgctgactttagat

SEQ ID NO: 655736 - DNA, 13 bp, D. melanogaster
tgctgagcaaaca

SEQ ID NO: 655737 - DNA, 13 bp, D. melanogaster
tgctgagcatgca

SEQ ID NO: 655738 - DNA, 13 bp, D. melanogaster
tgctgagctgctg

SEQ ID NO: 655739 - DNA, 13 bp, D. melanogaster
tgctgataaaaag

SEQ ID NO: 655740 - DNA, 13 bp, D. melanogaster
tgctgataagaaa

SEQ ID NO: 655741 - DNA, 13 bp, D. melanogaster
tgctgatattttt

SEQ ID NO: 655742 - DNA, 14 bp, D. melanogaster
tgctgatgacgatg

SEQ ID NO: 655743 - DNA, 13 bp, D. melanogaster
tgctgatgatgac

SEQ ID NO: 655744 - DNA, 13 bp, D. melanogaster
tgctgatgatgat

SEQ ID NO: 655745 - DNA, 14 bp, D. melanogaster
tgctgatgatgatg

SEQ ID NO: 655746 - DNA, 13 bp, D. melanogaster
tgctgatgatgct

SEQ ID NO: 655747 - DNA, 14 bp, D. melanogaster
tgctgatgatgctg

SEQ ID NO: 655748 - DNA, 13 bp, D. melanogaster
tgctgatgcagtt

SEQ ID NO: 655749 - DNA, 13 bp, D. melanogaster
tgctgatgctctc

SEQ ID NO: 655750 - DNA, 13 bp, D. melanogaster
tgctgatgctgat

SEQ ID NO: 655751 - DNA, 13 bp, D. melanogaster
tgctgatgctgcc

SEQ ID NO: 655752 - DNA, 14 bp, D. melanogaster
tgctgatgctgttg

SEQ ID NO: 655753 - DNA, 14 bp, D. melanogaster
tgctgatggcggtt

SEQ ID NO: 655754 - DNA, 13 bp, D. melanogaster
tgctgatgttgct

SEQ ID NO: 655755 - DNA, 14 bp, D. melanogaster
tgctgatgttgctg

SEQ ID NO: 655756 - DNA, 13 bp, D. melanogaster
tgctgatgttggt

SEQ ID NO: 655757 - DNA, 13 bp, D. melanogaster
tgctgatgttgtt

SEQ ID NO: 655758 - DNA, 13 bp, D. melanogaster
tgctgatgttttc

SEQ ID NO: 655759 - DNA, 13 bp, D. melanogaster
tgctgatgttttt

SEQ ID NO: 655760 - DNA, 13 bp, D. melanogaster
tgctgattaaata

SEQ ID NO: 655761 - DNA, 13 bp, D. melanogaster
tgctgattaaatt

SEQ ID NO: 655762 - DNA, 13 bp, D. melanogaster
tgctgattgaaat

SEQ ID NO: 655763 - DNA, 13 bp, D. melanogaster
tgctgattgtttt

SEQ ID NO: 655764 - DNA, 13 bp, D. melanogaster
tgctgatttgttg

SEQ ID NO: 655765 - DNA, 13 bp, D. melanogaster
tgctgattttgat

SEQ ID NO: 655766 - DNA, 13 bp, D. melanogaster
tgctgcaaaaagt

SEQ ID NO: 655767 - DNA, 13 bp, D. melanogaster
tgctgcaaaaata

SEQ ID NO: 655768 - DNA, 13 bp, D. melanogaster
tgctgcaaaagtt

SEQ ID NO: 655769 - DNA, 13 bp, D. melanogaster
tgctgcaaacagc

SEQ ID NO: 655770 - DNA, 13 bp, D. melanogaster
tgctgcaaatatt

SEQ ID NO: 655771 - DNA, 13 bp, D. melanogaster
tgctgcaaatgcc

SEQ ID NO: 655772 - DNA, 13 bp, D. melanogaster
tgctgcaactgca

SEQ ID NO: 655773 - DNA, 14 bp, D. melanogaster
tgctgcaactgcaa

SEQ ID NO: 655774 - DNA, 13 bp, D. melanogaster
tgctgcaactgct

SEQ ID NO: 655775 - DNA, 14 bp, D. melanogaster
tgctgcaactgctg

SEQ ID NO: 655776 - DNA, 13 bp, D. melanogaster
tgctgcaactttt

SEQ ID NO: 655777 - DNA, 13 bp, D. melanogaster
tgctgcaagacga

SEQ ID NO: 655778 - DNA, 13 bp, D. melanogaster
tgctgcaagtgca

SEQ ID NO: 655779 - DNA, 13 bp, D. melanogaster
tgctgcaagttgc

SEQ ID NO: 655780 - DNA, 13 bp, D. melanogaster
tgctgcaattatg

SEQ ID NO: 655781 - DNA, 13 bp, D. melanogaster
tgctgcacaaaca

SEQ ID NO: 655782 - DNA, 13 bp, D. melanogaster
tgctgcacacaca

SEQ ID NO: 655783 - DNA, 13 bp, D. melanogaster
tgctgcaccgaga

SEQ ID NO: 655784 - DNA, 13 bp, D. melanogaster
tgctgcactgcaa

SEQ ID NO: 655785 - DNA, 13 bp, D. melanogaster
tgctgcacttgaa

SEQ ID NO: 655786 - DNA, 13 bp, D. melanogaster
tgctgcactttaa

SEQ ID NO: 655787 - DNA, 13 bp, D. melanogaster
tgctgcactttgc

SEQ ID NO: 655788 - DNA, 13 bp, D. melanogaster
tgctgcagcaaca

SEQ ID NO: 655789 - DNA, 13 bp, D. melanogaster
tgctgcagcagca

SEQ ID NO: 655790 - DNA, 14 bp, D. melanogaster
tgctgcagcagcag

SEQ ID NO: 655791 - DNA, 13 bp, D. melanogaster
tgctgcagctgca

SEQ ID NO: 655792 - DNA, 14 bp, D. melanogaster
tgctgcagctgcag

SEQ ID NO: 655793 - DNA, 14 bp, D. melanogaster
tgctgcagctgctg

SEQ ID NO: 655794 - DNA, 13 bp, D. melanogaster
tgctgcagtgcag

SEQ ID NO: 655795 - DNA, 13 bp, D. melanogaster
tgctgcagtggca

SEQ ID NO: 655796 - DNA, 13 bp, D. melanogaster
tgctgcagttgat

SEQ ID NO: 655797 - DNA, 13 bp, D. melanogaster
tgctgcagttgca

SEQ ID NO: 655798 - DNA, 14 bp, D. melanogaster
tgctgcagttgcaa

SEQ ID NO: 655799 - DNA, 15 bp, D. melanogaster
tgctgcagttgcagt

SEQ ID NO: 655800 - DNA, 13 bp, D. melanogaster
tgctgcagttgcc

SEQ ID NO: 655801 - DNA, 13 bp, D. melanogaster
tgctgcagttgct

SEQ ID NO: 655802 - DNA, 14 bp, D. melanogaster
tgctgcagttgctc

SEQ ID NO: 655803 - DNA, 13 bp, D. melanogaster
tgctgcagttgtt

SEQ ID NO: 655804 - DNA, 13 bp, D. melanogaster
tgctgcagttttc

SEQ ID NO: 655805 - DNA, 13 bp, D. melanogaster
tgctgcatacttt

SEQ ID NO: 655806 - DNA, 14 bp, D. melanogaster
tgctgcatactttt

SEQ ID NO: 655807 - DNA, 13 bp, D. melanogaster
tgctgcatatttt

SEQ ID NO: 655808 - DNA, 13 bp, D. melanogaster
tgctgcatcgcag

SEQ ID NO: 655809 - DNA, 13 bp, D. melanogaster
tgctgcatgctgc

SEQ ID NO: 655810 - DNA, 13 bp, D. melanogaster
tgctgcatttaat

SEQ ID NO: 655811 - DNA, 13 bp, D. melanogaster
tgctgcatttgca

SEQ ID NO: 655812 - DNA, 13 bp, D. melanogaster
tgctgccaagtgc

SEQ ID NO: 655813 - DNA, 13 bp, D. melanogaster
tgctgccaataaa

SEQ ID NO: 655814 - DNA, 13 bp, D. melanogaster
tgctgccaattag

SEQ ID NO: 655815 - DNA, 13 bp, D. melanogaster
tgctgccacaaat

SEQ ID NO: 655816 - DNA, 13 bp, D. melanogaster
tgctgccactgac

SEQ ID NO: 655817 - DNA, 13 bp, D. melanogaster
tgctgccactgca

SEQ ID NO: 655818 - DNA, 13 bp, D. melanogaster
tgctgccactgct

SEQ ID NO: 655819 - DNA, 13 bp, D. melanogaster
tgctgccactgtt

SEQ ID NO: 655820 - DNA, 13 bp, D. melanogaster
tgctgccacttaa

SEQ ID NO: 655821 - DNA, 13 bp, D. melanogaster
tgctgccactttt

SEQ ID NO: 655822 - DNA, 13 bp, D. melanogaster
tgctgccattgtt

SEQ ID NO: 655823 - DNA, 13 bp, D. melanogaster
tgctgccatttcc

SEQ ID NO: 655824 - DNA, 13 bp, D. melanogaster
tgctgccattttc

SEQ ID NO: 655825 - DNA, 13 bp, D. melanogaster
tgctgccattttt

SEQ ID NO: 655826 - DNA, 13 bp, D. melanogaster
tgctgcccaaaaa

SEQ ID NO: 655827 - DNA, 13 bp, D. melanogaster
tgctgccccaaaa

SEQ ID NO: 655828 - DNA, 13 bp, D. melanogaster
tgctgccctgctg

SEQ ID NO: 655829 - DNA, 13 bp, D. melanogaster
tgctgcccttttt

SEQ ID NO: 655830 - DNA, 14 bp, D. melanogaster
tgctgccgccgctg

SEQ ID NO: 655831 - DNA, 13 bp, D. melanogaster
tgctgccgctgca

SEQ ID NO: 655832 - DNA, 13 bp, D. melanogaster
tgctgccgctgct

SEQ ID NO: 655833 - DNA, 14 bp, D. melanogaster
tgctgccgctgctg

SEQ ID NO: 655834 - DNA, 14 bp, D. melanogaster
tgctgccgctgctt

SEQ ID NO: 655835 - DNA, 13 bp, D. melanogaster
tgctgccgctggc

SEQ ID NO: 655836 - DNA, 13 bp, D. melanogaster
tgctgccgctgtc

SEQ ID NO: 655837 - DNA, 13 bp, D. melanogaster
tgctgccgctgtt

SEQ ID NO: 655838 - DNA, 14 bp, D. melanogaster
tgctgccgctgttg

SEQ ID NO: 655839 - DNA, 13 bp, D. melanogaster
tgctgccgctttt

SEQ ID NO: 655840 - DNA, 13 bp, D. melanogaster
tgctgccgttgca

SEQ ID NO: 655841 - DNA, 13 bp, D. melanogaster
tgctgccgttgtc

SEQ ID NO: 655842 - DNA, 14 bp, D. melanogaster
tgctgccgttgttg

SEQ ID NO: 655843 - DNA, 13 bp, D. melanogaster
tgctgccgttttt

SEQ ID NO: 655844 - DNA, 13 bp, D. melanogaster
tgctgcctacttt

SEQ ID NO: 655845 - DNA, 13 bp, D. melanogaster
tgctgcctctgct

SEQ ID NO: 655846 - DNA, 14 bp, D. melanogaster
tgctgcctctgctg

SEQ ID NO: 655847 - DNA, 13 bp, D. melanogaster
tgctgcctgctgc

SEQ ID NO: 655848 - DNA, 13 bp, D. melanogaster
tgctgcctgtttt

SEQ ID NO: 655849 - DNA, 13 bp, D. melanogaster
tgctgccttcttg

SEQ ID NO: 655850 - DNA, 13 bp, D. melanogaster
tgctgcctttgct

SEQ ID NO: 655851 - DNA, 14 bp, D. melanogaster
tgctgcctttgctg

SEQ ID NO: 655852 - DNA, 13 bp, D. melanogaster
tgctgccttttgt

SEQ ID NO: 655853 - DNA, 13 bp, D. melanogaster
tgctgcgagattt

SEQ ID NO: 655854 - DNA, 13 bp, D. melanogaster
tgctgcgatgttg

SEQ ID NO: 655855 - DNA, 13 bp, D. melanogaster
tgctgcgcagctg

SEQ ID NO: 655856 - DNA, 13 bp, D. melanogaster
tgctgcgccgctg

SEQ ID NO: 655857 - DNA, 13 bp, D. melanogaster
tgctgcgctgctg

SEQ ID NO: 655858 - DNA, 14 bp, D. melanogaster
tgctgcgctgctgc

SEQ ID NO: 655859 - DNA, 13 bp, D. melanogaster
tgctgcgcttttt

SEQ ID NO: 655860 - DNA, 13 bp, D. melanogaster
tgctgcggctgcc

SEQ ID NO: 655861 - DNA, 13 bp, D. melanogaster
tgctgcggctgct

SEQ ID NO: 655862 - DNA, 16 bp, D. melanogaster
tgctgcggctgctgct

SEQ ID NO: 655863 - DNA, 13 bp, D. melanogaster
tgctgcggttgca

SEQ ID NO: 655864 - DNA, 13 bp, D. melanogaster
tgctgcgtgagct

SEQ ID NO: 655865 - DNA, 13 bp, D. melanogaster
tgctgcgttgttg

SEQ ID NO: 655866 - DNA, 13 bp, D. melanogaster
tgctgctaaaaat

SEQ ID NO: 655867 - DNA, 14 bp, D. melanogaster
tgctgctattgctg

SEQ ID NO: 655868 - DNA, 13 bp, D. melanogaster
tgctgctcaacag

SEQ ID NO: 655869 - DNA, 13 bp, D. melanogaster
tgctgctcatttt

SEQ ID NO: 655870 - DNA, 13 bp, D. melanogaster
tgctgctcctcca

SEQ ID NO: 655871 - DNA, 13 bp, D. melanogaster
tgctgctcctccg

SEQ ID NO: 655872 - DNA, 13 bp, D. melanogaster
tgctgctcctgat

SEQ ID NO: 655873 - DNA, 13 bp, D. melanogaster
tgctgctcctgcc

SEQ ID NO: 655874 - DNA, 15 bp, D. melanogaster
tgctgctcctgctgc

SEQ ID NO: 655875 - DNA, 13 bp, D. melanogaster
tgctgctcctggt

SEQ ID NO: 655876 - DNA, 13 bp, D. melanogaster
tgctgctccttcg

SEQ ID NO: 655877 - DNA, 13 bp, D. melanogaster
tgctgctccttgg

SEQ ID NO: 655878 - DNA, 13 bp, D. melanogaster
tgctgctctgctc

SEQ ID NO: 655879 - DNA, 13 bp, D. melanogaster
tgctgctcttgtt

SEQ ID NO: 655880 - DNA, 13 bp, D. melanogaster
tgctgctcttttc

SEQ ID NO: 655881 - DNA, 14 bp, D. melanogaster
tgctgctgatgatg

SEQ ID NO: 655882 - DNA, 13 bp, D. melanogaster
tgctgctgatgcc

SEQ ID NO: 655883 - DNA, 14 bp, D. melanogaster
tgctgctgatgctg

SEQ ID NO: 655884 - DNA, 13 bp, D. melanogaster
tgctgctgatgtg

SEQ ID NO: 655885 - DNA, 13 bp, D. melanogaster
tgctgctgatgtt

SEQ ID NO: 655886 - DNA, 14 bp, D. melanogaster
tgctgctgatgttg

SEQ ID NO: 655887 - DNA, 13 bp, D. melanogaster
tgctgctgattct

SEQ ID NO: 655888 - DNA, 14 bp, D. melanogaster
tgctgctgattgga

SEQ ID NO: 655889 - DNA, 13 bp, D. melanogaster
tgctgctgattgt

SEQ ID NO: 655890 - DNA, 13 bp, D. melanogaster
tgctgctgatttt

SEQ ID NO: 655891 - DNA, 14 bp, D. melanogaster
tgctgctgattttg

SEQ ID NO: 655892 - DNA, 13 bp, D. melanogaster
tgctgctgcaaat

SEQ ID NO: 655893 - DNA, 13 bp, D. melanogaster
tgctgctgcaaca

SEQ ID NO: 655894 - DNA, 13 bp, D. melanogaster
tgctgctgcaact

SEQ ID NO: 655895 - DNA, 14 bp, D. melanogaster
tgctgctgcaactg

SEQ ID NO: 655896 - DNA, 13 bp, D. melanogaster
tgctgctgcaagt

SEQ ID NO: 655897 - DNA, 13 bp, D. melanogaster
tgctgctgcaatt

SEQ ID NO: 655898 - DNA, 13 bp, D. melanogaster
tgctgctgcacat

SEQ ID NO: 655899 - DNA, 13 bp, D. melanogaster
tgctgctgcactg

SEQ ID NO: 655900 - DNA, 13 bp, D. melanogaster
tgctgctgcactt

SEQ ID NO: 655901 - DNA, 13 bp, D. melanogaster
tgctgctgcagag

SEQ ID NO: 655902 - DNA, 13 bp, D. melanogaster
tgctgctgcagat

SEQ ID NO: 655903 - DNA, 14 bp, D. melanogaster
tgctgctgcagatg

SEQ ID NO: 655904 - DNA, 14 bp, D. melanogaster
tgctgctgcagcaa

SEQ ID NO: 655905 - DNA, 14 bp, D. melanogaster
tgctgctgcagctt

SEQ ID NO: 655906 - DNA, 13 bp, D. melanogaster
tgctgctgcagtt

SEQ ID NO: 655907 - DNA, 13 bp, D. melanogaster
tgctgctgcattt

SEQ ID NO: 655908 - DNA, 14 bp, D. melanogaster
tgctgctgcatttt

SEQ ID NO: 655909 - DNA, 14 bp, D. melanogaster
tgctgctgccactg

SEQ ID NO: 655910 - DNA, 13 bp, D. melanogaster
tgctgctgccgcc

SEQ ID NO: 655911 - DNA, 13 bp, D. melanogaster
tgctgctgccgtt

SEQ ID NO: 655912 - DNA, 14 bp, D. melanogaster
tgctgctgccgttg

SEQ ID NO: 655913 - DNA, 13 bp, D. melanogaster
tgctgctgcctgt

SEQ ID NO: 655914 - DNA, 14 bp, D. melanogaster
tgctgctgcctttg

SEQ ID NO: 655915 - DNA, 13 bp, D. melanogaster
tgctgctgcgaca

SEQ ID NO: 655916 - DNA, 13 bp, D. melanogaster
tgctgctgcgact

SEQ ID NO: 655917 - DNA, 13 bp, D. melanogaster
tgctgctgcgcct

SEQ ID NO: 655918 - DNA, 13 bp, D. melanogaster
tgctgctgcgctt

SEQ ID NO: 655919 - DNA, 13 bp, D. melanogaster
tgctgctgcgttg

SEQ ID NO: 655920 - DNA, 14 bp, D. melanogaster
tgctgctgctactg

SEQ ID NO: 655921 - DNA, 15 bp, D. melanogaster
tgctgctgctactgc

SEQ ID NO: 655922 - DNA, 14 bp, D. melanogaster
tgctgctgctactt

SEQ ID NO: 655923 - DNA, 13 bp, D. melanogaster
tgctgctgctagc

SEQ ID NO: 655924 - DNA, 13 bp, D. melanogaster
tgctgctgctatt

SEQ ID NO: 655925 - DNA, 13 bp, D. melanogaster
tgctgctgctcag

SEQ ID NO: 655926 - DNA, 13 bp, D. melanogaster
tgctgctgctcct

SEQ ID NO: 655927 - DNA, 14 bp, D. melanogaster
tgctgctgctcctt

SEQ ID NO: 655928 - DNA, 13 bp, D. melanogaster
tgctgctgctcgt

SEQ ID NO: 655929 - DNA, 13 bp, D. melanogaster
tgctgctgctgac

SEQ ID NO: 655930 - DNA, 13 bp, D. melanogaster
tgctgctgctgat

SEQ ID NO: 655931 - DNA, 13 bp, D. melanogaster
tgctgctgctgca

SEQ ID NO: 655932 - DNA, 14 bp, D. melanogaster
tgctgctgctgcgc

SEQ ID NO: 655933 - DNA, 14 bp, D. melanogaster
tgctgctgctgcgg

SEQ ID NO: 655934 - DNA, 13 bp, D. melanogaster
tgctgctgctgct

SEQ ID NO: 655935 - DNA, 14 bp, D. melanogaster
tgctgctgctgctc

SEQ ID NO: 655936 - DNA, 14 bp, D. melanogaster
tgctgctgctgctg

SEQ ID NO: 655937 - DNA, 13 bp, D. melanogaster
tgctgctgctgga

SEQ ID NO: 655938 - DNA, 13 bp, D. melanogaster
tgctgctgctggc

SEQ ID NO: 655939 - DNA, 13 bp, D. melanogaster
tgctgctgctggg

SEQ ID NO: 655940 - DNA, 13 bp, D. melanogaster
tgctgctgctggt

SEQ ID NO: 655941 - DNA, 13 bp, D. melanogaster
tgctgctgctgtg

SEQ ID NO: 655942 - DNA, 14 bp, D. melanogaster
tgctgctgctgtgg

SEQ ID NO: 655943 - DNA, 14 bp, D. melanogaster
tgctgctgctgtta

SEQ ID NO: 655944 - DNA, 14 bp, D. melanogaster
tgctgctgctgttt

SEQ ID NO: 655945 - DNA, 13 bp, D. melanogaster
tgctgctgcttct

SEQ ID NO: 655946 - DNA, 14 bp, D. melanogaster
tgctgctgcttctg

SEQ ID NO: 655947 - DNA, 13 bp, D. melanogaster
tgctgctgcttta

SEQ ID NO: 655948 - DNA, 13 bp, D. melanogaster
tgctgctgctttc

SEQ ID NO: 655949 - DNA, 14 bp, D. melanogaster
tgctgctgcttttt

SEQ ID NO: 655950 - DNA, 13 bp, D. melanogaster
tgctgctggaaaa

SEQ ID NO: 655951 - DNA, 13 bp, D. melanogaster
tgctgctggagct

SEQ ID NO: 655952 - DNA, 13 bp, D. melanogaster
tgctgctggcaca

SEQ ID NO: 655953 - DNA, 13 bp, D. melanogaster
tgctgctggcatt

SEQ ID NO: 655954 - DNA, 13 bp, D. melanogaster
tgctgctggccaa

SEQ ID NO: 655955 - DNA, 13 bp, D. melanogaster
tgctgctggctgc

SEQ ID NO: 655956 - DNA, 13 bp, D. melanogaster
tgctgctggctgt

SEQ ID NO: 655957 - DNA, 13 bp, D. melanogaster
tgctgctggcttt

SEQ ID NO: 655958 - DNA, 14 bp, D. melanogaster
tgctgctggtgctg

SEQ ID NO: 655959 - DNA, 13 bp, D. melanogaster
tgctgctggtgtt

SEQ ID NO: 655960 - DNA, 14 bp, D. melanogaster
tgctgctggtgttg

SEQ ID NO: 655961 - DNA, 13 bp, D. melanogaster
tgctgctggtttt

SEQ ID NO: 655962 - DNA, 13 bp, D. melanogaster
tgctgctgtcgct

SEQ ID NO: 655963 - DNA, 14 bp, D. melanogaster
tgctgctgtcgctg

SEQ ID NO: 655964 - DNA, 13 bp, D. melanogaster
tgctgctgtgctg

SEQ ID NO: 655965 - DNA, 13 bp, D. melanogaster
tgctgctgtggca

SEQ ID NO: 655966 - DNA, 13 bp, D. melanogaster
tgctgctgtggct

SEQ ID NO: 655967 - DNA, 14 bp, D. melanogaster
tgctgctgtggctg

SEQ ID NO: 655968 - DNA, 13 bp, D. melanogaster
tgctgctgtgtgg

SEQ ID NO: 655969 - DNA, 13 bp, D. melanogaster
tgctgctgtgttg

SEQ ID NO: 655970 - DNA, 13 bp, D. melanogaster
tgctgctgtgttt

SEQ ID NO: 655971 - DNA, 13 bp, D. melanogaster
tgctgctgttcgt

SEQ ID NO: 655972 - DNA, 13 bp, D. melanogaster
tgctgctgttgat

SEQ ID NO: 655973 - DNA, 14 bp, D. melanogaster
tgctgctgttgcac

SEQ ID NO: 655974 - DNA, 14 bp, D. melanogaster
tgctgctgttgcat

SEQ ID NO: 655975 - DNA, 13 bp, D. melanogaster
tgctgctgttgcc

SEQ ID NO: 655976 - DNA, 15 bp, D. melanogaster
tgctgctgttgctga

SEQ ID NO: 655977 - DNA, 14 bp, D. melanogaster
tgctgctgttgctt

SEQ ID NO: 655978 - DNA, 13 bp, D. melanogaster
tgctgctgttggt

SEQ ID NO: 655979 - DNA, 14 bp, D. melanogaster
tgctgctgttgttg

SEQ ID NO: 655980 - DNA, 13 bp, D. melanogaster
tgctgctgtttat

SEQ ID NO: 655981 - DNA, 13 bp, D. melanogaster
tgctgctgtttca

SEQ ID NO: 655982 - DNA, 14 bp, D. melanogaster
tgctgctgtttctg

SEQ ID NO: 655983 - DNA, 13 bp, D. melanogaster
tgctgcttctgct

SEQ ID NO: 655984 - DNA, 13 bp, D. melanogaster
tgctgcttctgtg

SEQ ID NO: 655985 - DNA, 13 bp, D. melanogaster
tgctgcttcttca

SEQ ID NO: 655986 - DNA, 13 bp, D. melanogaster
tgctgcttcttcc

SEQ ID NO: 655987 - DNA, 13 bp, D. melanogaster
tgctgctttattt

SEQ ID NO: 655988 - DNA, 13 bp, D. melanogaster
tgctgcttttaag

SEQ ID NO: 655989 - DNA, 15 bp, D. melanogaster
tgctgcttttaagct

SEQ ID NO: 655990 - DNA, 13 bp, D. melanogaster
tgctgcttttatt

SEQ ID NO: 655991 - DNA, 13 bp, D. melanogaster
tgctgcttttggt

SEQ ID NO: 655992 - DNA, 13 bp, D. melanogaster
tgctgctttttat

SEQ ID NO: 655993 - DNA, 13 bp, D. melanogaster
tgctggaaaaact

SEQ ID NO: 655994 - DNA, 14 bp, D. melanogaster
tgctggaaaacttt

SEQ ID NO: 655995 - DNA, 13 bp, D. melanogaster
tgctggaaaagcg

SEQ ID NO: 655996 - DNA, 13 bp, D. melanogaster
tgctggaaaagtg

SEQ ID NO: 655997 - DNA, 13 bp, D. melanogaster
tgctggaaaagtt

SEQ ID NO: 655998 - DNA, 13 bp, D. melanogaster
tgctggacatgcc

SEQ ID NO: 655999 - DNA, 13 bp, D. melanogaster
tgctggagctgct

SEQ ID NO: 656000 - DNA, 13 bp, D. melanogaster
tgctggcaaaaaa

SEQ ID NO: 656001 - DNA, 13 bp, D. melanogaster
tgctggcaaacaa

SEQ ID NO: 656002 - DNA, 13 bp, D. melanogaster
tgctggcaaagtg

SEQ ID NO: 656003 - DNA, 13 bp, D. melanogaster
tgctggcaaattg

SEQ ID NO: 656004 - DNA, 13 bp, D. melanogaster
tgctggcagccaa

SEQ ID NO: 656005 - DNA, 13 bp, D. melanogaster
tgctggcattgcc

SEQ ID NO: 656006 - DNA, 13 bp, D. melanogaster
tgctggccaaaaa

SEQ ID NO: 656007 - DNA, 14 bp, D. melanogaster
tgctggccaaaaaa

SEQ ID NO: 656008 - DNA, 13 bp, D. melanogaster
tgctggccaaaag

SEQ ID NO: 656009 - DNA, 13 bp, D. melanogaster
tgctggccaagaa

SEQ ID NO: 656010 - DNA, 13 bp, D. melanogaster
tgctggccaagtg

SEQ ID NO: 656011 - DNA, 13 bp, D. melanogaster
tgctggccaagtt

SEQ ID NO: 656012 - DNA, 13 bp, D. melanogaster
tgctggccagaaa

SEQ ID NO: 656013 - DNA, 13 bp, D. melanogaster
tgctggccataaa

SEQ ID NO: 656014 - DNA, 13 bp, D. melanogaster
tgctggccattaa

SEQ ID NO: 656015 - DNA, 13 bp, D. melanogaster
tgctggccattat

SEQ ID NO: 656016 - DNA, 13 bp, D. melanogaster
tgctggccattgt

SEQ ID NO: 656017 - DNA, 13 bp, D. melanogaster
tgctggccatttt

SEQ ID NO: 656018 - DNA, 13 bp, D. melanogaster
tgctggcctggcc

SEQ ID NO: 656019 - DNA, 13 bp, D. melanogaster
tgctggcgctgct

SEQ ID NO: 656020 - DNA, 14 bp, D. melanogaster
tgctggcgttggca

SEQ ID NO: 656021 - DNA, 13 bp, D. melanogaster
tgctggcgtttct

SEQ ID NO: 656022 - DNA, 14 bp, D. melanogaster
tgctggcgtttctg

SEQ ID NO: 656023 - DNA, 13 bp, D. melanogaster
tgctggctaacaa

SEQ ID NO: 656024 - DNA, 13 bp, D. melanogaster
tgctggctgcatt

SEQ ID NO: 656025 - DNA, 13 bp, D. melanogaster
tgctggctgctgc

SEQ ID NO: 656026 - DNA, 13 bp, D. melanogaster
tgctggctgctgg

SEQ ID NO: 656027 - DNA, 13 bp, D. melanogaster
tgctggctggcaa

SEQ ID NO: 656028 - DNA, 13 bp, D. melanogaster
tgctggctggctg

SEQ ID NO: 656029 - DNA, 13 bp, D. melanogaster
tgctggctgtttt

SEQ ID NO: 656030 - DNA, 13 bp, D. melanogaster
tgctggcttcttc

SEQ ID NO: 656031 - DNA, 13 bp, D. melanogaster
tgctgggatgctg

SEQ ID NO: 656032 - DNA, 13 bp, D. melanogaster
tgctgggcaaaca

SEQ ID NO: 656033 - DNA, 13 bp, D. melanogaster
tgctgggcaaata

SEQ ID NO: 656034 - DNA, 13 bp, D. melanogaster
tgctgggggaaaa

SEQ ID NO: 656035 - DNA, 13 bp, D. melanogaster
tgctggtaaaaac

SEQ ID NO: 656036 - DNA, 14 bp, D. melanogaster
tgctggtgctgctg

SEQ ID NO: 656037 - DNA, 14 bp, D. melanogaster
tgctggtgctggtg

SEQ ID NO: 656038 - DNA, 13 bp, D. melanogaster
tgctggtgctgtt

SEQ ID NO: 656039 - DNA, 14 bp, D. melanogaster
tgctggtgctgttg

SEQ ID NO: 656040 - DNA, 13 bp, D. melanogaster
tgctggtgggaga

SEQ ID NO: 656041 - DNA, 13 bp, D. melanogaster
tgctggtggtgat

SEQ ID NO: 656042 - DNA, 13 bp, D. melanogaster
tgctggtgttgca

SEQ ID NO: 656043 - DNA, 14 bp, D. melanogaster
tgctggtgttgcag

SEQ ID NO: 656044 - DNA, 13 bp, D. melanogaster
tgctggttgagaa

SEQ ID NO: 656045 - DNA, 13 bp, D. melanogaster
tgctgtaaatgaa

SEQ ID NO: 656046 - DNA, 13 bp, D. melanogaster
tgctgtatttatt

SEQ ID NO: 656047 - DNA, 13 bp, D. melanogaster
tgctgtcagtgag

SEQ ID NO: 656048 - DNA, 13 bp, D. melanogaster
tgctgtccattcg

SEQ ID NO: 656049 - DNA, 14 bp, D. melanogaster
tgctgtcgctgttg

SEQ ID NO: 656050 - DNA, 13 bp, D. melanogaster
tgctgtctcgctc

SEQ ID NO: 656051 - DNA, 13 bp, D. melanogaster
tgctgtctgtgtg

SEQ ID NO: 656052 - DNA, 13 bp, D. melanogaster
tgctgtgaaaatt

SEQ ID NO: 656053 - DNA, 13 bp, D. melanogaster
tgctgtgcaaata

SEQ ID NO: 656054 - DNA, 13 bp, D. melanogaster
tgctgtgcaacaa

SEQ ID NO: 656055 - DNA, 13 bp, D. melanogaster
tgctgtgcgtgtg

SEQ ID NO: 656056 - DNA, 14 bp, D. melanogaster
tgctgtgctgtgct

SEQ ID NO: 656057 - DNA, 13 bp, D. melanogaster
tgctgtggaaaat

SEQ ID NO: 656058 - DNA, 14 bp, D. melanogaster
tgctgtggaaaata

SEQ ID NO: 656059 - DNA, 13 bp, D. melanogaster
tgctgtggctgct

SEQ ID NO: 656060 - DNA, 13 bp, D. melanogaster
tgctgttattgct

SEQ ID NO: 656061 - DNA, 13 bp, D. melanogaster
tgctgttcaacaa

SEQ ID NO: 656062 - DNA, 14 bp, D. melanogaster
tgctgttcaacaag

SEQ ID NO: 656063 - DNA, 13 bp, D. melanogaster
tgctgttcctgct

SEQ ID NO: 656064 - DNA, 13 bp, D. melanogaster
tgctgttctgctg

SEQ ID NO: 656065 - DNA, 13 bp, D. melanogaster
tgctgttgatatt

SEQ ID NO: 656066 - DNA, 14 bp, D. melanogaster
tgctgttgatgatg

SEQ ID NO: 656067 - DNA, 13 bp, D. melanogaster
tgctgttgatttg

SEQ ID NO: 656068 - DNA, 13 bp, D. melanogaster
tgctgttgatttt

SEQ ID NO: 656069 - DNA, 13 bp, D. melanogaster
tgctgttgcagct

SEQ ID NO: 656070 - DNA, 14 bp, D. melanogaster
tgctgttgcagctg

SEQ ID NO: 656071 - DNA, 14 bp, D. melanogaster
tgctgttgcagttg

SEQ ID NO: 656072 - DNA, 13 bp, D. melanogaster
tgctgttgcattt

SEQ ID NO: 656073 - DNA, 13 bp, D. melanogaster
tgctgttgccatt

SEQ ID NO: 656074 - DNA, 14 bp, D. melanogaster
tgctgttgccattg

SEQ ID NO: 656075 - DNA, 14 bp, D. melanogaster
tgctgttgccattt

SEQ ID NO: 656076 - DNA, 13 bp, D. melanogaster
tgctgttgccgct

SEQ ID NO: 656077 - DNA, 13 bp, D. melanogaster
tgctgttgccggt

SEQ ID NO: 656078 - DNA, 13 bp, D. melanogaster
tgctgttgccttt

SEQ ID NO: 656079 - DNA, 13 bp, D. melanogaster
tgctgttgcggca

SEQ ID NO: 656080 - DNA, 14 bp, D. melanogaster
tgctgttgcggcag

SEQ ID NO: 656081 - DNA, 15 bp, D. melanogaster
tgctgttgctactgc

SEQ ID NO: 656082 - DNA, 13 bp, D. melanogaster
tgctgttgctatt

SEQ ID NO: 656083 - DNA, 14 bp, D. melanogaster
tgctgttgctattt

SEQ ID NO: 656084 - DNA, 13 bp, D. melanogaster
tgctgttgctcct

SEQ ID NO: 656085 - DNA, 13 bp, D. melanogaster
tgctgttgctctt

SEQ ID NO: 656086 - DNA, 13 bp, D. melanogaster
tgctgttgctgat

SEQ ID NO: 656087 - DNA, 13 bp, D. melanogaster
tgctgttgctgcc

SEQ ID NO: 656088 - DNA, 14 bp, D. melanogaster
tgctgttgctgcgg

SEQ ID NO: 656089 - DNA, 13 bp, D. melanogaster
tgctgttgctgct

SEQ ID NO: 656090 - DNA, 14 bp, D. melanogaster
tgctgttgctgctc

SEQ ID NO: 656091 - DNA, 14 bp, D. melanogaster
tgctgttgctgctg

SEQ ID NO: 656092 - DNA, 14 bp, D. melanogaster
tgctgttgctgctt

SEQ ID NO: 656093 - DNA, 13 bp, D. melanogaster
tgctgttgctggc

SEQ ID NO: 656094 - DNA, 13 bp, D. melanogaster
tgctgttgctgtt

SEQ ID NO: 656095 - DNA, 13 bp, D. melanogaster
tgctgttggcatt

SEQ ID NO: 656096 - DNA, 13 bp, D. melanogaster
tgctgttggccaa

SEQ ID NO: 656097 - DNA, 13 bp, D. melanogaster
tgctgttggcgtt

SEQ ID NO: 656098 - DNA, 13 bp, D. melanogaster
tgctgttggtgct

SEQ ID NO: 656099 - DNA, 13 bp, D. melanogaster
tgctgttgtctct

SEQ ID NO: 656100 - DNA, 13 bp, D. melanogaster
tgctgttgtggaa

SEQ ID NO: 656101 - DNA, 13 bp, D. melanogaster
tgctgttgtggct

SEQ ID NO: 656102 - DNA, 13 bp, D. melanogaster
tgctgttgttctg

SEQ ID NO: 656103 - DNA, 13 bp, D. melanogaster
tgctgttgttgca

SEQ ID NO: 656104 - DNA, 13 bp, D. melanogaster
tgctgttgttgct

SEQ ID NO: 656105 - DNA, 14 bp, D. melanogaster
tgctgttgttgctg

SEQ ID NO: 656106 - DNA, 13 bp, D. melanogaster
tgctgttgttgtc

SEQ ID NO: 656107 - DNA, 14 bp, D. melanogaster
tgctgttgttgtta

SEQ ID NO: 656108 - DNA, 13 bp, D. melanogaster
tgctgtttatgca

SEQ ID NO: 656109 - DNA, 13 bp, D. melanogaster
tgctgtttattta

SEQ ID NO: 656110 - DNA, 13 bp, D. melanogaster
tgctgtttcaatt

SEQ ID NO: 656111 - DNA, 13 bp, D. melanogaster
tgctgtttgcatt

SEQ ID NO: 656112 - DNA, 13 bp, D. melanogaster
tgctgtttgctta

SEQ ID NO: 656113 - DNA, 13 bp, D. melanogaster
tgctgtttgttat

SEQ ID NO: 656114 - DNA, 13 bp, D. melanogaster
tgctgttttggcc

SEQ ID NO: 656115 - DNA, 13 bp, D. melanogaster
tgcttaaaaagca

SEQ ID NO: 656116 - DNA, 13 bp, D. melanogaster
tgcttaaaaatat

SEQ ID NO: 656117 - DNA, 13 bp, D. melanogaster
tgcttaaaaatct

SEQ ID NO: 656118 - DNA, 13 bp, D. melanogaster
tgcttaaaatata

SEQ ID NO: 656119 - DNA, 13 bp, D. melanogaster
tgcttaaaatatt

SEQ ID NO: 656120 - DNA, 13 bp, D. melanogaster
tgcttaaacaaat

SEQ ID NO: 656121 - DNA, 13 bp, D. melanogaster
tgcttaaacattt

SEQ ID NO: 656122 - DNA, 13 bp, D. melanogaster
tgcttaaagcgaa

SEQ ID NO: 656123 - DNA, 13 bp, D. melanogaster
tgcttaaatattt

SEQ ID NO: 656124 - DNA, 14 bp, D. melanogaster
tgcttaaatatttg

SEQ ID NO: 656125 - DNA, 13 bp, D. melanogaster
tgcttaaattata

SEQ ID NO: 656126 - DNA, 14 bp, D. melanogaster
tgcttaacataaat

SEQ ID NO: 656127 - DNA, 13 bp, D. melanogaster
tgcttaacataat

SEQ ID NO: 656128 - DNA, 13 bp, D. melanogaster
tgcttaagctgac

SEQ ID NO: 656129 - DNA, 13 bp, D. melanogaster
tgcttaataataa

SEQ ID NO: 656130 - DNA, 14 bp, D. melanogaster
tgcttaatctcaac

SEQ ID NO: 656131 - DNA, 13 bp, D. melanogaster
tgcttaatcttaa

SEQ ID NO: 656132 - DNA, 13 bp, D. melanogaster
tgcttaatttata

SEQ ID NO: 656133 - DNA, 14 bp, D. melanogaster
tgcttaatttatat

SEQ ID NO: 656134 - DNA, 13 bp, D. melanogaster
tgcttaatttgat

SEQ ID NO: 656135 - DNA, 13 bp, D. melanogaster
tgcttacaaattt

SEQ ID NO: 656136 - DNA, 13 bp, D. melanogaster
tgcttacaattaa

SEQ ID NO: 656137 - DNA, 13 bp, D. melanogaster
tgcttacaatttt

SEQ ID NO: 656138 - DNA, 13 bp, D. melanogaster
tgcttacatatat

SEQ ID NO: 656139 - DNA, 13 bp, D. melanogaster
tgcttacattttt

SEQ ID NO: 656140 - DNA, 14 bp, D. melanogaster
tgcttagcatttat

SEQ ID NO: 656141 - DNA, 13 bp, D. melanogaster
tgcttagttttat

SEQ ID NO: 656142 - DNA, 13 bp, D. melanogaster
tgcttatacatat

SEQ ID NO: 656143 - DNA, 13 bp, D. melanogaster
tgcttatatctat

SEQ ID NO: 656144 - DNA, 13 bp, D. melanogaster
tgcttatgaaatt

SEQ ID NO: 656145 - DNA, 13 bp, D. melanogaster
tgcttatgcaaat

SEQ ID NO: 656146 - DNA, 13 bp, D. melanogaster
tgcttattaaatt

SEQ ID NO: 656147 - DNA, 13 bp, D. melanogaster
tgcttattaatta

SEQ ID NO: 656148 - DNA, 14 bp, D. melanogaster
tgcttattattatt

SEQ ID NO: 656149 - DNA, 13 bp, D. melanogaster
tgcttattgttat

SEQ ID NO: 656150 - DNA, 13 bp, D. melanogaster
tgcttatttattg

SEQ ID NO: 656151 - DNA, 13 bp, D. melanogaster
tgcttatttcaaa

SEQ ID NO: 656152 - DNA, 13 bp, D. melanogaster
tgcttatttttaa

SEQ ID NO: 656153 - DNA, 13 bp, D. melanogaster
tgcttcaatttaa

SEQ ID NO: 656154 - DNA, 13 bp, D. melanogaster
tgcttcagcttct

SEQ ID NO: 656155 - DNA, 13 bp, D. melanogaster
tgcttcattttcg

SEQ ID NO: 656156 - DNA, 14 bp, D. melanogaster
tgcttccgtttccg

SEQ ID NO: 656157 - DNA, 13 bp, D. melanogaster
tgcttcctctgtc

SEQ ID NO: 656158 - DNA, 13 bp, D. melanogaster
tgcttcggcggtg

SEQ ID NO: 656159 - DNA, 14 bp, D. melanogaster
tgcttctatttgac

SEQ ID NO: 656160 - DNA, 14 bp, D. melanogaster
tgcttctgctcctg

SEQ ID NO: 656161 - DNA, 13 bp, D. melanogaster
tgcttctgctgat

SEQ ID NO: 656162 - DNA, 13 bp, D. melanogaster
tgcttctgctgcc

SEQ ID NO: 656163 - DNA, 13 bp, D. melanogaster
tgcttctgctgct

SEQ ID NO: 656164 - DNA, 13 bp, D. melanogaster
tgcttctgctgtt

SEQ ID NO: 656165 - DNA, 13 bp, D. melanogaster
tgcttctgcttct

SEQ ID NO: 656166 - DNA, 13 bp, D. melanogaster
tgcttcttctgcc

SEQ ID NO: 656167 - DNA, 13 bp, D. melanogaster
tgcttcttcttca

SEQ ID NO: 656168 - DNA, 13 bp, D. melanogaster
tgcttcttcttgc

SEQ ID NO: 656169 - DNA, 13 bp, D. melanogaster
tgcttctttcgga

SEQ ID NO: 656170 - DNA, 13 bp, D. melanogaster
tgcttgcaacatt

SEQ ID NO: 656171 - DNA, 13 bp, D. melanogaster
tgcttgcattttt

SEQ ID NO: 656172 - DNA, 13 bp, D. melanogaster
tgcttgccaaaaa

SEQ ID NO: 656173 - DNA, 15 bp, D. melanogaster
tgcttgccatatatg

SEQ ID NO: 656174 - DNA, 13 bp, D. melanogaster
tgcttgcgatggt

SEQ ID NO: 656175 - DNA, 13 bp, D. melanogaster
tgcttgcttgcat

SEQ ID NO: 656176 - DNA, 14 bp, D. melanogaster
tgcttgcttgtgtg

SEQ ID NO: 656177 - DNA, 13 bp, D. melanogaster
tgcttggaaaatt

SEQ ID NO: 656178 - DNA, 15 bp, D. melanogaster
tgcttggaacagtct

SEQ ID NO: 656179 - DNA, 13 bp, D. melanogaster
tgcttggccaact

SEQ ID NO: 656180 - DNA, 13 bp, D. melanogaster
tgcttggccactg

SEQ ID NO: 656181 - DNA, 13 bp, D. melanogaster
tgcttggctgctt

SEQ ID NO: 656182 - DNA, 13 bp, D. melanogaster
tgcttgggtaaaa

SEQ ID NO: 656183 - DNA, 13 bp, D. melanogaster
tgcttggtgaaaa

SEQ ID NO: 656184 - DNA, 13 bp, D. melanogaster
tgcttgtaattaa

SEQ ID NO: 656185 - DNA, 13 bp, D. melanogaster
tgcttgtatcgtt

SEQ ID NO: 656186 - DNA, 13 bp, D. melanogaster
tgcttgtctattt

SEQ ID NO: 656187 - DNA, 14 bp, D. melanogaster
tgcttgtctatttt

SEQ ID NO: 656188 - DNA, 13 bp, D. melanogaster
tgcttgtgaaatt

SEQ ID NO: 656189 - DNA, 13 bp, D. melanogaster
tgcttgtgtgagt

SEQ ID NO: 656190 - DNA, 13 bp, D. melanogaster
tgcttgtttatat

SEQ ID NO: 656191 - DNA, 13 bp, D. melanogaster
tgcttgttttaat

SEQ ID NO: 656192 - DNA, 14 bp, D. melanogaster
tgctttaaaaataa

SEQ ID NO: 656193 - DNA, 13 bp, D. melanogaster
tgctttaaaataa

SEQ ID NO: 656194 - DNA, 13 bp, D. melanogaster
tgctttaaaggat

SEQ ID NO: 656195 - DNA, 13 bp, D. melanogaster
tgctttaaataaa

SEQ ID NO: 656196 - DNA, 13 bp, D. melanogaster
tgctttaaataat

SEQ ID NO: 656197 - DNA, 13 bp, D. melanogaster
tgctttaaatatt

SEQ ID NO: 656198 - DNA, 13 bp, D. melanogaster
tgctttaaatgaa

SEQ ID NO: 656199 - DNA, 13 bp, D. melanogaster
tgctttaaatttg

SEQ ID NO: 656200 - DNA, 13 bp, D. melanogaster
tgctttaagctaa

SEQ ID NO: 656201 - DNA, 14 bp, D. melanogaster
tgctttaagtttaa

SEQ ID NO: 656202 - DNA, 14 bp, D. melanogaster
tgctttaatactaa

SEQ ID NO: 656203 - DNA, 13 bp, D. melanogaster
tgctttaatattt

SEQ ID NO: 656204 - DNA, 13 bp, D. melanogaster
tgctttaatgaaa

SEQ ID NO: 656205 - DNA, 13 bp, D. melanogaster
tgctttaattata

SEQ ID NO: 656206 - DNA, 13 bp, D. melanogaster
tgctttaattttg

SEQ ID NO: 656207 - DNA, 13 bp, D. melanogaster
tgctttatatata

SEQ ID NO: 656208 - DNA, 13 bp, D. melanogaster
tgctttatttaat

SEQ ID NO: 656209 - DNA, 13 bp, D. melanogaster
tgctttatttata

SEQ ID NO: 656210 - DNA, 13 bp, D. melanogaster
tgctttatttgct

SEQ ID NO: 656211 - DNA, 13 bp, D. melanogaster
tgctttcaaatta

SEQ ID NO: 656212 - DNA, 13 bp, D. melanogaster
tgctttcaataaa

SEQ ID NO: 656213 - DNA, 13 bp, D. melanogaster
tgctttcaattaa

SEQ ID NO: 656214 - DNA, 13 bp, D. melanogaster
tgctttcatattt

SEQ ID NO: 656215 - DNA, 13 bp, D. melanogaster
tgctttcatttat

SEQ ID NO: 656216 - DNA, 13 bp, D. melanogaster
tgctttcatttca

SEQ ID NO: 656217 - DNA, 13 bp, D. melanogaster
tgctttccattta

SEQ ID NO: 656218 - DNA, 13 bp, D. melanogaster
tgctttccgcacc

SEQ ID NO: 656219 - DNA, 13 bp, D. melanogaster
tgctttcgatttt

SEQ ID NO: 656220 - DNA, 13 bp, D. melanogaster
tgctttcgcattt

SEQ ID NO: 656221 - DNA, 13 bp, D. melanogaster
tgctttcgctgac

SEQ ID NO: 656222 - DNA, 13 bp, D. melanogaster
tgctttcgggagt

SEQ ID NO: 656223 - DNA, 13 bp, D. melanogaster
tgctttctctgaa

SEQ ID NO: 656224 - DNA, 13 bp, D. melanogaster
tgctttctgctgc

SEQ ID NO: 656225 - DNA, 13 bp, D. melanogaster
tgctttcttcgag

SEQ ID NO: 656226 - DNA, 13 bp, D. melanogaster
tgctttgatattt

SEQ ID NO: 656227 - DNA, 13 bp, D. melanogaster
tgctttgattggt

SEQ ID NO: 656228 - DNA, 13 bp, D. melanogaster
tgctttgatttgc

SEQ ID NO: 656229 - DNA, 13 bp, D. melanogaster
tgctttgcataat

SEQ ID NO: 656230 - DNA, 13 bp, D. melanogaster
tgctttgcgttta

SEQ ID NO: 656231 - DNA, 13 bp, D. melanogaster
tgctttgctattt

SEQ ID NO: 656232 - DNA, 13 bp, D. melanogaster
tgctttgctgctg

SEQ ID NO: 656233 - DNA, 13 bp, D. melanogaster
tgctttgctgctt

SEQ ID NO: 656234 - DNA, 13 bp, D. melanogaster
tgctttgctgtag

SEQ ID NO: 656235 - DNA, 13 bp, D. melanogaster
tgctttgcttgct

SEQ ID NO: 656236 - DNA, 13 bp, D. melanogaster
tgctttgctttgc

SEQ ID NO: 656237 - DNA, 14 bp, D. melanogaster
tgctttgctttgct

SEQ ID NO: 656238 - DNA, 14 bp, D. melanogaster
tgctttgcttttgc

SEQ ID NO: 656239 - DNA, 13 bp, D. melanogaster
tgctttggaaaat

SEQ ID NO: 656240 - DNA, 13 bp, D. melanogaster
tgctttggccaaa

SEQ ID NO: 656241 - DNA, 13 bp, D. melanogaster
tgctttgtatttg

SEQ ID NO: 656242 - DNA, 14 bp, D. melanogaster
tgctttgtatttgt

SEQ ID NO: 656243 - DNA, 13 bp, D. melanogaster
tgcttttaaaata

SEQ ID NO: 656244 - DNA, 13 bp, D. melanogaster
tgcttttaaagtg

SEQ ID NO: 656245 - DNA, 13 bp, D. melanogaster
tgcttttaaatat

SEQ ID NO: 656246 - DNA, 13 bp, D. melanogaster
tgcttttaaattg

SEQ ID NO: 656247 - DNA, 14 bp, D. melanogaster
tgcttttaattgaa

SEQ ID NO: 656248 - DNA, 14 bp, D. melanogaster
tgcttttaattgcc

SEQ ID NO: 656249 - DNA, 13 bp, D. melanogaster
tgcttttataatt

SEQ ID NO: 656250 - DNA, 13 bp, D. melanogaster
tgcttttatataa

SEQ ID NO: 656251 - DNA, 13 bp, D. melanogaster
tgcttttatgact

SEQ ID NO: 656252 - DNA, 14 bp, D. melanogaster
tgcttttattatta

SEQ ID NO: 656253 - DNA, 13 bp, D. melanogaster
tgcttttattgct

SEQ ID NO: 656254 - DNA, 13 bp, D. melanogaster
tgcttttcaaaaa

SEQ ID NO: 656255 - DNA, 13 bp, D. melanogaster
tgcttttcaaaat

SEQ ID NO: 656256 - DNA, 13 bp, D. melanogaster
tgcttttcaattt

SEQ ID NO: 656257 - DNA, 13 bp, D. melanogaster
tgcttttcacttt

SEQ ID NO: 656258 - DNA, 14 bp, D. melanogaster
tgcttttcactttt

SEQ ID NO: 656259 - DNA, 13 bp, D. melanogaster
tgcttttcatttg

SEQ ID NO: 656260 - DNA, 13 bp, D. melanogaster
tgcttttccactt

SEQ ID NO: 656261 - DNA, 13 bp, D. melanogaster
tgcttttccagct

SEQ ID NO: 656262 - DNA, 13 bp, D. melanogaster
tgcttttcgattt

SEQ ID NO: 656263 - DNA, 13 bp, D. melanogaster
tgcttttctaatt

SEQ ID NO: 656264 - DNA, 13 bp, D. melanogaster
tgcttttgaaaat

SEQ ID NO: 656265 - DNA, 13 bp, D. melanogaster
tgcttttgaaatt

SEQ ID NO: 656266 - DNA, 13 bp, D. melanogaster
tgcttttgactgc

SEQ ID NO: 656267 - DNA, 13 bp, D. melanogaster
tgcttttgattaa

SEQ ID NO: 656268 - DNA, 13 bp, D. melanogaster
tgcttttgcaaat

SEQ ID NO: 656269 - DNA, 13 bp, D. melanogaster
tgcttttgccatt

SEQ ID NO: 656270 - DNA, 13 bp, D. melanogaster
tgcttttgccgct

SEQ ID NO: 656271 - DNA, 13 bp, D. melanogaster
tgcttttgccgtt

SEQ ID NO: 656272 - DNA, 13 bp, D. melanogaster
tgcttttggagca

SEQ ID NO: 656273 - DNA, 14 bp, D. melanogaster
tgcttttggcattt

SEQ ID NO: 656274 - DNA, 14 bp, D. melanogaster
tgcttttggccagg

SEQ ID NO: 656275 - DNA, 13 bp, D. melanogaster
tgcttttggcccg

SEQ ID NO: 656276 - DNA, 13 bp, D. melanogaster
tgcttttggccct

SEQ ID NO: 656277 - DNA, 13 bp, D. melanogaster
tgcttttggcctg

SEQ ID NO: 656278 - DNA, 13 bp, D. melanogaster
tgcttttgggcca

SEQ ID NO: 656279 - DNA, 13 bp, D. melanogaster
tgcttttggtgct

SEQ ID NO: 656280 - DNA, 13 bp, D. melanogaster
tgcttttgtcatt

SEQ ID NO: 656281 - DNA, 13 bp, D. melanogaster
tgctttttatgct

SEQ ID NO: 656282 - DNA, 13 bp, D. melanogaster
tgctttttgacat

SEQ ID NO: 656283 - DNA, 13 bp, D. melanogaster
tgctttttgcaca

SEQ ID NO: 656284 - DNA, 14 bp, D. melanogaster
tgctttttggccaa

SEQ ID NO: 656285 - DNA, 14 bp, D. melanogaster
tggaaaaaaatctt

SEQ ID NO: 656286 - DNA, 13 bp, D. melanogaster
tggaaaaaacaca

SEQ ID NO: 656287 - DNA, 13 bp, D. melanogaster
tggaaaaaacttt

SEQ ID NO: 656288 - DNA, 13 bp, D. melanogaster
tggaaaaaatcca

SEQ ID NO: 656289 - DNA, 13 bp, D. melanogaster
tggaaaaaatcga

SEQ ID NO: 656290 - DNA, 13 bp, D. melanogaster
tggaaaaaatgca

SEQ ID NO: 656291 - DNA, 13 bp, D. melanogaster
tggaaaaaatgct

SEQ ID NO: 656292 - DNA, 13 bp, D. melanogaster
tggaaaaaatgta

SEQ ID NO: 656293 - DNA, 13 bp, D. melanogaster
tggaaaaaattgt

SEQ ID NO: 656294 - DNA, 14 bp, D. melanogaster
tggaaaaacaaaat

SEQ ID NO: 656295 - DNA, 13 bp, D. melanogaster
tggaaaaacaaca

SEQ ID NO: 656296 - DNA, 14 bp, D. melanogaster
tggaaaaacaattt

SEQ ID NO: 656297 - DNA, 13 bp, D. melanogaster
tggaaaaacacac

SEQ ID NO: 656298 - DNA, 13 bp, D. melanogaster
tggaaaaacagaa

SEQ ID NO: 656299 - DNA, 13 bp, D. melanogaster
tggaaaaacatat

SEQ ID NO: 656300 - DNA, 13 bp, D. melanogaster
tggaaaaactatt

SEQ ID NO: 656301 - DNA, 13 bp, D. melanogaster
tggaaaaacttaa

SEQ ID NO: 656302 - DNA, 14 bp, D. melanogaster
tggaaaaacttttg

SEQ ID NO: 656303 - DNA, 13 bp, D. melanogaster
tggaaaaaggcag

SEQ ID NO: 656304 - DNA, 13 bp, D. melanogaster
tggaaaaagtaat

SEQ ID NO: 656305 - DNA, 13 bp, D. melanogaster
tggaaaaagtcaa

SEQ ID NO: 656306 - DNA, 13 bp, D. melanogaster
tggaaaaagtgaa

SEQ ID NO: 656307 - DNA, 14 bp, D. melanogaster
tggaaaaagttttt

SEQ ID NO: 656308 - DNA, 13 bp, D. melanogaster
tggaaaaatacct

SEQ ID NO: 656309 - DNA, 13 bp, D. melanogaster
tggaaaaatcaat

SEQ ID NO: 656310 - DNA, 13 bp, D. melanogaster
tggaaaaatgcaa

SEQ ID NO: 656311 - DNA, 14 bp, D. melanogaster
tggaaaaatgcaaa

SEQ ID NO: 656312 - DNA, 13 bp, D. melanogaster
tggaaaaatggga

SEQ ID NO: 656313 - DNA, 13 bp, D. melanogaster
tggaaaaatgtaa

SEQ ID NO: 656314 - DNA, 13 bp, D. melanogaster
tggaaaaatgtca

SEQ ID NO: 656315 - DNA, 14 bp, D. melanogaster
tggaaaaatgtcac

SEQ ID NO: 656316 - DNA, 13 bp, D. melanogaster
tggaaaaatgttt

SEQ ID NO: 656317 - DNA, 13 bp, D. melanogaster
tggaaaaattgca

SEQ ID NO: 656318 - DNA, 13 bp, D. melanogaster
tggaaaaatttaa

SEQ ID NO: 656319 - DNA, 13 bp, D. melanogaster
tggaaaacaaaac

SEQ ID NO: 656320 - DNA, 13 bp, D. melanogaster
tggaaaacaaaag

SEQ ID NO: 656321 - DNA, 14 bp, D. melanogaster
tggaaaacaaaagc

SEQ ID NO: 656322 - DNA, 13 bp, D. melanogaster
tggaaaacaaata

SEQ ID NO: 656323 - DNA, 13 bp, D. melanogaster
tggaaaacaacaa

SEQ ID NO: 656324 - DNA, 13 bp, D. melanogaster
tggaaaacaagtg

SEQ ID NO: 656325 - DNA, 13 bp, D. melanogaster
tggaaaacaatat

SEQ ID NO: 656326 - DNA, 13 bp, D. melanogaster
tggaaaacaattt

SEQ ID NO: 656327 - DNA, 13 bp, D. melanogaster
tggaaaacacaat

SEQ ID NO: 656328 - DNA, 13 bp, D. melanogaster
tggaaaacagaaa

SEQ ID NO: 656329 - DNA, 13 bp, D. melanogaster
tggaaaacatttg

SEQ ID NO: 656330 - DNA, 13 bp, D. melanogaster
tggaaaaccaaaa

SEQ ID NO: 656331 - DNA, 13 bp, D. melanogaster
tggaaaaccattt

SEQ ID NO: 656332 - DNA, 13 bp, D. melanogaster
tggaaaacccttt

SEQ ID NO: 656333 - DNA, 13 bp, D. melanogaster
tggaaaaccgaaa

SEQ ID NO: 656334 - DNA, 13 bp, D. melanogaster
tggaaaacctttt

SEQ ID NO: 656335 - DNA, 13 bp, D. melanogaster
tggaaaacgattt

SEQ ID NO: 656336 - DNA, 13 bp, D. melanogaster
tggaaaacgcaaa

SEQ ID NO: 656337 - DNA, 13 bp, D. melanogaster
tggaaaacgcatt

SEQ ID NO: 656338 - DNA, 13 bp, D. melanogaster
tggaaaacgggac

SEQ ID NO: 656339 - DNA, 13 bp, D. melanogaster
tggaaaactaatt

SEQ ID NO: 656340 - DNA, 13 bp, D. melanogaster
tggaaaactataa

SEQ ID NO: 656341 - DNA, 13 bp, D. melanogaster
tggaaaactatta

SEQ ID NO: 656342 - DNA, 14 bp, D. melanogaster
tggaaaactgaaaa

SEQ ID NO: 656343 - DNA, 13 bp, D. melanogaster
tggaaaactgctg

SEQ ID NO: 656344 - DNA, 13 bp, D. melanogaster
tggaaaactggca

SEQ ID NO: 656345 - DNA, 13 bp, D. melanogaster
tggaaaactgtca

SEQ ID NO: 656346 - DNA, 13 bp, D. melanogaster
tggaaaactttaa

SEQ ID NO: 656347 - DNA, 13 bp, D. melanogaster
tggaaaagaacaa

SEQ ID NO: 656348 - DNA, 14 bp, D. melanogaster
tggaaaagattttc

SEQ ID NO: 656349 - DNA, 13 bp, D. melanogaster
tggaaaagcaaac

SEQ ID NO: 656350 - DNA, 13 bp, D. melanogaster
tggaaaagcaaat

SEQ ID NO: 656351 - DNA, 13 bp, D. melanogaster
tggaaaagcattt

SEQ ID NO: 656352 - DNA, 13 bp, D. melanogaster
tggaaaagcggaa

SEQ ID NO: 656353 - DNA, 13 bp, D. melanogaster
tggaaaagcgggg

SEQ ID NO: 656354 - DNA, 13 bp, D. melanogaster
tggaaaagcgttt

SEQ ID NO: 656355 - DNA, 13 bp, D. melanogaster
tggaaaagggttt

SEQ ID NO: 656356 - DNA, 13 bp, D. melanogaster
tggaaaaggtgca

SEQ ID NO: 656357 - DNA, 14 bp, D. melanogaster
tggaaaaggtggca

SEQ ID NO: 656358 - DNA, 13 bp, D. melanogaster
tggaaaagtgaaa

SEQ ID NO: 656359 - DNA, 13 bp, D. melanogaster
tggaaaagtgcaa

SEQ ID NO: 656360 - DNA, 13 bp, D. melanogaster
tggaaaagtgcag

SEQ ID NO: 656361 - DNA, 13 bp, D. melanogaster
tggaaaagtggga

SEQ ID NO: 656362 - DNA, 13 bp, D. melanogaster
tggaaaagtgggc

SEQ ID NO: 656363 - DNA, 14 bp, D. melanogaster
tggaaaagtgggcg

SEQ ID NO: 656364 - DNA, 13 bp, D. melanogaster
tggaaaagtttag

SEQ ID NO: 656365 - DNA, 13 bp, D. melanogaster
tggaaaagtttca

SEQ ID NO: 656366 - DNA, 13 bp, D. melanogaster
tggaaaagtttgc

SEQ ID NO: 656367 - DNA, 14 bp, D. melanogaster
tggaaaagtttggc

SEQ ID NO: 656368 - DNA, 13 bp, D. melanogaster
tggaaaagttttt

SEQ ID NO: 656369 - DNA, 13 bp, D. melanogaster
tggaaaataaaac

SEQ ID NO: 656370 - DNA, 14 bp, D. melanogaster
tggaaaataaatgt

SEQ ID NO: 656371 - DNA, 14 bp, D. melanogaster
tggaaaataattta

SEQ ID NO: 656372 - DNA, 13 bp, D. melanogaster
tggaaaatacaaa

SEQ ID NO: 656373 - DNA, 13 bp, D. melanogaster
tggaaaatacata

SEQ ID NO: 656374 - DNA, 13 bp, D. melanogaster
tggaaaatagttt

SEQ ID NO: 656375 - DNA, 13 bp, D. melanogaster
tggaaaatataat

SEQ ID NO: 656376 - DNA, 13 bp, D. melanogaster
tggaaaatatata

SEQ ID NO: 656377 - DNA, 13 bp, D. melanogaster
tggaaaatatatg

SEQ ID NO: 656378 - DNA, 14 bp, D. melanogaster
tggaaaatatattt

SEQ ID NO: 656379 - DNA, 13 bp, D. melanogaster
tggaaaatatctg

SEQ ID NO: 656380 - DNA, 13 bp, D. melanogaster
tggaaaatatgtg

SEQ ID NO: 656381 - DNA, 13 bp, D. melanogaster
tggaaaatatgtt

SEQ ID NO: 656382 - DNA, 13 bp, D. melanogaster
tggaaaatattca

SEQ ID NO: 656383 - DNA, 14 bp, D. melanogaster
tggaaaatattcaa

SEQ ID NO: 656384 - DNA, 13 bp, D. melanogaster
tggaaaatattga

SEQ ID NO: 656385 - DNA, 13 bp, D. melanogaster
tggaaaatattgc

SEQ ID NO: 656386 - DNA, 14 bp, D. melanogaster
tggaaaatatttca

SEQ ID NO: 656387 - DNA, 14 bp, D. melanogaster
tggaaaatatttta

SEQ ID NO: 656388 - DNA, 14 bp, D. melanogaster
tggaaaatcaaagc

SEQ ID NO: 656389 - DNA, 13 bp, D. melanogaster
tggaaaatcaaat

SEQ ID NO: 656390 - DNA, 14 bp, D. melanogaster
tggaaaatcaaatt

SEQ ID NO: 656391 - DNA, 13 bp, D. melanogaster
tggaaaatcaatt

SEQ ID NO: 656392 - DNA, 13 bp, D. melanogaster
tggaaaatcataa

SEQ ID NO: 656393 - DNA, 13 bp, D. melanogaster
tggaaaatcattg

SEQ ID NO: 656394 - DNA, 13 bp, D. melanogaster
tggaaaatcattt

SEQ ID NO: 656395 - DNA, 13 bp, D. melanogaster
tggaaaatccatt

SEQ ID NO: 656396 - DNA, 13 bp, D. melanogaster
tggaaaatccttt

SEQ ID NO: 656397 - DNA, 13 bp, D. melanogaster
tggaaaatcgaaa

SEQ ID NO: 656398 - DNA, 14 bp, D. melanogaster
tggaaaatcgaaaa

SEQ ID NO: 656399 - DNA, 13 bp, D. melanogaster
tggaaaatcgata

SEQ ID NO: 656400 - DNA, 13 bp, D. melanogaster
tggaaaatcgcaa

SEQ ID NO: 656401 - DNA, 13 bp, D. melanogaster
tggaaaatcgctg

SEQ ID NO: 656402 - DNA, 13 bp, D. melanogaster
tggaaaatcgctt

SEQ ID NO: 656403 - DNA, 14 bp, D. melanogaster
tggaaaatcggaaa

SEQ ID NO: 656404 - DNA, 13 bp, D. melanogaster
tggaaaatctatt

SEQ ID NO: 656405 - DNA, 13 bp, D. melanogaster
tggaaaatcttaa

SEQ ID NO: 656406 - DNA, 13 bp, D. melanogaster
tggaaaatgaaat

SEQ ID NO: 656407 - DNA, 13 bp, D. melanogaster
tggaaaatgaata

SEQ ID NO: 656408 - DNA, 13 bp, D. melanogaster
tggaaaatgagga

SEQ ID NO: 656409 - DNA, 13 bp, D. melanogaster
tggaaaatgccag

SEQ ID NO: 656410 - DNA, 13 bp, D. melanogaster
tggaaaatgcgaa

SEQ ID NO: 656411 - DNA, 14 bp, D. melanogaster
tggaaaatgcgaaa

SEQ ID NO: 656412 - DNA, 13 bp, D. melanogaster
tggaaaatgctgt

SEQ ID NO: 656413 - DNA, 13 bp, D. melanogaster
tggaaaatgcttt

SEQ ID NO: 656414 - DNA, 14 bp, D. melanogaster
tggaaaatggaaat

SEQ ID NO: 656415 - DNA, 13 bp, D. melanogaster
tggaaaatggcag

SEQ ID NO: 656416 - DNA, 14 bp, D. melanogaster
tggaaaatgggaaa

SEQ ID NO: 656417 - DNA, 13 bp, D. melanogaster
tggaaaatgggag

SEQ ID NO: 656418 - DNA, 14 bp, D. melanogaster
tggaaaatggggaa

SEQ ID NO: 656419 - DNA, 14 bp, D. melanogaster
tggaaaatgggtgg

SEQ ID NO: 656420 - DNA, 13 bp, D. melanogaster
tggaaaatgtatt

SEQ ID NO: 656421 - DNA, 14 bp, D. melanogaster
tggaaaatgtgaaa

SEQ ID NO: 656422 - DNA, 13 bp, D. melanogaster
tggaaaatgttaa

SEQ ID NO: 656423 - DNA, 13 bp, D. melanogaster
tggaaaatgttat

SEQ ID NO: 656424 - DNA, 13 bp, D. melanogaster
tggaaaatgttct

SEQ ID NO: 656425 - DNA, 13 bp, D. melanogaster
tggaaaatgttga

SEQ ID NO: 656426 - DNA, 13 bp, D. melanogaster
tggaaaatgttgg

SEQ ID NO: 656427 - DNA, 13 bp, D. melanogaster
tggaaaatgttgt

SEQ ID NO: 656428 - DNA, 13 bp, D. melanogaster
tggaaaatgtttt

SEQ ID NO: 656429 - DNA, 14 bp, D. melanogaster
tggaaaattaattt

SEQ ID NO: 656430 - DNA, 13 bp, D. melanogaster
tggaaaattactt

SEQ ID NO: 656431 - DNA, 13 bp, D. melanogaster
tggaaaattcaag

SEQ ID NO: 656432 - DNA, 13 bp, D. melanogaster
tggaaaattcatt

SEQ ID NO: 656433 - DNA, 13 bp, D. melanogaster
tggaaaattgatt

SEQ ID NO: 656434 - DNA, 13 bp, D. melanogaster
tggaaaattgcat

SEQ ID NO: 656435 - DNA, 13 bp, D. melanogaster
tggaaaattggaa

SEQ ID NO: 656436 - DNA, 14 bp, D. melanogaster
tggaaaattgtaat

SEQ ID NO: 656437 - DNA, 13 bp, D. melanogaster
tggaaaatttcaa

SEQ ID NO: 656438 - DNA, 13 bp, D. melanogaster
tggaaaatttcat

SEQ ID NO: 656439 - DNA, 13 bp, D. melanogaster
tggaaaatttcca

SEQ ID NO: 656440 - DNA, 13 bp, D. melanogaster
tggaaaatttgca

SEQ ID NO: 656441 - DNA, 13 bp, D. melanogaster
tggaaaattttct

SEQ ID NO: 656442 - DNA, 13 bp, D. melanogaster
tggaaacaatggc

SEQ ID NO: 656443 - DNA, 13 bp, D. melanogaster
tggaaacacccat

SEQ ID NO: 656444 - DNA, 13 bp, D. melanogaster
tggaaacagaaaa

SEQ ID NO: 656445 - DNA, 13 bp, D. melanogaster
tggaaacagaggc

SEQ ID NO: 656446 - DNA, 13 bp, D. melanogaster
tggaaaccaaaaa

SEQ ID NO: 656447 - DNA, 13 bp, D. melanogaster
tggaaaccaattt

SEQ ID NO: 656448 - DNA, 13 bp, D. melanogaster
tggaaaccgcaga

SEQ ID NO: 656449 - DNA, 13 bp, D. melanogaster
tggaaactatttt

SEQ ID NO: 656450 - DNA, 13 bp, D. melanogaster
tggaaactgaaaa

SEQ ID NO: 656451 - DNA, 13 bp, D. melanogaster
tggaaactggaaa

SEQ ID NO: 656452 - DNA, 13 bp, D. melanogaster
tggaaagaaaaca

SEQ ID NO: 656453 - DNA, 13 bp, D. melanogaster
tggaaagagatta

SEQ ID NO: 656454 - DNA, 13 bp, D. melanogaster
tggaaagcaaaat

SEQ ID NO: 656455 - DNA, 13 bp, D. melanogaster
tggaaagccaaaa

SEQ ID NO: 656456 - DNA, 13 bp, D. melanogaster
tggaaagctgcat

SEQ ID NO: 656457 - DNA, 13 bp, D. melanogaster
tggaaaggaaaac

SEQ ID NO: 656458 - DNA, 13 bp, D. melanogaster
tggaaagtgaaaa

SEQ ID NO: 656459 - DNA, 13 bp, D. melanogaster
tggaaagtgacga

SEQ ID NO: 656460 - DNA, 13 bp, D. melanogaster
tggaaagtgcaaa

SEQ ID NO: 656461 - DNA, 13 bp, D. melanogaster
tggaaagtgccac

SEQ ID NO: 656462 - DNA, 13 bp, D. melanogaster
tggaaagtggaaa

SEQ ID NO: 656463 - DNA, 13 bp, D. melanogaster
tggaaagtggcaa

SEQ ID NO: 656464 - DNA, 13 bp, D. melanogaster
tggaaagtgggaa

SEQ ID NO: 656465 - DNA, 13 bp, D. melanogaster
tggaaagtgggtg

SEQ ID NO: 656466 - DNA, 14 bp, D. melanogaster
tggaaagtttttta

SEQ ID NO: 656467 - DNA, 13 bp, D. melanogaster
tggaaataaaatg

SEQ ID NO: 656468 - DNA, 13 bp, D. melanogaster
tggaaataaaatt

SEQ ID NO: 656469 - DNA, 13 bp, D. melanogaster
tggaaataaatat

SEQ ID NO: 656470 - DNA, 13 bp, D. melanogaster
tggaaataaatgt

SEQ ID NO: 656471 - DNA, 13 bp, D. melanogaster
tggaaataaattt

SEQ ID NO: 656472 - DNA, 13 bp, D. melanogaster
tggaaataatgaa

SEQ ID NO: 656473 - DNA, 13 bp, D. melanogaster
tggaaataatttg

SEQ ID NO: 656474 - DNA, 13 bp, D. melanogaster
tggaaataatttt

SEQ ID NO: 656475 - DNA, 13 bp, D. melanogaster
tggaaatacaaaa

SEQ ID NO: 656476 - DNA, 13 bp, D. melanogaster
tggaaatactttt

SEQ ID NO: 656477 - DNA, 13 bp, D. melanogaster
tggaaatatcttc

SEQ ID NO: 656478 - DNA, 13 bp, D. melanogaster
tggaaatatgtat

SEQ ID NO: 656479 - DNA, 13 bp, D. melanogaster
tggaaatattaat

SEQ ID NO: 656480 - DNA, 13 bp, D. melanogaster
tggaaatattgaa

SEQ ID NO: 656481 - DNA, 13 bp, D. melanogaster
tggaaatatttca

SEQ ID NO: 656482 - DNA, 13 bp, D. melanogaster
tggaaatcaaaaa

SEQ ID NO: 656483 - DNA, 14 bp, D. melanogaster
tggaaatcaaaata

SEQ ID NO: 656484 - DNA, 13 bp, D. melanogaster
tggaaatcaaatg

SEQ ID NO: 656485 - DNA, 13 bp, D. melanogaster
tggaaatcaatta

SEQ ID NO: 656486 - DNA, 13 bp, D. melanogaster
tggaaatccagca

SEQ ID NO: 656487 - DNA, 13 bp, D. melanogaster
tggaaatccattt

SEQ ID NO: 656488 - DNA, 13 bp, D. melanogaster
tggaaatcgaaat

SEQ ID NO: 656489 - DNA, 13 bp, D. melanogaster
tggaaatcgaatt

SEQ ID NO: 656490 - DNA, 13 bp, D. melanogaster
tggaaatcggcga

SEQ ID NO: 656491 - DNA, 13 bp, D. melanogaster
tggaaatcgtttt

SEQ ID NO: 656492 - DNA, 13 bp, D. melanogaster
tggaaatcttttg

SEQ ID NO: 656493 - DNA, 13 bp, D. melanogaster
tggaaatcttttt

SEQ ID NO: 656494 - DNA, 14 bp, D. melanogaster
tggaaatgaaaatg

SEQ ID NO: 656495 - DNA, 13 bp, D. melanogaster
tggaaatgaatga

SEQ ID NO: 656496 - DNA, 13 bp, D. melanogaster
tggaaatgacttt

SEQ ID NO: 656497 - DNA, 13 bp, D. melanogaster
tggaaatgattta

SEQ ID NO: 656498 - DNA, 13 bp, D. melanogaster
tggaaatgatttt

SEQ ID NO: 656499 - DNA, 13 bp, D. melanogaster
tggaaatgcaaat

SEQ ID NO: 656500 - DNA, 13 bp, D. melanogaster
tggaaatgcattt

SEQ ID NO: 656501 - DNA, 13 bp, D. melanogaster
tggaaatgcgaac

SEQ ID NO: 656502 - DNA, 13 bp, D. melanogaster
tggaaatgcgaat

SEQ ID NO: 656503 - DNA, 13 bp, D. melanogaster
tggaaatgctttt

SEQ ID NO: 656504 - DNA, 13 bp, D. melanogaster
tggaaatggaaag

SEQ ID NO: 656505 - DNA, 14 bp, D. melanogaster
tggaaatggaaatg

SEQ ID NO: 656506 - DNA, 16 bp, D. melanogaster
tggaaatggaaatgga

SEQ ID NO: 656507 - DNA, 13 bp, D. melanogaster
tggaaatggagat

SEQ ID NO: 656508 - DNA, 14 bp, D. melanogaster
tggaaatggagatg

SEQ ID NO: 656509 - DNA, 13 bp, D. melanogaster
tggaaatggagct

SEQ ID NO: 656510 - DNA, 13 bp, D. melanogaster
tggaaatggcagt

SEQ ID NO: 656511 - DNA, 13 bp, D. melanogaster
tggaaatgggtgg

SEQ ID NO: 656512 - DNA, 13 bp, D. melanogaster
tggaaatggtata

SEQ ID NO: 656513 - DNA, 13 bp, D. melanogaster
tggaaatgtgaaa

SEQ ID NO: 656514 - DNA, 13 bp, D. melanogaster
tggaaatgtgcaa

SEQ ID NO: 656515 - DNA, 13 bp, D. melanogaster
tggaaatgtggaa

SEQ ID NO: 656516 - DNA, 13 bp, D. melanogaster
tggaaatgttaga

SEQ ID NO: 656517 - DNA, 13 bp, D. melanogaster
tggaaatgtttaa

SEQ ID NO: 656518 - DNA, 13 bp, D. melanogaster
tggaaatgttttg

SEQ ID NO: 656519 - DNA, 13 bp, D. melanogaster
tggaaatgttttt

SEQ ID NO: 656520 - DNA, 13 bp, D. melanogaster
tggaaattaatat

SEQ ID NO: 656521 - DNA, 13 bp, D. melanogaster
tggaaattaatga

SEQ ID NO: 656522 - DNA, 13 bp, D. melanogaster
tggaaattaatgg

SEQ ID NO: 656523 - DNA, 14 bp, D. melanogaster
tggaaattaatttt

SEQ ID NO: 656524 - DNA, 13 bp, D. melanogaster
tggaaattagaaa

SEQ ID NO: 656525 - DNA, 15 bp, D. melanogaster
tggaaattagaaagt

SEQ ID NO: 656526 - DNA, 13 bp, D. melanogaster
tggaaattagcat

SEQ ID NO: 656527 - DNA, 13 bp, D. melanogaster
tggaaattataat

SEQ ID NO: 656528 - DNA, 13 bp, D. melanogaster
tggaaattatgaa

SEQ ID NO: 656529 - DNA, 14 bp, D. melanogaster
tggaaattatgcaa

SEQ ID NO: 656530 - DNA, 13 bp, D. melanogaster
tggaaattatttt

SEQ ID NO: 656531 - DNA, 13 bp, D. melanogaster
tggaaattcaaac

SEQ ID NO: 656532 - DNA, 14 bp, D. melanogaster
tggaaattcaaatt

SEQ ID NO: 656533 - DNA, 14 bp, D. melanogaster
tggaaattcaattt

SEQ ID NO: 656534 - DNA, 13 bp, D. melanogaster
tggaaattgaaat

SEQ ID NO: 656535 - DNA, 13 bp, D. melanogaster
tggaaattgaatg

SEQ ID NO: 656536 - DNA, 13 bp, D. melanogaster
tggaaattgaatt

SEQ ID NO: 656537 - DNA, 13 bp, D. melanogaster
tggaaattgattg

SEQ ID NO: 656538 - DNA, 14 bp, D. melanogaster
tggaaattgcaatt

SEQ ID NO: 656539 - DNA, 13 bp, D. melanogaster
tggaaattgcatt

SEQ ID NO: 656540 - DNA, 13 bp, D. melanogaster
tggaaattggaaa

SEQ ID NO: 656541 - DNA, 13 bp, D. melanogaster
tggaaattggcaa

SEQ ID NO: 656542 - DNA, 13 bp, D. melanogaster
tggaaattggttt

SEQ ID NO: 656543 - DNA, 13 bp, D. melanogaster
tggaaattgtaaa

SEQ ID NO: 656544 - DNA, 13 bp, D. melanogaster
tggaaattgttat

SEQ ID NO: 656545 - DNA, 13 bp, D. melanogaster
tggaaattgttta

SEQ ID NO: 656546 - DNA, 13 bp, D. melanogaster
tggaaattgtttt

SEQ ID NO: 656547 - DNA, 13 bp, D. melanogaster
tggaaatttagtt

SEQ ID NO: 656548 - DNA, 13 bp, D. melanogaster
tggaaatttatgc

SEQ ID NO: 656549 - DNA, 13 bp, D. melanogaster
tggaaatttattt

SEQ ID NO: 656550 - DNA, 13 bp, D. melanogaster
tggaaatttcttt

SEQ ID NO: 656551 - DNA, 13 bp, D. melanogaster
tggaaatttgaaa

SEQ ID NO: 656552 - DNA, 14 bp, D. melanogaster
tggaaatttgaaaa

SEQ ID NO: 656553 - DNA, 13 bp, D. melanogaster
tggaaatttgcat

SEQ ID NO: 656554 - DNA, 13 bp, D. melanogaster
tggaacaacaaca

SEQ ID NO: 656555 - DNA, 13 bp, D. melanogaster
tggaacaacattt

SEQ ID NO: 656556 - DNA, 13 bp, D. melanogaster
tggaacacctttt

SEQ ID NO: 656557 - DNA, 14 bp, D. melanogaster
tggaacagtcttta

SEQ ID NO: 656558 - DNA, 13 bp, D. melanogaster
tggaacatttttt

SEQ ID NO: 656559 - DNA, 13 bp, D. melanogaster
tggaaccaaaagt

SEQ ID NO: 656560 - DNA, 13 bp, D. melanogaster
tggaacgccaatg

SEQ ID NO: 656561 - DNA, 13 bp, D. melanogaster
tggaacgggctct

SEQ ID NO: 656562 - DNA, 13 bp, D. melanogaster
tggaactattttt

SEQ ID NO: 656563 - DNA, 13 bp, D. melanogaster
tggaactgaaact

SEQ ID NO: 656564 - DNA, 14 bp, D. melanogaster
tggaactgaaactg

SEQ ID NO: 656565 - DNA, 13 bp, D. melanogaster
tggaactgcaaaa

SEQ ID NO: 656566 - DNA, 14 bp, D. melanogaster
tggaactggaactg

SEQ ID NO: 656567 - DNA, 13 bp, D. melanogaster
tggaactggcaaa

SEQ ID NO: 656568 - DNA, 13 bp, D. melanogaster
tggaactggttca

SEQ ID NO: 656569 - DNA, 13 bp, D. melanogaster
tggaacttcatta

SEQ ID NO: 656570 - DNA, 14 bp, D. melanogaster
tggaacttcattaa

SEQ ID NO: 656571 - DNA, 13 bp, D. melanogaster
tggaagaaagttt

SEQ ID NO: 656572 - DNA, 13 bp, D. melanogaster
tggaagaaataca

SEQ ID NO: 656573 - DNA, 13 bp, D. melanogaster
tggaagaaatcca

SEQ ID NO: 656574 - DNA, 13 bp, D. melanogaster
tggaagaacttta

SEQ ID NO: 656575 - DNA, 14 bp, D. melanogaster
tggaagaagctgat

SEQ ID NO: 656576 - DNA, 13 bp, D. melanogaster
tggaagaccacct

SEQ ID NO: 656577 - DNA, 13 bp, D. melanogaster
tggaagatactcc

SEQ ID NO: 656578 - DNA, 13 bp, D. melanogaster
tggaagatgaaaa

SEQ ID NO: 656579 - DNA, 13 bp, D. melanogaster
tggaagatgatga

SEQ ID NO: 656580 - DNA, 13 bp, D. melanogaster
tggaagcgtgacg

SEQ ID NO: 656581 - DNA, 13 bp, D. melanogaster
tggaagctggaaa

SEQ ID NO: 656582 - DNA, 13 bp, D. melanogaster
tggaaggaataaa

SEQ ID NO: 656583 - DNA, 13 bp, D. melanogaster
tggaaggagtttg

SEQ ID NO: 656584 - DNA, 13 bp, D. melanogaster
tggaaggcgttta

SEQ ID NO: 656585 - DNA, 13 bp, D. melanogaster
tggaagggaaaat

SEQ ID NO: 656586 - DNA, 13 bp, D. melanogaster
tggaagtggaaat

SEQ ID NO: 656587 - DNA, 14 bp, D. melanogaster
tggaagtggaaatg

SEQ ID NO: 656588 - DNA, 13 bp, D. melanogaster
tggaagtggaact

SEQ ID NO: 656589 - DNA, 13 bp, D. melanogaster
tggaagtggaaga

SEQ ID NO: 656590 - DNA, 13 bp, D. melanogaster
tggaagtggaagc

SEQ ID NO: 656591 - DNA, 13 bp, D. melanogaster
tggaagtggcagc

SEQ ID NO: 656592 - DNA, 13 bp, D. melanogaster
tggaagtggctgg

SEQ ID NO: 656593 - DNA, 13 bp, D. melanogaster
tggaagtgggaat

SEQ ID NO: 656594 - DNA, 14 bp, D. melanogaster
tggaagtgggaatt

SEQ ID NO: 656595 - DNA, 13 bp, D. melanogaster
tggaataaaattt

SEQ ID NO: 656596 - DNA, 13 bp, D. melanogaster
tggaataaatata

SEQ ID NO: 656597 - DNA, 13 bp, D. melanogaster
tggaataaatttg

SEQ ID NO: 656598 - DNA, 13 bp, D. melanogaster
tggaataaggagg

SEQ ID NO: 656599 - DNA, 13 bp, D. melanogaster
tggaataataaat

SEQ ID NO: 656600 - DNA, 13 bp, D. melanogaster
tggaataatttgt

SEQ ID NO: 656601 - DNA, 14 bp, D. melanogaster
tggaataatttgtt

SEQ ID NO: 656602 - DNA, 13 bp, D. melanogaster
tggaataatttta

SEQ ID NO: 656603 - DNA, 13 bp, D. melanogaster
tggaatacaaaga

SEQ ID NO: 656604 - DNA, 13 bp, D. melanogaster
tggaatacaaatg

SEQ ID NO: 656605 - DNA, 13 bp, D. melanogaster
tggaatacaattt

SEQ ID NO: 656606 - DNA, 13 bp, D. melanogaster
tggaatagattac

SEQ ID NO: 656607 - DNA, 13 bp, D. melanogaster
tggaatagttact

SEQ ID NO: 656608 - DNA, 13 bp, D. melanogaster
tggaatataaaat

SEQ ID NO: 656609 - DNA, 13 bp, D. melanogaster
tggaatattttcg

SEQ ID NO: 656610 - DNA, 13 bp, D. melanogaster
tggaatcattatg

SEQ ID NO: 656611 - DNA, 13 bp, D. melanogaster
tggaatccacttg

SEQ ID NO: 656612 - DNA, 14 bp, D. melanogaster
tggaatccacttgc

SEQ ID NO: 656613 - DNA, 13 bp, D. melanogaster
tggaatccagaag

SEQ ID NO: 656614 - DNA, 13 bp, D. melanogaster
tggaatcgaaaat

SEQ ID NO: 656615 - DNA, 13 bp, D. melanogaster
tggaatcggaatc

SEQ ID NO: 656616 - DNA, 13 bp, D. melanogaster
tggaatcgtttgc

SEQ ID NO: 656617 - DNA, 13 bp, D. melanogaster
tggaatgcatatg

SEQ ID NO: 656618 - DNA, 13 bp, D. melanogaster
tggaatgccgaat

SEQ ID NO: 656619 - DNA, 13 bp, D. melanogaster
tggaatgcgaatg

SEQ ID NO: 656620 - DNA, 13 bp, D. melanogaster
tggaatggaaaat

SEQ ID NO: 656621 - DNA, 13 bp, D. melanogaster
tggaatggaatgg

SEQ ID NO: 656622 - DNA, 13 bp, D. melanogaster
tggaatggaattt

SEQ ID NO: 656623 - DNA, 13 bp, D. melanogaster
tggaatggaccgc

SEQ ID NO: 656624 - DNA, 13 bp, D. melanogaster
tggaatgggaaaa

SEQ ID NO: 656625 - DNA, 14 bp, D. melanogaster
tggaatgggaatgg

SEQ ID NO: 656626 - DNA, 13 bp, D. melanogaster
tggaatgggatgg

SEQ ID NO: 656627 - DNA, 13 bp, D. melanogaster
tggaatggggcag

SEQ ID NO: 656628 - DNA, 13 bp, D. melanogaster
tggaatggtatgg

SEQ ID NO: 656629 - DNA, 13 bp, D. melanogaster
tggaatgttatgc

SEQ ID NO: 656630 - DNA, 13 bp, D. melanogaster
tggaattaaaata

SEQ ID NO: 656631 - DNA, 13 bp, D. melanogaster
tggaattaaataa

SEQ ID NO: 656632 - DNA, 13 bp, D. melanogaster
tggaattacaaat

SEQ ID NO: 656633 - DNA, 13 bp, D. melanogaster
tggaattcaatta

SEQ ID NO: 656634 - DNA, 13 bp, D. melanogaster
tggaattcaattt

SEQ ID NO: 656635 - DNA, 13 bp, D. melanogaster
tggaattccaaaa

SEQ ID NO: 656636 - DNA, 13 bp, D. melanogaster
tggaattctattt

SEQ ID NO: 656637 - DNA, 13 bp, D. melanogaster
tggaattctttaa

SEQ ID NO: 656638 - DNA, 14 bp, D. melanogaster
tggaattctttaac

SEQ ID NO: 656639 - DNA, 13 bp, D. melanogaster
tggaattctttta

SEQ ID NO: 656640 - DNA, 13 bp, D. melanogaster
tggaattgatttg

SEQ ID NO: 656641 - DNA, 13 bp, D. melanogaster
tggaattgcaaat

SEQ ID NO: 656642 - DNA, 13 bp, D. melanogaster
tggaattggatat

SEQ ID NO: 656643 - DNA, 13 bp, D. melanogaster
tggaattgtattt

SEQ ID NO: 656644 - DNA, 13 bp, D. melanogaster
tggaattgttgga

SEQ ID NO: 656645 - DNA, 13 bp, D. melanogaster
tggaatttaaatt

SEQ ID NO: 656646 - DNA, 13 bp, D. melanogaster
tggaatttaattt

SEQ ID NO: 656647 - DNA, 13 bp, D. melanogaster
tggaatttacatt

SEQ ID NO: 656648 - DNA, 13 bp, D. melanogaster
tggaatttataaa

SEQ ID NO: 656649 - DNA, 13 bp, D. melanogaster
tggaatttcactt

SEQ ID NO: 656650 - DNA, 13 bp, D. melanogaster
tggaatttcgttt

SEQ ID NO: 656651 - DNA, 13 bp, D. melanogaster
tggaatttgattt

SEQ ID NO: 656652 - DNA, 13 bp, D. melanogaster
tggaatttgcatt

SEQ ID NO: 656653 - DNA, 13 bp, D. melanogaster
tggaattttaaat

SEQ ID NO: 656654 - DNA, 13 bp, D. melanogaster
tggaattttaatt

SEQ ID NO: 656655 - DNA, 13 bp, D. melanogaster
tggaattttcaaa

SEQ ID NO: 656656 - DNA, 13 bp, D. melanogaster
tggaattttcaca

SEQ ID NO: 656657 - DNA, 13 bp, D. melanogaster
tggaattttcatt

SEQ ID NO: 656658 - DNA, 14 bp, D. melanogaster
tggaattttgtcaa

SEQ ID NO: 656659 - DNA, 13 bp, D. melanogaster
tggaatttttaat

SEQ ID NO: 656660 - DNA, 13 bp, D. melanogaster
tggaatttttatg

SEQ ID NO: 656661 - DNA, 13 bp, D. melanogaster
tggacaaattttt

SEQ ID NO: 656662 - DNA, 13 bp, D. melanogaster
tggacaacaaatt

SEQ ID NO: 656663 - DNA, 13 bp, D. melanogaster
tggacaactattt

SEQ ID NO: 656664 - DNA, 13 bp, D. melanogaster
tggacaactgcgg

SEQ ID NO: 656665 - DNA, 13 bp, D. melanogaster
tggacaaggctaa

SEQ ID NO: 656666 - DNA, 13 bp, D. melanogaster
tggacaataatta

SEQ ID NO: 656667 - DNA, 13 bp, D. melanogaster
tggacaatccgct

SEQ ID NO: 656668 - DNA, 13 bp, D. melanogaster
tggacaattattt

SEQ ID NO: 656669 - DNA, 13 bp, D. melanogaster
tggacactggaca

SEQ ID NO: 656670 - DNA, 13 bp, D. melanogaster
tggacagactgac

SEQ ID NO: 656671 - DNA, 13 bp, D. melanogaster
tggacagtggaca

SEQ ID NO: 656672 - DNA, 13 bp, D. melanogaster
tggacatcttttc

SEQ ID NO: 656673 - DNA, 13 bp, D. melanogaster
tggacatgtgtac

SEQ ID NO: 656674 - DNA, 13 bp, D. melanogaster
tggacattcccga

SEQ ID NO: 656675 - DNA, 13 bp, D. melanogaster
tggaccaacttgg

SEQ ID NO: 656676 - DNA, 13 bp, D. melanogaster
tggaccaattgtg

SEQ ID NO: 656677 - DNA, 13 bp, D. melanogaster
tggaccaatttat

SEQ ID NO: 656678 - DNA, 13 bp, D. melanogaster
tggaccgattcaa

SEQ ID NO: 656679 - DNA, 13 bp, D. melanogaster
tggacctacttaa

SEQ ID NO: 656680 - DNA, 13 bp, D. melanogaster
tggacgaaattct

SEQ ID NO: 656681 - DNA, 13 bp, D. melanogaster
tggacgaactatt

SEQ ID NO: 656682 - DNA, 13 bp, D. melanogaster
tggacgatggacg

SEQ ID NO: 656683 - DNA, 13 bp, D. melanogaster
tggacggacaaat

SEQ ID NO: 656684 - DNA, 13 bp, D. melanogaster
tggacggacggac

SEQ ID NO: 656685 - DNA, 14 bp, D. melanogaster
tggacgtggatgtg

SEQ ID NO: 656686 - DNA, 13 bp, D. melanogaster
tggacgtggcaaa

SEQ ID NO: 656687 - DNA, 13 bp, D. melanogaster
tggacgtgggcaa

SEQ ID NO: 656688 - DNA, 14 bp, D. melanogaster
tggacgttgatttc

SEQ ID NO: 656689 - DNA, 13 bp, D. melanogaster
tggactctacagc

SEQ ID NO: 656690 - DNA, 13 bp, D. melanogaster
tggactctggact

SEQ ID NO: 656691 - DNA, 13 bp, D. melanogaster
tggactgaaagcg

SEQ ID NO: 656692 - DNA, 13 bp, D. melanogaster
tggactggactgg

SEQ ID NO: 656693 - DNA, 14 bp, D. melanogaster
tggactggactgga

SEQ ID NO: 656694 - DNA, 14 bp, D. melanogaster
tggactgggaaaag

SEQ ID NO: 656695 - DNA, 13 bp, D. melanogaster
tggacttaatatt

SEQ ID NO: 656696 - DNA, 13 bp, D. melanogaster
tggacttctactt

SEQ ID NO: 656697 - DNA, 13 bp, D. melanogaster
tggacttggactc

SEQ ID NO: 656698 - DNA, 14 bp, D. melanogaster
tggacttggacttg

SEQ ID NO: 656699 - DNA, 13 bp, D. melanogaster
tggacttggccaa

SEQ ID NO: 656700 - DNA, 13 bp, D. melanogaster
tggacttgtaaat

SEQ ID NO: 656701 - DNA, 13 bp, D. melanogaster
tggactttggact

SEQ ID NO: 656702 - DNA, 14 bp, D. melanogaster
tggagaaaaaacta

SEQ ID NO: 656703 - DNA, 13 bp, D. melanogaster
tggagaaaagcgg

SEQ ID NO: 656704 - DNA, 13 bp, D. melanogaster
tggagaaaatgca

SEQ ID NO: 656705 - DNA, 13 bp, D. melanogaster
tggagaaactgac

SEQ ID NO: 656706 - DNA, 13 bp, D. melanogaster
tggagaaataaat

SEQ ID NO: 656707 - DNA, 13 bp, D. melanogaster
tggagaaatattt

SEQ ID NO: 656708 - DNA, 13 bp, D. melanogaster
tggagaaattcaa

SEQ ID NO: 656709 - DNA, 13 bp, D. melanogaster
tggagaaattctc

SEQ ID NO: 656710 - DNA, 13 bp, D. melanogaster
tggagaaattgat

SEQ ID NO: 656711 - DNA, 14 bp, D. melanogaster
tggagaaattgatc

SEQ ID NO: 656712 - DNA, 13 bp, D. melanogaster
tggagaacttcag

SEQ ID NO: 656713 - DNA, 13 bp, D. melanogaster
tggagaagaagta

SEQ ID NO: 656714 - DNA, 13 bp, D. melanogaster
tggagaatgcagt

SEQ ID NO: 656715 - DNA, 13 bp, D. melanogaster
tggagaccgtaga

SEQ ID NO: 656716 - DNA, 13 bp, D. melanogaster
tggagactgaatt

SEQ ID NO: 656717 - DNA, 13 bp, D. melanogaster
tggagaggattag

SEQ ID NO: 656718 - DNA, 13 bp, D. melanogaster
tggagatccagct

SEQ ID NO: 656719 - DNA, 13 bp, D. melanogaster
tggagatctccac

SEQ ID NO: 656720 - DNA, 14 bp, D. melanogaster
tggagatgaagatg

SEQ ID NO: 656721 - DNA, 14 bp, D. melanogaster
tggagatggagatg

SEQ ID NO: 656722 - DNA, 13 bp, D. melanogaster
tggagcaaacaaa

SEQ ID NO: 656723 - DNA, 14 bp, D. melanogaster
tggagcaacaacaa

SEQ ID NO: 656724 - DNA, 13 bp, D. melanogaster
tggagcaatgcca

SEQ ID NO: 656725 - DNA, 13 bp, D. melanogaster
tggagcacacaca

SEQ ID NO: 656726 - DNA, 13 bp, D. melanogaster
tggagcacgccaa

SEQ ID NO: 656727 - DNA, 13 bp, D. melanogaster
tggagcagaaaaa

SEQ ID NO: 656728 - DNA, 13 bp, D. melanogaster
tggagcagcagca

SEQ ID NO: 656729 - DNA, 13 bp, D. melanogaster
tggagcaggagca

SEQ ID NO: 656730 - DNA, 14 bp, D. melanogaster
tggagcaggagcag

SEQ ID NO: 656731 - DNA, 13 bp, D. melanogaster
tggagcagtgcat

SEQ ID NO: 656732 - DNA, 13 bp, D. melanogaster
tggagcatggagc

SEQ ID NO: 656733 - DNA, 14 bp, D. melanogaster
tggagcatggagca

SEQ ID NO: 656734 - DNA, 13 bp, D. melanogaster
tggagcattggag

SEQ ID NO: 656735 - DNA, 13 bp, D. melanogaster
tggagcgccacag

SEQ ID NO: 656736 - DNA, 13 bp, D. melanogaster
tggagcgccgtgg

SEQ ID NO: 656737 - DNA, 13 bp, D. melanogaster
tggagcgcctgca

SEQ ID NO: 656738 - DNA, 13 bp, D. melanogaster
tggagctaacttc

SEQ ID NO: 656739 - DNA, 13 bp, D. melanogaster
tggagctgcaatg

SEQ ID NO: 656740 - DNA, 13 bp, D. melanogaster
tggagctgcactg

SEQ ID NO: 656741 - DNA, 13 bp, D. melanogaster
tggagctgcagct

SEQ ID NO: 656742 - DNA, 13 bp, D. melanogaster
tggagctgctgct

SEQ ID NO: 656743 - DNA, 13 bp, D. melanogaster
tggagctggagat

SEQ ID NO: 656744 - DNA, 14 bp, D. melanogaster
tggagctggagatg

SEQ ID NO: 656745 - DNA, 14 bp, D. melanogaster
tggagctggagcag

SEQ ID NO: 656746 - DNA, 13 bp, D. melanogaster
tggagctggagcc

SEQ ID NO: 656747 - DNA, 14 bp, D. melanogaster
tggagctggagctg

SEQ ID NO: 656748 - DNA, 15 bp, D. melanogaster
tggagctggagctgg

SEQ ID NO: 656749 - DNA, 13 bp, D. melanogaster
tggagcttggagc

SEQ ID NO: 656750 - DNA, 13 bp, D. melanogaster
tggaggagcagca

SEQ ID NO: 656751 - DNA, 13 bp, D. melanogaster
tggaggagcagga

SEQ ID NO: 656752 - DNA, 13 bp, D. melanogaster
tggaggagccgca

SEQ ID NO: 656753 - DNA, 13 bp, D. melanogaster
tggaggaggctag

SEQ ID NO: 656754 - DNA, 13 bp, D. melanogaster
tggaggcactgga

SEQ ID NO: 656755 - DNA, 14 bp, D. melanogaster
tggaggcactggaa

SEQ ID NO: 656756 - DNA, 13 bp, D. melanogaster
tggaggcggtgga

SEQ ID NO: 656757 - DNA, 13 bp, D. melanogaster
tggaggctttgaa

SEQ ID NO: 656758 - DNA, 13 bp, D. melanogaster
tggaggtagcggg

SEQ ID NO: 656759 - DNA, 13 bp, D. melanogaster
tggaggtggaaaa

SEQ ID NO: 656760 - DNA, 14 bp, D. melanogaster
tggaggtggagatg

SEQ ID NO: 656761 - DNA, 13 bp, D. melanogaster
tggagtagtagaa

SEQ ID NO: 656762 - DNA, 13 bp, D. melanogaster
tggagtatcttcc

SEQ ID NO: 656763 - DNA, 13 bp, D. melanogaster
tggagtccacaat

SEQ ID NO: 656764 - DNA, 13 bp, D. melanogaster
tggagtgcttacg

SEQ ID NO: 656765 - DNA, 14 bp, D. melanogaster
tggagtggagtgaa

SEQ ID NO: 656766 - DNA, 13 bp, D. melanogaster
tggagtggagtgc

SEQ ID NO: 656767 - DNA, 13 bp, D. melanogaster
tggagtgggaaaa

SEQ ID NO: 656768 - DNA, 13 bp, D. melanogaster
tggagtgggcgtg

SEQ ID NO: 656769 - DNA, 14 bp, D. melanogaster
tggagtgggcgtgg

SEQ ID NO: 656770 - DNA, 14 bp, D. melanogaster
tggagttacgagac

SEQ ID NO: 656771 - DNA, 13 bp, D. melanogaster
tggagttataaaa

SEQ ID NO: 656772 - DNA, 15 bp, D. melanogaster
tggagttccaccaaa

SEQ ID NO: 656773 - DNA, 13 bp, D. melanogaster
tggagttcctcaa

SEQ ID NO: 656774 - DNA, 14 bp, D. melanogaster
tggagttggagctg

SEQ ID NO: 656775 - DNA, 13 bp, D. melanogaster
tggagttggagtc

SEQ ID NO: 656776 - DNA, 13 bp, D. melanogaster
tggagttggagtt

SEQ ID NO: 656777 - DNA, 14 bp, D. melanogaster
tggagttggagttg

SEQ ID NO: 656778 - DNA, 13 bp, D. melanogaster
tggagtttggagt

SEQ ID NO: 656779 - DNA, 14 bp, D. melanogaster
tggagtttgtaaat

SEQ ID NO: 656780 - DNA, 13 bp, D. melanogaster
tggagttttgtca

SEQ ID NO: 656781 - DNA, 13 bp, D. melanogaster
tggagttttgtta

SEQ ID NO: 656782 - DNA, 14 bp, D. melanogaster
tggataaacagaaa

SEQ ID NO: 656783 - DNA, 13 bp, D. melanogaster
tggataaatgcga

SEQ ID NO: 656784 - DNA, 13 bp, D. melanogaster
tggatacaacccc

SEQ ID NO: 656785 - DNA, 13 bp, D. melanogaster
tggatacatgatt

SEQ ID NO: 656786 - DNA, 13 bp, D. melanogaster
tggatacggatac

SEQ ID NO: 656787 - DNA, 13 bp, D. melanogaster
tggataggaaaaa

SEQ ID NO: 656788 - DNA, 13 bp, D. melanogaster
tggatagtggata

SEQ ID NO: 656789 - DNA, 13 bp, D. melanogaster
tggatatacatat

SEQ ID NO: 656790 - DNA, 13 bp, D. melanogaster
tggatatataaat

SEQ ID NO: 656791 - DNA, 13 bp, D. melanogaster
tggatatataata

SEQ ID NO: 656792 - DNA, 13 bp, D. melanogaster
tggatatatggat

SEQ ID NO: 656793 - DNA, 13 bp, D. melanogaster
tggatatatgtac

SEQ ID NO: 656794 - DNA, 13 bp, D. melanogaster
tggatatatgtat

SEQ ID NO: 656795 - DNA, 13 bp, D. melanogaster
tggatatggaaat

SEQ ID NO: 656796 - DNA, 13 bp, D. melanogaster
tggatatggatat

SEQ ID NO: 656797 - DNA, 13 bp, D. melanogaster
tggatatggatgc

SEQ ID NO: 656798 - DNA, 14 bp, D. melanogaster
tggatatggatgtg

SEQ ID NO: 656799 - DNA, 13 bp, D. melanogaster
tggatcaggtagt

SEQ ID NO: 656800 - DNA, 13 bp, D. melanogaster
tggatcatgcgga

SEQ ID NO: 656801 - DNA, 13 bp, D. melanogaster
tggatcgctacat

SEQ ID NO: 656802 - DNA, 13 bp, D. melanogaster
tggatctggatct

SEQ ID NO: 656803 - DNA, 13 bp, D. melanogaster
tggatctgtcgca

SEQ ID NO: 656804 - DNA, 13 bp, D. melanogaster
tggatctgttgca

SEQ ID NO: 656805 - DNA, 13 bp, D. melanogaster
tggatgaagatga

SEQ ID NO: 656806 - DNA, 13 bp, D. melanogaster
tggatgaattttt

SEQ ID NO: 656807 - DNA, 13 bp, D. melanogaster
tggatgatattat

SEQ ID NO: 656808 - DNA, 14 bp, D. melanogaster
tggatgatattata

SEQ ID NO: 656809 - DNA, 13 bp, D. melanogaster
tggatgcagcgat

SEQ ID NO: 656810 - DNA, 13 bp, D. melanogaster
tggatgcataagc

SEQ ID NO: 656811 - DNA, 13 bp, D. melanogaster
tggatgcgaatgc

SEQ ID NO: 656812 - DNA, 13 bp, D. melanogaster
tggatgcggatgg

SEQ ID NO: 656813 - DNA, 14 bp, D. melanogaster
tggatgcggatgtg

SEQ ID NO: 656814 - DNA, 13 bp, D. melanogaster
tggatgctggatg

SEQ ID NO: 656815 - DNA, 13 bp, D. melanogaster
tggatggaaaatg

SEQ ID NO: 656816 - DNA, 13 bp, D. melanogaster
tggatggatgatg

SEQ ID NO: 656817 - DNA, 14 bp, D. melanogaster
tggatggatggatg

SEQ ID NO: 656818 - DNA, 13 bp, D. melanogaster
tggatggatggca

SEQ ID NO: 656819 - DNA, 13 bp, D. melanogaster
tggatggatggct

SEQ ID NO: 656820 - DNA, 13 bp, D. melanogaster
tggatggattgga

SEQ ID NO: 656821 - DNA, 13 bp, D. melanogaster
tggatggctggct

SEQ ID NO: 656822 - DNA, 13 bp, D. melanogaster
tggatggttggat

SEQ ID NO: 656823 - DNA, 13 bp, D. melanogaster
tggatgtaatttt

SEQ ID NO: 656824 - DNA, 13 bp, D. melanogaster
tggatgtctcacc

SEQ ID NO: 656825 - DNA, 13 bp, D. melanogaster
tggatgtgaatgt

SEQ ID NO: 656826 - DNA, 13 bp, D. melanogaster
tggatgtgcatgt

SEQ ID NO: 656827 - DNA, 14 bp, D. melanogaster
tggatgtggaaatg

SEQ ID NO: 656828 - DNA, 14 bp, D. melanogaster
tggatgtggaagtg

SEQ ID NO: 656829 - DNA, 13 bp, D. melanogaster
tggatgtggacgt

SEQ ID NO: 656830 - DNA, 16 bp, D. melanogaster
tggatgtggatgcgga

SEQ ID NO: 656831 - DNA, 13 bp, D. melanogaster
tggatgtggatgg

SEQ ID NO: 656832 - DNA, 13 bp, D. melanogaster
tggatgtggattg

SEQ ID NO: 656833 - DNA, 13 bp, D. melanogaster
tggatgtggattt

SEQ ID NO: 656834 - DNA, 13 bp, D. melanogaster
tggatgtggctgt

SEQ ID NO: 656835 - DNA, 13 bp, D. melanogaster
tggatgttgatgt

SEQ ID NO: 656836 - DNA, 13 bp, D. melanogaster
tggatgttgctgc

SEQ ID NO: 656837 - DNA, 13 bp, D. melanogaster
tggatgttggatg

SEQ ID NO: 656838 - DNA, 13 bp, D. melanogaster
tggatgttgtgta

SEQ ID NO: 656839 - DNA, 13 bp, D. melanogaster
tggatgttttaat

SEQ ID NO: 656840 - DNA, 13 bp, D. melanogaster
tggatgttttcac

SEQ ID NO: 656841 - DNA, 13 bp, D. melanogaster
tggattaattcaa

SEQ ID NO: 656842 - DNA, 13 bp, D. melanogaster
tggattacaatta

SEQ ID NO: 656843 - DNA, 15 bp, D. melanogaster
tggattacgtaattt

SEQ ID NO: 656844 - DNA, 13 bp, D. melanogaster
tggattatgacct

SEQ ID NO: 656845 - DNA, 13 bp, D. melanogaster
tggattcattatt

SEQ ID NO: 656846 - DNA, 13 bp, D. melanogaster
tggattccatcag

SEQ ID NO: 656847 - DNA, 13 bp, D. melanogaster
tggattccatttt

SEQ ID NO: 656848 - DNA, 13 bp, D. melanogaster
tggattcgattgg

SEQ ID NO: 656849 - DNA, 14 bp, D. melanogaster
tggattcggattcg

SEQ ID NO: 656850 - DNA, 13 bp, D. melanogaster
tggattctaaatt

SEQ ID NO: 656851 - DNA, 13 bp, D. melanogaster
tggattctgattg

SEQ ID NO: 656852 - DNA, 13 bp, D. melanogaster
tggattggagtgg

SEQ ID NO: 656853 - DNA, 14 bp, D. melanogaster
tggattggagtgga

SEQ ID NO: 656854 - DNA, 13 bp, D. melanogaster
tggattggatgga

SEQ ID NO: 656855 - DNA, 13 bp, D. melanogaster
tggattggattcg

SEQ ID NO: 656856 - DNA, 13 bp, D. melanogaster
tggattggattga

SEQ ID NO: 656857 - DNA, 13 bp, D. melanogaster
tggattggattgg

SEQ ID NO: 656858 - DNA, 14 bp, D. melanogaster
tggattggattggc

SEQ ID NO: 656859 - DNA, 14 bp, D. melanogaster
tggattggattggg

SEQ ID NO: 656860 - DNA, 13 bp, D. melanogaster
tggattgggtgcc

SEQ ID NO: 656861 - DNA, 13 bp, D. melanogaster
tggattgttttcc

SEQ ID NO: 656862 - DNA, 13 bp, D. melanogaster
tggatttaattat

SEQ ID NO: 656863 - DNA, 13 bp, D. melanogaster
tggatttagaaga

SEQ ID NO: 656864 - DNA, 13 bp, D. melanogaster
tggatttatatat

SEQ ID NO: 656865 - DNA, 13 bp, D. melanogaster
tggatttcaaatt

SEQ ID NO: 656866 - DNA, 13 bp, D. melanogaster
tggatttcaagct

SEQ ID NO: 656867 - DNA, 13 bp, D. melanogaster
tggatttccaagt

SEQ ID NO: 656868 - DNA, 13 bp, D. melanogaster
tggatttcgaatt

SEQ ID NO: 656869 - DNA, 13 bp, D. melanogaster
tggatttcggttt

SEQ ID NO: 656870 - DNA, 13 bp, D. melanogaster
tggatttctattt

SEQ ID NO: 656871 - DNA, 13 bp, D. melanogaster
tggatttgaaatt

SEQ ID NO: 656872 - DNA, 13 bp, D. melanogaster
tggatttgaattt

SEQ ID NO: 656873 - DNA, 13 bp, D. melanogaster
tggatttggattc

SEQ ID NO: 656874 - DNA, 14 bp, D. melanogaster
tggatttggattcg

SEQ ID NO: 656875 - DNA, 13 bp, D. melanogaster
tggatttggattt

SEQ ID NO: 656876 - DNA, 14 bp, D. melanogaster
tggatttggatttg

SEQ ID NO: 656877 - DNA, 13 bp, D. melanogaster
tggattttaaaat

SEQ ID NO: 656878 - DNA, 13 bp, D. melanogaster
tggattttattaa

SEQ ID NO: 656879 - DNA, 13 bp, D. melanogaster
tggattttctttc

SEQ ID NO: 656880 - DNA, 13 bp, D. melanogaster
tggatttttcatt

SEQ ID NO: 656881 - DNA, 13 bp, D. melanogaster
tggatttttccaa

SEQ ID NO: 656882 - DNA, 13 bp, D. melanogaster
tggatttttggat

SEQ ID NO: 656883 - DNA, 13 bp, D. melanogaster
tggattttttcca

SEQ ID NO: 656884 - DNA, 14 bp, D. melanogaster
tggcaaaaaaaaag

SEQ ID NO: 656885 - DNA, 14 bp, D. melanogaster
tggcaaaaaaaaat

SEQ ID NO: 656886 - DNA, 13 bp, D. melanogaster
tggcaaaaaaatt

SEQ ID NO: 656887 - DNA, 13 bp, D. melanogaster
tggcaaaaacaat

SEQ ID NO: 656888 - DNA, 13 bp, D. melanogaster
tggcaaaaacaca

SEQ ID NO: 656889 - DNA, 13 bp, D. melanogaster
tggcaaaaaccaa

SEQ ID NO: 656890 - DNA, 13 bp, D. melanogaster
tggcaaaaactat

SEQ ID NO: 656891 - DNA, 13 bp, D. melanogaster
tggcaaaaagcga

SEQ ID NO: 656892 - DNA, 13 bp, D. melanogaster
tggcaaaaaggaa

SEQ ID NO: 656893 - DNA, 13 bp, D. melanogaster
tggcaaaaaggca

SEQ ID NO: 656894 - DNA, 13 bp, D. melanogaster
tggcaaaaagggg

SEQ ID NO: 656895 - DNA, 13 bp, D. melanogaster
tggcaaaaagtaa

SEQ ID NO: 656896 - DNA, 13 bp, D. melanogaster
tggcaaaaagtgc

SEQ ID NO: 656897 - DNA, 13 bp, D. melanogaster
tggcaaaaagtgt

SEQ ID NO: 656898 - DNA, 13 bp, D. melanogaster
tggcaaaaagttt

SEQ ID NO: 656899 - DNA, 14 bp, D. melanogaster
tggcaaaaataaaa

SEQ ID NO: 656900 - DNA, 13 bp, D. melanogaster
tggcaaaaataat

SEQ ID NO: 656901 - DNA, 13 bp, D. melanogaster
tggcaaaaatata

SEQ ID NO: 656902 - DNA, 13 bp, D. melanogaster
tggcaaaaatcca

SEQ ID NO: 656903 - DNA, 13 bp, D. melanogaster
tggcaaaaatgaa

SEQ ID NO: 656904 - DNA, 13 bp, D. melanogaster
tggcaaaaatgca

SEQ ID NO: 656905 - DNA, 13 bp, D. melanogaster
tggcaaaaatgtt

SEQ ID NO: 656906 - DNA, 13 bp, D. melanogaster
tggcaaaaattaa

SEQ ID NO: 656907 - DNA, 13 bp, D. melanogaster
tggcaaaacaaaa

SEQ ID NO: 656908 - DNA, 14 bp, D. melanogaster
tggcaaaacaaaaa

SEQ ID NO: 656909 - DNA, 13 bp, D. melanogaster
tggcaaaacaaac

SEQ ID NO: 656910 - DNA, 13 bp, D. melanogaster
tggcaaaacaaat

SEQ ID NO: 656911 - DNA, 14 bp, D. melanogaster
tggcaaaacaataa

SEQ ID NO: 656912 - DNA, 13 bp, D. melanogaster
tggcaaaacgggc

SEQ ID NO: 656913 - DNA, 13 bp, D. melanogaster
tggcaaaactcaa

SEQ ID NO: 656914 - DNA, 13 bp, D. melanogaster
tggcaaaactttt

SEQ ID NO: 656915 - DNA, 13 bp, D. melanogaster
tggcaaaagaaaa

SEQ ID NO: 656916 - DNA, 13 bp, D. melanogaster
tggcaaaagccaa

SEQ ID NO: 656917 - DNA, 13 bp, D. melanogaster
tggcaaaaggaaa

SEQ ID NO: 656918 - DNA, 13 bp, D. melanogaster
tggcaaaaggcaa

SEQ ID NO: 656919 - DNA, 13 bp, D. melanogaster
tggcaaaagtatt

SEQ ID NO: 656920 - DNA, 13 bp, D. melanogaster
tggcaaaagtggt

SEQ ID NO: 656921 - DNA, 13 bp, D. melanogaster
tggcaaaagttgc

SEQ ID NO: 656922 - DNA, 13 bp, D. melanogaster
tggcaaaagtttt

SEQ ID NO: 656923 - DNA, 13 bp, D. melanogaster
tggcaaaataaat

SEQ ID NO: 656924 - DNA, 13 bp, D. melanogaster
tggcaaaataata

SEQ ID NO: 656925 - DNA, 13 bp, D. melanogaster
tggcaaaatatat

SEQ ID NO: 656926 - DNA, 13 bp, D. melanogaster
tggcaaaatattt

SEQ ID NO: 656927 - DNA, 14 bp, D. melanogaster
tggcaaaatatttg

SEQ ID NO: 656928 - DNA, 14 bp, D. melanogaster
tggcaaaatgcaaa

SEQ ID NO: 656929 - DNA, 13 bp, D. melanogaster
tggcaaaatgcat

SEQ ID NO: 656930 - DNA, 13 bp, D. melanogaster
tggcaaaatgctg

SEQ ID NO: 656931 - DNA, 13 bp, D. melanogaster
tggcaaaatggca

SEQ ID NO: 656932 - DNA, 13 bp, D. melanogaster
tggcaaaatgtaa

SEQ ID NO: 656933 - DNA, 13 bp, D. melanogaster
tggcaaaatgtat

SEQ ID NO: 656934 - DNA, 13 bp, D. melanogaster
tggcaaaatgttg

SEQ ID NO: 656935 - DNA, 13 bp, D. melanogaster
tggcaaaatgttt

SEQ ID NO: 656936 - DNA, 14 bp, D. melanogaster
tggcaaaatgtttt

SEQ ID NO: 656937 - DNA, 13 bp, D. melanogaster
tggcaaaattatt

SEQ ID NO: 656938 - DNA, 14 bp, D. melanogaster
tggcaaaattattt

SEQ ID NO: 656939 - DNA, 13 bp, D. melanogaster
tggcaaaattgtt

SEQ ID NO: 656940 - DNA, 13 bp, D. melanogaster
tggcaaacaaagc

SEQ ID NO: 656941 - DNA, 13 bp, D. melanogaster
tggcaaacaaatg

SEQ ID NO: 656942 - DNA, 14 bp, D. melanogaster
tggcaaacaaattt

SEQ ID NO: 656943 - DNA, 13 bp, D. melanogaster
tggcaaacaacaa

SEQ ID NO: 656944 - DNA, 13 bp, D. melanogaster
tggcaaacaagaa

SEQ ID NO: 656945 - DNA, 13 bp, D. melanogaster
tggcaaacaattt

SEQ ID NO: 656946 - DNA, 13 bp, D. melanogaster
tggcaaacacaca

SEQ ID NO: 656947 - DNA, 13 bp, D. melanogaster
tggcaaacacttg

SEQ ID NO: 656948 - DNA, 13 bp, D. melanogaster
tggcaaacagcaa

SEQ ID NO: 656949 - DNA, 13 bp, D. melanogaster
tggcaaacagttt

SEQ ID NO: 656950 - DNA, 13 bp, D. melanogaster
tggcaaacatatt

SEQ ID NO: 656951 - DNA, 13 bp, D. melanogaster
tggcaaacgcagc

SEQ ID NO: 656952 - DNA, 13 bp, D. melanogaster
tggcaaacggaaa

SEQ ID NO: 656953 - DNA, 13 bp, D. melanogaster
tggcaaacggaag

SEQ ID NO: 656954 - DNA, 13 bp, D. melanogaster
tggcaaactaaaa

SEQ ID NO: 656955 - DNA, 14 bp, D. melanogaster
tggcaaactggcaa

SEQ ID NO: 656956 - DNA, 13 bp, D. melanogaster
tggcaaactggtt

SEQ ID NO: 656957 - DNA, 13 bp, D. melanogaster
tggcaaactgttt

SEQ ID NO: 656958 - DNA, 13 bp, D. melanogaster
tggcaaacttgct

SEQ ID NO: 656959 - DNA, 13 bp, D. melanogaster
tggcaaagaaaaa

SEQ ID NO: 656960 - DNA, 14 bp, D. melanogaster
tggcaaagaaaaat

SEQ ID NO: 656961 - DNA, 13 bp, D. melanogaster
tggcaaagaaatg

SEQ ID NO: 656962 - DNA, 13 bp, D. melanogaster
tggcaaagaaatt

SEQ ID NO: 656963 - DNA, 13 bp, D. melanogaster
tggcaaagagaaa

SEQ ID NO: 656964 - DNA, 13 bp, D. melanogaster
tggcaaagcaaaa

SEQ ID NO: 656965 - DNA, 13 bp, D. melanogaster
tggcaaagctttt

SEQ ID NO: 656966 - DNA, 13 bp, D. melanogaster
tggcaaagggaaa

SEQ ID NO: 656967 - DNA, 13 bp, D. melanogaster
tggcaaagggggc

SEQ ID NO: 656968 - DNA, 13 bp, D. melanogaster
tggcaaagtaatt

SEQ ID NO: 656969 - DNA, 13 bp, D. melanogaster
tggcaaagtattt

SEQ ID NO: 656970 - DNA, 13 bp, D. melanogaster
tggcaaagtcaat

SEQ ID NO: 656971 - DNA, 13 bp, D. melanogaster
tggcaaagtggca

SEQ ID NO: 656972 - DNA, 13 bp, D. melanogaster
tggcaaagtgttt

SEQ ID NO: 656973 - DNA, 13 bp, D. melanogaster
tggcaaagtttat

SEQ ID NO: 656974 - DNA, 13 bp, D. melanogaster
tggcaaagtttgc

SEQ ID NO: 656975 - DNA, 13 bp, D. melanogaster
tggcaaagttttt

SEQ ID NO: 656976 - DNA, 14 bp, D. melanogaster
tggcaaagtttttg

SEQ ID NO: 656977 - DNA, 13 bp, D. melanogaster
tggcaaataaaaa

SEQ ID NO: 656978 - DNA, 14 bp, D. melanogaster
tggcaaataaaaaa

SEQ ID NO: 656979 - DNA, 14 bp, D. melanogaster
tggcaaataaaaca

SEQ ID NO: 656980 - DNA, 13 bp, D. melanogaster
tggcaaataaaca

SEQ ID NO: 656981 - DNA, 13 bp, D. melanogaster
tggcaaataaact

SEQ ID NO: 656982 - DNA, 13 bp, D. melanogaster
tggcaaataataa

SEQ ID NO: 656983 - DNA, 13 bp, D. melanogaster
tggcaaataatga

SEQ ID NO: 656984 - DNA, 13 bp, D. melanogaster
tggcaaatacata

SEQ ID NO: 656985 - DNA, 13 bp, D. melanogaster
tggcaaatagaaa

SEQ ID NO: 656986 - DNA, 13 bp, D. melanogaster
tggcaaatagttt

SEQ ID NO: 656987 - DNA, 13 bp, D. melanogaster
tggcaaatatata

SEQ ID NO: 656988 - DNA, 14 bp, D. melanogaster
tggcaaatatatat

SEQ ID NO: 656989 - DNA, 13 bp, D. melanogaster
tggcaaatatttt

SEQ ID NO: 656990 - DNA, 13 bp, D. melanogaster
tggcaaatcaaat

SEQ ID NO: 656991 - DNA, 13 bp, D. melanogaster
tggcaaatcaata

SEQ ID NO: 656992 - DNA, 13 bp, D. melanogaster
tggcaaatcaatt

SEQ ID NO: 656993 - DNA, 13 bp, D. melanogaster
tggcaaatccaat

SEQ ID NO: 656994 - DNA, 13 bp, D. melanogaster
tggcaaatcgaaa

SEQ ID NO: 656995 - DNA, 13 bp, D. melanogaster
tggcaaatcgata

SEQ ID NO: 656996 - DNA, 13 bp, D. melanogaster
tggcaaatgaaat

SEQ ID NO: 656997 - DNA, 13 bp, D. melanogaster
tggcaaatgaatt

SEQ ID NO: 656998 - DNA, 13 bp, D. melanogaster
tggcaaatgagtt

SEQ ID NO: 656999 - DNA, 13 bp, D. melanogaster
tggcaaatgattt

SEQ ID NO: 657000 - DNA, 13 bp, D. melanogaster
tggcaaatgcaaa

SEQ ID NO: 657001 - DNA, 14 bp, D. melanogaster
tggcaaatgcaaaa

SEQ ID NO: 657002 - DNA, 13 bp, D. melanogaster
tggcaaatgccaa

SEQ ID NO: 657003 - DNA, 13 bp, D. melanogaster
tggcaaatgcttt

SEQ ID NO: 657004 - DNA, 14 bp, D. melanogaster
tggcaaatggaaaa

SEQ ID NO: 657005 - DNA, 13 bp, D. melanogaster
tggcaaatggcaa

SEQ ID NO: 657006 - DNA, 13 bp, D. melanogaster
tggcaaatggcac

SEQ ID NO: 657007 - DNA, 13 bp, D. melanogaster
tggcaaatggcag

SEQ ID NO: 657008 - DNA, 13 bp, D. melanogaster
tggcaaatggcca

SEQ ID NO: 657009 - DNA, 13 bp, D. melanogaster
tggcaaatgtgtt

SEQ ID NO: 657010 - DNA, 13 bp, D. melanogaster
tggcaaatgttta

SEQ ID NO: 657011 - DNA, 13 bp, D. melanogaster
tggcaaatgtttt

SEQ ID NO: 657012 - DNA, 13 bp, D. melanogaster
tggcaaattaatt

SEQ ID NO: 657013 - DNA, 14 bp, D. melanogaster
tggcaaattcaatt

SEQ ID NO: 657014 - DNA, 13 bp, D. melanogaster
tggcaaattgaaa

SEQ ID NO: 657015 - DNA, 14 bp, D. melanogaster
tggcaaattgaaaa

SEQ ID NO: 657016 - DNA, 13 bp, D. melanogaster
tggcaaattgatt

SEQ ID NO: 657017 - DNA, 13 bp, D. melanogaster
tggcaaattgctc

SEQ ID NO: 657018 - DNA, 13 bp, D. melanogaster
tggcaaattgtgt

SEQ ID NO: 657019 - DNA, 13 bp, D. melanogaster
tggcaaattttca

SEQ ID NO: 657020 - DNA, 13 bp, D. melanogaster
tggcaaattttgg

SEQ ID NO: 657021 - DNA, 13 bp, D. melanogaster
tggcaacaaaaag

SEQ ID NO: 657022 - DNA, 13 bp, D. melanogaster
tggcaacaaaatg

SEQ ID NO: 657023 - DNA, 13 bp, D. melanogaster
tggcaacaaattt

SEQ ID NO: 657024 - DNA, 14 bp, D. melanogaster
tggcaacaacaaaa

SEQ ID NO: 657025 - DNA, 14 bp, D. melanogaster
tggcaacaacaaat

SEQ ID NO: 657026 - DNA, 14 bp, D. melanogaster
tggcaacaacaaca

SEQ ID NO: 657027 - DNA, 13 bp, D. melanogaster
tggcaacaacagc

SEQ ID NO: 657028 - DNA, 13 bp, D. melanogaster
tggcaacaacatt

SEQ ID NO: 657029 - DNA, 13 bp, D. melanogaster
tggcaacaacttt

SEQ ID NO: 657030 - DNA, 13 bp, D. melanogaster
tggcaacaagttg

SEQ ID NO: 657031 - DNA, 13 bp, D. melanogaster
tggcaacaagttt

SEQ ID NO: 657032 - DNA, 14 bp, D. melanogaster
tggcaacaataaca

SEQ ID NO: 657033 - DNA, 13 bp, D. melanogaster
tggcaacaataat

SEQ ID NO: 657034 - DNA, 14 bp, D. melanogaster
tggcaacaatgttg

SEQ ID NO: 657035 - DNA, 14 bp, D. melanogaster
tggcaacacacaca

SEQ ID NO: 657036 - DNA, 13 bp, D. melanogaster
tggcaacactggc

SEQ ID NO: 657037 - DNA, 13 bp, D. melanogaster
tggcaacactttc

SEQ ID NO: 657038 - DNA, 13 bp, D. melanogaster
tggcaacagaaac

SEQ ID NO: 657039 - DNA, 13 bp, D. melanogaster
tggcaacagcaaa

SEQ ID NO: 657040 - DNA, 14 bp, D. melanogaster
tggcaacagcaaca

SEQ ID NO: 657041 - DNA, 13 bp, D. melanogaster
tggcaacagcaga

SEQ ID NO: 657042 - DNA, 13 bp, D. melanogaster
tggcaacagttgg

SEQ ID NO: 657043 - DNA, 13 bp, D. melanogaster
tggcaacatggca

SEQ ID NO: 657044 - DNA, 13 bp, D. melanogaster
tggcaacatgtgt

SEQ ID NO: 657045 - DNA, 14 bp, D. melanogaster
tggcaacatgttgc

SEQ ID NO: 657046 - DNA, 13 bp, D. melanogaster
tggcaacatttca

SEQ ID NO: 657047 - DNA, 13 bp, D. melanogaster
tggcaacatttgg

SEQ ID NO: 657048 - DNA, 13 bp, D. melanogaster
tggcaacattttt

SEQ ID NO: 657049 - DNA, 13 bp, D. melanogaster
tggcaaccaaaaa

SEQ ID NO: 657050 - DNA, 13 bp, D. melanogaster
tggcaaccctggc

SEQ ID NO: 657051 - DNA, 13 bp, D. melanogaster
tggcaaccgaaaa

SEQ ID NO: 657052 - DNA, 13 bp, D. melanogaster
tggcaaccggcaa

SEQ ID NO: 657053 - DNA, 13 bp, D. melanogaster
tggcaacgaaaaa

SEQ ID NO: 657054 - DNA, 13 bp, D. melanogaster
tggcaacggcaaa

SEQ ID NO: 657055 - DNA, 13 bp, D. melanogaster
tggcaactctggc

SEQ ID NO: 657056 - DNA, 13 bp, D. melanogaster
tggcaactgaaaa

SEQ ID NO: 657057 - DNA, 13 bp, D. melanogaster
tggcaactgcaac

SEQ ID NO: 657058 - DNA, 14 bp, D. melanogaster
tggcaactgcaact

SEQ ID NO: 657059 - DNA, 13 bp, D. melanogaster
tggcaactgcagc

SEQ ID NO: 657060 - DNA, 13 bp, D. melanogaster
tggcaactgccac

SEQ ID NO: 657061 - DNA, 14 bp, D. melanogaster
tggcaactgccaca

SEQ ID NO: 657062 - DNA, 13 bp, D. melanogaster
tggcaactggcca

SEQ ID NO: 657063 - DNA, 13 bp, D. melanogaster
tggcaactgttgc

SEQ ID NO: 657064 - DNA, 14 bp, D. melanogaster
tggcaacttgcaac

SEQ ID NO: 657065 - DNA, 13 bp, D. melanogaster
tggcaacttggcc

SEQ ID NO: 657066 - DNA, 13 bp, D. melanogaster
tggcaacttttgc

SEQ ID NO: 657067 - DNA, 13 bp, D. melanogaster
tggcaagaaaaaa

SEQ ID NO: 657068 - DNA, 13 bp, D. melanogaster
tggcaagaaaaat

SEQ ID NO: 657069 - DNA, 13 bp, D. melanogaster
tggcaagaaaagt

SEQ ID NO: 657070 - DNA, 13 bp, D. melanogaster
tggcaagcaaaca

SEQ ID NO: 657071 - DNA, 13 bp, D. melanogaster
tggcaagcaaatt

SEQ ID NO: 657072 - DNA, 13 bp, D. melanogaster
tggcaagcaattt

SEQ ID NO: 657073 - DNA, 13 bp, D. melanogaster
tggcaagcatttc

SEQ ID NO: 657074 - DNA, 14 bp, D. melanogaster
tggcaagcatttca

SEQ ID NO: 657075 - DNA, 13 bp, D. melanogaster
tggcaagcggcaa

SEQ ID NO: 657076 - DNA, 13 bp, D. melanogaster
tggcaaggacatg

SEQ ID NO: 657077 - DNA, 13 bp, D. melanogaster
tggcaaggacatt

SEQ ID NO: 657078 - DNA, 13 bp, D. melanogaster
tggcaaggagcag

SEQ ID NO: 657079 - DNA, 16 bp, D. melanogaster
tggcaaggctcagaag

SEQ ID NO: 657080 - DNA, 13 bp, D. melanogaster
tggcaagtgaaaa

SEQ ID NO: 657081 - DNA, 13 bp, D. melanogaster
tggcaagtggaaa

SEQ ID NO: 657082 - DNA, 13 bp, D. melanogaster
tggcaagtggatt

SEQ ID NO: 657083 - DNA, 14 bp, D. melanogaster
tggcaagtggattc

SEQ ID NO: 657084 - DNA, 13 bp, D. melanogaster
tggcaagtggcat

SEQ ID NO: 657085 - DNA, 13 bp, D. melanogaster
tggcaagtgggcg

SEQ ID NO: 657086 - DNA, 13 bp, D. melanogaster
tggcaagtgggtg

SEQ ID NO: 657087 - DNA, 14 bp, D. melanogaster
tggcaagtgggtgg

SEQ ID NO: 657088 - DNA, 13 bp, D. melanogaster
tggcaagtgtgtg

SEQ ID NO: 657089 - DNA, 13 bp, D. melanogaster
tggcaagtgtttt

SEQ ID NO: 657090 - DNA, 13 bp, D. melanogaster
tggcaataaaaat

SEQ ID NO: 657091 - DNA, 13 bp, D. melanogaster
tggcaataaattc

SEQ ID NO: 657092 - DNA, 13 bp, D. melanogaster
tggcaataacaat

SEQ ID NO: 657093 - DNA, 13 bp, D. melanogaster
tggcaataacttt

SEQ ID NO: 657094 - DNA, 13 bp, D. melanogaster
tggcaatagcaat

SEQ ID NO: 657095 - DNA, 13 bp, D. melanogaster
tggcaatatattt

SEQ ID NO: 657096 - DNA, 13 bp, D. melanogaster
tggcaatattttt

SEQ ID NO: 657097 - DNA, 14 bp, D. melanogaster
tggcaatcaaaaaa

SEQ ID NO: 657098 - DNA, 13 bp, D. melanogaster
tggcaatcaattg

SEQ ID NO: 657099 - DNA, 13 bp, D. melanogaster
tggcaatcacagc

SEQ ID NO: 657100 - DNA, 13 bp, D. melanogaster
tggcaatcgaatg

SEQ ID NO: 657101 - DNA, 13 bp, D. melanogaster
tggcaatcgcaat

SEQ ID NO: 657102 - DNA, 13 bp, D. melanogaster
tggcaatgaaaaa

SEQ ID NO: 657103 - DNA, 13 bp, D. melanogaster
tggcaatgaaaat

SEQ ID NO: 657104 - DNA, 13 bp, D. melanogaster
tggcaatgaactt

SEQ ID NO: 657105 - DNA, 13 bp, D. melanogaster
tggcaatgagaaa

SEQ ID NO: 657106 - DNA, 13 bp, D. melanogaster
tggcaatgcaaat

SEQ ID NO: 657107 - DNA, 13 bp, D. melanogaster
tggcaatgcaatt

SEQ ID NO: 657108 - DNA, 13 bp, D. melanogaster
tggcaatgcattt

SEQ ID NO: 657109 - DNA, 13 bp, D. melanogaster
tggcaatgccaaa

SEQ ID NO: 657110 - DNA, 13 bp, D. melanogaster
tggcaatgccaat

SEQ ID NO: 657111 - DNA, 13 bp, D. melanogaster
tggcaatggaaaa

SEQ ID NO: 657112 - DNA, 13 bp, D. melanogaster
tggcaatggaaat

SEQ ID NO: 657113 - DNA, 14 bp, D. melanogaster
tggcaatggcaatg

SEQ ID NO: 657114 - DNA, 13 bp, D. melanogaster
tggcaatgggaaa

SEQ ID NO: 657115 - DNA, 13 bp, D. melanogaster
tggcaatgggtgg

SEQ ID NO: 657116 - DNA, 13 bp, D. melanogaster
tggcaatggtaat

SEQ ID NO: 657117 - DNA, 13 bp, D. melanogaster
tggcaatgtggca

SEQ ID NO: 657118 - DNA, 13 bp, D. melanogaster
tggcaatgttttt

SEQ ID NO: 657119 - DNA, 13 bp, D. melanogaster
tggcaattaaaat

SEQ ID NO: 657120 - DNA, 14 bp, D. melanogaster
tggcaattaaaatt

SEQ ID NO: 657121 - DNA, 13 bp, D. melanogaster
tggcaattaataa

SEQ ID NO: 657122 - DNA, 14 bp, D. melanogaster
tggcaattaatttg

SEQ ID NO: 657123 - DNA, 13 bp, D. melanogaster
tggcaattatgtg

SEQ ID NO: 657124 - DNA, 13 bp, D. melanogaster
tggcaattattat

SEQ ID NO: 657125 - DNA, 13 bp, D. melanogaster
tggcaattgaaaa

SEQ ID NO: 657126 - DNA, 13 bp, D. melanogaster
tggcaattgaaat

SEQ ID NO: 657127 - DNA, 14 bp, D. melanogaster
tggcaattgcaatt

SEQ ID NO: 657128 - DNA, 13 bp, D. melanogaster
tggcaattgcttt

SEQ ID NO: 657129 - DNA, 13 bp, D. melanogaster
tggcaattggcag

SEQ ID NO: 657130 - DNA, 13 bp, D. melanogaster
tggcaattggcca

SEQ ID NO: 657131 - DNA, 13 bp, D. melanogaster
tggcaatttaaag

SEQ ID NO: 657132 - DNA, 13 bp, D. melanogaster
tggcaatttataa

SEQ ID NO: 657133 - DNA, 13 bp, D. melanogaster
tggcaatttcatt

SEQ ID NO: 657134 - DNA, 13 bp, D. melanogaster
tggcaatttgcat

SEQ ID NO: 657135 - DNA, 13 bp, D. melanogaster
tggcaatttggca

SEQ ID NO: 657136 - DNA, 13 bp, D. melanogaster
tggcaatttgtgt

SEQ ID NO: 657137 - DNA, 13 bp, D. melanogaster
tggcaattttcaa

SEQ ID NO: 657138 - DNA, 13 bp, D. melanogaster
tggcaattttcca

SEQ ID NO: 657139 - DNA, 13 bp, D. melanogaster
tggcaattttcgg

SEQ ID NO: 657140 - DNA, 13 bp, D. melanogaster
tggcaattttctt

SEQ ID NO: 657141 - DNA, 13 bp, D. melanogaster
tggcaatttttca

SEQ ID NO: 657142 - DNA, 13 bp, D. melanogaster
tggcacaaaaaca

SEQ ID NO: 657143 - DNA, 13 bp, D. melanogaster
tggcacaaaaata

SEQ ID NO: 657144 - DNA, 13 bp, D. melanogaster
tggcacaaaatat

SEQ ID NO: 657145 - DNA, 13 bp, D. melanogaster
tggcacaaagaaa

SEQ ID NO: 657146 - DNA, 13 bp, D. melanogaster
tggcacaacattt

SEQ ID NO: 657147 - DNA, 13 bp, D. melanogaster
tggcacaagggtg

SEQ ID NO: 657148 - DNA, 15 bp, D. melanogaster
tggcacaataaataa

SEQ ID NO: 657149 - DNA, 13 bp, D. melanogaster
tggcacacaaaat

SEQ ID NO: 657150 - DNA, 13 bp, D. melanogaster
tggcacacaaaca

SEQ ID NO: 657151 - DNA, 13 bp, D. melanogaster
tggcacacaattt

SEQ ID NO: 657152 - DNA, 13 bp, D. melanogaster
tggcacacacaaa

SEQ ID NO: 657153 - DNA, 13 bp, D. melanogaster
tggcacacacaca

SEQ ID NO: 657154 - DNA, 13 bp, D. melanogaster
tggcacactcaca

SEQ ID NO: 657155 - DNA, 13 bp, D. melanogaster
tggcacacttctc

SEQ ID NO: 657156 - DNA, 13 bp, D. melanogaster
tggcacacttttg

SEQ ID NO: 657157 - DNA, 13 bp, D. melanogaster
tggcacagtgggc

SEQ ID NO: 657158 - DNA, 13 bp, D. melanogaster
tggcacagtggtt

SEQ ID NO: 657159 - DNA, 13 bp, D. melanogaster
tggcacatatata

SEQ ID NO: 657160 - DNA, 13 bp, D. melanogaster
tggcacatttaat

SEQ ID NO: 657161 - DNA, 13 bp, D. melanogaster
tggcaccaccccc

SEQ ID NO: 657162 - DNA, 13 bp, D. melanogaster
tggcaccgccata

SEQ ID NO: 657163 - DNA, 14 bp, D. melanogaster
tggcaccgtggaaa

SEQ ID NO: 657164 - DNA, 13 bp, D. melanogaster
tggcacctggttt

SEQ ID NO: 657165 - DNA, 13 bp, D. melanogaster
tggcacgcccact

SEQ ID NO: 657166 - DNA, 13 bp, D. melanogaster
tggcactctgccc

SEQ ID NO: 657167 - DNA, 13 bp, D. melanogaster
tggcactgaaaat

SEQ ID NO: 657168 - DNA, 13 bp, D. melanogaster
tggcactgccatt

SEQ ID NO: 657169 - DNA, 13 bp, D. melanogaster
tggcactggcact

SEQ ID NO: 657170 - DNA, 13 bp, D. melanogaster
tggcactgttaag

SEQ ID NO: 657171 - DNA, 13 bp, D. melanogaster
tggcacttgaaaa

SEQ ID NO: 657172 - DNA, 13 bp, D. melanogaster
tggcacttggcag

SEQ ID NO: 657173 - DNA, 13 bp, D. melanogaster
tggcacttggcca

SEQ ID NO: 657174 - DNA, 13 bp, D. melanogaster
tggcactttaaat

SEQ ID NO: 657175 - DNA, 13 bp, D. melanogaster
tggcactttggct

SEQ ID NO: 657176 - DNA, 13 bp, D. melanogaster
tggcacttttaat

SEQ ID NO: 657177 - DNA, 13 bp, D. melanogaster
tggcagaaaaatg

SEQ ID NO: 657178 - DNA, 13 bp, D. melanogaster
tggcagaaagaga

SEQ ID NO: 657179 - DNA, 13 bp, D. melanogaster
tggcagaaagttt

SEQ ID NO: 657180 - DNA, 14 bp, D. melanogaster
tggcagaagaagca

SEQ ID NO: 657181 - DNA, 14 bp, D. melanogaster
tggcagaatgttca

SEQ ID NO: 657182 - DNA, 13 bp, D. melanogaster
tggcagaggaaaa

SEQ ID NO: 657183 - DNA, 13 bp, D. melanogaster
tggcagatacaga

SEQ ID NO: 657184 - DNA, 13 bp, D. melanogaster
tggcagatagcca

SEQ ID NO: 657185 - DNA, 13 bp, D. melanogaster
tggcagatccctt

SEQ ID NO: 657186 - DNA, 13 bp, D. melanogaster
tggcagcaaaatg

SEQ ID NO: 657187 - DNA, 13 bp, D. melanogaster
tggcagcaaacaa

SEQ ID NO: 657188 - DNA, 13 bp, D. melanogaster
tggcagcaacaac

SEQ ID NO: 657189 - DNA, 13 bp, D. melanogaster
tggcagcaacaat

SEQ ID NO: 657190 - DNA, 13 bp, D. melanogaster
tggcagcaacttt

SEQ ID NO: 657191 - DNA, 13 bp, D. melanogaster
tggcagcaataaa

SEQ ID NO: 657192 - DNA, 13 bp, D. melanogaster
tggcagcaattaa

SEQ ID NO: 657193 - DNA, 14 bp, D. melanogaster
tggcagcaattaaa

SEQ ID NO: 657194 - DNA, 13 bp, D. melanogaster
tggcagcaatttc

SEQ ID NO: 657195 - DNA, 13 bp, D. melanogaster
tggcagcaatttg

SEQ ID NO: 657196 - DNA, 13 bp, D. melanogaster
tggcagcacaaaa

SEQ ID NO: 657197 - DNA, 13 bp, D. melanogaster
tggcagcactttg

SEQ ID NO: 657198 - DNA, 13 bp, D. melanogaster
tggcagcactttt

SEQ ID NO: 657199 - DNA, 13 bp, D. melanogaster
tggcagcagaaat

SEQ ID NO: 657200 - DNA, 13 bp, D. melanogaster
tggcagcagcaac

SEQ ID NO: 657201 - DNA, 14 bp, D. melanogaster
tggcagcagcaaca

SEQ ID NO: 657202 - DNA, 13 bp, D. melanogaster
tggcagcagcaga

SEQ ID NO: 657203 - DNA, 13 bp, D. melanogaster
tggcagcagcagc

SEQ ID NO: 657204 - DNA, 14 bp, D. melanogaster
tggcagcagcagca

SEQ ID NO: 657205 - DNA, 13 bp, D. melanogaster
tggcagcagctgc

SEQ ID NO: 657206 - DNA, 13 bp, D. melanogaster
tggcagcaggaca

SEQ ID NO: 657207 - DNA, 13 bp, D. melanogaster
tggcagcatttta

SEQ ID NO: 657208 - DNA, 13 bp, D. melanogaster
tggcagccaaaaa

SEQ ID NO: 657209 - DNA, 13 bp, D. melanogaster
tggcagccaaaca

SEQ ID NO: 657210 - DNA, 13 bp, D. melanogaster
tggcagccaaatg

SEQ ID NO: 657211 - DNA, 13 bp, D. melanogaster
tggcagccaacaa

SEQ ID NO: 657212 - DNA, 13 bp, D. melanogaster
tggcagccaagtg

SEQ ID NO: 657213 - DNA, 13 bp, D. melanogaster
tggcagccaagtt

SEQ ID NO: 657214 - DNA, 14 bp, D. melanogaster
tggcagccacaaaa

SEQ ID NO: 657215 - DNA, 13 bp, D. melanogaster
tggcagccacaga

SEQ ID NO: 657216 - DNA, 13 bp, D. melanogaster
tggcagccagcaa

SEQ ID NO: 657217 - DNA, 13 bp, D. melanogaster
tggcagccagcga

SEQ ID NO: 657218 - DNA, 13 bp, D. melanogaster
tggcagccaggat

SEQ ID NO: 657219 - DNA, 14 bp, D. melanogaster
tggcagccaggata

SEQ ID NO: 657220 - DNA, 13 bp, D. melanogaster
tggcagccattaa

SEQ ID NO: 657221 - DNA, 13 bp, D. melanogaster
tggcagccattca

SEQ ID NO: 657222 - DNA, 13 bp, D. melanogaster
tggcagccgcaaa

SEQ ID NO: 657223 - DNA, 13 bp, D. melanogaster
tggcagcgacgtc

SEQ ID NO: 657224 - DNA, 13 bp, D. melanogaster
tggcagcgctgtt

SEQ ID NO: 657225 - DNA, 13 bp, D. melanogaster
tggcagcggaaat

SEQ ID NO: 657226 - DNA, 13 bp, D. melanogaster
tggcagcggagac

SEQ ID NO: 657227 - DNA, 14 bp, D. melanogaster
tggcagcggcaaca

SEQ ID NO: 657228 - DNA, 13 bp, D. melanogaster
tggcagctgaaaa

SEQ ID NO: 657229 - DNA, 13 bp, D. melanogaster
tggcagctgcaaa

SEQ ID NO: 657230 - DNA, 13 bp, D. melanogaster
tggcagctgcaac

SEQ ID NO: 657231 - DNA, 13 bp, D. melanogaster
tggcagctgcatt

SEQ ID NO: 657232 - DNA, 13 bp, D. melanogaster
tggcagctgctgc

SEQ ID NO: 657233 - DNA, 13 bp, D. melanogaster
tggcagctgcttc

SEQ ID NO: 657234 - DNA, 13 bp, D. melanogaster
tggcagctgcttt

SEQ ID NO: 657235 - DNA, 13 bp, D. melanogaster
tggcagctggatg

SEQ ID NO: 657236 - DNA, 13 bp, D. melanogaster
tggcagctggcaa

SEQ ID NO: 657237 - DNA, 13 bp, D. melanogaster
tggcagctggtgc

SEQ ID NO: 657238 - DNA, 13 bp, D. melanogaster
tggcagctgttgc

SEQ ID NO: 657239 - DNA, 13 bp, D. melanogaster
tggcagctgttgt

SEQ ID NO: 657240 - DNA, 13 bp, D. melanogaster
tggcagctgtttt

SEQ ID NO: 657241 - DNA, 13 bp, D. melanogaster
tggcagcttattg

SEQ ID NO: 657242 - DNA, 14 bp, D. melanogaster
tggcagcttattga

SEQ ID NO: 657243 - DNA, 13 bp, D. melanogaster
tggcagcttggct

SEQ ID NO: 657244 - DNA, 13 bp, D. melanogaster
tggcaggaaaaac

SEQ ID NO: 657245 - DNA, 13 bp, D. melanogaster
tggcaggacaatg

SEQ ID NO: 657246 - DNA, 13 bp, D. melanogaster
tggcaggcaaaca

SEQ ID NO: 657247 - DNA, 13 bp, D. melanogaster
tggcaggcaaatt

SEQ ID NO: 657248 - DNA, 13 bp, D. melanogaster
tggcaggcagcag

SEQ ID NO: 657249 - DNA, 13 bp, D. melanogaster
tggcaggccaaaa

SEQ ID NO: 657250 - DNA, 13 bp, D. melanogaster
tggcaggcggcag

SEQ ID NO: 657251 - DNA, 13 bp, D. melanogaster
tggcagggcaaac

SEQ ID NO: 657252 - DNA, 13 bp, D. melanogaster
tggcaggggcagg

SEQ ID NO: 657253 - DNA, 13 bp, D. melanogaster
tggcaggtggcag

SEQ ID NO: 657254 - DNA, 13 bp, D. melanogaster
tggcagtacaaaa

SEQ ID NO: 657255 - DNA, 13 bp, D. melanogaster
tggcagtggcaaa

SEQ ID NO: 657256 - DNA, 14 bp, D. melanogaster
tggcagtggcaaaa

SEQ ID NO: 657257 - DNA, 13 bp, D. melanogaster
tggcagtggcaga

SEQ ID NO: 657258 - DNA, 13 bp, D. melanogaster
tggcagtgggcgt

SEQ ID NO: 657259 - DNA, 13 bp, D. melanogaster
tggcagtggtggc

SEQ ID NO: 657260 - DNA, 13 bp, D. melanogaster
tggcagtgttgca

SEQ ID NO: 657261 - DNA, 13 bp, D. melanogaster
tggcagttgcagc

SEQ ID NO: 657262 - DNA, 13 bp, D. melanogaster
tggcagttggaaa

SEQ ID NO: 657263 - DNA, 13 bp, D. melanogaster
tggcagttggctg

SEQ ID NO: 657264 - DNA, 13 bp, D. melanogaster
tggcagtttggca

SEQ ID NO: 657265 - DNA, 13 bp, D. melanogaster
tggcagttttgtg

SEQ ID NO: 657266 - DNA, 13 bp, D. melanogaster
tggcagtttttgg

SEQ ID NO: 657267 - DNA, 13 bp, D. melanogaster
tggcataaaaaag

SEQ ID NO: 657268 - DNA, 13 bp, D. melanogaster
tggcataaacaaa

SEQ ID NO: 657269 - DNA, 13 bp, D. melanogaster
tggcataaataaa

SEQ ID NO: 657270 - DNA, 13 bp, D. melanogaster
tggcataataaat

SEQ ID NO: 657271 - DNA, 13 bp, D. melanogaster
tggcataatcgga

SEQ ID NO: 657272 - DNA, 13 bp, D. melanogaster
tggcatacaaaat

SEQ ID NO: 657273 - DNA, 13 bp, D. melanogaster
tggcatacatatg

SEQ ID NO: 657274 - DNA, 13 bp, D. melanogaster
tggcatagaaatt

SEQ ID NO: 657275 - DNA, 13 bp, D. melanogaster
tggcatatacata

SEQ ID NO: 657276 - DNA, 15 bp, D. melanogaster
tggcatatatatata

SEQ ID NO: 657277 - DNA, 13 bp, D. melanogaster
tggcatatttata

SEQ ID NO: 657278 - DNA, 13 bp, D. melanogaster
tggcatattttgc

SEQ ID NO: 657279 - DNA, 13 bp, D. melanogaster
tggcatcatcatc

SEQ ID NO: 657280 - DNA, 13 bp, D. melanogaster
tggcatccatgtt

SEQ ID NO: 657281 - DNA, 13 bp, D. melanogaster
tggcatcctggca

SEQ ID NO: 657282 - DNA, 13 bp, D. melanogaster
tggcatcgaagct

SEQ ID NO: 657283 - DNA, 13 bp, D. melanogaster
tggcatcgatgtt

SEQ ID NO: 657284 - DNA, 13 bp, D. melanogaster
tggcatgaatggc

SEQ ID NO: 657285 - DNA, 13 bp, D. melanogaster
tggcatgcaaagc

SEQ ID NO: 657286 - DNA, 13 bp, D. melanogaster
tggcatgcaaata

SEQ ID NO: 657287 - DNA, 13 bp, D. melanogaster
tggcatgcaaatg

SEQ ID NO: 657288 - DNA, 13 bp, D. melanogaster
tggcatgcatttt

SEQ ID NO: 657289 - DNA, 13 bp, D. melanogaster
tggcatgcctttt

SEQ ID NO: 657290 - DNA, 13 bp, D. melanogaster
tggcatggaatca

SEQ ID NO: 657291 - DNA, 13 bp, D. melanogaster
tggcatggatcgc

SEQ ID NO: 657292 - DNA, 13 bp, D. melanogaster
tggcatggtatgg

SEQ ID NO: 657293 - DNA, 13 bp, D. melanogaster
tggcattaaaatt

SEQ ID NO: 657294 - DNA, 13 bp, D. melanogaster
tggcattaaatta

SEQ ID NO: 657295 - DNA, 13 bp, D. melanogaster
tggcattataatt

SEQ ID NO: 657296 - DNA, 13 bp, D. melanogaster
tggcattatattt

SEQ ID NO: 657297 - DNA, 13 bp, D. melanogaster
tggcattcaaagt

SEQ ID NO: 657298 - DNA, 13 bp, D. melanogaster
tggcattcaaatg

SEQ ID NO: 657299 - DNA, 13 bp, D. melanogaster
tggcattcaaatt

SEQ ID NO: 657300 - DNA, 13 bp, D. melanogaster
tggcattcattca

SEQ ID NO: 657301 - DNA, 13 bp, D. melanogaster
tggcattcatttg

SEQ ID NO: 657302 - DNA, 13 bp, D. melanogaster
tggcattccacat

SEQ ID NO: 657303 - DNA, 13 bp, D. melanogaster
tggcattccattt

SEQ ID NO: 657304 - DNA, 13 bp, D. melanogaster
tggcattcccagc

SEQ ID NO: 657305 - DNA, 14 bp, D. melanogaster
tggcattcccagct

SEQ ID NO: 657306 - DNA, 13 bp, D. melanogaster
tggcattcgaaat

SEQ ID NO: 657307 - DNA, 13 bp, D. melanogaster
tggcattcgaagg

SEQ ID NO: 657308 - DNA, 13 bp, D. melanogaster
tggcattcgcatt

SEQ ID NO: 657309 - DNA, 13 bp, D. melanogaster
tggcattcgcttg

SEQ ID NO: 657310 - DNA, 13 bp, D. melanogaster
tggcattcgcttt

SEQ ID NO: 657311 - DNA, 13 bp, D. melanogaster
tggcattctatag

SEQ ID NO: 657312 - DNA, 14 bp, D. melanogaster
tggcattctatagt

SEQ ID NO: 657313 - DNA, 13 bp, D. melanogaster
tggcattctggca

SEQ ID NO: 657314 - DNA, 13 bp, D. melanogaster
tggcattgaatta

SEQ ID NO: 657315 - DNA, 13 bp, D. melanogaster
tggcattgacatt

SEQ ID NO: 657316 - DNA, 14 bp, D. melanogaster
tggcattgacattg

SEQ ID NO: 657317 - DNA, 13 bp, D. melanogaster
tggcattgattgc

SEQ ID NO: 657318 - DNA, 14 bp, D. melanogaster
tggcattgattgcc

SEQ ID NO: 657319 - DNA, 13 bp, D. melanogaster
tggcattgcataa

SEQ ID NO: 657320 - DNA, 13 bp, D. melanogaster
tggcattgccatt

SEQ ID NO: 657321 - DNA, 14 bp, D. melanogaster
tggcattgccattg

SEQ ID NO: 657322 - DNA, 13 bp, D. melanogaster
tggcattgcccca

SEQ ID NO: 657323 - DNA, 13 bp, D. melanogaster
tggcattgcctgc

SEQ ID NO: 657324 - DNA, 13 bp, D. melanogaster
tggcattgccttt

SEQ ID NO: 657325 - DNA, 13 bp, D. melanogaster
tggcattggcaaa

SEQ ID NO: 657326 - DNA, 13 bp, D. melanogaster
tggcattggcaat

SEQ ID NO: 657327 - DNA, 13 bp, D. melanogaster
tggcattggcagt

SEQ ID NO: 657328 - DNA, 14 bp, D. melanogaster
tggcattggcattg

SEQ ID NO: 657329 - DNA, 13 bp, D. melanogaster
tggcattggccaa

SEQ ID NO: 657330 - DNA, 13 bp, D. melanogaster
tggcattggccat

SEQ ID NO: 657331 - DNA, 13 bp, D. melanogaster
tggcattggcttt

SEQ ID NO: 657332 - DNA, 13 bp, D. melanogaster
tggcattgtcctt

SEQ ID NO: 657333 - DNA, 13 bp, D. melanogaster
tggcattgtgttt

SEQ ID NO: 657334 - DNA, 13 bp, D. melanogaster
tggcattgttatt

SEQ ID NO: 657335 - DNA, 14 bp, D. melanogaster
tggcattgttgttg

SEQ ID NO: 657336 - DNA, 13 bp, D. melanogaster
tggcattgtttgg

SEQ ID NO: 657337 - DNA, 13 bp, D. melanogaster
tggcattgtttgt

SEQ ID NO: 657338 - DNA, 13 bp, D. melanogaster
tggcattgttttg

SEQ ID NO: 657339 - DNA, 13 bp, D. melanogaster
tggcatttaaaat

SEQ ID NO: 657340 - DNA, 13 bp, D. melanogaster
tggcatttaaatg

SEQ ID NO: 657341 - DNA, 13 bp, D. melanogaster
tggcatttaatta

SEQ ID NO: 657342 - DNA, 13 bp, D. melanogaster
tggcatttacata

SEQ ID NO: 657343 - DNA, 13 bp, D. melanogaster
tggcatttattaa

SEQ ID NO: 657344 - DNA, 13 bp, D. melanogaster
tggcatttattat

SEQ ID NO: 657345 - DNA, 13 bp, D. melanogaster
tggcatttatttg

SEQ ID NO: 657346 - DNA, 13 bp, D. melanogaster
tggcatttatttt

SEQ ID NO: 657347 - DNA, 13 bp, D. melanogaster
tggcatttcaatg

SEQ ID NO: 657348 - DNA, 13 bp, D. melanogaster
tggcatttcaatt

SEQ ID NO: 657349 - DNA, 14 bp, D. melanogaster
tggcatttcaattg

SEQ ID NO: 657350 - DNA, 13 bp, D. melanogaster
tggcatttcattt

SEQ ID NO: 657351 - DNA, 14 bp, D. melanogaster
tggcatttcatttg

SEQ ID NO: 657352 - DNA, 13 bp, D. melanogaster
tggcatttccatt

SEQ ID NO: 657353 - DNA, 13 bp, D. melanogaster
tggcatttctatt

SEQ ID NO: 657354 - DNA, 13 bp, D. melanogaster
tggcatttctttg

SEQ ID NO: 657355 - DNA, 13 bp, D. melanogaster
tggcatttgaaaa

SEQ ID NO: 657356 - DNA, 13 bp, D. melanogaster
tggcatttgcata

SEQ ID NO: 657357 - DNA, 14 bp, D. melanogaster
tggcatttgcattt

SEQ ID NO: 657358 - DNA, 13 bp, D. melanogaster
tggcatttgcttt

SEQ ID NO: 657359 - DNA, 13 bp, D. melanogaster
tggcatttggcat

SEQ ID NO: 657360 - DNA, 13 bp, D. melanogaster
tggcatttggcca

SEQ ID NO: 657361 - DNA, 13 bp, D. melanogaster
tggcatttggctg

SEQ ID NO: 657362 - DNA, 13 bp, D. melanogaster
tggcatttggtca

SEQ ID NO: 657363 - DNA, 13 bp, D. melanogaster
tggcatttgtcaa

SEQ ID NO: 657364 - DNA, 14 bp, D. melanogaster
tggcatttgttgtt

SEQ ID NO: 657365 - DNA, 13 bp, D. melanogaster
tggcatttgtttg

SEQ ID NO: 657366 - DNA, 13 bp, D. melanogaster
tggcattttaatg

SEQ ID NO: 657367 - DNA, 13 bp, D. melanogaster
tggcattttaatt

SEQ ID NO: 657368 - DNA, 14 bp, D. melanogaster
tggcattttaattg

SEQ ID NO: 657369 - DNA, 13 bp, D. melanogaster
tggcattttatgc

SEQ ID NO: 657370 - DNA, 13 bp, D. melanogaster
tggcattttcaag

SEQ ID NO: 657371 - DNA, 13 bp, D. melanogaster
tggcattttcatt

SEQ ID NO: 657372 - DNA, 14 bp, D. melanogaster
tggcattttccatt

SEQ ID NO: 657373 - DNA, 13 bp, D. melanogaster
tggcattttcgtt

SEQ ID NO: 657374 - DNA, 13 bp, D. melanogaster
tggcattttgatt

SEQ ID NO: 657375 - DNA, 13 bp, D. melanogaster
tggcattttgcat

SEQ ID NO: 657376 - DNA, 13 bp, D. melanogaster
tggcattttgctg

SEQ ID NO: 657377 - DNA, 13 bp, D. melanogaster
tggcattttgtgg

SEQ ID NO: 657378 - DNA, 13 bp, D. melanogaster
tggcatttttcta

SEQ ID NO: 657379 - DNA, 13 bp, D. melanogaster
tggcatttttgtg

SEQ ID NO: 657380 - DNA, 13 bp, D. melanogaster
tggcattttttat

SEQ ID NO: 657381 - DNA, 13 bp, D. melanogaster
tggccaaaaaaaa

SEQ ID NO: 657382 - DNA, 13 bp, D. melanogaster
tggccaaaaaaca

SEQ ID NO: 657383 - DNA, 14 bp, D. melanogaster
tggccaaaaaacaa

SEQ ID NO: 657384 - DNA, 14 bp, D. melanogaster
tggccaaaaaactg

SEQ ID NO: 657385 - DNA, 14 bp, D. melanogaster
tggccaaaaaataa

SEQ ID NO: 657386 - DNA, 13 bp, D. melanogaster
tggccaaaaacaa

SEQ ID NO: 657387 - DNA, 13 bp, D. melanogaster
tggccaaaaacac

SEQ ID NO: 657388 - DNA, 13 bp, D. melanogaster
tggccaaaaacag

SEQ ID NO: 657389 - DNA, 14 bp, D. melanogaster
tggccaaaaaccaa

SEQ ID NO: 657390 - DNA, 13 bp, D. melanogaster
tggccaaaaaccg

SEQ ID NO: 657391 - DNA, 13 bp, D. melanogaster
tggccaaaaactc

SEQ ID NO: 657392 - DNA, 13 bp, D. melanogaster
tggccaaaaactt

SEQ ID NO: 657393 - DNA, 14 bp, D. melanogaster
tggccaaaaagaaa

SEQ ID NO: 657394 - DNA, 13 bp, D. melanogaster
tggccaaaaaggg

SEQ ID NO: 657395 - DNA, 14 bp, D. melanogaster
tggccaaaaagggg

SEQ ID NO: 657396 - DNA, 13 bp, D. melanogaster
tggccaaaaagtg

SEQ ID NO: 657397 - DNA, 13 bp, D. melanogaster
tggccaaaaagtt

SEQ ID NO: 657398 - DNA, 14 bp, D. melanogaster
tggccaaaaagttt

SEQ ID NO: 657399 - DNA, 14 bp, D. melanogaster
tggccaaaaataaa

SEQ ID NO: 657400 - DNA, 13 bp, D. melanogaster
tggccaaaaatat

SEQ ID NO: 657401 - DNA, 13 bp, D. melanogaster
tggccaaaaatgg

SEQ ID NO: 657402 - DNA, 13 bp, D. melanogaster
tggccaaaaatta

SEQ ID NO: 657403 - DNA, 13 bp, D. melanogaster
tggccaaaaattg

SEQ ID NO: 657404 - DNA, 13 bp, D. melanogaster
tggccaaaaattt

SEQ ID NO: 657405 - DNA, 13 bp, D. melanogaster
tggccaaaacaaa

SEQ ID NO: 657406 - DNA, 14 bp, D. melanogaster
tggccaaaacaaag

SEQ ID NO: 657407 - DNA, 13 bp, D. melanogaster
tggccaaaacaca

SEQ ID NO: 657408 - DNA, 13 bp, D. melanogaster
tggccaaaacaga

SEQ ID NO: 657409 - DNA, 14 bp, D. melanogaster
tggccaaaacagaa

SEQ ID NO: 657410 - DNA, 13 bp, D. melanogaster
tggccaaaacatt

SEQ ID NO: 657411 - DNA, 13 bp, D. melanogaster
tggccaaaaccaa

SEQ ID NO: 657412 - DNA, 14 bp, D. melanogaster
tggccaaaaccaaa

SEQ ID NO: 657413 - DNA, 13 bp, D. melanogaster
tggccaaaaccat

SEQ ID NO: 657414 - DNA, 13 bp, D. melanogaster
tggccaaaaccca

SEQ ID NO: 657415 - DNA, 13 bp, D. melanogaster
tggccaaaaccga

SEQ ID NO: 657416 - DNA, 14 bp, D. melanogaster
tggccaaaaccgaa

SEQ ID NO: 657417 - DNA, 13 bp, D. melanogaster
tggccaaaacgaa

SEQ ID NO: 657418 - DNA, 14 bp, D. melanogaster
tggccaaaacgaaa

SEQ ID NO: 657419 - DNA, 13 bp, D. melanogaster
tggccaaaacgcc

SEQ ID NO: 657420 - DNA, 13 bp, D. melanogaster
tggccaaaacggc

SEQ ID NO: 657421 - DNA, 13 bp, D. melanogaster
tggccaaaagaaa

SEQ ID NO: 657422 - DNA, 13 bp, D. melanogaster
tggccaaaagaac

SEQ ID NO: 657423 - DNA, 13 bp, D. melanogaster
tggccaaaagaca

SEQ ID NO: 657424 - DNA, 13 bp, D. melanogaster
tggccaaaagagt

SEQ ID NO: 657425 - DNA, 14 bp, D. melanogaster
tggccaaaagcaaa

SEQ ID NO: 657426 - DNA, 13 bp, D. melanogaster
tggccaaaagcat

SEQ ID NO: 657427 - DNA, 13 bp, D. melanogaster
tggccaaaagcca

SEQ ID NO: 657428 - DNA, 14 bp, D. melanogaster
tggccaaaagccag

SEQ ID NO: 657429 - DNA, 13 bp, D. melanogaster
tggccaaaagccc

SEQ ID NO: 657430 - DNA, 14 bp, D. melanogaster
tggccaaaagcgaa

SEQ ID NO: 657431 - DNA, 13 bp, D. melanogaster
tggccaaaagcgg

SEQ ID NO: 657432 - DNA, 14 bp, D. melanogaster
tggccaaaagcggc

SEQ ID NO: 657433 - DNA, 13 bp, D. melanogaster
tggccaaaaggaa

SEQ ID NO: 657434 - DNA, 14 bp, D. melanogaster
tggccaaaaggagc

SEQ ID NO: 657435 - DNA, 13 bp, D. melanogaster
tggccaaaaggat

SEQ ID NO: 657436 - DNA, 13 bp, D. melanogaster
tggccaaaaggca

SEQ ID NO: 657437 - DNA, 13 bp, D. melanogaster
tggccaaaaggcg

SEQ ID NO: 657438 - DNA, 13 bp, D. melanogaster
tggccaaaagggg

SEQ ID NO: 657439 - DNA, 13 bp, D. melanogaster
tggccaaaagtga

SEQ ID NO: 657440 - DNA, 13 bp, D. melanogaster
tggccaaaagtgg

SEQ ID NO: 657441 - DNA, 13 bp, D. melanogaster
tggccaaaagttt

SEQ ID NO: 657442 - DNA, 14 bp, D. melanogaster
tggccaaaataaaa

SEQ ID NO: 657443 - DNA, 13 bp, D. melanogaster
tggccaaaataga

SEQ ID NO: 657444 - DNA, 13 bp, D. melanogaster
tggccaaaatcaa

SEQ ID NO: 657445 - DNA, 13 bp, D. melanogaster
tggccaaaatcga

SEQ ID NO: 657446 - DNA, 13 bp, D. melanogaster
tggccaaaatgag

SEQ ID NO: 657447 - DNA, 14 bp, D. melanogaster
tggccaaaatggca

SEQ ID NO: 657448 - DNA, 13 bp, D. melanogaster
tggccaaaatgtc

SEQ ID NO: 657449 - DNA, 13 bp, D. melanogaster
tggccaaaatgtg

SEQ ID NO: 657450 - DNA, 13 bp, D. melanogaster
tggccaaaattaa

SEQ ID NO: 657451 - DNA, 13 bp, D. melanogaster
tggccaaaattgg

SEQ ID NO: 657452 - DNA, 13 bp, D. melanogaster
tggccaaacaaac

SEQ ID NO: 657453 - DNA, 14 bp, D. melanogaster
tggccaaacaaaca

SEQ ID NO: 657454 - DNA, 13 bp, D. melanogaster
tggccaaacaaag

SEQ ID NO: 657455 - DNA, 13 bp, D. melanogaster
tggccaaacactt

SEQ ID NO: 657456 - DNA, 13 bp, D. melanogaster
tggccaaacattt

SEQ ID NO: 657457 - DNA, 13 bp, D. melanogaster
tggccaaacgaaa

SEQ ID NO: 657458 - DNA, 13 bp, D. melanogaster
tggccaaactttt

SEQ ID NO: 657459 - DNA, 13 bp, D. melanogaster
tggccaaagaaaa

SEQ ID NO: 657460 - DNA, 13 bp, D. melanogaster
tggccaaagacaa

SEQ ID NO: 657461 - DNA, 13 bp, D. melanogaster
tggccaaagcaaa

SEQ ID NO: 657462 - DNA, 14 bp, D. melanogaster
tggccaaagccaaa

SEQ ID NO: 657463 - DNA, 13 bp, D. melanogaster
tggccaaagcgaa

SEQ ID NO: 657464 - DNA, 13 bp, D. melanogaster
tggccaaaggaaa

SEQ ID NO: 657465 - DNA, 13 bp, D. melanogaster
tggccaaaggaca

SEQ ID NO: 657466 - DNA, 13 bp, D. melanogaster
tggccaaaggagc

SEQ ID NO: 657467 - DNA, 13 bp, D. melanogaster
tggccaaaggcaa

SEQ ID NO: 657468 - DNA, 13 bp, D. melanogaster
tggccaaagtcaa

SEQ ID NO: 657469 - DNA, 13 bp, D. melanogaster
tggccaaagtggc

SEQ ID NO: 657470 - DNA, 13 bp, D. melanogaster
tggccaaagtgtt

SEQ ID NO: 657471 - DNA, 13 bp, D. melanogaster
tggccaaagttca

SEQ ID NO: 657472 - DNA, 13 bp, D. melanogaster
tggccaaataatt

SEQ ID NO: 657473 - DNA, 13 bp, D. melanogaster
tggccaaatatgt

SEQ ID NO: 657474 - DNA, 13 bp, D. melanogaster
tggccaaatattg

SEQ ID NO: 657475 - DNA, 13 bp, D. melanogaster
tggccaaatattt

SEQ ID NO: 657476 - DNA, 13 bp, D. melanogaster
tggccaaatcaaa

SEQ ID NO: 657477 - DNA, 13 bp, D. melanogaster
tggccaaatccaa

SEQ ID NO: 657478 - DNA, 13 bp, D. melanogaster
tggccaaatcgaa

SEQ ID NO: 657479 - DNA, 13 bp, D. melanogaster
tggccaaatgaaa

SEQ ID NO: 657480 - DNA, 14 bp, D. melanogaster
tggccaaatgaaat

SEQ ID NO: 657481 - DNA, 13 bp, D. melanogaster
tggccaaatgaca

SEQ ID NO: 657482 - DNA, 13 bp, D. melanogaster
tggccaaatgcaa

SEQ ID NO: 657483 - DNA, 13 bp, D. melanogaster
tggccaaatgcag

SEQ ID NO: 657484 - DNA, 13 bp, D. melanogaster
tggccaaatgcca

SEQ ID NO: 657485 - DNA, 13 bp, D. melanogaster
tggccaaatgcga

SEQ ID NO: 657486 - DNA, 13 bp, D. melanogaster
tggccaaatgctg

SEQ ID NO: 657487 - DNA, 13 bp, D. melanogaster
tggccaaatggaa

SEQ ID NO: 657488 - DNA, 14 bp, D. melanogaster
tggccaaatggcaa

SEQ ID NO: 657489 - DNA, 13 bp, D. melanogaster
tggccaaatggcc

SEQ ID NO: 657490 - DNA, 13 bp, D. melanogaster
tggccaaatggct

SEQ ID NO: 657491 - DNA, 13 bp, D. melanogaster
tggccaaatggtt

SEQ ID NO: 657492 - DNA, 13 bp, D. melanogaster
tggccaaatgtgt

SEQ ID NO: 657493 - DNA, 13 bp, D. melanogaster
tggccaaattgaa

SEQ ID NO: 657494 - DNA, 14 bp, D. melanogaster
tggccaaattgaaa

SEQ ID NO: 657495 - DNA, 13 bp, D. melanogaster
tggccaaattgtt

SEQ ID NO: 657496 - DNA, 13 bp, D. melanogaster
tggccaaatttgt

SEQ ID NO: 657497 - DNA, 13 bp, D. melanogaster
tggccaacaaaaa

SEQ ID NO: 657498 - DNA, 13 bp, D. melanogaster
tggccaacaaaag

SEQ ID NO: 657499 - DNA, 13 bp, D. melanogaster
tggccaacaaaca

SEQ ID NO: 657500 - DNA, 14 bp, D. melanogaster
tggccaacaaacaa

SEQ ID NO: 657501 - DNA, 13 bp, D. melanogaster
tggccaacaaagg

SEQ ID NO: 657502 - DNA, 14 bp, D. melanogaster
tggccaacaaattg

SEQ ID NO: 657503 - DNA, 13 bp, D. melanogaster
tggccaacaacaa

SEQ ID NO: 657504 - DNA, 14 bp, D. melanogaster
tggccaacaacaaa

SEQ ID NO: 657505 - DNA, 13 bp, D. melanogaster
tggccaacaacat

SEQ ID NO: 657506 - DNA, 13 bp, D. melanogaster
tggccaacaactg

SEQ ID NO: 657507 - DNA, 13 bp, D. melanogaster
tggccaacaaggc

SEQ ID NO: 657508 - DNA, 13 bp, D. melanogaster
tggccaacaagtg

SEQ ID NO: 657509 - DNA, 13 bp, D. melanogaster
tggccaacaataa

SEQ ID NO: 657510 - DNA, 13 bp, D. melanogaster
tggccaacaatgg

SEQ ID NO: 657511 - DNA, 13 bp, D. melanogaster
tggccaacacaaa

SEQ ID NO: 657512 - DNA, 13 bp, D. melanogaster
tggccaacacaat

SEQ ID NO: 657513 - DNA, 13 bp, D. melanogaster
tggccaacacagc

SEQ ID NO: 657514 - DNA, 13 bp, D. melanogaster
tggccaacacttg

SEQ ID NO: 657515 - DNA, 13 bp, D. melanogaster
tggccaacacttt

SEQ ID NO: 657516 - DNA, 13 bp, D. melanogaster
tggccaacagcaa

SEQ ID NO: 657517 - DNA, 13 bp, D. melanogaster
tggccaacagcac

SEQ ID NO: 657518 - DNA, 13 bp, D. melanogaster
tggccaacagctg

SEQ ID NO: 657519 - DNA, 13 bp, D. melanogaster
tggccaacagttg

SEQ ID NO: 657520 - DNA, 13 bp, D. melanogaster
tggccaacatatt

SEQ ID NO: 657521 - DNA, 13 bp, D. melanogaster
tggccaacatgtg

SEQ ID NO: 657522 - DNA, 13 bp, D. melanogaster
tggccaacattta

SEQ ID NO: 657523 - DNA, 13 bp, D. melanogaster
tggccaaccacaa

SEQ ID NO: 657524 - DNA, 13 bp, D. melanogaster
tggccaacgaaaa

SEQ ID NO: 657525 - DNA, 13 bp, D. melanogaster
tggccaacggcaa

SEQ ID NO: 657526 - DNA, 13 bp, D. melanogaster
tggccaactattt

SEQ ID NO: 657527 - DNA, 13 bp, D. melanogaster
tggccaactcaac

SEQ ID NO: 657528 - DNA, 13 bp, D. melanogaster
tggccaactcatt

SEQ ID NO: 657529 - DNA, 13 bp, D. melanogaster
tggccaactgaaa

SEQ ID NO: 657530 - DNA, 13 bp, D. melanogaster
tggccaactgaca

SEQ ID NO: 657531 - DNA, 13 bp, D. melanogaster
tggccaactgcaa

SEQ ID NO: 657532 - DNA, 13 bp, D. melanogaster
tggccaactgcct

SEQ ID NO: 657533 - DNA, 14 bp, D. melanogaster
tggccaactgcctg

SEQ ID NO: 657534 - DNA, 13 bp, D. melanogaster
tggccaactggca

SEQ ID NO: 657535 - DNA, 14 bp, D. melanogaster
tggccaactggcag

SEQ ID NO: 657536 - DNA, 13 bp, D. melanogaster
tggccaactggcc

SEQ ID NO: 657537 - DNA, 14 bp, D. melanogaster
tggccaactggcca

SEQ ID NO: 657538 - DNA, 13 bp, D. melanogaster
tggccaactgttt

SEQ ID NO: 657539 - DNA, 13 bp, D. melanogaster
tggccaacttcat

SEQ ID NO: 657540 - DNA, 13 bp, D. melanogaster
tggccaacttggc

SEQ ID NO: 657541 - DNA, 13 bp, D. melanogaster
tggccaacttgtg

SEQ ID NO: 657542 - DNA, 13 bp, D. melanogaster
tggccaactttct

SEQ ID NO: 657543 - DNA, 13 bp, D. melanogaster
tggccaactttga

SEQ ID NO: 657544 - DNA, 13 bp, D. melanogaster
tggccaactttgg

SEQ ID NO: 657545 - DNA, 13 bp, D. melanogaster
tggccaacttttg

SEQ ID NO: 657546 - DNA, 13 bp, D. melanogaster
tggccaacttttt

SEQ ID NO: 657547 - DNA, 13 bp, D. melanogaster
tggccaagaaaac

SEQ ID NO: 657548 - DNA, 13 bp, D. melanogaster
tggccaagaaaag

SEQ ID NO: 657549 - DNA, 13 bp, D. melanogaster
tggccaagaagtg

SEQ ID NO: 657550 - DNA, 13 bp, D. melanogaster
tggccaagaatat

SEQ ID NO: 657551 - DNA, 13 bp, D. melanogaster
tggccaagaattt

SEQ ID NO: 657552 - DNA, 13 bp, D. melanogaster
tggccaagacaaa

SEQ ID NO: 657553 - DNA, 14 bp, D. melanogaster
tggccaagacaaat

SEQ ID NO: 657554 - DNA, 13 bp, D. melanogaster
tggccaagagaaa

SEQ ID NO: 657555 - DNA, 13 bp, D. melanogaster
tggccaagagagc

SEQ ID NO: 657556 - DNA, 13 bp, D. melanogaster
tggccaagagcca

SEQ ID NO: 657557 - DNA, 13 bp, D. melanogaster
tggccaagatgaa

SEQ ID NO: 657558 - DNA, 13 bp, D. melanogaster
tggccaagatggc

SEQ ID NO: 657559 - DNA, 13 bp, D. melanogaster
tggccaagcaaaa

SEQ ID NO: 657560 - DNA, 13 bp, D. melanogaster
tggccaagcaaat

SEQ ID NO: 657561 - DNA, 13 bp, D. melanogaster
tggccaagcaagg

SEQ ID NO: 657562 - DNA, 13 bp, D. melanogaster
tggccaagcgaaa

SEQ ID NO: 657563 - DNA, 13 bp, D. melanogaster
tggccaaggaaat

SEQ ID NO: 657564 - DNA, 13 bp, D. melanogaster
tggccaaggaatt

SEQ ID NO: 657565 - DNA, 14 bp, D. melanogaster
tggccaaggaattc

SEQ ID NO: 657566 - DNA, 13 bp, D. melanogaster
tggccaaggcgaa

SEQ ID NO: 657567 - DNA, 13 bp, D. melanogaster
tggccaagggaaa

SEQ ID NO: 657568 - DNA, 13 bp, D. melanogaster
tggccaaggtatc

SEQ ID NO: 657569 - DNA, 13 bp, D. melanogaster
tggccaaggtcaa

SEQ ID NO: 657570 - DNA, 14 bp, D. melanogaster
tggccaaggtcaaa

SEQ ID NO: 657571 - DNA, 13 bp, D. melanogaster
tggccaaggtttt

SEQ ID NO: 657572 - DNA, 13 bp, D. melanogaster
tggccaagtaatt

SEQ ID NO: 657573 - DNA, 13 bp, D. melanogaster
tggccaagtcaaa

SEQ ID NO: 657574 - DNA, 13 bp, D. melanogaster
tggccaagtcaag

SEQ ID NO: 657575 - DNA, 13 bp, D. melanogaster
tggccaagtgaag

SEQ ID NO: 657576 - DNA, 13 bp, D. melanogaster
tggccaagtgatt

SEQ ID NO: 657577 - DNA, 13 bp, D. melanogaster
tggccaagtgcac

SEQ ID NO: 657578 - DNA, 13 bp, D. melanogaster
tggccaagtgcag

SEQ ID NO: 657579 - DNA, 13 bp, D. melanogaster
tggccaagtgccg

SEQ ID NO: 657580 - DNA, 13 bp, D. melanogaster
tggccaagtggag

SEQ ID NO: 657581 - DNA, 13 bp, D. melanogaster
tggccaagtggcc

SEQ ID NO: 657582 - DNA, 14 bp, D. melanogaster
tggccaagtggcca

SEQ ID NO: 657583 - DNA, 13 bp, D. melanogaster
tggccaagtggcg

SEQ ID NO: 657584 - DNA, 13 bp, D. melanogaster
tggccaagtgttt

SEQ ID NO: 657585 - DNA, 13 bp, D. melanogaster
tggccaagttaag

SEQ ID NO: 657586 - DNA, 13 bp, D. melanogaster
tggccaagttaat

SEQ ID NO: 657587 - DNA, 13 bp, D. melanogaster
tggccaagttcaa

SEQ ID NO: 657588 - DNA, 13 bp, D. melanogaster
tggccaagttgcc

SEQ ID NO: 657589 - DNA, 13 bp, D. melanogaster
tggccaagttgtg

SEQ ID NO: 657590 - DNA, 13 bp, D. melanogaster
tggccaagtttaa

SEQ ID NO: 657591 - DNA, 13 bp, D. melanogaster
tggccaagtttat

SEQ ID NO: 657592 - DNA, 13 bp, D. melanogaster
tggccaagttttc

SEQ ID NO: 657593 - DNA, 13 bp, D. melanogaster
tggccaagttttg

SEQ ID NO: 657594 - DNA, 13 bp, D. melanogaster
tggccaagttttt

SEQ ID NO: 657595 - DNA, 13 bp, D. melanogaster
tggccaataaatt

SEQ ID NO: 657596 - DNA, 13 bp, D. melanogaster
tggccaatcaatt

SEQ ID NO: 657597 - DNA, 13 bp, D. melanogaster
tggccaatggaaa

SEQ ID NO: 657598 - DNA, 13 bp, D. melanogaster
tggccaatggcca

SEQ ID NO: 657599 - DNA, 14 bp, D. melanogaster
tggccaatggccaa

SEQ ID NO: 657600 - DNA, 13 bp, D. melanogaster
tggccaattcaat

SEQ ID NO: 657601 - DNA, 13 bp, D. melanogaster
tggccaattgcca

SEQ ID NO: 657602 - DNA, 13 bp, D. melanogaster
tggccaatttaat

SEQ ID NO: 657603 - DNA, 13 bp, D. melanogaster
tggccaatttcga

SEQ ID NO: 657604 - DNA, 14 bp, D. melanogaster
tggccaatttcgag

SEQ ID NO: 657605 - DNA, 13 bp, D. melanogaster
tggccaatttggc

SEQ ID NO: 657606 - DNA, 13 bp, D. melanogaster
tggccacaaaaaa

SEQ ID NO: 657607 - DNA, 13 bp, D. melanogaster
tggccacaaaaat

SEQ ID NO: 657608 - DNA, 13 bp, D. melanogaster
tggccacaaaacg

SEQ ID NO: 657609 - DNA, 13 bp, D. melanogaster
tggccacaaaagc

SEQ ID NO: 657610 - DNA, 13 bp, D. melanogaster
tggccacaaatca

SEQ ID NO: 657611 - DNA, 13 bp, D. melanogaster
tggccacaacttt

SEQ ID NO: 657612 - DNA, 13 bp, D. melanogaster
tggccacacaaaa

SEQ ID NO: 657613 - DNA, 13 bp, D. melanogaster
tggccacaccttt

SEQ ID NO: 657614 - DNA, 13 bp, D. melanogaster
tggccacacgagg

SEQ ID NO: 657615 - DNA, 13 bp, D. melanogaster
tggccacatccac

SEQ ID NO: 657616 - DNA, 13 bp, D. melanogaster
tggccacatcgtt

SEQ ID NO: 657617 - DNA, 13 bp, D. melanogaster
tggccacatttaa

SEQ ID NO: 657618 - DNA, 13 bp, D. melanogaster
tggccacatttgt

SEQ ID NO: 657619 - DNA, 13 bp, D. melanogaster
tggccaccaaaaa

SEQ ID NO: 657620 - DNA, 13 bp, D. melanogaster
tggccaccaaagc

SEQ ID NO: 657621 - DNA, 13 bp, D. melanogaster
tggccaccaactc

SEQ ID NO: 657622 - DNA, 13 bp, D. melanogaster
tggccaccgaaaa

SEQ ID NO: 657623 - DNA, 13 bp, D. melanogaster
tggccacgcccac

SEQ ID NO: 657624 - DNA, 14 bp, D. melanogaster
tggccacgcccaca

SEQ ID NO: 657625 - DNA, 13 bp, D. melanogaster
tggccacgcccca

SEQ ID NO: 657626 - DNA, 13 bp, D. melanogaster
tggccacgccccc

SEQ ID NO: 657627 - DNA, 14 bp, D. melanogaster
tggccacgccccca

SEQ ID NO: 657628 - DNA, 14 bp, D. melanogaster
tggccacgccccct

SEQ ID NO: 657629 - DNA, 14 bp, D. melanogaster
tggccacgcccctc

SEQ ID NO: 657630 - DNA, 14 bp, D. melanogaster
tggccacgcccctt

SEQ ID NO: 657631 - DNA, 13 bp, D. melanogaster
tggccactggcca

SEQ ID NO: 657632 - DNA, 14 bp, D. melanogaster
tggccactggccac

SEQ ID NO: 657633 - DNA, 14 bp, D. melanogaster
tggccacttggcca

SEQ ID NO: 657634 - DNA, 13 bp, D. melanogaster
tggccacttggct

SEQ ID NO: 657635 - DNA, 14 bp, D. melanogaster
tggccagaaaaaaa

SEQ ID NO: 657636 - DNA, 13 bp, D. melanogaster
tggccagaaaaag

SEQ ID NO: 657637 - DNA, 13 bp, D. melanogaster
tggccagaaaact

SEQ ID NO: 657638 - DNA, 13 bp, D. melanogaster
tggccagaacttt

SEQ ID NO: 657639 - DNA, 13 bp, D. melanogaster
tggccagaagaga

SEQ ID NO: 657640 - DNA, 13 bp, D. melanogaster
tggccagaagcag

SEQ ID NO: 657641 - DNA, 13 bp, D. melanogaster
tggccagaagttg

SEQ ID NO: 657642 - DNA, 13 bp, D. melanogaster
tggccagaggcaa

SEQ ID NO: 657643 - DNA, 13 bp, D. melanogaster
tggccagataaaa

SEQ ID NO: 657644 - DNA, 13 bp, D. melanogaster
tggccagcaaaaa

SEQ ID NO: 657645 - DNA, 14 bp, D. melanogaster
tggccagcaaaaaa

SEQ ID NO: 657646 - DNA, 13 bp, D. melanogaster
tggccagcaaatt

SEQ ID NO: 657647 - DNA, 13 bp, D. melanogaster
tggccagcaacaa

SEQ ID NO: 657648 - DNA, 13 bp, D. melanogaster
tggccagcaattt

SEQ ID NO: 657649 - DNA, 13 bp, D. melanogaster
tggccagcacttt

SEQ ID NO: 657650 - DNA, 13 bp, D. melanogaster
tggccagcagaag

SEQ ID NO: 657651 - DNA, 13 bp, D. melanogaster
tggccagcagacc

SEQ ID NO: 657652 - DNA, 14 bp, D. melanogaster
tggccagcagaccc

SEQ ID NO: 657653 - DNA, 13 bp, D. melanogaster
tggccagcagcca

SEQ ID NO: 657654 - DNA, 13 bp, D. melanogaster
tggccagcagctg

SEQ ID NO: 657655 - DNA, 13 bp, D. melanogaster
tggccagcagttg

SEQ ID NO: 657656 - DNA, 14 bp, D. melanogaster
tggccagcatttcc

SEQ ID NO: 657657 - DNA, 13 bp, D. melanogaster
tggccagccattt

SEQ ID NO: 657658 - DNA, 13 bp, D. melanogaster
tggccagcgaaaa

SEQ ID NO: 657659 - DNA, 13 bp, D. melanogaster
tggccagcgaaat

SEQ ID NO: 657660 - DNA, 13 bp, D. melanogaster
tggccagcgcttt

SEQ ID NO: 657661 - DNA, 13 bp, D. melanogaster
tggccagcggaaa

SEQ ID NO: 657662 - DNA, 13 bp, D. melanogaster
tggccagcggatt

SEQ ID NO: 657663 - DNA, 13 bp, D. melanogaster
tggccagcggcaa

SEQ ID NO: 657664 - DNA, 13 bp, D. melanogaster
tggccagcggcca

SEQ ID NO: 657665 - DNA, 13 bp, D. melanogaster
tggccagcgtatg

SEQ ID NO: 657666 - DNA, 13 bp, D. melanogaster
tggccagctaaaa

SEQ ID NO: 657667 - DNA, 13 bp, D. melanogaster
tggccagctgaaa

SEQ ID NO: 657668 - DNA, 13 bp, D. melanogaster
tggccagctgaat

SEQ ID NO: 657669 - DNA, 13 bp, D. melanogaster
tggccagctgttg

SEQ ID NO: 657670 - DNA, 13 bp, D. melanogaster
tggccagcttatt

SEQ ID NO: 657671 - DNA, 13 bp, D. melanogaster
tggccaggaaaat

SEQ ID NO: 657672 - DNA, 13 bp, D. melanogaster
tggccaggaaatg

SEQ ID NO: 657673 - DNA, 13 bp, D. melanogaster
tggccaggacaaa

SEQ ID NO: 657674 - DNA, 13 bp, D. melanogaster
tggccaggacaca

SEQ ID NO: 657675 - DNA, 13 bp, D. melanogaster
tggccaggagcag

SEQ ID NO: 657676 - DNA, 13 bp, D. melanogaster
tggccaggatatg

SEQ ID NO: 657677 - DNA, 13 bp, D. melanogaster
tggccaggcaaat

SEQ ID NO: 657678 - DNA, 14 bp, D. melanogaster
tggccaggccaaaa

SEQ ID NO: 657679 - DNA, 13 bp, D. melanogaster
tggccaggccaac

SEQ ID NO: 657680 - DNA, 14 bp, D. melanogaster
tggccaggccaaca

SEQ ID NO: 657681 - DNA, 13 bp, D. melanogaster
tggccaggccagg

SEQ ID NO: 657682 - DNA, 13 bp, D. melanogaster
tggccagggaaaa

SEQ ID NO: 657683 - DNA, 13 bp, D. melanogaster
tggccagtaaaaa

SEQ ID NO: 657684 - DNA, 13 bp, D. melanogaster
tggccagtctact

SEQ ID NO: 657685 - DNA, 13 bp, D. melanogaster
tggccagtggcca

SEQ ID NO: 657686 - DNA, 14 bp, D. melanogaster
tggccagtggccac

SEQ ID NO: 657687 - DNA, 13 bp, D. melanogaster
tggccagtgggcg

SEQ ID NO: 657688 - DNA, 13 bp, D. melanogaster
tggccagttcgac

SEQ ID NO: 657689 - DNA, 13 bp, D. melanogaster
tggccagttgcca

SEQ ID NO: 657690 - DNA, 13 bp, D. melanogaster
tggccagttggca

SEQ ID NO: 657691 - DNA, 14 bp, D. melanogaster
tggccagttggcca

SEQ ID NO: 657692 - DNA, 13 bp, D. melanogaster
tggccagttggct

SEQ ID NO: 657693 - DNA, 14 bp, D. melanogaster
tggccagtttccgt

SEQ ID NO: 657694 - DNA, 13 bp, D. melanogaster
tggccagtttgtt

SEQ ID NO: 657695 - DNA, 13 bp, D. melanogaster
tggccataaaaaa

SEQ ID NO: 657696 - DNA, 14 bp, D. melanogaster
tggccataaaaaaa

SEQ ID NO: 657697 - DNA, 13 bp, D. melanogaster
tggccataaacaa

SEQ ID NO: 657698 - DNA, 13 bp, D. melanogaster
tggccataaacac

SEQ ID NO: 657699 - DNA, 13 bp, D. melanogaster
tggccataaagca

SEQ ID NO: 657700 - DNA, 13 bp, D. melanogaster
tggccataaagct

SEQ ID NO: 657701 - DNA, 14 bp, D. melanogaster
tggccataaataaa

SEQ ID NO: 657702 - DNA, 14 bp, D. melanogaster
tggccataaatatt

SEQ ID NO: 657703 - DNA, 13 bp, D. melanogaster
tggccataaatca

SEQ ID NO: 657704 - DNA, 14 bp, D. melanogaster
tggccataaatcaa

SEQ ID NO: 657705 - DNA, 13 bp, D. melanogaster
tggccataaatta

SEQ ID NO: 657706 - DNA, 14 bp, D. melanogaster
tggccataaattaa

SEQ ID NO: 657707 - DNA, 13 bp, D. melanogaster
tggccataacaaa

SEQ ID NO: 657708 - DNA, 13 bp, D. melanogaster
tggccataattca

SEQ ID NO: 657709 - DNA, 13 bp, D. melanogaster
tggccataattga

SEQ ID NO: 657710 - DNA, 13 bp, D. melanogaster
tggccatatccat

SEQ ID NO: 657711 - DNA, 13 bp, D. melanogaster
tggccatattttg

SEQ ID NO: 657712 - DNA, 13 bp, D. melanogaster
tggccatattttt

SEQ ID NO: 657713 - DNA, 13 bp, D. melanogaster
tggccatcaaaaa

SEQ ID NO: 657714 - DNA, 13 bp, D. melanogaster
tggccatcaaatg

SEQ ID NO: 657715 - DNA, 13 bp, D. melanogaster
tggccatcaaatt

SEQ ID NO: 657716 - DNA, 13 bp, D. melanogaster
tggccatcatttg

SEQ ID NO: 657717 - DNA, 13 bp, D. melanogaster
tggccatctcgtc

SEQ ID NO: 657718 - DNA, 13 bp, D. melanogaster
tggccatctcttt

SEQ ID NO: 657719 - DNA, 14 bp, D. melanogaster
tggccatgcaaacg

SEQ ID NO: 657720 - DNA, 13 bp, D. melanogaster
tggccatgcaaat

SEQ ID NO: 657721 - DNA, 13 bp, D. melanogaster
tggccatgcccac

SEQ ID NO: 657722 - DNA, 13 bp, D. melanogaster
tggccatggcaaa

SEQ ID NO: 657723 - DNA, 13 bp, D. melanogaster
tggccatggcaac

SEQ ID NO: 657724 - DNA, 13 bp, D. melanogaster
tggccatggccaa

SEQ ID NO: 657725 - DNA, 13 bp, D. melanogaster
tggccatggctaa

SEQ ID NO: 657726 - DNA, 13 bp, D. melanogaster
tggccatgtccat

SEQ ID NO: 657727 - DNA, 13 bp, D. melanogaster
tggccatgtccgt

SEQ ID NO: 657728 - DNA, 13 bp, D. melanogaster
tggccatgtcctt

SEQ ID NO: 657729 - DNA, 13 bp, D. melanogaster
tggccatgttgtt

SEQ ID NO: 657730 - DNA, 13 bp, D. melanogaster
tggccatgtttgc

SEQ ID NO: 657731 - DNA, 13 bp, D. melanogaster
tggccatgtttgt

SEQ ID NO: 657732 - DNA, 13 bp, D. melanogaster
tggccatgttttg

SEQ ID NO: 657733 - DNA, 13 bp, D. melanogaster
tggccatgttttt

SEQ ID NO: 657734 - DNA, 13 bp, D. melanogaster
tggccattaaaac

SEQ ID NO: 657735 - DNA, 13 bp, D. melanogaster
tggccattaaatt

SEQ ID NO: 657736 - DNA, 13 bp, D. melanogaster
tggccattaagtg

SEQ ID NO: 657737 - DNA, 13 bp, D. melanogaster
tggccattaattt

SEQ ID NO: 657738 - DNA, 13 bp, D. melanogaster
tggccattatatg

SEQ ID NO: 657739 - DNA, 13 bp, D. melanogaster
tggccattatggt

SEQ ID NO: 657740 - DNA, 13 bp, D. melanogaster
tggccattgattt

SEQ ID NO: 657741 - DNA, 13 bp, D. melanogaster
tggccattgccat

SEQ ID NO: 657742 - DNA, 14 bp, D. melanogaster
tggccattgccatt

SEQ ID NO: 657743 - DNA, 13 bp, D. melanogaster
tggccattggcca

SEQ ID NO: 657744 - DNA, 14 bp, D. melanogaster
tggccattggccat

SEQ ID NO: 657745 - DNA, 13 bp, D. melanogaster
tggccattgtctg

SEQ ID NO: 657746 - DNA, 13 bp, D. melanogaster
tggccattgtttg

SEQ ID NO: 657747 - DNA, 13 bp, D. melanogaster
tggccattgtttt

SEQ ID NO: 657748 - DNA, 13 bp, D. melanogaster
tggccatttaatt

SEQ ID NO: 657749 - DNA, 13 bp, D. melanogaster
tggccatttcaat

SEQ ID NO: 657750 - DNA, 14 bp, D. melanogaster
tggccatttcattt

SEQ ID NO: 657751 - DNA, 13 bp, D. melanogaster
tggccatttccat

SEQ ID NO: 657752 - DNA, 13 bp, D. melanogaster
tggccatttccca

SEQ ID NO: 657753 - DNA, 13 bp, D. melanogaster
tggccatttggca

SEQ ID NO: 657754 - DNA, 14 bp, D. melanogaster
tggccatttggcca

SEQ ID NO: 657755 - DNA, 13 bp, D. melanogaster
tggccatttggct

SEQ ID NO: 657756 - DNA, 13 bp, D. melanogaster
tggccatttgtca

SEQ ID NO: 657757 - DNA, 13 bp, D. melanogaster
tggccattttcat

SEQ ID NO: 657758 - DNA, 13 bp, D. melanogaster
tggccattttgca

SEQ ID NO: 657759 - DNA, 13 bp, D. melanogaster
tggccattttgcg

SEQ ID NO: 657760 - DNA, 13 bp, D. melanogaster
tggccatttttat

SEQ ID NO: 657761 - DNA, 13 bp, D. melanogaster
tggccatttttgg

SEQ ID NO: 657762 - DNA, 13 bp, D. melanogaster
tggccattttttt

SEQ ID NO: 657763 - DNA, 13 bp, D. melanogaster
tggcccaaaaaaa

SEQ ID NO: 657764 - DNA, 13 bp, D. melanogaster
tggcccaaaaatg

SEQ ID NO: 657765 - DNA, 13 bp, D. melanogaster
tggcccaaaacaa

SEQ ID NO: 657766 - DNA, 13 bp, D. melanogaster
tggcccaaaagag

SEQ ID NO: 657767 - DNA, 13 bp, D. melanogaster
tggcccaaaaggt

SEQ ID NO: 657768 - DNA, 13 bp, D. melanogaster
tggcccaaacaat

SEQ ID NO: 657769 - DNA, 13 bp, D. melanogaster
tggcccaaagcaa

SEQ ID NO: 657770 - DNA, 13 bp, D. melanogaster
tggcccaaagtca

SEQ ID NO: 657771 - DNA, 13 bp, D. melanogaster
tggcccaaatgaa

SEQ ID NO: 657772 - DNA, 13 bp, D. melanogaster
tggcccaagtttt

SEQ ID NO: 657773 - DNA, 13 bp, D. melanogaster
tggcccacacaca

SEQ ID NO: 657774 - DNA, 13 bp, D. melanogaster
tggcccacataaa

SEQ ID NO: 657775 - DNA, 13 bp, D. melanogaster
tggcccactgtgc

SEQ ID NO: 657776 - DNA, 13 bp, D. melanogaster
tggcccagaaaaa

SEQ ID NO: 657777 - DNA, 13 bp, D. melanogaster
tggcccattaaac

SEQ ID NO: 657778 - DNA, 13 bp, D. melanogaster
tggcccattgttt

SEQ ID NO: 657779 - DNA, 13 bp, D. melanogaster
tggccccaaaaac

SEQ ID NO: 657780 - DNA, 13 bp, D. melanogaster
tggccccaaaaag

SEQ ID NO: 657781 - DNA, 13 bp, D. melanogaster
tggccccaaaatg

SEQ ID NO: 657782 - DNA, 14 bp, D. melanogaster
tggccccagatgac

SEQ ID NO: 657783 - DNA, 13 bp, D. melanogaster
tggccccctgcct

SEQ ID NO: 657784 - DNA, 13 bp, D. melanogaster
tggcccgaatgga

SEQ ID NO: 657785 - DNA, 13 bp, D. melanogaster
tggccctgaagat

SEQ ID NO: 657786 - DNA, 14 bp, D. melanogaster
tggccgaaaaaaaa

SEQ ID NO: 657787 - DNA, 13 bp, D. melanogaster
tggccgaaaagtg

SEQ ID NO: 657788 - DNA, 13 bp, D. melanogaster
tggccgaaacgaa

SEQ ID NO: 657789 - DNA, 13 bp, D. melanogaster
tggccgaaagaaa

SEQ ID NO: 657790 - DNA, 13 bp, D. melanogaster
tggccgccatttt

SEQ ID NO: 657791 - DNA, 13 bp, D. melanogaster
tggccgccggatt

SEQ ID NO: 657792 - DNA, 13 bp, D. melanogaster
tggccgcgcaagc

SEQ ID NO: 657793 - DNA, 13 bp, D. melanogaster
tggccgctggcca

SEQ ID NO: 657794 - DNA, 13 bp, D. melanogaster
tggccggaaaatg

SEQ ID NO: 657795 - DNA, 13 bp, D. melanogaster
tggccgggcaaaa

SEQ ID NO: 657796 - DNA, 13 bp, D. melanogaster
tggccgtcactaa

SEQ ID NO: 657797 - DNA, 13 bp, D. melanogaster
tggccgttaattc

SEQ ID NO: 657798 - DNA, 13 bp, D. melanogaster
tggcctacattca

SEQ ID NO: 657799 - DNA, 13 bp, D. melanogaster
tggcctatggtca

SEQ ID NO: 657800 - DNA, 14 bp, D. melanogaster
tggcctcaaaaatg

SEQ ID NO: 657801 - DNA, 13 bp, D. melanogaster
tggcctcacatcc

SEQ ID NO: 657802 - DNA, 14 bp, D. melanogaster
tggcctccttctat

SEQ ID NO: 657803 - DNA, 13 bp, D. melanogaster
tggcctcgctttt

SEQ ID NO: 657804 - DNA, 13 bp, D. melanogaster
tggcctgaagatg

SEQ ID NO: 657805 - DNA, 13 bp, D. melanogaster
tggcctgcctttt

SEQ ID NO: 657806 - DNA, 14 bp, D. melanogaster
tggcctgcctttta

SEQ ID NO: 657807 - DNA, 13 bp, D. melanogaster
tggcctgctcgca

SEQ ID NO: 657808 - DNA, 13 bp, D. melanogaster
tggcctgcttgca

SEQ ID NO: 657809 - DNA, 14 bp, D. melanogaster
tggcctggccaaaa

SEQ ID NO: 657810 - DNA, 13 bp, D. melanogaster
tggcctggccaac

SEQ ID NO: 657811 - DNA, 13 bp, D. melanogaster
tggcctggccata

SEQ ID NO: 657812 - DNA, 14 bp, D. melanogaster
tggcctggcccaaa

SEQ ID NO: 657813 - DNA, 13 bp, D. melanogaster
tggcctggcctgg

SEQ ID NO: 657814 - DNA, 14 bp, D. melanogaster
tggcctggcctggc

SEQ ID NO: 657815 - DNA, 13 bp, D. melanogaster
tggcctggctttc

SEQ ID NO: 657816 - DNA, 13 bp, D. melanogaster
tggcctgggaaaa

SEQ ID NO: 657817 - DNA, 13 bp, D. melanogaster
tggccttcaaatt

SEQ ID NO: 657818 - DNA, 14 bp, D. melanogaster
tggccttcagagcc

SEQ ID NO: 657819 - DNA, 13 bp, D. melanogaster
tggccttcgagtg

SEQ ID NO: 657820 - DNA, 14 bp, D. melanogaster
tggcctttaagttt

SEQ ID NO: 657821 - DNA, 13 bp, D. melanogaster
tggcctttgtttc

SEQ ID NO: 657822 - DNA, 13 bp, D. melanogaster
tggccttttggct

SEQ ID NO: 657823 - DNA, 13 bp, D. melanogaster
tggccttttgtgc

SEQ ID NO: 657824 - DNA, 13 bp, D. melanogaster
tggcgaaaaacaa

SEQ ID NO: 657825 - DNA, 14 bp, D. melanogaster
tggcgaaaaacaaa

SEQ ID NO: 657826 - DNA, 13 bp, D. melanogaster
tggcgaaaaataa

SEQ ID NO: 657827 - DNA, 13 bp, D. melanogaster
tggcgaaaaatca

SEQ ID NO: 657828 - DNA, 13 bp, D. melanogaster
tggcgaaaacaaa

SEQ ID NO: 657829 - DNA, 13 bp, D. melanogaster
tggcgaaaacttt

SEQ ID NO: 657830 - DNA, 13 bp, D. melanogaster
tggcgaaaataaa

SEQ ID NO: 657831 - DNA, 14 bp, D. melanogaster
tggcgaaaataaat

SEQ ID NO: 657832 - DNA, 13 bp, D. melanogaster
tggcgaaaataat

SEQ ID NO: 657833 - DNA, 13 bp, D. melanogaster
tggcgaaaggaaa

SEQ ID NO: 657834 - DNA, 13 bp, D. melanogaster
tggcgaaagtttt

SEQ ID NO: 657835 - DNA, 13 bp, D. melanogaster
tggcgaaattttt

SEQ ID NO: 657836 - DNA, 13 bp, D. melanogaster
tggcgaagggaaa

SEQ ID NO: 657837 - DNA, 13 bp, D. melanogaster
tggcgaatgatat

SEQ ID NO: 657838 - DNA, 13 bp, D. melanogaster
tggcgaatggcga

SEQ ID NO: 657839 - DNA, 13 bp, D. melanogaster
tggcgaccactgt

SEQ ID NO: 657840 - DNA, 13 bp, D. melanogaster
tggcgagaagtac

SEQ ID NO: 657841 - DNA, 13 bp, D. melanogaster
tggcgaggcttat

SEQ ID NO: 657842 - DNA, 13 bp, D. melanogaster
tggcgagggtatg

SEQ ID NO: 657843 - DNA, 13 bp, D. melanogaster
tggcgatgatgag

SEQ ID NO: 657844 - DNA, 13 bp, D. melanogaster
tggcgatgccggc

SEQ ID NO: 657845 - DNA, 13 bp, D. melanogaster
tggcgatggagat

SEQ ID NO: 657846 - DNA, 13 bp, D. melanogaster
tggcgatggcaat

SEQ ID NO: 657847 - DNA, 14 bp, D. melanogaster
tggcgatggcgatg

SEQ ID NO: 657848 - DNA, 13 bp, D. melanogaster
tggcgatggtcac

SEQ ID NO: 657849 - DNA, 14 bp, D. melanogaster
tggcgatggtgatg

SEQ ID NO: 657850 - DNA, 13 bp, D. melanogaster
tggcgatttctgg

SEQ ID NO: 657851 - DNA, 13 bp, D. melanogaster
tggcgcacagttt

SEQ ID NO: 657852 - DNA, 14 bp, D. melanogaster
tggcgcacagtttc

SEQ ID NO: 657853 - DNA, 13 bp, D. melanogaster
tggcgcagtttta

SEQ ID NO: 657854 - DNA, 13 bp, D. melanogaster
tggcgcataatta

SEQ ID NO: 657855 - DNA, 13 bp, D. melanogaster
tggcgcattaaat

SEQ ID NO: 657856 - DNA, 13 bp, D. melanogaster
tggcgcccaacgt

SEQ ID NO: 657857 - DNA, 14 bp, D. melanogaster
tggcgcccaacgtg

SEQ ID NO: 657858 - DNA, 14 bp, D. melanogaster
tggcgcccgaacag

SEQ ID NO: 657859 - DNA, 13 bp, D. melanogaster
tggcgcccgagca

SEQ ID NO: 657860 - DNA, 14 bp, D. melanogaster
tggcgcccgagcag

SEQ ID NO: 657861 - DNA, 13 bp, D. melanogaster
tggcgctgcgaga

SEQ ID NO: 657862 - DNA, 14 bp, D. melanogaster
tggcgctgctgctg

SEQ ID NO: 657863 - DNA, 13 bp, D. melanogaster
tggcgctgctttt

SEQ ID NO: 657864 - DNA, 13 bp, D. melanogaster
tggcggatggcgg

SEQ ID NO: 657865 - DNA, 14 bp, D. melanogaster
tggcggatggcgga

SEQ ID NO: 657866 - DNA, 13 bp, D. melanogaster
tggcggccataaa

SEQ ID NO: 657867 - DNA, 14 bp, D. melanogaster
tggcggccattttg

SEQ ID NO: 657868 - DNA, 13 bp, D. melanogaster
tggcggctgcttt

SEQ ID NO: 657869 - DNA, 13 bp, D. melanogaster
tggcggtgccacc

SEQ ID NO: 657870 - DNA, 13 bp, D. melanogaster
tggcggtggaaaa

SEQ ID NO: 657871 - DNA, 13 bp, D. melanogaster
tggcgtatgtgta

SEQ ID NO: 657872 - DNA, 13 bp, D. melanogaster
tggcgtcgcaact

SEQ ID NO: 657873 - DNA, 13 bp, D. melanogaster
tggcgtctttatt

SEQ ID NO: 657874 - DNA, 14 bp, D. melanogaster
tggcgttggcatca

SEQ ID NO: 657875 - DNA, 13 bp, D. melanogaster
tggcgtttctgtt

SEQ ID NO: 657876 - DNA, 13 bp, D. melanogaster
tggcgtttttatt

SEQ ID NO: 657877 - DNA, 14 bp, D. melanogaster
tggctaaaaaaaaa

SEQ ID NO: 657878 - DNA, 13 bp, D. melanogaster
tggctaaaatggc

SEQ ID NO: 657879 - DNA, 13 bp, D. melanogaster
tggctaaacaaaa

SEQ ID NO: 657880 - DNA, 13 bp, D. melanogaster
tggctaacaaagg

SEQ ID NO: 657881 - DNA, 13 bp, D. melanogaster
tggctaacacaca

SEQ ID NO: 657882 - DNA, 13 bp, D. melanogaster
tggctaagcaaat

SEQ ID NO: 657883 - DNA, 13 bp, D. melanogaster
tggctaataaaca

SEQ ID NO: 657884 - DNA, 13 bp, D. melanogaster
tggctaatgaaaa

SEQ ID NO: 657885 - DNA, 13 bp, D. melanogaster
tggctaatgaaat

SEQ ID NO: 657886 - DNA, 13 bp, D. melanogaster
tggctaattaatt

SEQ ID NO: 657887 - DNA, 13 bp, D. melanogaster
tggctacaaaatc

SEQ ID NO: 657888 - DNA, 13 bp, D. melanogaster
tggctacaaattg

SEQ ID NO: 657889 - DNA, 13 bp, D. melanogaster
tggctacaatggt

SEQ ID NO: 657890 - DNA, 13 bp, D. melanogaster
tggctaccaaaaa

SEQ ID NO: 657891 - DNA, 13 bp, D. melanogaster
tggctactgccca

SEQ ID NO: 657892 - DNA, 13 bp, D. melanogaster
tggctagattttg

SEQ ID NO: 657893 - DNA, 13 bp, D. melanogaster
tggctagctggct

SEQ ID NO: 657894 - DNA, 13 bp, D. melanogaster
tggctatatctat

SEQ ID NO: 657895 - DNA, 13 bp, D. melanogaster
tggctatatggct

SEQ ID NO: 657896 - DNA, 13 bp, D. melanogaster
tggctatgagcac

SEQ ID NO: 657897 - DNA, 13 bp, D. melanogaster
tggctatgatata

SEQ ID NO: 657898 - DNA, 13 bp, D. melanogaster
tggctatgcaaac

SEQ ID NO: 657899 - DNA, 13 bp, D. melanogaster
tggctatggctat

SEQ ID NO: 657900 - DNA, 13 bp, D. melanogaster
tggctattaaaaa

SEQ ID NO: 657901 - DNA, 13 bp, D. melanogaster
tggctattaaatt

SEQ ID NO: 657902 - DNA, 13 bp, D. melanogaster
tggctatttaaaa

SEQ ID NO: 657903 - DNA, 13 bp, D. melanogaster
tggctatttttat

SEQ ID NO: 657904 - DNA, 13 bp, D. melanogaster
tggctatttttgg

SEQ ID NO: 657905 - DNA, 13 bp, D. melanogaster
tggctcaaaaaaa

SEQ ID NO: 657906 - DNA, 13 bp, D. melanogaster
tggctcaattaaa

SEQ ID NO: 657907 - DNA, 14 bp, D. melanogaster
tggctcacacacac

SEQ ID NO: 657908 - DNA, 13 bp, D. melanogaster
tggctcatatttt

SEQ ID NO: 657909 - DNA, 13 bp, D. melanogaster
tggctcatcatct

SEQ ID NO: 657910 - DNA, 13 bp, D. melanogaster
tggctcattaaaa

SEQ ID NO: 657911 - DNA, 14 bp, D. melanogaster
tggctcatttgcat

SEQ ID NO: 657912 - DNA, 13 bp, D. melanogaster
tggctcgacggcc

SEQ ID NO: 657913 - DNA, 13 bp, D. melanogaster
tggctcgtaaatt

SEQ ID NO: 657914 - DNA, 13 bp, D. melanogaster
tggctctcaaatt

SEQ ID NO: 657915 - DNA, 13 bp, D. melanogaster
tggctctgcagga

SEQ ID NO: 657916 - DNA, 13 bp, D. melanogaster
tggctctggctct

SEQ ID NO: 657917 - DNA, 14 bp, D. melanogaster
tggctctggctctg

SEQ ID NO: 657918 - DNA, 13 bp, D. melanogaster
tggctcttggctt

SEQ ID NO: 657919 - DNA, 13 bp, D. melanogaster
tggctcttggtca

SEQ ID NO: 657920 - DNA, 13 bp, D. melanogaster
tggctcttttaat

SEQ ID NO: 657921 - DNA, 13 bp, D. melanogaster
tggctgaaaagtg

SEQ ID NO: 657922 - DNA, 13 bp, D. melanogaster
tggctgaaaattt

SEQ ID NO: 657923 - DNA, 13 bp, D. melanogaster
tggctgaaataat

SEQ ID NO: 657924 - DNA, 13 bp, D. melanogaster
tggctgaaatatt

SEQ ID NO: 657925 - DNA, 13 bp, D. melanogaster
tggctgaaatcaa

SEQ ID NO: 657926 - DNA, 13 bp, D. melanogaster
tggctgacatatt

SEQ ID NO: 657927 - DNA, 14 bp, D. melanogaster
tggctgactggctg

SEQ ID NO: 657928 - DNA, 13 bp, D. melanogaster
tggctgacttttg

SEQ ID NO: 657929 - DNA, 13 bp, D. melanogaster
tggctgagatcgg

SEQ ID NO: 657930 - DNA, 14 bp, D. melanogaster
tggctgagatcggt

SEQ ID NO: 657931 - DNA, 13 bp, D. melanogaster
tggctgatggctg

SEQ ID NO: 657932 - DNA, 13 bp, D. melanogaster
tggctgcaacaaa

SEQ ID NO: 657933 - DNA, 13 bp, D. melanogaster
tggctgcaactgc

SEQ ID NO: 657934 - DNA, 13 bp, D. melanogaster
tggctgcaacttt

SEQ ID NO: 657935 - DNA, 13 bp, D. melanogaster
tggctgcaaggcg

SEQ ID NO: 657936 - DNA, 13 bp, D. melanogaster
tggctgcaattgt

SEQ ID NO: 657937 - DNA, 13 bp, D. melanogaster
tggctgcaatttt

SEQ ID NO: 657938 - DNA, 13 bp, D. melanogaster
tggctgcactgca

SEQ ID NO: 657939 - DNA, 13 bp, D. melanogaster
tggctgcacttaa

SEQ ID NO: 657940 - DNA, 13 bp, D. melanogaster
tggctgcactttg

SEQ ID NO: 657941 - DNA, 13 bp, D. melanogaster
tggctgcataatt

SEQ ID NO: 657942 - DNA, 13 bp, D. melanogaster
tggctgcatttca

SEQ ID NO: 657943 - DNA, 13 bp, D. melanogaster
tggctgcattttg

SEQ ID NO: 657944 - DNA, 13 bp, D. melanogaster
tggctgccaaaaa

SEQ ID NO: 657945 - DNA, 13 bp, D. melanogaster
tggctgccaaagg

SEQ ID NO: 657946 - DNA, 13 bp, D. melanogaster
tggctgccaaatg

SEQ ID NO: 657947 - DNA, 13 bp, D. melanogaster
tggctgccaaatt

SEQ ID NO: 657948 - DNA, 13 bp, D. melanogaster
tggctgccaattg

SEQ ID NO: 657949 - DNA, 13 bp, D. melanogaster
tggctgccacaca

SEQ ID NO: 657950 - DNA, 13 bp, D. melanogaster
tggctgccactcg

SEQ ID NO: 657951 - DNA, 13 bp, D. melanogaster
tggctgccagttt

SEQ ID NO: 657952 - DNA, 13 bp, D. melanogaster
tggctgccataaa

SEQ ID NO: 657953 - DNA, 13 bp, D. melanogaster
tggctgccattaa

SEQ ID NO: 657954 - DNA, 13 bp, D. melanogaster
tggctgccattgt

SEQ ID NO: 657955 - DNA, 13 bp, D. melanogaster
tggctgccgctgc

SEQ ID NO: 657956 - DNA, 14 bp, D. melanogaster
tggctgccgctgct

SEQ ID NO: 657957 - DNA, 13 bp, D. melanogaster
tggctgccgtttt

SEQ ID NO: 657958 - DNA, 13 bp, D. melanogaster
tggctgcctgcct

SEQ ID NO: 657959 - DNA, 13 bp, D. melanogaster
tggctgcctgcgt

SEQ ID NO: 657960 - DNA, 13 bp, D. melanogaster
tggctgcctggct

SEQ ID NO: 657961 - DNA, 14 bp, D. melanogaster
tggctgcctggctg

SEQ ID NO: 657962 - DNA, 13 bp, D. melanogaster
tggctgcctggtt

SEQ ID NO: 657963 - DNA, 13 bp, D. melanogaster
tggctgcctttcc

SEQ ID NO: 657964 - DNA, 13 bp, D. melanogaster
tggctgcctttta

SEQ ID NO: 657965 - DNA, 13 bp, D. melanogaster
tggctgcggaact

SEQ ID NO: 657966 - DNA, 13 bp, D. melanogaster
tggctgctattaa

SEQ ID NO: 657967 - DNA, 14 bp, D. melanogaster
tggctgctccctcg

SEQ ID NO: 657968 - DNA, 13 bp, D. melanogaster
tggctgctccttt

SEQ ID NO: 657969 - DNA, 13 bp, D. melanogaster
tggctgctgcatt

SEQ ID NO: 657970 - DNA, 13 bp, D. melanogaster
tggctgctgccat

SEQ ID NO: 657971 - DNA, 13 bp, D. melanogaster
tggctgctgctga

SEQ ID NO: 657972 - DNA, 14 bp, D. melanogaster
tggctgctgctgtt

SEQ ID NO: 657973 - DNA, 13 bp, D. melanogaster
tggctgctgcttt

SEQ ID NO: 657974 - DNA, 13 bp, D. melanogaster
tggctgctggctg

SEQ ID NO: 657975 - DNA, 13 bp, D. melanogaster
tggctgctgtggc

SEQ ID NO: 657976 - DNA, 14 bp, D. melanogaster
tggctgctgttgct

SEQ ID NO: 657977 - DNA, 13 bp, D. melanogaster
tggctgctgttgt

SEQ ID NO: 657978 - DNA, 14 bp, D. melanogaster
tggctgctgttgtt

SEQ ID NO: 657979 - DNA, 13 bp, D. melanogaster
tggctgcttccgg

SEQ ID NO: 657980 - DNA, 13 bp, D. melanogaster
tggctgcttggct

SEQ ID NO: 657981 - DNA, 13 bp, D. melanogaster
tggctgctttgtt

SEQ ID NO: 657982 - DNA, 13 bp, D. melanogaster
tggctgctttttg

SEQ ID NO: 657983 - DNA, 13 bp, D. melanogaster
tggctggaaaact

SEQ ID NO: 657984 - DNA, 13 bp, D. melanogaster
tggctggagcact

SEQ ID NO: 657985 - DNA, 13 bp, D. melanogaster
tggctggatggat

SEQ ID NO: 657986 - DNA, 13 bp, D. melanogaster
tggctggcaaaaa

SEQ ID NO: 657987 - DNA, 13 bp, D. melanogaster
tggctggcaaatt

SEQ ID NO: 657988 - DNA, 14 bp, D. melanogaster
tggctggcaaattg

SEQ ID NO: 657989 - DNA, 13 bp, D. melanogaster
tggctggcaattg

SEQ ID NO: 657990 - DNA, 13 bp, D. melanogaster
tggctggcaattt

SEQ ID NO: 657991 - DNA, 13 bp, D. melanogaster
tggctggcagttt

SEQ ID NO: 657992 - DNA, 13 bp, D. melanogaster
tggctggcatttg

SEQ ID NO: 657993 - DNA, 14 bp, D. melanogaster
tggctggccataaa

SEQ ID NO: 657994 - DNA, 13 bp, D. melanogaster
tggctggcctggc

SEQ ID NO: 657995 - DNA, 13 bp, D. melanogaster
tggctggctgcct

SEQ ID NO: 657996 - DNA, 14 bp, D. melanogaster
tggctggctgcctg

SEQ ID NO: 657997 - DNA, 13 bp, D. melanogaster
tggctggctggca

SEQ ID NO: 657998 - DNA, 14 bp, D. melanogaster
tggctggctggcaa

SEQ ID NO: 657999 - DNA, 14 bp, D. melanogaster
tggctggctggcag

SEQ ID NO: 658000 - DNA, 13 bp, D. melanogaster
tggctggctggct

SEQ ID NO: 658001 - DNA, 14 bp, D. melanogaster
tggctggctggctg

SEQ ID NO: 658002 - DNA, 13 bp, D. melanogaster
tggctggctgtct

SEQ ID NO: 658003 - DNA, 13 bp, D. melanogaster
tggctggcttgct

SEQ ID NO: 658004 - DNA, 13 bp, D. melanogaster
tggctgggaaaat

SEQ ID NO: 658005 - DNA, 13 bp, D. melanogaster
tggctggggcatt

SEQ ID NO: 658006 - DNA, 13 bp, D. melanogaster
tggctgggtggct

SEQ ID NO: 658007 - DNA, 13 bp, D. melanogaster
tggctggttggct

SEQ ID NO: 658008 - DNA, 14 bp, D. melanogaster
tggctggttggctg

SEQ ID NO: 658009 - DNA, 13 bp, D. melanogaster
tggctgtaactgt

SEQ ID NO: 658010 - DNA, 13 bp, D. melanogaster
tggctgtcaaact

SEQ ID NO: 658011 - DNA, 13 bp, D. melanogaster
tggctgtctgtct

SEQ ID NO: 658012 - DNA, 13 bp, D. melanogaster
tggctgtggatgt

SEQ ID NO: 658013 - DNA, 14 bp, D. melanogaster
tggctgtggatgtg

SEQ ID NO: 658014 - DNA, 13 bp, D. melanogaster
tggctgtggctgt

SEQ ID NO: 658015 - DNA, 14 bp, D. melanogaster
tggctgtggctgtg

SEQ ID NO: 658016 - DNA, 13 bp, D. melanogaster
tggctgtgtgcgt

SEQ ID NO: 658017 - DNA, 13 bp, D. melanogaster
tggctgtgtggca

SEQ ID NO: 658018 - DNA, 13 bp, D. melanogaster
tggctgttgaaaa

SEQ ID NO: 658019 - DNA, 13 bp, D. melanogaster
tggctgttgattt

SEQ ID NO: 658020 - DNA, 13 bp, D. melanogaster
tggctgtttattt

SEQ ID NO: 658021 - DNA, 15 bp, D. melanogaster
tggctgttttccgat

SEQ ID NO: 658022 - DNA, 13 bp, D. melanogaster
tggctgttttcga

SEQ ID NO: 658023 - DNA, 13 bp, D. melanogaster
tggcttaaaaatt

SEQ ID NO: 658024 - DNA, 13 bp, D. melanogaster
tggcttaactttt

SEQ ID NO: 658025 - DNA, 14 bp, D. melanogaster
tggcttaattaaaa

SEQ ID NO: 658026 - DNA, 13 bp, D. melanogaster
tggcttaattaag

SEQ ID NO: 658027 - DNA, 13 bp, D. melanogaster
tggcttaattgca

SEQ ID NO: 658028 - DNA, 13 bp, D. melanogaster
tggcttcataatt

SEQ ID NO: 658029 - DNA, 13 bp, D. melanogaster
tggcttccatttc

SEQ ID NO: 658030 - DNA, 13 bp, D. melanogaster
tggcttccatttt

SEQ ID NO: 658031 - DNA, 13 bp, D. melanogaster
tggcttcctttgt

SEQ ID NO: 658032 - DNA, 13 bp, D. melanogaster
tggcttcgaggtg

SEQ ID NO: 658033 - DNA, 13 bp, D. melanogaster
tggcttcgatttg

SEQ ID NO: 658034 - DNA, 14 bp, D. melanogaster
tggcttcttattgt

SEQ ID NO: 658035 - DNA, 13 bp, D. melanogaster
tggcttgattgat

SEQ ID NO: 658036 - DNA, 13 bp, D. melanogaster
tggcttgcacttt

SEQ ID NO: 658037 - DNA, 13 bp, D. melanogaster
tggcttgccaaaa

SEQ ID NO: 658038 - DNA, 13 bp, D. melanogaster
tggcttgccgact

SEQ ID NO: 658039 - DNA, 13 bp, D. melanogaster
tggcttggaaaaa

SEQ ID NO: 658040 - DNA, 13 bp, D. melanogaster
tggcttggattgg

SEQ ID NO: 658041 - DNA, 13 bp, D. melanogaster
tggcttggatttc

SEQ ID NO: 658042 - DNA, 13 bp, D. melanogaster
tggcttggatttt

SEQ ID NO: 658043 - DNA, 13 bp, D. melanogaster
tggcttggcaaca

SEQ ID NO: 658044 - DNA, 13 bp, D. melanogaster
tggcttggccaaa

SEQ ID NO: 658045 - DNA, 13 bp, D. melanogaster
tggcttggctggc

SEQ ID NO: 658046 - DNA, 13 bp, D. melanogaster
tggcttggcttgg

SEQ ID NO: 658047 - DNA, 13 bp, D. melanogaster
tggcttggttttc

SEQ ID NO: 658048 - DNA, 13 bp, D. melanogaster
tggcttgtgggcg

SEQ ID NO: 658049 - DNA, 13 bp, D. melanogaster
tggctttaaaaaa

SEQ ID NO: 658050 - DNA, 13 bp, D. melanogaster
tggctttaaagtt

SEQ ID NO: 658051 - DNA, 13 bp, D. melanogaster
tggctttaacttt

SEQ ID NO: 658052 - DNA, 13 bp, D. melanogaster
tggctttaagcca

SEQ ID NO: 658053 - DNA, 13 bp, D. melanogaster
tggctttaatggc

SEQ ID NO: 658054 - DNA, 13 bp, D. melanogaster
tggctttaattag

SEQ ID NO: 658055 - DNA, 13 bp, D. melanogaster
tggctttaattgt

SEQ ID NO: 658056 - DNA, 13 bp, D. melanogaster
tggctttattttg

SEQ ID NO: 658057 - DNA, 13 bp, D. melanogaster
tggctttcgcttt

SEQ ID NO: 658058 - DNA, 13 bp, D. melanogaster
tggctttcggttt

SEQ ID NO: 658059 - DNA, 13 bp, D. melanogaster
tggctttgaaatt

SEQ ID NO: 658060 - DNA, 13 bp, D. melanogaster
tggctttgagttt

SEQ ID NO: 658061 - DNA, 13 bp, D. melanogaster
tggctttgatttc

SEQ ID NO: 658062 - DNA, 13 bp, D. melanogaster
tggctttgcaaat

SEQ ID NO: 658063 - DNA, 13 bp, D. melanogaster
tggctttgcatat

SEQ ID NO: 658064 - DNA, 13 bp, D. melanogaster
tggctttgcattt

SEQ ID NO: 658065 - DNA, 13 bp, D. melanogaster
tggctttgccatt

SEQ ID NO: 658066 - DNA, 13 bp, D. melanogaster
tggctttggaatc

SEQ ID NO: 658067 - DNA, 13 bp, D. melanogaster
tggctttggccat

SEQ ID NO: 658068 - DNA, 13 bp, D. melanogaster
tggctttggcgct

SEQ ID NO: 658069 - DNA, 13 bp, D. melanogaster
tggctttggctac

SEQ ID NO: 658070 - DNA, 13 bp, D. melanogaster
tggctttggctgc

SEQ ID NO: 658071 - DNA, 13 bp, D. melanogaster
tggctttggctgt

SEQ ID NO: 658072 - DNA, 13 bp, D. melanogaster
tggctttggcttg

SEQ ID NO: 658073 - DNA, 13 bp, D. melanogaster
tggctttggcttt

SEQ ID NO: 658074 - DNA, 14 bp, D. melanogaster
tggctttggctttc

SEQ ID NO: 658075 - DNA, 13 bp, D. melanogaster
tggctttggtggc

SEQ ID NO: 658076 - DNA, 13 bp, D. melanogaster
tggctttgtaatt

SEQ ID NO: 658077 - DNA, 13 bp, D. melanogaster
tggctttgtgtgc

SEQ ID NO: 658078 - DNA, 13 bp, D. melanogaster
tggcttttaaatt

SEQ ID NO: 658079 - DNA, 13 bp, D. melanogaster
tggcttttacttt

SEQ ID NO: 658080 - DNA, 13 bp, D. melanogaster
tggcttttatggc

SEQ ID NO: 658081 - DNA, 13 bp, D. melanogaster
tggcttttatttc

SEQ ID NO: 658082 - DNA, 13 bp, D. melanogaster
tggcttttcattc

SEQ ID NO: 658083 - DNA, 13 bp, D. melanogaster
tggcttttcattt

SEQ ID NO: 658084 - DNA, 14 bp, D. melanogaster
tggcttttcatttt

SEQ ID NO: 658085 - DNA, 13 bp, D. melanogaster
tggcttttccacc

SEQ ID NO: 658086 - DNA, 13 bp, D. melanogaster
tggcttttcccct

SEQ ID NO: 658087 - DNA, 13 bp, D. melanogaster
tggcttttccttc

SEQ ID NO: 658088 - DNA, 13 bp, D. melanogaster
tggcttttgaatt

SEQ ID NO: 658089 - DNA, 13 bp, D. melanogaster
tggcttttgcctt

SEQ ID NO: 658090 - DNA, 13 bp, D. melanogaster
tggcttttgctaa

SEQ ID NO: 658091 - DNA, 13 bp, D. melanogaster
tggcttttggcta

SEQ ID NO: 658092 - DNA, 13 bp, D. melanogaster
tggcttttgttgc

SEQ ID NO: 658093 - DNA, 13 bp, D. melanogaster
tggctttttgatt

SEQ ID NO: 658094 - DNA, 13 bp, D. melanogaster
tggctttttggct

SEQ ID NO: 658095 - DNA, 13 bp, D. melanogaster
tggctttttgtgc

SEQ ID NO: 658096 - DNA, 13 bp, D. melanogaster
tgggaaaaaacac

SEQ ID NO: 658097 - DNA, 13 bp, D. melanogaster
tgggaaaaaattg

SEQ ID NO: 658098 - DNA, 13 bp, D. melanogaster
tgggaaaaacatt

SEQ ID NO: 658099 - DNA, 13 bp, D. melanogaster
tgggaaaaaccaa

SEQ ID NO: 658100 - DNA, 13 bp, D. melanogaster
tgggaaaaatggg

SEQ ID NO: 658101 - DNA, 14 bp, D. melanogaster
tgggaaaacaaaaa

SEQ ID NO: 658102 - DNA, 13 bp, D. melanogaster
tgggaaaacaaat

SEQ ID NO: 658103 - DNA, 13 bp, D. melanogaster
tgggaaaacacaa

SEQ ID NO: 658104 - DNA, 13 bp, D. melanogaster
tgggaaaactaaa

SEQ ID NO: 658105 - DNA, 13 bp, D. melanogaster
tgggaaaactgca

SEQ ID NO: 658106 - DNA, 13 bp, D. melanogaster
tgggaaaactggg

SEQ ID NO: 658107 - DNA, 13 bp, D. melanogaster
tgggaaaacttaa

SEQ ID NO: 658108 - DNA, 13 bp, D. melanogaster
tgggaaaactttt

SEQ ID NO: 658109 - DNA, 13 bp, D. melanogaster
tgggaaaagcact

SEQ ID NO: 658110 - DNA, 13 bp, D. melanogaster
tgggaaaagcgga

SEQ ID NO: 658111 - DNA, 13 bp, D. melanogaster
tgggaaaagcggg

SEQ ID NO: 658112 - DNA, 13 bp, D. melanogaster
tgggaaaagtaaa

SEQ ID NO: 658113 - DNA, 13 bp, D. melanogaster
tgggaaaagttga

SEQ ID NO: 658114 - DNA, 13 bp, D. melanogaster
tgggaaaatattt

SEQ ID NO: 658115 - DNA, 14 bp, D. melanogaster
tgggaaaatatttt

SEQ ID NO: 658116 - DNA, 13 bp, D. melanogaster
tgggaaaatcaaa

SEQ ID NO: 658117 - DNA, 13 bp, D. melanogaster
tgggaaaatccaa

SEQ ID NO: 658118 - DNA, 13 bp, D. melanogaster
tgggaaaatcgag

SEQ ID NO: 658119 - DNA, 13 bp, D. melanogaster
tgggaaaatgctg

SEQ ID NO: 658120 - DNA, 13 bp, D. melanogaster
tgggaaaatgtat

SEQ ID NO: 658121 - DNA, 13 bp, D. melanogaster
tgggaaaatgtgt

SEQ ID NO: 658122 - DNA, 13 bp, D. melanogaster
tgggaaaatgttt

SEQ ID NO: 658123 - DNA, 13 bp, D. melanogaster
tgggaaaattttt

SEQ ID NO: 658124 - DNA, 14 bp, D. melanogaster
tgggaaaatttttt

SEQ ID NO: 658125 - DNA, 13 bp, D. melanogaster
tgggaaacaagcc

SEQ ID NO: 658126 - DNA, 13 bp, D. melanogaster
tgggaaactggaa

SEQ ID NO: 658127 - DNA, 13 bp, D. melanogaster
tgggaaacttttc

SEQ ID NO: 658128 - DNA, 13 bp, D. melanogaster
tgggaaagatagc

SEQ ID NO: 658129 - DNA, 13 bp, D. melanogaster
tgggaaagcaaaa

SEQ ID NO: 658130 - DNA, 13 bp, D. melanogaster
tgggaaagtttca

SEQ ID NO: 658131 - DNA, 13 bp, D. melanogaster
tgggaaagttttt

SEQ ID NO: 658132 - DNA, 13 bp, D. melanogaster
tgggaaataaaat

SEQ ID NO: 658133 - DNA, 13 bp, D. melanogaster
tgggaaataaata

SEQ ID NO: 658134 - DNA, 13 bp, D. melanogaster
tgggaaatctaat

SEQ ID NO: 658135 - DNA, 14 bp, D. melanogaster
tgggaaatctaatg

SEQ ID NO: 658136 - DNA, 13 bp, D. melanogaster
tgggaaatgcatt

SEQ ID NO: 658137 - DNA, 13 bp, D. melanogaster
tgggaaatgcgga

SEQ ID NO: 658138 - DNA, 13 bp, D. melanogaster
tgggaaatggagt

SEQ ID NO: 658139 - DNA, 14 bp, D. melanogaster
tgggaaatggagtt

SEQ ID NO: 658140 - DNA, 13 bp, D. melanogaster
tgggaaatggcaa

SEQ ID NO: 658141 - DNA, 13 bp, D. melanogaster
tgggaaatggcca

SEQ ID NO: 658142 - DNA, 14 bp, D. melanogaster
tgggaaatgggaaa

SEQ ID NO: 658143 - DNA, 13 bp, D. melanogaster
tgggaaatgggga

SEQ ID NO: 658144 - DNA, 13 bp, D. melanogaster
tgggaaatgggtt

SEQ ID NO: 658145 - DNA, 13 bp, D. melanogaster
tgggaaatgtgtg

SEQ ID NO: 658146 - DNA, 13 bp, D. melanogaster
tgggaaatgtgtt

SEQ ID NO: 658147 - DNA, 13 bp, D. melanogaster
tgggaaatttgca

SEQ ID NO: 658148 - DNA, 13 bp, D. melanogaster
tgggaagctggag

SEQ ID NO: 658149 - DNA, 13 bp, D. melanogaster
tgggaagtggaag

SEQ ID NO: 658150 - DNA, 13 bp, D. melanogaster
tgggaagtgttaa

SEQ ID NO: 658151 - DNA, 13 bp, D. melanogaster
tgggaatataaaa

SEQ ID NO: 658152 - DNA, 13 bp, D. melanogaster
tgggaatatttat

SEQ ID NO: 658153 - DNA, 13 bp, D. melanogaster
tgggaatgaggat

SEQ ID NO: 658154 - DNA, 13 bp, D. melanogaster
tgggaatgccact

SEQ ID NO: 658155 - DNA, 16 bp, D. melanogaster
tgggaatggaaatggg

SEQ ID NO: 658156 - DNA, 13 bp, D. melanogaster
tgggaatggcaat

SEQ ID NO: 658157 - DNA, 13 bp, D. melanogaster
tgggaatggggaa

SEQ ID NO: 658158 - DNA, 13 bp, D. melanogaster
tgggaatggggat

SEQ ID NO: 658159 - DNA, 14 bp, D. melanogaster
tgggaatggggatg

SEQ ID NO: 658160 - DNA, 13 bp, D. melanogaster
tgggaattaaatt

SEQ ID NO: 658161 - DNA, 13 bp, D. melanogaster
tgggaattcagaa

SEQ ID NO: 658162 - DNA, 13 bp, D. melanogaster
tgggaattggaat

SEQ ID NO: 658163 - DNA, 13 bp, D. melanogaster
tgggaattgtctt

SEQ ID NO: 658164 - DNA, 13 bp, D. melanogaster
tgggaatttcatt

SEQ ID NO: 658165 - DNA, 14 bp, D. melanogaster
tgggactcaaagaa

SEQ ID NO: 658166 - DNA, 13 bp, D. melanogaster
tgggactgggaat

SEQ ID NO: 658167 - DNA, 13 bp, D. melanogaster
tgggacttctatt

SEQ ID NO: 658168 - DNA, 13 bp, D. melanogaster
tgggagaagtcta

SEQ ID NO: 658169 - DNA, 13 bp, D. melanogaster
tgggagaccacag

SEQ ID NO: 658170 - DNA, 13 bp, D. melanogaster
tgggagagagttg

SEQ ID NO: 658171 - DNA, 13 bp, D. melanogaster
tgggagcgagagg

SEQ ID NO: 658172 - DNA, 13 bp, D. melanogaster
tgggagcgggaaa

SEQ ID NO: 658173 - DNA, 13 bp, D. melanogaster
tgggagctggaaa

SEQ ID NO: 658174 - DNA, 13 bp, D. melanogaster
tgggagctgggaa

SEQ ID NO: 658175 - DNA, 13 bp, D. melanogaster
tgggagtaagctg

SEQ ID NO: 658176 - DNA, 13 bp, D. melanogaster
tgggagtggaaaa

SEQ ID NO: 658177 - DNA, 14 bp, D. melanogaster
tgggagtggaagtg

SEQ ID NO: 658178 - DNA, 13 bp, D. melanogaster
tgggagtggcaaa

SEQ ID NO: 658179 - DNA, 13 bp, D. melanogaster
tgggagtggcagt

SEQ ID NO: 658180 - DNA, 13 bp, D. melanogaster
tgggagtgggaat

SEQ ID NO: 658181 - DNA, 13 bp, D. melanogaster
tgggagtttttga

SEQ ID NO: 658182 - DNA, 13 bp, D. melanogaster
tgggataaaaata

SEQ ID NO: 658183 - DNA, 14 bp, D. melanogaster
tgggatcaggaatt

SEQ ID NO: 658184 - DNA, 13 bp, D. melanogaster
tgggatcggatcg

SEQ ID NO: 658185 - DNA, 13 bp, D. melanogaster
tgggatggaaaat

SEQ ID NO: 658186 - DNA, 13 bp, D. melanogaster
tgggatggcatgg

SEQ ID NO: 658187 - DNA, 13 bp, D. melanogaster
tgggatgtgggat

SEQ ID NO: 658188 - DNA, 13 bp, D. melanogaster
tgggatgttggga

SEQ ID NO: 658189 - DNA, 13 bp, D. melanogaster
tgggattcggatt

SEQ ID NO: 658190 - DNA, 13 bp, D. melanogaster
tgggattgagatt

SEQ ID NO: 658191 - DNA, 13 bp, D. melanogaster
tgggattgcagaa

SEQ ID NO: 658192 - DNA, 14 bp, D. melanogaster
tgggattggattgg

SEQ ID NO: 658193 - DNA, 14 bp, D. melanogaster
tgggattgggactg

SEQ ID NO: 658194 - DNA, 14 bp, D. melanogaster
tgggattgggattc

SEQ ID NO: 658195 - DNA, 13 bp, D. melanogaster
tgggatttgcatt

SEQ ID NO: 658196 - DNA, 13 bp, D. melanogaster
tgggattttacag

SEQ ID NO: 658197 - DNA, 13 bp, D. melanogaster
tgggattttattg

SEQ ID NO: 658198 - DNA, 13 bp, D. melanogaster
tgggatttttctt

SEQ ID NO: 658199 - DNA, 14 bp, D. melanogaster
tgggatttttcttg

SEQ ID NO: 658200 - DNA, 13 bp, D. melanogaster
tgggcaaaaacaa

SEQ ID NO: 658201 - DNA, 14 bp, D. melanogaster
tgggcaaaaacaaa

SEQ ID NO: 658202 - DNA, 13 bp, D. melanogaster
tgggcaaaaagtt

SEQ ID NO: 658203 - DNA, 13 bp, D. melanogaster
tgggcaaaaataa

SEQ ID NO: 658204 - DNA, 13 bp, D. melanogaster
tgggcaaaaatgc

SEQ ID NO: 658205 - DNA, 13 bp, D. melanogaster
tgggcaaaacttt

SEQ ID NO: 658206 - DNA, 13 bp, D. melanogaster
tgggcaaaagatc

SEQ ID NO: 658207 - DNA, 13 bp, D. melanogaster
tgggcaaaagcaa

SEQ ID NO: 658208 - DNA, 13 bp, D. melanogaster
tgggcaaaataaa

SEQ ID NO: 658209 - DNA, 13 bp, D. melanogaster
tgggcaaacaaaa

SEQ ID NO: 658210 - DNA, 14 bp, D. melanogaster
tgggcaaacaaaaa

SEQ ID NO: 658211 - DNA, 13 bp, D. melanogaster
tgggcaaacaatg

SEQ ID NO: 658212 - DNA, 13 bp, D. melanogaster
tgggcaaacaatt

SEQ ID NO: 658213 - DNA, 13 bp, D. melanogaster
tgggcaaacactt

SEQ ID NO: 658214 - DNA, 13 bp, D. melanogaster
tgggcaaacagaa

SEQ ID NO: 658215 - DNA, 13 bp, D. melanogaster
tgggcaaacatgg

SEQ ID NO: 658216 - DNA, 13 bp, D. melanogaster
tgggcaaacattt

SEQ ID NO: 658217 - DNA, 13 bp, D. melanogaster
tgggcaaacgaaa

SEQ ID NO: 658218 - DNA, 13 bp, D. melanogaster
tgggcaaacgcgg

SEQ ID NO: 658219 - DNA, 13 bp, D. melanogaster
tgggcaaagccaa

SEQ ID NO: 658220 - DNA, 13 bp, D. melanogaster
tgggcaaataaat

SEQ ID NO: 658221 - DNA, 13 bp, D. melanogaster
tgggcaaatgcaa

SEQ ID NO: 658222 - DNA, 13 bp, D. melanogaster
tgggcaacaaaaa

SEQ ID NO: 658223 - DNA, 13 bp, D. melanogaster
tgggcaacggcac

SEQ ID NO: 658224 - DNA, 13 bp, D. melanogaster
tgggcaactgggc

SEQ ID NO: 658225 - DNA, 13 bp, D. melanogaster
tgggcaacttttt

SEQ ID NO: 658226 - DNA, 13 bp, D. melanogaster
tgggcaataaaaa

SEQ ID NO: 658227 - DNA, 13 bp, D. melanogaster
tgggcaataaaat

SEQ ID NO: 658228 - DNA, 13 bp, D. melanogaster
tgggcaatcgaaa

SEQ ID NO: 658229 - DNA, 13 bp, D. melanogaster
tgggcaatgcact

SEQ ID NO: 658230 - DNA, 13 bp, D. melanogaster
tgggcaattaaaa

SEQ ID NO: 658231 - DNA, 13 bp, D. melanogaster
tgggcaattattt

SEQ ID NO: 658232 - DNA, 14 bp, D. melanogaster
tgggcacacacaca

SEQ ID NO: 658233 - DNA, 13 bp, D. melanogaster
tgggcactgggca

SEQ ID NO: 658234 - DNA, 13 bp, D. melanogaster
tgggcagcaaaaa

SEQ ID NO: 658235 - DNA, 13 bp, D. melanogaster
tgggcaggaaaaa

SEQ ID NO: 658236 - DNA, 13 bp, D. melanogaster
tgggcagtaaatt

SEQ ID NO: 658237 - DNA, 13 bp, D. melanogaster
tgggcagtagact

SEQ ID NO: 658238 - DNA, 13 bp, D. melanogaster
tgggcagtagcca

SEQ ID NO: 658239 - DNA, 13 bp, D. melanogaster
tgggcataagtat

SEQ ID NO: 658240 - DNA, 13 bp, D. melanogaster
tgggcataattaa

SEQ ID NO: 658241 - DNA, 13 bp, D. melanogaster
tgggcatattttt

SEQ ID NO: 658242 - DNA, 13 bp, D. melanogaster
tgggcatgcaaat

SEQ ID NO: 658243 - DNA, 13 bp, D. melanogaster
tgggcatggaaat

SEQ ID NO: 658244 - DNA, 13 bp, D. melanogaster
tgggcatgggtat

SEQ ID NO: 658245 - DNA, 13 bp, D. melanogaster
tgggcatgtttgt

SEQ ID NO: 658246 - DNA, 13 bp, D. melanogaster
tgggcattaattt

SEQ ID NO: 658247 - DNA, 14 bp, D. melanogaster
tgggcattatggtg

SEQ ID NO: 658248 - DNA, 13 bp, D. melanogaster
tgggcattttgtt

SEQ ID NO: 658249 - DNA, 13 bp, D. melanogaster
tgggccaaaaact

SEQ ID NO: 658250 - DNA, 13 bp, D. melanogaster
tgggccaaaaaga

SEQ ID NO: 658251 - DNA, 13 bp, D. melanogaster
tgggccaaaaagt

SEQ ID NO: 658252 - DNA, 13 bp, D. melanogaster
tgggccaaaacaa

SEQ ID NO: 658253 - DNA, 13 bp, D. melanogaster
tgggccaaaactt

SEQ ID NO: 658254 - DNA, 13 bp, D. melanogaster
tgggccaaaagtt

SEQ ID NO: 658255 - DNA, 13 bp, D. melanogaster
tgggccaaaatgg

SEQ ID NO: 658256 - DNA, 13 bp, D. melanogaster
tgggccaaacaat

SEQ ID NO: 658257 - DNA, 13 bp, D. melanogaster
tgggccaaaccga

SEQ ID NO: 658258 - DNA, 13 bp, D. melanogaster
tgggccaaagcaa

SEQ ID NO: 658259 - DNA, 13 bp, D. melanogaster
tgggccaaagttt

SEQ ID NO: 658260 - DNA, 13 bp, D. melanogaster
tgggccaaattaa

SEQ ID NO: 658261 - DNA, 13 bp, D. melanogaster
tgggccaacaaat

SEQ ID NO: 658262 - DNA, 13 bp, D. melanogaster
tgggccaacactt

SEQ ID NO: 658263 - DNA, 13 bp, D. melanogaster
tgggccaacattt

SEQ ID NO: 658264 - DNA, 13 bp, D. melanogaster
tgggccaactgtt

SEQ ID NO: 658265 - DNA, 13 bp, D. melanogaster
tgggccacgccca

SEQ ID NO: 658266 - DNA, 14 bp, D. melanogaster
tgggccacgcccac

SEQ ID NO: 658267 - DNA, 13 bp, D. melanogaster
tgggccatcaaaa

SEQ ID NO: 658268 - DNA, 13 bp, D. melanogaster
tgggcccagtcca

SEQ ID NO: 658269 - DNA, 13 bp, D. melanogaster
tgggcccataacc

SEQ ID NO: 658270 - DNA, 13 bp, D. melanogaster
tgggcctagtttt

SEQ ID NO: 658271 - DNA, 13 bp, D. melanogaster
tgggcctgtacga

SEQ ID NO: 658272 - DNA, 13 bp, D. melanogaster
tgggcgaaaagtt

SEQ ID NO: 658273 - DNA, 13 bp, D. melanogaster
tgggcgaaaatgg

SEQ ID NO: 658274 - DNA, 13 bp, D. melanogaster
tgggcgaaagtgg

SEQ ID NO: 658275 - DNA, 13 bp, D. melanogaster
tgggcgaaatgaa

SEQ ID NO: 658276 - DNA, 13 bp, D. melanogaster
tgggcgaaatggg

SEQ ID NO: 658277 - DNA, 13 bp, D. melanogaster
tgggcgatgttct

SEQ ID NO: 658278 - DNA, 13 bp, D. melanogaster
tgggcgccagagg

SEQ ID NO: 658279 - DNA, 13 bp, D. melanogaster
tgggcgccataaa

SEQ ID NO: 658280 - DNA, 13 bp, D. melanogaster
tgggcgcgagtgt

SEQ ID NO: 658281 - DNA, 13 bp, D. melanogaster
tgggcggaaaatt

SEQ ID NO: 658282 - DNA, 13 bp, D. melanogaster
tgggcggatgggc

SEQ ID NO: 658283 - DNA, 13 bp, D. melanogaster
tgggcggtggaaa

SEQ ID NO: 658284 - DNA, 13 bp, D. melanogaster
tgggcggtgggca

SEQ ID NO: 658285 - DNA, 13 bp, D. melanogaster
tgggcgtcgcatt

SEQ ID NO: 658286 - DNA, 13 bp, D. melanogaster
tgggcgtgacagt

SEQ ID NO: 658287 - DNA, 13 bp, D. melanogaster
tgggcgtgaccgg

SEQ ID NO: 658288 - DNA, 13 bp, D. melanogaster
tgggcgtggcaaa

SEQ ID NO: 658289 - DNA, 13 bp, D. melanogaster
tgggcgtggcaac

SEQ ID NO: 658290 - DNA, 14 bp, D. melanogaster
tgggcgtggcaaca

SEQ ID NO: 658291 - DNA, 14 bp, D. melanogaster
tgggcgtggcaagt

SEQ ID NO: 658292 - DNA, 14 bp, D. melanogaster
tgggcgtggcactc

SEQ ID NO: 658293 - DNA, 13 bp, D. melanogaster
tgggcgtggcagt

SEQ ID NO: 658294 - DNA, 13 bp, D. melanogaster
tgggcgtggcata

SEQ ID NO: 658295 - DNA, 13 bp, D. melanogaster
tgggcgtggcatc

SEQ ID NO: 658296 - DNA, 13 bp, D. melanogaster
tgggcgtggcatg

SEQ ID NO: 658297 - DNA, 13 bp, D. melanogaster
tgggcgtggcatt

SEQ ID NO: 658298 - DNA, 14 bp, D. melanogaster
tgggcgtggcattt

SEQ ID NO: 658299 - DNA, 13 bp, D. melanogaster
tgggcgtggccac

SEQ ID NO: 658300 - DNA, 14 bp, D. melanogaster
tgggcgtggccagg

SEQ ID NO: 658301 - DNA, 14 bp, D. melanogaster
tgggcgtggccagt

SEQ ID NO: 658302 - DNA, 13 bp, D. melanogaster
tgggcgtggcgca

SEQ ID NO: 658303 - DNA, 13 bp, D. melanogaster
tgggcgtggtcag

SEQ ID NO: 658304 - DNA, 13 bp, D. melanogaster
tgggcgtggtcgc

SEQ ID NO: 658305 - DNA, 13 bp, D. melanogaster
tgggctaaaaata

SEQ ID NO: 658306 - DNA, 13 bp, D. melanogaster
tgggctaaaatag

SEQ ID NO: 658307 - DNA, 13 bp, D. melanogaster
tgggctgcatttt

SEQ ID NO: 658308 - DNA, 13 bp, D. melanogaster
tgggctgctgttt

SEQ ID NO: 658309 - DNA, 13 bp, D. melanogaster
tgggctgggattg

SEQ ID NO: 658310 - DNA, 13 bp, D. melanogaster
tgggcttaccaaa

SEQ ID NO: 658311 - DNA, 13 bp, D. melanogaster
tgggcttgggtta

SEQ ID NO: 658312 - DNA, 13 bp, D. melanogaster
tgggcttttattt

SEQ ID NO: 658313 - DNA, 13 bp, D. melanogaster
tggggaaaaacaa

SEQ ID NO: 658314 - DNA, 13 bp, D. melanogaster
tggggaaaaactt

SEQ ID NO: 658315 - DNA, 13 bp, D. melanogaster
tggggaaaaatga

SEQ ID NO: 658316 - DNA, 13 bp, D. melanogaster
tggggaaaacttt

SEQ ID NO: 658317 - DNA, 13 bp, D. melanogaster
tggggaaaatcaa

SEQ ID NO: 658318 - DNA, 13 bp, D. melanogaster
tggggaaatattt

SEQ ID NO: 658319 - DNA, 13 bp, D. melanogaster
tggggaaattgca

SEQ ID NO: 658320 - DNA, 13 bp, D. melanogaster
tggggatcgggat

SEQ ID NO: 658321 - DNA, 13 bp, D. melanogaster
tggggatgaggac

SEQ ID NO: 658322 - DNA, 13 bp, D. melanogaster
tggggattttgaa

SEQ ID NO: 658323 - DNA, 13 bp, D. melanogaster
tggggcaaaaaaa

SEQ ID NO: 658324 - DNA, 13 bp, D. melanogaster
tggggcaacaaca

SEQ ID NO: 658325 - DNA, 13 bp, D. melanogaster
tggggcaacgcat

SEQ ID NO: 658326 - DNA, 13 bp, D. melanogaster
tggggcaatgcca

SEQ ID NO: 658327 - DNA, 13 bp, D. melanogaster
tggggcagcagga

SEQ ID NO: 658328 - DNA, 13 bp, D. melanogaster
tggggcagtttgc

SEQ ID NO: 658329 - DNA, 13 bp, D. melanogaster
tggggcataaatt

SEQ ID NO: 658330 - DNA, 13 bp, D. melanogaster
tggggcatgcaaa

SEQ ID NO: 658331 - DNA, 13 bp, D. melanogaster
tggggcatttggc

SEQ ID NO: 658332 - DNA, 13 bp, D. melanogaster
tggggccaaaaaa

SEQ ID NO: 658333 - DNA, 13 bp, D. melanogaster
tggggccaataat

SEQ ID NO: 658334 - DNA, 13 bp, D. melanogaster
tggggcctcttct

SEQ ID NO: 658335 - DNA, 13 bp, D. melanogaster
tggggcgctggag

SEQ ID NO: 658336 - DNA, 13 bp, D. melanogaster
tggggcgtggcag

SEQ ID NO: 658337 - DNA, 13 bp, D. melanogaster
tggggctggaaaa

SEQ ID NO: 658338 - DNA, 13 bp, D. melanogaster
tgggggaaatgcg

SEQ ID NO: 658339 - DNA, 13 bp, D. melanogaster
tgggggaacccaa

SEQ ID NO: 658340 - DNA, 13 bp, D. melanogaster
tgggggaatcccc

SEQ ID NO: 658341 - DNA, 13 bp, D. melanogaster
tgggggcgtggca

SEQ ID NO: 658342 - DNA, 14 bp, D. melanogaster
tgggggcgtggcaa

SEQ ID NO: 658343 - DNA, 13 bp, D. melanogaster
tggggtaaaaaaa

SEQ ID NO: 658344 - DNA, 13 bp, D. melanogaster
tggggtctaatta

SEQ ID NO: 658345 - DNA, 13 bp, D. melanogaster
tgggtaaaattaa

SEQ ID NO: 658346 - DNA, 13 bp, D. melanogaster
tgggtaaatcaaa

SEQ ID NO: 658347 - DNA, 13 bp, D. melanogaster
tgggtaacataat

SEQ ID NO: 658348 - DNA, 13 bp, D. melanogaster
tgggtaacttcaa

SEQ ID NO: 658349 - DNA, 13 bp, D. melanogaster
tgggtaagaaaaa

SEQ ID NO: 658350 - DNA, 13 bp, D. melanogaster
tgggtaatgggta

SEQ ID NO: 658351 - DNA, 14 bp, D. melanogaster
tgggtaatgggtaa

SEQ ID NO: 658352 - DNA, 13 bp, D. melanogaster
tgggtagctgggt

SEQ ID NO: 658353 - DNA, 13 bp, D. melanogaster
tgggtagtggacc

SEQ ID NO: 658354 - DNA, 14 bp, D. melanogaster
tgggtagtggacca

SEQ ID NO: 658355 - DNA, 13 bp, D. melanogaster
tgggtagttctga

SEQ ID NO: 658356 - DNA, 13 bp, D. melanogaster
tgggtatgggaat

SEQ ID NO: 658357 - DNA, 14 bp, D. melanogaster
tgggtatgggaatg

SEQ ID NO: 658358 - DNA, 13 bp, D. melanogaster
tgggtatggggat

SEQ ID NO: 658359 - DNA, 13 bp, D. melanogaster
tgggtatgggtat

SEQ ID NO: 658360 - DNA, 14 bp, D. melanogaster
tgggtatgggtatg

SEQ ID NO: 658361 - DNA, 13 bp, D. melanogaster
tgggtattccctt

SEQ ID NO: 658362 - DNA, 13 bp, D. melanogaster
tgggtcaacaaac

SEQ ID NO: 658363 - DNA, 13 bp, D. melanogaster
tgggtcatgtggt

SEQ ID NO: 658364 - DNA, 13 bp, D. melanogaster
tgggtcatttcct

SEQ ID NO: 658365 - DNA, 15 bp, D. melanogaster
tgggtctgctggcca

SEQ ID NO: 658366 - DNA, 13 bp, D. melanogaster
tgggtctgggtct

SEQ ID NO: 658367 - DNA, 14 bp, D. melanogaster
tgggtctgggtctg

SEQ ID NO: 658368 - DNA, 13 bp, D. melanogaster
tgggtgaaaagtg

SEQ ID NO: 658369 - DNA, 13 bp, D. melanogaster
tgggtgacggcgg

SEQ ID NO: 658370 - DNA, 13 bp, D. melanogaster
tgggtgatgttga

SEQ ID NO: 658371 - DNA, 13 bp, D. melanogaster
tgggtgcagccgt

SEQ ID NO: 658372 - DNA, 13 bp, D. melanogaster
tgggtggaaaaaa

SEQ ID NO: 658373 - DNA, 13 bp, D. melanogaster
tgggtggaaaatc

SEQ ID NO: 658374 - DNA, 13 bp, D. melanogaster
tgggtggaaaatg

SEQ ID NO: 658375 - DNA, 14 bp, D. melanogaster
tgggtggaaaatgg

SEQ ID NO: 658376 - DNA, 13 bp, D. melanogaster
tgggtggaaatgg

SEQ ID NO: 658377 - DNA, 14 bp, D. melanogaster
tgggtggaatattt

SEQ ID NO: 658378 - DNA, 14 bp, D. melanogaster
tgggtggcaagtgg

SEQ ID NO: 658379 - DNA, 13 bp, D. melanogaster
tgggtggcaatgg

SEQ ID NO: 658380 - DNA, 14 bp, D. melanogaster
tgggtggcaatggg

SEQ ID NO: 658381 - DNA, 13 bp, D. melanogaster
tgggtggcaggag

SEQ ID NO: 658382 - DNA, 13 bp, D. melanogaster
tgggtggcagtgg

SEQ ID NO: 658383 - DNA, 14 bp, D. melanogaster
tgggtggcagtggg

SEQ ID NO: 658384 - DNA, 13 bp, D. melanogaster
tgggtggcatggg

SEQ ID NO: 658385 - DNA, 13 bp, D. melanogaster
tgggtggcattgg

SEQ ID NO: 658386 - DNA, 13 bp, D. melanogaster
tgggtggcgatgg

SEQ ID NO: 658387 - DNA, 13 bp, D. melanogaster
tgggtggcttcga

SEQ ID NO: 658388 - DNA, 13 bp, D. melanogaster
tgggtgggaaaaa

SEQ ID NO: 658389 - DNA, 13 bp, D. melanogaster
tgggtgggaaaac

SEQ ID NO: 658390 - DNA, 13 bp, D. melanogaster
tgggtggggaaaa

SEQ ID NO: 658391 - DNA, 13 bp, D. melanogaster
tgggtgggtggca

SEQ ID NO: 658392 - DNA, 13 bp, D. melanogaster
tgggtggtggcaa

SEQ ID NO: 658393 - DNA, 14 bp, D. melanogaster
tgggtgtcagctgg

SEQ ID NO: 658394 - DNA, 13 bp, D. melanogaster
tgggttaagtgga

SEQ ID NO: 658395 - DNA, 13 bp, D. melanogaster
tgggttaattgca

SEQ ID NO: 658396 - DNA, 13 bp, D. melanogaster
tgggttataaaaa

SEQ ID NO: 658397 - DNA, 13 bp, D. melanogaster
tgggttcatcatc

SEQ ID NO: 658398 - DNA, 13 bp, D. melanogaster
tgggttcttccga

SEQ ID NO: 658399 - DNA, 13 bp, D. melanogaster
tgggttgccaaaa

SEQ ID NO: 658400 - DNA, 13 bp, D. melanogaster
tgggttgggccac

SEQ ID NO: 658401 - DNA, 13 bp, D. melanogaster
tgggttttccact

SEQ ID NO: 658402 - DNA, 13 bp, D. melanogaster
tgggttttccatt

SEQ ID NO: 658403 - DNA, 13 bp, D. melanogaster
tgggttttgaata

SEQ ID NO: 658404 - DNA, 14 bp, D. melanogaster
tgggttttgaatat

SEQ ID NO: 658405 - DNA, 14 bp, D. melanogaster
tgggtttttgaaaa

SEQ ID NO: 658406 - DNA, 13 bp, D. melanogaster
tgggtttttggca

SEQ ID NO: 658407 - DNA, 13 bp, D. melanogaster
tgggtttttggcc

SEQ ID NO: 658408 - DNA, 13 bp, D. melanogaster
tggtaaaaataat

SEQ ID NO: 658409 - DNA, 13 bp, D. melanogaster
tggtaaaacaaaa

SEQ ID NO: 658410 - DNA, 13 bp, D. melanogaster
tggtaaacaaaag

SEQ ID NO: 658411 - DNA, 13 bp, D. melanogaster
tggtaaacatttt

SEQ ID NO: 658412 - DNA, 13 bp, D. melanogaster
tggtaaatggtaa

SEQ ID NO: 658413 - DNA, 13 bp, D. melanogaster
tggtaacaaaaaa

SEQ ID NO: 658414 - DNA, 14 bp, D. melanogaster
tggtaacaaaaaaa

SEQ ID NO: 658415 - DNA, 13 bp, D. melanogaster
tggtaactcctcc

SEQ ID NO: 658416 - DNA, 13 bp, D. melanogaster
tggtaactgatgg

SEQ ID NO: 658417 - DNA, 13 bp, D. melanogaster
tggtaactggcaa

SEQ ID NO: 658418 - DNA, 13 bp, D. melanogaster
tggtaataatttt

SEQ ID NO: 658419 - DNA, 13 bp, D. melanogaster
tggtaatgataat

SEQ ID NO: 658420 - DNA, 13 bp, D. melanogaster
tggtaatgggaat

SEQ ID NO: 658421 - DNA, 13 bp, D. melanogaster
tggtaatgggcaa

SEQ ID NO: 658422 - DNA, 13 bp, D. melanogaster
tggtaatggtaat

SEQ ID NO: 658423 - DNA, 14 bp, D. melanogaster
tggtaatggtaatg

SEQ ID NO: 658424 - DNA, 13 bp, D. melanogaster
tggtaattaagga

SEQ ID NO: 658425 - DNA, 13 bp, D. melanogaster
tggtaattgcaat

SEQ ID NO: 658426 - DNA, 13 bp, D. melanogaster
tggtaatttaaaa

SEQ ID NO: 658427 - DNA, 13 bp, D. melanogaster
tggtacaaaaaca

SEQ ID NO: 658428 - DNA, 14 bp, D. melanogaster
tggtactggtactg

SEQ ID NO: 658429 - DNA, 13 bp, D. melanogaster
tggtagtaccaaa

SEQ ID NO: 658430 - DNA, 13 bp, D. melanogaster
tggtagtagtagt

SEQ ID NO: 658431 - DNA, 13 bp, D. melanogaster
tggtagtgaaatt

SEQ ID NO: 658432 - DNA, 13 bp, D. melanogaster
tggtagttgcctc

SEQ ID NO: 658433 - DNA, 13 bp, D. melanogaster
tggtagttggtag

SEQ ID NO: 658434 - DNA, 13 bp, D. melanogaster
tggtagtttgcaa

SEQ ID NO: 658435 - DNA, 13 bp, D. melanogaster
tggtataatggat

SEQ ID NO: 658436 - DNA, 13 bp, D. melanogaster
tggtatataatat

SEQ ID NO: 658437 - DNA, 13 bp, D. melanogaster
tggtatatacata

SEQ ID NO: 658438 - DNA, 14 bp, D. melanogaster
tggtatatacatat

SEQ ID NO: 658439 - DNA, 13 bp, D. melanogaster
tggtatatataaa

SEQ ID NO: 658440 - DNA, 13 bp, D. melanogaster
tggtatatataca

SEQ ID NO: 658441 - DNA, 13 bp, D. melanogaster
tggtattagataa

SEQ ID NO: 658442 - DNA, 13 bp, D. melanogaster
tggtattcccaaa

SEQ ID NO: 658443 - DNA, 13 bp, D. melanogaster
tggtattgcccat

SEQ ID NO: 658444 - DNA, 13 bp, D. melanogaster
tggtattgctgca

SEQ ID NO: 658445 - DNA, 13 bp, D. melanogaster
tggtatttcaatt

SEQ ID NO: 658446 - DNA, 13 bp, D. melanogaster
tggtatttcattt

SEQ ID NO: 658447 - DNA, 13 bp, D. melanogaster
tggtcaaaaaata

SEQ ID NO: 658448 - DNA, 13 bp, D. melanogaster
tggtcaaaaacaa

SEQ ID NO: 658449 - DNA, 13 bp, D. melanogaster
tggtcaaaataat

SEQ ID NO: 658450 - DNA, 13 bp, D. melanogaster
tggtcaaacattt

SEQ ID NO: 658451 - DNA, 13 bp, D. melanogaster
tggtcaaagtaaa

SEQ ID NO: 658452 - DNA, 13 bp, D. melanogaster
tggtcaaatgttt

SEQ ID NO: 658453 - DNA, 13 bp, D. melanogaster
tggtcaacaaaat

SEQ ID NO: 658454 - DNA, 13 bp, D. melanogaster
tggtcaacttttt

SEQ ID NO: 658455 - DNA, 13 bp, D. melanogaster
tggtcaagcgaat

SEQ ID NO: 658456 - DNA, 13 bp, D. melanogaster
tggtcaagtcgag

SEQ ID NO: 658457 - DNA, 13 bp, D. melanogaster
tggtcaatgctga

SEQ ID NO: 658458 - DNA, 13 bp, D. melanogaster
tggtcaattaaaa

SEQ ID NO: 658459 - DNA, 13 bp, D. melanogaster
tggtcaccctgaa

SEQ ID NO: 658460 - DNA, 13 bp, D. melanogaster
tggtcaccgccga

SEQ ID NO: 658461 - DNA, 13 bp, D. melanogaster
tggtcactggcaa

SEQ ID NO: 658462 - DNA, 13 bp, D. melanogaster
tggtcactttgta

SEQ ID NO: 658463 - DNA, 13 bp, D. melanogaster
tggtcagcaattt

SEQ ID NO: 658464 - DNA, 14 bp, D. melanogaster
tggtcagcaatttg

SEQ ID NO: 658465 - DNA, 13 bp, D. melanogaster
tggtcagcattca

SEQ ID NO: 658466 - DNA, 14 bp, D. melanogaster
tggtcagcgaaagc

SEQ ID NO: 658467 - DNA, 13 bp, D. melanogaster
tggtcagcttttc

SEQ ID NO: 658468 - DNA, 14 bp, D. melanogaster
tggtcaggaggagc

SEQ ID NO: 658469 - DNA, 13 bp, D. melanogaster
tggtcagtcagtc

SEQ ID NO: 658470 - DNA, 13 bp, D. melanogaster
tggtccaagtacc

SEQ ID NO: 658471 - DNA, 13 bp, D. melanogaster
tggtccaatttgg

SEQ ID NO: 658472 - DNA, 13 bp, D. melanogaster
tggtccagtgtct

SEQ ID NO: 658473 - DNA, 14 bp, D. melanogaster
tggtcctgctcctg

SEQ ID NO: 658474 - DNA, 13 bp, D. melanogaster
tggtcctgctgct

SEQ ID NO: 658475 - DNA, 13 bp, D. melanogaster
tggtcctggtcct

SEQ ID NO: 658476 - DNA, 13 bp, D. melanogaster
tggtccttcgagc

SEQ ID NO: 658477 - DNA, 14 bp, D. melanogaster
tggtccttcgagcc

SEQ ID NO: 658478 - DNA, 14 bp, D. melanogaster
tggtccttcgtcct

SEQ ID NO: 658479 - DNA, 14 bp, D. melanogaster
tggtcgaaaacgct

SEQ ID NO: 658480 - DNA, 13 bp, D. melanogaster
tggtcgaaagctc

SEQ ID NO: 658481 - DNA, 13 bp, D. melanogaster
tggtcgagcaaaa

SEQ ID NO: 658482 - DNA, 14 bp, D. melanogaster
tggtcgagggcagt

SEQ ID NO: 658483 - DNA, 13 bp, D. melanogaster
tggtcgatggtcg

SEQ ID NO: 658484 - DNA, 13 bp, D. melanogaster
tggtcgctcacaa

SEQ ID NO: 658485 - DNA, 13 bp, D. melanogaster
tggtcggaataca

SEQ ID NO: 658486 - DNA, 13 bp, D. melanogaster
tggtcggaatcgg

SEQ ID NO: 658487 - DNA, 13 bp, D. melanogaster
tggtcggtggtcg

SEQ ID NO: 658488 - DNA, 13 bp, D. melanogaster
tggtcgtcttaat

SEQ ID NO: 658489 - DNA, 14 bp, D. melanogaster
tggtcgtcttaatg

SEQ ID NO: 658490 - DNA, 13 bp, D. melanogaster
tggtctacaggca

SEQ ID NO: 658491 - DNA, 13 bp, D. melanogaster
tggtctctggtct

SEQ ID NO: 658492 - DNA, 13 bp, D. melanogaster
tggtctgcttctg

SEQ ID NO: 658493 - DNA, 13 bp, D. melanogaster
tggtctggtctgg

SEQ ID NO: 658494 - DNA, 14 bp, D. melanogaster
tggtctggtctggt

SEQ ID NO: 658495 - DNA, 13 bp, D. melanogaster
tggtctgttttca

SEQ ID NO: 658496 - DNA, 13 bp, D. melanogaster
tggtcttaaaata

SEQ ID NO: 658497 - DNA, 13 bp, D. melanogaster
tggtcttccaatt

SEQ ID NO: 658498 - DNA, 14 bp, D. melanogaster
tggtcttggtcttg

SEQ ID NO: 658499 - DNA, 13 bp, D. melanogaster
tggtctttggtct

SEQ ID NO: 658500 - DNA, 13 bp, D. melanogaster
tggtgaaggtcaa

SEQ ID NO: 658501 - DNA, 13 bp, D. melanogaster
tggtgaatggtga

SEQ ID NO: 658502 - DNA, 14 bp, D. melanogaster
tggtgaatggtgaa

SEQ ID NO: 658503 - DNA, 13 bp, D. melanogaster
tggtgaattgatt

SEQ ID NO: 658504 - DNA, 13 bp, D. melanogaster
tggtgacagcaag

SEQ ID NO: 658505 - DNA, 13 bp, D. melanogaster
tggtgaccccgac

SEQ ID NO: 658506 - DNA, 14 bp, D. melanogaster
tggtgaccccgacg

SEQ ID NO: 658507 - DNA, 13 bp, D. melanogaster
tggtgaccccgat

SEQ ID NO: 658508 - DNA, 13 bp, D. melanogaster
tggtgagtcctga

SEQ ID NO: 658509 - DNA, 13 bp, D. melanogaster
tggtgatagatgg

SEQ ID NO: 658510 - DNA, 13 bp, D. melanogaster
tggtgatattcgc

SEQ ID NO: 658511 - DNA, 13 bp, D. melanogaster
tggtgatcagcga

SEQ ID NO: 658512 - DNA, 13 bp, D. melanogaster
tggtgatgagctg

SEQ ID NO: 658513 - DNA, 13 bp, D. melanogaster
tggtgatgatgat

SEQ ID NO: 658514 - DNA, 13 bp, D. melanogaster
tggtgatggcatt

SEQ ID NO: 658515 - DNA, 13 bp, D. melanogaster
tggtgatggtcga

SEQ ID NO: 658516 - DNA, 13 bp, D. melanogaster
tggtgatggtgat

SEQ ID NO: 658517 - DNA, 14 bp, D. melanogaster
tggtgatggtgatg

SEQ ID NO: 658518 - DNA, 14 bp, D. melanogaster
tggtgatggtgtgc

SEQ ID NO: 658519 - DNA, 13 bp, D. melanogaster
tggtgatgttctt

SEQ ID NO: 658520 - DNA, 13 bp, D. melanogaster
tggtgattccaaa

SEQ ID NO: 658521 - DNA, 13 bp, D. melanogaster
tggtgcaaaaata

SEQ ID NO: 658522 - DNA, 13 bp, D. melanogaster
tggtgcaactgtt

SEQ ID NO: 658523 - DNA, 13 bp, D. melanogaster
tggtgcaatggtg

SEQ ID NO: 658524 - DNA, 14 bp, D. melanogaster
tggtgcagtggtgc

SEQ ID NO: 658525 - DNA, 14 bp, D. melanogaster
tggtgccggattgg

SEQ ID NO: 658526 - DNA, 13 bp, D. melanogaster
tggtgcgcttcgt

SEQ ID NO: 658527 - DNA, 14 bp, D. melanogaster
tggtgctgctgctg

SEQ ID NO: 658528 - DNA, 13 bp, D. melanogaster
tggtgctgctggt

SEQ ID NO: 658529 - DNA, 14 bp, D. melanogaster
tggtgctgctgttg

SEQ ID NO: 658530 - DNA, 13 bp, D. melanogaster
tggtgctggtgct

SEQ ID NO: 658531 - DNA, 14 bp, D. melanogaster
tggtgctgttgctg

SEQ ID NO: 658532 - DNA, 13 bp, D. melanogaster
tggtgcttcatac

SEQ ID NO: 658533 - DNA, 14 bp, D. melanogaster
tggtggaaacagag

SEQ ID NO: 658534 - DNA, 13 bp, D. melanogaster
tggtggaaatgga

SEQ ID NO: 658535 - DNA, 13 bp, D. melanogaster
tggtggaactggt

SEQ ID NO: 658536 - DNA, 13 bp, D. melanogaster
tggtggaatccag

SEQ ID NO: 658537 - DNA, 14 bp, D. melanogaster
tggtggactccatg

SEQ ID NO: 658538 - DNA, 13 bp, D. melanogaster
tggtggcatatat

SEQ ID NO: 658539 - DNA, 13 bp, D. melanogaster
tggtggccaaaaa

SEQ ID NO: 658540 - DNA, 13 bp, D. melanogaster
tggtggccataaa

SEQ ID NO: 658541 - DNA, 13 bp, D. melanogaster
tggtggccatgca

SEQ ID NO: 658542 - DNA, 13 bp, D. melanogaster
tggtggccattat

SEQ ID NO: 658543 - DNA, 14 bp, D. melanogaster
tggtggccattatg

SEQ ID NO: 658544 - DNA, 13 bp, D. melanogaster
tggtggcggatga

SEQ ID NO: 658545 - DNA, 13 bp, D. melanogaster
tggtggctgctgc

SEQ ID NO: 658546 - DNA, 13 bp, D. melanogaster
tggtgggcaacta

SEQ ID NO: 658547 - DNA, 13 bp, D. melanogaster
tggtgggcatgtt

SEQ ID NO: 658548 - DNA, 13 bp, D. melanogaster
tggtgggcgagat

SEQ ID NO: 658549 - DNA, 14 bp, D. melanogaster
tggtgggcggaaaa

SEQ ID NO: 658550 - DNA, 13 bp, D. melanogaster
tggtggggcagcc

SEQ ID NO: 658551 - DNA, 14 bp, D. melanogaster
tggtgggggaaccc

SEQ ID NO: 658552 - DNA, 13 bp, D. melanogaster
tggtggtcctttt

SEQ ID NO: 658553 - DNA, 14 bp, D. melanogaster
tggtggtgatgatg

SEQ ID NO: 658554 - DNA, 14 bp, D. melanogaster
tggtggtgctgctg

SEQ ID NO: 658555 - DNA, 13 bp, D. melanogaster
tggtggtggctct

SEQ ID NO: 658556 - DNA, 14 bp, D. melanogaster
tggtggtgggcgga

SEQ ID NO: 658557 - DNA, 14 bp, D. melanogaster
tggtggtggtggca

SEQ ID NO: 658558 - DNA, 13 bp, D. melanogaster
tggtggtggttca

SEQ ID NO: 658559 - DNA, 13 bp, D. melanogaster
tggtggttatagt

SEQ ID NO: 658560 - DNA, 13 bp, D. melanogaster
tggtggttgaaaa

SEQ ID NO: 658561 - DNA, 13 bp, D. melanogaster
tggtgtatatata

SEQ ID NO: 658562 - DNA, 13 bp, D. melanogaster
tggtgtcaatatt

SEQ ID NO: 658563 - DNA, 14 bp, D. melanogaster
tggtgtcaatatta

SEQ ID NO: 658564 - DNA, 13 bp, D. melanogaster
tggtgtcctttgg

SEQ ID NO: 658565 - DNA, 13 bp, D. melanogaster
tggtgtctcctcc

SEQ ID NO: 658566 - DNA, 13 bp, D. melanogaster
tggtgtgccacgc

SEQ ID NO: 658567 - DNA, 13 bp, D. melanogaster
tggtgtggaatgc

SEQ ID NO: 658568 - DNA, 13 bp, D. melanogaster
tggtgtggcatgg

SEQ ID NO: 658569 - DNA, 13 bp, D. melanogaster
tggtgttgcagtt

SEQ ID NO: 658570 - DNA, 13 bp, D. melanogaster
tggtgttgctgct

SEQ ID NO: 658571 - DNA, 14 bp, D. melanogaster
tggtgttgctgctg

SEQ ID NO: 658572 - DNA, 13 bp, D. melanogaster
tggtgtttcagtt

SEQ ID NO: 658573 - DNA, 13 bp, D. melanogaster
tggttaaaaagaa

SEQ ID NO: 658574 - DNA, 13 bp, D. melanogaster
tggttaaatatat

SEQ ID NO: 658575 - DNA, 13 bp, D. melanogaster
tggttaaatgttt

SEQ ID NO: 658576 - DNA, 13 bp, D. melanogaster
tggttaaatttaa

SEQ ID NO: 658577 - DNA, 13 bp, D. melanogaster
tggttaataaaaa

SEQ ID NO: 658578 - DNA, 13 bp, D. melanogaster
tggttaataataa

SEQ ID NO: 658579 - DNA, 13 bp, D. melanogaster
tggttaatgaaaa

SEQ ID NO: 658580 - DNA, 13 bp, D. melanogaster
tggttaattgcat

SEQ ID NO: 658581 - DNA, 13 bp, D. melanogaster
tggttaattttga

SEQ ID NO: 658582 - DNA, 13 bp, D. melanogaster
tggttacatttta

SEQ ID NO: 658583 - DNA, 13 bp, D. melanogaster
tggttaccatatt

SEQ ID NO: 658584 - DNA, 13 bp, D. melanogaster
tggttaccggcaa

SEQ ID NO: 658585 - DNA, 14 bp, D. melanogaster
tggttaccggcaac

SEQ ID NO: 658586 - DNA, 13 bp, D. melanogaster
tggttagtggtgc

SEQ ID NO: 658587 - DNA, 13 bp, D. melanogaster
tggttagtgtgaa

SEQ ID NO: 658588 - DNA, 14 bp, D. melanogaster
tggttatagctaca

SEQ ID NO: 658589 - DNA, 13 bp, D. melanogaster
tggttatgcaaaa

SEQ ID NO: 658590 - DNA, 13 bp, D. melanogaster
tggttatggttat

SEQ ID NO: 658591 - DNA, 13 bp, D. melanogaster
tggttatgtatgt

SEQ ID NO: 658592 - DNA, 13 bp, D. melanogaster
tggttattaaaat

SEQ ID NO: 658593 - DNA, 14 bp, D. melanogaster
tggttatttcattt

SEQ ID NO: 658594 - DNA, 13 bp, D. melanogaster
tggttcaaaaatg

SEQ ID NO: 658595 - DNA, 13 bp, D. melanogaster
tggttcaactatt

SEQ ID NO: 658596 - DNA, 14 bp, D. melanogaster
tggttcaactattt

SEQ ID NO: 658597 - DNA, 13 bp, D. melanogaster
tggttcaagacca

SEQ ID NO: 658598 - DNA, 13 bp, D. melanogaster
tggttcagtggtt

SEQ ID NO: 658599 - DNA, 13 bp, D. melanogaster
tggttcgagcttt

SEQ ID NO: 658600 - DNA, 13 bp, D. melanogaster
tggttcgagttct

SEQ ID NO: 658601 - DNA, 13 bp, D. melanogaster
tggttctatgtat

SEQ ID NO: 658602 - DNA, 13 bp, D. melanogaster
tggttctctttca

SEQ ID NO: 658603 - DNA, 13 bp, D. melanogaster
tggttctggttct

SEQ ID NO: 658604 - DNA, 14 bp, D. melanogaster
tggttctggttctg

SEQ ID NO: 658605 - DNA, 14 bp, D. melanogaster
tggttcttaatgcc

SEQ ID NO: 658606 - DNA, 13 bp, D. melanogaster
tggttgaaaaaaa

SEQ ID NO: 658607 - DNA, 13 bp, D. melanogaster
tggttgaaaaaca

SEQ ID NO: 658608 - DNA, 13 bp, D. melanogaster
tggttgcagctcc

SEQ ID NO: 658609 - DNA, 13 bp, D. melanogaster
tggttgctgctgc

SEQ ID NO: 658610 - DNA, 13 bp, D. melanogaster
tggttggaatttc

SEQ ID NO: 658611 - DNA, 13 bp, D. melanogaster
tggttggctggat

SEQ ID NO: 658612 - DNA, 13 bp, D. melanogaster
tggttgggcaaac

SEQ ID NO: 658613 - DNA, 13 bp, D. melanogaster
tggttggttgcct

SEQ ID NO: 658614 - DNA, 13 bp, D. melanogaster
tggttgtacggta

SEQ ID NO: 658615 - DNA, 13 bp, D. melanogaster
tggttgtcaaaaa

SEQ ID NO: 658616 - DNA, 13 bp, D. melanogaster
tggttgttgctgc

SEQ ID NO: 658617 - DNA, 13 bp, D. melanogaster
tggtttaaaaata

SEQ ID NO: 658618 - DNA, 13 bp, D. melanogaster
tggtttaaataaa

SEQ ID NO: 658619 - DNA, 13 bp, D. melanogaster
tggtttaataaag

SEQ ID NO: 658620 - DNA, 13 bp, D. melanogaster
tggtttattttgc

SEQ ID NO: 658621 - DNA, 13 bp, D. melanogaster
tggtttcaaaatt

SEQ ID NO: 658622 - DNA, 13 bp, D. melanogaster
tggtttcaattgc

SEQ ID NO: 658623 - DNA, 14 bp, D. melanogaster
tggtttcaattgcc

SEQ ID NO: 658624 - DNA, 13 bp, D. melanogaster
tggtttcagtttt

SEQ ID NO: 658625 - DNA, 14 bp, D. melanogaster
tggtttcattaatt

SEQ ID NO: 658626 - DNA, 13 bp, D. melanogaster
tggtttcccgagg

SEQ ID NO: 658627 - DNA, 13 bp, D. melanogaster
tggtttccctaag

SEQ ID NO: 658628 - DNA, 13 bp, D. melanogaster
tggtttcgaagtg

SEQ ID NO: 658629 - DNA, 13 bp, D. melanogaster
tggtttcgatttc

SEQ ID NO: 658630 - DNA, 14 bp, D. melanogaster
tggtttcggtttcg

SEQ ID NO: 658631 - DNA, 13 bp, D. melanogaster
tggtttcgtttcg

SEQ ID NO: 658632 - DNA, 13 bp, D. melanogaster
tggtttctggcct

SEQ ID NO: 658633 - DNA, 13 bp, D. melanogaster
tggtttctttgga

SEQ ID NO: 658634 - DNA, 28 bp, D. melanogaster
tggtttggcactatgcagccactttttt

SEQ ID NO: 658635 - DNA, 13 bp, D. melanogaster
tggtttggtttca

SEQ ID NO: 658636 - DNA, 13 bp, D. melanogaster
tggttttaaaact

SEQ ID NO: 658637 - DNA, 13 bp, D. melanogaster
tggttttaaaata

SEQ ID NO: 658638 - DNA, 13 bp, D. melanogaster
tggttttaaaatt

SEQ ID NO: 658639 - DNA, 13 bp, D. melanogaster
tggttttaaagtt

SEQ ID NO: 658640 - DNA, 13 bp, D. melanogaster
tggttttaaattg

SEQ ID NO: 658641 - DNA, 13 bp, D. melanogaster
tggttttaataaa

SEQ ID NO: 658642 - DNA, 13 bp, D. melanogaster
tggttttattaaa

SEQ ID NO: 658643 - DNA, 13 bp, D. melanogaster
tggttttcaattt

SEQ ID NO: 658644 - DNA, 13 bp, D. melanogaster
tggttttccattt

SEQ ID NO: 658645 - DNA, 13 bp, D. melanogaster
tggttttcgattt

SEQ ID NO: 658646 - DNA, 13 bp, D. melanogaster
tggttttctactt

SEQ ID NO: 658647 - DNA, 13 bp, D. melanogaster
tggttttgaaatt

SEQ ID NO: 658648 - DNA, 13 bp, D. melanogaster
tggttttggccaa

SEQ ID NO: 658649 - DNA, 14 bp, D. melanogaster
tggttttggccaac

SEQ ID NO: 658650 - DNA, 13 bp, D. melanogaster
tggttttggccag

SEQ ID NO: 658651 - DNA, 13 bp, D. melanogaster
tggttttggcctt

SEQ ID NO: 658652 - DNA, 14 bp, D. melanogaster
tggtttttaaaatt

SEQ ID NO: 658653 - DNA, 13 bp, D. melanogaster
tggtttttaaata

SEQ ID NO: 658654 - DNA, 13 bp, D. melanogaster
tggtttttcaaaa

SEQ ID NO: 658655 - DNA, 13 bp, D. melanogaster
tggtttttgcagt

SEQ ID NO: 658656 - DNA, 13 bp, D. melanogaster
tggtttttggcat

SEQ ID NO: 658657 - DNA, 13 bp, D. melanogaster
tggtttttggcta

SEQ ID NO: 658658 - DNA, 14 bp, D. melanogaster
tgtaaaaaaaaact

SEQ ID NO: 658659 - DNA, 14 bp, D. melanogaster
tgtaaaaaatccaa

SEQ ID NO: 658660 - DNA, 14 bp, D. melanogaster
tgtaaaaaccaagt

SEQ ID NO: 658661 - DNA, 14 bp, D. melanogaster
tgtaaaaactaatt

SEQ ID NO: 658662 - DNA, 13 bp, D. melanogaster
tgtaaaaacttta

SEQ ID NO: 658663 - DNA, 13 bp, D. melanogaster
tgtaaaaactttt

SEQ ID NO: 658664 - DNA, 14 bp, D. melanogaster
tgtaaaaagaatgt

SEQ ID NO: 658665 - DNA, 13 bp, D. melanogaster
tgtaaaaagtttt

SEQ ID NO: 658666 - DNA, 13 bp, D. melanogaster
tgtaaaaatacat

SEQ ID NO: 658667 - DNA, 13 bp, D. melanogaster
tgtaaaaatcaat

SEQ ID NO: 658668 - DNA, 13 bp, D. melanogaster
tgtaaaaatccaa

SEQ ID NO: 658669 - DNA, 14 bp, D. melanogaster
tgtaaaaatgttta

SEQ ID NO: 658670 - DNA, 13 bp, D. melanogaster
tgtaaaacaaaac

SEQ ID NO: 658671 - DNA, 13 bp, D. melanogaster
tgtaaaacaaaca

SEQ ID NO: 658672 - DNA, 13 bp, D. melanogaster
tgtaaaacggagc

SEQ ID NO: 658673 - DNA, 13 bp, D. melanogaster
tgtaaaactataa

SEQ ID NO: 658674 - DNA, 13 bp, D. melanogaster
tgtaaaacttaaa

SEQ ID NO: 658675 - DNA, 13 bp, D. melanogaster
tgtaaaagcaaaa

SEQ ID NO: 658676 - DNA, 13 bp, D. melanogaster
tgtaaaataagta

SEQ ID NO: 658677 - DNA, 14 bp, D. melanogaster
tgtaaaatacaatt

SEQ ID NO: 658678 - DNA, 13 bp, D. melanogaster
tgtaaaatagttt

SEQ ID NO: 658679 - DNA, 13 bp, D. melanogaster
tgtaaaatataca

SEQ ID NO: 658680 - DNA, 13 bp, D. melanogaster
tgtaaaatcaaat

SEQ ID NO: 658681 - DNA, 13 bp, D. melanogaster
tgtaaaatcccaa

SEQ ID NO: 658682 - DNA, 13 bp, D. melanogaster
tgtaaaatgaatt

SEQ ID NO: 658683 - DNA, 13 bp, D. melanogaster
tgtaaaatgcaaa

SEQ ID NO: 658684 - DNA, 13 bp, D. melanogaster
tgtaaaatgcaca

SEQ ID NO: 658685 - DNA, 13 bp, D. melanogaster
tgtaaaatgcatg

SEQ ID NO: 658686 - DNA, 13 bp, D. melanogaster
tgtaaaatgcatt

SEQ ID NO: 658687 - DNA, 13 bp, D. melanogaster
tgtaaaatggaat

SEQ ID NO: 658688 - DNA, 13 bp, D. melanogaster
tgtaaaatgtatt

SEQ ID NO: 658689 - DNA, 14 bp, D. melanogaster
tgtaaaatgtattt

SEQ ID NO: 658690 - DNA, 13 bp, D. melanogaster
tgtaaaattgaaa

SEQ ID NO: 658691 - DNA, 13 bp, D. melanogaster
tgtaaaattgggt

SEQ ID NO: 658692 - DNA, 13 bp, D. melanogaster
tgtaaaatttcta

SEQ ID NO: 658693 - DNA, 13 bp, D. melanogaster
tgtaaaatttgaa

SEQ ID NO: 658694 - DNA, 13 bp, D. melanogaster
tgtaaacaaaaac

SEQ ID NO: 658695 - DNA, 13 bp, D. melanogaster
tgtaaacaaaaag

SEQ ID NO: 658696 - DNA, 13 bp, D. melanogaster
tgtaaacaaaaca

SEQ ID NO: 658697 - DNA, 13 bp, D. melanogaster
tgtaaacaaagtg

SEQ ID NO: 658698 - DNA, 13 bp, D. melanogaster
tgtaaacaaataa

SEQ ID NO: 658699 - DNA, 14 bp, D. melanogaster
tgtaaacaaataaa

SEQ ID NO: 658700 - DNA, 13 bp, D. melanogaster
tgtaaacaaatca

SEQ ID NO: 658701 - DNA, 13 bp, D. melanogaster
tgtaaacaataat

SEQ ID NO: 658702 - DNA, 13 bp, D. melanogaster
tgtaaacaattaa

SEQ ID NO: 658703 - DNA, 13 bp, D. melanogaster
tgtaaacacattt

SEQ ID NO: 658704 - DNA, 13 bp, D. melanogaster
tgtaaacagtttc

SEQ ID NO: 658705 - DNA, 14 bp, D. melanogaster
tgtaaacagtttct

SEQ ID NO: 658706 - DNA, 13 bp, D. melanogaster
tgtaaacagtttt

SEQ ID NO: 658707 - DNA, 13 bp, D. melanogaster
tgtaaacatattt

SEQ ID NO: 658708 - DNA, 13 bp, D. melanogaster
tgtaaaccaattt

SEQ ID NO: 658709 - DNA, 13 bp, D. melanogaster
tgtaaacccaatt

SEQ ID NO: 658710 - DNA, 13 bp, D. melanogaster
tgtaaacgaactt

SEQ ID NO: 658711 - DNA, 13 bp, D. melanogaster
tgtaaagaaaatg

SEQ ID NO: 658712 - DNA, 13 bp, D. melanogaster
tgtaaagaaattg

SEQ ID NO: 658713 - DNA, 13 bp, D. melanogaster
tgtaaagcaattt

SEQ ID NO: 658714 - DNA, 13 bp, D. melanogaster
tgtaaagtaaata

SEQ ID NO: 658715 - DNA, 13 bp, D. melanogaster
tgtaaagtatata

SEQ ID NO: 658716 - DNA, 13 bp, D. melanogaster
tgtaaagtgcagt

SEQ ID NO: 658717 - DNA, 13 bp, D. melanogaster
tgtaaagttatga

SEQ ID NO: 658718 - DNA, 14 bp, D. melanogaster
tgtaaagttatgac

SEQ ID NO: 658719 - DNA, 13 bp, D. melanogaster
tgtaaataaaact

SEQ ID NO: 658720 - DNA, 13 bp, D. melanogaster
tgtaaataaaatg

SEQ ID NO: 658721 - DNA, 13 bp, D. melanogaster
tgtaaataaacaa

SEQ ID NO: 658722 - DNA, 14 bp, D. melanogaster
tgtaaataaacaaa

SEQ ID NO: 658723 - DNA, 13 bp, D. melanogaster
tgtaaataaactc

SEQ ID NO: 658724 - DNA, 13 bp, D. melanogaster
tgtaaataaatga

SEQ ID NO: 658725 - DNA, 13 bp, D. melanogaster
tgtaaataaatgc

SEQ ID NO: 658726 - DNA, 13 bp, D. melanogaster
tgtaaataaattg

SEQ ID NO: 658727 - DNA, 13 bp, D. melanogaster
tgtaaataatatg

SEQ ID NO: 658728 - DNA, 13 bp, D. melanogaster
tgtaaataattca

SEQ ID NO: 658729 - DNA, 13 bp, D. melanogaster
tgtaaatacatat

SEQ ID NO: 658730 - DNA, 14 bp, D. melanogaster
tgtaaatactttga

SEQ ID NO: 658731 - DNA, 13 bp, D. melanogaster
tgtaaatactttt

SEQ ID NO: 658732 - DNA, 14 bp, D. melanogaster
tgtaaatacttttg

SEQ ID NO: 658733 - DNA, 13 bp, D. melanogaster
tgtaaatagtttg

SEQ ID NO: 658734 - DNA, 13 bp, D. melanogaster
tgtaaatataaac

SEQ ID NO: 658735 - DNA, 13 bp, D. melanogaster
tgtaaatatatac

SEQ ID NO: 658736 - DNA, 13 bp, D. melanogaster
tgtaaatatctat

SEQ ID NO: 658737 - DNA, 13 bp, D. melanogaster
tgtaaatatgatt

SEQ ID NO: 658738 - DNA, 14 bp, D. melanogaster
tgtaaatatgtaaa

SEQ ID NO: 658739 - DNA, 13 bp, D. melanogaster
tgtaaatatgtat

SEQ ID NO: 658740 - DNA, 14 bp, D. melanogaster
tgtaaatatgtatg

SEQ ID NO: 658741 - DNA, 14 bp, D. melanogaster
tgtaaatatgtatt

SEQ ID NO: 658742 - DNA, 13 bp, D. melanogaster
tgtaaatatgttt

SEQ ID NO: 658743 - DNA, 14 bp, D. melanogaster
tgtaaatatgtttc

SEQ ID NO: 658744 - DNA, 13 bp, D. melanogaster
tgtaaatattcat

SEQ ID NO: 658745 - DNA, 13 bp, D. melanogaster
tgtaaatattgtt

SEQ ID NO: 658746 - DNA, 14 bp, D. melanogaster
tgtaaatatttaca

SEQ ID NO: 658747 - DNA, 13 bp, D. melanogaster
tgtaaatatttag

SEQ ID NO: 658748 - DNA, 13 bp, D. melanogaster
tgtaaatatttgt

SEQ ID NO: 658749 - DNA, 14 bp, D. melanogaster
tgtaaatatttgtg

SEQ ID NO: 658750 - DNA, 13 bp, D. melanogaster
tgtaaatcaaaaa

SEQ ID NO: 658751 - DNA, 13 bp, D. melanogaster
tgtaaatcaaaag

SEQ ID NO: 658752 - DNA, 13 bp, D. melanogaster
tgtaaatcaaata

SEQ ID NO: 658753 - DNA, 13 bp, D. melanogaster
tgtaaatcaaatt

SEQ ID NO: 658754 - DNA, 13 bp, D. melanogaster
tgtaaatcaattt

SEQ ID NO: 658755 - DNA, 13 bp, D. melanogaster
tgtaaatctttca

SEQ ID NO: 658756 - DNA, 14 bp, D. melanogaster
tgtaaatgaaaatg

SEQ ID NO: 658757 - DNA, 14 bp, D. melanogaster
tgtaaatgaatcga

SEQ ID NO: 658758 - DNA, 13 bp, D. melanogaster
tgtaaatgagttt

SEQ ID NO: 658759 - DNA, 14 bp, D. melanogaster
tgtaaatgatattt

SEQ ID NO: 658760 - DNA, 13 bp, D. melanogaster
tgtaaatgcattt

SEQ ID NO: 658761 - DNA, 13 bp, D. melanogaster
tgtaaatggatct

SEQ ID NO: 658762 - DNA, 13 bp, D. melanogaster
tgtaaatggccaa

SEQ ID NO: 658763 - DNA, 13 bp, D. melanogaster
tgtaaatgtaaat

SEQ ID NO: 658764 - DNA, 14 bp, D. melanogaster
tgtaaatgtaaata

SEQ ID NO: 658765 - DNA, 14 bp, D. melanogaster
tgtaaatgtaaatt

SEQ ID NO: 658766 - DNA, 13 bp, D. melanogaster
tgtaaatgtaagt

SEQ ID NO: 658767 - DNA, 13 bp, D. melanogaster
tgtaaatgtagat

SEQ ID NO: 658768 - DNA, 14 bp, D. melanogaster
tgtaaatgtagatg

SEQ ID NO: 658769 - DNA, 13 bp, D. melanogaster
tgtaaatgtatct

SEQ ID NO: 658770 - DNA, 14 bp, D. melanogaster
tgtaaatgtatctg

SEQ ID NO: 658771 - DNA, 13 bp, D. melanogaster
tgtaaatgttaaa

SEQ ID NO: 658772 - DNA, 13 bp, D. melanogaster
tgtaaatgttaat

SEQ ID NO: 658773 - DNA, 13 bp, D. melanogaster
tgtaaatgttgtt

SEQ ID NO: 658774 - DNA, 13 bp, D. melanogaster
tgtaaatgtttgt

SEQ ID NO: 658775 - DNA, 14 bp, D. melanogaster
tgtaaattatgaaa

SEQ ID NO: 658776 - DNA, 13 bp, D. melanogaster
tgtaaattcatat

SEQ ID NO: 658777 - DNA, 13 bp, D. melanogaster
tgtaaattcattt

SEQ ID NO: 658778 - DNA, 13 bp, D. melanogaster
tgtaaattcgttt

SEQ ID NO: 658779 - DNA, 13 bp, D. melanogaster
tgtaaattctttt

SEQ ID NO: 658780 - DNA, 13 bp, D. melanogaster
tgtaaattgaatt

SEQ ID NO: 658781 - DNA, 14 bp, D. melanogaster
tgtaaattgaattt

SEQ ID NO: 658782 - DNA, 13 bp, D. melanogaster
tgtaaattgattt

SEQ ID NO: 658783 - DNA, 13 bp, D. melanogaster
tgtaaattgcttt

SEQ ID NO: 658784 - DNA, 14 bp, D. melanogaster
tgtaaattgggtga

SEQ ID NO: 658785 - DNA, 14 bp, D. melanogaster
tgtaaattgtaaat

SEQ ID NO: 658786 - DNA, 14 bp, D. melanogaster
tgtaaattgtatat

SEQ ID NO: 658787 - DNA, 13 bp, D. melanogaster
tgtaaattgtcag

SEQ ID NO: 658788 - DNA, 13 bp, D. melanogaster
tgtaaattgtgtg

SEQ ID NO: 658789 - DNA, 13 bp, D. melanogaster
tgtaaattgtgtt

SEQ ID NO: 658790 - DNA, 13 bp, D. melanogaster
tgtaaattgttta

SEQ ID NO: 658791 - DNA, 13 bp, D. melanogaster
tgtaaatttaatg

SEQ ID NO: 658792 - DNA, 13 bp, D. melanogaster
tgtaaatttacaa

SEQ ID NO: 658793 - DNA, 13 bp, D. melanogaster
tgtaaatttcgaa

SEQ ID NO: 658794 - DNA, 13 bp, D. melanogaster
tgtaaatttgtat

SEQ ID NO: 658795 - DNA, 14 bp, D. melanogaster
tgtaaatttttgtg

SEQ ID NO: 658796 - DNA, 14 bp, D. melanogaster
tgtaacaaaatatg

SEQ ID NO: 658797 - DNA, 13 bp, D. melanogaster
tgtaacaatattt

SEQ ID NO: 658798 - DNA, 13 bp, D. melanogaster
tgtaacatttaaa

SEQ ID NO: 658799 - DNA, 13 bp, D. melanogaster
tgtaaccatttcg

SEQ ID NO: 658800 - DNA, 13 bp, D. melanogaster
tgtaacccaaata

SEQ ID NO: 658801 - DNA, 13 bp, D. melanogaster
tgtaacttatttt

SEQ ID NO: 658802 - DNA, 13 bp, D. melanogaster
tgtaacttgttaa

SEQ ID NO: 658803 - DNA, 14 bp, D. melanogaster
tgtaacttgttaag

SEQ ID NO: 658804 - DNA, 13 bp, D. melanogaster
tgtaactttaggt

SEQ ID NO: 658805 - DNA, 13 bp, D. melanogaster
tgtaactttttat

SEQ ID NO: 658806 - DNA, 13 bp, D. melanogaster
tgtaagaataact

SEQ ID NO: 658807 - DNA, 14 bp, D. melanogaster
tgtaaggagagtgt

SEQ ID NO: 658808 - DNA, 13 bp, D. melanogaster
tgtaagtaattaa

SEQ ID NO: 658809 - DNA, 13 bp, D. melanogaster
tgtaagtatgtaa

SEQ ID NO: 658810 - DNA, 13 bp, D. melanogaster
tgtaagtgtgcgt

SEQ ID NO: 658811 - DNA, 14 bp, D. melanogaster
tgtaagtgtgtgtg

SEQ ID NO: 658812 - DNA, 13 bp, D. melanogaster
tgtaagttaaata

SEQ ID NO: 658813 - DNA, 14 bp, D. melanogaster
tgtaagttgttggc

SEQ ID NO: 658814 - DNA, 14 bp, D. melanogaster
tgtaataaaaatgt

SEQ ID NO: 658815 - DNA, 14 bp, D. melanogaster
tgtaataaaccaat

SEQ ID NO: 658816 - DNA, 14 bp, D. melanogaster
tgtaataaagtcaa

SEQ ID NO: 658817 - DNA, 13 bp, D. melanogaster
tgtaataaatcaa

SEQ ID NO: 658818 - DNA, 14 bp, D. melanogaster
tgtaataaattttg

SEQ ID NO: 658819 - DNA, 13 bp, D. melanogaster
tgtaataatgtaa

SEQ ID NO: 658820 - DNA, 13 bp, D. melanogaster
tgtaataattaca

SEQ ID NO: 658821 - DNA, 14 bp, D. melanogaster
tgtaataattacag

SEQ ID NO: 658822 - DNA, 14 bp, D. melanogaster
tgtaataattgtaa

SEQ ID NO: 658823 - DNA, 13 bp, D. melanogaster
tgtaatatatttc

SEQ ID NO: 658824 - DNA, 13 bp, D. melanogaster
tgtaatatgtaat

SEQ ID NO: 658825 - DNA, 14 bp, D. melanogaster
tgtaatatgtaata

SEQ ID NO: 658826 - DNA, 13 bp, D. melanogaster
tgtaatatgtatt

SEQ ID NO: 658827 - DNA, 14 bp, D. melanogaster
tgtaatatttaagt

SEQ ID NO: 658828 - DNA, 13 bp, D. melanogaster
tgtaatatttcat

SEQ ID NO: 658829 - DNA, 13 bp, D. melanogaster
tgtaatatttgat

SEQ ID NO: 658830 - DNA, 13 bp, D. melanogaster
tgtaatatttgta

SEQ ID NO: 658831 - DNA, 13 bp, D. melanogaster
tgtaatcaaattt

SEQ ID NO: 658832 - DNA, 13 bp, D. melanogaster
tgtaatcaacatt

SEQ ID NO: 658833 - DNA, 14 bp, D. melanogaster
tgtaatcaccacca

SEQ ID NO: 658834 - DNA, 13 bp, D. melanogaster
tgtaatgatgaac

SEQ ID NO: 658835 - DNA, 14 bp, D. melanogaster
tgtaatgatgaact

SEQ ID NO: 658836 - DNA, 13 bp, D. melanogaster
tgtaatgtaaata

SEQ ID NO: 658837 - DNA, 14 bp, D. melanogaster
tgtaatgtaatgta

SEQ ID NO: 658838 - DNA, 13 bp, D. melanogaster
tgtaatgtcagca

SEQ ID NO: 658839 - DNA, 13 bp, D. melanogaster
tgtaatgtgttgt

SEQ ID NO: 658840 - DNA, 13 bp, D. melanogaster
tgtaattaacatt

SEQ ID NO: 658841 - DNA, 13 bp, D. melanogaster
tgtaattaagttt

SEQ ID NO: 658842 - DNA, 14 bp, D. melanogaster
tgtaattaataaac

SEQ ID NO: 658843 - DNA, 13 bp, D. melanogaster
tgtaattaatttg

SEQ ID NO: 658844 - DNA, 13 bp, D. melanogaster
tgtaattacaaat

SEQ ID NO: 658845 - DNA, 13 bp, D. melanogaster
tgtaattacattt

SEQ ID NO: 658846 - DNA, 13 bp, D. melanogaster
tgtaattacttca

SEQ ID NO: 658847 - DNA, 13 bp, D. melanogaster
tgtaattagtgtc

SEQ ID NO: 658848 - DNA, 13 bp, D. melanogaster
tgtaattatacaa

SEQ ID NO: 658849 - DNA, 13 bp, D. melanogaster
tgtaattatgtgc

SEQ ID NO: 658850 - DNA, 13 bp, D. melanogaster
tgtaattatttac

SEQ ID NO: 658851 - DNA, 13 bp, D. melanogaster
tgtaattatttca

SEQ ID NO: 658852 - DNA, 13 bp, D. melanogaster
tgtaattcaaaaa

SEQ ID NO: 658853 - DNA, 13 bp, D. melanogaster
tgtaattgaaaac

SEQ ID NO: 658854 - DNA, 13 bp, D. melanogaster
tgtaattgaaaat

SEQ ID NO: 658855 - DNA, 13 bp, D. melanogaster
tgtaattgaaatt

SEQ ID NO: 658856 - DNA, 13 bp, D. melanogaster
tgtaattgattta

SEQ ID NO: 658857 - DNA, 13 bp, D. melanogaster
tgtaattgcaatt

SEQ ID NO: 658858 - DNA, 13 bp, D. melanogaster
tgtaattgcatta

SEQ ID NO: 658859 - DNA, 13 bp, D. melanogaster
tgtaattggaaat

SEQ ID NO: 658860 - DNA, 13 bp, D. melanogaster
tgtaattggattt

SEQ ID NO: 658861 - DNA, 13 bp, D. melanogaster
tgtaattggcact

SEQ ID NO: 658862 - DNA, 13 bp, D. melanogaster
tgtaattgtaatt

SEQ ID NO: 658863 - DNA, 14 bp, D. melanogaster
tgtaattgtaattg

SEQ ID NO: 658864 - DNA, 13 bp, D. melanogaster
tgtaattgtagtt

SEQ ID NO: 658865 - DNA, 13 bp, D. melanogaster
tgtaattgtataa

SEQ ID NO: 658866 - DNA, 13 bp, D. melanogaster
tgtaatttaaatc

SEQ ID NO: 658867 - DNA, 13 bp, D. melanogaster
tgtaatttaattc

SEQ ID NO: 658868 - DNA, 13 bp, D. melanogaster
tgtaatttatcat

SEQ ID NO: 658869 - DNA, 13 bp, D. melanogaster
tgtaatttatgaa

SEQ ID NO: 658870 - DNA, 13 bp, D. melanogaster
tgtaatttatgtg

SEQ ID NO: 658871 - DNA, 13 bp, D. melanogaster
tgtaatttatttc

SEQ ID NO: 658872 - DNA, 13 bp, D. melanogaster
tgtaatttcatta

SEQ ID NO: 658873 - DNA, 15 bp, D. melanogaster
tgtaattttaagcca

SEQ ID NO: 658874 - DNA, 13 bp, D. melanogaster
tgtaattttccat

SEQ ID NO: 658875 - DNA, 13 bp, D. melanogaster
tgtaattttctta

SEQ ID NO: 658876 - DNA, 13 bp, D. melanogaster
tgtaattttgtaa

SEQ ID NO: 658877 - DNA, 13 bp, D. melanogaster
tgtacaaaaaaca

SEQ ID NO: 658878 - DNA, 13 bp, D. melanogaster
tgtacaaaaacaa

SEQ ID NO: 658879 - DNA, 13 bp, D. melanogaster
tgtacaaagcatt

SEQ ID NO: 658880 - DNA, 13 bp, D. melanogaster
tgtacaaataaat

SEQ ID NO: 658881 - DNA, 13 bp, D. melanogaster
tgtacaaatcaaa

SEQ ID NO: 658882 - DNA, 13 bp, D. melanogaster
tgtacaaatccat

SEQ ID NO: 658883 - DNA, 13 bp, D. melanogaster
tgtacaaatgtat

SEQ ID NO: 658884 - DNA, 13 bp, D. melanogaster
tgtacaaatttat

SEQ ID NO: 658885 - DNA, 13 bp, D. melanogaster
tgtacaacaattt

SEQ ID NO: 658886 - DNA, 13 bp, D. melanogaster
tgtacaacatatt

SEQ ID NO: 658887 - DNA, 13 bp, D. melanogaster
tgtacaataataa

SEQ ID NO: 658888 - DNA, 13 bp, D. melanogaster
tgtacaatataat

SEQ ID NO: 658889 - DNA, 13 bp, D. melanogaster
tgtacaatatatt

SEQ ID NO: 658890 - DNA, 13 bp, D. melanogaster
tgtacaatattta

SEQ ID NO: 658891 - DNA, 14 bp, D. melanogaster
tgtacaatatttat

SEQ ID NO: 658892 - DNA, 13 bp, D. melanogaster
tgtacaatgtaca

SEQ ID NO: 658893 - DNA, 13 bp, D. melanogaster
tgtacaattattt

SEQ ID NO: 658894 - DNA, 13 bp, D. melanogaster
tgtacaatttatt

SEQ ID NO: 658895 - DNA, 13 bp, D. melanogaster
tgtacaatttgtt

SEQ ID NO: 658896 - DNA, 13 bp, D. melanogaster
tgtacaattttaa

SEQ ID NO: 658897 - DNA, 13 bp, D. melanogaster
tgtacaatttttg

SEQ ID NO: 658898 - DNA, 13 bp, D. melanogaster
tgtacaatttttt

SEQ ID NO: 658899 - DNA, 14 bp, D. melanogaster
tgtacacacacaca

SEQ ID NO: 658900 - DNA, 13 bp, D. melanogaster
tgtacacacattt

SEQ ID NO: 658901 - DNA, 14 bp, D. melanogaster
tgtacacatacata

SEQ ID NO: 658902 - DNA, 13 bp, D. melanogaster
tgtacacattttt

SEQ ID NO: 658903 - DNA, 13 bp, D. melanogaster
tgtacaccacaca

SEQ ID NO: 658904 - DNA, 13 bp, D. melanogaster
tgtacaccccaac

SEQ ID NO: 658905 - DNA, 13 bp, D. melanogaster
tgtacactcgctt

SEQ ID NO: 658906 - DNA, 13 bp, D. melanogaster
tgtacactgaaaa

SEQ ID NO: 658907 - DNA, 13 bp, D. melanogaster
tgtacacttaaaa

SEQ ID NO: 658908 - DNA, 13 bp, D. melanogaster
tgtacagcagtat

SEQ ID NO: 658909 - DNA, 13 bp, D. melanogaster
tgtacataaacaa

SEQ ID NO: 658910 - DNA, 13 bp, D. melanogaster
tgtacataaataa

SEQ ID NO: 658911 - DNA, 14 bp, D. melanogaster
tgtacataaatatg

SEQ ID NO: 658912 - DNA, 13 bp, D. melanogaster
tgtacataaatgt

SEQ ID NO: 658913 - DNA, 13 bp, D. melanogaster
tgtacataaatta

SEQ ID NO: 658914 - DNA, 13 bp, D. melanogaster
tgtacataagtgt

SEQ ID NO: 658915 - DNA, 14 bp, D. melanogaster
tgtacataatatat

SEQ ID NO: 658916 - DNA, 13 bp, D. melanogaster
tgtacataatgct

SEQ ID NO: 658917 - DNA, 13 bp, D. melanogaster
tgtacataatgta

SEQ ID NO: 658918 - DNA, 13 bp, D. melanogaster
tgtacataattta

SEQ ID NO: 658919 - DNA, 13 bp, D. melanogaster
tgtacatacaatt

SEQ ID NO: 658920 - DNA, 13 bp, D. melanogaster
tgtacatacacat

SEQ ID NO: 658921 - DNA, 13 bp, D. melanogaster
tgtacatacataa

SEQ ID NO: 658922 - DNA, 14 bp, D. melanogaster
tgtacatacataaa

SEQ ID NO: 658923 - DNA, 14 bp, D. melanogaster
tgtacatacatacg

SEQ ID NO: 658924 - DNA, 13 bp, D. melanogaster
tgtacatacatag

SEQ ID NO: 658925 - DNA, 14 bp, D. melanogaster
tgtacatacatagt

SEQ ID NO: 658926 - DNA, 14 bp, D. melanogaster
tgtacatacatatg

SEQ ID NO: 658927 - DNA, 13 bp, D. melanogaster
tgtacatacatgc

SEQ ID NO: 658928 - DNA, 13 bp, D. melanogaster
tgtacatacgtat

SEQ ID NO: 658929 - DNA, 14 bp, D. melanogaster
tgtacatacgtatg

SEQ ID NO: 658930 - DNA, 13 bp, D. melanogaster
tgtacatactata

SEQ ID NO: 658931 - DNA, 13 bp, D. melanogaster
tgtacatagatat

SEQ ID NO: 658932 - DNA, 13 bp, D. melanogaster
tgtacatataaac

SEQ ID NO: 658933 - DNA, 14 bp, D. melanogaster
tgtacatataaata

SEQ ID NO: 658934 - DNA, 13 bp, D. melanogaster
tgtacatataatg

SEQ ID NO: 658935 - DNA, 13 bp, D. melanogaster
tgtacatatataa

SEQ ID NO: 658936 - DNA, 14 bp, D. melanogaster
tgtacatatataag

SEQ ID NO: 658937 - DNA, 13 bp, D. melanogaster
tgtacatatatac

SEQ ID NO: 658938 - DNA, 14 bp, D. melanogaster
tgtacatatataca

SEQ ID NO: 658939 - DNA, 14 bp, D. melanogaster
tgtacatatatacg

SEQ ID NO: 658940 - DNA, 13 bp, D. melanogaster
tgtacatatatag

SEQ ID NO: 658941 - DNA, 14 bp, D. melanogaster
tgtacatatatagt

SEQ ID NO: 658942 - DNA, 14 bp, D. melanogaster
tgtacatatatatc

SEQ ID NO: 658943 - DNA, 14 bp, D. melanogaster
tgtacatatatatt

SEQ ID NO: 658944 - DNA, 13 bp, D. melanogaster
tgtacatatatcc

SEQ ID NO: 658945 - DNA, 14 bp, D. melanogaster
tgtacatatatcca

SEQ ID NO: 658946 - DNA, 13 bp, D. melanogaster
tgtacatatatga

SEQ ID NO: 658947 - DNA, 14 bp, D. melanogaster
tgtacatatattat

SEQ ID NO: 658948 - DNA, 13 bp, D. melanogaster
tgtacatatattg

SEQ ID NO: 658949 - DNA, 14 bp, D. melanogaster
tgtacatatattgt

SEQ ID NO: 658950 - DNA, 13 bp, D. melanogaster
tgtacatatgcat

SEQ ID NO: 658951 - DNA, 13 bp, D. melanogaster
tgtacatatgtac

SEQ ID NO: 658952 - DNA, 14 bp, D. melanogaster
tgtacatatgtact

SEQ ID NO: 658953 - DNA, 14 bp, D. melanogaster
tgtacatatgtatt

SEQ ID NO: 658954 - DNA, 13 bp, D. melanogaster
tgtacatatgtgt

SEQ ID NO: 658955 - DNA, 14 bp, D. melanogaster
tgtacatatgtgtg

SEQ ID NO: 658956 - DNA, 13 bp, D. melanogaster
tgtacatattata

SEQ ID NO: 658957 - DNA, 13 bp, D. melanogaster
tgtacatattgta

SEQ ID NO: 658958 - DNA, 14 bp, D. melanogaster
tgtacatattgtat

SEQ ID NO: 658959 - DNA, 13 bp, D. melanogaster
tgtacatatttac

SEQ ID NO: 658960 - DNA, 14 bp, D. melanogaster
tgtacatatttaca

SEQ ID NO: 658961 - DNA, 13 bp, D. melanogaster
tgtacatatttat

SEQ ID NO: 658962 - DNA, 14 bp, D. melanogaster
tgtacatatttatt

SEQ ID NO: 658963 - DNA, 13 bp, D. melanogaster
tgtacatatttgt

SEQ ID NO: 658964 - DNA, 14 bp, D. melanogaster
tgtacatattttat

SEQ ID NO: 658965 - DNA, 14 bp, D. melanogaster
tgtacatattttta

SEQ ID NO: 658966 - DNA, 13 bp, D. melanogaster
tgtacatcctgtg

SEQ ID NO: 658967 - DNA, 13 bp, D. melanogaster
tgtacatgcatat

SEQ ID NO: 658968 - DNA, 14 bp, D. melanogaster
tgtacatgtacata

SEQ ID NO: 658969 - DNA, 13 bp, D. melanogaster
tgtacatgtatgt

SEQ ID NO: 658970 - DNA, 13 bp, D. melanogaster
tgtacatgtattt

SEQ ID NO: 658971 - DNA, 13 bp, D. melanogaster
tgtacatgtgcat

SEQ ID NO: 658972 - DNA, 14 bp, D. melanogaster
tgtacatgtgtaca

SEQ ID NO: 658973 - DNA, 13 bp, D. melanogaster
tgtacatgtgtgt

SEQ ID NO: 658974 - DNA, 14 bp, D. melanogaster
tgtacatgtgtgtg

SEQ ID NO: 658975 - DNA, 14 bp, D. melanogaster
tgtacattaaacat

SEQ ID NO: 658976 - DNA, 13 bp, D. melanogaster
tgtacattgtaca

SEQ ID NO: 658977 - DNA, 13 bp, D. melanogaster
tgtacatttaaaa

SEQ ID NO: 658978 - DNA, 14 bp, D. melanogaster
tgtacatttaaaaa

SEQ ID NO: 658979 - DNA, 13 bp, D. melanogaster
tgtacatttatgt

SEQ ID NO: 658980 - DNA, 13 bp, D. melanogaster
tgtacattttaaa

SEQ ID NO: 658981 - DNA, 13 bp, D. melanogaster
tgtacattttaca

SEQ ID NO: 658982 - DNA, 13 bp, D. melanogaster
tgtacattttgaa

SEQ ID NO: 658983 - DNA, 13 bp, D. melanogaster
tgtacattttgca

SEQ ID NO: 658984 - DNA, 13 bp, D. melanogaster
tgtacatttttat

SEQ ID NO: 658985 - DNA, 13 bp, D. melanogaster
tgtacatttttgt

SEQ ID NO: 658986 - DNA, 14 bp, D. melanogaster
tgtacatttttgta

SEQ ID NO: 658987 - DNA, 13 bp, D. melanogaster
tgtaccaaatact

SEQ ID NO: 658988 - DNA, 13 bp, D. melanogaster
tgtacctacatat

SEQ ID NO: 658989 - DNA, 13 bp, D. melanogaster
tgtacgaaaataa

SEQ ID NO: 658990 - DNA, 13 bp, D. melanogaster
tgtacgagtatgt

SEQ ID NO: 658991 - DNA, 14 bp, D. melanogaster
tgtacgagtatgta

SEQ ID NO: 658992 - DNA, 13 bp, D. melanogaster
tgtacgagtattt

SEQ ID NO: 658993 - DNA, 14 bp, D. melanogaster
tgtacgagtgtgtg

SEQ ID NO: 658994 - DNA, 13 bp, D. melanogaster
tgtacggcaagaa

SEQ ID NO: 658995 - DNA, 13 bp, D. melanogaster
tgtacgtatatat

SEQ ID NO: 658996 - DNA, 14 bp, D. melanogaster
tgtacgtatgtaat

SEQ ID NO: 658997 - DNA, 13 bp, D. melanogaster
tgtacgtgtgtgt

SEQ ID NO: 658998 - DNA, 14 bp, D. melanogaster
tgtacgtgtgtgtg

SEQ ID NO: 658999 - DNA, 13 bp, D. melanogaster
tgtacgttttttg

SEQ ID NO: 659000 - DNA, 13 bp, D. melanogaster
tgtactaaatgta

SEQ ID NO: 659001 - DNA, 13 bp, D. melanogaster
tgtactacataca

SEQ ID NO: 659002 - DNA, 13 bp, D. melanogaster
tgtactacatata

SEQ ID NO: 659003 - DNA, 13 bp, D. melanogaster
tgtactatatatg

SEQ ID NO: 659004 - DNA, 13 bp, D. melanogaster
tgtactatatatt

SEQ ID NO: 659005 - DNA, 13 bp, D. melanogaster
tgtactatattta

SEQ ID NO: 659006 - DNA, 13 bp, D. melanogaster
tgtactatatttt

SEQ ID NO: 659007 - DNA, 13 bp, D. melanogaster
tgtactcatattt

SEQ ID NO: 659008 - DNA, 13 bp, D. melanogaster
tgtactcgttctt

SEQ ID NO: 659009 - DNA, 13 bp, D. melanogaster
tgtactgcaatgt

SEQ ID NO: 659010 - DNA, 13 bp, D. melanogaster
tgtactgcagtgt

SEQ ID NO: 659011 - DNA, 13 bp, D. melanogaster
tgtactgtactgt

SEQ ID NO: 659012 - DNA, 13 bp, D. melanogaster
tgtacttatacat

SEQ ID NO: 659013 - DNA, 14 bp, D. melanogaster
tgtacttatacatt

SEQ ID NO: 659014 - DNA, 14 bp, D. melanogaster
tgtacttatgtata

SEQ ID NO: 659015 - DNA, 13 bp, D. melanogaster
tgtacttctacat

SEQ ID NO: 659016 - DNA, 14 bp, D. melanogaster
tgtacttgtacttg

SEQ ID NO: 659017 - DNA, 13 bp, D. melanogaster
tgtactttaaaaa

SEQ ID NO: 659018 - DNA, 13 bp, D. melanogaster
tgtactttaatat

SEQ ID NO: 659019 - DNA, 13 bp, D. melanogaster
tgtactttaattt

SEQ ID NO: 659020 - DNA, 13 bp, D. melanogaster
tgtactttatata

SEQ ID NO: 659021 - DNA, 13 bp, D. melanogaster
tgtactttcaatt

SEQ ID NO: 659022 - DNA, 13 bp, D. melanogaster
tgtactttgttct

SEQ ID NO: 659023 - DNA, 13 bp, D. melanogaster
tgtacttttcatt

SEQ ID NO: 659024 - DNA, 13 bp, D. melanogaster
tgtagaacaacag

SEQ ID NO: 659025 - DNA, 13 bp, D. melanogaster
tgtagaagaacct

SEQ ID NO: 659026 - DNA, 13 bp, D. melanogaster
tgtagaatgtaga

SEQ ID NO: 659027 - DNA, 13 bp, D. melanogaster
tgtagatacattt

SEQ ID NO: 659028 - DNA, 13 bp, D. melanogaster
tgtagatgcaaaa

SEQ ID NO: 659029 - DNA, 13 bp, D. melanogaster
tgtagatgtagat

SEQ ID NO: 659030 - DNA, 14 bp, D. melanogaster
tgtagattttgaaa

SEQ ID NO: 659031 - DNA, 13 bp, D. melanogaster
tgtagcaaatatt

SEQ ID NO: 659032 - DNA, 14 bp, D. melanogaster
tgtagcacactttt

SEQ ID NO: 659033 - DNA, 14 bp, D. melanogaster
tgtagcatactttt

SEQ ID NO: 659034 - DNA, 13 bp, D. melanogaster
tgtagccacaaca

SEQ ID NO: 659035 - DNA, 13 bp, D. melanogaster
tgtagcccaacaa

SEQ ID NO: 659036 - DNA, 14 bp, D. melanogaster
tgtagccctgaaaa

SEQ ID NO: 659037 - DNA, 14 bp, D. melanogaster
tgtagctataacca

SEQ ID NO: 659038 - DNA, 13 bp, D. melanogaster
tgtagctgctgct

SEQ ID NO: 659039 - DNA, 13 bp, D. melanogaster
tgtagctgctgtt

SEQ ID NO: 659040 - DNA, 13 bp, D. melanogaster
tgtagctgtagct

SEQ ID NO: 659041 - DNA, 13 bp, D. melanogaster
tgtaggcaacata

SEQ ID NO: 659042 - DNA, 13 bp, D. melanogaster
tgtaggtaatttt

SEQ ID NO: 659043 - DNA, 25 bp, D. melanogaster
tgtagtaggctgctccttctaccct

SEQ ID NO: 659044 - DNA, 13 bp, D. melanogaster
tgtagtagtagta

SEQ ID NO: 659045 - DNA, 14 bp, D. melanogaster
tgtagtagttttta

SEQ ID NO: 659046 - DNA, 13 bp, D. melanogaster
tgtagtatacata

SEQ ID NO: 659047 - DNA, 13 bp, D. melanogaster
tgtagtatgtgcc

SEQ ID NO: 659048 - DNA, 17 bp, D. melanogaster
tgtagtatgtgcctatg

SEQ ID NO: 659049 - DNA, 13 bp, D. melanogaster
tgtagtcttgtag

SEQ ID NO: 659050 - DNA, 13 bp, D. melanogaster
tgtagttaaatta

SEQ ID NO: 659051 - DNA, 13 bp, D. melanogaster
tgtagttaattag

SEQ ID NO: 659052 - DNA, 13 bp, D. melanogaster
tgtagttgctcag

SEQ ID NO: 659053 - DNA, 14 bp, D. melanogaster
tgtagttgtagttg

SEQ ID NO: 659054 - DNA, 13 bp, D. melanogaster
tgtagttgttctg

SEQ ID NO: 659055 - DNA, 14 bp, D. melanogaster
tgtagtttattaaa

SEQ ID NO: 659056 - DNA, 13 bp, D. melanogaster
tgtagtttcgaaa

SEQ ID NO: 659057 - DNA, 13 bp, D. melanogaster
tgtagtttctatt

SEQ ID NO: 659058 - DNA, 13 bp, D. melanogaster
tgtagttttttgc

SEQ ID NO: 659059 - DNA, 14 bp, D. melanogaster
tgtataaaaaattg

SEQ ID NO: 659060 - DNA, 13 bp, D. melanogaster
tgtataaaagtta

SEQ ID NO: 659061 - DNA, 13 bp, D. melanogaster
tgtataaaatgca

SEQ ID NO: 659062 - DNA, 13 bp, D. melanogaster
tgtataaacaaca

SEQ ID NO: 659063 - DNA, 13 bp, D. melanogaster
tgtataaacacat

SEQ ID NO: 659064 - DNA, 13 bp, D. melanogaster
tgtataaacatat

SEQ ID NO: 659065 - DNA, 13 bp, D. melanogaster
tgtataaagtata

SEQ ID NO: 659066 - DNA, 13 bp, D. melanogaster
tgtataaatacat

SEQ ID NO: 659067 - DNA, 13 bp, D. melanogaster
tgtataaatactt

SEQ ID NO: 659068 - DNA, 13 bp, D. melanogaster
tgtataaatatgt

SEQ ID NO: 659069 - DNA, 14 bp, D. melanogaster
tgtataaatatgta

SEQ ID NO: 659070 - DNA, 13 bp, D. melanogaster
tgtataaatcaaa

SEQ ID NO: 659071 - DNA, 13 bp, D. melanogaster
tgtataaatcatt

SEQ ID NO: 659072 - DNA, 13 bp, D. melanogaster
tgtataaatgtaa

SEQ ID NO: 659073 - DNA, 13 bp, D. melanogaster
tgtataaatgtat

SEQ ID NO: 659074 - DNA, 14 bp, D. melanogaster
tgtataaatgtata

SEQ ID NO: 659075 - DNA, 13 bp, D. melanogaster
tgtataactaatt

SEQ ID NO: 659076 - DNA, 13 bp, D. melanogaster
tgtataagaacta

SEQ ID NO: 659077 - DNA, 13 bp, D. melanogaster
tgtataagtacac

SEQ ID NO: 659078 - DNA, 14 bp, D. melanogaster
tgtataataaatac

SEQ ID NO: 659079 - DNA, 13 bp, D. melanogaster
tgtataatataca

SEQ ID NO: 659080 - DNA, 13 bp, D. melanogaster
tgtataattgatt

SEQ ID NO: 659081 - DNA, 14 bp, D. melanogaster
tgtatacatacata

SEQ ID NO: 659082 - DNA, 14 bp, D. melanogaster
tgtatacatataca

SEQ ID NO: 659083 - DNA, 13 bp, D. melanogaster
tgtatacattttt

SEQ ID NO: 659084 - DNA, 13 bp, D. melanogaster
tgtataccatata

SEQ ID NO: 659085 - DNA, 13 bp, D. melanogaster
tgtatacgtatat

SEQ ID NO: 659086 - DNA, 13 bp, D. melanogaster
tgtatacgtatgt

SEQ ID NO: 659087 - DNA, 13 bp, D. melanogaster
tgtatactacaat

SEQ ID NO: 659088 - DNA, 13 bp, D. melanogaster
tgtatactgtata

SEQ ID NO: 659089 - DNA, 13 bp, D. melanogaster
tgtatactttata

SEQ ID NO: 659090 - DNA, 13 bp, D. melanogaster
tgtatacttttaa

SEQ ID NO: 659091 - DNA, 13 bp, D. melanogaster
tgtatagtatagt

SEQ ID NO: 659092 - DNA, 13 bp, D. melanogaster
tgtatagtggtgt

SEQ ID NO: 659093 - DNA, 13 bp, D. melanogaster
tgtatagtttaat

SEQ ID NO: 659094 - DNA, 13 bp, D. melanogaster
tgtatataaaatg

SEQ ID NO: 659095 - DNA, 13 bp, D. melanogaster
tgtatataaatgc

SEQ ID NO: 659096 - DNA, 13 bp, D. melanogaster
tgtatataaatgt

SEQ ID NO: 659097 - DNA, 14 bp, D. melanogaster
tgtatataatgtat

SEQ ID NO: 659098 - DNA, 15 bp, D. melanogaster
tgtatatacatatat

SEQ ID NO: 659099 - DNA, 13 bp, D. melanogaster
tgtatatactata

SEQ ID NO: 659100 - DNA, 14 bp, D. melanogaster
tgtatatactatat

SEQ ID NO: 659101 - DNA, 13 bp, D. melanogaster
tgtatatagcata

SEQ ID NO: 659102 - DNA, 13 bp, D. melanogaster
tgtatatagtatg

SEQ ID NO: 659103 - DNA, 13 bp, D. melanogaster
tgtatatataaca

SEQ ID NO: 659104 - DNA, 15 bp, D. melanogaster
tgtatatatacatac

SEQ ID NO: 659105 - DNA, 13 bp, D. melanogaster
tgtatatatagtt

SEQ ID NO: 659106 - DNA, 14 bp, D. melanogaster
tgtatatatatatc

SEQ ID NO: 659107 - DNA, 14 bp, D. melanogaster
tgtatatatatatg

SEQ ID NO: 659108 - DNA, 13 bp, D. melanogaster
tgtatatatatgg

SEQ ID NO: 659109 - DNA, 13 bp, D. melanogaster
tgtatatatcatt

SEQ ID NO: 659110 - DNA, 13 bp, D. melanogaster
tgtatatatctat

SEQ ID NO: 659111 - DNA, 13 bp, D. melanogaster
tgtatatatctgt

SEQ ID NO: 659112 - DNA, 13 bp, D. melanogaster
tgtatatatgaat

SEQ ID NO: 659113 - DNA, 13 bp, D. melanogaster
tgtatatatgtac

SEQ ID NO: 659114 - DNA, 16 bp, D. melanogaster
tgtatatatgtatatg

SEQ ID NO: 659115 - DNA, 14 bp, D. melanogaster
tgtatatatgtatt

SEQ ID NO: 659116 - DNA, 13 bp, D. melanogaster
tgtatatatgtgc

SEQ ID NO: 659117 - DNA, 13 bp, D. melanogaster
tgtatatatgtgt

SEQ ID NO: 659118 - DNA, 13 bp, D. melanogaster
tgtatatattcaa

SEQ ID NO: 659119 - DNA, 13 bp, D. melanogaster
tgtatatattgca

SEQ ID NO: 659120 - DNA, 13 bp, D. melanogaster
tgtatatattgta

SEQ ID NO: 659121 - DNA, 13 bp, D. melanogaster
tgtatatatttga

SEQ ID NO: 659122 - DNA, 13 bp, D. melanogaster
tgtatatattttc

SEQ ID NO: 659123 - DNA, 14 bp, D. melanogaster
tgtatatcaaacaa

SEQ ID NO: 659124 - DNA, 13 bp, D. melanogaster
tgtatatctatgt

SEQ ID NO: 659125 - DNA, 13 bp, D. melanogaster
tgtatatctgtat

SEQ ID NO: 659126 - DNA, 13 bp, D. melanogaster
tgtatatgaaata

SEQ ID NO: 659127 - DNA, 13 bp, D. melanogaster
tgtatatgaaatt

SEQ ID NO: 659128 - DNA, 14 bp, D. melanogaster
tgtatatgaatgta

SEQ ID NO: 659129 - DNA, 13 bp, D. melanogaster
tgtatatgccata

SEQ ID NO: 659130 - DNA, 14 bp, D. melanogaster
tgtatatgtaaata

SEQ ID NO: 659131 - DNA, 14 bp, D. melanogaster
tgtatatgtacata

SEQ ID NO: 659132 - DNA, 13 bp, D. melanogaster
tgtatatgtataa

SEQ ID NO: 659133 - DNA, 14 bp, D. melanogaster
tgtatatgtataat

SEQ ID NO: 659134 - DNA, 14 bp, D. melanogaster
tgtatatgtatatg

SEQ ID NO: 659135 - DNA, 13 bp, D. melanogaster
tgtatatgtatga

SEQ ID NO: 659136 - DNA, 15 bp, D. melanogaster
tgtatatgtatgttt

SEQ ID NO: 659137 - DNA, 13 bp, D. melanogaster
tgtatatgtgtaa

SEQ ID NO: 659138 - DNA, 13 bp, D. melanogaster
tgtatatgtgtac

SEQ ID NO: 659139 - DNA, 13 bp, D. melanogaster
tgtatatgtgtgt

SEQ ID NO: 659140 - DNA, 13 bp, D. melanogaster
tgtatattacaaa

SEQ ID NO: 659141 - DNA, 13 bp, D. melanogaster
tgtatattacttt

SEQ ID NO: 659142 - DNA, 13 bp, D. melanogaster
tgtatattatttc

SEQ ID NO: 659143 - DNA, 13 bp, D. melanogaster
tgtatattcatat

SEQ ID NO: 659144 - DNA, 13 bp, D. melanogaster
tgtatattcttga

SEQ ID NO: 659145 - DNA, 14 bp, D. melanogaster
tgtatattggcgga

SEQ ID NO: 659146 - DNA, 13 bp, D. melanogaster
tgtatatttgaaa

SEQ ID NO: 659147 - DNA, 13 bp, D. melanogaster
tgtatatttgata

SEQ ID NO: 659148 - DNA, 13 bp, D. melanogaster
tgtatattttcta

SEQ ID NO: 659149 - DNA, 13 bp, D. melanogaster
tgtatattttgaa

SEQ ID NO: 659150 - DNA, 13 bp, D. melanogaster
tgtatattttgca

SEQ ID NO: 659151 - DNA, 13 bp, D. melanogaster
tgtatcaaatttt

SEQ ID NO: 659152 - DNA, 14 bp, D. melanogaster
tgtatcatatttta

SEQ ID NO: 659153 - DNA, 14 bp, D. melanogaster
tgtatccgcatctg

SEQ ID NO: 659154 - DNA, 14 bp, D. melanogaster
tgtatccgtatctg

SEQ ID NO: 659155 - DNA, 13 bp, D. melanogaster
tgtatcgcatctt

SEQ ID NO: 659156 - DNA, 14 bp, D. melanogaster
tgtatctaaagatc

SEQ ID NO: 659157 - DNA, 13 bp, D. melanogaster
tgtatctatatat

SEQ ID NO: 659158 - DNA, 14 bp, D. melanogaster
tgtatctatctatc

SEQ ID NO: 659159 - DNA, 13 bp, D. melanogaster
tgtatctatgaga

SEQ ID NO: 659160 - DNA, 13 bp, D. melanogaster
tgtatctatgtgt

SEQ ID NO: 659161 - DNA, 13 bp, D. melanogaster
tgtatctatgttt

SEQ ID NO: 659162 - DNA, 13 bp, D. melanogaster
tgtatctatttat

SEQ ID NO: 659163 - DNA, 13 bp, D. melanogaster
tgtatctcaataa

SEQ ID NO: 659164 - DNA, 13 bp, D. melanogaster
tgtatctcaatct

SEQ ID NO: 659165 - DNA, 13 bp, D. melanogaster
tgtatctctatct

SEQ ID NO: 659166 - DNA, 14 bp, D. melanogaster
tgtatctctatctg

SEQ ID NO: 659167 - DNA, 13 bp, D. melanogaster
tgtatctgaatcc

SEQ ID NO: 659168 - DNA, 13 bp, D. melanogaster
tgtatctgaatct

SEQ ID NO: 659169 - DNA, 14 bp, D. melanogaster
tgtatctgaatctg

SEQ ID NO: 659170 - DNA, 13 bp, D. melanogaster
tgtatctgcagct

SEQ ID NO: 659171 - DNA, 13 bp, D. melanogaster
tgtatctgcatct

SEQ ID NO: 659172 - DNA, 14 bp, D. melanogaster
tgtatctgcatctg

SEQ ID NO: 659173 - DNA, 13 bp, D. melanogaster
tgtatctggatga

SEQ ID NO: 659174 - DNA, 14 bp, D. melanogaster
tgtatctggcggat

SEQ ID NO: 659175 - DNA, 13 bp, D. melanogaster
tgtatctgtaaat

SEQ ID NO: 659176 - DNA, 13 bp, D. melanogaster
tgtatctgtacct

SEQ ID NO: 659177 - DNA, 13 bp, D. melanogaster
tgtatctgtatct

SEQ ID NO: 659178 - DNA, 14 bp, D. melanogaster
tgtatctgtatcta

SEQ ID NO: 659179 - DNA, 14 bp, D. melanogaster
tgtatctgtatctg

SEQ ID NO: 659180 - DNA, 13 bp, D. melanogaster
tgtatctgtattt

SEQ ID NO: 659181 - DNA, 13 bp, D. melanogaster
tgtatctgtgcat

SEQ ID NO: 659182 - DNA, 13 bp, D. melanogaster
tgtatctgtgtaa

SEQ ID NO: 659183 - DNA, 13 bp, D. melanogaster
tgtatctgtgttt

SEQ ID NO: 659184 - DNA, 13 bp, D. melanogaster
tgtatctgtttgt

SEQ ID NO: 659185 - DNA, 13 bp, D. melanogaster
tgtatcttaaaga

SEQ ID NO: 659186 - DNA, 13 bp, D. melanogaster
tgtatcttaaatt

SEQ ID NO: 659187 - DNA, 14 bp, D. melanogaster
tgtatcttgtatct

SEQ ID NO: 659188 - DNA, 13 bp, D. melanogaster
tgtatctttatct

SEQ ID NO: 659189 - DNA, 13 bp, D. melanogaster
tgtatctttcgga

SEQ ID NO: 659190 - DNA, 13 bp, D. melanogaster
tgtatctttggct

SEQ ID NO: 659191 - DNA, 14 bp, D. melanogaster
tgtatctttgtatc

SEQ ID NO: 659192 - DNA, 13 bp, D. melanogaster
tgtatctttgtgt

SEQ ID NO: 659193 - DNA, 13 bp, D. melanogaster
tgtatgaatgaat

SEQ ID NO: 659194 - DNA, 13 bp, D. melanogaster
tgtatgagtgtat

SEQ ID NO: 659195 - DNA, 13 bp, D. melanogaster
tgtatgcaaaact

SEQ ID NO: 659196 - DNA, 13 bp, D. melanogaster
tgtatgcaaaata

SEQ ID NO: 659197 - DNA, 13 bp, D. melanogaster
tgtatgcaaataa

SEQ ID NO: 659198 - DNA, 13 bp, D. melanogaster
tgtatgcaaatcg

SEQ ID NO: 659199 - DNA, 13 bp, D. melanogaster
tgtatgcataaat

SEQ ID NO: 659200 - DNA, 13 bp, D. melanogaster
tgtatgcatattt

SEQ ID NO: 659201 - DNA, 13 bp, D. melanogaster
tgtatgcatgtgt

SEQ ID NO: 659202 - DNA, 13 bp, D. melanogaster
tgtatgcatttaa

SEQ ID NO: 659203 - DNA, 13 bp, D. melanogaster
tgtatgcgtagaa

SEQ ID NO: 659204 - DNA, 13 bp, D. melanogaster
tgtatgcgtgtat

SEQ ID NO: 659205 - DNA, 13 bp, D. melanogaster
tgtatgcgtgtgt

SEQ ID NO: 659206 - DNA, 13 bp, D. melanogaster
tgtatgcgtttgt

SEQ ID NO: 659207 - DNA, 13 bp, D. melanogaster
tgtatgctaattt

SEQ ID NO: 659208 - DNA, 13 bp, D. melanogaster
tgtatgctatggg

SEQ ID NO: 659209 - DNA, 13 bp, D. melanogaster
tgtatgcttctcg

SEQ ID NO: 659210 - DNA, 13 bp, D. melanogaster
tgtatggaaatat

SEQ ID NO: 659211 - DNA, 14 bp, D. melanogaster
tgtatggatgtgtg

SEQ ID NO: 659212 - DNA, 13 bp, D. melanogaster
tgtatggccgtta

SEQ ID NO: 659213 - DNA, 13 bp, D. melanogaster
tgtatgtaaatat

SEQ ID NO: 659214 - DNA, 14 bp, D. melanogaster
tgtatgtaaatata

SEQ ID NO: 659215 - DNA, 13 bp, D. melanogaster
tgtatgtaaatga

SEQ ID NO: 659216 - DNA, 13 bp, D. melanogaster
tgtatgtaaatgt

SEQ ID NO: 659217 - DNA, 13 bp, D. melanogaster
tgtatgtaagtgt

SEQ ID NO: 659218 - DNA, 14 bp, D. melanogaster
tgtatgtaatatgt

SEQ ID NO: 659219 - DNA, 13 bp, D. melanogaster
tgtatgtaatgca

SEQ ID NO: 659220 - DNA, 13 bp, D. melanogaster
tgtatgtacaaaa

SEQ ID NO: 659221 - DNA, 13 bp, D. melanogaster
tgtatgtacataa

SEQ ID NO: 659222 - DNA, 14 bp, D. melanogaster
tgtatgtacataaa

SEQ ID NO: 659223 - DNA, 14 bp, D. melanogaster
tgtatgtacataga

SEQ ID NO: 659224 - DNA, 15 bp, D. melanogaster
tgtatgtacatatac

SEQ ID NO: 659225 - DNA, 13 bp, D. melanogaster
tgtatgtacatct

SEQ ID NO: 659226 - DNA, 13 bp, D. melanogaster
tgtatgtacgtac

SEQ ID NO: 659227 - DNA, 14 bp, D. melanogaster
tgtatgtacgtaca

SEQ ID NO: 659228 - DNA, 13 bp, D. melanogaster
tgtatgtacgtat

SEQ ID NO: 659229 - DNA, 13 bp, D. melanogaster
tgtatgtagatat

SEQ ID NO: 659230 - DNA, 13 bp, D. melanogaster
tgtatgtataaac

SEQ ID NO: 659231 - DNA, 13 bp, D. melanogaster
tgtatgtatactt

SEQ ID NO: 659232 - DNA, 14 bp, D. melanogaster
tgtatgtatatatg

SEQ ID NO: 659233 - DNA, 14 bp, D. melanogaster
tgtatgtatatgca

SEQ ID NO: 659234 - DNA, 14 bp, D. melanogaster
tgtatgtatatgtg

SEQ ID NO: 659235 - DNA, 14 bp, D. melanogaster
tgtatgtatattga

SEQ ID NO: 659236 - DNA, 14 bp, D. melanogaster
tgtatgtatatttg

SEQ ID NO: 659237 - DNA, 13 bp, D. melanogaster
tgtatgtatcttt

SEQ ID NO: 659238 - DNA, 14 bp, D. melanogaster
tgtatgtatgtaga

SEQ ID NO: 659239 - DNA, 14 bp, D. melanogaster
tgtatgtatgtgta

SEQ ID NO: 659240 - DNA, 14 bp, D. melanogaster
tgtatgtatgtgtg

SEQ ID NO: 659241 - DNA, 13 bp, D. melanogaster
tgtatgtatgttc

SEQ ID NO: 659242 - DNA, 14 bp, D. melanogaster
tgtatgtatgttcg

SEQ ID NO: 659243 - DNA, 13 bp, D. melanogaster
tgtatgtctgtgt

SEQ ID NO: 659244 - DNA, 13 bp, D. melanogaster
tgtatgtgaatgt

SEQ ID NO: 659245 - DNA, 13 bp, D. melanogaster
tgtatgtgcatat

SEQ ID NO: 659246 - DNA, 13 bp, D. melanogaster
tgtatgtgtaagt

SEQ ID NO: 659247 - DNA, 13 bp, D. melanogaster
tgtatgtgtatgc

SEQ ID NO: 659248 - DNA, 15 bp, D. melanogaster
tgtatgtgtatgtat

SEQ ID NO: 659249 - DNA, 13 bp, D. melanogaster
tgtatgtgtctgt

SEQ ID NO: 659250 - DNA, 13 bp, D. melanogaster
tgtatgtgtgagc

SEQ ID NO: 659251 - DNA, 14 bp, D. melanogaster
tgtatgtgtgagtg

SEQ ID NO: 659252 - DNA, 13 bp, D. melanogaster
tgtatgtgtgcat

SEQ ID NO: 659253 - DNA, 13 bp, D. melanogaster
tgtatgtgtgcga

SEQ ID NO: 659254 - DNA, 13 bp, D. melanogaster
tgtatgtgtgctt

SEQ ID NO: 659255 - DNA, 13 bp, D. melanogaster
tgtatgtgtgtat

SEQ ID NO: 659256 - DNA, 14 bp, D. melanogaster
tgtatgtgtgtggc

SEQ ID NO: 659257 - DNA, 13 bp, D. melanogaster
tgtatgtgtttgc

SEQ ID NO: 659258 - DNA, 13 bp, D. melanogaster
tgtatgttgtata

SEQ ID NO: 659259 - DNA, 13 bp, D. melanogaster
tgtatgtttgcat

SEQ ID NO: 659260 - DNA, 14 bp, D. melanogaster
tgtatgtttgtata

SEQ ID NO: 659261 - DNA, 13 bp, D. melanogaster
tgtattaaaaaag

SEQ ID NO: 659262 - DNA, 14 bp, D. melanogaster
tgtattaataattc

SEQ ID NO: 659263 - DNA, 13 bp, D. melanogaster
tgtattactaatg

SEQ ID NO: 659264 - DNA, 13 bp, D. melanogaster
tgtattatatgta

SEQ ID NO: 659265 - DNA, 13 bp, D. melanogaster
tgtattatgtaaa

SEQ ID NO: 659266 - DNA, 13 bp, D. melanogaster
tgtattattcatt

SEQ ID NO: 659267 - DNA, 14 bp, D. melanogaster
tgtattatttttcc

SEQ ID NO: 659268 - DNA, 13 bp, D. melanogaster
tgtattcaaaatt

SEQ ID NO: 659269 - DNA, 13 bp, D. melanogaster
tgtattcaaagtt

SEQ ID NO: 659270 - DNA, 13 bp, D. melanogaster
tgtattcaataaa

SEQ ID NO: 659271 - DNA, 13 bp, D. melanogaster
tgtattcaatttt

SEQ ID NO: 659272 - DNA, 13 bp, D. melanogaster
tgtattcacaaat

SEQ ID NO: 659273 - DNA, 13 bp, D. melanogaster
tgtattcacattt

SEQ ID NO: 659274 - DNA, 13 bp, D. melanogaster
tgtattcatttgt

SEQ ID NO: 659275 - DNA, 14 bp, D. melanogaster
tgtattcatttgta

SEQ ID NO: 659276 - DNA, 13 bp, D. melanogaster
tgtattccatttc

SEQ ID NO: 659277 - DNA, 13 bp, D. melanogaster
tgtattccgacca

SEQ ID NO: 659278 - DNA, 13 bp, D. melanogaster
tgtattgaaaaaa

SEQ ID NO: 659279 - DNA, 14 bp, D. melanogaster
tgtattgtatatgt

SEQ ID NO: 659280 - DNA, 13 bp, D. melanogaster
tgtattgttgcca

SEQ ID NO: 659281 - DNA, 14 bp, D. melanogaster
tgtatttaaaatgt

SEQ ID NO: 659282 - DNA, 14 bp, D. melanogaster
tgtatttaaaattc

SEQ ID NO: 659283 - DNA, 13 bp, D. melanogaster
tgtatttaaacaa

SEQ ID NO: 659284 - DNA, 13 bp, D. melanogaster
tgtatttaaattg

SEQ ID NO: 659285 - DNA, 13 bp, D. melanogaster
tgtatttaacatt

SEQ ID NO: 659286 - DNA, 13 bp, D. melanogaster
tgtatttaagcga

SEQ ID NO: 659287 - DNA, 13 bp, D. melanogaster
tgtatttaatgaa

SEQ ID NO: 659288 - DNA, 14 bp, D. melanogaster
tgtatttacatata

SEQ ID NO: 659289 - DNA, 13 bp, D. melanogaster
tgtatttacttaa

SEQ ID NO: 659290 - DNA, 13 bp, D. melanogaster
tgtatttagccta

SEQ ID NO: 659291 - DNA, 13 bp, D. melanogaster
tgtatttatactg

SEQ ID NO: 659292 - DNA, 13 bp, D. melanogaster
tgtatttatatac

SEQ ID NO: 659293 - DNA, 14 bp, D. melanogaster
tgtatttatgtatg

SEQ ID NO: 659294 - DNA, 14 bp, D. melanogaster
tgtatttatttaca

SEQ ID NO: 659295 - DNA, 13 bp, D. melanogaster
tgtatttatttgc

SEQ ID NO: 659296 - DNA, 14 bp, D. melanogaster
tgtatttatttgct

SEQ ID NO: 659297 - DNA, 13 bp, D. melanogaster
tgtatttcaaatt

SEQ ID NO: 659298 - DNA, 13 bp, D. melanogaster
tgtatttcaataa

SEQ ID NO: 659299 - DNA, 13 bp, D. melanogaster
tgtatttcaatta

SEQ ID NO: 659300 - DNA, 13 bp, D. melanogaster
tgtatttcacttc

SEQ ID NO: 659301 - DNA, 13 bp, D. melanogaster
tgtatttcatata

SEQ ID NO: 659302 - DNA, 13 bp, D. melanogaster
tgtatttcatatt

SEQ ID NO: 659303 - DNA, 13 bp, D. melanogaster
tgtatttcattta

SEQ ID NO: 659304 - DNA, 13 bp, D. melanogaster
tgtatttccattt

SEQ ID NO: 659305 - DNA, 13 bp, D. melanogaster
tgtatttcgattt

SEQ ID NO: 659306 - DNA, 13 bp, D. melanogaster
tgtatttctgtat

SEQ ID NO: 659307 - DNA, 13 bp, D. melanogaster
tgtatttctgtgt

SEQ ID NO: 659308 - DNA, 13 bp, D. melanogaster
tgtatttgaaaat

SEQ ID NO: 659309 - DNA, 13 bp, D. melanogaster
tgtatttgacttt

SEQ ID NO: 659310 - DNA, 13 bp, D. melanogaster
tgtatttgcaaca

SEQ ID NO: 659311 - DNA, 13 bp, D. melanogaster
tgtatttgctgtt

SEQ ID NO: 659312 - DNA, 13 bp, D. melanogaster
tgtatttgcttgt

SEQ ID NO: 659313 - DNA, 14 bp, D. melanogaster
tgtatttgcttgtg

SEQ ID NO: 659314 - DNA, 13 bp, D. melanogaster
tgtatttggaaaa

SEQ ID NO: 659315 - DNA, 13 bp, D. melanogaster
tgtatttgtaaaa

SEQ ID NO: 659316 - DNA, 13 bp, D. melanogaster
tgtatttgtaaat

SEQ ID NO: 659317 - DNA, 13 bp, D. melanogaster
tgtatttgtacat

SEQ ID NO: 659318 - DNA, 13 bp, D. melanogaster
tgtatttgtatct

SEQ ID NO: 659319 - DNA, 13 bp, D. melanogaster
tgtatttgtgtaa

SEQ ID NO: 659320 - DNA, 13 bp, D. melanogaster
tgtatttgtgtgc

SEQ ID NO: 659321 - DNA, 14 bp, D. melanogaster
tgtatttgtgtgcg

SEQ ID NO: 659322 - DNA, 13 bp, D. melanogaster
tgtatttgtttac

SEQ ID NO: 659323 - DNA, 13 bp, D. melanogaster
tgtattttaaagt

SEQ ID NO: 659324 - DNA, 13 bp, D. melanogaster
tgtattttaagtg

SEQ ID NO: 659325 - DNA, 13 bp, D. melanogaster
tgtattttaatca

SEQ ID NO: 659326 - DNA, 13 bp, D. melanogaster
tgtattttacaaa

SEQ ID NO: 659327 - DNA, 13 bp, D. melanogaster
tgtattttcgtgt

SEQ ID NO: 659328 - DNA, 13 bp, D. melanogaster
tgtattttctaaa

SEQ ID NO: 659329 - DNA, 13 bp, D. melanogaster
tgtattttctata

SEQ ID NO: 659330 - DNA, 13 bp, D. melanogaster
tgtattttgaaaa

SEQ ID NO: 659331 - DNA, 13 bp, D. melanogaster
tgtattttgccat

SEQ ID NO: 659332 - DNA, 13 bp, D. melanogaster
tgtatttttacaa

SEQ ID NO: 659333 - DNA, 13 bp, D. melanogaster
tgtatttttcaat

SEQ ID NO: 659334 - DNA, 13 bp, D. melanogaster
tgtatttttgcaa

SEQ ID NO: 659335 - DNA, 13 bp, D. melanogaster
tgtatttttgtgc

SEQ ID NO: 659336 - DNA, 13 bp, D. melanogaster
tgtcaaaaacttt

SEQ ID NO: 659337 - DNA, 13 bp, D. melanogaster
tgtcaaaaagttt

SEQ ID NO: 659338 - DNA, 13 bp, D. melanogaster
tgtcaaaaatatc

SEQ ID NO: 659339 - DNA, 13 bp, D. melanogaster
tgtcaaaaatgcc

SEQ ID NO: 659340 - DNA, 14 bp, D. melanogaster
tgtcaaaaatgcca

SEQ ID NO: 659341 - DNA, 13 bp, D. melanogaster
tgtcaaaaattca

SEQ ID NO: 659342 - DNA, 14 bp, D. melanogaster
tgtcaaaaattcag

SEQ ID NO: 659343 - DNA, 13 bp, D. melanogaster
tgtcaaaacaaat

SEQ ID NO: 659344 - DNA, 13 bp, D. melanogaster
tgtcaaaagcaaa

SEQ ID NO: 659345 - DNA, 13 bp, D. melanogaster
tgtcaaaataaaa

SEQ ID NO: 659346 - DNA, 13 bp, D. melanogaster
tgtcaaaataaat

SEQ ID NO: 659347 - DNA, 13 bp, D. melanogaster
tgtcaaaatatat

SEQ ID NO: 659348 - DNA, 13 bp, D. melanogaster
tgtcaaaatattt

SEQ ID NO: 659349 - DNA, 13 bp, D. melanogaster
tgtcaaaatgttt

SEQ ID NO: 659350 - DNA, 13 bp, D. melanogaster
tgtcaaaattgtt

SEQ ID NO: 659351 - DNA, 13 bp, D. melanogaster
tgtcaaacaaata

SEQ ID NO: 659352 - DNA, 13 bp, D. melanogaster
tgtcaaacatttt

SEQ ID NO: 659353 - DNA, 13 bp, D. melanogaster
tgtcaaagaattt

SEQ ID NO: 659354 - DNA, 13 bp, D. melanogaster
tgtcaaagcaaag

SEQ ID NO: 659355 - DNA, 14 bp, D. melanogaster
tgtcaaagcaaagc

SEQ ID NO: 659356 - DNA, 13 bp, D. melanogaster
tgtcaaagtcaaa

SEQ ID NO: 659357 - DNA, 13 bp, D. melanogaster
tgtcaaagttcaa

SEQ ID NO: 659358 - DNA, 13 bp, D. melanogaster
tgtcaaatgcaga

SEQ ID NO: 659359 - DNA, 13 bp, D. melanogaster
tgtcaaatgcctg

SEQ ID NO: 659360 - DNA, 15 bp, D. melanogaster
tgtcaaatgcctgcg

SEQ ID NO: 659361 - DNA, 13 bp, D. melanogaster
tgtcaaattaatt

SEQ ID NO: 659362 - DNA, 13 bp, D. melanogaster
tgtcaaattttaa

SEQ ID NO: 659363 - DNA, 13 bp, D. melanogaster
tgtcaaattttct

SEQ ID NO: 659364 - DNA, 13 bp, D. melanogaster
tgtcaaatttttg

SEQ ID NO: 659365 - DNA, 13 bp, D. melanogaster
tgtcaacaaaagt

SEQ ID NO: 659366 - DNA, 13 bp, D. melanogaster
tgtcaacaaaatg

SEQ ID NO: 659367 - DNA, 13 bp, D. melanogaster
tgtcaacatattt

SEQ ID NO: 659368 - DNA, 13 bp, D. melanogaster
tgtcaacatgaat

SEQ ID NO: 659369 - DNA, 13 bp, D. melanogaster
tgtcaacattttt

SEQ ID NO: 659370 - DNA, 13 bp, D. melanogaster
tgtcaaccataac

SEQ ID NO: 659371 - DNA, 13 bp, D. melanogaster
tgtcaaccgtgcc

SEQ ID NO: 659372 - DNA, 13 bp, D. melanogaster
tgtcaactctttt

SEQ ID NO: 659373 - DNA, 13 bp, D. melanogaster
tgtcaacttttta

SEQ ID NO: 659374 - DNA, 13 bp, D. melanogaster
tgtcaactttttc

SEQ ID NO: 659375 - DNA, 13 bp, D. melanogaster
tgtcaagaaactg

SEQ ID NO: 659376 - DNA, 13 bp, D. melanogaster
tgtcaagtgtcaa

SEQ ID NO: 659377 - DNA, 13 bp, D. melanogaster
tgtcaagtttatg

SEQ ID NO: 659378 - DNA, 13 bp, D. melanogaster
tgtcaataaaaat

SEQ ID NO: 659379 - DNA, 13 bp, D. melanogaster
tgtcaataaatgt

SEQ ID NO: 659380 - DNA, 13 bp, D. melanogaster
tgtcaataaggcc

SEQ ID NO: 659381 - DNA, 14 bp, D. melanogaster
tgtcaatattaaat

SEQ ID NO: 659382 - DNA, 13 bp, D. melanogaster
tgtcaatattatt

SEQ ID NO: 659383 - DNA, 13 bp, D. melanogaster
tgtcaatcaaaaa

SEQ ID NO: 659384 - DNA, 13 bp, D. melanogaster
tgtcaatgccaaa

SEQ ID NO: 659385 - DNA, 13 bp, D. melanogaster
tgtcaatggtcta

SEQ ID NO: 659386 - DNA, 13 bp, D. melanogaster
tgtcaattaaaat

SEQ ID NO: 659387 - DNA, 13 bp, D. melanogaster
tgtcaattaaatg

SEQ ID NO: 659388 - DNA, 13 bp, D. melanogaster
tgtcaattcaatt

SEQ ID NO: 659389 - DNA, 13 bp, D. melanogaster
tgtcaattgtcaa

SEQ ID NO: 659390 - DNA, 13 bp, D. melanogaster
tgtcaattgtttg

SEQ ID NO: 659391 - DNA, 13 bp, D. melanogaster
tgtcaatttcaat

SEQ ID NO: 659392 - DNA, 13 bp, D. melanogaster
tgtcaatttgttg

SEQ ID NO: 659393 - DNA, 13 bp, D. melanogaster
tgtcacaaaaaaa

SEQ ID NO: 659394 - DNA, 13 bp, D. melanogaster
tgtcacaatattt

SEQ ID NO: 659395 - DNA, 13 bp, D. melanogaster
tgtcaccagaatt

SEQ ID NO: 659396 - DNA, 13 bp, D. melanogaster
tgtcacgcccaca

SEQ ID NO: 659397 - DNA, 14 bp, D. melanogaster
tgtcacgcccacac

SEQ ID NO: 659398 - DNA, 13 bp, D. melanogaster
tgtcacgcccact

SEQ ID NO: 659399 - DNA, 13 bp, D. melanogaster
tgtcactattttt

SEQ ID NO: 659400 - DNA, 13 bp, D. melanogaster
tgtcactttgaca

SEQ ID NO: 659401 - DNA, 13 bp, D. melanogaster
tgtcagaatcagc

SEQ ID NO: 659402 - DNA, 13 bp, D. melanogaster
tgtcagcagtttg

SEQ ID NO: 659403 - DNA, 13 bp, D. melanogaster
tgtcagcagtttt

SEQ ID NO: 659404 - DNA, 13 bp, D. melanogaster
tgtcagcataaat

SEQ ID NO: 659405 - DNA, 13 bp, D. melanogaster
tgtcagcattatc

SEQ ID NO: 659406 - DNA, 13 bp, D. melanogaster
tgtcagccagttg

SEQ ID NO: 659407 - DNA, 13 bp, D. melanogaster
tgtcagcccgacg

SEQ ID NO: 659408 - DNA, 13 bp, D. melanogaster
tgtcagtctgtcc

SEQ ID NO: 659409 - DNA, 13 bp, D. melanogaster
tgtcagtggaaaa

SEQ ID NO: 659410 - DNA, 13 bp, D. melanogaster
tgtcagtggcagc

SEQ ID NO: 659411 - DNA, 13 bp, D. melanogaster
tgtcagtggcagg

SEQ ID NO: 659412 - DNA, 13 bp, D. melanogaster
tgtcagtgtgtgt

SEQ ID NO: 659413 - DNA, 14 bp, D. melanogaster
tgtcagtgtgtgtg

SEQ ID NO: 659414 - DNA, 13 bp, D. melanogaster
tgtcagtttgtca

SEQ ID NO: 659415 - DNA, 13 bp, D. melanogaster
tgtcataaacgag

SEQ ID NO: 659416 - DNA, 13 bp, D. melanogaster
tgtcataaattcc

SEQ ID NO: 659417 - DNA, 13 bp, D. melanogaster
tgtcataattgtg

SEQ ID NO: 659418 - DNA, 14 bp, D. melanogaster
tgtcataattgtgt

SEQ ID NO: 659419 - DNA, 13 bp, D. melanogaster
tgtcatcactgcc

SEQ ID NO: 659420 - DNA, 13 bp, D. melanogaster
tgtcatcatcatc

SEQ ID NO: 659421 - DNA, 13 bp, D. melanogaster
tgtcatccagctg

SEQ ID NO: 659422 - DNA, 14 bp, D. melanogaster
tgtcatctgggagt

SEQ ID NO: 659423 - DNA, 13 bp, D. melanogaster
tgtcattaaaaat

SEQ ID NO: 659424 - DNA, 13 bp, D. melanogaster
tgtcattaaatat

SEQ ID NO: 659425 - DNA, 13 bp, D. melanogaster
tgtcattaaatta

SEQ ID NO: 659426 - DNA, 13 bp, D. melanogaster
tgtcattaatttt

SEQ ID NO: 659427 - DNA, 13 bp, D. melanogaster
tgtcattacatca

SEQ ID NO: 659428 - DNA, 14 bp, D. melanogaster
tgtcattattattg

SEQ ID NO: 659429 - DNA, 13 bp, D. melanogaster
tgtcattattgtt

SEQ ID NO: 659430 - DNA, 13 bp, D. melanogaster
tgtcattatttat

SEQ ID NO: 659431 - DNA, 13 bp, D. melanogaster
tgtcattcattca

SEQ ID NO: 659432 - DNA, 13 bp, D. melanogaster
tgtcattcggtgg

SEQ ID NO: 659433 - DNA, 13 bp, D. melanogaster
tgtcattgcattt

SEQ ID NO: 659434 - DNA, 13 bp, D. melanogaster
tgtcattgctttt

SEQ ID NO: 659435 - DNA, 13 bp, D. melanogaster
tgtcattggcatt

SEQ ID NO: 659436 - DNA, 14 bp, D. melanogaster
tgtcattgtcattg

SEQ ID NO: 659437 - DNA, 13 bp, D. melanogaster
tgtcattgttttc

SEQ ID NO: 659438 - DNA, 13 bp, D. melanogaster
tgtcatttaatct

SEQ ID NO: 659439 - DNA, 13 bp, D. melanogaster
tgtcatttggcca

SEQ ID NO: 659440 - DNA, 13 bp, D. melanogaster
tgtcatttgtggc

SEQ ID NO: 659441 - DNA, 13 bp, D. melanogaster
tgtcattttgtcc

SEQ ID NO: 659442 - DNA, 13 bp, D. melanogaster
tgtcatttttaat

SEQ ID NO: 659443 - DNA, 13 bp, D. melanogaster
tgtccaaaaaaaa

SEQ ID NO: 659444 - DNA, 13 bp, D. melanogaster
tgtccaaaaatgg

SEQ ID NO: 659445 - DNA, 14 bp, D. melanogaster
tgtccaaaaatgga

SEQ ID NO: 659446 - DNA, 14 bp, D. melanogaster
tgtccaaaaatttg

SEQ ID NO: 659447 - DNA, 13 bp, D. melanogaster
tgtccaaaagtat

SEQ ID NO: 659448 - DNA, 13 bp, D. melanogaster
tgtccaaacaaaa

SEQ ID NO: 659449 - DNA, 13 bp, D. melanogaster
tgtccaaatattt

SEQ ID NO: 659450 - DNA, 13 bp, D. melanogaster
tgtccaacatggc

SEQ ID NO: 659451 - DNA, 13 bp, D. melanogaster
tgtccaccgcctc

SEQ ID NO: 659452 - DNA, 14 bp, D. melanogaster
tgtccactcgaatg

SEQ ID NO: 659453 - DNA, 13 bp, D. melanogaster
tgtccactgtcca

SEQ ID NO: 659454 - DNA, 13 bp, D. melanogaster
tgtccagagatat

SEQ ID NO: 659455 - DNA, 13 bp, D. melanogaster
tgtccagtgtcca

SEQ ID NO: 659456 - DNA, 13 bp, D. melanogaster
tgtccatatgaac

SEQ ID NO: 659457 - DNA, 13 bp, D. melanogaster
tgtccatattgac

SEQ ID NO: 659458 - DNA, 13 bp, D. melanogaster
tgtccatgtccaa

SEQ ID NO: 659459 - DNA, 13 bp, D. melanogaster
tgtccatgtccgt

SEQ ID NO: 659460 - DNA, 13 bp, D. melanogaster
tgtccatgtgtgt

SEQ ID NO: 659461 - DNA, 14 bp, D. melanogaster
tgtccatgtgtgtg

SEQ ID NO: 659462 - DNA, 13 bp, D. melanogaster
tgtccatttcaat

SEQ ID NO: 659463 - DNA, 13 bp, D. melanogaster
tgtccatttgtcc

SEQ ID NO: 659464 - DNA, 13 bp, D. melanogaster
tgtcccaaaaatg

SEQ ID NO: 659465 - DNA, 13 bp, D. melanogaster
tgtcccccgcaac

SEQ ID NO: 659466 - DNA, 13 bp, D. melanogaster
tgtcccgtcagtt

SEQ ID NO: 659467 - DNA, 13 bp, D. melanogaster
tgtccctaaatca

SEQ ID NO: 659468 - DNA, 13 bp, D. melanogaster
tgtccgaagcaaa

SEQ ID NO: 659469 - DNA, 14 bp, D. melanogaster
tgtccgcacttcgt

SEQ ID NO: 659470 - DNA, 13 bp, D. melanogaster
tgtccgcctgtcc

SEQ ID NO: 659471 - DNA, 13 bp, D. melanogaster
tgtccgtatccgt

SEQ ID NO: 659472 - DNA, 14 bp, D. melanogaster
tgtccgtatgaacg

SEQ ID NO: 659473 - DNA, 13 bp, D. melanogaster
tgtccgtccgtat

SEQ ID NO: 659474 - DNA, 14 bp, D. melanogaster
tgtccgtccgtata

SEQ ID NO: 659475 - DNA, 14 bp, D. melanogaster
tgtccgtccgtatg

SEQ ID NO: 659476 - DNA, 14 bp, D. melanogaster
tgtccgtccgtccg

SEQ ID NO: 659477 - DNA, 13 bp, D. melanogaster
tgtccgtctcttt

SEQ ID NO: 659478 - DNA, 13 bp, D. melanogaster
tgtccgtctgtcc

SEQ ID NO: 659479 - DNA, 13 bp, D. melanogaster
tgtccgtctgtct

SEQ ID NO: 659480 - DNA, 14 bp, D. melanogaster
tgtccgtctgtctg

SEQ ID NO: 659481 - DNA, 13 bp, D. melanogaster
tgtccgttgtccg

SEQ ID NO: 659482 - DNA, 14 bp, D. melanogaster
tgtccgttgtccgt

SEQ ID NO: 659483 - DNA, 13 bp, D. melanogaster
tgtccgtttcctg

SEQ ID NO: 659484 - DNA, 13 bp, D. melanogaster
tgtcctcgtcttg

SEQ ID NO: 659485 - DNA, 13 bp, D. melanogaster
tgtcctctattat

SEQ ID NO: 659486 - DNA, 13 bp, D. melanogaster
tgtcctgcgtcct

SEQ ID NO: 659487 - DNA, 13 bp, D. melanogaster
tgtcctgctcctt

SEQ ID NO: 659488 - DNA, 13 bp, D. melanogaster
tgtcctggccaaa

SEQ ID NO: 659489 - DNA, 13 bp, D. melanogaster
tgtccttgccacc

SEQ ID NO: 659490 - DNA, 13 bp, D. melanogaster
tgtccttggtgcc

SEQ ID NO: 659491 - DNA, 13 bp, D. melanogaster
tgtcctttgtcct

SEQ ID NO: 659492 - DNA, 13 bp, D. melanogaster
tgtccttttgtcc

SEQ ID NO: 659493 - DNA, 13 bp, D. melanogaster
tgtcctttttgcc

SEQ ID NO: 659494 - DNA, 13 bp, D. melanogaster
tgtcgaaaagttt

SEQ ID NO: 659495 - DNA, 13 bp, D. melanogaster
tgtcgaactccgc

SEQ ID NO: 659496 - DNA, 13 bp, D. melanogaster
tgtcgaatatctc

SEQ ID NO: 659497 - DNA, 13 bp, D. melanogaster
tgtcgaatatttt

SEQ ID NO: 659498 - DNA, 13 bp, D. melanogaster
tgtcgaattggat

SEQ ID NO: 659499 - DNA, 13 bp, D. melanogaster
tgtcgacggcggc

SEQ ID NO: 659500 - DNA, 13 bp, D. melanogaster
tgtcgacttcttt

SEQ ID NO: 659501 - DNA, 13 bp, D. melanogaster
tgtcgatcatgaa

SEQ ID NO: 659502 - DNA, 13 bp, D. melanogaster
tgtcgatgaaacc

SEQ ID NO: 659503 - DNA, 13 bp, D. melanogaster
tgtcgatggccaa

SEQ ID NO: 659504 - DNA, 13 bp, D. melanogaster
tgtcgatgtcgat

SEQ ID NO: 659505 - DNA, 13 bp, D. melanogaster
tgtcgattgccac

SEQ ID NO: 659506 - DNA, 14 bp, D. melanogaster
tgtcgattgccacc

SEQ ID NO: 659507 - DNA, 13 bp, D. melanogaster
tgtcgcagacgca

SEQ ID NO: 659508 - DNA, 13 bp, D. melanogaster
tgtcgcagatcat

SEQ ID NO: 659509 - DNA, 13 bp, D. melanogaster
tgtcgcatttgaa

SEQ ID NO: 659510 - DNA, 13 bp, D. melanogaster
tgtcgcctgtcgc

SEQ ID NO: 659511 - DNA, 13 bp, D. melanogaster
tgtcgctatccaa

SEQ ID NO: 659512 - DNA, 13 bp, D. melanogaster
tgtcgctgctgct

SEQ ID NO: 659513 - DNA, 13 bp, D. melanogaster
tgtcgctgctgtt

SEQ ID NO: 659514 - DNA, 13 bp, D. melanogaster
tgtcgctggcatt

SEQ ID NO: 659515 - DNA, 13 bp, D. melanogaster
tgtcgcttgttgc

SEQ ID NO: 659516 - DNA, 13 bp, D. melanogaster
tgtcgtatgcgca

SEQ ID NO: 659517 - DNA, 15 bp, D. melanogaster
tgtcgtcgggattca

SEQ ID NO: 659518 - DNA, 13 bp, D. melanogaster
tgtcgtcgtcgtt

SEQ ID NO: 659519 - DNA, 13 bp, D. melanogaster
tgtcgttcgctga

SEQ ID NO: 659520 - DNA, 13 bp, D. melanogaster
tgtcgttgctgtt

SEQ ID NO: 659521 - DNA, 14 bp, D. melanogaster
tgtcgttgtcgctg

SEQ ID NO: 659522 - DNA, 13 bp, D. melanogaster
tgtcgtttaattt

SEQ ID NO: 659523 - DNA, 13 bp, D. melanogaster
tgtctaaaaaaaa

SEQ ID NO: 659524 - DNA, 13 bp, D. melanogaster
tgtctaaaaatat

SEQ ID NO: 659525 - DNA, 14 bp, D. melanogaster
tgtctaacatattt

SEQ ID NO: 659526 - DNA, 13 bp, D. melanogaster
tgtctaatttaat

SEQ ID NO: 659527 - DNA, 13 bp, D. melanogaster
tgtctaattttgt

SEQ ID NO: 659528 - DNA, 13 bp, D. melanogaster
tgtctagttgcaa

SEQ ID NO: 659529 - DNA, 13 bp, D. melanogaster
tgtctagttttga

SEQ ID NO: 659530 - DNA, 14 bp, D. melanogaster
tgtctatatatttt

SEQ ID NO: 659531 - DNA, 13 bp, D. melanogaster
tgtctatctgtct

SEQ ID NO: 659532 - DNA, 13 bp, D. melanogaster
tgtctatgtctat

SEQ ID NO: 659533 - DNA, 13 bp, D. melanogaster
tgtctatttcttc

SEQ ID NO: 659534 - DNA, 13 bp, D. melanogaster
tgtctatttttaa

SEQ ID NO: 659535 - DNA, 13 bp, D. melanogaster
tgtctctgtctgt

SEQ ID NO: 659536 - DNA, 13 bp, D. melanogaster
tgtctctgtgtgc

SEQ ID NO: 659537 - DNA, 14 bp, D. melanogaster
tgtctctgtgtgtg

SEQ ID NO: 659538 - DNA, 13 bp, D. melanogaster
tgtctgaactttt

SEQ ID NO: 659539 - DNA, 13 bp, D. melanogaster
tgtctgaatataa

SEQ ID NO: 659540 - DNA, 13 bp, D. melanogaster
tgtctgcaatttg

SEQ ID NO: 659541 - DNA, 13 bp, D. melanogaster
tgtctgcactttg

SEQ ID NO: 659542 - DNA, 13 bp, D. melanogaster
tgtctgcattgtt

SEQ ID NO: 659543 - DNA, 13 bp, D. melanogaster
tgtctgcctgtcc

SEQ ID NO: 659544 - DNA, 13 bp, D. melanogaster
tgtctgcgtaatt

SEQ ID NO: 659545 - DNA, 14 bp, D. melanogaster
tgtctgcgtgtgtg

SEQ ID NO: 659546 - DNA, 13 bp, D. melanogaster
tgtctgctatcac

SEQ ID NO: 659547 - DNA, 13 bp, D. melanogaster
tgtctgcttttat

SEQ ID NO: 659548 - DNA, 13 bp, D. melanogaster
tgtctggacgtgg

SEQ ID NO: 659549 - DNA, 13 bp, D. melanogaster
tgtctggccaaaa

SEQ ID NO: 659550 - DNA, 13 bp, D. melanogaster
tgtctggcgattt

SEQ ID NO: 659551 - DNA, 14 bp, D. melanogaster
tgtctggcgatttc

SEQ ID NO: 659552 - DNA, 13 bp, D. melanogaster
tgtctggctgcct

SEQ ID NO: 659553 - DNA, 13 bp, D. melanogaster
tgtctggctggct

SEQ ID NO: 659554 - DNA, 13 bp, D. melanogaster
tgtctggcttttg

SEQ ID NO: 659555 - DNA, 13 bp, D. melanogaster
tgtctgtatgtgt

SEQ ID NO: 659556 - DNA, 14 bp, D. melanogaster
tgtctgtccgtctg

SEQ ID NO: 659557 - DNA, 13 bp, D. melanogaster
tgtctgtctctct

SEQ ID NO: 659558 - DNA, 13 bp, D. melanogaster
tgtctgtctgcgt

SEQ ID NO: 659559 - DNA, 13 bp, D. melanogaster
tgtctgtctgctg

SEQ ID NO: 659560 - DNA, 14 bp, D. melanogaster
tgtctgtctgtctg

SEQ ID NO: 659561 - DNA, 13 bp, D. melanogaster
tgtctgtcttcat

SEQ ID NO: 659562 - DNA, 13 bp, D. melanogaster
tgtctgtgcattt

SEQ ID NO: 659563 - DNA, 14 bp, D. melanogaster
tgtctgtgcatttg

SEQ ID NO: 659564 - DNA, 14 bp, D. melanogaster
tgtctgtgtaatct

SEQ ID NO: 659565 - DNA, 14 bp, D. melanogaster
tgtctgtgtctgtg

SEQ ID NO: 659566 - DNA, 13 bp, D. melanogaster
tgtctgtgtgcgc

SEQ ID NO: 659567 - DNA, 13 bp, D. melanogaster
tgtctgtgtgctg

SEQ ID NO: 659568 - DNA, 13 bp, D. melanogaster
tgtctgtgtgggc

SEQ ID NO: 659569 - DNA, 13 bp, D. melanogaster
tgtctgtgtgtct

SEQ ID NO: 659570 - DNA, 14 bp, D. melanogaster
tgtctgtgtgtgag

SEQ ID NO: 659571 - DNA, 13 bp, D. melanogaster
tgtctgttgtctg

SEQ ID NO: 659572 - DNA, 13 bp, D. melanogaster
tgtctgtttgcct

SEQ ID NO: 659573 - DNA, 13 bp, D. melanogaster
tgtcttcaaatgg

SEQ ID NO: 659574 - DNA, 13 bp, D. melanogaster
tgtcttcatttat

SEQ ID NO: 659575 - DNA, 14 bp, D. melanogaster
tgtcttgcatatta

SEQ ID NO: 659576 - DNA, 13 bp, D. melanogaster
tgtcttggccaac

SEQ ID NO: 659577 - DNA, 13 bp, D. melanogaster
tgtcttggccatt

SEQ ID NO: 659578 - DNA, 14 bp, D. melanogaster
tgtcttgttgcact

SEQ ID NO: 659579 - DNA, 13 bp, D. melanogaster
tgtctttaagctg

SEQ ID NO: 659580 - DNA, 13 bp, D. melanogaster
tgtctttatactt

SEQ ID NO: 659581 - DNA, 14 bp, D. melanogaster
tgtctttatactta

SEQ ID NO: 659582 - DNA, 13 bp, D. melanogaster
tgtctttcatttg

SEQ ID NO: 659583 - DNA, 13 bp, D. melanogaster
tgtctttgattat

SEQ ID NO: 659584 - DNA, 13 bp, D. melanogaster
tgtctttggcatt

SEQ ID NO: 659585 - DNA, 13 bp, D. melanogaster
tgtctttgggcat

SEQ ID NO: 659586 - DNA, 13 bp, D. melanogaster
tgtctttttaaca

SEQ ID NO: 659587 - DNA, 14 bp, D. melanogaster
tgtgaaaaaaaaac

SEQ ID NO: 659588 - DNA, 13 bp, D. melanogaster
tgtgaaaaaatat

SEQ ID NO: 659589 - DNA, 13 bp, D. melanogaster
tgtgaaaaacaaa

SEQ ID NO: 659590 - DNA, 13 bp, D. melanogaster
tgtgaaaaatatt

SEQ ID NO: 659591 - DNA, 13 bp, D. melanogaster
tgtgaaaaatgaa

SEQ ID NO: 659592 - DNA, 13 bp, D. melanogaster
tgtgaaaaattaa

SEQ ID NO: 659593 - DNA, 14 bp, D. melanogaster
tgtgaaaaattaat

SEQ ID NO: 659594 - DNA, 13 bp, D. melanogaster
tgtgaaaacaaat

SEQ ID NO: 659595 - DNA, 13 bp, D. melanogaster
tgtgaaaacagac

SEQ ID NO: 659596 - DNA, 13 bp, D. melanogaster
tgtgaaaagcgaa

SEQ ID NO: 659597 - DNA, 13 bp, D. melanogaster
tgtgaaaagtgaa

SEQ ID NO: 659598 - DNA, 13 bp, D. melanogaster
tgtgaaaagtgca

SEQ ID NO: 659599 - DNA, 13 bp, D. melanogaster
tgtgaaaagtgtg

SEQ ID NO: 659600 - DNA, 13 bp, D. melanogaster
tgtgaaaagtttg

SEQ ID NO: 659601 - DNA, 13 bp, D. melanogaster
tgtgaaaagtttt

SEQ ID NO: 659602 - DNA, 13 bp, D. melanogaster
tgtgaaaataaat

SEQ ID NO: 659603 - DNA, 13 bp, D. melanogaster
tgtgaaaatattc

SEQ ID NO: 659604 - DNA, 13 bp, D. melanogaster
tgtgaaaatattt

SEQ ID NO: 659605 - DNA, 14 bp, D. melanogaster
tgtgaaaatatttt

SEQ ID NO: 659606 - DNA, 13 bp, D. melanogaster
tgtgaaaatcatt

SEQ ID NO: 659607 - DNA, 13 bp, D. melanogaster
tgtgaaaatgaaa

SEQ ID NO: 659608 - DNA, 14 bp, D. melanogaster
tgtgaaaatgaaaa

SEQ ID NO: 659609 - DNA, 13 bp, D. melanogaster
tgtgaaaatgcat

SEQ ID NO: 659610 - DNA, 13 bp, D. melanogaster
tgtgaaaatgctt

SEQ ID NO: 659611 - DNA, 13 bp, D. melanogaster
tgtgaaaatggaa

SEQ ID NO: 659612 - DNA, 13 bp, D. melanogaster
tgtgaaaattaat

SEQ ID NO: 659613 - DNA, 13 bp, D. melanogaster
tgtgaaaattgct

SEQ ID NO: 659614 - DNA, 13 bp, D. melanogaster
tgtgaaaattgtg

SEQ ID NO: 659615 - DNA, 13 bp, D. melanogaster
tgtgaaaatttaa

SEQ ID NO: 659616 - DNA, 13 bp, D. melanogaster
tgtgaaacatgtt

SEQ ID NO: 659617 - DNA, 14 bp, D. melanogaster
tgtgaaacatgttt

SEQ ID NO: 659618 - DNA, 13 bp, D. melanogaster
tgtgaaacgatgt

SEQ ID NO: 659619 - DNA, 13 bp, D. melanogaster
tgtgaaactaaaa

SEQ ID NO: 659620 - DNA, 13 bp, D. melanogaster
tgtgaaagtgaaa

SEQ ID NO: 659621 - DNA, 13 bp, D. melanogaster
tgtgaaataaaat

SEQ ID NO: 659622 - DNA, 13 bp, D. melanogaster
tgtgaaataaatt

SEQ ID NO: 659623 - DNA, 13 bp, D. melanogaster
tgtgaaataatat

SEQ ID NO: 659624 - DNA, 13 bp, D. melanogaster
tgtgaaatagttt

SEQ ID NO: 659625 - DNA, 13 bp, D. melanogaster
tgtgaaatatgaa

SEQ ID NO: 659626 - DNA, 13 bp, D. melanogaster
tgtgaaatatgtt

SEQ ID NO: 659627 - DNA, 14 bp, D. melanogaster
tgtgaaatattttc

SEQ ID NO: 659628 - DNA, 13 bp, D. melanogaster
tgtgaaatcaaaa

SEQ ID NO: 659629 - DNA, 13 bp, D. melanogaster
tgtgaaatcaaat

SEQ ID NO: 659630 - DNA, 13 bp, D. melanogaster
tgtgaaatggaaa

SEQ ID NO: 659631 - DNA, 13 bp, D. melanogaster
tgtgaaatgtgtg

SEQ ID NO: 659632 - DNA, 13 bp, D. melanogaster
tgtgaaattaaaa

SEQ ID NO: 659633 - DNA, 13 bp, D. melanogaster
tgtgaaattgaaa

SEQ ID NO: 659634 - DNA, 13 bp, D. melanogaster
tgtgaaattgttt

SEQ ID NO: 659635 - DNA, 13 bp, D. melanogaster
tgtgaaatttgtg

SEQ ID NO: 659636 - DNA, 13 bp, D. melanogaster
tgtgaaattttaa

SEQ ID NO: 659637 - DNA, 13 bp, D. melanogaster
tgtgaaattttgc

SEQ ID NO: 659638 - DNA, 14 bp, D. melanogaster
tgtgaaattttgct

SEQ ID NO: 659639 - DNA, 13 bp, D. melanogaster
tgtgaaatttttg

SEQ ID NO: 659640 - DNA, 13 bp, D. melanogaster
tgtgaacattttg

SEQ ID NO: 659641 - DNA, 13 bp, D. melanogaster
tgtgaagaaatgc

SEQ ID NO: 659642 - DNA, 14 bp, D. melanogaster
tgtgaagaaatgca

SEQ ID NO: 659643 - DNA, 13 bp, D. melanogaster
tgtgaagaagaga

SEQ ID NO: 659644 - DNA, 16 bp, D. melanogaster
tgtgaagaagccccac

SEQ ID NO: 659645 - DNA, 13 bp, D. melanogaster
tgtgaagacttta

SEQ ID NO: 659646 - DNA, 13 bp, D. melanogaster
tgtgaagttttaa

SEQ ID NO: 659647 - DNA, 13 bp, D. melanogaster
tgtgaataaaaat

SEQ ID NO: 659648 - DNA, 13 bp, D. melanogaster
tgtgaatatatat

SEQ ID NO: 659649 - DNA, 13 bp, D. melanogaster
tgtgaatatattt

SEQ ID NO: 659650 - DNA, 13 bp, D. melanogaster
tgtgaatatgtca

SEQ ID NO: 659651 - DNA, 13 bp, D. melanogaster
tgtgaatatttaa

SEQ ID NO: 659652 - DNA, 13 bp, D. melanogaster
tgtgaatgaaatg

SEQ ID NO: 659653 - DNA, 13 bp, D. melanogaster
tgtgaatgaaatt

SEQ ID NO: 659654 - DNA, 13 bp, D. melanogaster
tgtgaatgcgagt

SEQ ID NO: 659655 - DNA, 13 bp, D. melanogaster
tgtgaatggaaat

SEQ ID NO: 659656 - DNA, 13 bp, D. melanogaster
tgtgaatgtaaat

SEQ ID NO: 659657 - DNA, 14 bp, D. melanogaster
tgtgaatgtgaatg

SEQ ID NO: 659658 - DNA, 14 bp, D. melanogaster
tgtgaatgtgagtg

SEQ ID NO: 659659 - DNA, 13 bp, D. melanogaster
tgtgaatgtgatt

SEQ ID NO: 659660 - DNA, 13 bp, D. melanogaster
tgtgaatgtgttt

SEQ ID NO: 659661 - DNA, 13 bp, D. melanogaster
tgtgaattaaaga

SEQ ID NO: 659662 - DNA, 13 bp, D. melanogaster
tgtgaattatgtt

SEQ ID NO: 659663 - DNA, 14 bp, D. melanogaster
tgtgaattatgttt

SEQ ID NO: 659664 - DNA, 13 bp, D. melanogaster
tgtgaatttaatt

SEQ ID NO: 659665 - DNA, 13 bp, D. melanogaster
tgtgaatttatat

SEQ ID NO: 659666 - DNA, 13 bp, D. melanogaster
tgtgaatttcatt

SEQ ID NO: 659667 - DNA, 13 bp, D. melanogaster
tgtgacaaaatat

SEQ ID NO: 659668 - DNA, 13 bp, D. melanogaster
tgtgacacagtta

SEQ ID NO: 659669 - DNA, 13 bp, D. melanogaster
tgtgacagccaag

SEQ ID NO: 659670 - DNA, 13 bp, D. melanogaster
tgtgacattgggt

SEQ ID NO: 659671 - DNA, 13 bp, D. melanogaster
tgtgacatttatg

SEQ ID NO: 659672 - DNA, 13 bp, D. melanogaster
tgtgacattttaa

SEQ ID NO: 659673 - DNA, 13 bp, D. melanogaster
tgtgacattttta

SEQ ID NO: 659674 - DNA, 13 bp, D. melanogaster
tgtgaccaaaaaa

SEQ ID NO: 659675 - DNA, 13 bp, D. melanogaster
tgtgaccaagaaa

SEQ ID NO: 659676 - DNA, 13 bp, D. melanogaster
tgtgacccaaata

SEQ ID NO: 659677 - DNA, 13 bp, D. melanogaster
tgtgactgcgact

SEQ ID NO: 659678 - DNA, 13 bp, D. melanogaster
tgtgactggtgtg

SEQ ID NO: 659679 - DNA, 13 bp, D. melanogaster
tgtgactgtgact

SEQ ID NO: 659680 - DNA, 13 bp, D. melanogaster
tgtgacttcgttc

SEQ ID NO: 659681 - DNA, 14 bp, D. melanogaster
tgtgagagtgtgtg

SEQ ID NO: 659682 - DNA, 13 bp, D. melanogaster
tgtgagcagcctg

SEQ ID NO: 659683 - DNA, 16 bp, D. melanogaster
tgtgagccaaccacat

SEQ ID NO: 659684 - DNA, 14 bp, D. melanogaster
tgtgagcgaaaatt

SEQ ID NO: 659685 - DNA, 13 bp, D. melanogaster
tgtgagctcttgt

SEQ ID NO: 659686 - DNA, 13 bp, D. melanogaster
tgtgagctgtgag

SEQ ID NO: 659687 - DNA, 13 bp, D. melanogaster
tgtgaggccaggt

SEQ ID NO: 659688 - DNA, 13 bp, D. melanogaster
tgtgagtcgagtg

SEQ ID NO: 659689 - DNA, 14 bp, D. melanogaster
tgtgagtcgagtgg

SEQ ID NO: 659690 - DNA, 13 bp, D. melanogaster
tgtgagtgcgtgt

SEQ ID NO: 659691 - DNA, 13 bp, D. melanogaster
tgtgagtgctttt

SEQ ID NO: 659692 - DNA, 14 bp, D. melanogaster
tgtgagtgtgagtg

SEQ ID NO: 659693 - DNA, 13 bp, D. melanogaster
tgtgagtgtgggc

SEQ ID NO: 659694 - DNA, 13 bp, D. melanogaster
tgtgagttgctct

SEQ ID NO: 659695 - DNA, 13 bp, D. melanogaster
tgtgataaataaa

SEQ ID NO: 659696 - DNA, 13 bp, D. melanogaster
tgtgataagaaaa

SEQ ID NO: 659697 - DNA, 13 bp, D. melanogaster
tgtgatcagtata

SEQ ID NO: 659698 - DNA, 13 bp, D. melanogaster
tgtgatcagtgtt

SEQ ID NO: 659699 - DNA, 13 bp, D. melanogaster
tgtgatggatcac

SEQ ID NO: 659700 - DNA, 13 bp, D. melanogaster
tgtgatgggaaaa

SEQ ID NO: 659701 - DNA, 13 bp, D. melanogaster
tgtgatgttgcag

SEQ ID NO: 659702 - DNA, 13 bp, D. melanogaster
tgtgattgcgatt

SEQ ID NO: 659703 - DNA, 13 bp, D. melanogaster
tgtgatttatgtg

SEQ ID NO: 659704 - DNA, 13 bp, D. melanogaster
tgtgatttctttc

SEQ ID NO: 659705 - DNA, 13 bp, D. melanogaster
tgtgatttgcatg

SEQ ID NO: 659706 - DNA, 13 bp, D. melanogaster
tgtgatttgtgca

SEQ ID NO: 659707 - DNA, 13 bp, D. melanogaster
tgtgattttaaat

SEQ ID NO: 659708 - DNA, 14 bp, D. melanogaster
tgtgatttttaaag

SEQ ID NO: 659709 - DNA, 13 bp, D. melanogaster
tgtgatttttctc

SEQ ID NO: 659710 - DNA, 13 bp, D. melanogaster
tgtgcaaaaatat

SEQ ID NO: 659711 - DNA, 13 bp, D. melanogaster
tgtgcaaaaattg

SEQ ID NO: 659712 - DNA, 13 bp, D. melanogaster
tgtgcaaaacaaa

SEQ ID NO: 659713 - DNA, 13 bp, D. melanogaster
tgtgcaaaagttt

SEQ ID NO: 659714 - DNA, 13 bp, D. melanogaster
tgtgcaaaataaa

SEQ ID NO: 659715 - DNA, 14 bp, D. melanogaster
tgtgcaaaataaaa

SEQ ID NO: 659716 - DNA, 13 bp, D. melanogaster
tgtgcaaaataat

SEQ ID NO: 659717 - DNA, 13 bp, D. melanogaster
tgtgcaaaatgaa

SEQ ID NO: 659718 - DNA, 13 bp, D. melanogaster
tgtgcaaaatgtt

SEQ ID NO: 659719 - DNA, 13 bp, D. melanogaster
tgtgcaaaattat

SEQ ID NO: 659720 - DNA, 13 bp, D. melanogaster
tgtgcaaacaaat

SEQ ID NO: 659721 - DNA, 14 bp, D. melanogaster
tgtgcaaacaattt

SEQ ID NO: 659722 - DNA, 13 bp, D. melanogaster
tgtgcaaacattt

SEQ ID NO: 659723 - DNA, 13 bp, D. melanogaster
tgtgcaaagtgca

SEQ ID NO: 659724 - DNA, 13 bp, D. melanogaster
tgtgcaaagtgtt

SEQ ID NO: 659725 - DNA, 13 bp, D. melanogaster
tgtgcaaagtttt

SEQ ID NO: 659726 - DNA, 13 bp, D. melanogaster
tgtgcaaataaaa

SEQ ID NO: 659727 - DNA, 13 bp, D. melanogaster
tgtgcaaataaat

SEQ ID NO: 659728 - DNA, 13 bp, D. melanogaster
tgtgcaaataatt

SEQ ID NO: 659729 - DNA, 13 bp, D. melanogaster
tgtgcaaatataa

SEQ ID NO: 659730 - DNA, 13 bp, D. melanogaster
tgtgcaaatattg

SEQ ID NO: 659731 - DNA, 13 bp, D. melanogaster
tgtgcaaatattt

SEQ ID NO: 659732 - DNA, 14 bp, D. melanogaster
tgtgcaaatattta

SEQ ID NO: 659733 - DNA, 14 bp, D. melanogaster
tgtgcaaatatttg

SEQ ID NO: 659734 - DNA, 13 bp, D. melanogaster
tgtgcaaatggaa

SEQ ID NO: 659735 - DNA, 13 bp, D. melanogaster
tgtgcaaatgttt

SEQ ID NO: 659736 - DNA, 13 bp, D. melanogaster
tgtgcaaattatt

SEQ ID NO: 659737 - DNA, 13 bp, D. melanogaster
tgtgcaaattcaa

SEQ ID NO: 659738 - DNA, 13 bp, D. melanogaster
tgtgcaaatttaa

SEQ ID NO: 659739 - DNA, 13 bp, D. melanogaster
tgtgcaaatttat

SEQ ID NO: 659740 - DNA, 13 bp, D. melanogaster
tgtgcaaatttct

SEQ ID NO: 659741 - DNA, 13 bp, D. melanogaster
tgtgcaacaaaaa

SEQ ID NO: 659742 - DNA, 13 bp, D. melanogaster
tgtgcaacaaaat

SEQ ID NO: 659743 - DNA, 13 bp, D. melanogaster
tgtgcaacaaatt

SEQ ID NO: 659744 - DNA, 13 bp, D. melanogaster
tgtgcaacaattt

SEQ ID NO: 659745 - DNA, 13 bp, D. melanogaster
tgtgcaacatcag

SEQ ID NO: 659746 - DNA, 13 bp, D. melanogaster
tgtgcaacatttg

SEQ ID NO: 659747 - DNA, 13 bp, D. melanogaster
tgtgcaacatttt

SEQ ID NO: 659748 - DNA, 13 bp, D. melanogaster
tgtgcaactattt

SEQ ID NO: 659749 - DNA, 13 bp, D. melanogaster
tgtgcaagtgtgc

SEQ ID NO: 659750 - DNA, 13 bp, D. melanogaster
tgtgcaagtgtgt

SEQ ID NO: 659751 - DNA, 13 bp, D. melanogaster
tgtgcaagttttt

SEQ ID NO: 659752 - DNA, 13 bp, D. melanogaster
tgtgcaataaaaa

SEQ ID NO: 659753 - DNA, 13 bp, D. melanogaster
tgtgcaataataa

SEQ ID NO: 659754 - DNA, 13 bp, D. melanogaster
tgtgcaatatttt

SEQ ID NO: 659755 - DNA, 13 bp, D. melanogaster
tgtgcaatcagtg

SEQ ID NO: 659756 - DNA, 13 bp, D. melanogaster
tgtgcaatgtgca

SEQ ID NO: 659757 - DNA, 14 bp, D. melanogaster
tgtgcaatgtgcaa

SEQ ID NO: 659758 - DNA, 13 bp, D. melanogaster
tgtgcaattattt

SEQ ID NO: 659759 - DNA, 13 bp, D. melanogaster
tgtgcaattgttg

SEQ ID NO: 659760 - DNA, 13 bp, D. melanogaster
tgtgcaatttatt

SEQ ID NO: 659761 - DNA, 13 bp, D. melanogaster
tgtgcaattttta

SEQ ID NO: 659762 - DNA, 13 bp, D. melanogaster
tgtgcaatttttg

SEQ ID NO: 659763 - DNA, 14 bp, D. melanogaster
tgtgcaattttttt

SEQ ID NO: 659764 - DNA, 13 bp, D. melanogaster
tgtgcacacaaat

SEQ ID NO: 659765 - DNA, 13 bp, D. melanogaster
tgtgcacacacac

SEQ ID NO: 659766 - DNA, 13 bp, D. melanogaster
tgtgcacacgtat

SEQ ID NO: 659767 - DNA, 13 bp, D. melanogaster
tgtgcacactttt

SEQ ID NO: 659768 - DNA, 14 bp, D. melanogaster
tgtgcacatatgta

SEQ ID NO: 659769 - DNA, 13 bp, D. melanogaster
tgtgcacattttt

SEQ ID NO: 659770 - DNA, 13 bp, D. melanogaster
tgtgcactatttt

SEQ ID NO: 659771 - DNA, 14 bp, D. melanogaster
tgtgcacttaaatt

SEQ ID NO: 659772 - DNA, 13 bp, D. melanogaster
tgtgcacttttat

SEQ ID NO: 659773 - DNA, 13 bp, D. melanogaster
tgtgcacttttgg

SEQ ID NO: 659774 - DNA, 13 bp, D. melanogaster
tgtgcactttttt

SEQ ID NO: 659775 - DNA, 13 bp, D. melanogaster
tgtgcagcacaaa

SEQ ID NO: 659776 - DNA, 13 bp, D. melanogaster
tgtgcagtattct

SEQ ID NO: 659777 - DNA, 13 bp, D. melanogaster
tgtgcagttgttt

SEQ ID NO: 659778 - DNA, 13 bp, D. melanogaster
tgtgcagtttgca

SEQ ID NO: 659779 - DNA, 13 bp, D. melanogaster
tgtgcataaaaat

SEQ ID NO: 659780 - DNA, 13 bp, D. melanogaster
tgtgcataaacaa

SEQ ID NO: 659781 - DNA, 13 bp, D. melanogaster
tgtgcataataaa

SEQ ID NO: 659782 - DNA, 13 bp, D. melanogaster
tgtgcatacaaat

SEQ ID NO: 659783 - DNA, 14 bp, D. melanogaster
tgtgcatacatatg

SEQ ID NO: 659784 - DNA, 14 bp, D. melanogaster
tgtgcatatatcga

SEQ ID NO: 659785 - DNA, 13 bp, D. melanogaster
tgtgcatatatct

SEQ ID NO: 659786 - DNA, 13 bp, D. melanogaster
tgtgcatatattt

SEQ ID NO: 659787 - DNA, 13 bp, D. melanogaster
tgtgcatattaat

SEQ ID NO: 659788 - DNA, 13 bp, D. melanogaster
tgtgcatatttca

SEQ ID NO: 659789 - DNA, 13 bp, D. melanogaster
tgtgcatgcaaaa

SEQ ID NO: 659790 - DNA, 13 bp, D. melanogaster
tgtgcatgtaaat

SEQ ID NO: 659791 - DNA, 13 bp, D. melanogaster
tgtgcatgtattt

SEQ ID NO: 659792 - DNA, 13 bp, D. melanogaster
tgtgcatgtgcat

SEQ ID NO: 659793 - DNA, 13 bp, D. melanogaster
tgtgcatgtggat

SEQ ID NO: 659794 - DNA, 13 bp, D. melanogaster
tgtgcatgtgggt

SEQ ID NO: 659795 - DNA, 14 bp, D. melanogaster
tgtgcatgtgtgag

SEQ ID NO: 659796 - DNA, 13 bp, D. melanogaster
tgtgcatgtgtgc

SEQ ID NO: 659797 - DNA, 13 bp, D. melanogaster
tgtgcatgtgtgg

SEQ ID NO: 659798 - DNA, 13 bp, D. melanogaster
tgtgcatgtgtgt

SEQ ID NO: 659799 - DNA, 13 bp, D. melanogaster
tgtgcatgtgttt

SEQ ID NO: 659800 - DNA, 14 bp, D. melanogaster
tgtgcatgtgttta

SEQ ID NO: 659801 - DNA, 13 bp, D. melanogaster
tgtgcattatttt

SEQ ID NO: 659802 - DNA, 13 bp, D. melanogaster
tgtgcattcaaat

SEQ ID NO: 659803 - DNA, 13 bp, D. melanogaster
tgtgcattctggg

SEQ ID NO: 659804 - DNA, 13 bp, D. melanogaster
tgtgcattgcatt

SEQ ID NO: 659805 - DNA, 13 bp, D. melanogaster
tgtgcatttcaat

SEQ ID NO: 659806 - DNA, 13 bp, D. melanogaster
tgtgcatttgtga

SEQ ID NO: 659807 - DNA, 13 bp, D. melanogaster
tgtgcatttgtgt

SEQ ID NO: 659808 - DNA, 14 bp, D. melanogaster
tgtgcatttgtgtc

SEQ ID NO: 659809 - DNA, 14 bp, D. melanogaster
tgtgcattttaaat

SEQ ID NO: 659810 - DNA, 14 bp, D. melanogaster
tgtgcattttaatt

SEQ ID NO: 659811 - DNA, 13 bp, D. melanogaster
tgtgcattttatg

SEQ ID NO: 659812 - DNA, 13 bp, D. melanogaster
tgtgcattttgaa

SEQ ID NO: 659813 - DNA, 13 bp, D. melanogaster
tgtgcatttttaa

SEQ ID NO: 659814 - DNA, 13 bp, D. melanogaster
tgtgcatttttga

SEQ ID NO: 659815 - DNA, 13 bp, D. melanogaster
tgtgccaaaaaat

SEQ ID NO: 659816 - DNA, 13 bp, D. melanogaster
tgtgccaaaaagt

SEQ ID NO: 659817 - DNA, 13 bp, D. melanogaster
tgtgccaaaagtt

SEQ ID NO: 659818 - DNA, 13 bp, D. melanogaster
tgtgccaaacaaa

SEQ ID NO: 659819 - DNA, 13 bp, D. melanogaster
tgtgccaaattaa

SEQ ID NO: 659820 - DNA, 13 bp, D. melanogaster
tgtgccaacattt

SEQ ID NO: 659821 - DNA, 13 bp, D. melanogaster
tgtgccaataaat

SEQ ID NO: 659822 - DNA, 13 bp, D. melanogaster
tgtgccacaaaaa

SEQ ID NO: 659823 - DNA, 13 bp, D. melanogaster
tgtgccacaaagt

SEQ ID NO: 659824 - DNA, 13 bp, D. melanogaster
tgtgccacaattt

SEQ ID NO: 659825 - DNA, 13 bp, D. melanogaster
tgtgccacatgca

SEQ ID NO: 659826 - DNA, 13 bp, D. melanogaster
tgtgccacatgtg

SEQ ID NO: 659827 - DNA, 13 bp, D. melanogaster
tgtgccacccact

SEQ ID NO: 659828 - DNA, 13 bp, D. melanogaster
tgtgccacgcagg

SEQ ID NO: 659829 - DNA, 14 bp, D. melanogaster
tgtgccacgcccac

SEQ ID NO: 659830 - DNA, 14 bp, D. melanogaster
tgtgccacgccccc

SEQ ID NO: 659831 - DNA, 13 bp, D. melanogaster
tgtgccactgcca

SEQ ID NO: 659832 - DNA, 13 bp, D. melanogaster
tgtgccacttttg

SEQ ID NO: 659833 - DNA, 13 bp, D. melanogaster
tgtgccagcagat

SEQ ID NO: 659834 - DNA, 13 bp, D. melanogaster
tgtgccagctgta

SEQ ID NO: 659835 - DNA, 13 bp, D. melanogaster
tgtgccagttttt

SEQ ID NO: 659836 - DNA, 13 bp, D. melanogaster
tgtgccatgtgcc

SEQ ID NO: 659837 - DNA, 13 bp, D. melanogaster
tgtgccattttat

SEQ ID NO: 659838 - DNA, 13 bp, D. melanogaster
tgtgcccactttt

SEQ ID NO: 659839 - DNA, 13 bp, D. melanogaster
tgtgcccctcaag

SEQ ID NO: 659840 - DNA, 13 bp, D. melanogaster
tgtgccgcgaata

SEQ ID NO: 659841 - DNA, 13 bp, D. melanogaster
tgtgccgtgaata

SEQ ID NO: 659842 - DNA, 13 bp, D. melanogaster
tgtgcctatacat

SEQ ID NO: 659843 - DNA, 13 bp, D. melanogaster
tgtgcctccactt

SEQ ID NO: 659844 - DNA, 13 bp, D. melanogaster
tgtgcctctgtgt

SEQ ID NO: 659845 - DNA, 13 bp, D. melanogaster
tgtgcctgcgcca

SEQ ID NO: 659846 - DNA, 13 bp, D. melanogaster
tgtgcctgctttt

SEQ ID NO: 659847 - DNA, 13 bp, D. melanogaster
tgtgcctgtgtgt

SEQ ID NO: 659848 - DNA, 14 bp, D. melanogaster
tgtgcctgtgtgtg

SEQ ID NO: 659849 - DNA, 16 bp, D. melanogaster
tgtgcctgtgtgtgtg

SEQ ID NO: 659850 - DNA, 13 bp, D. melanogaster
tgtgcctgtgttt

SEQ ID NO: 659851 - DNA, 13 bp, D. melanogaster
tgtgcgaaaaatt

SEQ ID NO: 659852 - DNA, 13 bp, D. melanogaster
tgtgcgaaaatat

SEQ ID NO: 659853 - DNA, 13 bp, D. melanogaster
tgtgcgaaaatgt

SEQ ID NO: 659854 - DNA, 13 bp, D. melanogaster
tgtgcgaaaattg

SEQ ID NO: 659855 - DNA, 13 bp, D. melanogaster
tgtgcgaaagaga

SEQ ID NO: 659856 - DNA, 13 bp, D. melanogaster
tgtgcgaaatgca

SEQ ID NO: 659857 - DNA, 13 bp, D. melanogaster
tgtgcgacgagaa

SEQ ID NO: 659858 - DNA, 13 bp, D. melanogaster
tgtgcgagagtgt

SEQ ID NO: 659859 - DNA, 13 bp, D. melanogaster
tgtgcgagcgaga

SEQ ID NO: 659860 - DNA, 13 bp, D. melanogaster
tgtgcgagtgcgt

SEQ ID NO: 659861 - DNA, 13 bp, D. melanogaster
tgtgcgagtgtat

SEQ ID NO: 659862 - DNA, 13 bp, D. melanogaster
tgtgcgagtgtgc

SEQ ID NO: 659863 - DNA, 14 bp, D. melanogaster
tgtgcgagtgtgcg

SEQ ID NO: 659864 - DNA, 13 bp, D. melanogaster
tgtgcgagtgtgg

SEQ ID NO: 659865 - DNA, 14 bp, D. melanogaster
tgtgcgagtgtgtg

SEQ ID NO: 659866 - DNA, 13 bp, D. melanogaster
tgtgcgatgtgtg

SEQ ID NO: 659867 - DNA, 13 bp, D. melanogaster
tgtgcgattgttt

SEQ ID NO: 659868 - DNA, 13 bp, D. melanogaster
tgtgcgatttgtg

SEQ ID NO: 659869 - DNA, 13 bp, D. melanogaster
tgtgcgatttttg

SEQ ID NO: 659870 - DNA, 13 bp, D. melanogaster
tgtgcgcaaaata

SEQ ID NO: 659871 - DNA, 13 bp, D. melanogaster
tgtgcgcatatat

SEQ ID NO: 659872 - DNA, 13 bp, D. melanogaster
tgtgcgccaagtc

SEQ ID NO: 659873 - DNA, 13 bp, D. melanogaster
tgtgcgccatttt

SEQ ID NO: 659874 - DNA, 13 bp, D. melanogaster
tgtgcgctttttg

SEQ ID NO: 659875 - DNA, 13 bp, D. melanogaster
tgtgcggaagcct

SEQ ID NO: 659876 - DNA, 13 bp, D. melanogaster
tgtgcggctgtgt

SEQ ID NO: 659877 - DNA, 13 bp, D. melanogaster
tgtgcgggaaaat

SEQ ID NO: 659878 - DNA, 13 bp, D. melanogaster
tgtgcgggtgcta

SEQ ID NO: 659879 - DNA, 13 bp, D. melanogaster
tgtgcgtatgtgc

SEQ ID NO: 659880 - DNA, 13 bp, D. melanogaster
tgtgcgtctgtgt

SEQ ID NO: 659881 - DNA, 13 bp, D. melanogaster
tgtgcgtgagtat

SEQ ID NO: 659882 - DNA, 13 bp, D. melanogaster
tgtgcgtgagtgg

SEQ ID NO: 659883 - DNA, 13 bp, D. melanogaster
tgtgcgtgcctgt

SEQ ID NO: 659884 - DNA, 13 bp, D. melanogaster
tgtgcgtgcgtat

SEQ ID NO: 659885 - DNA, 13 bp, D. melanogaster
tgtgcgtgcgtgc

SEQ ID NO: 659886 - DNA, 13 bp, D. melanogaster
tgtgcgtgggtat

SEQ ID NO: 659887 - DNA, 14 bp, D. melanogaster
tgtgcgtgtatgtg

SEQ ID NO: 659888 - DNA, 14 bp, D. melanogaster
tgtgcgtgtgagtg

SEQ ID NO: 659889 - DNA, 13 bp, D. melanogaster
tgtgcgtgtgcaa

SEQ ID NO: 659890 - DNA, 13 bp, D. melanogaster
tgtgcgtgtgcac

SEQ ID NO: 659891 - DNA, 13 bp, D. melanogaster
tgtgcgtgtgcag

SEQ ID NO: 659892 - DNA, 13 bp, D. melanogaster
tgtgcgtgtgccg

SEQ ID NO: 659893 - DNA, 13 bp, D. melanogaster
tgtgcgtgtgcga

SEQ ID NO: 659894 - DNA, 14 bp, D. melanogaster
tgtgcgtgtgcgtg

SEQ ID NO: 659895 - DNA, 13 bp, D. melanogaster
tgtgcgtgtgctt

SEQ ID NO: 659896 - DNA, 13 bp, D. melanogaster
tgtgcgtgtgggc

SEQ ID NO: 659897 - DNA, 13 bp, D. melanogaster
tgtgcgtgtgtaa

SEQ ID NO: 659898 - DNA, 13 bp, D. melanogaster
tgtgcgtgtgtag

SEQ ID NO: 659899 - DNA, 13 bp, D. melanogaster
tgtgcgtgtgtct

SEQ ID NO: 659900 - DNA, 14 bp, D. melanogaster
tgtgcgtgtgtctg

SEQ ID NO: 659901 - DNA, 13 bp, D. melanogaster
tgtgcgtgtgtga

SEQ ID NO: 659902 - DNA, 13 bp, D. melanogaster
tgtgcgtgtgtgc

SEQ ID NO: 659903 - DNA, 14 bp, D. melanogaster
tgtgcgtgtgtgca

SEQ ID NO: 659904 - DNA, 14 bp, D. melanogaster
tgtgcgtgtgtgtc

SEQ ID NO: 659905 - DNA, 13 bp, D. melanogaster
tgtgcgttgaaaa

SEQ ID NO: 659906 - DNA, 13 bp, D. melanogaster
tgtgctaaaaaaa

SEQ ID NO: 659907 - DNA, 13 bp, D. melanogaster
tgtgctaatgcac

SEQ ID NO: 659908 - DNA, 13 bp, D. melanogaster
tgtgctaattaaa

SEQ ID NO: 659909 - DNA, 13 bp, D. melanogaster
tgtgctaatttct

SEQ ID NO: 659910 - DNA, 14 bp, D. melanogaster
tgtgctagtgtgtg

SEQ ID NO: 659911 - DNA, 13 bp, D. melanogaster
tgtgctatatttt

SEQ ID NO: 659912 - DNA, 13 bp, D. melanogaster
tgtgctattattt

SEQ ID NO: 659913 - DNA, 13 bp, D. melanogaster
tgtgctattttta

SEQ ID NO: 659914 - DNA, 13 bp, D. melanogaster
tgtgctcacgaaa

SEQ ID NO: 659915 - DNA, 14 bp, D. melanogaster
tgtgctcatgtctt

SEQ ID NO: 659916 - DNA, 13 bp, D. melanogaster
tgtgctccacttt

SEQ ID NO: 659917 - DNA, 13 bp, D. melanogaster
tgtgctccatttg

SEQ ID NO: 659918 - DNA, 13 bp, D. melanogaster
tgtgctcgctgaa

SEQ ID NO: 659919 - DNA, 13 bp, D. melanogaster
tgtgctgccaatt

SEQ ID NO: 659920 - DNA, 13 bp, D. melanogaster
tgtgctgcctttt

SEQ ID NO: 659921 - DNA, 13 bp, D. melanogaster
tgtgctgctcctg

SEQ ID NO: 659922 - DNA, 14 bp, D. melanogaster
tgtgctgctgctgc

SEQ ID NO: 659923 - DNA, 13 bp, D. melanogaster
tgtgctggcaaaa

SEQ ID NO: 659924 - DNA, 13 bp, D. melanogaster
tgtgctggcattt

SEQ ID NO: 659925 - DNA, 14 bp, D. melanogaster
tgtgctgtatttaa

SEQ ID NO: 659926 - DNA, 15 bp, D. melanogaster
tgtgctgtgcaacaa

SEQ ID NO: 659927 - DNA, 13 bp, D. melanogaster
tgtgctgtgctgc

SEQ ID NO: 659928 - DNA, 13 bp, D. melanogaster
tgtgctgtgctgt

SEQ ID NO: 659929 - DNA, 14 bp, D. melanogaster
tgtgctgtgctgtg

SEQ ID NO: 659930 - DNA, 13 bp, D. melanogaster
tgtgctgttgaag

SEQ ID NO: 659931 - DNA, 13 bp, D. melanogaster
tgtgcttaaatat

SEQ ID NO: 659932 - DNA, 13 bp, D. melanogaster
tgtgcttaattaa

SEQ ID NO: 659933 - DNA, 13 bp, D. melanogaster
tgtgcttgcttaa

SEQ ID NO: 659934 - DNA, 14 bp, D. melanogaster
tgtgcttgcttaaa

SEQ ID NO: 659935 - DNA, 13 bp, D. melanogaster
tgtgcttgtaatt

SEQ ID NO: 659936 - DNA, 13 bp, D. melanogaster
tgtgcttgtgctg

SEQ ID NO: 659937 - DNA, 13 bp, D. melanogaster
tgtgcttgtgtgc

SEQ ID NO: 659938 - DNA, 14 bp, D. melanogaster
tgtgcttgtgtgcg

SEQ ID NO: 659939 - DNA, 13 bp, D. melanogaster
tgtgctttacttt

SEQ ID NO: 659940 - DNA, 13 bp, D. melanogaster
tgtgctttcgggt

SEQ ID NO: 659941 - DNA, 13 bp, D. melanogaster
tgtgctttgaatt

SEQ ID NO: 659942 - DNA, 13 bp, D. melanogaster
tgtgcttttaatt

SEQ ID NO: 659943 - DNA, 13 bp, D. melanogaster
tgtgctttttgcg

SEQ ID NO: 659944 - DNA, 13 bp, D. melanogaster
tgtggaaaaaata

SEQ ID NO: 659945 - DNA, 13 bp, D. melanogaster
tgtggaaaaacaa

SEQ ID NO: 659946 - DNA, 13 bp, D. melanogaster
tgtggaaaaactt

SEQ ID NO: 659947 - DNA, 13 bp, D. melanogaster
tgtggaaaaatat

SEQ ID NO: 659948 - DNA, 13 bp, D. melanogaster
tgtggaaaagcaa

SEQ ID NO: 659949 - DNA, 13 bp, D. melanogaster
tgtggaaaagtga

SEQ ID NO: 659950 - DNA, 13 bp, D. melanogaster
tgtggaaatggaa

SEQ ID NO: 659951 - DNA, 13 bp, D. melanogaster
tgtggaaatgtgg

SEQ ID NO: 659952 - DNA, 13 bp, D. melanogaster
tgtggaaattgtg

SEQ ID NO: 659953 - DNA, 14 bp, D. melanogaster
tgtggaaatttgtg

SEQ ID NO: 659954 - DNA, 13 bp, D. melanogaster
tgtggaaccacaa

SEQ ID NO: 659955 - DNA, 13 bp, D. melanogaster
tgtggaacgcaaa

SEQ ID NO: 659956 - DNA, 13 bp, D. melanogaster
tgtggaacttgct

SEQ ID NO: 659957 - DNA, 13 bp, D. melanogaster
tgtggaagtggaa

SEQ ID NO: 659958 - DNA, 13 bp, D. melanogaster
tgtggacctactt

SEQ ID NO: 659959 - DNA, 13 bp, D. melanogaster
tgtggacgtggca

SEQ ID NO: 659960 - DNA, 13 bp, D. melanogaster
tgtggactccaaa

SEQ ID NO: 659961 - DNA, 13 bp, D. melanogaster
tgtggagaaatat

SEQ ID NO: 659962 - DNA, 13 bp, D. melanogaster
tgtggagatctcc

SEQ ID NO: 659963 - DNA, 13 bp, D. melanogaster
tgtggaggacaca

SEQ ID NO: 659964 - DNA, 13 bp, D. melanogaster
tgtggataaaatt

SEQ ID NO: 659965 - DNA, 13 bp, D. melanogaster
tgtggatatatgt

SEQ ID NO: 659966 - DNA, 13 bp, D. melanogaster
tgtggatatgtgg

SEQ ID NO: 659967 - DNA, 13 bp, D. melanogaster
tgtggatctgttg

SEQ ID NO: 659968 - DNA, 13 bp, D. melanogaster
tgtggatgaggat

SEQ ID NO: 659969 - DNA, 13 bp, D. melanogaster
tgtggatggatgt

SEQ ID NO: 659970 - DNA, 13 bp, D. melanogaster
tgtggatggggat

SEQ ID NO: 659971 - DNA, 13 bp, D. melanogaster
tgtggatgtgcat

SEQ ID NO: 659972 - DNA, 14 bp, D. melanogaster
tgtggatgtggatg

SEQ ID NO: 659973 - DNA, 15 bp, D. melanogaster
tgtggatgtggatga

SEQ ID NO: 659974 - DNA, 14 bp, D. melanogaster
tgtggatgtggctg

SEQ ID NO: 659975 - DNA, 15 bp, D. melanogaster
tgtggatgtggctgt

SEQ ID NO: 659976 - DNA, 13 bp, D. melanogaster
tgtggatgtgtat

SEQ ID NO: 659977 - DNA, 13 bp, D. melanogaster
tgtggatttgatg

SEQ ID NO: 659978 - DNA, 13 bp, D. melanogaster
tgtggcaaaaagt

SEQ ID NO: 659979 - DNA, 13 bp, D. melanogaster
tgtggcaaaaatg

SEQ ID NO: 659980 - DNA, 13 bp, D. melanogaster
tgtggcaaaataa

SEQ ID NO: 659981 - DNA, 13 bp, D. melanogaster
tgtggcaaacaca

SEQ ID NO: 659982 - DNA, 13 bp, D. melanogaster
tgtggcaaattta

SEQ ID NO: 659983 - DNA, 13 bp, D. melanogaster
tgtggcaacaaaa

SEQ ID NO: 659984 - DNA, 13 bp, D. melanogaster
tgtggcaacaaca

SEQ ID NO: 659985 - DNA, 14 bp, D. melanogaster
tgtggcaacaacaa

SEQ ID NO: 659986 - DNA, 13 bp, D. melanogaster
tgtggcaacaatg

SEQ ID NO: 659987 - DNA, 13 bp, D. melanogaster
tgtggcaacagca

SEQ ID NO: 659988 - DNA, 13 bp, D. melanogaster
tgtggcaacatca

SEQ ID NO: 659989 - DNA, 13 bp, D. melanogaster
tgtggcaacattt

SEQ ID NO: 659990 - DNA, 13 bp, D. melanogaster
tgtggcaactgca

SEQ ID NO: 659991 - DNA, 13 bp, D. melanogaster
tgtggcaaggaaa

SEQ ID NO: 659992 - DNA, 13 bp, D. melanogaster
tgtggcaagtgaa

SEQ ID NO: 659993 - DNA, 13 bp, D. melanogaster
tgtggcaataaaa

SEQ ID NO: 659994 - DNA, 13 bp, D. melanogaster
tgtggcaatgtgg

SEQ ID NO: 659995 - DNA, 13 bp, D. melanogaster
tgtggcacaaaaa

SEQ ID NO: 659996 - DNA, 13 bp, D. melanogaster
tgtggcacaataa

SEQ ID NO: 659997 - DNA, 14 bp, D. melanogaster
tgtggcacacacac

SEQ ID NO: 659998 - DNA, 13 bp, D. melanogaster
tgtggcacagtgg

SEQ ID NO: 659999 - DNA, 13 bp, D. melanogaster
tgtggcacatttt

SEQ ID NO: 660000 - DNA, 13 bp, D. melanogaster
tgtggcagagaag

SEQ ID NO: 660001 - DNA, 13 bp, D. melanogaster
tgtggcagcaaca

SEQ ID NO: 660002 - DNA, 14 bp, D. melanogaster
tgtggcagcaacaa

SEQ ID NO: 660003 - DNA, 13 bp, D. melanogaster
tgtggcagcagca

SEQ ID NO: 660004 - DNA, 13 bp, D. melanogaster
tgtggcagccaca

SEQ ID NO: 660005 - DNA, 13 bp, D. melanogaster
tgtggcagccact

SEQ ID NO: 660006 - DNA, 13 bp, D. melanogaster
tgtggcagctgca

SEQ ID NO: 660007 - DNA, 13 bp, D. melanogaster
tgtggcagcttgt

SEQ ID NO: 660008 - DNA, 13 bp, D. melanogaster
tgtggcaggaaaa

SEQ ID NO: 660009 - DNA, 13 bp, D. melanogaster
tgtggcagtgtgt

SEQ ID NO: 660010 - DNA, 13 bp, D. melanogaster
tgtggcataattt

SEQ ID NO: 660011 - DNA, 13 bp, D. melanogaster
tgtggcatacttt

SEQ ID NO: 660012 - DNA, 13 bp, D. melanogaster
tgtggcatatttt

SEQ ID NO: 660013 - DNA, 13 bp, D. melanogaster
tgtggcatgcaac

SEQ ID NO: 660014 - DNA, 13 bp, D. melanogaster
tgtggcatgccac

SEQ ID NO: 660015 - DNA, 14 bp, D. melanogaster
tgtggcatgccaca

SEQ ID NO: 660016 - DNA, 14 bp, D. melanogaster
tgtggcatgtggca

SEQ ID NO: 660017 - DNA, 13 bp, D. melanogaster
tgtggcatttgca

SEQ ID NO: 660018 - DNA, 13 bp, D. melanogaster
tgtggcatttgtt

SEQ ID NO: 660019 - DNA, 13 bp, D. melanogaster
tgtggcatttttt

SEQ ID NO: 660020 - DNA, 13 bp, D. melanogaster
tgtggccaaaaaa

SEQ ID NO: 660021 - DNA, 13 bp, D. melanogaster
tgtggccaaaaat

SEQ ID NO: 660022 - DNA, 13 bp, D. melanogaster
tgtggccaaaact

SEQ ID NO: 660023 - DNA, 13 bp, D. melanogaster
tgtggccaaaata

SEQ ID NO: 660024 - DNA, 13 bp, D. melanogaster
tgtggccaaactg

SEQ ID NO: 660025 - DNA, 13 bp, D. melanogaster
tgtggccaaatgt

SEQ ID NO: 660026 - DNA, 13 bp, D. melanogaster
tgtggccaagtgg

SEQ ID NO: 660027 - DNA, 13 bp, D. melanogaster
tgtggccaataat

SEQ ID NO: 660028 - DNA, 13 bp, D. melanogaster
tgtggccagaaat

SEQ ID NO: 660029 - DNA, 13 bp, D. melanogaster
tgtggccagcaag

SEQ ID NO: 660030 - DNA, 13 bp, D. melanogaster
tgtggccataaaa

SEQ ID NO: 660031 - DNA, 14 bp, D. melanogaster
tgtggccataaaaa

SEQ ID NO: 660032 - DNA, 13 bp, D. melanogaster
tgtggccataaat

SEQ ID NO: 660033 - DNA, 13 bp, D. melanogaster
tgtggccatgtgg

SEQ ID NO: 660034 - DNA, 13 bp, D. melanogaster
tgtggccattaaa

SEQ ID NO: 660035 - DNA, 13 bp, D. melanogaster
tgtggccattcat

SEQ ID NO: 660036 - DNA, 13 bp, D. melanogaster
tgtggcccaaact

SEQ ID NO: 660037 - DNA, 13 bp, D. melanogaster
tgtggcccataaa

SEQ ID NO: 660038 - DNA, 13 bp, D. melanogaster
tgtggccctgaaa

SEQ ID NO: 660039 - DNA, 13 bp, D. melanogaster
tgtggccgtggga

SEQ ID NO: 660040 - DNA, 13 bp, D. melanogaster
tgtggcctccttc

SEQ ID NO: 660041 - DNA, 13 bp, D. melanogaster
tgtggcctttgtt

SEQ ID NO: 660042 - DNA, 13 bp, D. melanogaster
tgtggcgcagttt

SEQ ID NO: 660043 - DNA, 13 bp, D. melanogaster
tgtggcgcccaac

SEQ ID NO: 660044 - DNA, 14 bp, D. melanogaster
tgtggcgcccaacg

SEQ ID NO: 660045 - DNA, 13 bp, D. melanogaster
tgtggcgtatgcg

SEQ ID NO: 660046 - DNA, 13 bp, D. melanogaster
tgtggctaaaaaa

SEQ ID NO: 660047 - DNA, 13 bp, D. melanogaster
tgtggctatatct

SEQ ID NO: 660048 - DNA, 13 bp, D. melanogaster
tgtggctcgatgg

SEQ ID NO: 660049 - DNA, 13 bp, D. melanogaster
tgtggctgaaaat

SEQ ID NO: 660050 - DNA, 13 bp, D. melanogaster
tgtggctgccaca

SEQ ID NO: 660051 - DNA, 14 bp, D. melanogaster
tgtggctgctgttg

SEQ ID NO: 660052 - DNA, 13 bp, D. melanogaster
tgtggctggctgg

SEQ ID NO: 660053 - DNA, 13 bp, D. melanogaster
tgtggctgtggca

SEQ ID NO: 660054 - DNA, 13 bp, D. melanogaster
tgtggctgtggct

SEQ ID NO: 660055 - DNA, 14 bp, D. melanogaster
tgtggctgtggctg

SEQ ID NO: 660056 - DNA, 13 bp, D. melanogaster
tgtggcttaaaaa

SEQ ID NO: 660057 - DNA, 13 bp, D. melanogaster
tgtggcttaaatt

SEQ ID NO: 660058 - DNA, 13 bp, D. melanogaster
tgtggcttataaa

SEQ ID NO: 660059 - DNA, 13 bp, D. melanogaster
tgtggctttaatt

SEQ ID NO: 660060 - DNA, 13 bp, D. melanogaster
tgtgggaaaaact

SEQ ID NO: 660061 - DNA, 13 bp, D. melanogaster
tgtgggaaaaatg

SEQ ID NO: 660062 - DNA, 13 bp, D. melanogaster
tgtgggaaatgca

SEQ ID NO: 660063 - DNA, 13 bp, D. melanogaster
tgtgggaaatgga

SEQ ID NO: 660064 - DNA, 13 bp, D. melanogaster
tgtgggaatggaa

SEQ ID NO: 660065 - DNA, 13 bp, D. melanogaster
tgtgggaattttt

SEQ ID NO: 660066 - DNA, 13 bp, D. melanogaster
tgtgggcaaacaa

SEQ ID NO: 660067 - DNA, 13 bp, D. melanogaster
tgtgggcagaaaa

SEQ ID NO: 660068 - DNA, 13 bp, D. melanogaster
tgtgggcatggca

SEQ ID NO: 660069 - DNA, 13 bp, D. melanogaster
tgtgggccaaaag

SEQ ID NO: 660070 - DNA, 13 bp, D. melanogaster
tgtgggcggaaaa

SEQ ID NO: 660071 - DNA, 13 bp, D. melanogaster
tgtgggcggggca

SEQ ID NO: 660072 - DNA, 13 bp, D. melanogaster
tgtgggcgtgacc

SEQ ID NO: 660073 - DNA, 13 bp, D. melanogaster
tgtgggcgtggca

SEQ ID NO: 660074 - DNA, 14 bp, D. melanogaster
tgtgggcgtggcag

SEQ ID NO: 660075 - DNA, 14 bp, D. melanogaster
tgtgggcgtggcca

SEQ ID NO: 660076 - DNA, 13 bp, D. melanogaster
tgtgggcgtggta

SEQ ID NO: 660077 - DNA, 13 bp, D. melanogaster
tgtgggcgtgtcc

SEQ ID NO: 660078 - DNA, 13 bp, D. melanogaster
tgtgggcgttgga

SEQ ID NO: 660079 - DNA, 13 bp, D. melanogaster
tgtgggtaatatt

SEQ ID NO: 660080 - DNA, 14 bp, D. melanogaster
tgtgggtaatattc

SEQ ID NO: 660081 - DNA, 13 bp, D. melanogaster
tgtgggtataccg

SEQ ID NO: 660082 - DNA, 13 bp, D. melanogaster
tgtgggtatattt

SEQ ID NO: 660083 - DNA, 13 bp, D. melanogaster
tgtgggtgaaaaa

SEQ ID NO: 660084 - DNA, 13 bp, D. melanogaster
tgtgggtggaaaa

SEQ ID NO: 660085 - DNA, 13 bp, D. melanogaster
tgtgggtgggaaa

SEQ ID NO: 660086 - DNA, 13 bp, D. melanogaster
tgtggtaataaaa

SEQ ID NO: 660087 - DNA, 13 bp, D. melanogaster
tgtggtaatggag

SEQ ID NO: 660088 - DNA, 14 bp, D. melanogaster
tgtggtataattta

SEQ ID NO: 660089 - DNA, 13 bp, D. melanogaster
tgtggtatttatg

SEQ ID NO: 660090 - DNA, 13 bp, D. melanogaster
tgtggtgcaactg

SEQ ID NO: 660091 - DNA, 13 bp, D. melanogaster
tgtggtgtacaaa

SEQ ID NO: 660092 - DNA, 14 bp, D. melanogaster
tgtggttaaaacaa

SEQ ID NO: 660093 - DNA, 13 bp, D. melanogaster
tgtggttatagct

SEQ ID NO: 660094 - DNA, 13 bp, D. melanogaster
tgtggttctccaa

SEQ ID NO: 660095 - DNA, 13 bp, D. melanogaster
tgtgtaaaaaaca

SEQ ID NO: 660096 - DNA, 13 bp, D. melanogaster
tgtgtaaaaaata

SEQ ID NO: 660097 - DNA, 13 bp, D. melanogaster
tgtgtaaaaacaa

SEQ ID NO: 660098 - DNA, 13 bp, D. melanogaster
tgtgtaaaagtat

SEQ ID NO: 660099 - DNA, 13 bp, D. melanogaster
tgtgtaaacagtt

SEQ ID NO: 660100 - DNA, 14 bp, D. melanogaster
tgtgtaaacttgga

SEQ ID NO: 660101 - DNA, 13 bp, D. melanogaster
tgtgtaaagagtt

SEQ ID NO: 660102 - DNA, 14 bp, D. melanogaster
tgtgtaaagagttt

SEQ ID NO: 660103 - DNA, 13 bp, D. melanogaster
tgtgtaaatatat

SEQ ID NO: 660104 - DNA, 13 bp, D. melanogaster
tgtgtaaatatgt

SEQ ID NO: 660105 - DNA, 14 bp, D. melanogaster
tgtgtaaatatgtt

SEQ ID NO: 660106 - DNA, 13 bp, D. melanogaster
tgtgtaaatattt

SEQ ID NO: 660107 - DNA, 14 bp, D. melanogaster
tgtgtaaatattta

SEQ ID NO: 660108 - DNA, 13 bp, D. melanogaster
tgtgtaaatgtgt

SEQ ID NO: 660109 - DNA, 13 bp, D. melanogaster
tgtgtaacgtgtg

SEQ ID NO: 660110 - DNA, 13 bp, D. melanogaster
tgtgtaactattt

SEQ ID NO: 660111 - DNA, 13 bp, D. melanogaster
tgtgtaagtgtgc

SEQ ID NO: 660112 - DNA, 13 bp, D. melanogaster
tgtgtaattaaaa

SEQ ID NO: 660113 - DNA, 13 bp, D. melanogaster
tgtgtaattgtaa

SEQ ID NO: 660114 - DNA, 13 bp, D. melanogaster
tgtgtaatttaaa

SEQ ID NO: 660115 - DNA, 13 bp, D. melanogaster
tgtgtaatttgct

SEQ ID NO: 660116 - DNA, 13 bp, D. melanogaster
tgtgtacaaaaaa

SEQ ID NO: 660117 - DNA, 13 bp, D. melanogaster
tgtgtacaaaaat

SEQ ID NO: 660118 - DNA, 13 bp, D. melanogaster
tgtgtacacacac

SEQ ID NO: 660119 - DNA, 13 bp, D. melanogaster
tgtgtacacattt

SEQ ID NO: 660120 - DNA, 13 bp, D. melanogaster
tgtgtacataaat

SEQ ID NO: 660121 - DNA, 14 bp, D. melanogaster
tgtgtacataaata

SEQ ID NO: 660122 - DNA, 13 bp, D. melanogaster
tgtgtacatataa

SEQ ID NO: 660123 - DNA, 13 bp, D. melanogaster
tgtgtacatatat

SEQ ID NO: 660124 - DNA, 14 bp, D. melanogaster
tgtgtacatatatg

SEQ ID NO: 660125 - DNA, 14 bp, D. melanogaster
tgtgtacatatatt

SEQ ID NO: 660126 - DNA, 14 bp, D. melanogaster
tgtgtacatatgta

SEQ ID NO: 660127 - DNA, 13 bp, D. melanogaster
tgtgtacatattt

SEQ ID NO: 660128 - DNA, 13 bp, D. melanogaster
tgtgtacatgtgt

SEQ ID NO: 660129 - DNA, 13 bp, D. melanogaster
tgtgtacatttgt

SEQ ID NO: 660130 - DNA, 13 bp, D. melanogaster
tgtgtacattttt

SEQ ID NO: 660131 - DNA, 13 bp, D. melanogaster
tgtgtacgtgtgc

SEQ ID NO: 660132 - DNA, 13 bp, D. melanogaster
tgtgtacgtgtgt

SEQ ID NO: 660133 - DNA, 13 bp, D. melanogaster
tgtgtactttgtg

SEQ ID NO: 660134 - DNA, 13 bp, D. melanogaster
tgtgtagtagttt

SEQ ID NO: 660135 - DNA, 13 bp, D. melanogaster
tgtgtagtttttc

SEQ ID NO: 660136 - DNA, 13 bp, D. melanogaster
tgtgtataataaa

SEQ ID NO: 660137 - DNA, 13 bp, D. melanogaster
tgtgtataattaa

SEQ ID NO: 660138 - DNA, 13 bp, D. melanogaster
tgtgtatacaaaa

SEQ ID NO: 660139 - DNA, 13 bp, D. melanogaster
tgtgtatacatat

SEQ ID NO: 660140 - DNA, 13 bp, D. melanogaster
tgtgtatataaat

SEQ ID NO: 660141 - DNA, 14 bp, D. melanogaster
tgtgtatataaata

SEQ ID NO: 660142 - DNA, 13 bp, D. melanogaster
tgtgtatataatt

SEQ ID NO: 660143 - DNA, 13 bp, D. melanogaster
tgtgtatatatag

SEQ ID NO: 660144 - DNA, 14 bp, D. melanogaster
tgtgtatatatatt

SEQ ID NO: 660145 - DNA, 13 bp, D. melanogaster
tgtgtatatatgt

SEQ ID NO: 660146 - DNA, 14 bp, D. melanogaster
tgtgtatatatgta

SEQ ID NO: 660147 - DNA, 13 bp, D. melanogaster
tgtgtatatatta

SEQ ID NO: 660148 - DNA, 13 bp, D. melanogaster
tgtgtatatctat

SEQ ID NO: 660149 - DNA, 13 bp, D. melanogaster
tgtgtatatgaaa

SEQ ID NO: 660150 - DNA, 13 bp, D. melanogaster
tgtgtatatgcat

SEQ ID NO: 660151 - DNA, 13 bp, D. melanogaster
tgtgtatatgtac

SEQ ID NO: 660152 - DNA, 13 bp, D. melanogaster
tgtgtatatgtgt

SEQ ID NO: 660153 - DNA, 13 bp, D. melanogaster
tgtgtatatttaa

SEQ ID NO: 660154 - DNA, 13 bp, D. melanogaster
tgtgtatattttc

SEQ ID NO: 660155 - DNA, 14 bp, D. melanogaster
tgtgtatctgtatc

SEQ ID NO: 660156 - DNA, 13 bp, D. melanogaster
tgtgtatctgtgt

SEQ ID NO: 660157 - DNA, 14 bp, D. melanogaster
tgtgtatctgtgtg

SEQ ID NO: 660158 - DNA, 14 bp, D. melanogaster
tgtgtatctgtgtt

SEQ ID NO: 660159 - DNA, 13 bp, D. melanogaster
tgtgtatctttgt

SEQ ID NO: 660160 - DNA, 13 bp, D. melanogaster
tgtgtatgtatgg

SEQ ID NO: 660161 - DNA, 13 bp, D. melanogaster
tgtgtatgtatgt

SEQ ID NO: 660162 - DNA, 14 bp, D. melanogaster
tgtgtatgtatgta

SEQ ID NO: 660163 - DNA, 14 bp, D. melanogaster
tgtgtatgtatgtg

SEQ ID NO: 660164 - DNA, 13 bp, D. melanogaster
tgtgtatgtattg

SEQ ID NO: 660165 - DNA, 13 bp, D. melanogaster
tgtgtatgtgtac

SEQ ID NO: 660166 - DNA, 13 bp, D. melanogaster
tgtgtatgtgtat

SEQ ID NO: 660167 - DNA, 14 bp, D. melanogaster
tgtgtatgtgtatg

SEQ ID NO: 660168 - DNA, 13 bp, D. melanogaster
tgtgtatgtgtga

SEQ ID NO: 660169 - DNA, 13 bp, D. melanogaster
tgtgtatgtgtgc

SEQ ID NO: 660170 - DNA, 14 bp, D. melanogaster
tgtgtatgtgtgca

SEQ ID NO: 660171 - DNA, 14 bp, D. melanogaster
tgtgtatgtgtgta

SEQ ID NO: 660172 - DNA, 14 bp, D. melanogaster
tgtgtatgtgtgtc

SEQ ID NO: 660173 - DNA, 13 bp, D. melanogaster
tgtgtatgttttc

SEQ ID NO: 660174 - DNA, 13 bp, D. melanogaster
tgtgtattaaatt

SEQ ID NO: 660175 - DNA, 13 bp, D. melanogaster
tgtgtattgctaa

SEQ ID NO: 660176 - DNA, 13 bp, D. melanogaster
tgtgtatttgtgc

SEQ ID NO: 660177 - DNA, 13 bp, D. melanogaster
tgtgtatttttgc

SEQ ID NO: 660178 - DNA, 13 bp, D. melanogaster
tgtgtcaaaaatg

SEQ ID NO: 660179 - DNA, 13 bp, D. melanogaster
tgtgtcacacgaa

SEQ ID NO: 660180 - DNA, 13 bp, D. melanogaster
tgtgtcagtgtgt

SEQ ID NO: 660181 - DNA, 13 bp, D. melanogaster
tgtgtccacaaca

SEQ ID NO: 660182 - DNA, 13 bp, D. melanogaster
tgtgtcccaaaaa

SEQ ID NO: 660183 - DNA, 13 bp, D. melanogaster
tgtgtccgtgtcc

SEQ ID NO: 660184 - DNA, 13 bp, D. melanogaster
tgtgtcctgtgtc

SEQ ID NO: 660185 - DNA, 14 bp, D. melanogaster
tgtgtcctgtgtcc

SEQ ID NO: 660186 - DNA, 13 bp, D. melanogaster
tgtgtcctgtgtg

SEQ ID NO: 660187 - DNA, 13 bp, D. melanogaster
tgtgtcgcattta

SEQ ID NO: 660188 - DNA, 13 bp, D. melanogaster
tgtgtcgccaaag

SEQ ID NO: 660189 - DNA, 14 bp, D. melanogaster
tgtgtcgccaaagg

SEQ ID NO: 660190 - DNA, 13 bp, D. melanogaster
tgtgtctaatttt

SEQ ID NO: 660191 - DNA, 13 bp, D. melanogaster
tgtgtctagaagg

SEQ ID NO: 660192 - DNA, 13 bp, D. melanogaster
tgtgtctatgtgt

SEQ ID NO: 660193 - DNA, 14 bp, D. melanogaster
tgtgtctatgtgtg

SEQ ID NO: 660194 - DNA, 13 bp, D. melanogaster
tgtgtctgcgtct

SEQ ID NO: 660195 - DNA, 13 bp, D. melanogaster
tgtgtctgcgtgt

SEQ ID NO: 660196 - DNA, 13 bp, D. melanogaster
tgtgtctgtactt

SEQ ID NO: 660197 - DNA, 13 bp, D. melanogaster
tgtgtctgtatct

SEQ ID NO: 660198 - DNA, 13 bp, D. melanogaster
tgtgtctgtatgt

SEQ ID NO: 660199 - DNA, 13 bp, D. melanogaster
tgtgtctgtgagt

SEQ ID NO: 660200 - DNA, 13 bp, D. melanogaster
tgtgtctgtgcgt

SEQ ID NO: 660201 - DNA, 13 bp, D. melanogaster
tgtgtctgtgtat

SEQ ID NO: 660202 - DNA, 13 bp, D. melanogaster
tgtgtctgtgtgc

SEQ ID NO: 660203 - DNA, 14 bp, D. melanogaster
tgtgtctgtgtgcc

SEQ ID NO: 660204 - DNA, 14 bp, D. melanogaster
tgtgtctgtgtgtc

SEQ ID NO: 660205 - DNA, 13 bp, D. melanogaster
tgtgtgaaaaagt

SEQ ID NO: 660206 - DNA, 13 bp, D. melanogaster
tgtgtgaaaaatc

SEQ ID NO: 660207 - DNA, 13 bp, D. melanogaster
tgtgtgaaaatat

SEQ ID NO: 660208 - DNA, 13 bp, D. melanogaster
tgtgtgaaaattg

SEQ ID NO: 660209 - DNA, 13 bp, D. melanogaster
tgtgtgaaaattt

SEQ ID NO: 660210 - DNA, 13 bp, D. melanogaster
tgtgtgaaagtgt

SEQ ID NO: 660211 - DNA, 13 bp, D. melanogaster
tgtgtgaaatgtg

SEQ ID NO: 660212 - DNA, 13 bp, D. melanogaster
tgtgtgaaatttc

SEQ ID NO: 660213 - DNA, 13 bp, D. melanogaster
tgtgtgaaatttt

SEQ ID NO: 660214 - DNA, 13 bp, D. melanogaster
tgtgtgaatgtga

SEQ ID NO: 660215 - DNA, 13 bp, D. melanogaster
tgtgtgaatgtgt

SEQ ID NO: 660216 - DNA, 13 bp, D. melanogaster
tgtgtgacaaatg

SEQ ID NO: 660217 - DNA, 13 bp, D. melanogaster
tgtgtgacatttg

SEQ ID NO: 660218 - DNA, 13 bp, D. melanogaster
tgtgtgagagtgt

SEQ ID NO: 660219 - DNA, 14 bp, D. melanogaster
tgtgtgagagtgtg

SEQ ID NO: 660220 - DNA, 13 bp, D. melanogaster
tgtgtgagcgagt

SEQ ID NO: 660221 - DNA, 13 bp, D. melanogaster
tgtgtgagcggca

SEQ ID NO: 660222 - DNA, 13 bp, D. melanogaster
tgtgtgagtatct

SEQ ID NO: 660223 - DNA, 13 bp, D. melanogaster
tgtgtgagtgcat

SEQ ID NO: 660224 - DNA, 13 bp, D. melanogaster
tgtgtgagtgcgg

SEQ ID NO: 660225 - DNA, 13 bp, D. melanogaster
tgtgtgagtggat

SEQ ID NO: 660226 - DNA, 13 bp, D. melanogaster
tgtgtgagtggct

SEQ ID NO: 660227 - DNA, 13 bp, D. melanogaster
tgtgtgagtgtga

SEQ ID NO: 660228 - DNA, 14 bp, D. melanogaster
tgtgtgagtgtgag

SEQ ID NO: 660229 - DNA, 13 bp, D. melanogaster
tgtgtgcaaaaaa

SEQ ID NO: 660230 - DNA, 13 bp, D. melanogaster
tgtgtgcaaaagt

SEQ ID NO: 660231 - DNA, 13 bp, D. melanogaster
tgtgtgcaaacaa

SEQ ID NO: 660232 - DNA, 13 bp, D. melanogaster
tgtgtgcaaatat

SEQ ID NO: 660233 - DNA, 14 bp, D. melanogaster
tgtgtgcaagtgtg

SEQ ID NO: 660234 - DNA, 13 bp, D. melanogaster
tgtgtgcaataaa

SEQ ID NO: 660235 - DNA, 13 bp, D. melanogaster
tgtgtgcaatttt

SEQ ID NO: 660236 - DNA, 13 bp, D. melanogaster
tgtgtgcacaaaa

SEQ ID NO: 660237 - DNA, 13 bp, D. melanogaster
tgtgtgcacacac

SEQ ID NO: 660238 - DNA, 13 bp, D. melanogaster
tgtgtgcactgag

SEQ ID NO: 660239 - DNA, 13 bp, D. melanogaster
tgtgtgcactgca

SEQ ID NO: 660240 - DNA, 13 bp, D. melanogaster
tgtgtgcacttca

SEQ ID NO: 660241 - DNA, 13 bp, D. melanogaster
tgtgtgcacttta

SEQ ID NO: 660242 - DNA, 13 bp, D. melanogaster
tgtgtgcagctca

SEQ ID NO: 660243 - DNA, 13 bp, D. melanogaster
tgtgtgcagtttt

SEQ ID NO: 660244 - DNA, 13 bp, D. melanogaster
tgtgtgcataatt

SEQ ID NO: 660245 - DNA, 13 bp, D. melanogaster
tgtgtgcatatat

SEQ ID NO: 660246 - DNA, 13 bp, D. melanogaster
tgtgtgcatattt

SEQ ID NO: 660247 - DNA, 13 bp, D. melanogaster
tgtgtgcatctgt

SEQ ID NO: 660248 - DNA, 13 bp, D. melanogaster
tgtgtgcatgtgc

SEQ ID NO: 660249 - DNA, 13 bp, D. melanogaster
tgtgtgcatgtgg

SEQ ID NO: 660250 - DNA, 14 bp, D. melanogaster
tgtgtgcatgtgta

SEQ ID NO: 660251 - DNA, 14 bp, D. melanogaster
tgtgtgcatgtgtg

SEQ ID NO: 660252 - DNA, 13 bp, D. melanogaster
tgtgtgcattaaa

SEQ ID NO: 660253 - DNA, 13 bp, D. melanogaster
tgtgtgcatttaa

SEQ ID NO: 660254 - DNA, 13 bp, D. melanogaster
tgtgtgcatttat

SEQ ID NO: 660255 - DNA, 13 bp, D. melanogaster
tgtgtgcatttgg

SEQ ID NO: 660256 - DNA, 13 bp, D. melanogaster
tgtgtgcatttta

SEQ ID NO: 660257 - DNA, 13 bp, D. melanogaster
tgtgtgccaaaaa

SEQ ID NO: 660258 - DNA, 13 bp, D. melanogaster
tgtgtgccaaatg

SEQ ID NO: 660259 - DNA, 13 bp, D. melanogaster
tgtgtgccagcca

SEQ ID NO: 660260 - DNA, 13 bp, D. melanogaster
tgtgtgccatgtg

SEQ ID NO: 660261 - DNA, 13 bp, D. melanogaster
tgtgtgccatttg

SEQ ID NO: 660262 - DNA, 13 bp, D. melanogaster
tgtgtgccgtgtg

SEQ ID NO: 660263 - DNA, 13 bp, D. melanogaster
tgtgtgcctgcct

SEQ ID NO: 660264 - DNA, 13 bp, D. melanogaster
tgtgtgcctgtgc

SEQ ID NO: 660265 - DNA, 13 bp, D. melanogaster
tgtgtgccttttg

SEQ ID NO: 660266 - DNA, 13 bp, D. melanogaster
tgtgtgcgaaaag

SEQ ID NO: 660267 - DNA, 13 bp, D. melanogaster
tgtgtgcgaaagt

SEQ ID NO: 660268 - DNA, 13 bp, D. melanogaster
tgtgtgcgaaatt

SEQ ID NO: 660269 - DNA, 13 bp, D. melanogaster
tgtgtgcgaattt

SEQ ID NO: 660270 - DNA, 13 bp, D. melanogaster
tgtgtgcgagagt

SEQ ID NO: 660271 - DNA, 13 bp, D. melanogaster
tgtgtgcgagcga

SEQ ID NO: 660272 - DNA, 13 bp, D. melanogaster
tgtgtgcgagtat

SEQ ID NO: 660273 - DNA, 13 bp, D. melanogaster
tgtgtgcgagtgc

SEQ ID NO: 660274 - DNA, 14 bp, D. melanogaster
tgtgtgcgagtgtt

SEQ ID NO: 660275 - DNA, 13 bp, D. melanogaster
tgtgtgcgagttt

SEQ ID NO: 660276 - DNA, 13 bp, D. melanogaster
tgtgtgcgatttt

SEQ ID NO: 660277 - DNA, 13 bp, D. melanogaster
tgtgtgcgcattt

SEQ ID NO: 660278 - DNA, 13 bp, D. melanogaster
tgtgtgcgcctgt

SEQ ID NO: 660279 - DNA, 13 bp, D. melanogaster
tgtgtgcgcgagt

SEQ ID NO: 660280 - DNA, 14 bp, D. melanogaster
tgtgtgcgcgagtg

SEQ ID NO: 660281 - DNA, 13 bp, D. melanogaster
tgtgtgcgcgctt

SEQ ID NO: 660282 - DNA, 13 bp, D. melanogaster
tgtgtgcgcttgt

SEQ ID NO: 660283 - DNA, 14 bp, D. melanogaster
tgtgtgcgcttgtg

SEQ ID NO: 660284 - DNA, 13 bp, D. melanogaster
tgtgtgcgctttt

SEQ ID NO: 660285 - DNA, 13 bp, D. melanogaster
tgtgtgcggcaaa

SEQ ID NO: 660286 - DNA, 13 bp, D. melanogaster
tgtgtgcggcttt

SEQ ID NO: 660287 - DNA, 14 bp, D. melanogaster
tgtgtgcgtatgtg

SEQ ID NO: 660288 - DNA, 13 bp, D. melanogaster
tgtgtgcgtctgt

SEQ ID NO: 660289 - DNA, 14 bp, D. melanogaster
tgtgtgcgtctgtg

SEQ ID NO: 660290 - DNA, 13 bp, D. melanogaster
tgtgtgcgtgaga

SEQ ID NO: 660291 - DNA, 13 bp, D. melanogaster
tgtgtgcgtgagt

SEQ ID NO: 660292 - DNA, 14 bp, D. melanogaster
tgtgtgcgtgagtt

SEQ ID NO: 660293 - DNA, 13 bp, D. melanogaster
tgtgtgcgtgccg

SEQ ID NO: 660294 - DNA, 13 bp, D. melanogaster
tgtgtgcgtgcgt

SEQ ID NO: 660295 - DNA, 13 bp, D. melanogaster
tgtgtgcgtgctt

SEQ ID NO: 660296 - DNA, 14 bp, D. melanogaster
tgtgtgcgtgcttg

SEQ ID NO: 660297 - DNA, 13 bp, D. melanogaster
tgtgtgcgtggca

SEQ ID NO: 660298 - DNA, 13 bp, D. melanogaster
tgtgtgcgtgggc

SEQ ID NO: 660299 - DNA, 13 bp, D. melanogaster
tgtgtgcgtgtgc

SEQ ID NO: 660300 - DNA, 14 bp, D. melanogaster
tgtgtgcgtgtgct

SEQ ID NO: 660301 - DNA, 15 bp, D. melanogaster
tgtgtgcgtgtgctt

SEQ ID NO: 660302 - DNA, 14 bp, D. melanogaster
tgtgtgcgtgtggc

SEQ ID NO: 660303 - DNA, 13 bp, D. melanogaster
tgtgtgcgtgttc

SEQ ID NO: 660304 - DNA, 13 bp, D. melanogaster
tgtgtgcgttgcg

SEQ ID NO: 660305 - DNA, 13 bp, D. melanogaster
tgtgtgcgtttcg

SEQ ID NO: 660306 - DNA, 14 bp, D. melanogaster
tgtgtgctagtgtg

SEQ ID NO: 660307 - DNA, 13 bp, D. melanogaster
tgtgtgctctgtt

SEQ ID NO: 660308 - DNA, 13 bp, D. melanogaster
tgtgtgctctttg

SEQ ID NO: 660309 - DNA, 13 bp, D. melanogaster
tgtgtgctgaaaa

SEQ ID NO: 660310 - DNA, 13 bp, D. melanogaster
tgtgtgctgctgg

SEQ ID NO: 660311 - DNA, 13 bp, D. melanogaster
tgtgtgctgctgt

SEQ ID NO: 660312 - DNA, 13 bp, D. melanogaster
tgtgtgctgcttt

SEQ ID NO: 660313 - DNA, 13 bp, D. melanogaster
tgtgtgctggcaa

SEQ ID NO: 660314 - DNA, 13 bp, D. melanogaster
tgtgtgctggctg

SEQ ID NO: 660315 - DNA, 13 bp, D. melanogaster
tgtgtgcttaatt

SEQ ID NO: 660316 - DNA, 13 bp, D. melanogaster
tgtgtgcttctgt

SEQ ID NO: 660317 - DNA, 13 bp, D. melanogaster
tgtgtgcttgtgc

SEQ ID NO: 660318 - DNA, 13 bp, D. melanogaster
tgtgtgctttaaa

SEQ ID NO: 660319 - DNA, 13 bp, D. melanogaster
tgtgtgctttgca

SEQ ID NO: 660320 - DNA, 13 bp, D. melanogaster
tgtgtggaaaatt

SEQ ID NO: 660321 - DNA, 13 bp, D. melanogaster
tgtgtggatggat

SEQ ID NO: 660322 - DNA, 13 bp, D. melanogaster
tgtgtggcaagtt

SEQ ID NO: 660323 - DNA, 13 bp, D. melanogaster
tgtgtggcagtgg

SEQ ID NO: 660324 - DNA, 13 bp, D. melanogaster
tgtgtggcatatt

SEQ ID NO: 660325 - DNA, 13 bp, D. melanogaster
tgtgtgggtgagc

SEQ ID NO: 660326 - DNA, 13 bp, D. melanogaster
tgtgtgggtgcga

SEQ ID NO: 660327 - DNA, 13 bp, D. melanogaster
tgtgtgtaaaaat

SEQ ID NO: 660328 - DNA, 13 bp, D. melanogaster
tgtgtgtaaacaa

SEQ ID NO: 660329 - DNA, 13 bp, D. melanogaster
tgtgtgtaaataa

SEQ ID NO: 660330 - DNA, 13 bp, D. melanogaster
tgtgtgtaagtat

SEQ ID NO: 660331 - DNA, 13 bp, D. melanogaster
tgtgtgtaagtgc

SEQ ID NO: 660332 - DNA, 13 bp, D. melanogaster
tgtgtgtaagtgt

SEQ ID NO: 660333 - DNA, 13 bp, D. melanogaster
tgtgtgtaataaa

SEQ ID NO: 660334 - DNA, 13 bp, D. melanogaster
tgtgtgtaatctt

SEQ ID NO: 660335 - DNA, 13 bp, D. melanogaster
tgtgtgtaatgtg

SEQ ID NO: 660336 - DNA, 13 bp, D. melanogaster
tgtgtgtaatttg

SEQ ID NO: 660337 - DNA, 13 bp, D. melanogaster
tgtgtgtacattt

SEQ ID NO: 660338 - DNA, 13 bp, D. melanogaster
tgtgtgtacgtgt

SEQ ID NO: 660339 - DNA, 13 bp, D. melanogaster
tgtgtgtataaaa

SEQ ID NO: 660340 - DNA, 13 bp, D. melanogaster
tgtgtgtataaat

SEQ ID NO: 660341 - DNA, 13 bp, D. melanogaster
tgtgtgtataatt

SEQ ID NO: 660342 - DNA, 13 bp, D. melanogaster
tgtgtgtatacat

SEQ ID NO: 660343 - DNA, 14 bp, D. melanogaster
tgtgtgtatacata

SEQ ID NO: 660344 - DNA, 13 bp, D. melanogaster
tgtgtgtatgcgg

SEQ ID NO: 660345 - DNA, 14 bp, D. melanogaster
tgtgtgtatgtaca

SEQ ID NO: 660346 - DNA, 13 bp, D. melanogaster
tgtgtgtatgtat

SEQ ID NO: 660347 - DNA, 13 bp, D. melanogaster
tgtgtgtatgtga

SEQ ID NO: 660348 - DNA, 13 bp, D. melanogaster
tgtgtgtatgtgc

SEQ ID NO: 660349 - DNA, 13 bp, D. melanogaster
tgtgtgtatttaa

SEQ ID NO: 660350 - DNA, 13 bp, D. melanogaster
tgtgtgtatttct

SEQ ID NO: 660351 - DNA, 13 bp, D. melanogaster
tgtgtgtatttga

SEQ ID NO: 660352 - DNA, 13 bp, D. melanogaster
tgtgtgtcaagtg

SEQ ID NO: 660353 - DNA, 13 bp, D. melanogaster
tgtgtgtcagtgt

SEQ ID NO: 660354 - DNA, 13 bp, D. melanogaster
tgtgtgtctgctt

SEQ ID NO: 660355 - DNA, 13 bp, D. melanogaster
tgtgtgtctgtct

SEQ ID NO: 660356 - DNA, 14 bp, D. melanogaster
tgtgtgtctgtctg

SEQ ID NO: 660357 - DNA, 13 bp, D. melanogaster
tgtgtgtctgtgc

SEQ ID NO: 660358 - DNA, 13 bp, D. melanogaster
tgtgtgtgaatat

SEQ ID NO: 660359 - DNA, 13 bp, D. melanogaster
tgtgtgtgaattt

SEQ ID NO: 660360 - DNA, 13 bp, D. melanogaster
tgtgtgtgagagg

SEQ ID NO: 660361 - DNA, 13 bp, D. melanogaster
tgtgtgtgagcaa

SEQ ID NO: 660362 - DNA, 13 bp, D. melanogaster
tgtgtgtgagcag

SEQ ID NO: 660363 - DNA, 13 bp, D. melanogaster
tgtgtgtgagcat

SEQ ID NO: 660364 - DNA, 13 bp, D. melanogaster
tgtgtgtgagcct

SEQ ID NO: 660365 - DNA, 13 bp, D. melanogaster
tgtgtgtgagcgt

SEQ ID NO: 660366 - DNA, 13 bp, D. melanogaster
tgtgtgtgaggga

SEQ ID NO: 660367 - DNA, 13 bp, D. melanogaster
tgtgtgtgagtcg

SEQ ID NO: 660368 - DNA, 13 bp, D. melanogaster
tgtgtgtgcaaat

SEQ ID NO: 660369 - DNA, 13 bp, D. melanogaster
tgtgtgtgcacat

SEQ ID NO: 660370 - DNA, 13 bp, D. melanogaster
tgtgtgtgcagaa

SEQ ID NO: 660371 - DNA, 13 bp, D. melanogaster
tgtgtgtgcataa

SEQ ID NO: 660372 - DNA, 13 bp, D. melanogaster
tgtgtgtgcatgc

SEQ ID NO: 660373 - DNA, 13 bp, D. melanogaster
tgtgtgtgcattc

SEQ ID NO: 660374 - DNA, 13 bp, D. melanogaster
tgtgtgtgcattg

SEQ ID NO: 660375 - DNA, 13 bp, D. melanogaster
tgtgtgtgcattt

SEQ ID NO: 660376 - DNA, 13 bp, D. melanogaster
tgtgtgtgccact

SEQ ID NO: 660377 - DNA, 13 bp, D. melanogaster
tgtgtgtgccagc

SEQ ID NO: 660378 - DNA, 13 bp, D. melanogaster
tgtgtgtgcccat

SEQ ID NO: 660379 - DNA, 13 bp, D. melanogaster
tgtgtgtgccgca

SEQ ID NO: 660380 - DNA, 13 bp, D. melanogaster
tgtgtgtgccggt

SEQ ID NO: 660381 - DNA, 13 bp, D. melanogaster
tgtgtgtgcctgc

SEQ ID NO: 660382 - DNA, 13 bp, D. melanogaster
tgtgtgtgcctgt

SEQ ID NO: 660383 - DNA, 13 bp, D. melanogaster
tgtgtgtgcgaaa

SEQ ID NO: 660384 - DNA, 13 bp, D. melanogaster
tgtgtgtgcgagg

SEQ ID NO: 660385 - DNA, 13 bp, D. melanogaster
tgtgtgtgcgatt

SEQ ID NO: 660386 - DNA, 13 bp, D. melanogaster
tgtgtgtgcgcct

SEQ ID NO: 660387 - DNA, 14 bp, D. melanogaster
tgtgtgtgcgcctt

SEQ ID NO: 660388 - DNA, 13 bp, D. melanogaster
tgtgtgtgcgcgc

SEQ ID NO: 660389 - DNA, 14 bp, D. melanogaster
tgtgtgtgcgcgcg

SEQ ID NO: 660390 - DNA, 13 bp, D. melanogaster
tgtgtgtgcgctg

SEQ ID NO: 660391 - DNA, 13 bp, D. melanogaster
tgtgtgtgcggcg

SEQ ID NO: 660392 - DNA, 13 bp, D. melanogaster
tgtgtgtgcggct

SEQ ID NO: 660393 - DNA, 13 bp, D. melanogaster
tgtgtgtgcggga

SEQ ID NO: 660394 - DNA, 13 bp, D. melanogaster
tgtgtgtgcgtga

SEQ ID NO: 660395 - DNA, 13 bp, D. melanogaster
tgtgtgtgcgtgc

SEQ ID NO: 660396 - DNA, 14 bp, D. melanogaster
tgtgtgtgcgtgca

SEQ ID NO: 660397 - DNA, 14 bp, D. melanogaster
tgtgtgtgcgtgcc

SEQ ID NO: 660398 - DNA, 14 bp, D. melanogaster
tgtgtgtgcgtgct

SEQ ID NO: 660399 - DNA, 14 bp, D. melanogaster
tgtgtgtgcgtgta

SEQ ID NO: 660400 - DNA, 14 bp, D. melanogaster
tgtgtgtgcgtgtc

SEQ ID NO: 660401 - DNA, 14 bp, D. melanogaster
tgtgtgtgcgtttc

SEQ ID NO: 660402 - DNA, 13 bp, D. melanogaster
tgtgtgtgctatg

SEQ ID NO: 660403 - DNA, 13 bp, D. melanogaster
tgtgtgtgctcat

SEQ ID NO: 660404 - DNA, 13 bp, D. melanogaster
tgtgtgtgctcgt

SEQ ID NO: 660405 - DNA, 13 bp, D. melanogaster
tgtgtgtgctctc

SEQ ID NO: 660406 - DNA, 13 bp, D. melanogaster
tgtgtgtgctgca

SEQ ID NO: 660407 - DNA, 13 bp, D. melanogaster
tgtgtgtgcttaa

SEQ ID NO: 660408 - DNA, 13 bp, D. melanogaster
tgtgtgtgcttct

SEQ ID NO: 660409 - DNA, 13 bp, D. melanogaster
tgtgtgtgctttc

SEQ ID NO: 660410 - DNA, 14 bp, D. melanogaster
tgtgtgtggaaaaa

SEQ ID NO: 660411 - DNA, 14 bp, D. melanogaster
tgtgtgtggaaaat

SEQ ID NO: 660412 - DNA, 13 bp, D. melanogaster
tgtgtgtggaaat

SEQ ID NO: 660413 - DNA, 13 bp, D. melanogaster
tgtgtgtggaagt

SEQ ID NO: 660414 - DNA, 13 bp, D. melanogaster
tgtgtgtggcaag

SEQ ID NO: 660415 - DNA, 13 bp, D. melanogaster
tgtgtgtggcaat

SEQ ID NO: 660416 - DNA, 13 bp, D. melanogaster
tgtgtgtggcagg

SEQ ID NO: 660417 - DNA, 13 bp, D. melanogaster
tgtgtgtggcatg

SEQ ID NO: 660418 - DNA, 13 bp, D. melanogaster
tgtgtgtggcatt

SEQ ID NO: 660419 - DNA, 13 bp, D. melanogaster
tgtgtgtgggaaa

SEQ ID NO: 660420 - DNA, 13 bp, D. melanogaster
tgtgtgtgggcaa

SEQ ID NO: 660421 - DNA, 13 bp, D. melanogaster
tgtgtgtggggaa

SEQ ID NO: 660422 - DNA, 13 bp, D. melanogaster
tgtgtgtgggtaa

SEQ ID NO: 660423 - DNA, 13 bp, D. melanogaster
tgtgtgtggtaaa

SEQ ID NO: 660424 - DNA, 13 bp, D. melanogaster
tgtgtgtgtaaat

SEQ ID NO: 660425 - DNA, 13 bp, D. melanogaster
tgtgtgtgtaatg

SEQ ID NO: 660426 - DNA, 13 bp, D. melanogaster
tgtgtgtgtactt

SEQ ID NO: 660427 - DNA, 13 bp, D. melanogaster
tgtgtgtgtagat

SEQ ID NO: 660428 - DNA, 13 bp, D. melanogaster
tgtgtgtgtatac

SEQ ID NO: 660429 - DNA, 13 bp, D. melanogaster
tgtgtgtgtatat

SEQ ID NO: 660430 - DNA, 14 bp, D. melanogaster
tgtgtgtgtatatg

SEQ ID NO: 660431 - DNA, 13 bp, D. melanogaster
tgtgtgtgtatcc

SEQ ID NO: 660432 - DNA, 13 bp, D. melanogaster
tgtgtgtgtatga

SEQ ID NO: 660433 - DNA, 13 bp, D. melanogaster
tgtgtgtgtatgc

SEQ ID NO: 660434 - DNA, 14 bp, D. melanogaster
tgtgtgtgtatgta

SEQ ID NO: 660435 - DNA, 13 bp, D. melanogaster
tgtgtgtgtatta

SEQ ID NO: 660436 - DNA, 13 bp, D. melanogaster
tgtgtgtgtcagc

SEQ ID NO: 660437 - DNA, 13 bp, D. melanogaster
tgtgtgtgtctat

SEQ ID NO: 660438 - DNA, 13 bp, D. melanogaster
tgtgtgtgtctgc

SEQ ID NO: 660439 - DNA, 14 bp, D. melanogaster
tgtgtgtgtctgtc

SEQ ID NO: 660440 - DNA, 13 bp, D. melanogaster
tgtgtgtgtgaag

SEQ ID NO: 660441 - DNA, 13 bp, D. melanogaster
tgtgtgtgtgaca

SEQ ID NO: 660442 - DNA, 13 bp, D. melanogaster
tgtgtgtgtgacc

SEQ ID NO: 660443 - DNA, 14 bp, D. melanogaster
tgtgtgtgtgagaa

SEQ ID NO: 660444 - DNA, 15 bp, D. melanogaster
tgtgtgtgtgagagt

SEQ ID NO: 660445 - DNA, 13 bp, D. melanogaster
tgtgtgtgtgagc

SEQ ID NO: 660446 - DNA, 14 bp, D. melanogaster
tgtgtgtgtgagcc

SEQ ID NO: 660447 - DNA, 14 bp, D. melanogaster
tgtgtgtgtgcaaa

SEQ ID NO: 660448 - DNA, 14 bp, D. melanogaster
tgtgtgtgtgcaac

SEQ ID NO: 660449 - DNA, 14 bp, D. melanogaster
tgtgtgtgtgcaag

SEQ ID NO: 660450 - DNA, 13 bp, D. melanogaster
tgtgtgtgtgcac

SEQ ID NO: 660451 - DNA, 14 bp, D. melanogaster
tgtgtgtgtgcaca

SEQ ID NO: 660452 - DNA, 14 bp, D. melanogaster
tgtgtgtgtgcagt

SEQ ID NO: 660453 - DNA, 14 bp, D. melanogaster
tgtgtgtgtgcata

SEQ ID NO: 660454 - DNA, 14 bp, D. melanogaster
tgtgtgtgtgcatc

SEQ ID NO: 660455 - DNA, 14 bp, D. melanogaster
tgtgtgtgtgccaa

SEQ ID NO: 660456 - DNA, 13 bp, D. melanogaster
tgtgtgtgtgccc

SEQ ID NO: 660457 - DNA, 14 bp, D. melanogaster
tgtgtgtgtgccca

SEQ ID NO: 660458 - DNA, 13 bp, D. melanogaster
tgtgtgtgtgcct

SEQ ID NO: 660459 - DNA, 14 bp, D. melanogaster
tgtgtgtgtgcctc

SEQ ID NO: 660460 - DNA, 13 bp, D. melanogaster
tgtgtgtgtgcgc

SEQ ID NO: 660461 - DNA, 14 bp, D. melanogaster
tgtgtgtgtgcgca

SEQ ID NO: 660462 - DNA, 14 bp, D. melanogaster
tgtgtgtgtgcgcc

SEQ ID NO: 660463 - DNA, 14 bp, D. melanogaster
tgtgtgtgtgctag

SEQ ID NO: 660464 - DNA, 14 bp, D. melanogaster
tgtgtgtgtgctcc

SEQ ID NO: 660465 - DNA, 14 bp, D. melanogaster
tgtgtgtgtgctgc

SEQ ID NO: 660466 - DNA, 14 bp, D. melanogaster
tgtgtgtgtgctta

SEQ ID NO: 660467 - DNA, 14 bp, D. melanogaster
tgtgtgtgtggaaa

SEQ ID NO: 660468 - DNA, 13 bp, D. melanogaster
tgtgtgtgtggca

SEQ ID NO: 660469 - DNA, 14 bp, D. melanogaster
tgtgtgtgtggcac

SEQ ID NO: 660470 - DNA, 14 bp, D. melanogaster
tgtgtgtgtggcag

SEQ ID NO: 660471 - DNA, 14 bp, D. melanogaster
tgtgtgtgtggcca

SEQ ID NO: 660472 - DNA, 14 bp, D. melanogaster
tgtgtgtgtgtaaa

SEQ ID NO: 660473 - DNA, 14 bp, D. melanogaster
tgtgtgtgtgtaag

SEQ ID NO: 660474 - DNA, 14 bp, D. melanogaster
tgtgtgtgtgtaat

SEQ ID NO: 660475 - DNA, 14 bp, D. melanogaster
tgtgtgtgtgtaca

SEQ ID NO: 660476 - DNA, 14 bp, D. melanogaster
tgtgtgtgtgtacc

SEQ ID NO: 660477 - DNA, 14 bp, D. melanogaster
tgtgtgtgtgtaga

SEQ ID NO: 660478 - DNA, 14 bp, D. melanogaster
tgtgtgtgtgtatc

SEQ ID NO: 660479 - DNA, 13 bp, D. melanogaster
tgtgtgtgtgtcc

SEQ ID NO: 660480 - DNA, 14 bp, D. melanogaster
tgtgtgtgtgtctc

SEQ ID NO: 660481 - DNA, 15 bp, D. melanogaster
tgtgtgtgtgtgcac

SEQ ID NO: 660482 - DNA, 13 bp, D. melanogaster
tgtgtgtgttcca

SEQ ID NO: 660483 - DNA, 14 bp, D. melanogaster
tgtgtgtgttccat

SEQ ID NO: 660484 - DNA, 13 bp, D. melanogaster
tgtgtgtgttgca

SEQ ID NO: 660485 - DNA, 13 bp, D. melanogaster
tgtgtgtgttgcc

SEQ ID NO: 660486 - DNA, 13 bp, D. melanogaster
tgtgtgttcattt

SEQ ID NO: 660487 - DNA, 13 bp, D. melanogaster
tgtgtgttccatt

SEQ ID NO: 660488 - DNA, 13 bp, D. melanogaster
tgtgtgttgcaat

SEQ ID NO: 660489 - DNA, 13 bp, D. melanogaster
tgtgtgttgcatg

SEQ ID NO: 660490 - DNA, 14 bp, D. melanogaster
tgtgtgttggccaa

SEQ ID NO: 660491 - DNA, 13 bp, D. melanogaster
tgtgtgtttaagt

SEQ ID NO: 660492 - DNA, 13 bp, D. melanogaster
tgtgtgtttatct

SEQ ID NO: 660493 - DNA, 13 bp, D. melanogaster
tgtgtgtttcatt

SEQ ID NO: 660494 - DNA, 14 bp, D. melanogaster
tgtgtgtttgcata

SEQ ID NO: 660495 - DNA, 13 bp, D. melanogaster
tgtgtgtttgccc

SEQ ID NO: 660496 - DNA, 13 bp, D. melanogaster
tgtgtgtttgcct

SEQ ID NO: 660497 - DNA, 13 bp, D. melanogaster
tgtgtgtttggaa

SEQ ID NO: 660498 - DNA, 13 bp, D. melanogaster
tgtgtgttttagc

SEQ ID NO: 660499 - DNA, 14 bp, D. melanogaster
tgtgtgttttggcc

SEQ ID NO: 660500 - DNA, 13 bp, D. melanogaster
tgtgtgtttttca

SEQ ID NO: 660501 - DNA, 13 bp, D. melanogaster
tgtgttaaaattt

SEQ ID NO: 660502 - DNA, 13 bp, D. melanogaster
tgtgttaaataaa

SEQ ID NO: 660503 - DNA, 13 bp, D. melanogaster
tgtgttagttatg

SEQ ID NO: 660504 - DNA, 13 bp, D. melanogaster
tgtgttcaaaaaa

SEQ ID NO: 660505 - DNA, 13 bp, D. melanogaster
tgtgttcagaaaa

SEQ ID NO: 660506 - DNA, 13 bp, D. melanogaster
tgtgttcgagtgt

SEQ ID NO: 660507 - DNA, 13 bp, D. melanogaster
tgtgttcttaatt

SEQ ID NO: 660508 - DNA, 13 bp, D. melanogaster
tgtgttcttcata

SEQ ID NO: 660509 - DNA, 13 bp, D. melanogaster
tgtgttgaaacaa

SEQ ID NO: 660510 - DNA, 13 bp, D. melanogaster
tgtgttgaatatt

SEQ ID NO: 660511 - DNA, 13 bp, D. melanogaster
tgtgttgcaaaaa

SEQ ID NO: 660512 - DNA, 13 bp, D. melanogaster
tgtgttgctgctg

SEQ ID NO: 660513 - DNA, 14 bp, D. melanogaster
tgtgttgctgctgc

SEQ ID NO: 660514 - DNA, 13 bp, D. melanogaster
tgtgttggccaaa

SEQ ID NO: 660515 - DNA, 13 bp, D. melanogaster
tgtgttggctctg

SEQ ID NO: 660516 - DNA, 13 bp, D. melanogaster
tgtgttgtctgta

SEQ ID NO: 660517 - DNA, 13 bp, D. melanogaster
tgtgtttaaatat

SEQ ID NO: 660518 - DNA, 13 bp, D. melanogaster
tgtgtttaacggt

SEQ ID NO: 660519 - DNA, 13 bp, D. melanogaster
tgtgtttacattt

SEQ ID NO: 660520 - DNA, 14 bp, D. melanogaster
tgtgtttatacaat

SEQ ID NO: 660521 - DNA, 14 bp, D. melanogaster
tgtgtttattttca

SEQ ID NO: 660522 - DNA, 13 bp, D. melanogaster
tgtgtttccattt

SEQ ID NO: 660523 - DNA, 13 bp, D. melanogaster
tgtgtttgaaatg

SEQ ID NO: 660524 - DNA, 13 bp, D. melanogaster
tgtgtttgccaat

SEQ ID NO: 660525 - DNA, 13 bp, D. melanogaster
tgtgtttgccatt

SEQ ID NO: 660526 - DNA, 13 bp, D. melanogaster
tgtgtttgcctgt

SEQ ID NO: 660527 - DNA, 13 bp, D. melanogaster
tgtgtttgctgct

SEQ ID NO: 660528 - DNA, 13 bp, D. melanogaster
tgtgtttggaaaa

SEQ ID NO: 660529 - DNA, 13 bp, D. melanogaster
tgtgttttcaaaa

SEQ ID NO: 660530 - DNA, 13 bp, D. melanogaster
tgtgtttttcaca

SEQ ID NO: 660531 - DNA, 13 bp, D. melanogaster
tgtgtttttcgga

SEQ ID NO: 660532 - DNA, 13 bp, D. melanogaster
tgtgtttttgaaa

SEQ ID NO: 660533 - DNA, 13 bp, D. melanogaster
tgtgtttttgcat

SEQ ID NO: 660534 - DNA, 14 bp, D. melanogaster
tgttaaaaaaaaac

SEQ ID NO: 660535 - DNA, 13 bp, D. melanogaster
tgttaaaaaaaac

SEQ ID NO: 660536 - DNA, 13 bp, D. melanogaster
tgttaaaaaatga

SEQ ID NO: 660537 - DNA, 13 bp, D. melanogaster
tgttaaaaagaca

SEQ ID NO: 660538 - DNA, 13 bp, D. melanogaster
tgttaaaaagtta

SEQ ID NO: 660539 - DNA, 13 bp, D. melanogaster
tgttaaaaagttt

SEQ ID NO: 660540 - DNA, 13 bp, D. melanogaster
tgttaaaaatttg

SEQ ID NO: 660541 - DNA, 13 bp, D. melanogaster
tgttaaacaaatg

SEQ ID NO: 660542 - DNA, 13 bp, D. melanogaster
tgttaaacaatgt

SEQ ID NO: 660543 - DNA, 14 bp, D. melanogaster
tgttaaacaatgta

SEQ ID NO: 660544 - DNA, 13 bp, D. melanogaster
tgttaaacaattt

SEQ ID NO: 660545 - DNA, 14 bp, D. melanogaster
tgttaaacataaaa

SEQ ID NO: 660546 - DNA, 13 bp, D. melanogaster
tgttaaacattac

SEQ ID NO: 660547 - DNA, 13 bp, D. melanogaster
tgttaaacattat

SEQ ID NO: 660548 - DNA, 13 bp, D. melanogaster
tgttaaacttttt

SEQ ID NO: 660549 - DNA, 13 bp, D. melanogaster
tgttaaagaattc

SEQ ID NO: 660550 - DNA, 14 bp, D. melanogaster
tgttaaaggttttt

SEQ ID NO: 660551 - DNA, 13 bp, D. melanogaster
tgttaaagtttaa

SEQ ID NO: 660552 - DNA, 13 bp, D. melanogaster
tgttaaagtttta

SEQ ID NO: 660553 - DNA, 13 bp, D. melanogaster
tgttaaagttttc

SEQ ID NO: 660554 - DNA, 13 bp, D. melanogaster
tgttaaatcgcaa

SEQ ID NO: 660555 - DNA, 13 bp, D. melanogaster
tgttaaatgttaa

SEQ ID NO: 660556 - DNA, 13 bp, D. melanogaster
tgttaaatgttca

SEQ ID NO: 660557 - DNA, 13 bp, D. melanogaster
tgttaaattattg

SEQ ID NO: 660558 - DNA, 14 bp, D. melanogaster
tgttaaatttactt

SEQ ID NO: 660559 - DNA, 13 bp, D. melanogaster
tgttaaatttcaa

SEQ ID NO: 660560 - DNA, 14 bp, D. melanogaster
tgttaaatttgaaa

SEQ ID NO: 660561 - DNA, 13 bp, D. melanogaster
tgttaaatttgca

SEQ ID NO: 660562 - DNA, 13 bp, D. melanogaster
tgttaacaaattg

SEQ ID NO: 660563 - DNA, 13 bp, D. melanogaster
tgttaacaattaa

SEQ ID NO: 660564 - DNA, 13 bp, D. melanogaster
tgttaacaattta

SEQ ID NO: 660565 - DNA, 13 bp, D. melanogaster
tgttaacaatttg

SEQ ID NO: 660566 - DNA, 13 bp, D. melanogaster
tgttaaccttttt

SEQ ID NO: 660567 - DNA, 13 bp, D. melanogaster
tgttaactatttt

SEQ ID NO: 660568 - DNA, 13 bp, D. melanogaster
tgttaacttaaat

SEQ ID NO: 660569 - DNA, 15 bp, D. melanogaster
tgttaaggcggagga

SEQ ID NO: 660570 - DNA, 13 bp, D. melanogaster
tgttaataaatgt

SEQ ID NO: 660571 - DNA, 13 bp, D. melanogaster
tgttaatcaaaaa

SEQ ID NO: 660572 - DNA, 13 bp, D. melanogaster
tgttaattaaatg

SEQ ID NO: 660573 - DNA, 13 bp, D. melanogaster
tgttaattaattg

SEQ ID NO: 660574 - DNA, 13 bp, D. melanogaster
tgttaattagttg

SEQ ID NO: 660575 - DNA, 13 bp, D. melanogaster
tgttaattgttaa

SEQ ID NO: 660576 - DNA, 13 bp, D. melanogaster
tgttaatttctct

SEQ ID NO: 660577 - DNA, 13 bp, D. melanogaster
tgttaattttgaa

SEQ ID NO: 660578 - DNA, 13 bp, D. melanogaster
tgttacaaaatat

SEQ ID NO: 660579 - DNA, 13 bp, D. melanogaster
tgttacaaattat

SEQ ID NO: 660580 - DNA, 13 bp, D. melanogaster
tgttacaatttaa

SEQ ID NO: 660581 - DNA, 13 bp, D. melanogaster
tgttacatatttt

SEQ ID NO: 660582 - DNA, 13 bp, D. melanogaster
tgttacattttct

SEQ ID NO: 660583 - DNA, 13 bp, D. melanogaster
tgttaccaaaaaa

SEQ ID NO: 660584 - DNA, 13 bp, D. melanogaster
tgttacccagaaa

SEQ ID NO: 660585 - DNA, 14 bp, D. melanogaster
tgttacctttgtct

SEQ ID NO: 660586 - DNA, 13 bp, D. melanogaster
tgttacgaattca

SEQ ID NO: 660587 - DNA, 13 bp, D. melanogaster
tgttacgcccgaa

SEQ ID NO: 660588 - DNA, 13 bp, D. melanogaster
tgttactgctgct

SEQ ID NO: 660589 - DNA, 13 bp, D. melanogaster
tgttactgttgct

SEQ ID NO: 660590 - DNA, 13 bp, D. melanogaster
tgttactttaaaa

SEQ ID NO: 660591 - DNA, 13 bp, D. melanogaster
tgttagaaaaaat

SEQ ID NO: 660592 - DNA, 13 bp, D. melanogaster
tgttagacaaaaa

SEQ ID NO: 660593 - DNA, 13 bp, D. melanogaster
tgttagccaagtt

SEQ ID NO: 660594 - DNA, 13 bp, D. melanogaster
tgttagtttcaat

SEQ ID NO: 660595 - DNA, 14 bp, D. melanogaster
tgttatacaaaaaa

SEQ ID NO: 660596 - DNA, 13 bp, D. melanogaster
tgttatacattta

SEQ ID NO: 660597 - DNA, 14 bp, D. melanogaster
tgttataccaaaga

SEQ ID NO: 660598 - DNA, 13 bp, D. melanogaster
tgttatacttaat

SEQ ID NO: 660599 - DNA, 13 bp, D. melanogaster
tgttatatacata

SEQ ID NO: 660600 - DNA, 14 bp, D. melanogaster
tgttatatacatat

SEQ ID NO: 660601 - DNA, 14 bp, D. melanogaster
tgttatatactttt

SEQ ID NO: 660602 - DNA, 13 bp, D. melanogaster
tgttatatatgta

SEQ ID NO: 660603 - DNA, 13 bp, D. melanogaster
tgttatatgtata

SEQ ID NO: 660604 - DNA, 13 bp, D. melanogaster
tgttatattaagt

SEQ ID NO: 660605 - DNA, 13 bp, D. melanogaster
tgttatcatcttt

SEQ ID NO: 660606 - DNA, 14 bp, D. melanogaster
tgttatcttaaata

SEQ ID NO: 660607 - DNA, 13 bp, D. melanogaster
tgttatgaaatat

SEQ ID NO: 660608 - DNA, 13 bp, D. melanogaster
tgttatgcaaaaa

SEQ ID NO: 660609 - DNA, 13 bp, D. melanogaster
tgttatgcagttt

SEQ ID NO: 660610 - DNA, 13 bp, D. melanogaster
tgttatgccccac

SEQ ID NO: 660611 - DNA, 14 bp, D. melanogaster
tgttatggtgggca

SEQ ID NO: 660612 - DNA, 13 bp, D. melanogaster
tgttatgtaaatt

SEQ ID NO: 660613 - DNA, 13 bp, D. melanogaster
tgttatgtaattg

SEQ ID NO: 660614 - DNA, 13 bp, D. melanogaster
tgttattaacttt

SEQ ID NO: 660615 - DNA, 13 bp, D. melanogaster
tgttattactatt

SEQ ID NO: 660616 - DNA, 13 bp, D. melanogaster
tgttattatgccg

SEQ ID NO: 660617 - DNA, 13 bp, D. melanogaster
tgttattattgcc

SEQ ID NO: 660618 - DNA, 13 bp, D. melanogaster
tgttattcaaatt

SEQ ID NO: 660619 - DNA, 13 bp, D. melanogaster
tgttattcgtagt

SEQ ID NO: 660620 - DNA, 13 bp, D. melanogaster
tgttattgaaaag

SEQ ID NO: 660621 - DNA, 13 bp, D. melanogaster
tgttattgaaaat

SEQ ID NO: 660622 - DNA, 13 bp, D. melanogaster
tgttattgcagtt

SEQ ID NO: 660623 - DNA, 13 bp, D. melanogaster
tgttattgcattt

SEQ ID NO: 660624 - DNA, 13 bp, D. melanogaster
tgttattgctatt

SEQ ID NO: 660625 - DNA, 13 bp, D. melanogaster
tgttattgctgtt

SEQ ID NO: 660626 - DNA, 13 bp, D. melanogaster
tgttattgttgcc

SEQ ID NO: 660627 - DNA, 14 bp, D. melanogaster
tgttattgttgccg

SEQ ID NO: 660628 - DNA, 13 bp, D. melanogaster
tgttattgttgct

SEQ ID NO: 660629 - DNA, 14 bp, D. melanogaster
tgttattgttgctg

SEQ ID NO: 660630 - DNA, 14 bp, D. melanogaster
tgttattgttgctt

SEQ ID NO: 660631 - DNA, 13 bp, D. melanogaster
tgttattgttggc

SEQ ID NO: 660632 - DNA, 13 bp, D. melanogaster
tgttattgttgtc

SEQ ID NO: 660633 - DNA, 13 bp, D. melanogaster
tgttattgtttcg

SEQ ID NO: 660634 - DNA, 13 bp, D. melanogaster
tgttatttatgca

SEQ ID NO: 660635 - DNA, 13 bp, D. melanogaster
tgttatttatgcg

SEQ ID NO: 660636 - DNA, 13 bp, D. melanogaster
tgttatttattca

SEQ ID NO: 660637 - DNA, 14 bp, D. melanogaster
tgttcaaaaaatac

SEQ ID NO: 660638 - DNA, 13 bp, D. melanogaster
tgttcaaaaaatc

SEQ ID NO: 660639 - DNA, 15 bp, D. melanogaster
tgttcaaaaatgcaa

SEQ ID NO: 660640 - DNA, 13 bp, D. melanogaster
tgttcaaaagcag

SEQ ID NO: 660641 - DNA, 13 bp, D. melanogaster
tgttcaaaatgtt

SEQ ID NO: 660642 - DNA, 14 bp, D. melanogaster
tgttcaaaatgttt

SEQ ID NO: 660643 - DNA, 13 bp, D. melanogaster
tgttcaaaattgt

SEQ ID NO: 660644 - DNA, 13 bp, D. melanogaster
tgttcaaaattta

SEQ ID NO: 660645 - DNA, 13 bp, D. melanogaster
tgttcaaaatttt

SEQ ID NO: 660646 - DNA, 13 bp, D. melanogaster
tgttcaaacaaaa

SEQ ID NO: 660647 - DNA, 13 bp, D. melanogaster
tgttcaaactttt

SEQ ID NO: 660648 - DNA, 13 bp, D. melanogaster
tgttcaaataaat

SEQ ID NO: 660649 - DNA, 14 bp, D. melanogaster
tgttcaaataaata

SEQ ID NO: 660650 - DNA, 14 bp, D. melanogaster
tgttcaaatcttaa

SEQ ID NO: 660651 - DNA, 13 bp, D. melanogaster
tgttcaaatttct

SEQ ID NO: 660652 - DNA, 14 bp, D. melanogaster
tgttcaaatttgtt

SEQ ID NO: 660653 - DNA, 13 bp, D. melanogaster
tgttcaacaaaaa

SEQ ID NO: 660654 - DNA, 13 bp, D. melanogaster
tgttcaataaata

SEQ ID NO: 660655 - DNA, 13 bp, D. melanogaster
tgttcaatatcaa

SEQ ID NO: 660656 - DNA, 14 bp, D. melanogaster
tgttcaatatcaaa

SEQ ID NO: 660657 - DNA, 13 bp, D. melanogaster
tgttcaatatttg

SEQ ID NO: 660658 - DNA, 13 bp, D. melanogaster
tgttcaatgtttt

SEQ ID NO: 660659 - DNA, 13 bp, D. melanogaster
tgttcaattaaaa

SEQ ID NO: 660660 - DNA, 13 bp, D. melanogaster
tgttcaattattt

SEQ ID NO: 660661 - DNA, 14 bp, D. melanogaster
tgttcaattcgaat

SEQ ID NO: 660662 - DNA, 13 bp, D. melanogaster
tgttcaatttaat

SEQ ID NO: 660663 - DNA, 13 bp, D. melanogaster
tgttcaatttatt

SEQ ID NO: 660664 - DNA, 13 bp, D. melanogaster
tgttcaatttcaa

SEQ ID NO: 660665 - DNA, 13 bp, D. melanogaster
tgttcacaatttt

SEQ ID NO: 660666 - DNA, 13 bp, D. melanogaster
tgttcacacatga

SEQ ID NO: 660667 - DNA, 13 bp, D. melanogaster
tgttcacgttgaa

SEQ ID NO: 660668 - DNA, 13 bp, D. melanogaster
tgttcagatttat

SEQ ID NO: 660669 - DNA, 13 bp, D. melanogaster
tgttcagctcggt

SEQ ID NO: 660670 - DNA, 13 bp, D. melanogaster
tgttcataatttt

SEQ ID NO: 660671 - DNA, 14 bp, D. melanogaster
tgttcatatatgta

SEQ ID NO: 660672 - DNA, 13 bp, D. melanogaster
tgttcatggacaa

SEQ ID NO: 660673 - DNA, 13 bp, D. melanogaster
tgttcatgttcat

SEQ ID NO: 660674 - DNA, 13 bp, D. melanogaster
tgttcatgttgtt

SEQ ID NO: 660675 - DNA, 13 bp, D. melanogaster
tgttcattaaaaa

SEQ ID NO: 660676 - DNA, 13 bp, D. melanogaster
tgttcattaatta

SEQ ID NO: 660677 - DNA, 13 bp, D. melanogaster
tgttcattaattt

SEQ ID NO: 660678 - DNA, 14 bp, D. melanogaster
tgttcatttttcat

SEQ ID NO: 660679 - DNA, 14 bp, D. melanogaster
tgttcatttttgac

SEQ ID NO: 660680 - DNA, 13 bp, D. melanogaster
tgttccaaagtgt

SEQ ID NO: 660681 - DNA, 14 bp, D. melanogaster
tgttccaaagtgtg

SEQ ID NO: 660682 - DNA, 13 bp, D. melanogaster
tgttccagttgcc

SEQ ID NO: 660683 - DNA, 14 bp, D. melanogaster
tgttccagttgccg

SEQ ID NO: 660684 - DNA, 13 bp, D. melanogaster
tgttccatacatc

SEQ ID NO: 660685 - DNA, 13 bp, D. melanogaster
tgttccatttgaa

SEQ ID NO: 660686 - DNA, 13 bp, D. melanogaster
tgttcccatgtcc

SEQ ID NO: 660687 - DNA, 13 bp, D. melanogaster
tgttcccattttc

SEQ ID NO: 660688 - DNA, 14 bp, D. melanogaster
tgttccccattggc

SEQ ID NO: 660689 - DNA, 13 bp, D. melanogaster
tgttcctaatgtc

SEQ ID NO: 660690 - DNA, 14 bp, D. melanogaster
tgttcctgctcctg

SEQ ID NO: 660691 - DNA, 13 bp, D. melanogaster
tgttcctgctgct

SEQ ID NO: 660692 - DNA, 14 bp, D. melanogaster
tgttcctgctgctg

SEQ ID NO: 660693 - DNA, 13 bp, D. melanogaster
tgttcctgctgtt

SEQ ID NO: 660694 - DNA, 13 bp, D. melanogaster
tgttcctgttgct

SEQ ID NO: 660695 - DNA, 13 bp, D. melanogaster
tgttcgattttaa

SEQ ID NO: 660696 - DNA, 13 bp, D. melanogaster
tgttcgcctggta

SEQ ID NO: 660697 - DNA, 13 bp, D. melanogaster
tgttcgcttggtg

SEQ ID NO: 660698 - DNA, 13 bp, D. melanogaster
tgttcggaatgag

SEQ ID NO: 660699 - DNA, 13 bp, D. melanogaster
tgttcgggcgcca

SEQ ID NO: 660700 - DNA, 13 bp, D. melanogaster
tgttcggttcggt

SEQ ID NO: 660701 - DNA, 13 bp, D. melanogaster
tgttcgtaattta

SEQ ID NO: 660702 - DNA, 15 bp, D. melanogaster
tgttcgtatataata

SEQ ID NO: 660703 - DNA, 13 bp, D. melanogaster
tgttcgtctgtcc

SEQ ID NO: 660704 - DNA, 13 bp, D. melanogaster
tgttctaaatgct

SEQ ID NO: 660705 - DNA, 13 bp, D. melanogaster
tgttctaagtcca

SEQ ID NO: 660706 - DNA, 13 bp, D. melanogaster
tgttctacatttt

SEQ ID NO: 660707 - DNA, 14 bp, D. melanogaster
tgttctaccgaaaa

SEQ ID NO: 660708 - DNA, 13 bp, D. melanogaster
tgttctactaata

SEQ ID NO: 660709 - DNA, 13 bp, D. melanogaster
tgttctatgttta

SEQ ID NO: 660710 - DNA, 13 bp, D. melanogaster
tgttctcaattct

SEQ ID NO: 660711 - DNA, 15 bp, D. melanogaster
tgttctcagtgaaaa

SEQ ID NO: 660712 - DNA, 14 bp, D. melanogaster
tgttctctgaaatc

SEQ ID NO: 660713 - DNA, 13 bp, D. melanogaster
tgttctgctgctg

SEQ ID NO: 660714 - DNA, 14 bp, D. melanogaster
tgttctgctgtttc

SEQ ID NO: 660715 - DNA, 13 bp, D. melanogaster
tgttctggataac

SEQ ID NO: 660716 - DNA, 13 bp, D. melanogaster
tgttctgttctgg

SEQ ID NO: 660717 - DNA, 13 bp, D. melanogaster
tgttcttaagggc

SEQ ID NO: 660718 - DNA, 13 bp, D. melanogaster
tgttcttaatatt

SEQ ID NO: 660719 - DNA, 13 bp, D. melanogaster
tgttcttaattaa

SEQ ID NO: 660720 - DNA, 13 bp, D. melanogaster
tgttcttatttaa

SEQ ID NO: 660721 - DNA, 13 bp, D. melanogaster
tgttcttgcaaat

SEQ ID NO: 660722 - DNA, 13 bp, D. melanogaster
tgttctttggtat

SEQ ID NO: 660723 - DNA, 13 bp, D. melanogaster
tgttgaaaaaatt

SEQ ID NO: 660724 - DNA, 13 bp, D. melanogaster
tgttgaaaaatct

SEQ ID NO: 660725 - DNA, 13 bp, D. melanogaster
tgttgaaaagtaa

SEQ ID NO: 660726 - DNA, 13 bp, D. melanogaster
tgttgaaaagtat

SEQ ID NO: 660727 - DNA, 13 bp, D. melanogaster
tgttgaaaatatt

SEQ ID NO: 660728 - DNA, 14 bp, D. melanogaster
tgttgaaaatattt

SEQ ID NO: 660729 - DNA, 13 bp, D. melanogaster
tgttgaaaatgac

SEQ ID NO: 660730 - DNA, 13 bp, D. melanogaster
tgttgaaacaata

SEQ ID NO: 660731 - DNA, 13 bp, D. melanogaster
tgttgaaagcgtt

SEQ ID NO: 660732 - DNA, 13 bp, D. melanogaster
tgttgaaatatat

SEQ ID NO: 660733 - DNA, 13 bp, D. melanogaster
tgttgaaatattt

SEQ ID NO: 660734 - DNA, 13 bp, D. melanogaster
tgttgaaatgttt

SEQ ID NO: 660735 - DNA, 13 bp, D. melanogaster
tgttgaaattatt

SEQ ID NO: 660736 - DNA, 13 bp, D. melanogaster
tgttgaaattgaa

SEQ ID NO: 660737 - DNA, 13 bp, D. melanogaster
tgttgaaattgca

SEQ ID NO: 660738 - DNA, 13 bp, D. melanogaster
tgttgaacaaatt

SEQ ID NO: 660739 - DNA, 14 bp, D. melanogaster
tgttgaacattttt

SEQ ID NO: 660740 - DNA, 14 bp, D. melanogaster
tgttgaatattaag

SEQ ID NO: 660741 - DNA, 13 bp, D. melanogaster
tgttgaatattta

SEQ ID NO: 660742 - DNA, 13 bp, D. melanogaster
tgttgaatgaatt

SEQ ID NO: 660743 - DNA, 13 bp, D. melanogaster
tgttgaattaaaa

SEQ ID NO: 660744 - DNA, 14 bp, D. melanogaster
tgttgaattaaaaa

SEQ ID NO: 660745 - DNA, 13 bp, D. melanogaster
tgttgaatttcaa

SEQ ID NO: 660746 - DNA, 13 bp, D. melanogaster
tgttgaattttca

SEQ ID NO: 660747 - DNA, 13 bp, D. melanogaster
tgttgacaaattg

SEQ ID NO: 660748 - DNA, 13 bp, D. melanogaster
tgttgacaacatt

SEQ ID NO: 660749 - DNA, 13 bp, D. melanogaster
tgttgacaatttg

SEQ ID NO: 660750 - DNA, 13 bp, D. melanogaster
tgttgacagtttt

SEQ ID NO: 660751 - DNA, 13 bp, D. melanogaster
tgttgacatttgc

SEQ ID NO: 660752 - DNA, 13 bp, D. melanogaster
tgttgactttgcc

SEQ ID NO: 660753 - DNA, 13 bp, D. melanogaster
tgttgacttttcg

SEQ ID NO: 660754 - DNA, 14 bp, D. melanogaster
tgttgagattataa

SEQ ID NO: 660755 - DNA, 13 bp, D. melanogaster
tgttgataaacat

SEQ ID NO: 660756 - DNA, 13 bp, D. melanogaster
tgttgataataat

SEQ ID NO: 660757 - DNA, 13 bp, D. melanogaster
tgttgatattcaa

SEQ ID NO: 660758 - DNA, 13 bp, D. melanogaster
tgttgatattgat

SEQ ID NO: 660759 - DNA, 13 bp, D. melanogaster
tgttgatatttac

SEQ ID NO: 660760 - DNA, 13 bp, D. melanogaster
tgttgatcatttg

SEQ ID NO: 660761 - DNA, 15 bp, D. melanogaster
tgttgatctgttttg

SEQ ID NO: 660762 - DNA, 13 bp, D. melanogaster
tgttgatgacttg

SEQ ID NO: 660763 - DNA, 14 bp, D. melanogaster
tgttgatgatgatg

SEQ ID NO: 660764 - DNA, 13 bp, D. melanogaster
tgttgatgcccaa

SEQ ID NO: 660765 - DNA, 13 bp, D. melanogaster
tgttgatgctgct

SEQ ID NO: 660766 - DNA, 14 bp, D. melanogaster
tgttgatgctgctg

SEQ ID NO: 660767 - DNA, 13 bp, D. melanogaster
tgttgatgtggat

SEQ ID NO: 660768 - DNA, 13 bp, D. melanogaster
tgttgatgttgat

SEQ ID NO: 660769 - DNA, 14 bp, D. melanogaster
tgttgatgttgctg

SEQ ID NO: 660770 - DNA, 13 bp, D. melanogaster
tgttgatgtttgc

SEQ ID NO: 660771 - DNA, 13 bp, D. melanogaster
tgttgattaaata

SEQ ID NO: 660772 - DNA, 14 bp, D. melanogaster
tgttgattaaataa

SEQ ID NO: 660773 - DNA, 13 bp, D. melanogaster
tgttgattcaatt

SEQ ID NO: 660774 - DNA, 14 bp, D. melanogaster
tgttgattgatatt

SEQ ID NO: 660775 - DNA, 13 bp, D. melanogaster
tgttgattgttga

SEQ ID NO: 660776 - DNA, 14 bp, D. melanogaster
tgttgattgttttc

SEQ ID NO: 660777 - DNA, 13 bp, D. melanogaster
tgttgatttcatt

SEQ ID NO: 660778 - DNA, 13 bp, D. melanogaster
tgttgcaaaaaca

SEQ ID NO: 660779 - DNA, 13 bp, D. melanogaster
tgttgcaaatgca

SEQ ID NO: 660780 - DNA, 13 bp, D. melanogaster
tgttgcaaatgtt

SEQ ID NO: 660781 - DNA, 13 bp, D. melanogaster
tgttgcaaattaa

SEQ ID NO: 660782 - DNA, 13 bp, D. melanogaster
tgttgcaacaaca

SEQ ID NO: 660783 - DNA, 13 bp, D. melanogaster
tgttgcaacaatt

SEQ ID NO: 660784 - DNA, 13 bp, D. melanogaster
tgttgcaacagca

SEQ ID NO: 660785 - DNA, 13 bp, D. melanogaster
tgttgcaagttgc

SEQ ID NO: 660786 - DNA, 13 bp, D. melanogaster
tgttgcaattgca

SEQ ID NO: 660787 - DNA, 13 bp, D. melanogaster
tgttgcaattgct

SEQ ID NO: 660788 - DNA, 13 bp, D. melanogaster
tgttgcaattgtt

SEQ ID NO: 660789 - DNA, 13 bp, D. melanogaster
tgttgcaatttat

SEQ ID NO: 660790 - DNA, 13 bp, D. melanogaster
tgttgcaatttct

SEQ ID NO: 660791 - DNA, 13 bp, D. melanogaster
tgttgcaattttc

SEQ ID NO: 660792 - DNA, 13 bp, D. melanogaster
tgttgcacaaaaa

SEQ ID NO: 660793 - DNA, 13 bp, D. melanogaster
tgttgcacaaaca

SEQ ID NO: 660794 - DNA, 13 bp, D. melanogaster
tgttgcacaaatt

SEQ ID NO: 660795 - DNA, 13 bp, D. melanogaster
tgttgcacagcac

SEQ ID NO: 660796 - DNA, 13 bp, D. melanogaster
tgttgcacagtgt

SEQ ID NO: 660797 - DNA, 13 bp, D. melanogaster
tgttgcacataaa

SEQ ID NO: 660798 - DNA, 13 bp, D. melanogaster
tgttgcacatttc

SEQ ID NO: 660799 - DNA, 13 bp, D. melanogaster
tgttgcacatttt

SEQ ID NO: 660800 - DNA, 14 bp, D. melanogaster
tgttgcacattttt

SEQ ID NO: 660801 - DNA, 13 bp, D. melanogaster
tgttgcaccgcac

SEQ ID NO: 660802 - DNA, 13 bp, D. melanogaster
tgttgcacgttgc

SEQ ID NO: 660803 - DNA, 13 bp, D. melanogaster
tgttgcactttgt

SEQ ID NO: 660804 - DNA, 13 bp, D. melanogaster
tgttgcacttttt

SEQ ID NO: 660805 - DNA, 13 bp, D. melanogaster
tgttgcagcaaca

SEQ ID NO: 660806 - DNA, 14 bp, D. melanogaster
tgttgcagcagcag

SEQ ID NO: 660807 - DNA, 14 bp, D. melanogaster
tgttgcagcggaaa

SEQ ID NO: 660808 - DNA, 14 bp, D. melanogaster
tgttgcagctgcaa

SEQ ID NO: 660809 - DNA, 13 bp, D. melanogaster
tgttgcagctgtt

SEQ ID NO: 660810 - DNA, 13 bp, D. melanogaster
tgttgcagttgaa

SEQ ID NO: 660811 - DNA, 13 bp, D. melanogaster
tgttgcagttgca

SEQ ID NO: 660812 - DNA, 14 bp, D. melanogaster
tgttgcagttgcag

SEQ ID NO: 660813 - DNA, 13 bp, D. melanogaster
tgttgcagttgct

SEQ ID NO: 660814 - DNA, 14 bp, D. melanogaster
tgttgcagttgctg

SEQ ID NO: 660815 - DNA, 13 bp, D. melanogaster
tgttgcagttgtt

SEQ ID NO: 660816 - DNA, 14 bp, D. melanogaster
tgttgcagtttgaa

SEQ ID NO: 660817 - DNA, 13 bp, D. melanogaster
tgttgcatacttc

SEQ ID NO: 660818 - DNA, 13 bp, D. melanogaster
tgttgcatacttt

SEQ ID NO: 660819 - DNA, 14 bp, D. melanogaster
tgttgcatgcaaca

SEQ ID NO: 660820 - DNA, 13 bp, D. melanogaster
tgttgcatgcccc

SEQ ID NO: 660821 - DNA, 13 bp, D. melanogaster
tgttgcatgctgc

SEQ ID NO: 660822 - DNA, 13 bp, D. melanogaster
tgttgcatgcttt

SEQ ID NO: 660823 - DNA, 13 bp, D. melanogaster
tgttgcatgtggc

SEQ ID NO: 660824 - DNA, 13 bp, D. melanogaster
tgttgcatgtgtg

SEQ ID NO: 660825 - DNA, 13 bp, D. melanogaster
tgttgcatgttgc

SEQ ID NO: 660826 - DNA, 13 bp, D. melanogaster
tgttgcatgtttt

SEQ ID NO: 660827 - DNA, 13 bp, D. melanogaster
tgttgcattaaaa

SEQ ID NO: 660828 - DNA, 13 bp, D. melanogaster
tgttgcattaaat

SEQ ID NO: 660829 - DNA, 13 bp, D. melanogaster
tgttgcatttatt

SEQ ID NO: 660830 - DNA, 13 bp, D. melanogaster
tgttgcatttgcc

SEQ ID NO: 660831 - DNA, 13 bp, D. melanogaster
tgttgcatttgtt

SEQ ID NO: 660832 - DNA, 13 bp, D. melanogaster
tgttgcattttat

SEQ ID NO: 660833 - DNA, 13 bp, D. melanogaster
tgttgcattttcc

SEQ ID NO: 660834 - DNA, 13 bp, D. melanogaster
tgttgccaaaaaa

SEQ ID NO: 660835 - DNA, 13 bp, D. melanogaster
tgttgccaaaatc

SEQ ID NO: 660836 - DNA, 13 bp, D. melanogaster
tgttgccaaaatg

SEQ ID NO: 660837 - DNA, 13 bp, D. melanogaster
tgttgccaaattt

SEQ ID NO: 660838 - DNA, 13 bp, D. melanogaster
tgttgccaacaaa

SEQ ID NO: 660839 - DNA, 13 bp, D. melanogaster
tgttgccaactgt

SEQ ID NO: 660840 - DNA, 13 bp, D. melanogaster
tgttgccaacttg

SEQ ID NO: 660841 - DNA, 13 bp, D. melanogaster
tgttgccaatttg

SEQ ID NO: 660842 - DNA, 13 bp, D. melanogaster
tgttgccacaatt

SEQ ID NO: 660843 - DNA, 13 bp, D. melanogaster
tgttgccactgct

SEQ ID NO: 660844 - DNA, 13 bp, D. melanogaster
tgttgccactttt

SEQ ID NO: 660845 - DNA, 13 bp, D. melanogaster
tgttgccagcgct

SEQ ID NO: 660846 - DNA, 13 bp, D. melanogaster
tgttgccagcttt

SEQ ID NO: 660847 - DNA, 13 bp, D. melanogaster
tgttgccatattt

SEQ ID NO: 660848 - DNA, 13 bp, D. melanogaster
tgttgccattatt

SEQ ID NO: 660849 - DNA, 13 bp, D. melanogaster
tgttgccatttca

SEQ ID NO: 660850 - DNA, 13 bp, D. melanogaster
tgttgccatttcc

SEQ ID NO: 660851 - DNA, 13 bp, D. melanogaster
tgttgcccgcttt

SEQ ID NO: 660852 - DNA, 13 bp, D. melanogaster
tgttgccgcattt

SEQ ID NO: 660853 - DNA, 13 bp, D. melanogaster
tgttgccgccgct

SEQ ID NO: 660854 - DNA, 13 bp, D. melanogaster
tgttgccgccgtt

SEQ ID NO: 660855 - DNA, 13 bp, D. melanogaster
tgttgccgctgat

SEQ ID NO: 660856 - DNA, 13 bp, D. melanogaster
tgttgccgctgca

SEQ ID NO: 660857 - DNA, 13 bp, D. melanogaster
tgttgccgctgcc

SEQ ID NO: 660858 - DNA, 14 bp, D. melanogaster
tgttgccgctgcca

SEQ ID NO: 660859 - DNA, 13 bp, D. melanogaster
tgttgccgctgct

SEQ ID NO: 660860 - DNA, 13 bp, D. melanogaster
tgttgccgctgtc

SEQ ID NO: 660861 - DNA, 13 bp, D. melanogaster
tgttgccgctgtt

SEQ ID NO: 660862 - DNA, 13 bp, D. melanogaster
tgttgccgttgtt

SEQ ID NO: 660863 - DNA, 14 bp, D. melanogaster
tgttgccgttgttg

SEQ ID NO: 660864 - DNA, 13 bp, D. melanogaster
tgttgcctaatat

SEQ ID NO: 660865 - DNA, 14 bp, D. melanogaster
tgttgcctaatata

SEQ ID NO: 660866 - DNA, 14 bp, D. melanogaster
tgttgcctactttt

SEQ ID NO: 660867 - DNA, 13 bp, D. melanogaster
tgttgcctgttgc

SEQ ID NO: 660868 - DNA, 13 bp, D. melanogaster
tgttgcctttgct

SEQ ID NO: 660869 - DNA, 13 bp, D. melanogaster
tgttgccttttaa

SEQ ID NO: 660870 - DNA, 13 bp, D. melanogaster
tgttgccttttgc

SEQ ID NO: 660871 - DNA, 13 bp, D. melanogaster
tgttgccttttta

SEQ ID NO: 660872 - DNA, 13 bp, D. melanogaster
tgttgcgaaaatt

SEQ ID NO: 660873 - DNA, 13 bp, D. melanogaster
tgttgcgaaattt

SEQ ID NO: 660874 - DNA, 13 bp, D. melanogaster
tgttgcgctgaat

SEQ ID NO: 660875 - DNA, 13 bp, D. melanogaster
tgttgcggaatgt

SEQ ID NO: 660876 - DNA, 14 bp, D. melanogaster
tgttgcggctgctg

SEQ ID NO: 660877 - DNA, 13 bp, D. melanogaster
tgttgcggttgct

SEQ ID NO: 660878 - DNA, 13 bp, D. melanogaster
tgttgcgtggtgc

SEQ ID NO: 660879 - DNA, 13 bp, D. melanogaster
tgttgctactgct

SEQ ID NO: 660880 - DNA, 18 bp, D. melanogaster
tgttgctactgctgttgc

SEQ ID NO: 660881 - DNA, 13 bp, D. melanogaster
tgttgctactgtt

SEQ ID NO: 660882 - DNA, 14 bp, D. melanogaster
tgttgctactgttg

SEQ ID NO: 660883 - DNA, 13 bp, D. melanogaster
tgttgctattgcc

SEQ ID NO: 660884 - DNA, 13 bp, D. melanogaster
tgttgctattgct

SEQ ID NO: 660885 - DNA, 13 bp, D. melanogaster
tgttgctatttgc

SEQ ID NO: 660886 - DNA, 13 bp, D. melanogaster
tgttgctattttc

SEQ ID NO: 660887 - DNA, 13 bp, D. melanogaster
tgttgctcatacg

SEQ ID NO: 660888 - DNA, 13 bp, D. melanogaster
tgttgctcctgcc

SEQ ID NO: 660889 - DNA, 14 bp, D. melanogaster
tgttgctcctgctg

SEQ ID NO: 660890 - DNA, 13 bp, D. melanogaster
tgttgctctgctc

SEQ ID NO: 660891 - DNA, 13 bp, D. melanogaster
tgttgctcttctg

SEQ ID NO: 660892 - DNA, 14 bp, D. melanogaster
tgttgctgatgctg

SEQ ID NO: 660893 - DNA, 13 bp, D. melanogaster
tgttgctgatttt

SEQ ID NO: 660894 - DNA, 13 bp, D. melanogaster
tgttgctgcaaca

SEQ ID NO: 660895 - DNA, 13 bp, D. melanogaster
tgttgctgcaatt

SEQ ID NO: 660896 - DNA, 14 bp, D. melanogaster
tgttgctgcagctg

SEQ ID NO: 660897 - DNA, 13 bp, D. melanogaster
tgttgctgcagtt

SEQ ID NO: 660898 - DNA, 14 bp, D. melanogaster
tgttgctgcagttg

SEQ ID NO: 660899 - DNA, 13 bp, D. melanogaster
tgttgctgcattt

SEQ ID NO: 660900 - DNA, 13 bp, D. melanogaster
tgttgctgccaca

SEQ ID NO: 660901 - DNA, 14 bp, D. melanogaster
tgttgctgccacag

SEQ ID NO: 660902 - DNA, 13 bp, D. melanogaster
tgttgctgccgtc

SEQ ID NO: 660903 - DNA, 13 bp, D. melanogaster
tgttgctgcctgt

SEQ ID NO: 660904 - DNA, 13 bp, D. melanogaster
tgttgctgcggct

SEQ ID NO: 660905 - DNA, 14 bp, D. melanogaster
tgttgctgctcaac

SEQ ID NO: 660906 - DNA, 13 bp, D. melanogaster
tgttgctgctgaa

SEQ ID NO: 660907 - DNA, 13 bp, D. melanogaster
tgttgctgctgat

SEQ ID NO: 660908 - DNA, 14 bp, D. melanogaster
tgttgctgctgatg

SEQ ID NO: 660909 - DNA, 14 bp, D. melanogaster
tgttgctgctgatt

SEQ ID NO: 660910 - DNA, 14 bp, D. melanogaster
tgttgctgctgcaa

SEQ ID NO: 660911 - DNA, 14 bp, D. melanogaster
tgttgctgctgccc

SEQ ID NO: 660912 - DNA, 13 bp, D. melanogaster
tgttgctgctggt

SEQ ID NO: 660913 - DNA, 14 bp, D. melanogaster
tgttgctgctgtcg

SEQ ID NO: 660914 - DNA, 13 bp, D. melanogaster
tgttgctgctgtg

SEQ ID NO: 660915 - DNA, 13 bp, D. melanogaster
tgttgctgctgtt

SEQ ID NO: 660916 - DNA, 14 bp, D. melanogaster
tgttgctgctgttg

SEQ ID NO: 660917 - DNA, 13 bp, D. melanogaster
tgttgctgcttct

SEQ ID NO: 660918 - DNA, 14 bp, D. melanogaster
tgttgctgcttctg

SEQ ID NO: 660919 - DNA, 13 bp, D. melanogaster
tgttgctgcttgc

SEQ ID NO: 660920 - DNA, 13 bp, D. melanogaster
tgttgctgcttgt

SEQ ID NO: 660921 - DNA, 13 bp, D. melanogaster
tgttgctggaaaa

SEQ ID NO: 660922 - DNA, 13 bp, D. melanogaster
tgttgctggcaac

SEQ ID NO: 660923 - DNA, 13 bp, D. melanogaster
tgttgctggcatt

SEQ ID NO: 660924 - DNA, 13 bp, D. melanogaster
tgttgctggcgtt

SEQ ID NO: 660925 - DNA, 13 bp, D. melanogaster
tgttgctgtagct

SEQ ID NO: 660926 - DNA, 13 bp, D. melanogaster
tgttgctgtcgct

SEQ ID NO: 660927 - DNA, 14 bp, D. melanogaster
tgttgctgtcgctg

SEQ ID NO: 660928 - DNA, 13 bp, D. melanogaster
tgttgctgtcgtg

SEQ ID NO: 660929 - DNA, 13 bp, D. melanogaster
tgttgctgtcgtt

SEQ ID NO: 660930 - DNA, 13 bp, D. melanogaster
tgttgctgttaat

SEQ ID NO: 660931 - DNA, 13 bp, D. melanogaster
tgttgctgttact

SEQ ID NO: 660932 - DNA, 14 bp, D. melanogaster
tgttgctgttactg

SEQ ID NO: 660933 - DNA, 13 bp, D. melanogaster
tgttgctgttgca

SEQ ID NO: 660934 - DNA, 14 bp, D. melanogaster
tgttgctgttgcag

SEQ ID NO: 660935 - DNA, 13 bp, D. melanogaster
tgttgctgttgcc

SEQ ID NO: 660936 - DNA, 13 bp, D. melanogaster
tgttgctgttgct

SEQ ID NO: 660937 - DNA, 14 bp, D. melanogaster
tgttgctgttgctc

SEQ ID NO: 660938 - DNA, 14 bp, D. melanogaster
tgttgctgttgctg

SEQ ID NO: 660939 - DNA, 14 bp, D. melanogaster
tgttgctgttgtgc

SEQ ID NO: 660940 - DNA, 14 bp, D. melanogaster
tgttgctgttgtta

SEQ ID NO: 660941 - DNA, 13 bp, D. melanogaster
tgttgctgtttgc

SEQ ID NO: 660942 - DNA, 13 bp, D. melanogaster
tgttgcttattta

SEQ ID NO: 660943 - DNA, 14 bp, D. melanogaster
tgttgcttctgctg

SEQ ID NO: 660944 - DNA, 13 bp, D. melanogaster
tgttgcttgttgc

SEQ ID NO: 660945 - DNA, 13 bp, D. melanogaster
tgttgctttgctg

SEQ ID NO: 660946 - DNA, 13 bp, D. melanogaster
tgttgcttttccc

SEQ ID NO: 660947 - DNA, 13 bp, D. melanogaster
tgttgcttttgat

SEQ ID NO: 660948 - DNA, 13 bp, D. melanogaster
tgttggaaaaaca

SEQ ID NO: 660949 - DNA, 13 bp, D. melanogaster
tgttggaaaataa

SEQ ID NO: 660950 - DNA, 13 bp, D. melanogaster
tgttggaaataaa

SEQ ID NO: 660951 - DNA, 13 bp, D. melanogaster
tgttggacatttt

SEQ ID NO: 660952 - DNA, 13 bp, D. melanogaster
tgttggagtagtg

SEQ ID NO: 660953 - DNA, 13 bp, D. melanogaster
tgttggagttcca

SEQ ID NO: 660954 - DNA, 13 bp, D. melanogaster
tgttggataattt

SEQ ID NO: 660955 - DNA, 13 bp, D. melanogaster
tgttggcaaatat

SEQ ID NO: 660956 - DNA, 13 bp, D. melanogaster
tgttggcaacttt

SEQ ID NO: 660957 - DNA, 13 bp, D. melanogaster
tgttggcactttg

SEQ ID NO: 660958 - DNA, 13 bp, D. melanogaster
tgttggcagctgg

SEQ ID NO: 660959 - DNA, 13 bp, D. melanogaster
tgttggcattaaa

SEQ ID NO: 660960 - DNA, 13 bp, D. melanogaster
tgttggcattgtt

SEQ ID NO: 660961 - DNA, 13 bp, D. melanogaster
tgttggcatttca

SEQ ID NO: 660962 - DNA, 14 bp, D. melanogaster
tgttggccaaaaaa

SEQ ID NO: 660963 - DNA, 14 bp, D. melanogaster
tgttggccaaaaag

SEQ ID NO: 660964 - DNA, 13 bp, D. melanogaster
tgttggccaaaag

SEQ ID NO: 660965 - DNA, 13 bp, D. melanogaster
tgttggccaaaca

SEQ ID NO: 660966 - DNA, 13 bp, D. melanogaster
tgttggccaacaa

SEQ ID NO: 660967 - DNA, 13 bp, D. melanogaster
tgttggccaactg

SEQ ID NO: 660968 - DNA, 13 bp, D. melanogaster
tgttggccaactt

SEQ ID NO: 660969 - DNA, 13 bp, D. melanogaster
tgttggccaagtc

SEQ ID NO: 660970 - DNA, 13 bp, D. melanogaster
tgttggccaagtg

SEQ ID NO: 660971 - DNA, 13 bp, D. melanogaster
tgttggccaagtt

SEQ ID NO: 660972 - DNA, 13 bp, D. melanogaster
tgttggccacatt

SEQ ID NO: 660973 - DNA, 13 bp, D. melanogaster
tgttggccacggc

SEQ ID NO: 660974 - DNA, 13 bp, D. melanogaster
tgttggccagaaa

SEQ ID NO: 660975 - DNA, 13 bp, D. melanogaster
tgttggccagcaa

SEQ ID NO: 660976 - DNA, 13 bp, D. melanogaster
tgttggccagctg

SEQ ID NO: 660977 - DNA, 13 bp, D. melanogaster
tgttggccaggcc

SEQ ID NO: 660978 - DNA, 13 bp, D. melanogaster
tgttggccaggct

SEQ ID NO: 660979 - DNA, 13 bp, D. melanogaster
tgttggccagtgt

SEQ ID NO: 660980 - DNA, 13 bp, D. melanogaster
tgttggccagttg

SEQ ID NO: 660981 - DNA, 13 bp, D. melanogaster
tgttggccataaa

SEQ ID NO: 660982 - DNA, 13 bp, D. melanogaster
tgttggccatata

SEQ ID NO: 660983 - DNA, 13 bp, D. melanogaster
tgttggccatctc

SEQ ID NO: 660984 - DNA, 14 bp, D. melanogaster
tgttggccatctcg

SEQ ID NO: 660985 - DNA, 13 bp, D. melanogaster
tgttggccatgtt

SEQ ID NO: 660986 - DNA, 14 bp, D. melanogaster
tgttggccatgttg

SEQ ID NO: 660987 - DNA, 13 bp, D. melanogaster
tgttggccattgg

SEQ ID NO: 660988 - DNA, 13 bp, D. melanogaster
tgttggccatttg

SEQ ID NO: 660989 - DNA, 13 bp, D. melanogaster
tgttggcccaaag

SEQ ID NO: 660990 - DNA, 13 bp, D. melanogaster
tgttggcccaatt

SEQ ID NO: 660991 - DNA, 13 bp, D. melanogaster
tgttggcctatgc

SEQ ID NO: 660992 - DNA, 13 bp, D. melanogaster
tgttggcctggcc

SEQ ID NO: 660993 - DNA, 14 bp, D. melanogaster
tgttggcctggcca

SEQ ID NO: 660994 - DNA, 13 bp, D. melanogaster
tgttggcgttgct

SEQ ID NO: 660995 - DNA, 13 bp, D. melanogaster
tgttggctgctgc

SEQ ID NO: 660996 - DNA, 13 bp, D. melanogaster
tgttggctttggc

SEQ ID NO: 660997 - DNA, 13 bp, D. melanogaster
tgttgggcatttt

SEQ ID NO: 660998 - DNA, 13 bp, D. melanogaster
tgttggttcgatt

SEQ ID NO: 660999 - DNA, 13 bp, D. melanogaster
tgttggtttataa

SEQ ID NO: 661000 - DNA, 13 bp, D. melanogaster
tgttggtttcatt

SEQ ID NO: 661001 - DNA, 13 bp, D. melanogaster
tgttggttttact

SEQ ID NO: 661002 - DNA, 15 bp, D. melanogaster
tgttggttttacttc

SEQ ID NO: 661003 - DNA, 13 bp, D. melanogaster
tgttggttttcaa

SEQ ID NO: 661004 - DNA, 13 bp, D. melanogaster
tgttgtaaacaaa

SEQ ID NO: 661005 - DNA, 13 bp, D. melanogaster
tgttgtaaacatt

SEQ ID NO: 661006 - DNA, 13 bp, D. melanogaster
tgttgtaattaaa

SEQ ID NO: 661007 - DNA, 13 bp, D. melanogaster
tgttgtacaattt

SEQ ID NO: 661008 - DNA, 13 bp, D. melanogaster
tgttgtacatttt

SEQ ID NO: 661009 - DNA, 13 bp, D. melanogaster
tgttgtagatgca

SEQ ID NO: 661010 - DNA, 13 bp, D. melanogaster
tgttgtagttgta

SEQ ID NO: 661011 - DNA, 13 bp, D. melanogaster
tgttgtcacagct

SEQ ID NO: 661012 - DNA, 14 bp, D. melanogaster
tgttgtcacagctg

SEQ ID NO: 661013 - DNA, 13 bp, D. melanogaster
tgttgtcatattt

SEQ ID NO: 661014 - DNA, 13 bp, D. melanogaster
tgttgtcatccag

SEQ ID NO: 661015 - DNA, 13 bp, D. melanogaster
tgttgtccatgaa

SEQ ID NO: 661016 - DNA, 13 bp, D. melanogaster
tgttgtccttgcc

SEQ ID NO: 661017 - DNA, 13 bp, D. melanogaster
tgttgtccttgct

SEQ ID NO: 661018 - DNA, 13 bp, D. melanogaster
tgttgtcgcattc

SEQ ID NO: 661019 - DNA, 13 bp, D. melanogaster
tgttgtcgctggc

SEQ ID NO: 661020 - DNA, 13 bp, D. melanogaster
tgttgtcgctgtc

SEQ ID NO: 661021 - DNA, 13 bp, D. melanogaster
tgttgtcgctgtt

SEQ ID NO: 661022 - DNA, 14 bp, D. melanogaster
tgttgtcgtcgtcg

SEQ ID NO: 661023 - DNA, 13 bp, D. melanogaster
tgttgtcgttgcc

SEQ ID NO: 661024 - DNA, 13 bp, D. melanogaster
tgttgtcgttgtc

SEQ ID NO: 661025 - DNA, 13 bp, D. melanogaster
tgttgtgcaaaca

SEQ ID NO: 661026 - DNA, 13 bp, D. melanogaster
tgttgtgcaattt

SEQ ID NO: 661027 - DNA, 13 bp, D. melanogaster
tgttgtgcacgat

SEQ ID NO: 661028 - DNA, 13 bp, D. melanogaster
tgttgtgcatatt

SEQ ID NO: 661029 - DNA, 14 bp, D. melanogaster
tgttgtgcatattt

SEQ ID NO: 661030 - DNA, 13 bp, D. melanogaster
tgttgtgcatgtg

SEQ ID NO: 661031 - DNA, 13 bp, D. melanogaster
tgttgtgctagaa

SEQ ID NO: 661032 - DNA, 13 bp, D. melanogaster
tgttgtgctattt

SEQ ID NO: 661033 - DNA, 13 bp, D. melanogaster
tgttgtgctgctg

SEQ ID NO: 661034 - DNA, 14 bp, D. melanogaster
tgttgtgcttaatt

SEQ ID NO: 661035 - DNA, 14 bp, D. melanogaster
tgttgtggcagttg

SEQ ID NO: 661036 - DNA, 13 bp, D. melanogaster
tgttgtggccttt

SEQ ID NO: 661037 - DNA, 13 bp, D. melanogaster
tgttgtggctgct

SEQ ID NO: 661038 - DNA, 13 bp, D. melanogaster
tgttgtgtgcaaa

SEQ ID NO: 661039 - DNA, 13 bp, D. melanogaster
tgttgtgtgtgca

SEQ ID NO: 661040 - DNA, 13 bp, D. melanogaster
tgttgttaaacaa

SEQ ID NO: 661041 - DNA, 13 bp, D. melanogaster
tgttgttaaacat

SEQ ID NO: 661042 - DNA, 14 bp, D. melanogaster
tgttgttaaacata

SEQ ID NO: 661043 - DNA, 13 bp, D. melanogaster
tgttgttaatata

SEQ ID NO: 661044 - DNA, 13 bp, D. melanogaster
tgttgttaattga

SEQ ID NO: 661045 - DNA, 13 bp, D. melanogaster
tgttgttacggcc

SEQ ID NO: 661046 - DNA, 13 bp, D. melanogaster
tgttgttactgct

SEQ ID NO: 661047 - DNA, 13 bp, D. melanogaster
tgttgttcaattt

SEQ ID NO: 661048 - DNA, 13 bp, D. melanogaster
tgttgttcagttt

SEQ ID NO: 661049 - DNA, 14 bp, D. melanogaster
tgttgttcctgctg

SEQ ID NO: 661050 - DNA, 13 bp, D. melanogaster
tgttgttctacac

SEQ ID NO: 661051 - DNA, 13 bp, D. melanogaster
tgttgttgaaaaa

SEQ ID NO: 661052 - DNA, 13 bp, D. melanogaster
tgttgttgatgct

SEQ ID NO: 661053 - DNA, 13 bp, D. melanogaster
tgttgttgcaatt

SEQ ID NO: 661054 - DNA, 13 bp, D. melanogaster
tgttgttgcagcc

SEQ ID NO: 661055 - DNA, 13 bp, D. melanogaster
tgttgttgcagct

SEQ ID NO: 661056 - DNA, 14 bp, D. melanogaster
tgttgttgcagctg

SEQ ID NO: 661057 - DNA, 13 bp, D. melanogaster
tgttgttgccaca

SEQ ID NO: 661058 - DNA, 13 bp, D. melanogaster
tgttgttgccgca

SEQ ID NO: 661059 - DNA, 13 bp, D. melanogaster
tgttgttgccgct

SEQ ID NO: 661060 - DNA, 14 bp, D. melanogaster
tgttgttgccgctg

SEQ ID NO: 661061 - DNA, 13 bp, D. melanogaster
tgttgttgccgtc

SEQ ID NO: 661062 - DNA, 13 bp, D. melanogaster
tgttgttgcctgt

SEQ ID NO: 661063 - DNA, 13 bp, D. melanogaster
tgttgttgccttc

SEQ ID NO: 661064 - DNA, 13 bp, D. melanogaster
tgttgttgccttg

SEQ ID NO: 661065 - DNA, 14 bp, D. melanogaster
tgttgttgctattg

SEQ ID NO: 661066 - DNA, 13 bp, D. melanogaster
tgttgttgctgat

SEQ ID NO: 661067 - DNA, 14 bp, D. melanogaster
tgttgttgctgatg

SEQ ID NO: 661068 - DNA, 13 bp, D. melanogaster
tgttgttgctgca

SEQ ID NO: 661069 - DNA, 14 bp, D. melanogaster
tgttgttgctgcaa

SEQ ID NO: 661070 - DNA, 14 bp, D. melanogaster
tgttgttgctgcca

SEQ ID NO: 661071 - DNA, 14 bp, D. melanogaster
tgttgttgctgcgg

SEQ ID NO: 661072 - DNA, 14 bp, D. melanogaster
tgttgttgctgctc

SEQ ID NO: 661073 - DNA, 14 bp, D. melanogaster
tgttgttgctggcc

SEQ ID NO: 661074 - DNA, 14 bp, D. melanogaster
tgttgttgctggct

SEQ ID NO: 661075 - DNA, 13 bp, D. melanogaster
tgttgttggcatt

SEQ ID NO: 661076 - DNA, 13 bp, D. melanogaster
tgttgttggccaa

SEQ ID NO: 661077 - DNA, 13 bp, D. melanogaster
tgttgttgtagct

SEQ ID NO: 661078 - DNA, 13 bp, D. melanogaster
tgttgttgtcgcc

SEQ ID NO: 661079 - DNA, 13 bp, D. melanogaster
tgttgttgttact

SEQ ID NO: 661080 - DNA, 13 bp, D. melanogaster
tgttgttgttgac

SEQ ID NO: 661081 - DNA, 13 bp, D. melanogaster
tgttgttgttgca

SEQ ID NO: 661082 - DNA, 13 bp, D. melanogaster
tgttgttgttgcc

SEQ ID NO: 661083 - DNA, 14 bp, D. melanogaster
tgttgttgttgccc

SEQ ID NO: 661084 - DNA, 14 bp, D. melanogaster
tgttgttgttgccg

SEQ ID NO: 661085 - DNA, 14 bp, D. melanogaster
tgttgttgttttca

SEQ ID NO: 661086 - DNA, 13 bp, D. melanogaster
tgttgtttataaa

SEQ ID NO: 661087 - DNA, 13 bp, D. melanogaster
tgttgtttgccaa

SEQ ID NO: 661088 - DNA, 13 bp, D. melanogaster
tgttgtttgccat

SEQ ID NO: 661089 - DNA, 13 bp, D. melanogaster
tgttgtttgccgt

SEQ ID NO: 661090 - DNA, 13 bp, D. melanogaster
tgttgttttcaaa

SEQ ID NO: 661091 - DNA, 13 bp, D. melanogaster
tgttgttttccat

SEQ ID NO: 661092 - DNA, 13 bp, D. melanogaster
tgttgttttgcag

SEQ ID NO: 661093 - DNA, 13 bp, D. melanogaster
tgttgttttggcc

SEQ ID NO: 661094 - DNA, 13 bp, D. melanogaster
tgttgtttttcaa

SEQ ID NO: 661095 - DNA, 13 bp, D. melanogaster
tgtttaaaaacta

SEQ ID NO: 661096 - DNA, 13 bp, D. melanogaster
tgtttaaaaattg

SEQ ID NO: 661097 - DNA, 13 bp, D. melanogaster
tgtttaaaacata

SEQ ID NO: 661098 - DNA, 13 bp, D. melanogaster
tgtttaaaacatt

SEQ ID NO: 661099 - DNA, 13 bp, D. melanogaster
tgtttaaaaggaa

SEQ ID NO: 661100 - DNA, 13 bp, D. melanogaster
tgtttaaaagtat

SEQ ID NO: 661101 - DNA, 14 bp, D. melanogaster
tgtttaaaagtatg

SEQ ID NO: 661102 - DNA, 13 bp, D. melanogaster
tgtttaaaataag

SEQ ID NO: 661103 - DNA, 14 bp, D. melanogaster
tgtttaaaatgctt

SEQ ID NO: 661104 - DNA, 13 bp, D. melanogaster
tgtttaaacaaat

SEQ ID NO: 661105 - DNA, 14 bp, D. melanogaster
tgtttaaacaattt

SEQ ID NO: 661106 - DNA, 13 bp, D. melanogaster
tgtttaaaccaaa

SEQ ID NO: 661107 - DNA, 13 bp, D. melanogaster
tgtttaaactaaa

SEQ ID NO: 661108 - DNA, 13 bp, D. melanogaster
tgtttaaactaat

SEQ ID NO: 661109 - DNA, 13 bp, D. melanogaster
tgtttaaactact

SEQ ID NO: 661110 - DNA, 13 bp, D. melanogaster
tgtttaaacttaa

SEQ ID NO: 661111 - DNA, 13 bp, D. melanogaster
tgtttaaagtaaa

SEQ ID NO: 661112 - DNA, 14 bp, D. melanogaster
tgtttaaagtaaac

SEQ ID NO: 661113 - DNA, 13 bp, D. melanogaster
tgtttaaataaac

SEQ ID NO: 661114 - DNA, 13 bp, D. melanogaster
tgtttaaataaag

SEQ ID NO: 661115 - DNA, 13 bp, D. melanogaster
tgtttaaatgtaa

SEQ ID NO: 661116 - DNA, 13 bp, D. melanogaster
tgtttaaattaac

SEQ ID NO: 661117 - DNA, 13 bp, D. melanogaster
tgtttaaattaag

SEQ ID NO: 661118 - DNA, 13 bp, D. melanogaster
tgtttaaattgct

SEQ ID NO: 661119 - DNA, 13 bp, D. melanogaster
tgtttaacaatta

SEQ ID NO: 661120 - DNA, 13 bp, D. melanogaster
tgtttaacagttt

SEQ ID NO: 661121 - DNA, 13 bp, D. melanogaster
tgtttaacattaa

SEQ ID NO: 661122 - DNA, 13 bp, D. melanogaster
tgtttaaccccaa

SEQ ID NO: 661123 - DNA, 15 bp, D. melanogaster
tgtttaactttcact

SEQ ID NO: 661124 - DNA, 13 bp, D. melanogaster
tgtttaactttct

SEQ ID NO: 661125 - DNA, 13 bp, D. melanogaster
tgtttaactttta

SEQ ID NO: 661126 - DNA, 13 bp, D. melanogaster
tgtttaagaaaat

SEQ ID NO: 661127 - DNA, 13 bp, D. melanogaster
tgtttaagattaa

SEQ ID NO: 661128 - DNA, 13 bp, D. melanogaster
tgtttaagctttt

SEQ ID NO: 661129 - DNA, 13 bp, D. melanogaster
tgtttaaggtaaa

SEQ ID NO: 661130 - DNA, 13 bp, D. melanogaster
tgtttaagtttaa

SEQ ID NO: 661131 - DNA, 13 bp, D. melanogaster
tgtttaagttttc

SEQ ID NO: 661132 - DNA, 13 bp, D. melanogaster
tgtttaataaaac

SEQ ID NO: 661133 - DNA, 13 bp, D. melanogaster
tgtttaataaaca

SEQ ID NO: 661134 - DNA, 13 bp, D. melanogaster
tgtttaatgaatt

SEQ ID NO: 661135 - DNA, 13 bp, D. melanogaster
tgtttaatgcaaa

SEQ ID NO: 661136 - DNA, 14 bp, D. melanogaster
tgtttaatgtacat

SEQ ID NO: 661137 - DNA, 13 bp, D. melanogaster
tgtttaatgtgca

SEQ ID NO: 661138 - DNA, 13 bp, D. melanogaster
tgtttaattaaca

SEQ ID NO: 661139 - DNA, 13 bp, D. melanogaster
tgtttaattgtca

SEQ ID NO: 661140 - DNA, 14 bp, D. melanogaster
tgtttaatttacat

SEQ ID NO: 661141 - DNA, 13 bp, D. melanogaster
tgtttaatttatc

SEQ ID NO: 661142 - DNA, 13 bp, D. melanogaster
tgtttaatttctc

SEQ ID NO: 661143 - DNA, 13 bp, D. melanogaster
tgtttaattttca

SEQ ID NO: 661144 - DNA, 13 bp, D. melanogaster
tgtttacaaaaat

SEQ ID NO: 661145 - DNA, 14 bp, D. melanogaster
tgtttacaaacaaa

SEQ ID NO: 661146 - DNA, 13 bp, D. melanogaster
tgtttacaaattg

SEQ ID NO: 661147 - DNA, 13 bp, D. melanogaster
tgtttacaacaaa

SEQ ID NO: 661148 - DNA, 13 bp, D. melanogaster
tgtttacaattta

SEQ ID NO: 661149 - DNA, 13 bp, D. melanogaster
tgtttacaatttg

SEQ ID NO: 661150 - DNA, 13 bp, D. melanogaster
tgtttacaatttt

SEQ ID NO: 661151 - DNA, 13 bp, D. melanogaster
tgtttacacaaat

SEQ ID NO: 661152 - DNA, 13 bp, D. melanogaster
tgtttacacaatt

SEQ ID NO: 661153 - DNA, 13 bp, D. melanogaster
tgtttacacaccg

SEQ ID NO: 661154 - DNA, 13 bp, D. melanogaster
tgtttacataatt

SEQ ID NO: 661155 - DNA, 14 bp, D. melanogaster
tgtttacatatttt

SEQ ID NO: 661156 - DNA, 13 bp, D. melanogaster
tgtttacattgca

SEQ ID NO: 661157 - DNA, 13 bp, D. melanogaster
tgtttacatttcc

SEQ ID NO: 661158 - DNA, 13 bp, D. melanogaster
tgtttacattttg

SEQ ID NO: 661159 - DNA, 13 bp, D. melanogaster
tgtttaccattta

SEQ ID NO: 661160 - DNA, 13 bp, D. melanogaster
tgtttacccaaaa

SEQ ID NO: 661161 - DNA, 13 bp, D. melanogaster
tgtttaccttttg

SEQ ID NO: 661162 - DNA, 13 bp, D. melanogaster
tgtttacgagtgc

SEQ ID NO: 661163 - DNA, 13 bp, D. melanogaster
tgtttacgttttc

SEQ ID NO: 661164 - DNA, 14 bp, D. melanogaster
tgtttacgttttcg

SEQ ID NO: 661165 - DNA, 13 bp, D. melanogaster
tgtttactgttta

SEQ ID NO: 661166 - DNA, 13 bp, D. melanogaster
tgtttactgtttg

SEQ ID NO: 661167 - DNA, 13 bp, D. melanogaster
tgtttacttaaaa

SEQ ID NO: 661168 - DNA, 13 bp, D. melanogaster
tgtttactttgca

SEQ ID NO: 661169 - DNA, 13 bp, D. melanogaster
tgtttactttgct

SEQ ID NO: 661170 - DNA, 13 bp, D. melanogaster
tgtttactttgtg

SEQ ID NO: 661171 - DNA, 13 bp, D. melanogaster
tgtttagaaattt

SEQ ID NO: 661172 - DNA, 13 bp, D. melanogaster
tgtttagcatttt

SEQ ID NO: 661173 - DNA, 13 bp, D. melanogaster
tgtttagcgtaaa

SEQ ID NO: 661174 - DNA, 13 bp, D. melanogaster
tgtttagcttttg

SEQ ID NO: 661175 - DNA, 14 bp, D. melanogaster
tgtttaggcaaatt

SEQ ID NO: 661176 - DNA, 13 bp, D. melanogaster
tgtttagtaaata

SEQ ID NO: 661177 - DNA, 13 bp, D. melanogaster
tgtttagtaatat

SEQ ID NO: 661178 - DNA, 13 bp, D. melanogaster
tgtttagttttcc

SEQ ID NO: 661179 - DNA, 13 bp, D. melanogaster
tgtttataaacaa

SEQ ID NO: 661180 - DNA, 14 bp, D. melanogaster
tgtttataaacaaa

SEQ ID NO: 661181 - DNA, 13 bp, D. melanogaster
tgtttataattga

SEQ ID NO: 661182 - DNA, 13 bp, D. melanogaster
tgtttataattgc

SEQ ID NO: 661183 - DNA, 13 bp, D. melanogaster
tgtttatacaaat

SEQ ID NO: 661184 - DNA, 13 bp, D. melanogaster
tgtttatacaatt

SEQ ID NO: 661185 - DNA, 13 bp, D. melanogaster
tgtttatatgaaa

SEQ ID NO: 661186 - DNA, 13 bp, D. melanogaster
tgtttatatgcaa

SEQ ID NO: 661187 - DNA, 13 bp, D. melanogaster
tgtttatattaca

SEQ ID NO: 661188 - DNA, 13 bp, D. melanogaster
tgtttatcattta

SEQ ID NO: 661189 - DNA, 13 bp, D. melanogaster
tgtttatctacct

SEQ ID NO: 661190 - DNA, 13 bp, D. melanogaster
tgtttatcttact

SEQ ID NO: 661191 - DNA, 13 bp, D. melanogaster
tgtttatgaatat

SEQ ID NO: 661192 - DNA, 13 bp, D. melanogaster
tgtttatgcatat

SEQ ID NO: 661193 - DNA, 13 bp, D. melanogaster
tgtttatgcattt

SEQ ID NO: 661194 - DNA, 13 bp, D. melanogaster
tgtttatgccaaa

SEQ ID NO: 661195 - DNA, 13 bp, D. melanogaster
tgtttatggccag

SEQ ID NO: 661196 - DNA, 13 bp, D. melanogaster
tgtttatggccat

SEQ ID NO: 661197 - DNA, 13 bp, D. melanogaster
tgtttatgtgcaa

SEQ ID NO: 661198 - DNA, 13 bp, D. melanogaster
tgtttatgttgct

SEQ ID NO: 661199 - DNA, 13 bp, D. melanogaster
tgtttatgtttac

SEQ ID NO: 661200 - DNA, 13 bp, D. melanogaster
tgtttatgtttgc

SEQ ID NO: 661201 - DNA, 13 bp, D. melanogaster
tgtttattaaatg

SEQ ID NO: 661202 - DNA, 13 bp, D. melanogaster
tgtttattaatgc

SEQ ID NO: 661203 - DNA, 13 bp, D. melanogaster
tgtttattcaaat

SEQ ID NO: 661204 - DNA, 13 bp, D. melanogaster
tgtttattgcaaa

SEQ ID NO: 661205 - DNA, 13 bp, D. melanogaster
tgtttattgcatt

SEQ ID NO: 661206 - DNA, 13 bp, D. melanogaster
tgtttatttatac

SEQ ID NO: 661207 - DNA, 13 bp, D. melanogaster
tgtttatttcaat

SEQ ID NO: 661208 - DNA, 13 bp, D. melanogaster
tgtttatttcgat

SEQ ID NO: 661209 - DNA, 13 bp, D. melanogaster
tgtttatttgcca

SEQ ID NO: 661210 - DNA, 13 bp, D. melanogaster
tgtttatttgctc

SEQ ID NO: 661211 - DNA, 14 bp, D. melanogaster
tgtttatttgctta

SEQ ID NO: 661212 - DNA, 14 bp, D. melanogaster
tgtttatttggctt

SEQ ID NO: 661213 - DNA, 14 bp, D. melanogaster
tgtttatttgttgc

SEQ ID NO: 661214 - DNA, 13 bp, D. melanogaster
tgtttattttcag

SEQ ID NO: 661215 - DNA, 13 bp, D. melanogaster
tgtttattttggc

SEQ ID NO: 661216 - DNA, 14 bp, D. melanogaster
tgtttatttttgca

SEQ ID NO: 661217 - DNA, 13 bp, D. melanogaster
tgtttcaaaatca

SEQ ID NO: 661218 - DNA, 13 bp, D. melanogaster
tgtttcaaatata

SEQ ID NO: 661219 - DNA, 13 bp, D. melanogaster
tgtttcaaatgca

SEQ ID NO: 661220 - DNA, 13 bp, D. melanogaster
tgtttcaaattaa

SEQ ID NO: 661221 - DNA, 13 bp, D. melanogaster
tgtttcaatgaaa

SEQ ID NO: 661222 - DNA, 13 bp, D. melanogaster
tgtttcaattatt

SEQ ID NO: 661223 - DNA, 13 bp, D. melanogaster
tgtttcacatttt

SEQ ID NO: 661224 - DNA, 13 bp, D. melanogaster
tgtttcactttca

SEQ ID NO: 661225 - DNA, 13 bp, D. melanogaster
tgtttcagtttca

SEQ ID NO: 661226 - DNA, 13 bp, D. melanogaster
tgtttcatgtttc

SEQ ID NO: 661227 - DNA, 13 bp, D. melanogaster
tgtttcattaatt

SEQ ID NO: 661228 - DNA, 13 bp, D. melanogaster
tgtttcatttaat

SEQ ID NO: 661229 - DNA, 13 bp, D. melanogaster
tgtttcatttcat

SEQ ID NO: 661230 - DNA, 13 bp, D. melanogaster
tgtttcatttgaa

SEQ ID NO: 661231 - DNA, 13 bp, D. melanogaster
tgtttccaaaaat

SEQ ID NO: 661232 - DNA, 13 bp, D. melanogaster
tgtttccattgtt

SEQ ID NO: 661233 - DNA, 13 bp, D. melanogaster
tgtttccatttcc

SEQ ID NO: 661234 - DNA, 13 bp, D. melanogaster
tgtttccatttcg

SEQ ID NO: 661235 - DNA, 13 bp, D. melanogaster
tgtttccattttg

SEQ ID NO: 661236 - DNA, 13 bp, D. melanogaster
tgtttcccaaatc

SEQ ID NO: 661237 - DNA, 13 bp, D. melanogaster
tgtttcccatttt

SEQ ID NO: 661238 - DNA, 13 bp, D. melanogaster
tgtttccctaagt

SEQ ID NO: 661239 - DNA, 13 bp, D. melanogaster
tgtttccgtttcc

SEQ ID NO: 661240 - DNA, 14 bp, D. melanogaster
tgtttccgtttccg

SEQ ID NO: 661241 - DNA, 13 bp, D. melanogaster
tgtttcgaaattt

SEQ ID NO: 661242 - DNA, 13 bp, D. melanogaster
tgtttcgaataaa

SEQ ID NO: 661243 - DNA, 13 bp, D. melanogaster
tgtttcgactttt

SEQ ID NO: 661244 - DNA, 13 bp, D. melanogaster
tgtttcgatttta

SEQ ID NO: 661245 - DNA, 13 bp, D. melanogaster
tgtttcggattca

SEQ ID NO: 661246 - DNA, 13 bp, D. melanogaster
tgtttcgtatccg

SEQ ID NO: 661247 - DNA, 14 bp, D. melanogaster
tgtttcgtcctaaa

SEQ ID NO: 661248 - DNA, 13 bp, D. melanogaster
tgtttcgttaatg

SEQ ID NO: 661249 - DNA, 13 bp, D. melanogaster
tgtttcgtttcat

SEQ ID NO: 661250 - DNA, 14 bp, D. melanogaster
tgtttcgtttctta

SEQ ID NO: 661251 - DNA, 13 bp, D. melanogaster
tgtttctaattta

SEQ ID NO: 661252 - DNA, 13 bp, D. melanogaster
tgtttctgcattt

SEQ ID NO: 661253 - DNA, 14 bp, D. melanogaster
tgtttctgcattta

SEQ ID NO: 661254 - DNA, 13 bp, D. melanogaster
tgtttctgctgcc

SEQ ID NO: 661255 - DNA, 14 bp, D. melanogaster
tgtttctgctgctg

SEQ ID NO: 661256 - DNA, 13 bp, D. melanogaster
tgtttctgttgta

SEQ ID NO: 661257 - DNA, 13 bp, D. melanogaster
tgtttgaaaaaat

SEQ ID NO: 661258 - DNA, 13 bp, D. melanogaster
tgtttgaaaagct

SEQ ID NO: 661259 - DNA, 13 bp, D. melanogaster
tgtttgaaaatta

SEQ ID NO: 661260 - DNA, 14 bp, D. melanogaster
tgtttgaaatgttt

SEQ ID NO: 661261 - DNA, 13 bp, D. melanogaster
tgtttgaacaaat

SEQ ID NO: 661262 - DNA, 13 bp, D. melanogaster
tgtttgaacacaa

SEQ ID NO: 661263 - DNA, 13 bp, D. melanogaster
tgtttgaatatat

SEQ ID NO: 661264 - DNA, 13 bp, D. melanogaster
tgtttgaattgaa

SEQ ID NO: 661265 - DNA, 13 bp, D. melanogaster
tgtttgactttaa

SEQ ID NO: 661266 - DNA, 13 bp, D. melanogaster
tgtttgactttgt

SEQ ID NO: 661267 - DNA, 14 bp, D. melanogaster
tgtttgactttgtg

SEQ ID NO: 661268 - DNA, 13 bp, D. melanogaster
tgtttgacttttg

SEQ ID NO: 661269 - DNA, 13 bp, D. melanogaster
tgtttgagaaaaa

SEQ ID NO: 661270 - DNA, 13 bp, D. melanogaster
tgtttgataaaaa

SEQ ID NO: 661271 - DNA, 13 bp, D. melanogaster
tgtttgataaata

SEQ ID NO: 661272 - DNA, 13 bp, D. melanogaster
tgtttgataataa

SEQ ID NO: 661273 - DNA, 13 bp, D. melanogaster
tgtttgattaaaa

SEQ ID NO: 661274 - DNA, 13 bp, D. melanogaster
tgtttgatttcct

SEQ ID NO: 661275 - DNA, 13 bp, D. melanogaster
tgtttgatttgcg

SEQ ID NO: 661276 - DNA, 13 bp, D. melanogaster
tgtttgatttgct

SEQ ID NO: 661277 - DNA, 13 bp, D. melanogaster
tgtttgattttca

SEQ ID NO: 661278 - DNA, 13 bp, D. melanogaster
tgtttgcaaataa

SEQ ID NO: 661279 - DNA, 13 bp, D. melanogaster
tgtttgcaaatgc

SEQ ID NO: 661280 - DNA, 13 bp, D. melanogaster
tgtttgcaaatgt

SEQ ID NO: 661281 - DNA, 13 bp, D. melanogaster
tgtttgcacaaca

SEQ ID NO: 661282 - DNA, 13 bp, D. melanogaster
tgtttgcacaact

SEQ ID NO: 661283 - DNA, 13 bp, D. melanogaster
tgtttgcacactt

SEQ ID NO: 661284 - DNA, 13 bp, D. melanogaster
tgtttgcagtgca

SEQ ID NO: 661285 - DNA, 13 bp, D. melanogaster
tgtttgcatacaa

SEQ ID NO: 661286 - DNA, 13 bp, D. melanogaster
tgtttgcatatat

SEQ ID NO: 661287 - DNA, 13 bp, D. melanogaster
tgtttgcatatta

SEQ ID NO: 661288 - DNA, 13 bp, D. melanogaster
tgtttgcatattt

SEQ ID NO: 661289 - DNA, 13 bp, D. melanogaster
tgtttgcatgtgt

SEQ ID NO: 661290 - DNA, 13 bp, D. melanogaster
tgtttgcattaaa

SEQ ID NO: 661291 - DNA, 13 bp, D. melanogaster
tgtttgcattgca

SEQ ID NO: 661292 - DNA, 13 bp, D. melanogaster
tgtttgcattggc

SEQ ID NO: 661293 - DNA, 13 bp, D. melanogaster
tgtttgcatttga

SEQ ID NO: 661294 - DNA, 13 bp, D. melanogaster
tgtttgcatttgg

SEQ ID NO: 661295 - DNA, 14 bp, D. melanogaster
tgtttgcatttttg

SEQ ID NO: 661296 - DNA, 13 bp, D. melanogaster
tgtttgccaaaaa

SEQ ID NO: 661297 - DNA, 13 bp, D. melanogaster
tgtttgccaaagc

SEQ ID NO: 661298 - DNA, 13 bp, D. melanogaster
tgtttgccaaatt

SEQ ID NO: 661299 - DNA, 13 bp, D. melanogaster
tgtttgccaacaa

SEQ ID NO: 661300 - DNA, 13 bp, D. melanogaster
tgtttgccaactg

SEQ ID NO: 661301 - DNA, 13 bp, D. melanogaster
tgtttgccaactt

SEQ ID NO: 661302 - DNA, 13 bp, D. melanogaster
tgtttgccaagtt

SEQ ID NO: 661303 - DNA, 13 bp, D. melanogaster
tgtttgccaatgt

SEQ ID NO: 661304 - DNA, 13 bp, D. melanogaster
tgtttgccaattg

SEQ ID NO: 661305 - DNA, 13 bp, D. melanogaster
tgtttgccacaaa

SEQ ID NO: 661306 - DNA, 13 bp, D. melanogaster
tgtttgccacatt

SEQ ID NO: 661307 - DNA, 13 bp, D. melanogaster
tgtttgccacttt

SEQ ID NO: 661308 - DNA, 13 bp, D. melanogaster
tgtttgccagccg

SEQ ID NO: 661309 - DNA, 13 bp, D. melanogaster
tgtttgccagctt

SEQ ID NO: 661310 - DNA, 13 bp, D. melanogaster
tgtttgccagtgt

SEQ ID NO: 661311 - DNA, 13 bp, D. melanogaster
tgtttgccatgca

SEQ ID NO: 661312 - DNA, 13 bp, D. melanogaster
tgtttgccatgtt

SEQ ID NO: 661313 - DNA, 13 bp, D. melanogaster
tgtttgccattcg

SEQ ID NO: 661314 - DNA, 13 bp, D. melanogaster
tgtttgccattgt

SEQ ID NO: 661315 - DNA, 13 bp, D. melanogaster
tgtttgccatttg

SEQ ID NO: 661316 - DNA, 13 bp, D. melanogaster
tgtttgcccaaat

SEQ ID NO: 661317 - DNA, 13 bp, D. melanogaster
tgtttgcccaaca

SEQ ID NO: 661318 - DNA, 13 bp, D. melanogaster
tgtttgcccaact

SEQ ID NO: 661319 - DNA, 13 bp, D. melanogaster
tgtttgcccagaa

SEQ ID NO: 661320 - DNA, 13 bp, D. melanogaster
tgtttgcccagca

SEQ ID NO: 661321 - DNA, 13 bp, D. melanogaster
tgtttgcccagcc

SEQ ID NO: 661322 - DNA, 13 bp, D. melanogaster
tgtttgcccagct

SEQ ID NO: 661323 - DNA, 13 bp, D. melanogaster
tgtttgccctgcc

SEQ ID NO: 661324 - DNA, 13 bp, D. melanogaster
tgtttgccctggc

SEQ ID NO: 661325 - DNA, 13 bp, D. melanogaster
tgtttgccgcttg

SEQ ID NO: 661326 - DNA, 13 bp, D. melanogaster
tgtttgccgcttt

SEQ ID NO: 661327 - DNA, 13 bp, D. melanogaster
tgtttgccggcca

SEQ ID NO: 661328 - DNA, 13 bp, D. melanogaster
tgtttgccgttgt

SEQ ID NO: 661329 - DNA, 13 bp, D. melanogaster
tgtttgcctgcca

SEQ ID NO: 661330 - DNA, 13 bp, D. melanogaster
tgtttgccttatt

SEQ ID NO: 661331 - DNA, 13 bp, D. melanogaster
tgtttgccttggc

SEQ ID NO: 661332 - DNA, 13 bp, D. melanogaster
tgtttgccttgtg

SEQ ID NO: 661333 - DNA, 13 bp, D. melanogaster
tgtttgcctttaa

SEQ ID NO: 661334 - DNA, 13 bp, D. melanogaster
tgtttgcgccaag

SEQ ID NO: 661335 - DNA, 13 bp, D. melanogaster
tgtttgcgtttgc

SEQ ID NO: 661336 - DNA, 13 bp, D. melanogaster
tgtttgctatgct

SEQ ID NO: 661337 - DNA, 14 bp, D. melanogaster
tgtttgctatgcta

SEQ ID NO: 661338 - DNA, 13 bp, D. melanogaster
tgtttgctcaatt

SEQ ID NO: 661339 - DNA, 13 bp, D. melanogaster
tgtttgctcagca

SEQ ID NO: 661340 - DNA, 13 bp, D. melanogaster
tgtttgctcagct

SEQ ID NO: 661341 - DNA, 13 bp, D. melanogaster
tgtttgctctgct

SEQ ID NO: 661342 - DNA, 13 bp, D. melanogaster
tgtttgctgattt

SEQ ID NO: 661343 - DNA, 13 bp, D. melanogaster
tgtttgctggcaa

SEQ ID NO: 661344 - DNA, 13 bp, D. melanogaster
tgtttgctgtaat

SEQ ID NO: 661345 - DNA, 14 bp, D. melanogaster
tgtttgctgttggc

SEQ ID NO: 661346 - DNA, 13 bp, D. melanogaster
tgtttgcttaact

SEQ ID NO: 661347 - DNA, 13 bp, D. melanogaster
tgtttgcttaatt

SEQ ID NO: 661348 - DNA, 13 bp, D. melanogaster
tgtttgcttatct

SEQ ID NO: 661349 - DNA, 14 bp, D. melanogaster
tgtttgcttatttg

SEQ ID NO: 661350 - DNA, 13 bp, D. melanogaster
tgtttgcttggct

SEQ ID NO: 661351 - DNA, 14 bp, D. melanogaster
tgtttgcttgttat

SEQ ID NO: 661352 - DNA, 13 bp, D. melanogaster
tgtttgctttcac

SEQ ID NO: 661353 - DNA, 13 bp, D. melanogaster
tgtttgctttgcc

SEQ ID NO: 661354 - DNA, 13 bp, D. melanogaster
tgtttgcttttaa

SEQ ID NO: 661355 - DNA, 13 bp, D. melanogaster
tgtttggaaattt

SEQ ID NO: 661356 - DNA, 13 bp, D. melanogaster
tgtttggatgctg

SEQ ID NO: 661357 - DNA, 13 bp, D. melanogaster
tgtttggattgga

SEQ ID NO: 661358 - DNA, 13 bp, D. melanogaster
tgtttggcaaaca

SEQ ID NO: 661359 - DNA, 13 bp, D. melanogaster
tgtttggcaaatg

SEQ ID NO: 661360 - DNA, 13 bp, D. melanogaster
tgtttggcaactt

SEQ ID NO: 661361 - DNA, 13 bp, D. melanogaster
tgtttggcatttt

SEQ ID NO: 661362 - DNA, 14 bp, D. melanogaster
tgtttggcattttg

SEQ ID NO: 661363 - DNA, 13 bp, D. melanogaster
tgtttggccaaaa

SEQ ID NO: 661364 - DNA, 13 bp, D. melanogaster
tgtttggccaagt

SEQ ID NO: 661365 - DNA, 13 bp, D. melanogaster
tgtttggctattt

SEQ ID NO: 661366 - DNA, 13 bp, D. melanogaster
tgtttggctgctg

SEQ ID NO: 661367 - DNA, 13 bp, D. melanogaster
tgtttggctgctt

SEQ ID NO: 661368 - DNA, 13 bp, D. melanogaster
tgtttggctttta

SEQ ID NO: 661369 - DNA, 13 bp, D. melanogaster
tgtttggtgtatc

SEQ ID NO: 661370 - DNA, 13 bp, D. melanogaster
tgtttggtttcca

SEQ ID NO: 661371 - DNA, 13 bp, D. melanogaster
tgtttggttttca

SEQ ID NO: 661372 - DNA, 13 bp, D. melanogaster
tgtttgtaaaaca

SEQ ID NO: 661373 - DNA, 13 bp, D. melanogaster
tgtttgtaaaata

SEQ ID NO: 661374 - DNA, 13 bp, D. melanogaster
tgtttgtaaaatt

SEQ ID NO: 661375 - DNA, 13 bp, D. melanogaster
tgtttgtaaacaa

SEQ ID NO: 661376 - DNA, 13 bp, D. melanogaster
tgtttgtaaataa

SEQ ID NO: 661377 - DNA, 13 bp, D. melanogaster
tgtttgtaaatgt

SEQ ID NO: 661378 - DNA, 13 bp, D. melanogaster
tgtttgtataaat

SEQ ID NO: 661379 - DNA, 13 bp, D. melanogaster
tgtttgtatctgt

SEQ ID NO: 661380 - DNA, 13 bp, D. melanogaster
tgtttgtcaaaat

SEQ ID NO: 661381 - DNA, 13 bp, D. melanogaster
tgtttgtcaaatt

SEQ ID NO: 661382 - DNA, 13 bp, D. melanogaster
tgtttgtcctggc

SEQ ID NO: 661383 - DNA, 13 bp, D. melanogaster
tgtttgtcgaaaa

SEQ ID NO: 661384 - DNA, 13 bp, D. melanogaster
tgtttgtctaatt

SEQ ID NO: 661385 - DNA, 13 bp, D. melanogaster
tgtttgtctgcct

SEQ ID NO: 661386 - DNA, 13 bp, D. melanogaster
tgtttgtctgcgg

SEQ ID NO: 661387 - DNA, 13 bp, D. melanogaster
tgtttgtctgtat

SEQ ID NO: 661388 - DNA, 13 bp, D. melanogaster
tgtttgtctttca

SEQ ID NO: 661389 - DNA, 13 bp, D. melanogaster
tgtttgtgaaaat

SEQ ID NO: 661390 - DNA, 13 bp, D. melanogaster
tgtttgtgcaatt

SEQ ID NO: 661391 - DNA, 13 bp, D. melanogaster
tgtttgtgcagca

SEQ ID NO: 661392 - DNA, 13 bp, D. melanogaster
tgtttgtgcatgt

SEQ ID NO: 661393 - DNA, 13 bp, D. melanogaster
tgtttgtgccaca

SEQ ID NO: 661394 - DNA, 13 bp, D. melanogaster
tgtttgtgctgct

SEQ ID NO: 661395 - DNA, 13 bp, D. melanogaster
tgtttgtggcatt

SEQ ID NO: 661396 - DNA, 13 bp, D. melanogaster
tgtttgtggccaa

SEQ ID NO: 661397 - DNA, 13 bp, D. melanogaster
tgtttgtgtaaat

SEQ ID NO: 661398 - DNA, 13 bp, D. melanogaster
tgtttgtgtctgc

SEQ ID NO: 661399 - DNA, 13 bp, D. melanogaster
tgtttgtgtgaat

SEQ ID NO: 661400 - DNA, 13 bp, D. melanogaster
tgtttgtgttgca

SEQ ID NO: 661401 - DNA, 13 bp, D. melanogaster
tgtttgttaataa

SEQ ID NO: 661402 - DNA, 13 bp, D. melanogaster
tgtttgttgataa

SEQ ID NO: 661403 - DNA, 13 bp, D. melanogaster
tgtttgttgattc

SEQ ID NO: 661404 - DNA, 13 bp, D. melanogaster
tgtttgttgctgc

SEQ ID NO: 661405 - DNA, 13 bp, D. melanogaster
tgtttgttggcca

SEQ ID NO: 661406 - DNA, 14 bp, D. melanogaster
tgtttgttggccaa

SEQ ID NO: 661407 - DNA, 13 bp, D. melanogaster
tgtttgtttacaa

SEQ ID NO: 661408 - DNA, 13 bp, D. melanogaster
tgtttgtttacat

SEQ ID NO: 661409 - DNA, 13 bp, D. melanogaster
tgtttgtttcaaa

SEQ ID NO: 661410 - DNA, 13 bp, D. melanogaster
tgtttgtttccaa

SEQ ID NO: 661411 - DNA, 13 bp, D. melanogaster
tgtttgtttgcca

SEQ ID NO: 661412 - DNA, 14 bp, D. melanogaster
tgtttgtttgccca

SEQ ID NO: 661413 - DNA, 13 bp, D. melanogaster
tgtttgttttgca

SEQ ID NO: 661414 - DNA, 14 bp, D. melanogaster
tgtttgttttgcat

SEQ ID NO: 661415 - DNA, 13 bp, D. melanogaster
tgttttaaaacaa

SEQ ID NO: 661416 - DNA, 14 bp, D. melanogaster
tgttttaaaacaag

SEQ ID NO: 661417 - DNA, 14 bp, D. melanogaster
tgttttaaattcca

SEQ ID NO: 661418 - DNA, 13 bp, D. melanogaster
tgttttaatgaat

SEQ ID NO: 661419 - DNA, 13 bp, D. melanogaster
tgttttaattact

SEQ ID NO: 661420 - DNA, 13 bp, D. melanogaster
tgttttaattgaa

SEQ ID NO: 661421 - DNA, 13 bp, D. melanogaster
tgttttaatttca

SEQ ID NO: 661422 - DNA, 13 bp, D. melanogaster
tgttttaatttcg

SEQ ID NO: 661423 - DNA, 13 bp, D. melanogaster
tgttttacaaaaa

SEQ ID NO: 661424 - DNA, 13 bp, D. melanogaster
tgttttacaaatt

SEQ ID NO: 661425 - DNA, 13 bp, D. melanogaster
tgttttacaattt

SEQ ID NO: 661426 - DNA, 14 bp, D. melanogaster
tgttttacaatttt

SEQ ID NO: 661427 - DNA, 13 bp, D. melanogaster
tgttttaccaatt

SEQ ID NO: 661428 - DNA, 13 bp, D. melanogaster
tgttttagtaaat

SEQ ID NO: 661429 - DNA, 13 bp, D. melanogaster
tgttttatagatg

SEQ ID NO: 661430 - DNA, 13 bp, D. melanogaster
tgttttatgaatg

SEQ ID NO: 661431 - DNA, 13 bp, D. melanogaster
tgttttatgcgat

SEQ ID NO: 661432 - DNA, 13 bp, D. melanogaster
tgttttatgtaaa

SEQ ID NO: 661433 - DNA, 13 bp, D. melanogaster
tgttttatgtaca

SEQ ID NO: 661434 - DNA, 14 bp, D. melanogaster
tgttttatttgcca

SEQ ID NO: 661435 - DNA, 13 bp, D. melanogaster
tgttttcaaaaat

SEQ ID NO: 661436 - DNA, 13 bp, D. melanogaster
tgttttcaaagaa

SEQ ID NO: 661437 - DNA, 14 bp, D. melanogaster
tgttttcaagagtt

SEQ ID NO: 661438 - DNA, 14 bp, D. melanogaster
tgttttcaatattt

SEQ ID NO: 661439 - DNA, 13 bp, D. melanogaster
tgttttcaattcg

SEQ ID NO: 661440 - DNA, 13 bp, D. melanogaster
tgttttcaatttg

SEQ ID NO: 661441 - DNA, 13 bp, D. melanogaster
tgttttcacagtg

SEQ ID NO: 661442 - DNA, 13 bp, D. melanogaster
tgttttcacattt

SEQ ID NO: 661443 - DNA, 13 bp, D. melanogaster
tgttttcactgcc

SEQ ID NO: 661444 - DNA, 13 bp, D. melanogaster
tgttttcactttg

SEQ ID NO: 661445 - DNA, 14 bp, D. melanogaster
tgttttcagatctt

SEQ ID NO: 661446 - DNA, 13 bp, D. melanogaster
tgttttcagtgca

SEQ ID NO: 661447 - DNA, 14 bp, D. melanogaster
tgttttcagtgcat

SEQ ID NO: 661448 - DNA, 13 bp, D. melanogaster
tgttttcagtgta

SEQ ID NO: 661449 - DNA, 13 bp, D. melanogaster
tgttttcatcaaa

SEQ ID NO: 661450 - DNA, 13 bp, D. melanogaster
tgttttcattgat

SEQ ID NO: 661451 - DNA, 13 bp, D. melanogaster
tgttttcattgga

SEQ ID NO: 661452 - DNA, 14 bp, D. melanogaster
tgttttcattggac

SEQ ID NO: 661453 - DNA, 13 bp, D. melanogaster
tgttttcatttca

SEQ ID NO: 661454 - DNA, 14 bp, D. melanogaster
tgttttcatttcaa

SEQ ID NO: 661455 - DNA, 13 bp, D. melanogaster
tgttttccacaca

SEQ ID NO: 661456 - DNA, 13 bp, D. melanogaster
tgttttccacttt

SEQ ID NO: 661457 - DNA, 13 bp, D. melanogaster
tgttttccatatt

SEQ ID NO: 661458 - DNA, 13 bp, D. melanogaster
tgttttccatttc

SEQ ID NO: 661459 - DNA, 14 bp, D. melanogaster
tgttttccatttca

SEQ ID NO: 661460 - DNA, 13 bp, D. melanogaster
tgttttcccaaca

SEQ ID NO: 661461 - DNA, 13 bp, D. melanogaster
tgttttcccattt

SEQ ID NO: 661462 - DNA, 14 bp, D. melanogaster
tgttttcccatttc

SEQ ID NO: 661463 - DNA, 13 bp, D. melanogaster
tgttttccccaaa

SEQ ID NO: 661464 - DNA, 13 bp, D. melanogaster
tgttttcctactt

SEQ ID NO: 661465 - DNA, 13 bp, D. melanogaster
tgttttcgaattc

SEQ ID NO: 661466 - DNA, 14 bp, D. melanogaster
tgttttcgaattct

SEQ ID NO: 661467 - DNA, 13 bp, D. melanogaster
tgttttcgatgtt

SEQ ID NO: 661468 - DNA, 13 bp, D. melanogaster
tgttttcgctgtc

SEQ ID NO: 661469 - DNA, 13 bp, D. melanogaster
tgttttcgggccc

SEQ ID NO: 661470 - DNA, 13 bp, D. melanogaster
tgttttctccatt

SEQ ID NO: 661471 - DNA, 13 bp, D. melanogaster
tgttttctgtgca

SEQ ID NO: 661472 - DNA, 13 bp, D. melanogaster
tgttttctgttca

SEQ ID NO: 661473 - DNA, 13 bp, D. melanogaster
tgttttctttgca

SEQ ID NO: 661474 - DNA, 13 bp, D. melanogaster
tgttttgaaaagt

SEQ ID NO: 661475 - DNA, 13 bp, D. melanogaster
tgttttgaaaata

SEQ ID NO: 661476 - DNA, 13 bp, D. melanogaster
tgttttgaaatat

SEQ ID NO: 661477 - DNA, 13 bp, D. melanogaster
tgttttgaaattg

SEQ ID NO: 661478 - DNA, 13 bp, D. melanogaster
tgttttgaataca

SEQ ID NO: 661479 - DNA, 13 bp, D. melanogaster
tgttttgaatgct

SEQ ID NO: 661480 - DNA, 13 bp, D. melanogaster
tgttttgcaaaaa

SEQ ID NO: 661481 - DNA, 13 bp, D. melanogaster
tgttttgcaaaca

SEQ ID NO: 661482 - DNA, 13 bp, D. melanogaster
tgttttgcaattg

SEQ ID NO: 661483 - DNA, 13 bp, D. melanogaster
tgttttgcagttt

SEQ ID NO: 661484 - DNA, 13 bp, D. melanogaster
tgttttgcataca

SEQ ID NO: 661485 - DNA, 13 bp, D. melanogaster
tgttttgcattat

SEQ ID NO: 661486 - DNA, 13 bp, D. melanogaster
tgttttgcattcg

SEQ ID NO: 661487 - DNA, 13 bp, D. melanogaster
tgttttgcatttc

SEQ ID NO: 661488 - DNA, 13 bp, D. melanogaster
tgttttgccaaat

SEQ ID NO: 661489 - DNA, 13 bp, D. melanogaster
tgttttgccaaca

SEQ ID NO: 661490 - DNA, 13 bp, D. melanogaster
tgttttgccatat

SEQ ID NO: 661491 - DNA, 13 bp, D. melanogaster
tgttttgctagta

SEQ ID NO: 661492 - DNA, 13 bp, D. melanogaster
tgttttgctcatt

SEQ ID NO: 661493 - DNA, 13 bp, D. melanogaster
tgttttgctgacg

SEQ ID NO: 661494 - DNA, 13 bp, D. melanogaster
tgttttgctgctc

SEQ ID NO: 661495 - DNA, 13 bp, D. melanogaster
tgttttgctggca

SEQ ID NO: 661496 - DNA, 13 bp, D. melanogaster
tgttttgctttca

SEQ ID NO: 661497 - DNA, 13 bp, D. melanogaster
tgttttggcattt

SEQ ID NO: 661498 - DNA, 13 bp, D. melanogaster
tgttttggccaaa

SEQ ID NO: 661499 - DNA, 14 bp, D. melanogaster
tgttttggccaaaa

SEQ ID NO: 661500 - DNA, 14 bp, D. melanogaster
tgttttggccaaat

SEQ ID NO: 661501 - DNA, 13 bp, D. melanogaster
tgttttggccaat

SEQ ID NO: 661502 - DNA, 13 bp, D. melanogaster
tgttttggccact

SEQ ID NO: 661503 - DNA, 13 bp, D. melanogaster
tgttttggccatt

SEQ ID NO: 661504 - DNA, 13 bp, D. melanogaster
tgttttggccgca

SEQ ID NO: 661505 - DNA, 13 bp, D. melanogaster
tgttttggcggca

SEQ ID NO: 661506 - DNA, 13 bp, D. melanogaster
tgttttgggccat

SEQ ID NO: 661507 - DNA, 13 bp, D. melanogaster
tgttttggggcaa

SEQ ID NO: 661508 - DNA, 13 bp, D. melanogaster
tgttttggtaaat

SEQ ID NO: 661509 - DNA, 14 bp, D. melanogaster
tgttttggtaaatt

SEQ ID NO: 661510 - DNA, 13 bp, D. melanogaster
tgttttgtaaaca

SEQ ID NO: 661511 - DNA, 13 bp, D. melanogaster
tgttttgtataaa

SEQ ID NO: 661512 - DNA, 13 bp, D. melanogaster
tgttttgtgccct

SEQ ID NO: 661513 - DNA, 13 bp, D. melanogaster
tgttttgtgctat

SEQ ID NO: 661514 - DNA, 13 bp, D. melanogaster
tgtttttaaaaca

SEQ ID NO: 661515 - DNA, 13 bp, D. melanogaster
tgtttttaaagag

SEQ ID NO: 661516 - DNA, 13 bp, D. melanogaster
tgtttttaaagta

SEQ ID NO: 661517 - DNA, 13 bp, D. melanogaster
tgtttttaaatac

SEQ ID NO: 661518 - DNA, 13 bp, D. melanogaster
tgtttttaacatt

SEQ ID NO: 661519 - DNA, 14 bp, D. melanogaster
tgtttttaatatgc

SEQ ID NO: 661520 - DNA, 13 bp, D. melanogaster
tgtttttacaact

SEQ ID NO: 661521 - DNA, 13 bp, D. melanogaster
tgtttttagaaaa

SEQ ID NO: 661522 - DNA, 13 bp, D. melanogaster
tgtttttaggtaa

SEQ ID NO: 661523 - DNA, 13 bp, D. melanogaster
tgtttttataccc

SEQ ID NO: 661524 - DNA, 13 bp, D. melanogaster
tgtttttatcaat

SEQ ID NO: 661525 - DNA, 13 bp, D. melanogaster
tgtttttatggca

SEQ ID NO: 661526 - DNA, 13 bp, D. melanogaster
tgtttttatggct

SEQ ID NO: 661527 - DNA, 14 bp, D. melanogaster
tgtttttatttgcc

SEQ ID NO: 661528 - DNA, 13 bp, D. melanogaster
tgtttttcaaaaa

SEQ ID NO: 661529 - DNA, 13 bp, D. melanogaster
tgtttttcaactt

SEQ ID NO: 661530 - DNA, 13 bp, D. melanogaster
tgtttttcagtgt

SEQ ID NO: 661531 - DNA, 13 bp, D. melanogaster
tgtttttcataaa

SEQ ID NO: 661532 - DNA, 13 bp, D. melanogaster
tgtttttcatata

SEQ ID NO: 661533 - DNA, 13 bp, D. melanogaster
tgtttttccaaaa

SEQ ID NO: 661534 - DNA, 13 bp, D. melanogaster
tgtttttccaaca

SEQ ID NO: 661535 - DNA, 13 bp, D. melanogaster
tgtttttcgaaaa

SEQ ID NO: 661536 - DNA, 13 bp, D. melanogaster
tgtttttcgcatt

SEQ ID NO: 661537 - DNA, 13 bp, D. melanogaster
tgtttttcgccat

SEQ ID NO: 661538 - DNA, 13 bp, D. melanogaster
tgtttttctaaat

SEQ ID NO: 661539 - DNA, 13 bp, D. melanogaster
tgtttttctcact

SEQ ID NO: 661540 - DNA, 13 bp, D. melanogaster
tgtttttctctca

SEQ ID NO: 661541 - DNA, 13 bp, D. melanogaster
tgtttttgaaaaa

SEQ ID NO: 661542 - DNA, 14 bp, D. melanogaster
tgtttttgaaaaat

SEQ ID NO: 661543 - DNA, 13 bp, D. melanogaster
tgtttttgaaaag

SEQ ID NO: 661544 - DNA, 13 bp, D. melanogaster
tgtttttgacaaa

SEQ ID NO: 661545 - DNA, 13 bp, D. melanogaster
tgtttttgcaaca

SEQ ID NO: 661546 - DNA, 13 bp, D. melanogaster
tgtttttgccaaa

SEQ ID NO: 661547 - DNA, 13 bp, D. melanogaster
tgtttttgccact

SEQ ID NO: 661548 - DNA, 13 bp, D. melanogaster
tgtttttgccaga

SEQ ID NO: 661549 - DNA, 13 bp, D. melanogaster
tgtttttgccgct

SEQ ID NO: 661550 - DNA, 13 bp, D. melanogaster
tgtttttgctgcc

SEQ ID NO: 661551 - DNA, 13 bp, D. melanogaster
tgtttttggaaat

SEQ ID NO: 661552 - DNA, 13 bp, D. melanogaster
tgtttttggagag

SEQ ID NO: 661553 - DNA, 13 bp, D. melanogaster
tgtttttggcatt

SEQ ID NO: 661554 - DNA, 13 bp, D. melanogaster
tgtttttggctta

SEQ ID NO: 661555 - DNA, 13 bp, D. melanogaster
tgtttttgtacca

SEQ ID NO: 661556 - DNA, 14 bp, D. melanogaster
tgtttttgtaccat

SEQ ID NO: 661557 - DNA, 13 bp, D. melanogaster
tgtttttgtgcaa

SEQ ID NO: 661558 - DNA, 13 bp, D. melanogaster
tgtttttgtggaa

SEQ ID NO: 661559 - DNA, 14 bp, D. melanogaster
tgtttttgtgtaaa

SEQ ID NO: 661560 - DNA, 13 bp, D. melanogaster
tgttttttaacaa

SEQ ID NO: 661561 - DNA, 13 bp, D. melanogaster
tgttttttcagct

SEQ ID NO: 661562 - DNA, 14 bp, D. melanogaster
tgttttttccagtg

SEQ ID NO: 661563 - DNA, 13 bp, D. melanogaster
tgttttttcccat

SEQ ID NO: 661564 - DNA, 14 bp, D. melanogaster
tgttttttcccatc

SEQ ID NO: 661565 - DNA, 13 bp, D. melanogaster
tgttttttgcagc

SEQ ID NO: 661566 - DNA, 13 bp, D. melanogaster
tgttttttggcca

SEQ ID NO: 661567 - DNA, 14 bp, D. melanogaster
tgttttttggccac

SEQ ID NO: 661568 - DNA, 13 bp, D. melanogaster
tgtttttttccca

SEQ ID NO: 661569 - DNA, 13 bp, D. melanogaster
tgtttttttgcac

SEQ ID NO: 661570 - DNA, 13 bp, D. melanogaster
ttaaaaaaaactg

SEQ ID NO: 661571 - DNA, 13 bp, D. melanogaster
ttaaaaaaaggca

SEQ ID NO: 661572 - DNA, 13 bp, D. melanogaster
ttaaaaaaatgca

SEQ ID NO: 661573 - DNA, 14 bp, D. melanogaster
ttaaaaaagattgt

SEQ ID NO: 661574 - DNA, 13 bp, D. melanogaster
ttaaaaaagcagc

SEQ ID NO: 661575 - DNA, 13 bp, D. melanogaster
ttaaaaaagcatt

SEQ ID NO: 661576 - DNA, 13 bp, D. melanogaster
ttaaaaaagccaa

SEQ ID NO: 661577 - DNA, 13 bp, D. melanogaster
ttaaaaaaggatt

SEQ ID NO: 661578 - DNA, 13 bp, D. melanogaster
ttaaaaaaggcaa

SEQ ID NO: 661579 - DNA, 13 bp, D. melanogaster
ttaaaaaagtgtt

SEQ ID NO: 661580 - DNA, 13 bp, D. melanogaster
ttaaaaaagtttc

SEQ ID NO: 661581 - DNA, 13 bp, D. melanogaster
ttaaaaaatcatc

SEQ ID NO: 661582 - DNA, 13 bp, D. melanogaster
ttaaaaaatggtt

SEQ ID NO: 661583 - DNA, 13 bp, D. melanogaster
ttaaaaaattgct

SEQ ID NO: 661584 - DNA, 13 bp, D. melanogaster
ttaaaaaattgtc

SEQ ID NO: 661585 - DNA, 14 bp, D. melanogaster
ttaaaaacaaaatg

SEQ ID NO: 661586 - DNA, 13 bp, D. melanogaster
ttaaaaacaagag

SEQ ID NO: 661587 - DNA, 13 bp, D. melanogaster
ttaaaaacaagtt

SEQ ID NO: 661588 - DNA, 14 bp, D. melanogaster
ttaaaaacacattt

SEQ ID NO: 661589 - DNA, 13 bp, D. melanogaster
ttaaaaacacttt

SEQ ID NO: 661590 - DNA, 13 bp, D. melanogaster
ttaaaaacatttc

SEQ ID NO: 661591 - DNA, 13 bp, D. melanogaster
ttaaaaacatttg

SEQ ID NO: 661592 - DNA, 13 bp, D. melanogaster
ttaaaaaccattt

SEQ ID NO: 661593 - DNA, 14 bp, D. melanogaster
ttaaaaacccattt

SEQ ID NO: 661594 - DNA, 13 bp, D. melanogaster
ttaaaaaccttaa

SEQ ID NO: 661595 - DNA, 13 bp, D. melanogaster
ttaaaaaccttca

SEQ ID NO: 661596 - DNA, 14 bp, D. melanogaster
ttaaaaaccttttt

SEQ ID NO: 661597 - DNA, 13 bp, D. melanogaster
ttaaaaacgaaac

SEQ ID NO: 661598 - DNA, 13 bp, D. melanogaster
ttaaaaacgaaat

SEQ ID NO: 661599 - DNA, 13 bp, D. melanogaster
ttaaaaacgagtt

SEQ ID NO: 661600 - DNA, 13 bp, D. melanogaster
ttaaaaacgcatt

SEQ ID NO: 661601 - DNA, 13 bp, D. melanogaster
ttaaaaacgtttt

SEQ ID NO: 661602 - DNA, 13 bp, D. melanogaster
ttaaaaactatgt

SEQ ID NO: 661603 - DNA, 13 bp, D. melanogaster
ttaaaaactgaat

SEQ ID NO: 661604 - DNA, 13 bp, D. melanogaster
ttaaaaactgcaa

SEQ ID NO: 661605 - DNA, 13 bp, D. melanogaster
ttaaaaacttcat

SEQ ID NO: 661606 - DNA, 13 bp, D. melanogaster
ttaaaaacttttg

SEQ ID NO: 661607 - DNA, 14 bp, D. melanogaster
ttaaaaactttttg

SEQ ID NO: 661608 - DNA, 13 bp, D. melanogaster
ttaaaaagaaact

SEQ ID NO: 661609 - DNA, 14 bp, D. melanogaster
ttaaaaagaaagcg

SEQ ID NO: 661610 - DNA, 13 bp, D. melanogaster
ttaaaaagaaatc

SEQ ID NO: 661611 - DNA, 13 bp, D. melanogaster
ttaaaaagacatt

SEQ ID NO: 661612 - DNA, 13 bp, D. melanogaster
ttaaaaagagttt

SEQ ID NO: 661613 - DNA, 13 bp, D. melanogaster
ttaaaaagcaaca

SEQ ID NO: 661614 - DNA, 13 bp, D. melanogaster
ttaaaaagcatta

SEQ ID NO: 661615 - DNA, 13 bp, D. melanogaster
ttaaaaagcattt

SEQ ID NO: 661616 - DNA, 13 bp, D. melanogaster
ttaaaaagccaaa

SEQ ID NO: 661617 - DNA, 13 bp, D. melanogaster
ttaaaaagccatt

SEQ ID NO: 661618 - DNA, 13 bp, D. melanogaster
ttaaaaagcgttt

SEQ ID NO: 661619 - DNA, 13 bp, D. melanogaster
ttaaaaagctaat

SEQ ID NO: 661620 - DNA, 13 bp, D. melanogaster
ttaaaaagctttg

SEQ ID NO: 661621 - DNA, 13 bp, D. melanogaster
ttaaaaaggatat

SEQ ID NO: 661622 - DNA, 13 bp, D. melanogaster
ttaaaaaggattt

SEQ ID NO: 661623 - DNA, 13 bp, D. melanogaster
ttaaaaaggttat

SEQ ID NO: 661624 - DNA, 13 bp, D. melanogaster
ttaaaaaggtttt

SEQ ID NO: 661625 - DNA, 13 bp, D. melanogaster
ttaaaaagtcatt

SEQ ID NO: 661626 - DNA, 13 bp, D. melanogaster
ttaaaaagtgcat

SEQ ID NO: 661627 - DNA, 13 bp, D. melanogaster
ttaaaaagtgttt

SEQ ID NO: 661628 - DNA, 13 bp, D. melanogaster
ttaaaaagttgta

SEQ ID NO: 661629 - DNA, 13 bp, D. melanogaster
ttaaaaagttgtt

SEQ ID NO: 661630 - DNA, 13 bp, D. melanogaster
ttaaaaagtttac

SEQ ID NO: 661631 - DNA, 13 bp, D. melanogaster
ttaaaaagtttca

SEQ ID NO: 661632 - DNA, 13 bp, D. melanogaster
ttaaaaagtttcc

SEQ ID NO: 661633 - DNA, 13 bp, D. melanogaster
ttaaaaagtttga

SEQ ID NO: 661634 - DNA, 13 bp, D. melanogaster
ttaaaaataagtg

SEQ ID NO: 661635 - DNA, 13 bp, D. melanogaster
ttaaaaataatcg

SEQ ID NO: 661636 - DNA, 13 bp, D. melanogaster
ttaaaaatagatg

SEQ ID NO: 661637 - DNA, 13 bp, D. melanogaster
ttaaaaatagcgc

SEQ ID NO: 661638 - DNA, 13 bp, D. melanogaster
ttaaaaatagctt

SEQ ID NO: 661639 - DNA, 13 bp, D. melanogaster
ttaaaaatcagca

SEQ ID NO: 661640 - DNA, 13 bp, D. melanogaster
ttaaaaatccata

SEQ ID NO: 661641 - DNA, 13 bp, D. melanogaster
ttaaaaatccatt

SEQ ID NO: 661642 - DNA, 13 bp, D. melanogaster
ttaaaaatcgttt

SEQ ID NO: 661643 - DNA, 13 bp, D. melanogaster
ttaaaaatctaac

SEQ ID NO: 661644 - DNA, 13 bp, D. melanogaster
ttaaaaatcttgt

SEQ ID NO: 661645 - DNA, 13 bp, D. melanogaster
ttaaaaatgaatc

SEQ ID NO: 661646 - DNA, 14 bp, D. melanogaster
ttaaaaatgcaaaa

SEQ ID NO: 661647 - DNA, 14 bp, D. melanogaster
ttaaaaatgcaaat

SEQ ID NO: 661648 - DNA, 13 bp, D. melanogaster
ttaaaaatgcagc

SEQ ID NO: 661649 - DNA, 13 bp, D. melanogaster
ttaaaaatgcata

SEQ ID NO: 661650 - DNA, 13 bp, D. melanogaster
ttaaaaatgcatt

SEQ ID NO: 661651 - DNA, 14 bp, D. melanogaster
ttaaaaatgcatta

SEQ ID NO: 661652 - DNA, 13 bp, D. melanogaster
ttaaaaatgctaa

SEQ ID NO: 661653 - DNA, 13 bp, D. melanogaster
ttaaaaatgctga

SEQ ID NO: 661654 - DNA, 14 bp, D. melanogaster
ttaaaaatggaaag

SEQ ID NO: 661655 - DNA, 13 bp, D. melanogaster
ttaaaaatggtaa

SEQ ID NO: 661656 - DNA, 14 bp, D. melanogaster
ttaaaaatggtttt

SEQ ID NO: 661657 - DNA, 13 bp, D. melanogaster
ttaaaaatgtaac

SEQ ID NO: 661658 - DNA, 13 bp, D. melanogaster
ttaaaaatgtatc

SEQ ID NO: 661659 - DNA, 13 bp, D. melanogaster
ttaaaaatgtcaa

SEQ ID NO: 661660 - DNA, 13 bp, D. melanogaster
ttaaaaattcgaa

SEQ ID NO: 661661 - DNA, 13 bp, D. melanogaster
ttaaaaattgtga

SEQ ID NO: 661662 - DNA, 13 bp, D. melanogaster
ttaaaaattgttc

SEQ ID NO: 661663 - DNA, 13 bp, D. melanogaster
ttaaaaatttcca

SEQ ID NO: 661664 - DNA, 13 bp, D. melanogaster
ttaaaaatttcga

SEQ ID NO: 661665 - DNA, 13 bp, D. melanogaster
ttaaaacaaaagt

SEQ ID NO: 661666 - DNA, 13 bp, D. melanogaster
ttaaaacacattt

SEQ ID NO: 661667 - DNA, 13 bp, D. melanogaster
ttaaaacactttt

SEQ ID NO: 661668 - DNA, 13 bp, D. melanogaster
ttaaaacagcaaa

SEQ ID NO: 661669 - DNA, 14 bp, D. melanogaster
ttaaaacatatttc

SEQ ID NO: 661670 - DNA, 13 bp, D. melanogaster
ttaaaacatgttt

SEQ ID NO: 661671 - DNA, 13 bp, D. melanogaster
ttaaaacatttga

SEQ ID NO: 661672 - DNA, 13 bp, D. melanogaster
ttaaaacattttg

SEQ ID NO: 661673 - DNA, 14 bp, D. melanogaster
ttaaaacatttttc

SEQ ID NO: 661674 - DNA, 13 bp, D. melanogaster
ttaaaaccaaaag

SEQ ID NO: 661675 - DNA, 13 bp, D. melanogaster
ttaaaaccaagtt

SEQ ID NO: 661676 - DNA, 13 bp, D. melanogaster
ttaaaaccaattt

SEQ ID NO: 661677 - DNA, 13 bp, D. melanogaster
ttaaaaccatttc

SEQ ID NO: 661678 - DNA, 13 bp, D. melanogaster
ttaaaacccaatc

SEQ ID NO: 661679 - DNA, 13 bp, D. melanogaster
ttaaaacccaatt

SEQ ID NO: 661680 - DNA, 13 bp, D. melanogaster
ttaaaacccattt

SEQ ID NO: 661681 - DNA, 13 bp, D. melanogaster
ttaaaaccgaaac

SEQ ID NO: 661682 - DNA, 13 bp, D. melanogaster
ttaaaaccgcaaa

SEQ ID NO: 661683 - DNA, 13 bp, D. melanogaster
ttaaaacctatct

SEQ ID NO: 661684 - DNA, 14 bp, D. melanogaster
ttaaaacgaggaaa

SEQ ID NO: 661685 - DNA, 13 bp, D. melanogaster
ttaaaacgataaa

SEQ ID NO: 661686 - DNA, 13 bp, D. melanogaster
ttaaaacgattta

SEQ ID NO: 661687 - DNA, 13 bp, D. melanogaster
ttaaaacgatttt

SEQ ID NO: 661688 - DNA, 13 bp, D. melanogaster
ttaaaacgcaaat

SEQ ID NO: 661689 - DNA, 13 bp, D. melanogaster
ttaaaacgcattt

SEQ ID NO: 661690 - DNA, 13 bp, D. melanogaster
ttaaaacggaaat

SEQ ID NO: 661691 - DNA, 13 bp, D. melanogaster
ttaaaacgtatta

SEQ ID NO: 661692 - DNA, 14 bp, D. melanogaster
ttaaaacgtattaa

SEQ ID NO: 661693 - DNA, 13 bp, D. melanogaster
ttaaaactaaaag

SEQ ID NO: 661694 - DNA, 13 bp, D. melanogaster
ttaaaactaacta

SEQ ID NO: 661695 - DNA, 13 bp, D. melanogaster
ttaaaactaagaa

SEQ ID NO: 661696 - DNA, 13 bp, D. melanogaster
ttaaaactaatca

SEQ ID NO: 661697 - DNA, 13 bp, D. melanogaster
ttaaaactatgaa

SEQ ID NO: 661698 - DNA, 13 bp, D. melanogaster
ttaaaactgaaaa

SEQ ID NO: 661699 - DNA, 14 bp, D. melanogaster
ttaaaactgaaaat

SEQ ID NO: 661700 - DNA, 14 bp, D. melanogaster
ttaaaactgaaata

SEQ ID NO: 661701 - DNA, 13 bp, D. melanogaster
ttaaaactgcgcc

SEQ ID NO: 661702 - DNA, 14 bp, D. melanogaster
ttaaaactgcgcca

SEQ ID NO: 661703 - DNA, 14 bp, D. melanogaster
ttaaaactgtaaat

SEQ ID NO: 661704 - DNA, 13 bp, D. melanogaster
ttaaaactgtatt

SEQ ID NO: 661705 - DNA, 13 bp, D. melanogaster
ttaaaacttagtt

SEQ ID NO: 661706 - DNA, 13 bp, D. melanogaster
ttaaaacttcaaa

SEQ ID NO: 661707 - DNA, 13 bp, D. melanogaster
ttaaaacttgatt

SEQ ID NO: 661708 - DNA, 13 bp, D. melanogaster
ttaaaactttgaa

SEQ ID NO: 661709 - DNA, 13 bp, D. melanogaster
ttaaaacttttgc

SEQ ID NO: 661710 - DNA, 13 bp, D. melanogaster
ttaaaactttttc

SEQ ID NO: 661711 - DNA, 13 bp, D. melanogaster
ttaaaagaaaact

SEQ ID NO: 661712 - DNA, 14 bp, D. melanogaster
ttaaaagaaaactt

SEQ ID NO: 661713 - DNA, 13 bp, D. melanogaster
ttaaaagaaactt

SEQ ID NO: 661714 - DNA, 13 bp, D. melanogaster
ttaaaagaaatca

SEQ ID NO: 661715 - DNA, 13 bp, D. melanogaster
ttaaaagacattt

SEQ ID NO: 661716 - DNA, 13 bp, D. melanogaster
ttaaaagagattt

SEQ ID NO: 661717 - DNA, 13 bp, D. melanogaster
ttaaaagagttta

SEQ ID NO: 661718 - DNA, 13 bp, D. melanogaster
ttaaaagcaaaca

SEQ ID NO: 661719 - DNA, 13 bp, D. melanogaster
ttaaaagcaataa

SEQ ID NO: 661720 - DNA, 14 bp, D. melanogaster
ttaaaagcaataaa

SEQ ID NO: 661721 - DNA, 13 bp, D. melanogaster
ttaaaagcaatta

SEQ ID NO: 661722 - DNA, 13 bp, D. melanogaster
ttaaaagcaattc

SEQ ID NO: 661723 - DNA, 13 bp, D. melanogaster
ttaaaagcaattt

SEQ ID NO: 661724 - DNA, 13 bp, D. melanogaster
ttaaaagcacatt

SEQ ID NO: 661725 - DNA, 13 bp, D. melanogaster
ttaaaagcataaa

SEQ ID NO: 661726 - DNA, 13 bp, D. melanogaster
ttaaaagcatact

SEQ ID NO: 661727 - DNA, 13 bp, D. melanogaster
ttaaaagcatttc

SEQ ID NO: 661728 - DNA, 13 bp, D. melanogaster
ttaaaagcatttt

SEQ ID NO: 661729 - DNA, 13 bp, D. melanogaster
ttaaaagccaaaa

SEQ ID NO: 661730 - DNA, 13 bp, D. melanogaster
ttaaaagccaaat

SEQ ID NO: 661731 - DNA, 13 bp, D. melanogaster
ttaaaagccaaca

SEQ ID NO: 661732 - DNA, 13 bp, D. melanogaster
ttaaaagccacaa

SEQ ID NO: 661733 - DNA, 13 bp, D. melanogaster
ttaaaagccttat

SEQ ID NO: 661734 - DNA, 13 bp, D. melanogaster
ttaaaagcgaaat

SEQ ID NO: 661735 - DNA, 13 bp, D. melanogaster
ttaaaagcgattt

SEQ ID NO: 661736 - DNA, 13 bp, D. melanogaster
ttaaaagcttaaa

SEQ ID NO: 661737 - DNA, 14 bp, D. melanogaster
ttaaaagcttaaaa

SEQ ID NO: 661738 - DNA, 13 bp, D. melanogaster
ttaaaagctttaa

SEQ ID NO: 661739 - DNA, 13 bp, D. melanogaster
ttaaaagcttttt

SEQ ID NO: 661740 - DNA, 13 bp, D. melanogaster
ttaaaaggcattt

SEQ ID NO: 661741 - DNA, 13 bp, D. melanogaster
ttaaaaggcttaa

SEQ ID NO: 661742 - DNA, 13 bp, D. melanogaster
ttaaaagggaaat

SEQ ID NO: 661743 - DNA, 13 bp, D. melanogaster
ttaaaagtaatgt

SEQ ID NO: 661744 - DNA, 13 bp, D. melanogaster
ttaaaagtactta

SEQ ID NO: 661745 - DNA, 13 bp, D. melanogaster
ttaaaagtacttt

SEQ ID NO: 661746 - DNA, 13 bp, D. melanogaster
ttaaaagtagagc

SEQ ID NO: 661747 - DNA, 13 bp, D. melanogaster
ttaaaagtatttc

SEQ ID NO: 661748 - DNA, 13 bp, D. melanogaster
ttaaaagtcaaaa

SEQ ID NO: 661749 - DNA, 13 bp, D. melanogaster
ttaaaagtgattt

SEQ ID NO: 661750 - DNA, 13 bp, D. melanogaster
ttaaaagtgcaat

SEQ ID NO: 661751 - DNA, 13 bp, D. melanogaster
ttaaaagtgcatt

SEQ ID NO: 661752 - DNA, 14 bp, D. melanogaster
ttaaaagtgcattt

SEQ ID NO: 661753 - DNA, 13 bp, D. melanogaster
ttaaaagtggttt

SEQ ID NO: 661754 - DNA, 13 bp, D. melanogaster
ttaaaagtgttta

SEQ ID NO: 661755 - DNA, 15 bp, D. melanogaster
ttaaaagtgtttcaa

SEQ ID NO: 661756 - DNA, 13 bp, D. melanogaster
ttaaaagtgtttt

SEQ ID NO: 661757 - DNA, 13 bp, D. melanogaster
ttaaaagttatct

SEQ ID NO: 661758 - DNA, 13 bp, D. melanogaster
ttaaaagttctta

SEQ ID NO: 661759 - DNA, 13 bp, D. melanogaster
ttaaaagttgcaa

SEQ ID NO: 661760 - DNA, 13 bp, D. melanogaster
ttaaaagttgttg

SEQ ID NO: 661761 - DNA, 13 bp, D. melanogaster
ttaaaagtttcct

SEQ ID NO: 661762 - DNA, 14 bp, D. melanogaster
ttaaaagtttcctg

SEQ ID NO: 661763 - DNA, 13 bp, D. melanogaster
ttaaaagtttctg

SEQ ID NO: 661764 - DNA, 13 bp, D. melanogaster
ttaaaagttttag

SEQ ID NO: 661765 - DNA, 13 bp, D. melanogaster
ttaaaataaaggg

SEQ ID NO: 661766 - DNA, 13 bp, D. melanogaster
ttaaaataaatcc

SEQ ID NO: 661767 - DNA, 14 bp, D. melanogaster
ttaaaataaatgca

SEQ ID NO: 661768 - DNA, 14 bp, D. melanogaster
ttaaaataaatgtg

SEQ ID NO: 661769 - DNA, 14 bp, D. melanogaster
ttaaaataagcaaa

SEQ ID NO: 661770 - DNA, 13 bp, D. melanogaster
ttaaaataatgtg

SEQ ID NO: 661771 - DNA, 13 bp, D. melanogaster
ttaaaataattcc

SEQ ID NO: 661772 - DNA, 13 bp, D. melanogaster
ttaaaatacaacc

SEQ ID NO: 661773 - DNA, 13 bp, D. melanogaster
ttaaaatacaatc

SEQ ID NO: 661774 - DNA, 13 bp, D. melanogaster
ttaaaataccttt

SEQ ID NO: 661775 - DNA, 13 bp, D. melanogaster
ttaaaatatccat

SEQ ID NO: 661776 - DNA, 13 bp, D. melanogaster
ttaaaatatgtac

SEQ ID NO: 661777 - DNA, 14 bp, D. melanogaster
ttaaaatattcatg

SEQ ID NO: 661778 - DNA, 13 bp, D. melanogaster
ttaaaatattgca

SEQ ID NO: 661779 - DNA, 13 bp, D. melanogaster
ttaaaatcaaact

SEQ ID NO: 661780 - DNA, 13 bp, D. melanogaster
ttaaaatcaaaga

SEQ ID NO: 661781 - DNA, 13 bp, D. melanogaster
ttaaaatcaaagt

SEQ ID NO: 661782 - DNA, 13 bp, D. melanogaster
ttaaaatcaactt

SEQ ID NO: 661783 - DNA, 13 bp, D. melanogaster
ttaaaatcaattg

SEQ ID NO: 661784 - DNA, 13 bp, D. melanogaster
ttaaaatcacatt

SEQ ID NO: 661785 - DNA, 13 bp, D. melanogaster
ttaaaatcagatt

SEQ ID NO: 661786 - DNA, 13 bp, D. melanogaster
ttaaaatcatatg

SEQ ID NO: 661787 - DNA, 14 bp, D. melanogaster
ttaaaatcattaag

SEQ ID NO: 661788 - DNA, 13 bp, D. melanogaster
ttaaaatccaatt

SEQ ID NO: 661789 - DNA, 13 bp, D. melanogaster
ttaaaatccattt

SEQ ID NO: 661790 - DNA, 14 bp, D. melanogaster
ttaaaatccatttt

SEQ ID NO: 661791 - DNA, 13 bp, D. melanogaster
ttaaaatcgaaat

SEQ ID NO: 661792 - DNA, 13 bp, D. melanogaster
ttaaaatcgaaca

SEQ ID NO: 661793 - DNA, 13 bp, D. melanogaster
ttaaaatcgaatt

SEQ ID NO: 661794 - DNA, 13 bp, D. melanogaster
ttaaaatcgatta

SEQ ID NO: 661795 - DNA, 13 bp, D. melanogaster
ttaaaatcgccgc

SEQ ID NO: 661796 - DNA, 13 bp, D. melanogaster
ttaaaatcgcttt

SEQ ID NO: 661797 - DNA, 13 bp, D. melanogaster
ttaaaatcgtaat

SEQ ID NO: 661798 - DNA, 13 bp, D. melanogaster
ttaaaatcgtatt

SEQ ID NO: 661799 - DNA, 13 bp, D. melanogaster
ttaaaatctatga

SEQ ID NO: 661800 - DNA, 14 bp, D. melanogaster
ttaaaatctatgaa

SEQ ID NO: 661801 - DNA, 13 bp, D. melanogaster
ttaaaatctgttt

SEQ ID NO: 661802 - DNA, 13 bp, D. melanogaster
ttaaaatgattgt

SEQ ID NO: 661803 - DNA, 13 bp, D. melanogaster
ttaaaatgcaaac

SEQ ID NO: 661804 - DNA, 13 bp, D. melanogaster
ttaaaatgcaaat

SEQ ID NO: 661805 - DNA, 14 bp, D. melanogaster
ttaaaatgcaataa

SEQ ID NO: 661806 - DNA, 13 bp, D. melanogaster
ttaaaatgcaatc

SEQ ID NO: 661807 - DNA, 13 bp, D. melanogaster
ttaaaatgcaatt

SEQ ID NO: 661808 - DNA, 14 bp, D. melanogaster
ttaaaatgcaattt

SEQ ID NO: 661809 - DNA, 13 bp, D. melanogaster
ttaaaatgcattt

SEQ ID NO: 661810 - DNA, 14 bp, D. melanogaster
ttaaaatgcattta

SEQ ID NO: 661811 - DNA, 14 bp, D. melanogaster
ttaaaatgcatttg

SEQ ID NO: 661812 - DNA, 13 bp, D. melanogaster
ttaaaatgccagt

SEQ ID NO: 661813 - DNA, 13 bp, D. melanogaster
ttaaaatgccatt

SEQ ID NO: 661814 - DNA, 13 bp, D. melanogaster
ttaaaatgctaat

SEQ ID NO: 661815 - DNA, 14 bp, D. melanogaster
ttaaaatgctaatt

SEQ ID NO: 661816 - DNA, 13 bp, D. melanogaster
ttaaaatgctgcc

SEQ ID NO: 661817 - DNA, 13 bp, D. melanogaster
ttaaaatgctgtt

SEQ ID NO: 661818 - DNA, 13 bp, D. melanogaster
ttaaaatgcttat

SEQ ID NO: 661819 - DNA, 13 bp, D. melanogaster
ttaaaatgctttt

SEQ ID NO: 661820 - DNA, 14 bp, D. melanogaster
ttaaaatggaaatt

SEQ ID NO: 661821 - DNA, 13 bp, D. melanogaster
ttaaaatggaatt

SEQ ID NO: 661822 - DNA, 13 bp, D. melanogaster
ttaaaatggcaaa

SEQ ID NO: 661823 - DNA, 13 bp, D. melanogaster
ttaaaatggcaat

SEQ ID NO: 661824 - DNA, 13 bp, D. melanogaster
ttaaaatggccat

SEQ ID NO: 661825 - DNA, 13 bp, D. melanogaster
ttaaaatggttat

SEQ ID NO: 661826 - DNA, 13 bp, D. melanogaster
ttaaaatgtacat

SEQ ID NO: 661827 - DNA, 13 bp, D. melanogaster
ttaaaatgtatct

SEQ ID NO: 661828 - DNA, 13 bp, D. melanogaster
ttaaaatgtatgc

SEQ ID NO: 661829 - DNA, 14 bp, D. melanogaster
ttaaaatgtcaaca

SEQ ID NO: 661830 - DNA, 13 bp, D. melanogaster
ttaaaatgtcaca

SEQ ID NO: 661831 - DNA, 13 bp, D. melanogaster
ttaaaatgtgcaa

SEQ ID NO: 661832 - DNA, 13 bp, D. melanogaster
ttaaaatgttaac

SEQ ID NO: 661833 - DNA, 13 bp, D. melanogaster
ttaaaatgttgtt

SEQ ID NO: 661834 - DNA, 13 bp, D. melanogaster
ttaaaatgtttac

SEQ ID NO: 661835 - DNA, 13 bp, D. melanogaster
ttaaaatgtttct

SEQ ID NO: 661836 - DNA, 13 bp, D. melanogaster
ttaaaatgttttc

SEQ ID NO: 661837 - DNA, 13 bp, D. melanogaster
ttaaaattaccaa

SEQ ID NO: 661838 - DNA, 13 bp, D. melanogaster
ttaaaattatgca

SEQ ID NO: 661839 - DNA, 13 bp, D. melanogaster
ttaaaattcaaac

SEQ ID NO: 661840 - DNA, 13 bp, D. melanogaster
ttaaaattccaat

SEQ ID NO: 661841 - DNA, 13 bp, D. melanogaster
ttaaaattccatt

SEQ ID NO: 661842 - DNA, 13 bp, D. melanogaster
ttaaaattcccaa

SEQ ID NO: 661843 - DNA, 13 bp, D. melanogaster
ttaaaattcgaaa

SEQ ID NO: 661844 - DNA, 13 bp, D. melanogaster
ttaaaattgaact

SEQ ID NO: 661845 - DNA, 13 bp, D. melanogaster
ttaaaattgagtt

SEQ ID NO: 661846 - DNA, 13 bp, D. melanogaster
ttaaaattgcagc

SEQ ID NO: 661847 - DNA, 14 bp, D. melanogaster
ttaaaattgcattt

SEQ ID NO: 661848 - DNA, 13 bp, D. melanogaster
ttaaaattgccaa

SEQ ID NO: 661849 - DNA, 13 bp, D. melanogaster
ttaaaattggaat

SEQ ID NO: 661850 - DNA, 13 bp, D. melanogaster
ttaaaattgttca

SEQ ID NO: 661851 - DNA, 14 bp, D. melanogaster
ttaaaattgttttc

SEQ ID NO: 661852 - DNA, 13 bp, D. melanogaster
ttaaaatttcagc

SEQ ID NO: 661853 - DNA, 14 bp, D. melanogaster
ttaaaatttgcaaa

SEQ ID NO: 661854 - DNA, 13 bp, D. melanogaster
ttaaaatttggtt

SEQ ID NO: 661855 - DNA, 13 bp, D. melanogaster
ttaaaattttcca

SEQ ID NO: 661856 - DNA, 13 bp, D. melanogaster
ttaaaattttcgc

SEQ ID NO: 661857 - DNA, 13 bp, D. melanogaster
ttaaacaaaaacg

SEQ ID NO: 661858 - DNA, 13 bp, D. melanogaster
ttaaacaaaaagt

SEQ ID NO: 661859 - DNA, 13 bp, D. melanogaster
ttaaacaaaaatg

SEQ ID NO: 661860 - DNA, 13 bp, D. melanogaster
ttaaacaaaagtc

SEQ ID NO: 661861 - DNA, 14 bp, D. melanogaster
ttaaacaaaagtcc

SEQ ID NO: 661862 - DNA, 13 bp, D. melanogaster
ttaaacaaaatag

SEQ ID NO: 661863 - DNA, 13 bp, D. melanogaster
ttaaacaaaattc

SEQ ID NO: 661864 - DNA, 13 bp, D. melanogaster
ttaaacaaagaca

SEQ ID NO: 661865 - DNA, 14 bp, D. melanogaster
ttaaacaaagacaa

SEQ ID NO: 661866 - DNA, 13 bp, D. melanogaster
ttaaacaaatagc

SEQ ID NO: 661867 - DNA, 13 bp, D. melanogaster
ttaaacaaatgag

SEQ ID NO: 661868 - DNA, 13 bp, D. melanogaster
ttaaacaaattga

SEQ ID NO: 661869 - DNA, 14 bp, D. melanogaster
ttaaacaaattgaa

SEQ ID NO: 661870 - DNA, 14 bp, D. melanogaster
ttaaacaaattgtt

SEQ ID NO: 661871 - DNA, 13 bp, D. melanogaster
ttaaacaacacta

SEQ ID NO: 661872 - DNA, 13 bp, D. melanogaster
ttaaacaacattt

SEQ ID NO: 661873 - DNA, 13 bp, D. melanogaster
ttaaacaaccttt

SEQ ID NO: 661874 - DNA, 14 bp, D. melanogaster
ttaaacaacctttt

SEQ ID NO: 661875 - DNA, 13 bp, D. melanogaster
ttaaacaactgca

SEQ ID NO: 661876 - DNA, 13 bp, D. melanogaster
ttaaacaactttt

SEQ ID NO: 661877 - DNA, 13 bp, D. melanogaster
ttaaacaagaaat

SEQ ID NO: 661878 - DNA, 13 bp, D. melanogaster
ttaaacaagctga

SEQ ID NO: 661879 - DNA, 13 bp, D. melanogaster
ttaaacaagtaaa

SEQ ID NO: 661880 - DNA, 13 bp, D. melanogaster
ttaaacaagtttt

SEQ ID NO: 661881 - DNA, 13 bp, D. melanogaster
ttaaacaattcat

SEQ ID NO: 661882 - DNA, 13 bp, D. melanogaster
ttaaacaatttcg

SEQ ID NO: 661883 - DNA, 13 bp, D. melanogaster
ttaaacaatttgc

SEQ ID NO: 661884 - DNA, 13 bp, D. melanogaster
ttaaacaatttgg

SEQ ID NO: 661885 - DNA, 13 bp, D. melanogaster
ttaaacaatttgt

SEQ ID NO: 661886 - DNA, 14 bp, D. melanogaster
ttaaacaattttga

SEQ ID NO: 661887 - DNA, 13 bp, D. melanogaster
ttaaacacaaagt

SEQ ID NO: 661888 - DNA, 14 bp, D. melanogaster
ttaaacacaaagtg

SEQ ID NO: 661889 - DNA, 13 bp, D. melanogaster
ttaaacacaaatt

SEQ ID NO: 661890 - DNA, 13 bp, D. melanogaster
ttaaacacattaa

SEQ ID NO: 661891 - DNA, 13 bp, D. melanogaster
ttaaacacttaaa

SEQ ID NO: 661892 - DNA, 14 bp, D. melanogaster
ttaaacacttaaat

SEQ ID NO: 661893 - DNA, 13 bp, D. melanogaster
ttaaacacttttg

SEQ ID NO: 661894 - DNA, 13 bp, D. melanogaster
ttaaacagcaaaa

SEQ ID NO: 661895 - DNA, 13 bp, D. melanogaster
ttaaacagctttt

SEQ ID NO: 661896 - DNA, 13 bp, D. melanogaster
ttaaacatcaatt

SEQ ID NO: 661897 - DNA, 13 bp, D. melanogaster
ttaaacatccaat

SEQ ID NO: 661898 - DNA, 13 bp, D. melanogaster
ttaaacatctaaa

SEQ ID NO: 661899 - DNA, 13 bp, D. melanogaster
ttaaacatggaaa

SEQ ID NO: 661900 - DNA, 13 bp, D. melanogaster
ttaaacatgtttc

SEQ ID NO: 661901 - DNA, 13 bp, D. melanogaster
ttaaacatgtttt

SEQ ID NO: 661902 - DNA, 13 bp, D. melanogaster
ttaaacattgatt

SEQ ID NO: 661903 - DNA, 13 bp, D. melanogaster
ttaaacatttatg

SEQ ID NO: 661904 - DNA, 14 bp, D. melanogaster
ttaaacatttcaat

SEQ ID NO: 661905 - DNA, 13 bp, D. melanogaster
ttaaacatttgaa

SEQ ID NO: 661906 - DNA, 13 bp, D. melanogaster
ttaaacatttgct

SEQ ID NO: 661907 - DNA, 13 bp, D. melanogaster
ttaaacattttca

SEQ ID NO: 661908 - DNA, 14 bp, D. melanogaster
ttaaacattttcaa

SEQ ID NO: 661909 - DNA, 13 bp, D. melanogaster
ttaaacattttgc

SEQ ID NO: 661910 - DNA, 13 bp, D. melanogaster
ttaaacatttttc

SEQ ID NO: 661911 - DNA, 13 bp, D. melanogaster
ttaaaccaaatcc

SEQ ID NO: 661912 - DNA, 13 bp, D. melanogaster
ttaaaccaattaa

SEQ ID NO: 661913 - DNA, 13 bp, D. melanogaster
ttaaaccagaaat

SEQ ID NO: 661914 - DNA, 13 bp, D. melanogaster
ttaaaccatattt

SEQ ID NO: 661915 - DNA, 13 bp, D. melanogaster
ttaaaccatcaac

SEQ ID NO: 661916 - DNA, 13 bp, D. melanogaster
ttaaaccatcgaa

SEQ ID NO: 661917 - DNA, 13 bp, D. melanogaster
ttaaaccatttat

SEQ ID NO: 661918 - DNA, 13 bp, D. melanogaster
ttaaaccattttt

SEQ ID NO: 661919 - DNA, 13 bp, D. melanogaster
ttaaacctgaaaa

SEQ ID NO: 661920 - DNA, 13 bp, D. melanogaster
ttaaaccttgaaa

SEQ ID NO: 661921 - DNA, 13 bp, D. melanogaster
ttaaacgaaaaca

SEQ ID NO: 661922 - DNA, 13 bp, D. melanogaster
ttaaacgaaaagt

SEQ ID NO: 661923 - DNA, 13 bp, D. melanogaster
ttaaacgaaaata

SEQ ID NO: 661924 - DNA, 13 bp, D. melanogaster
ttaaacgaaataa

SEQ ID NO: 661925 - DNA, 13 bp, D. melanogaster
ttaaacgaaatta

SEQ ID NO: 661926 - DNA, 13 bp, D. melanogaster
ttaaacgaatttc

SEQ ID NO: 661927 - DNA, 13 bp, D. melanogaster
ttaaacgagtttt

SEQ ID NO: 661928 - DNA, 13 bp, D. melanogaster
ttaaacgattaaa

SEQ ID NO: 661929 - DNA, 13 bp, D. melanogaster
ttaaacgattttg

SEQ ID NO: 661930 - DNA, 13 bp, D. melanogaster
ttaaacgattttt

SEQ ID NO: 661931 - DNA, 13 bp, D. melanogaster
ttaaacgcaaaaa

SEQ ID NO: 661932 - DNA, 13 bp, D. melanogaster
ttaaacgcaaatt

SEQ ID NO: 661933 - DNA, 13 bp, D. melanogaster
ttaaacgcattta

SEQ ID NO: 661934 - DNA, 13 bp, D. melanogaster
ttaaacgccattt

SEQ ID NO: 661935 - DNA, 13 bp, D. melanogaster
ttaaacgttttat

SEQ ID NO: 661936 - DNA, 13 bp, D. melanogaster
ttaaacgttttct

SEQ ID NO: 661937 - DNA, 13 bp, D. melanogaster
ttaaactaaaatc

SEQ ID NO: 661938 - DNA, 13 bp, D. melanogaster
ttaaactaaacta

SEQ ID NO: 661939 - DNA, 13 bp, D. melanogaster
ttaaactaaagtt

SEQ ID NO: 661940 - DNA, 13 bp, D. melanogaster
ttaaactagaaaa

SEQ ID NO: 661941 - DNA, 13 bp, D. melanogaster
ttaaactagttta

SEQ ID NO: 661942 - DNA, 13 bp, D. melanogaster
ttaaactcatttt

SEQ ID NO: 661943 - DNA, 13 bp, D. melanogaster
ttaaactgaaaat

SEQ ID NO: 661944 - DNA, 13 bp, D. melanogaster
ttaaactgaattt

SEQ ID NO: 661945 - DNA, 13 bp, D. melanogaster
ttaaactgacatt

SEQ ID NO: 661946 - DNA, 13 bp, D. melanogaster
ttaaactgcaaat

SEQ ID NO: 661947 - DNA, 13 bp, D. melanogaster
ttaaactgcaatt

SEQ ID NO: 661948 - DNA, 13 bp, D. melanogaster
ttaaactgcattt

SEQ ID NO: 661949 - DNA, 13 bp, D. melanogaster
ttaaactggtttt

SEQ ID NO: 661950 - DNA, 13 bp, D. melanogaster
ttaaactgttatg

SEQ ID NO: 661951 - DNA, 13 bp, D. melanogaster
ttaaactgtttgc

SEQ ID NO: 661952 - DNA, 13 bp, D. melanogaster
ttaaacttaaact

SEQ ID NO: 661953 - DNA, 14 bp, D. melanogaster
ttaaacttaaactt

SEQ ID NO: 661954 - DNA, 13 bp, D. melanogaster
ttaaacttaaagc

SEQ ID NO: 661955 - DNA, 13 bp, D. melanogaster
ttaaacttattgt

SEQ ID NO: 661956 - DNA, 13 bp, D. melanogaster
ttaaacttcaatt

SEQ ID NO: 661957 - DNA, 13 bp, D. melanogaster
ttaaacttgaaaa

SEQ ID NO: 661958 - DNA, 14 bp, D. melanogaster
ttaaacttgaaaat

SEQ ID NO: 661959 - DNA, 13 bp, D. melanogaster
ttaaacttgaact

SEQ ID NO: 661960 - DNA, 13 bp, D. melanogaster
ttaaacttgattt

SEQ ID NO: 661961 - DNA, 13 bp, D. melanogaster
ttaaactttaaac

SEQ ID NO: 661962 - DNA, 14 bp, D. melanogaster
ttaaactttaaact

SEQ ID NO: 661963 - DNA, 13 bp, D. melanogaster
ttaaactttaagt

SEQ ID NO: 661964 - DNA, 13 bp, D. melanogaster
ttaaactttaatg

SEQ ID NO: 661965 - DNA, 13 bp, D. melanogaster
ttaaactttagtt

SEQ ID NO: 661966 - DNA, 13 bp, D. melanogaster
ttaaacttttacc

SEQ ID NO: 661967 - DNA, 13 bp, D. melanogaster
ttaaacttttgat

SEQ ID NO: 661968 - DNA, 13 bp, D. melanogaster
ttaaactttttcg

SEQ ID NO: 661969 - DNA, 13 bp, D. melanogaster
ttaaagaaaatac

SEQ ID NO: 661970 - DNA, 15 bp, D. melanogaster
ttaaagaaaatcact

SEQ ID NO: 661971 - DNA, 13 bp, D. melanogaster
ttaaagaaaatgc

SEQ ID NO: 661972 - DNA, 13 bp, D. melanogaster
ttaaagaaacata

SEQ ID NO: 661973 - DNA, 13 bp, D. melanogaster
ttaaagaaacatt

SEQ ID NO: 661974 - DNA, 13 bp, D. melanogaster
ttaaagaaagttt

SEQ ID NO: 661975 - DNA, 13 bp, D. melanogaster
ttaaagaaatgtt

SEQ ID NO: 661976 - DNA, 13 bp, D. melanogaster
ttaaagaaatttc

SEQ ID NO: 661977 - DNA, 14 bp, D. melanogaster
ttaaagaaatttca

SEQ ID NO: 661978 - DNA, 13 bp, D. melanogaster
ttaaagaacattt

SEQ ID NO: 661979 - DNA, 13 bp, D. melanogaster
ttaaagaacttat

SEQ ID NO: 661980 - DNA, 13 bp, D. melanogaster
ttaaagaagaagg

SEQ ID NO: 661981 - DNA, 14 bp, D. melanogaster
ttaaagaagaaggt

SEQ ID NO: 661982 - DNA, 13 bp, D. melanogaster
ttaaagaagaatt

SEQ ID NO: 661983 - DNA, 14 bp, D. melanogaster
ttaaagaagcaaat

SEQ ID NO: 661984 - DNA, 14 bp, D. melanogaster
ttaaagaatatgtt

SEQ ID NO: 661985 - DNA, 14 bp, D. melanogaster
ttaaagaattccat

SEQ ID NO: 661986 - DNA, 13 bp, D. melanogaster
ttaaagaattttc

SEQ ID NO: 661987 - DNA, 13 bp, D. melanogaster
ttaaagacaatta

SEQ ID NO: 661988 - DNA, 13 bp, D. melanogaster
ttaaagacattat

SEQ ID NO: 661989 - DNA, 14 bp, D. melanogaster
ttaaagacattatg

SEQ ID NO: 661990 - DNA, 13 bp, D. melanogaster
ttaaagacttaaa

SEQ ID NO: 661991 - DNA, 14 bp, D. melanogaster
ttaaagacttacaa

SEQ ID NO: 661992 - DNA, 14 bp, D. melanogaster
ttaaagagaagcct

SEQ ID NO: 661993 - DNA, 13 bp, D. melanogaster
ttaaagagcttta

SEQ ID NO: 661994 - DNA, 14 bp, D. melanogaster
ttaaagaggacttg

SEQ ID NO: 661995 - DNA, 13 bp, D. melanogaster
ttaaagatacaaa

SEQ ID NO: 661996 - DNA, 13 bp, D. melanogaster
ttaaagatacatt

SEQ ID NO: 661997 - DNA, 14 bp, D. melanogaster
ttaaagatacattt

SEQ ID NO: 661998 - DNA, 13 bp, D. melanogaster
ttaaagatacttt

SEQ ID NO: 661999 - DNA, 13 bp, D. melanogaster
ttaaagatatttg

SEQ ID NO: 662000 - DNA, 13 bp, D. melanogaster
ttaaagatcttaa

SEQ ID NO: 662001 - DNA, 13 bp, D. melanogaster
ttaaagatgagct

SEQ ID NO: 662002 - DNA, 13 bp, D. melanogaster
ttaaagatgatga

SEQ ID NO: 662003 - DNA, 13 bp, D. melanogaster
ttaaagatgattt

SEQ ID NO: 662004 - DNA, 13 bp, D. melanogaster
ttaaagatttctt

SEQ ID NO: 662005 - DNA, 13 bp, D. melanogaster
ttaaagatttgtt

SEQ ID NO: 662006 - DNA, 13 bp, D. melanogaster
ttaaagcaaaaat

SEQ ID NO: 662007 - DNA, 13 bp, D. melanogaster
ttaaagcaaaatt

SEQ ID NO: 662008 - DNA, 13 bp, D. melanogaster
ttaaagcaaacaa

SEQ ID NO: 662009 - DNA, 14 bp, D. melanogaster
ttaaagcaaacaaa

SEQ ID NO: 662010 - DNA, 13 bp, D. melanogaster
ttaaagcaaataa

SEQ ID NO: 662011 - DNA, 14 bp, D. melanogaster
ttaaagcaaatatt

SEQ ID NO: 662012 - DNA, 13 bp, D. melanogaster
ttaaagcaacaac

SEQ ID NO: 662013 - DNA, 14 bp, D. melanogaster
ttaaagcaagaatt

SEQ ID NO: 662014 - DNA, 14 bp, D. melanogaster
ttaaagcaataaat

SEQ ID NO: 662015 - DNA, 13 bp, D. melanogaster
ttaaagcaataat

SEQ ID NO: 662016 - DNA, 13 bp, D. melanogaster
ttaaagcaatcaa

SEQ ID NO: 662017 - DNA, 13 bp, D. melanogaster
ttaaagcacacaa

SEQ ID NO: 662018 - DNA, 13 bp, D. melanogaster
ttaaagcagcatt

SEQ ID NO: 662019 - DNA, 13 bp, D. melanogaster
ttaaagcataaat

SEQ ID NO: 662020 - DNA, 13 bp, D. melanogaster
ttaaagcatttaa

SEQ ID NO: 662021 - DNA, 13 bp, D. melanogaster
ttaaagccaaaca

SEQ ID NO: 662022 - DNA, 13 bp, D. melanogaster
ttaaagccaacaa

SEQ ID NO: 662023 - DNA, 13 bp, D. melanogaster
ttaaagccaattt

SEQ ID NO: 662024 - DNA, 13 bp, D. melanogaster
ttaaagccacaaa

SEQ ID NO: 662025 - DNA, 13 bp, D. melanogaster
ttaaagccatttt

SEQ ID NO: 662026 - DNA, 13 bp, D. melanogaster
ttaaagcccattt

SEQ ID NO: 662027 - DNA, 13 bp, D. melanogaster
ttaaagccctttt

SEQ ID NO: 662028 - DNA, 13 bp, D. melanogaster
ttaaagcctaaaa

SEQ ID NO: 662029 - DNA, 13 bp, D. melanogaster
ttaaagccttttt

SEQ ID NO: 662030 - DNA, 13 bp, D. melanogaster
ttaaagcgaaata

SEQ ID NO: 662031 - DNA, 13 bp, D. melanogaster
ttaaagcgatttg

SEQ ID NO: 662032 - DNA, 13 bp, D. melanogaster
ttaaagcggagaa

SEQ ID NO: 662033 - DNA, 15 bp, D. melanogaster
ttaaagcgttgtttt

SEQ ID NO: 662034 - DNA, 13 bp, D. melanogaster
ttaaagctaaaaa

SEQ ID NO: 662035 - DNA, 14 bp, D. melanogaster
ttaaagctaaaaat

SEQ ID NO: 662036 - DNA, 13 bp, D. melanogaster
ttaaagctaaact

SEQ ID NO: 662037 - DNA, 13 bp, D. melanogaster
ttaaagctaattt

SEQ ID NO: 662038 - DNA, 13 bp, D. melanogaster
ttaaagctatttt

SEQ ID NO: 662039 - DNA, 13 bp, D. melanogaster
ttaaagctcaaaa

SEQ ID NO: 662040 - DNA, 13 bp, D. melanogaster
ttaaagctgaatg

SEQ ID NO: 662041 - DNA, 13 bp, D. melanogaster
ttaaagctgtttt

SEQ ID NO: 662042 - DNA, 13 bp, D. melanogaster
ttaaagcttaaag

SEQ ID NO: 662043 - DNA, 13 bp, D. melanogaster
ttaaagcttaaat

SEQ ID NO: 662044 - DNA, 13 bp, D. melanogaster
ttaaagcttattt

SEQ ID NO: 662045 - DNA, 13 bp, D. melanogaster
ttaaagctttaaa

SEQ ID NO: 662046 - DNA, 13 bp, D. melanogaster
ttaaaggagctgg

SEQ ID NO: 662047 - DNA, 13 bp, D. melanogaster
ttaaaggcaaaaa

SEQ ID NO: 662048 - DNA, 13 bp, D. melanogaster
ttaaaggcagaca

SEQ ID NO: 662049 - DNA, 13 bp, D. melanogaster
ttaaaggcatttt

SEQ ID NO: 662050 - DNA, 13 bp, D. melanogaster
ttaaaggctttaa

SEQ ID NO: 662051 - DNA, 13 bp, D. melanogaster
ttaaagggaattt

SEQ ID NO: 662052 - DNA, 13 bp, D. melanogaster
ttaaaggttttta

SEQ ID NO: 662053 - DNA, 13 bp, D. melanogaster
ttaaagtaaaagt

SEQ ID NO: 662054 - DNA, 13 bp, D. melanogaster
ttaaagtaaaatg

SEQ ID NO: 662055 - DNA, 13 bp, D. melanogaster
ttaaagtaaatgg

SEQ ID NO: 662056 - DNA, 13 bp, D. melanogaster
ttaaagtaactta

SEQ ID NO: 662057 - DNA, 13 bp, D. melanogaster
ttaaagtaagctt

SEQ ID NO: 662058 - DNA, 13 bp, D. melanogaster
ttaaagtaattca

SEQ ID NO: 662059 - DNA, 13 bp, D. melanogaster
ttaaagtacaatt

SEQ ID NO: 662060 - DNA, 13 bp, D. melanogaster
ttaaagtacataa

SEQ ID NO: 662061 - DNA, 13 bp, D. melanogaster
ttaaagtcaaaga

SEQ ID NO: 662062 - DNA, 13 bp, D. melanogaster
ttaaagtcataaa

SEQ ID NO: 662063 - DNA, 15 bp, D. melanogaster
ttaaagtctgcctgc

SEQ ID NO: 662064 - DNA, 13 bp, D. melanogaster
ttaaagtgaattt

SEQ ID NO: 662065 - DNA, 14 bp, D. melanogaster
ttaaagtgaatttc

SEQ ID NO: 662066 - DNA, 13 bp, D. melanogaster
ttaaagtgacatt

SEQ ID NO: 662067 - DNA, 13 bp, D. melanogaster
ttaaagtgattta

SEQ ID NO: 662068 - DNA, 13 bp, D. melanogaster
ttaaagtgatttt

SEQ ID NO: 662069 - DNA, 13 bp, D. melanogaster
ttaaagtgcaaat

SEQ ID NO: 662070 - DNA, 13 bp, D. melanogaster
ttaaagtgcaatt

SEQ ID NO: 662071 - DNA, 13 bp, D. melanogaster
ttaaagtgcattt

SEQ ID NO: 662072 - DNA, 13 bp, D. melanogaster
ttaaagtgctaaa

SEQ ID NO: 662073 - DNA, 13 bp, D. melanogaster
ttaaagtggaatt

SEQ ID NO: 662074 - DNA, 13 bp, D. melanogaster
ttaaagtggtttt

SEQ ID NO: 662075 - DNA, 13 bp, D. melanogaster
ttaaagtgttatt

SEQ ID NO: 662076 - DNA, 13 bp, D. melanogaster
ttaaagttaaaga

SEQ ID NO: 662077 - DNA, 14 bp, D. melanogaster
ttaaagttaaagtt

SEQ ID NO: 662078 - DNA, 13 bp, D. melanogaster
ttaaagttaacaa

SEQ ID NO: 662079 - DNA, 13 bp, D. melanogaster
ttaaagttatggc

SEQ ID NO: 662080 - DNA, 13 bp, D. melanogaster
ttaaagttatttc

SEQ ID NO: 662081 - DNA, 13 bp, D. melanogaster
ttaaagttcaatg

SEQ ID NO: 662082 - DNA, 13 bp, D. melanogaster
ttaaagttcctta

SEQ ID NO: 662083 - DNA, 13 bp, D. melanogaster
ttaaagttgaaaa

SEQ ID NO: 662084 - DNA, 13 bp, D. melanogaster
ttaaagttgaaat

SEQ ID NO: 662085 - DNA, 13 bp, D. melanogaster
ttaaagttgattt

SEQ ID NO: 662086 - DNA, 13 bp, D. melanogaster
ttaaagttgccat

SEQ ID NO: 662087 - DNA, 13 bp, D. melanogaster
ttaaagtttaagt

SEQ ID NO: 662088 - DNA, 14 bp, D. melanogaster
ttaaagtttaagtt

SEQ ID NO: 662089 - DNA, 13 bp, D. melanogaster
ttaaagtttagtt

SEQ ID NO: 662090 - DNA, 13 bp, D. melanogaster
ttaaagtttcaat

SEQ ID NO: 662091 - DNA, 13 bp, D. melanogaster
ttaaagtttcttt

SEQ ID NO: 662092 - DNA, 13 bp, D. melanogaster
ttaaagtttgaaa

SEQ ID NO: 662093 - DNA, 13 bp, D. melanogaster
ttaaagtttgcca

SEQ ID NO: 662094 - DNA, 13 bp, D. melanogaster
ttaaagttttaca

SEQ ID NO: 662095 - DNA, 13 bp, D. melanogaster
ttaaagtttttag

SEQ ID NO: 662096 - DNA, 13 bp, D. melanogaster
ttaaagtttttct

SEQ ID NO: 662097 - DNA, 13 bp, D. melanogaster
ttaaataaaactc

SEQ ID NO: 662098 - DNA, 13 bp, D. melanogaster
ttaaataaaagtg

SEQ ID NO: 662099 - DNA, 14 bp, D. melanogaster
ttaaataaaatgca

SEQ ID NO: 662100 - DNA, 13 bp, D. melanogaster
ttaaataaacact

SEQ ID NO: 662101 - DNA, 13 bp, D. melanogaster
ttaaataaaccat

SEQ ID NO: 662102 - DNA, 13 bp, D. melanogaster
ttaaataaacgaa

SEQ ID NO: 662103 - DNA, 13 bp, D. melanogaster
ttaaataaagttg

SEQ ID NO: 662104 - DNA, 13 bp, D. melanogaster
ttaaataaatagc

SEQ ID NO: 662105 - DNA, 14 bp, D. melanogaster
ttaaataaatcctt

SEQ ID NO: 662106 - DNA, 13 bp, D. melanogaster
ttaaataaatgac

SEQ ID NO: 662107 - DNA, 13 bp, D. melanogaster
ttaaataaattgg

SEQ ID NO: 662108 - DNA, 13 bp, D. melanogaster
ttaaataacaatc

SEQ ID NO: 662109 - DNA, 13 bp, D. melanogaster
ttaaataagaagg

SEQ ID NO: 662110 - DNA, 13 bp, D. melanogaster
ttaaataagcaaa

SEQ ID NO: 662111 - DNA, 14 bp, D. melanogaster
ttaaataagcaaaa

SEQ ID NO: 662112 - DNA, 13 bp, D. melanogaster
ttaaataagcaat

SEQ ID NO: 662113 - DNA, 13 bp, D. melanogaster
ttaaataagctta

SEQ ID NO: 662114 - DNA, 13 bp, D. melanogaster
ttaaataattcac

SEQ ID NO: 662115 - DNA, 13 bp, D. melanogaster
ttaaataattgtc

SEQ ID NO: 662116 - DNA, 13 bp, D. melanogaster
ttaaatacaatga

SEQ ID NO: 662117 - DNA, 13 bp, D. melanogaster
ttaaatacacata

SEQ ID NO: 662118 - DNA, 13 bp, D. melanogaster
ttaaataccaata

SEQ ID NO: 662119 - DNA, 13 bp, D. melanogaster
ttaaatacctaaa

SEQ ID NO: 662120 - DNA, 13 bp, D. melanogaster
ttaaatacctatt

SEQ ID NO: 662121 - DNA, 14 bp, D. melanogaster
ttaaatacctattt

SEQ ID NO: 662122 - DNA, 13 bp, D. melanogaster
ttaaatacctttt

SEQ ID NO: 662123 - DNA, 14 bp, D. melanogaster
ttaaataccttttg

SEQ ID NO: 662124 - DNA, 13 bp, D. melanogaster
ttaaatacgtatt

SEQ ID NO: 662125 - DNA, 13 bp, D. melanogaster
ttaaatacttgaa

SEQ ID NO: 662126 - DNA, 13 bp, D. melanogaster
ttaaatagacaaa

SEQ ID NO: 662127 - DNA, 13 bp, D. melanogaster
ttaaatagcttaa

SEQ ID NO: 662128 - DNA, 13 bp, D. melanogaster
ttaaatagcttat

SEQ ID NO: 662129 - DNA, 13 bp, D. melanogaster
ttaaatagctttt

SEQ ID NO: 662130 - DNA, 13 bp, D. melanogaster
ttaaataggattt

SEQ ID NO: 662131 - DNA, 13 bp, D. melanogaster
ttaaataggtttt

SEQ ID NO: 662132 - DNA, 13 bp, D. melanogaster
ttaaatagttcaa

SEQ ID NO: 662133 - DNA, 13 bp, D. melanogaster
ttaaatagtttca

SEQ ID NO: 662134 - DNA, 13 bp, D. melanogaster
ttaaatagttttc

SEQ ID NO: 662135 - DNA, 13 bp, D. melanogaster
ttaaatataaacc

SEQ ID NO: 662136 - DNA, 14 bp, D. melanogaster
ttaaatatagctta

SEQ ID NO: 662137 - DNA, 13 bp, D. melanogaster
ttaaatatccaaa

SEQ ID NO: 662138 - DNA, 13 bp, D. melanogaster
ttaaatatcccat

SEQ ID NO: 662139 - DNA, 13 bp, D. melanogaster
ttaaatatccttt

SEQ ID NO: 662140 - DNA, 13 bp, D. melanogaster
ttaaatatcgaaa

SEQ ID NO: 662141 - DNA, 13 bp, D. melanogaster
ttaaatatcgttt

SEQ ID NO: 662142 - DNA, 13 bp, D. melanogaster
ttaaatatgaatg

SEQ ID NO: 662143 - DNA, 14 bp, D. melanogaster
ttaaatatgataac

SEQ ID NO: 662144 - DNA, 13 bp, D. melanogaster
ttaaatatgcaaa

SEQ ID NO: 662145 - DNA, 14 bp, D. melanogaster
ttaaatatgcaatt

SEQ ID NO: 662146 - DNA, 13 bp, D. melanogaster
ttaaatatgcatt

SEQ ID NO: 662147 - DNA, 13 bp, D. melanogaster
ttaaatatgctaa

SEQ ID NO: 662148 - DNA, 13 bp, D. melanogaster
ttaaatatgctta

SEQ ID NO: 662149 - DNA, 13 bp, D. melanogaster
ttaaatatggatt

SEQ ID NO: 662150 - DNA, 13 bp, D. melanogaster
ttaaatattccta

SEQ ID NO: 662151 - DNA, 13 bp, D. melanogaster
ttaaatattcgga

SEQ ID NO: 662152 - DNA, 13 bp, D. melanogaster
ttaaatattgaac

SEQ ID NO: 662153 - DNA, 13 bp, D. melanogaster
ttaaatattgaag

SEQ ID NO: 662154 - DNA, 13 bp, D. melanogaster
ttaaatatttagc

SEQ ID NO: 662155 - DNA, 13 bp, D. melanogaster
ttaaatatttcac

SEQ ID NO: 662156 - DNA, 14 bp, D. melanogaster
ttaaatatttcaca

SEQ ID NO: 662157 - DNA, 13 bp, D. melanogaster
ttaaatcaaacta

SEQ ID NO: 662158 - DNA, 13 bp, D. melanogaster
ttaaatcaaatgt

SEQ ID NO: 662159 - DNA, 13 bp, D. melanogaster
ttaaatcaacaat

SEQ ID NO: 662160 - DNA, 13 bp, D. melanogaster
ttaaatcaagtaa

SEQ ID NO: 662161 - DNA, 13 bp, D. melanogaster
ttaaatcaatcaa

SEQ ID NO: 662162 - DNA, 13 bp, D. melanogaster
ttaaatcaatgtt

SEQ ID NO: 662163 - DNA, 13 bp, D. melanogaster
ttaaatcaattgt

SEQ ID NO: 662164 - DNA, 13 bp, D. melanogaster
ttaaatcacaatt

SEQ ID NO: 662165 - DNA, 14 bp, D. melanogaster
ttaaatcacaatta

SEQ ID NO: 662166 - DNA, 13 bp, D. melanogaster
ttaaatcacatat

SEQ ID NO: 662167 - DNA, 13 bp, D. melanogaster
ttaaatcagaaaa

SEQ ID NO: 662168 - DNA, 13 bp, D. melanogaster
ttaaatcagtttc

SEQ ID NO: 662169 - DNA, 13 bp, D. melanogaster
ttaaatcatacaa

SEQ ID NO: 662170 - DNA, 13 bp, D. melanogaster
ttaaatcattcaa

SEQ ID NO: 662171 - DNA, 13 bp, D. melanogaster
ttaaatcattgta

SEQ ID NO: 662172 - DNA, 13 bp, D. melanogaster
ttaaatcatttga

SEQ ID NO: 662173 - DNA, 14 bp, D. melanogaster
ttaaatcatttgac

SEQ ID NO: 662174 - DNA, 13 bp, D. melanogaster
ttaaatccaaatc

SEQ ID NO: 662175 - DNA, 13 bp, D. melanogaster
ttaaatccataaa

SEQ ID NO: 662176 - DNA, 13 bp, D. melanogaster
ttaaatcccaatc

SEQ ID NO: 662177 - DNA, 14 bp, D. melanogaster
ttaaatcccaatcg

SEQ ID NO: 662178 - DNA, 13 bp, D. melanogaster
ttaaatcctattt

SEQ ID NO: 662179 - DNA, 13 bp, D. melanogaster
ttaaatcgaaaaa

SEQ ID NO: 662180 - DNA, 13 bp, D. melanogaster
ttaaatcgaaatc

SEQ ID NO: 662181 - DNA, 13 bp, D. melanogaster
ttaaatcgaataa

SEQ ID NO: 662182 - DNA, 13 bp, D. melanogaster
ttaaatcgaatta

SEQ ID NO: 662183 - DNA, 13 bp, D. melanogaster
ttaaatcgatatt

SEQ ID NO: 662184 - DNA, 13 bp, D. melanogaster
ttaaatcgatttt

SEQ ID NO: 662185 - DNA, 13 bp, D. melanogaster
ttaaatcgcaaaa

SEQ ID NO: 662186 - DNA, 13 bp, D. melanogaster
ttaaatcgcaaat

SEQ ID NO: 662187 - DNA, 13 bp, D. melanogaster
ttaaatcgctttt

SEQ ID NO: 662188 - DNA, 13 bp, D. melanogaster
ttaaatcgtattt

SEQ ID NO: 662189 - DNA, 13 bp, D. melanogaster
ttaaatcgttaaa

SEQ ID NO: 662190 - DNA, 13 bp, D. melanogaster
ttaaatcgtttta

SEQ ID NO: 662191 - DNA, 13 bp, D. melanogaster
ttaaatctaaatc

SEQ ID NO: 662192 - DNA, 13 bp, D. melanogaster
ttaaatctatgtt

SEQ ID NO: 662193 - DNA, 13 bp, D. melanogaster
ttaaatctgaaat

SEQ ID NO: 662194 - DNA, 13 bp, D. melanogaster
ttaaatctgaatt

SEQ ID NO: 662195 - DNA, 13 bp, D. melanogaster
ttaaatcttcaaa

SEQ ID NO: 662196 - DNA, 13 bp, D. melanogaster
ttaaatctttgaa

SEQ ID NO: 662197 - DNA, 13 bp, D. melanogaster
ttaaatgaaaagc

SEQ ID NO: 662198 - DNA, 13 bp, D. melanogaster
ttaaatgaaacaa

SEQ ID NO: 662199 - DNA, 13 bp, D. melanogaster
ttaaatgaaatct

SEQ ID NO: 662200 - DNA, 13 bp, D. melanogaster
ttaaatgaaatga

SEQ ID NO: 662201 - DNA, 13 bp, D. melanogaster
ttaaatgaaatgc

SEQ ID NO: 662202 - DNA, 13 bp, D. melanogaster
ttaaatgaaattg

SEQ ID NO: 662203 - DNA, 13 bp, D. melanogaster
ttaaatgaacatt

SEQ ID NO: 662204 - DNA, 13 bp, D. melanogaster
ttaaatgaataca

SEQ ID NO: 662205 - DNA, 13 bp, D. melanogaster
ttaaatgaatgtt

SEQ ID NO: 662206 - DNA, 13 bp, D. melanogaster
ttaaatgacattt

SEQ ID NO: 662207 - DNA, 13 bp, D. melanogaster
ttaaatgacttaa

SEQ ID NO: 662208 - DNA, 13 bp, D. melanogaster
ttaaatgactttt

SEQ ID NO: 662209 - DNA, 13 bp, D. melanogaster
ttaaatgagctgc

SEQ ID NO: 662210 - DNA, 13 bp, D. melanogaster
ttaaatgagtttt

SEQ ID NO: 662211 - DNA, 14 bp, D. melanogaster
ttaaatgattttca

SEQ ID NO: 662212 - DNA, 13 bp, D. melanogaster
ttaaatgattttg

SEQ ID NO: 662213 - DNA, 13 bp, D. melanogaster
ttaaatgcaaaaa

SEQ ID NO: 662214 - DNA, 14 bp, D. melanogaster
ttaaatgcaaaaat

SEQ ID NO: 662215 - DNA, 13 bp, D. melanogaster
ttaaatgcaaaat

SEQ ID NO: 662216 - DNA, 14 bp, D. melanogaster
ttaaatgcaaaata

SEQ ID NO: 662217 - DNA, 14 bp, D. melanogaster
ttaaatgcaaatca

SEQ ID NO: 662218 - DNA, 13 bp, D. melanogaster
ttaaatgcaactt

SEQ ID NO: 662219 - DNA, 13 bp, D. melanogaster
ttaaatgcaataa

SEQ ID NO: 662220 - DNA, 14 bp, D. melanogaster
ttaaatgcaataaa

SEQ ID NO: 662221 - DNA, 13 bp, D. melanogaster
ttaaatgcaattg

SEQ ID NO: 662222 - DNA, 13 bp, D. melanogaster
ttaaatgcaattt

SEQ ID NO: 662223 - DNA, 13 bp, D. melanogaster
ttaaatgcagaaa

SEQ ID NO: 662224 - DNA, 13 bp, D. melanogaster
ttaaatgcagctg

SEQ ID NO: 662225 - DNA, 13 bp, D. melanogaster
ttaaatgcagtgc

SEQ ID NO: 662226 - DNA, 14 bp, D. melanogaster
ttaaatgcagtttt

SEQ ID NO: 662227 - DNA, 14 bp, D. melanogaster
ttaaatgcataaaa

SEQ ID NO: 662228 - DNA, 13 bp, D. melanogaster
ttaaatgcataat

SEQ ID NO: 662229 - DNA, 13 bp, D. melanogaster
ttaaatgcatatg

SEQ ID NO: 662230 - DNA, 13 bp, D. melanogaster
ttaaatgcattat

SEQ ID NO: 662231 - DNA, 13 bp, D. melanogaster
ttaaatgcattga

SEQ ID NO: 662232 - DNA, 13 bp, D. melanogaster
ttaaatgcattta

SEQ ID NO: 662233 - DNA, 14 bp, D. melanogaster
ttaaatgcatttat

SEQ ID NO: 662234 - DNA, 14 bp, D. melanogaster
ttaaatgcatttca

SEQ ID NO: 662235 - DNA, 13 bp, D. melanogaster
ttaaatgcatttg

SEQ ID NO: 662236 - DNA, 14 bp, D. melanogaster
ttaaatgcattttt

SEQ ID NO: 662237 - DNA, 13 bp, D. melanogaster
ttaaatgccaact

SEQ ID NO: 662238 - DNA, 13 bp, D. melanogaster
ttaaatgccaatc

SEQ ID NO: 662239 - DNA, 13 bp, D. melanogaster
ttaaatgccaatt

SEQ ID NO: 662240 - DNA, 13 bp, D. melanogaster
ttaaatgccacaa

SEQ ID NO: 662241 - DNA, 14 bp, D. melanogaster
ttaaatgccattta

SEQ ID NO: 662242 - DNA, 13 bp, D. melanogaster
ttaaatgcctttg

SEQ ID NO: 662243 - DNA, 13 bp, D. melanogaster
ttaaatgcgaaat

SEQ ID NO: 662244 - DNA, 13 bp, D. melanogaster
ttaaatgcgcaaa

SEQ ID NO: 662245 - DNA, 13 bp, D. melanogaster
ttaaatgcgcttt

SEQ ID NO: 662246 - DNA, 13 bp, D. melanogaster
ttaaatgctaatt

SEQ ID NO: 662247 - DNA, 13 bp, D. melanogaster
ttaaatgcttaaa

SEQ ID NO: 662248 - DNA, 14 bp, D. melanogaster
ttaaatgcttaaat

SEQ ID NO: 662249 - DNA, 13 bp, D. melanogaster
ttaaatgcttaac

SEQ ID NO: 662250 - DNA, 13 bp, D. melanogaster
ttaaatgctttaa

SEQ ID NO: 662251 - DNA, 13 bp, D. melanogaster
ttaaatgcttttt

SEQ ID NO: 662252 - DNA, 13 bp, D. melanogaster
ttaaatggaaaac

SEQ ID NO: 662253 - DNA, 13 bp, D. melanogaster
ttaaatggaaaat

SEQ ID NO: 662254 - DNA, 13 bp, D. melanogaster
ttaaatggaaatt

SEQ ID NO: 662255 - DNA, 14 bp, D. melanogaster
ttaaatggaaattt

SEQ ID NO: 662256 - DNA, 13 bp, D. melanogaster
ttaaatggaactt

SEQ ID NO: 662257 - DNA, 13 bp, D. melanogaster
ttaaatggaatta

SEQ ID NO: 662258 - DNA, 13 bp, D. melanogaster
ttaaatggaattt

SEQ ID NO: 662259 - DNA, 14 bp, D. melanogaster
ttaaatggagaaaa

SEQ ID NO: 662260 - DNA, 13 bp, D. melanogaster
ttaaatggagttt

SEQ ID NO: 662261 - DNA, 13 bp, D. melanogaster
ttaaatggatata

SEQ ID NO: 662262 - DNA, 13 bp, D. melanogaster
ttaaatggatttt

SEQ ID NO: 662263 - DNA, 14 bp, D. melanogaster
ttaaatggcaaaca

SEQ ID NO: 662264 - DNA, 13 bp, D. melanogaster
ttaaatggcaata

SEQ ID NO: 662265 - DNA, 13 bp, D. melanogaster
ttaaatggcattt

SEQ ID NO: 662266 - DNA, 14 bp, D. melanogaster
ttaaatggcatttt

SEQ ID NO: 662267 - DNA, 13 bp, D. melanogaster
ttaaatggccaag

SEQ ID NO: 662268 - DNA, 13 bp, D. melanogaster
ttaaatgggattt

SEQ ID NO: 662269 - DNA, 13 bp, D. melanogaster
ttaaatggtaaac

SEQ ID NO: 662270 - DNA, 14 bp, D. melanogaster
ttaaatggtaaata

SEQ ID NO: 662271 - DNA, 13 bp, D. melanogaster
ttaaatggtataa

SEQ ID NO: 662272 - DNA, 13 bp, D. melanogaster
ttaaatggtattt

SEQ ID NO: 662273 - DNA, 13 bp, D. melanogaster
ttaaatggtgttt

SEQ ID NO: 662274 - DNA, 14 bp, D. melanogaster
ttaaatgtaaatgt

SEQ ID NO: 662275 - DNA, 13 bp, D. melanogaster
ttaaatgtacatt

SEQ ID NO: 662276 - DNA, 13 bp, D. melanogaster
ttaaatgtatgaa

SEQ ID NO: 662277 - DNA, 14 bp, D. melanogaster
ttaaatgtatgaat

SEQ ID NO: 662278 - DNA, 13 bp, D. melanogaster
ttaaatgtatttg

SEQ ID NO: 662279 - DNA, 13 bp, D. melanogaster
ttaaatgtcaaaa

SEQ ID NO: 662280 - DNA, 13 bp, D. melanogaster
ttaaatgtcaatt

SEQ ID NO: 662281 - DNA, 13 bp, D. melanogaster
ttaaatgtgaaag

SEQ ID NO: 662282 - DNA, 14 bp, D. melanogaster
ttaaatgtgaaagc

SEQ ID NO: 662283 - DNA, 13 bp, D. melanogaster
ttaaatgtgaata

SEQ ID NO: 662284 - DNA, 13 bp, D. melanogaster
ttaaatgtgaatg

SEQ ID NO: 662285 - DNA, 13 bp, D. melanogaster
ttaaatgtgataa

SEQ ID NO: 662286 - DNA, 13 bp, D. melanogaster
ttaaatgtgattt

SEQ ID NO: 662287 - DNA, 13 bp, D. melanogaster
ttaaatgtgccaa

SEQ ID NO: 662288 - DNA, 13 bp, D. melanogaster
ttaaatgtggaaa

SEQ ID NO: 662289 - DNA, 13 bp, D. melanogaster
ttaaatgtgtaat

SEQ ID NO: 662290 - DNA, 13 bp, D. melanogaster
ttaaatgtgttaa

SEQ ID NO: 662291 - DNA, 13 bp, D. melanogaster
ttaaatgttacaa

SEQ ID NO: 662292 - DNA, 13 bp, D. melanogaster
ttaaatgttagtt

SEQ ID NO: 662293 - DNA, 13 bp, D. melanogaster
ttaaatgttatac

SEQ ID NO: 662294 - DNA, 13 bp, D. melanogaster
ttaaatgttatga

SEQ ID NO: 662295 - DNA, 13 bp, D. melanogaster
ttaaatgttcaaa

SEQ ID NO: 662296 - DNA, 14 bp, D. melanogaster
ttaaatgttcaaaa

SEQ ID NO: 662297 - DNA, 13 bp, D. melanogaster
ttaaatgttccaa

SEQ ID NO: 662298 - DNA, 13 bp, D. melanogaster
ttaaatgttctta

SEQ ID NO: 662299 - DNA, 13 bp, D. melanogaster
ttaaatgttgatt

SEQ ID NO: 662300 - DNA, 13 bp, D. melanogaster
ttaaatgttgtac

SEQ ID NO: 662301 - DNA, 13 bp, D. melanogaster
ttaaatgttgtat

SEQ ID NO: 662302 - DNA, 13 bp, D. melanogaster
ttaaatgtttgat

SEQ ID NO: 662303 - DNA, 13 bp, D. melanogaster
ttaaatgttttct

SEQ ID NO: 662304 - DNA, 13 bp, D. melanogaster
ttaaattaaaagc

SEQ ID NO: 662305 - DNA, 13 bp, D. melanogaster
ttaaattaaacga

SEQ ID NO: 662306 - DNA, 13 bp, D. melanogaster
ttaaattaaatcc

SEQ ID NO: 662307 - DNA, 13 bp, D. melanogaster
ttaaattaaccat

SEQ ID NO: 662308 - DNA, 13 bp, D. melanogaster
ttaaattaacctt

SEQ ID NO: 662309 - DNA, 13 bp, D. melanogaster
ttaaattaagcac

SEQ ID NO: 662310 - DNA, 14 bp, D. melanogaster
ttaaattaattgca

SEQ ID NO: 662311 - DNA, 13 bp, D. melanogaster
ttaaattacacaa

SEQ ID NO: 662312 - DNA, 13 bp, D. melanogaster
ttaaattacacac

SEQ ID NO: 662313 - DNA, 13 bp, D. melanogaster
ttaaattacatca

SEQ ID NO: 662314 - DNA, 13 bp, D. melanogaster
ttaaattactttc

SEQ ID NO: 662315 - DNA, 13 bp, D. melanogaster
ttaaattaggtaa

SEQ ID NO: 662316 - DNA, 13 bp, D. melanogaster
ttaaattagtttc

SEQ ID NO: 662317 - DNA, 13 bp, D. melanogaster
ttaaattattgct

SEQ ID NO: 662318 - DNA, 13 bp, D. melanogaster
ttaaattcaaaga

SEQ ID NO: 662319 - DNA, 13 bp, D. melanogaster
ttaaattcaaatc

SEQ ID NO: 662320 - DNA, 13 bp, D. melanogaster
ttaaattcaaatg

SEQ ID NO: 662321 - DNA, 13 bp, D. melanogaster
ttaaattcaacaa

SEQ ID NO: 662322 - DNA, 13 bp, D. melanogaster
ttaaattcaacgc

SEQ ID NO: 662323 - DNA, 14 bp, D. melanogaster
ttaaattcaataca

SEQ ID NO: 662324 - DNA, 14 bp, D. melanogaster
ttaaattcaattag

SEQ ID NO: 662325 - DNA, 13 bp, D. melanogaster
ttaaattcaattg

SEQ ID NO: 662326 - DNA, 14 bp, D. melanogaster
ttaaattcaatttg

SEQ ID NO: 662327 - DNA, 13 bp, D. melanogaster
ttaaattcagaaa

SEQ ID NO: 662328 - DNA, 13 bp, D. melanogaster
ttaaattcagtta

SEQ ID NO: 662329 - DNA, 13 bp, D. melanogaster
ttaaattcagttt

SEQ ID NO: 662330 - DNA, 13 bp, D. melanogaster
ttaaattcatttc

SEQ ID NO: 662331 - DNA, 13 bp, D. melanogaster
ttaaattccattt

SEQ ID NO: 662332 - DNA, 13 bp, D. melanogaster
ttaaattccgaaa

SEQ ID NO: 662333 - DNA, 13 bp, D. melanogaster
ttaaattcgaaat

SEQ ID NO: 662334 - DNA, 13 bp, D. melanogaster
ttaaattcgattt

SEQ ID NO: 662335 - DNA, 14 bp, D. melanogaster
ttaaattcgatttt

SEQ ID NO: 662336 - DNA, 13 bp, D. melanogaster
ttaaattcggttt

SEQ ID NO: 662337 - DNA, 13 bp, D. melanogaster
ttaaattcgtatt

SEQ ID NO: 662338 - DNA, 13 bp, D. melanogaster
ttaaattcgttaa

SEQ ID NO: 662339 - DNA, 13 bp, D. melanogaster
ttaaattcgtttg

SEQ ID NO: 662340 - DNA, 13 bp, D. melanogaster
ttaaattctgttt

SEQ ID NO: 662341 - DNA, 13 bp, D. melanogaster
ttaaattgaagaa

SEQ ID NO: 662342 - DNA, 13 bp, D. melanogaster
ttaaattgacttt

SEQ ID NO: 662343 - DNA, 13 bp, D. melanogaster
ttaaattgagatt

SEQ ID NO: 662344 - DNA, 14 bp, D. melanogaster
ttaaattgagatta

SEQ ID NO: 662345 - DNA, 13 bp, D. melanogaster
ttaaattgagcaa

SEQ ID NO: 662346 - DNA, 13 bp, D. melanogaster
ttaaattgagtta

SEQ ID NO: 662347 - DNA, 13 bp, D. melanogaster
ttaaattgatttc

SEQ ID NO: 662348 - DNA, 14 bp, D. melanogaster
ttaaattgatttca

SEQ ID NO: 662349 - DNA, 13 bp, D. melanogaster
ttaaattgatttg

SEQ ID NO: 662350 - DNA, 13 bp, D. melanogaster
ttaaattgcaaaa

SEQ ID NO: 662351 - DNA, 14 bp, D. melanogaster
ttaaattgcaaaaa

SEQ ID NO: 662352 - DNA, 14 bp, D. melanogaster
ttaaattgcaaaat

SEQ ID NO: 662353 - DNA, 14 bp, D. melanogaster
ttaaattgcaaata

SEQ ID NO: 662354 - DNA, 14 bp, D. melanogaster
ttaaattgcaattt

SEQ ID NO: 662355 - DNA, 13 bp, D. melanogaster
ttaaattgcacac

SEQ ID NO: 662356 - DNA, 13 bp, D. melanogaster
ttaaattgcataa

SEQ ID NO: 662357 - DNA, 13 bp, D. melanogaster
ttaaattgcatta

SEQ ID NO: 662358 - DNA, 13 bp, D. melanogaster
ttaaattgcattt

SEQ ID NO: 662359 - DNA, 14 bp, D. melanogaster
ttaaattgcatttc

SEQ ID NO: 662360 - DNA, 13 bp, D. melanogaster
ttaaattgccaac

SEQ ID NO: 662361 - DNA, 13 bp, D. melanogaster
ttaaattgccgaa

SEQ ID NO: 662362 - DNA, 13 bp, D. melanogaster
ttaaattgctgaa

SEQ ID NO: 662363 - DNA, 13 bp, D. melanogaster
ttaaattgctttg

SEQ ID NO: 662364 - DNA, 13 bp, D. melanogaster
ttaaattggaaaa

SEQ ID NO: 662365 - DNA, 14 bp, D. melanogaster
ttaaattggaaaat

SEQ ID NO: 662366 - DNA, 13 bp, D. melanogaster
ttaaattggaaat

SEQ ID NO: 662367 - DNA, 13 bp, D. melanogaster
ttaaattggaata

SEQ ID NO: 662368 - DNA, 13 bp, D. melanogaster
ttaaattggatta

SEQ ID NO: 662369 - DNA, 13 bp, D. melanogaster
ttaaattgtcaaa

SEQ ID NO: 662370 - DNA, 13 bp, D. melanogaster
ttaaattgtgtta

SEQ ID NO: 662371 - DNA, 13 bp, D. melanogaster
ttaaattgtgttg

SEQ ID NO: 662372 - DNA, 13 bp, D. melanogaster
ttaaattgttaac

SEQ ID NO: 662373 - DNA, 13 bp, D. melanogaster
ttaaattgttctg

SEQ ID NO: 662374 - DNA, 13 bp, D. melanogaster
ttaaattgtttac

SEQ ID NO: 662375 - DNA, 13 bp, D. melanogaster
ttaaattgttttc

SEQ ID NO: 662376 - DNA, 13 bp, D. melanogaster
ttaaatttaactc

SEQ ID NO: 662377 - DNA, 13 bp, D. melanogaster
ttaaatttaagct

SEQ ID NO: 662378 - DNA, 13 bp, D. melanogaster
ttaaatttatggc

SEQ ID NO: 662379 - DNA, 13 bp, D. melanogaster
ttaaatttcacca

SEQ ID NO: 662380 - DNA, 13 bp, D. melanogaster
ttaaatttcagtt

SEQ ID NO: 662381 - DNA, 13 bp, D. melanogaster
ttaaatttcatca

SEQ ID NO: 662382 - DNA, 13 bp, D. melanogaster
ttaaatttccaat

SEQ ID NO: 662383 - DNA, 13 bp, D. melanogaster
ttaaatttccatt

SEQ ID NO: 662384 - DNA, 13 bp, D. melanogaster
ttaaatttcccaa

SEQ ID NO: 662385 - DNA, 13 bp, D. melanogaster
ttaaatttcgaaa

SEQ ID NO: 662386 - DNA, 13 bp, D. melanogaster
ttaaatttctcaa

SEQ ID NO: 662387 - DNA, 13 bp, D. melanogaster
ttaaatttctttg

SEQ ID NO: 662388 - DNA, 13 bp, D. melanogaster
ttaaatttgaaca

SEQ ID NO: 662389 - DNA, 13 bp, D. melanogaster
ttaaatttgaatg

SEQ ID NO: 662390 - DNA, 14 bp, D. melanogaster
ttaaatttgaattg

SEQ ID NO: 662391 - DNA, 14 bp, D. melanogaster
ttaaatttgcattt

SEQ ID NO: 662392 - DNA, 13 bp, D. melanogaster
ttaaatttgccaa

SEQ ID NO: 662393 - DNA, 13 bp, D. melanogaster
ttaaatttgcctt

SEQ ID NO: 662394 - DNA, 13 bp, D. melanogaster
ttaaatttgcttt

SEQ ID NO: 662395 - DNA, 13 bp, D. melanogaster
ttaaatttggaaa

SEQ ID NO: 662396 - DNA, 13 bp, D. melanogaster
ttaaatttggctt

SEQ ID NO: 662397 - DNA, 13 bp, D. melanogaster
ttaaattttaagc

SEQ ID NO: 662398 - DNA, 13 bp, D. melanogaster
ttaaattttgcat

SEQ ID NO: 662399 - DNA, 13 bp, D. melanogaster
ttaaatttttgca

SEQ ID NO: 662400 - DNA, 13 bp, D. melanogaster
ttaaatttttggc

SEQ ID NO: 662401 - DNA, 13 bp, D. melanogaster
ttaacaaaaagca

SEQ ID NO: 662402 - DNA, 13 bp, D. melanogaster
ttaacaaaacaag

SEQ ID NO: 662403 - DNA, 13 bp, D. melanogaster
ttaacaaaatcat

SEQ ID NO: 662404 - DNA, 13 bp, D. melanogaster
ttaacaaaatcgt

SEQ ID NO: 662405 - DNA, 13 bp, D. melanogaster
ttaacaaaatgca

SEQ ID NO: 662406 - DNA, 13 bp, D. melanogaster
ttaacaaaattgc

SEQ ID NO: 662407 - DNA, 13 bp, D. melanogaster
ttaacaaacaatt

SEQ ID NO: 662408 - DNA, 14 bp, D. melanogaster
ttaacaaacaattt

SEQ ID NO: 662409 - DNA, 13 bp, D. melanogaster
ttaacaaacactg

SEQ ID NO: 662410 - DNA, 13 bp, D. melanogaster
ttaacaaacattt

SEQ ID NO: 662411 - DNA, 13 bp, D. melanogaster
ttaacaaacgaaa

SEQ ID NO: 662412 - DNA, 13 bp, D. melanogaster
ttaacaaactaat

SEQ ID NO: 662413 - DNA, 13 bp, D. melanogaster
ttaacaaacttaa

SEQ ID NO: 662414 - DNA, 13 bp, D. melanogaster
ttaacaaatagtt

SEQ ID NO: 662415 - DNA, 13 bp, D. melanogaster
ttaacaaatcaat

SEQ ID NO: 662416 - DNA, 13 bp, D. melanogaster
ttaacaaatgaat

SEQ ID NO: 662417 - DNA, 13 bp, D. melanogaster
ttaacaaattcat

SEQ ID NO: 662418 - DNA, 13 bp, D. melanogaster
ttaacaaatttct

SEQ ID NO: 662419 - DNA, 13 bp, D. melanogaster
ttaacaaattttc

SEQ ID NO: 662420 - DNA, 13 bp, D. melanogaster
ttaacaacaaatt

SEQ ID NO: 662421 - DNA, 13 bp, D. melanogaster
ttaacaacaattt

SEQ ID NO: 662422 - DNA, 13 bp, D. melanogaster
ttaacaacattta

SEQ ID NO: 662423 - DNA, 13 bp, D. melanogaster
ttaacaacatttt

SEQ ID NO: 662424 - DNA, 13 bp, D. melanogaster
ttaacaactttaa

SEQ ID NO: 662425 - DNA, 13 bp, D. melanogaster
ttaacaactttat

SEQ ID NO: 662426 - DNA, 13 bp, D. melanogaster
ttaacaacttttt

SEQ ID NO: 662427 - DNA, 13 bp, D. melanogaster
ttaacaaggaaaa

SEQ ID NO: 662428 - DNA, 13 bp, D. melanogaster
ttaacaagttaca

SEQ ID NO: 662429 - DNA, 13 bp, D. melanogaster
ttaacaagttctc

SEQ ID NO: 662430 - DNA, 13 bp, D. melanogaster
ttaacaagttggc

SEQ ID NO: 662431 - DNA, 13 bp, D. melanogaster
ttaacaagttttt

SEQ ID NO: 662432 - DNA, 13 bp, D. melanogaster
ttaacaataattg

SEQ ID NO: 662433 - DNA, 13 bp, D. melanogaster
ttaacaatcataa

SEQ ID NO: 662434 - DNA, 13 bp, D. melanogaster
ttaacaatgaaaa

SEQ ID NO: 662435 - DNA, 13 bp, D. melanogaster
ttaacaatgaaat

SEQ ID NO: 662436 - DNA, 13 bp, D. melanogaster
ttaacaatggcaa

SEQ ID NO: 662437 - DNA, 13 bp, D. melanogaster
ttaacaattaaag

SEQ ID NO: 662438 - DNA, 13 bp, D. melanogaster
ttaacaattagtt

SEQ ID NO: 662439 - DNA, 13 bp, D. melanogaster
ttaacaattcaaa

SEQ ID NO: 662440 - DNA, 13 bp, D. melanogaster
ttaacaattgctt

SEQ ID NO: 662441 - DNA, 13 bp, D. melanogaster
ttaacaatttcaa

SEQ ID NO: 662442 - DNA, 13 bp, D. melanogaster
ttaacaatttcat

SEQ ID NO: 662443 - DNA, 13 bp, D. melanogaster
ttaacaatttcta

SEQ ID NO: 662444 - DNA, 13 bp, D. melanogaster
ttaacacaatttc

SEQ ID NO: 662445 - DNA, 13 bp, D. melanogaster
ttaacacacaatt

SEQ ID NO: 662446 - DNA, 13 bp, D. melanogaster
ttaacacatttaa

SEQ ID NO: 662447 - DNA, 13 bp, D. melanogaster
ttaacaccttttt

SEQ ID NO: 662448 - DNA, 13 bp, D. melanogaster
ttaacacgaacac

SEQ ID NO: 662449 - DNA, 13 bp, D. melanogaster
ttaacacttccca

SEQ ID NO: 662450 - DNA, 13 bp, D. melanogaster
ttaacagagtcaa

SEQ ID NO: 662451 - DNA, 13 bp, D. melanogaster
ttaacagcaacaa

SEQ ID NO: 662452 - DNA, 13 bp, D. melanogaster
ttaacagcattta

SEQ ID NO: 662453 - DNA, 13 bp, D. melanogaster
ttaacataaacat

SEQ ID NO: 662454 - DNA, 14 bp, D. melanogaster
ttaacatacatttt

SEQ ID NO: 662455 - DNA, 13 bp, D. melanogaster
ttaacatacctga

SEQ ID NO: 662456 - DNA, 13 bp, D. melanogaster
ttaacatcaaaat

SEQ ID NO: 662457 - DNA, 14 bp, D. melanogaster
ttaacatccgctgc

SEQ ID NO: 662458 - DNA, 13 bp, D. melanogaster
ttaacatgattaa

SEQ ID NO: 662459 - DNA, 13 bp, D. melanogaster
ttaacatgatttt

SEQ ID NO: 662460 - DNA, 13 bp, D. melanogaster
ttaacatgcattt

SEQ ID NO: 662461 - DNA, 13 bp, D. melanogaster
ttaacatggcttt

SEQ ID NO: 662462 - DNA, 13 bp, D. melanogaster
ttaacattaacat

SEQ ID NO: 662463 - DNA, 13 bp, D. melanogaster
ttaacattcaaat

SEQ ID NO: 662464 - DNA, 13 bp, D. melanogaster
ttaacattcattt

SEQ ID NO: 662465 - DNA, 13 bp, D. melanogaster
ttaacattgtttt

SEQ ID NO: 662466 - DNA, 13 bp, D. melanogaster
ttaacatttactt

SEQ ID NO: 662467 - DNA, 13 bp, D. melanogaster
ttaacattttaga

SEQ ID NO: 662468 - DNA, 13 bp, D. melanogaster
ttaacattttgtg

SEQ ID NO: 662469 - DNA, 13 bp, D. melanogaster
ttaacatttttca

SEQ ID NO: 662470 - DNA, 13 bp, D. melanogaster
ttaacatttttgt

SEQ ID NO: 662471 - DNA, 13 bp, D. melanogaster
ttaaccaaaagtt

SEQ ID NO: 662472 - DNA, 13 bp, D. melanogaster
ttaaccaaaatat

SEQ ID NO: 662473 - DNA, 13 bp, D. melanogaster
ttaaccaaagaca

SEQ ID NO: 662474 - DNA, 13 bp, D. melanogaster
ttaaccaaatcat

SEQ ID NO: 662475 - DNA, 13 bp, D. melanogaster
ttaaccaaatgaa

SEQ ID NO: 662476 - DNA, 13 bp, D. melanogaster
ttaaccaaattaa

SEQ ID NO: 662477 - DNA, 13 bp, D. melanogaster
ttaaccaacactg

SEQ ID NO: 662478 - DNA, 13 bp, D. melanogaster
ttaaccaactttt

SEQ ID NO: 662479 - DNA, 13 bp, D. melanogaster
ttaaccaatttta

SEQ ID NO: 662480 - DNA, 13 bp, D. melanogaster
ttaaccaattttg

SEQ ID NO: 662481 - DNA, 13 bp, D. melanogaster
ttaaccacaaaat

SEQ ID NO: 662482 - DNA, 13 bp, D. melanogaster
ttaaccacttttt

SEQ ID NO: 662483 - DNA, 13 bp, D. melanogaster
ttaaccagaatga

SEQ ID NO: 662484 - DNA, 13 bp, D. melanogaster
ttaaccataaatt

SEQ ID NO: 662485 - DNA, 13 bp, D. melanogaster
ttaaccattaaat

SEQ ID NO: 662486 - DNA, 13 bp, D. melanogaster
ttaaccattttta

SEQ ID NO: 662487 - DNA, 13 bp, D. melanogaster
ttaacccacattt

SEQ ID NO: 662488 - DNA, 13 bp, D. melanogaster
ttaacccactaaa

SEQ ID NO: 662489 - DNA, 13 bp, D. melanogaster
ttaacccattaaa

SEQ ID NO: 662490 - DNA, 13 bp, D. melanogaster
ttaacccattaat

SEQ ID NO: 662491 - DNA, 13 bp, D. melanogaster
ttaacccatttat

SEQ ID NO: 662492 - DNA, 13 bp, D. melanogaster
ttaacccattttg

SEQ ID NO: 662493 - DNA, 13 bp, D. melanogaster
ttaaccccttttc

SEQ ID NO: 662494 - DNA, 13 bp, D. melanogaster
ttaaccgaaaatt

SEQ ID NO: 662495 - DNA, 14 bp, D. melanogaster
ttaaccgaaaattt

SEQ ID NO: 662496 - DNA, 13 bp, D. melanogaster
ttaaccgccaaat

SEQ ID NO: 662497 - DNA, 13 bp, D. melanogaster
ttaacctaattaa

SEQ ID NO: 662498 - DNA, 13 bp, D. melanogaster
ttaacctcttctt

SEQ ID NO: 662499 - DNA, 13 bp, D. melanogaster
ttaaccttttaaa

SEQ ID NO: 662500 - DNA, 13 bp, D. melanogaster
ttaacctttttgt

SEQ ID NO: 662501 - DNA, 13 bp, D. melanogaster
ttaacgaaattaa

SEQ ID NO: 662502 - DNA, 14 bp, D. melanogaster
ttaacgatcgaaaa

SEQ ID NO: 662503 - DNA, 13 bp, D. melanogaster
ttaacgattattt

SEQ ID NO: 662504 - DNA, 13 bp, D. melanogaster
ttaacgattttat

SEQ ID NO: 662505 - DNA, 13 bp, D. melanogaster
ttaacgatttttt

SEQ ID NO: 662506 - DNA, 13 bp, D. melanogaster
ttaacgtaaacat

SEQ ID NO: 662507 - DNA, 14 bp, D. melanogaster
ttaacgtaaacata

SEQ ID NO: 662508 - DNA, 13 bp, D. melanogaster
ttaacgtaaagat

SEQ ID NO: 662509 - DNA, 14 bp, D. melanogaster
ttaacgtagttaaa

SEQ ID NO: 662510 - DNA, 13 bp, D. melanogaster
ttaacgtgccatt

SEQ ID NO: 662511 - DNA, 14 bp, D. melanogaster
ttaacgttattatt

SEQ ID NO: 662512 - DNA, 13 bp, D. melanogaster
ttaacgttatttt

SEQ ID NO: 662513 - DNA, 13 bp, D. melanogaster
ttaacgtttattg

SEQ ID NO: 662514 - DNA, 13 bp, D. melanogaster
ttaactaaacatt

SEQ ID NO: 662515 - DNA, 13 bp, D. melanogaster
ttaactaaactaa

SEQ ID NO: 662516 - DNA, 14 bp, D. melanogaster
ttaactaaactaac

SEQ ID NO: 662517 - DNA, 13 bp, D. melanogaster
ttaactaaattgt

SEQ ID NO: 662518 - DNA, 13 bp, D. melanogaster
ttaactaactaac

SEQ ID NO: 662519 - DNA, 13 bp, D. melanogaster
ttaactaagttaa

SEQ ID NO: 662520 - DNA, 13 bp, D. melanogaster
ttaactacattta

SEQ ID NO: 662521 - DNA, 13 bp, D. melanogaster
ttaactacatttt

SEQ ID NO: 662522 - DNA, 13 bp, D. melanogaster
ttaactagaataa

SEQ ID NO: 662523 - DNA, 14 bp, D. melanogaster
ttaactagaataag

SEQ ID NO: 662524 - DNA, 13 bp, D. melanogaster
ttaactatttatc

SEQ ID NO: 662525 - DNA, 13 bp, D. melanogaster
ttaactcaaaaat

SEQ ID NO: 662526 - DNA, 13 bp, D. melanogaster
ttaactcaattaa

SEQ ID NO: 662527 - DNA, 14 bp, D. melanogaster
ttaactgaaaaatt

SEQ ID NO: 662528 - DNA, 13 bp, D. melanogaster
ttaactgaaaatg

SEQ ID NO: 662529 - DNA, 13 bp, D. melanogaster
ttaactgaatttt

SEQ ID NO: 662530 - DNA, 13 bp, D. melanogaster
ttaactgcaatta

SEQ ID NO: 662531 - DNA, 13 bp, D. melanogaster
ttaactgcatttt

SEQ ID NO: 662532 - DNA, 13 bp, D. melanogaster
ttaactggcaatt

SEQ ID NO: 662533 - DNA, 13 bp, D. melanogaster
ttaactggcattt

SEQ ID NO: 662534 - DNA, 13 bp, D. melanogaster
ttaactggctttc

SEQ ID NO: 662535 - DNA, 14 bp, D. melanogaster
ttaactggctttcg

SEQ ID NO: 662536 - DNA, 13 bp, D. melanogaster
ttaacttaaaaag

SEQ ID NO: 662537 - DNA, 13 bp, D. melanogaster
ttaacttaaaatg

SEQ ID NO: 662538 - DNA, 13 bp, D. melanogaster
ttaacttaaattg

SEQ ID NO: 662539 - DNA, 13 bp, D. melanogaster
ttaacttaactaa

SEQ ID NO: 662540 - DNA, 13 bp, D. melanogaster
ttaacttaactta

SEQ ID NO: 662541 - DNA, 14 bp, D. melanogaster
ttaacttaacttaa

SEQ ID NO: 662542 - DNA, 13 bp, D. melanogaster
ttaacttaattgc

SEQ ID NO: 662543 - DNA, 13 bp, D. melanogaster
ttaacttaccatt

SEQ ID NO: 662544 - DNA, 13 bp, D. melanogaster
ttaacttagttaa

SEQ ID NO: 662545 - DNA, 13 bp, D. melanogaster
ttaacttcattat

SEQ ID NO: 662546 - DNA, 13 bp, D. melanogaster
ttaacttctcggt

SEQ ID NO: 662547 - DNA, 14 bp, D. melanogaster
ttaacttctcggtt

SEQ ID NO: 662548 - DNA, 13 bp, D. melanogaster
ttaacttctgtaa

SEQ ID NO: 662549 - DNA, 13 bp, D. melanogaster
ttaacttggccaa

SEQ ID NO: 662550 - DNA, 13 bp, D. melanogaster
ttaacttggctaa

SEQ ID NO: 662551 - DNA, 13 bp, D. melanogaster
ttaacttggcttt

SEQ ID NO: 662552 - DNA, 13 bp, D. melanogaster
ttaactttaaaac

SEQ ID NO: 662553 - DNA, 13 bp, D. melanogaster
ttaactttaactt

SEQ ID NO: 662554 - DNA, 13 bp, D. melanogaster
ttaactttaatga

SEQ ID NO: 662555 - DNA, 13 bp, D. melanogaster
ttaactttcactt

SEQ ID NO: 662556 - DNA, 13 bp, D. melanogaster
ttaactttgaaaa

SEQ ID NO: 662557 - DNA, 13 bp, D. melanogaster
ttaactttgagaa

SEQ ID NO: 662558 - DNA, 13 bp, D. melanogaster
ttaactttgcttt

SEQ ID NO: 662559 - DNA, 13 bp, D. melanogaster
ttaactttggcca

SEQ ID NO: 662560 - DNA, 13 bp, D. melanogaster
ttaactttgtaaa

SEQ ID NO: 662561 - DNA, 13 bp, D. melanogaster
ttaactttgttgt

SEQ ID NO: 662562 - DNA, 13 bp, D. melanogaster
ttaactttgttta

SEQ ID NO: 662563 - DNA, 13 bp, D. melanogaster
ttaacttttaact

SEQ ID NO: 662564 - DNA, 14 bp, D. melanogaster
ttaacttttaattg

SEQ ID NO: 662565 - DNA, 13 bp, D. melanogaster
ttaacttttattg

SEQ ID NO: 662566 - DNA, 13 bp, D. melanogaster
ttaacttttggct

SEQ ID NO: 662567 - DNA, 13 bp, D. melanogaster
ttaacttttttgc

SEQ ID NO: 662568 - DNA, 13 bp, D. melanogaster
ttaagaaaacata

SEQ ID NO: 662569 - DNA, 13 bp, D. melanogaster
ttaagaaaagttt

SEQ ID NO: 662570 - DNA, 13 bp, D. melanogaster
ttaagaaaataac

SEQ ID NO: 662571 - DNA, 13 bp, D. melanogaster
ttaagaaaatgca

SEQ ID NO: 662572 - DNA, 13 bp, D. melanogaster
ttaagaaaatgta

SEQ ID NO: 662573 - DNA, 13 bp, D. melanogaster
ttaagaaacaaac

SEQ ID NO: 662574 - DNA, 13 bp, D. melanogaster
ttaagaaacaaca

SEQ ID NO: 662575 - DNA, 13 bp, D. melanogaster
ttaagaaactaaa

SEQ ID NO: 662576 - DNA, 13 bp, D. melanogaster
ttaagaaagaatt

SEQ ID NO: 662577 - DNA, 13 bp, D. melanogaster
ttaagaaaggaat

SEQ ID NO: 662578 - DNA, 14 bp, D. melanogaster
ttaagaaatacaat

SEQ ID NO: 662579 - DNA, 13 bp, D. melanogaster
ttaagaaatattc

SEQ ID NO: 662580 - DNA, 13 bp, D. melanogaster
ttaagaaatgtaa

SEQ ID NO: 662581 - DNA, 13 bp, D. melanogaster
ttaagaaattaca

SEQ ID NO: 662582 - DNA, 14 bp, D. melanogaster
ttaagaaattacaa

SEQ ID NO: 662583 - DNA, 13 bp, D. melanogaster
ttaagaacaataa

SEQ ID NO: 662584 - DNA, 13 bp, D. melanogaster
ttaagaacatttt

SEQ ID NO: 662585 - DNA, 13 bp, D. melanogaster
ttaagaaccaaca

SEQ ID NO: 662586 - DNA, 13 bp, D. melanogaster
ttaagaacttctg

SEQ ID NO: 662587 - DNA, 13 bp, D. melanogaster
ttaagaagcaatt

SEQ ID NO: 662588 - DNA, 13 bp, D. melanogaster
ttaagaagctaaa

SEQ ID NO: 662589 - DNA, 13 bp, D. melanogaster
ttaagaagtttta

SEQ ID NO: 662590 - DNA, 13 bp, D. melanogaster
ttaagaatacctt

SEQ ID NO: 662591 - DNA, 13 bp, D. melanogaster
ttaagaatgaaat

SEQ ID NO: 662592 - DNA, 14 bp, D. melanogaster
ttaagaatgaaatt

SEQ ID NO: 662593 - DNA, 13 bp, D. melanogaster
ttaagaattgttt

SEQ ID NO: 662594 - DNA, 13 bp, D. melanogaster
ttaagaatttcaa

SEQ ID NO: 662595 - DNA, 13 bp, D. melanogaster
ttaagaatttctt

SEQ ID NO: 662596 - DNA, 13 bp, D. melanogaster
ttaagacaatttt

SEQ ID NO: 662597 - DNA, 13 bp, D. melanogaster
ttaagacacttgt

SEQ ID NO: 662598 - DNA, 13 bp, D. melanogaster
ttaagactaaaaa

SEQ ID NO: 662599 - DNA, 14 bp, D. melanogaster
ttaagactaaaaat

SEQ ID NO: 662600 - DNA, 13 bp, D. melanogaster
ttaagactgaaaa

SEQ ID NO: 662601 - DNA, 13 bp, D. melanogaster
ttaagacttaaag

SEQ ID NO: 662602 - DNA, 14 bp, D. melanogaster
ttaagagactcttt

SEQ ID NO: 662603 - DNA, 13 bp, D. melanogaster
ttaagagagctgc

SEQ ID NO: 662604 - DNA, 13 bp, D. melanogaster
ttaagagcatttt

SEQ ID NO: 662605 - DNA, 13 bp, D. melanogaster
ttaagagctaaaa

SEQ ID NO: 662606 - DNA, 13 bp, D. melanogaster
ttaagagcttaaa

SEQ ID NO: 662607 - DNA, 13 bp, D. melanogaster
ttaagagtttaaa

SEQ ID NO: 662608 - DNA, 13 bp, D. melanogaster
ttaagagttttac

SEQ ID NO: 662609 - DNA, 13 bp, D. melanogaster
ttaagataaatac

SEQ ID NO: 662610 - DNA, 13 bp, D. melanogaster
ttaagataagata

SEQ ID NO: 662611 - DNA, 13 bp, D. melanogaster
ttaagatacattt

SEQ ID NO: 662612 - DNA, 13 bp, D. melanogaster
ttaagatacttta

SEQ ID NO: 662613 - DNA, 13 bp, D. melanogaster
ttaagatactttt

SEQ ID NO: 662614 - DNA, 13 bp, D. melanogaster
ttaagatatgata

SEQ ID NO: 662615 - DNA, 13 bp, D. melanogaster
ttaagatatttgt

SEQ ID NO: 662616 - DNA, 13 bp, D. melanogaster
ttaagatcatttt

SEQ ID NO: 662617 - DNA, 13 bp, D. melanogaster
ttaagatgcgatt

SEQ ID NO: 662618 - DNA, 13 bp, D. melanogaster
ttaagatttattg

SEQ ID NO: 662619 - DNA, 13 bp, D. melanogaster
ttaagatttccat

SEQ ID NO: 662620 - DNA, 13 bp, D. melanogaster
ttaagcaaaacaa

SEQ ID NO: 662621 - DNA, 13 bp, D. melanogaster
ttaagcaaaatat

SEQ ID NO: 662622 - DNA, 14 bp, D. melanogaster
ttaagcaaacaaaa

SEQ ID NO: 662623 - DNA, 14 bp, D. melanogaster
ttaagcaaacattt

SEQ ID NO: 662624 - DNA, 13 bp, D. melanogaster
ttaagcaaactaa

SEQ ID NO: 662625 - DNA, 13 bp, D. melanogaster
ttaagcaaataaa

SEQ ID NO: 662626 - DNA, 13 bp, D. melanogaster
ttaagcaaatatt

SEQ ID NO: 662627 - DNA, 13 bp, D. melanogaster
ttaagcaaattgt

SEQ ID NO: 662628 - DNA, 13 bp, D. melanogaster
ttaagcaaattta

SEQ ID NO: 662629 - DNA, 13 bp, D. melanogaster
ttaagcaacaaca

SEQ ID NO: 662630 - DNA, 13 bp, D. melanogaster
ttaagcaagcaca

SEQ ID NO: 662631 - DNA, 13 bp, D. melanogaster
ttaagcaataaaa

SEQ ID NO: 662632 - DNA, 13 bp, D. melanogaster
ttaagcaatattt

SEQ ID NO: 662633 - DNA, 13 bp, D. melanogaster
ttaagcaatcggt

SEQ ID NO: 662634 - DNA, 13 bp, D. melanogaster
ttaagcaatttgt

SEQ ID NO: 662635 - DNA, 13 bp, D. melanogaster
ttaagcaattttt

SEQ ID NO: 662636 - DNA, 13 bp, D. melanogaster
ttaagcacacaaa

SEQ ID NO: 662637 - DNA, 13 bp, D. melanogaster
ttaagcacttaaa

SEQ ID NO: 662638 - DNA, 13 bp, D. melanogaster
ttaagcacttata

SEQ ID NO: 662639 - DNA, 13 bp, D. melanogaster
ttaagcactttaa

SEQ ID NO: 662640 - DNA, 13 bp, D. melanogaster
ttaagcacttttt

SEQ ID NO: 662641 - DNA, 13 bp, D. melanogaster
ttaagcagatcaa

SEQ ID NO: 662642 - DNA, 13 bp, D. melanogaster
ttaagcataaaat

SEQ ID NO: 662643 - DNA, 13 bp, D. melanogaster
ttaagcataaata

SEQ ID NO: 662644 - DNA, 13 bp, D. melanogaster
ttaagcataaatt

SEQ ID NO: 662645 - DNA, 13 bp, D. melanogaster
ttaagcatacaaa

SEQ ID NO: 662646 - DNA, 13 bp, D. melanogaster
ttaagcatattaa

SEQ ID NO: 662647 - DNA, 13 bp, D. melanogaster
ttaagcattaagc

SEQ ID NO: 662648 - DNA, 13 bp, D. melanogaster
ttaagcatttatt

SEQ ID NO: 662649 - DNA, 13 bp, D. melanogaster
ttaagcatttcaa

SEQ ID NO: 662650 - DNA, 13 bp, D. melanogaster
ttaagcattttgt

SEQ ID NO: 662651 - DNA, 13 bp, D. melanogaster
ttaagcatttttc

SEQ ID NO: 662652 - DNA, 13 bp, D. melanogaster
ttaagccaaaaaa

SEQ ID NO: 662653 - DNA, 13 bp, D. melanogaster
ttaagccaaaatg

SEQ ID NO: 662654 - DNA, 13 bp, D. melanogaster
ttaagccaaacaa

SEQ ID NO: 662655 - DNA, 14 bp, D. melanogaster
ttaagccaaacaaa

SEQ ID NO: 662656 - DNA, 13 bp, D. melanogaster
ttaagccaaataa

SEQ ID NO: 662657 - DNA, 13 bp, D. melanogaster
ttaagccaaatgt

SEQ ID NO: 662658 - DNA, 13 bp, D. melanogaster
ttaagccaaatta

SEQ ID NO: 662659 - DNA, 13 bp, D. melanogaster
ttaagccaaattg

SEQ ID NO: 662660 - DNA, 13 bp, D. melanogaster
ttaagccaacaac

SEQ ID NO: 662661 - DNA, 13 bp, D. melanogaster
ttaagccaagaaa

SEQ ID NO: 662662 - DNA, 13 bp, D. melanogaster
ttaagccaattaa

SEQ ID NO: 662663 - DNA, 13 bp, D. melanogaster
ttaagccaatttt

SEQ ID NO: 662664 - DNA, 13 bp, D. melanogaster
ttaagccataaaa

SEQ ID NO: 662665 - DNA, 13 bp, D. melanogaster
ttaagccattttc

SEQ ID NO: 662666 - DNA, 14 bp, D. melanogaster
ttaagccattttca

SEQ ID NO: 662667 - DNA, 13 bp, D. melanogaster
ttaagcccaaaaa

SEQ ID NO: 662668 - DNA, 13 bp, D. melanogaster
ttaagccgaaaac

SEQ ID NO: 662669 - DNA, 13 bp, D. melanogaster
ttaagccgcattt

SEQ ID NO: 662670 - DNA, 13 bp, D. melanogaster
ttaagccgcttag

SEQ ID NO: 662671 - DNA, 13 bp, D. melanogaster
ttaagcctttaaa

SEQ ID NO: 662672 - DNA, 13 bp, D. melanogaster
ttaagcctttgaa

SEQ ID NO: 662673 - DNA, 13 bp, D. melanogaster
ttaagcgaaataa

SEQ ID NO: 662674 - DNA, 13 bp, D. melanogaster
ttaagcgcaataa

SEQ ID NO: 662675 - DNA, 13 bp, D. melanogaster
ttaagcgcattta

SEQ ID NO: 662676 - DNA, 13 bp, D. melanogaster
ttaagcggctttt

SEQ ID NO: 662677 - DNA, 13 bp, D. melanogaster
ttaagcgggcaga

SEQ ID NO: 662678 - DNA, 13 bp, D. melanogaster
ttaagctaaatat

SEQ ID NO: 662679 - DNA, 13 bp, D. melanogaster
ttaagctacaaat

SEQ ID NO: 662680 - DNA, 13 bp, D. melanogaster
ttaagctatttat

SEQ ID NO: 662681 - DNA, 13 bp, D. melanogaster
ttaagctgaacgt

SEQ ID NO: 662682 - DNA, 13 bp, D. melanogaster
ttaagctgaattt

SEQ ID NO: 662683 - DNA, 13 bp, D. melanogaster
ttaagctgacaaa

SEQ ID NO: 662684 - DNA, 13 bp, D. melanogaster
ttaagctgcaaaa

SEQ ID NO: 662685 - DNA, 13 bp, D. melanogaster
ttaagctgcaaat

SEQ ID NO: 662686 - DNA, 13 bp, D. melanogaster
ttaagctgctttc

SEQ ID NO: 662687 - DNA, 13 bp, D. melanogaster
ttaagctgctttt

SEQ ID NO: 662688 - DNA, 13 bp, D. melanogaster
ttaagcttaaaat

SEQ ID NO: 662689 - DNA, 13 bp, D. melanogaster
ttaagcttaagtt

SEQ ID NO: 662690 - DNA, 13 bp, D. melanogaster
ttaagcttaataa

SEQ ID NO: 662691 - DNA, 13 bp, D. melanogaster
ttaagcttaatta

SEQ ID NO: 662692 - DNA, 13 bp, D. melanogaster
ttaagcttattaa

SEQ ID NO: 662693 - DNA, 13 bp, D. melanogaster
ttaagctttcaaa

SEQ ID NO: 662694 - DNA, 13 bp, D. melanogaster
ttaagctttcttt

SEQ ID NO: 662695 - DNA, 13 bp, D. melanogaster
ttaagctttgttt

SEQ ID NO: 662696 - DNA, 13 bp, D. melanogaster
ttaagcttttaaa

SEQ ID NO: 662697 - DNA, 13 bp, D. melanogaster
ttaaggaaaacaa

SEQ ID NO: 662698 - DNA, 13 bp, D. melanogaster
ttaaggaaaatgt

SEQ ID NO: 662699 - DNA, 13 bp, D. melanogaster
ttaaggaaatgga

SEQ ID NO: 662700 - DNA, 13 bp, D. melanogaster
ttaaggaaattat

SEQ ID NO: 662701 - DNA, 13 bp, D. melanogaster
ttaaggaaatttt

SEQ ID NO: 662702 - DNA, 13 bp, D. melanogaster
ttaaggaactttt

SEQ ID NO: 662703 - DNA, 14 bp, D. melanogaster
ttaaggaagatatt

SEQ ID NO: 662704 - DNA, 13 bp, D. melanogaster
ttaaggaagatct

SEQ ID NO: 662705 - DNA, 13 bp, D. melanogaster
ttaaggaattaaa

SEQ ID NO: 662706 - DNA, 13 bp, D. melanogaster
ttaaggaatttat

SEQ ID NO: 662707 - DNA, 13 bp, D. melanogaster
ttaaggcaaggaa

SEQ ID NO: 662708 - DNA, 13 bp, D. melanogaster
ttaaggcaatcaa

SEQ ID NO: 662709 - DNA, 13 bp, D. melanogaster
ttaaggcacttta

SEQ ID NO: 662710 - DNA, 13 bp, D. melanogaster
ttaaggcattttt

SEQ ID NO: 662711 - DNA, 13 bp, D. melanogaster
ttaaggccaggtt

SEQ ID NO: 662712 - DNA, 13 bp, D. melanogaster
ttaaggctattgt

SEQ ID NO: 662713 - DNA, 13 bp, D. melanogaster
ttaaggctttaaa

SEQ ID NO: 662714 - DNA, 14 bp, D. melanogaster
ttaaggctttaact

SEQ ID NO: 662715 - DNA, 13 bp, D. melanogaster
ttaaggctttaag

SEQ ID NO: 662716 - DNA, 13 bp, D. melanogaster
ttaagtaaatgtt

SEQ ID NO: 662717 - DNA, 13 bp, D. melanogaster
ttaagtaaattga

SEQ ID NO: 662718 - DNA, 14 bp, D. melanogaster
ttaagtaatatctt

SEQ ID NO: 662719 - DNA, 13 bp, D. melanogaster
ttaagtaatcaaa

SEQ ID NO: 662720 - DNA, 13 bp, D. melanogaster
ttaagtaatcaat

SEQ ID NO: 662721 - DNA, 13 bp, D. melanogaster
ttaagtaattgca

SEQ ID NO: 662722 - DNA, 13 bp, D. melanogaster
ttaagtaatttgc

SEQ ID NO: 662723 - DNA, 13 bp, D. melanogaster
ttaagtacaaatt

SEQ ID NO: 662724 - DNA, 13 bp, D. melanogaster
ttaagtacttaaa

SEQ ID NO: 662725 - DNA, 13 bp, D. melanogaster
ttaagtacttctt

SEQ ID NO: 662726 - DNA, 13 bp, D. melanogaster
ttaagtactttaa

SEQ ID NO: 662727 - DNA, 13 bp, D. melanogaster
ttaagtataacaa

SEQ ID NO: 662728 - DNA, 13 bp, D. melanogaster
ttaagtatacgcc

SEQ ID NO: 662729 - DNA, 14 bp, D. melanogaster
ttaagtatacgccc

SEQ ID NO: 662730 - DNA, 13 bp, D. melanogaster
ttaagtatgtaaa

SEQ ID NO: 662731 - DNA, 13 bp, D. melanogaster
ttaagtattcaaa

SEQ ID NO: 662732 - DNA, 13 bp, D. melanogaster
ttaagtattcatt

SEQ ID NO: 662733 - DNA, 13 bp, D. melanogaster
ttaagtatttatg

SEQ ID NO: 662734 - DNA, 13 bp, D. melanogaster
ttaagtcaaatta

SEQ ID NO: 662735 - DNA, 13 bp, D. melanogaster
ttaagtcaatttt

SEQ ID NO: 662736 - DNA, 13 bp, D. melanogaster
ttaagtcatccat

SEQ ID NO: 662737 - DNA, 13 bp, D. melanogaster
ttaagtccttaaa

SEQ ID NO: 662738 - DNA, 13 bp, D. melanogaster
ttaagtcggatca

SEQ ID NO: 662739 - DNA, 13 bp, D. melanogaster
ttaagtctttcct

SEQ ID NO: 662740 - DNA, 13 bp, D. melanogaster
ttaagtgaaaaat

SEQ ID NO: 662741 - DNA, 13 bp, D. melanogaster
ttaagtgaaaatt

SEQ ID NO: 662742 - DNA, 13 bp, D. melanogaster
ttaagtgaaattg

SEQ ID NO: 662743 - DNA, 13 bp, D. melanogaster
ttaagtgatttct

SEQ ID NO: 662744 - DNA, 13 bp, D. melanogaster
ttaagtgattttc

SEQ ID NO: 662745 - DNA, 13 bp, D. melanogaster
ttaagtgattttg

SEQ ID NO: 662746 - DNA, 13 bp, D. melanogaster
ttaagtgcaaaat

SEQ ID NO: 662747 - DNA, 13 bp, D. melanogaster
ttaagtgcaaata

SEQ ID NO: 662748 - DNA, 13 bp, D. melanogaster
ttaagtgcaacat

SEQ ID NO: 662749 - DNA, 13 bp, D. melanogaster
ttaagtgcaataa

SEQ ID NO: 662750 - DNA, 13 bp, D. melanogaster
ttaagtgcaatta

SEQ ID NO: 662751 - DNA, 13 bp, D. melanogaster
ttaagtgcaattt

SEQ ID NO: 662752 - DNA, 13 bp, D. melanogaster
ttaagtgcacatt

SEQ ID NO: 662753 - DNA, 13 bp, D. melanogaster
ttaagtgcattaa

SEQ ID NO: 662754 - DNA, 13 bp, D. melanogaster
ttaagtgcgaaaa

SEQ ID NO: 662755 - DNA, 13 bp, D. melanogaster
ttaagtgcttaat

SEQ ID NO: 662756 - DNA, 13 bp, D. melanogaster
ttaagtgctttaa

SEQ ID NO: 662757 - DNA, 13 bp, D. melanogaster
ttaagtggaaaag

SEQ ID NO: 662758 - DNA, 13 bp, D. melanogaster
ttaagtggaaatg

SEQ ID NO: 662759 - DNA, 13 bp, D. melanogaster
ttaagtggcagca

SEQ ID NO: 662760 - DNA, 13 bp, D. melanogaster
ttaagtgtaaata

SEQ ID NO: 662761 - DNA, 13 bp, D. melanogaster
ttaagtgtaatta

SEQ ID NO: 662762 - DNA, 13 bp, D. melanogaster
ttaagtgtgaaaa

SEQ ID NO: 662763 - DNA, 13 bp, D. melanogaster
ttaagtgtgtgtg

SEQ ID NO: 662764 - DNA, 13 bp, D. melanogaster
ttaagtgtgtttg

SEQ ID NO: 662765 - DNA, 13 bp, D. melanogaster
ttaagtgttaaaa

SEQ ID NO: 662766 - DNA, 13 bp, D. melanogaster
ttaagttaaaaac

SEQ ID NO: 662767 - DNA, 13 bp, D. melanogaster
ttaagttaaaagg

SEQ ID NO: 662768 - DNA, 13 bp, D. melanogaster
ttaagttaaagaa

SEQ ID NO: 662769 - DNA, 13 bp, D. melanogaster
ttaagttaaagtt

SEQ ID NO: 662770 - DNA, 13 bp, D. melanogaster
ttaagttaacaac

SEQ ID NO: 662771 - DNA, 13 bp, D. melanogaster
ttaagttaacttt

SEQ ID NO: 662772 - DNA, 13 bp, D. melanogaster
ttaagttaagcaa

SEQ ID NO: 662773 - DNA, 13 bp, D. melanogaster
ttaagttaagtta

SEQ ID NO: 662774 - DNA, 14 bp, D. melanogaster
ttaagttaagttaa

SEQ ID NO: 662775 - DNA, 13 bp, D. melanogaster
ttaagttaatgtt

SEQ ID NO: 662776 - DNA, 13 bp, D. melanogaster
ttaagttaattac

SEQ ID NO: 662777 - DNA, 13 bp, D. melanogaster
ttaagttaatttg

SEQ ID NO: 662778 - DNA, 13 bp, D. melanogaster
ttaagttatgtta

SEQ ID NO: 662779 - DNA, 13 bp, D. melanogaster
ttaagttattaag

SEQ ID NO: 662780 - DNA, 14 bp, D. melanogaster
ttaagttattaagt

SEQ ID NO: 662781 - DNA, 13 bp, D. melanogaster
ttaagttattttc

SEQ ID NO: 662782 - DNA, 14 bp, D. melanogaster
ttaagttattttcg

SEQ ID NO: 662783 - DNA, 13 bp, D. melanogaster
ttaagttcaaatt

SEQ ID NO: 662784 - DNA, 13 bp, D. melanogaster
ttaagttcaattt

SEQ ID NO: 662785 - DNA, 13 bp, D. melanogaster
ttaagttcacatt

SEQ ID NO: 662786 - DNA, 15 bp, D. melanogaster
ttaagttcacattga

SEQ ID NO: 662787 - DNA, 13 bp, D. melanogaster
ttaagttcatttt

SEQ ID NO: 662788 - DNA, 13 bp, D. melanogaster
ttaagttctttaa

SEQ ID NO: 662789 - DNA, 13 bp, D. melanogaster
ttaagttcttttg

SEQ ID NO: 662790 - DNA, 13 bp, D. melanogaster
ttaagttgaaata

SEQ ID NO: 662791 - DNA, 13 bp, D. melanogaster
ttaagttgaatcc

SEQ ID NO: 662792 - DNA, 13 bp, D. melanogaster
ttaagttgctcag

SEQ ID NO: 662793 - DNA, 13 bp, D. melanogaster
ttaagttgctttt

SEQ ID NO: 662794 - DNA, 13 bp, D. melanogaster
ttaagttggattt

SEQ ID NO: 662795 - DNA, 13 bp, D. melanogaster
ttaagttgtaaaa

SEQ ID NO: 662796 - DNA, 13 bp, D. melanogaster
ttaagttgtaaat

SEQ ID NO: 662797 - DNA, 13 bp, D. melanogaster
ttaagtttaaaca

SEQ ID NO: 662798 - DNA, 13 bp, D. melanogaster
ttaagtttaagat

SEQ ID NO: 662799 - DNA, 13 bp, D. melanogaster
ttaagtttaagtt

SEQ ID NO: 662800 - DNA, 13 bp, D. melanogaster
ttaagtttaattg

SEQ ID NO: 662801 - DNA, 13 bp, D. melanogaster
ttaagtttaggac

SEQ ID NO: 662802 - DNA, 13 bp, D. melanogaster
ttaagtttcaaaa

SEQ ID NO: 662803 - DNA, 13 bp, D. melanogaster
ttaagtttcagtt

SEQ ID NO: 662804 - DNA, 13 bp, D. melanogaster
ttaagtttgaaaa

SEQ ID NO: 662805 - DNA, 13 bp, D. melanogaster
ttaagtttgagtt

SEQ ID NO: 662806 - DNA, 13 bp, D. melanogaster
ttaagttttacca

SEQ ID NO: 662807 - DNA, 15 bp, D. melanogaster
ttaagttttaccagg

SEQ ID NO: 662808 - DNA, 13 bp, D. melanogaster
ttaagttttcaaa

SEQ ID NO: 662809 - DNA, 14 bp, D. melanogaster
ttaagttttcaaat

SEQ ID NO: 662810 - DNA, 13 bp, D. melanogaster
ttaagtttttaag

SEQ ID NO: 662811 - DNA, 14 bp, D. melanogaster
ttaagtttttaatc

SEQ ID NO: 662812 - DNA, 13 bp, D. melanogaster
ttaagtttttcat

SEQ ID NO: 662813 - DNA, 14 bp, D. melanogaster
ttaagtttttcatt

SEQ ID NO: 662814 - DNA, 13 bp, D. melanogaster
ttaagtttttcca

SEQ ID NO: 662815 - DNA, 13 bp, D. melanogaster
ttaagtttttcga

SEQ ID NO: 662816 - DNA, 13 bp, D. melanogaster
ttaataaaagcca

SEQ ID NO: 662817 - DNA, 13 bp, D. melanogaster
ttaataaaatgcc

SEQ ID NO: 662818 - DNA, 13 bp, D. melanogaster
ttaataaacactt

SEQ ID NO: 662819 - DNA, 13 bp, D. melanogaster
ttaataaaccggg

SEQ ID NO: 662820 - DNA, 13 bp, D. melanogaster
ttaataaacgaaa

SEQ ID NO: 662821 - DNA, 13 bp, D. melanogaster
ttaataaagaact

SEQ ID NO: 662822 - DNA, 13 bp, D. melanogaster
ttaataaagagtt

SEQ ID NO: 662823 - DNA, 14 bp, D. melanogaster
ttaataaagagttg

SEQ ID NO: 662824 - DNA, 13 bp, D. melanogaster
ttaataaagcaaa

SEQ ID NO: 662825 - DNA, 13 bp, D. melanogaster
ttaataaagtctc

SEQ ID NO: 662826 - DNA, 13 bp, D. melanogaster
ttaataaagtttc

SEQ ID NO: 662827 - DNA, 13 bp, D. melanogaster
ttaataaatacac

SEQ ID NO: 662828 - DNA, 13 bp, D. melanogaster
ttaataaatacag

SEQ ID NO: 662829 - DNA, 13 bp, D. melanogaster
ttaataaatacgt

SEQ ID NO: 662830 - DNA, 13 bp, D. melanogaster
ttaataaatgcaa

SEQ ID NO: 662831 - DNA, 13 bp, D. melanogaster
ttaataaatgtgt

SEQ ID NO: 662832 - DNA, 13 bp, D. melanogaster
ttaataaattcca

SEQ ID NO: 662833 - DNA, 13 bp, D. melanogaster
ttaataaattgag

SEQ ID NO: 662834 - DNA, 13 bp, D. melanogaster
ttaataaatttcc

SEQ ID NO: 662835 - DNA, 13 bp, D. melanogaster
ttaataacaatag

SEQ ID NO: 662836 - DNA, 13 bp, D. melanogaster
ttaataacaattg

SEQ ID NO: 662837 - DNA, 13 bp, D. melanogaster
ttaataacatttc

SEQ ID NO: 662838 - DNA, 13 bp, D. melanogaster
ttaataactcaat

SEQ ID NO: 662839 - DNA, 13 bp, D. melanogaster
ttaataactgatt

SEQ ID NO: 662840 - DNA, 13 bp, D. melanogaster
ttaataactttga

SEQ ID NO: 662841 - DNA, 13 bp, D. melanogaster
ttaataagaaact

SEQ ID NO: 662842 - DNA, 13 bp, D. melanogaster
ttaataagcattt

SEQ ID NO: 662843 - DNA, 13 bp, D. melanogaster
ttaataagccaaa

SEQ ID NO: 662844 - DNA, 13 bp, D. melanogaster
ttaataagcttaa

SEQ ID NO: 662845 - DNA, 13 bp, D. melanogaster
ttaataaggaaat

SEQ ID NO: 662846 - DNA, 13 bp, D. melanogaster
ttaataaggcaat

SEQ ID NO: 662847 - DNA, 14 bp, D. melanogaster
ttaataataacaag

SEQ ID NO: 662848 - DNA, 15 bp, D. melanogaster
ttaataataatgtca

SEQ ID NO: 662849 - DNA, 13 bp, D. melanogaster
ttaataatacaac

SEQ ID NO: 662850 - DNA, 13 bp, D. melanogaster
ttaataatccaaa

SEQ ID NO: 662851 - DNA, 13 bp, D. melanogaster
ttaataatgcaaa

SEQ ID NO: 662852 - DNA, 13 bp, D. melanogaster
ttaataatgcaat

SEQ ID NO: 662853 - DNA, 13 bp, D. melanogaster
ttaataatgcttt

SEQ ID NO: 662854 - DNA, 13 bp, D. melanogaster
ttaataattacag

SEQ ID NO: 662855 - DNA, 13 bp, D. melanogaster
ttaataattcaca

SEQ ID NO: 662856 - DNA, 13 bp, D. melanogaster
ttaataattcgct

SEQ ID NO: 662857 - DNA, 13 bp, D. melanogaster
ttaataatttagc

SEQ ID NO: 662858 - DNA, 13 bp, D. melanogaster
ttaatacacattt

SEQ ID NO: 662859 - DNA, 13 bp, D. melanogaster
ttaatacatacat

SEQ ID NO: 662860 - DNA, 13 bp, D. melanogaster
ttaatacatatgt

SEQ ID NO: 662861 - DNA, 13 bp, D. melanogaster
ttaataccaccta

SEQ ID NO: 662862 - DNA, 13 bp, D. melanogaster
ttaataccgtaca

SEQ ID NO: 662863 - DNA, 13 bp, D. melanogaster
ttaatactttttg

SEQ ID NO: 662864 - DNA, 14 bp, D. melanogaster
ttaatagatacttt

SEQ ID NO: 662865 - DNA, 13 bp, D. melanogaster
ttaatagcaattt

SEQ ID NO: 662866 - DNA, 13 bp, D. melanogaster
ttaatagctttta

SEQ ID NO: 662867 - DNA, 13 bp, D. melanogaster
ttaataggaaatt

SEQ ID NO: 662868 - DNA, 13 bp, D. melanogaster
ttaatagttcctg

SEQ ID NO: 662869 - DNA, 14 bp, D. melanogaster
ttaatagttcctga

SEQ ID NO: 662870 - DNA, 13 bp, D. melanogaster
ttaatagtttgta

SEQ ID NO: 662871 - DNA, 13 bp, D. melanogaster
ttaatatacatac

SEQ ID NO: 662872 - DNA, 14 bp, D. melanogaster
ttaatatacataca

SEQ ID NO: 662873 - DNA, 13 bp, D. melanogaster
ttaatatattcgt

SEQ ID NO: 662874 - DNA, 13 bp, D. melanogaster
ttaatatattgct

SEQ ID NO: 662875 - DNA, 14 bp, D. melanogaster
ttaatatatttcca

SEQ ID NO: 662876 - DNA, 13 bp, D. melanogaster
ttaatatcaaagt

SEQ ID NO: 662877 - DNA, 13 bp, D. melanogaster
ttaatatccttta

SEQ ID NO: 662878 - DNA, 13 bp, D. melanogaster
ttaatatcgcttt

SEQ ID NO: 662879 - DNA, 13 bp, D. melanogaster
ttaatatcttcaa

SEQ ID NO: 662880 - DNA, 13 bp, D. melanogaster
ttaatatgatcaa

SEQ ID NO: 662881 - DNA, 13 bp, D. melanogaster
ttaatatgcagcg

SEQ ID NO: 662882 - DNA, 13 bp, D. melanogaster
ttaatatgcttaa

SEQ ID NO: 662883 - DNA, 13 bp, D. melanogaster
ttaatatgctttt

SEQ ID NO: 662884 - DNA, 13 bp, D. melanogaster
ttaatatggaaaa

SEQ ID NO: 662885 - DNA, 13 bp, D. melanogaster
ttaatatgtatgt

SEQ ID NO: 662886 - DNA, 13 bp, D. melanogaster
ttaatattaaagc

SEQ ID NO: 662887 - DNA, 13 bp, D. melanogaster
ttaatattaagtg

SEQ ID NO: 662888 - DNA, 13 bp, D. melanogaster
ttaatattacgtt

SEQ ID NO: 662889 - DNA, 13 bp, D. melanogaster
ttaatattcaaca

SEQ ID NO: 662890 - DNA, 13 bp, D. melanogaster
ttaatattcgatt

SEQ ID NO: 662891 - DNA, 13 bp, D. melanogaster
ttaatattggatt

SEQ ID NO: 662892 - DNA, 14 bp, D. melanogaster
ttaatatttaatgc

SEQ ID NO: 662893 - DNA, 13 bp, D. melanogaster
ttaatatttcaca

SEQ ID NO: 662894 - DNA, 13 bp, D. melanogaster
ttaatatttccat

SEQ ID NO: 662895 - DNA, 13 bp, D. melanogaster
ttaatatttgagc

SEQ ID NO: 662896 - DNA, 13 bp, D. melanogaster
ttaatatttgcat

SEQ ID NO: 662897 - DNA, 13 bp, D. melanogaster
ttaatatttgctt

SEQ ID NO: 662898 - DNA, 13 bp, D. melanogaster
ttaatattttctg

SEQ ID NO: 662899 - DNA, 13 bp, D. melanogaster
ttaatattttgga

SEQ ID NO: 662900 - DNA, 14 bp, D. melanogaster
ttaatcaaaataga

SEQ ID NO: 662901 - DNA, 13 bp, D. melanogaster
ttaatcaaacccc

SEQ ID NO: 662902 - DNA, 13 bp, D. melanogaster
ttaatcaaagaaa

SEQ ID NO: 662903 - DNA, 13 bp, D. melanogaster
ttaatcaaatcat

SEQ ID NO: 662904 - DNA, 13 bp, D. melanogaster
ttaatcaaatgaa

SEQ ID NO: 662905 - DNA, 13 bp, D. melanogaster
ttaatcaaatgcc

SEQ ID NO: 662906 - DNA, 13 bp, D. melanogaster
ttaatcaaatgtt

SEQ ID NO: 662907 - DNA, 13 bp, D. melanogaster
ttaatcaaattca

SEQ ID NO: 662908 - DNA, 13 bp, D. melanogaster
ttaatcaaatttc

SEQ ID NO: 662909 - DNA, 13 bp, D. melanogaster
ttaatcaaatttg

SEQ ID NO: 662910 - DNA, 13 bp, D. melanogaster
ttaatcaagccaa

SEQ ID NO: 662911 - DNA, 13 bp, D. melanogaster
ttaatcaagttaa

SEQ ID NO: 662912 - DNA, 13 bp, D. melanogaster
ttaatcaatcaaa

SEQ ID NO: 662913 - DNA, 13 bp, D. melanogaster
ttaatcaatcaat

SEQ ID NO: 662914 - DNA, 13 bp, D. melanogaster
ttaatcaattaag

SEQ ID NO: 662915 - DNA, 13 bp, D. melanogaster
ttaatcaatttca

SEQ ID NO: 662916 - DNA, 13 bp, D. melanogaster
ttaatcaatttgg

SEQ ID NO: 662917 - DNA, 13 bp, D. melanogaster
ttaatcaattttg

SEQ ID NO: 662918 - DNA, 13 bp, D. melanogaster
ttaatcacattaa

SEQ ID NO: 662919 - DNA, 13 bp, D. melanogaster
ttaatcacatttt

SEQ ID NO: 662920 - DNA, 13 bp, D. melanogaster
ttaatcagatttt

SEQ ID NO: 662921 - DNA, 13 bp, D. melanogaster
ttaatcagcttaa

SEQ ID NO: 662922 - DNA, 13 bp, D. melanogaster
ttaatcataatca

SEQ ID NO: 662923 - DNA, 13 bp, D. melanogaster
ttaatcatacgca

SEQ ID NO: 662924 - DNA, 14 bp, D. melanogaster
ttaatcatacgcac

SEQ ID NO: 662925 - DNA, 13 bp, D. melanogaster
ttaatcatgtttt

SEQ ID NO: 662926 - DNA, 13 bp, D. melanogaster
ttaatcatttttg

SEQ ID NO: 662927 - DNA, 13 bp, D. melanogaster
ttaatccaaagac

SEQ ID NO: 662928 - DNA, 13 bp, D. melanogaster
ttaatccaataaa

SEQ ID NO: 662929 - DNA, 13 bp, D. melanogaster
ttaatcctaaaaa

SEQ ID NO: 662930 - DNA, 13 bp, D. melanogaster
ttaatcgaattta

SEQ ID NO: 662931 - DNA, 13 bp, D. melanogaster
ttaatcgactctg

SEQ ID NO: 662932 - DNA, 13 bp, D. melanogaster
ttaatcgattttt

SEQ ID NO: 662933 - DNA, 13 bp, D. melanogaster
ttaatcgtgttga

SEQ ID NO: 662934 - DNA, 13 bp, D. melanogaster
ttaatctctcact

SEQ ID NO: 662935 - DNA, 13 bp, D. melanogaster
ttaatcttaaaca

SEQ ID NO: 662936 - DNA, 13 bp, D. melanogaster
ttaatcttaattg

SEQ ID NO: 662937 - DNA, 13 bp, D. melanogaster
ttaatcttgttta

SEQ ID NO: 662938 - DNA, 13 bp, D. melanogaster
ttaatgaaaatac

SEQ ID NO: 662939 - DNA, 13 bp, D. melanogaster
ttaatgaaaatga

SEQ ID NO: 662940 - DNA, 13 bp, D. melanogaster
ttaatgaaataca

SEQ ID NO: 662941 - DNA, 14 bp, D. melanogaster
ttaatgaaatcaaa

SEQ ID NO: 662942 - DNA, 14 bp, D. melanogaster
ttaatgaaatccaa

SEQ ID NO: 662943 - DNA, 13 bp, D. melanogaster
ttaatgaaatgat

SEQ ID NO: 662944 - DNA, 14 bp, D. melanogaster
ttaatgaaatgatt

SEQ ID NO: 662945 - DNA, 13 bp, D. melanogaster
ttaatgaaattag

SEQ ID NO: 662946 - DNA, 13 bp, D. melanogaster
ttaatgaaattgt

SEQ ID NO: 662947 - DNA, 14 bp, D. melanogaster
ttaatgaaattgtt

SEQ ID NO: 662948 - DNA, 13 bp, D. melanogaster
ttaatgaaatttc

SEQ ID NO: 662949 - DNA, 13 bp, D. melanogaster
ttaatgaactgaa

SEQ ID NO: 662950 - DNA, 13 bp, D. melanogaster
ttaatgaagaaat

SEQ ID NO: 662951 - DNA, 13 bp, D. melanogaster
ttaatgaagataa

SEQ ID NO: 662952 - DNA, 13 bp, D. melanogaster
ttaatgaagctat

SEQ ID NO: 662953 - DNA, 13 bp, D. melanogaster
ttaatgaatcttt

SEQ ID NO: 662954 - DNA, 13 bp, D. melanogaster
ttaatgaatggaa

SEQ ID NO: 662955 - DNA, 13 bp, D. melanogaster
ttaatgaattgaa

SEQ ID NO: 662956 - DNA, 14 bp, D. melanogaster
ttaatgaatttcaa

SEQ ID NO: 662957 - DNA, 13 bp, D. melanogaster
ttaatgacatttt

SEQ ID NO: 662958 - DNA, 13 bp, D. melanogaster
ttaatgacctcaa

SEQ ID NO: 662959 - DNA, 13 bp, D. melanogaster
ttaatgacttaat

SEQ ID NO: 662960 - DNA, 13 bp, D. melanogaster
ttaatgactttga

SEQ ID NO: 662961 - DNA, 13 bp, D. melanogaster
ttaatgactttgt

SEQ ID NO: 662962 - DNA, 13 bp, D. melanogaster
ttaatgagaaaat

SEQ ID NO: 662963 - DNA, 14 bp, D. melanogaster
ttaatgagacgaat

SEQ ID NO: 662964 - DNA, 13 bp, D. melanogaster
ttaatgagatttc

SEQ ID NO: 662965 - DNA, 13 bp, D. melanogaster
ttaatgagatttt

SEQ ID NO: 662966 - DNA, 13 bp, D. melanogaster
ttaatgagcaaat

SEQ ID NO: 662967 - DNA, 13 bp, D. melanogaster
ttaatgagcaatt

SEQ ID NO: 662968 - DNA, 13 bp, D. melanogaster
ttaatgagcattt

SEQ ID NO: 662969 - DNA, 13 bp, D. melanogaster
ttaatgagccgca

SEQ ID NO: 662970 - DNA, 13 bp, D. melanogaster
ttaatgagcttaa

SEQ ID NO: 662971 - DNA, 13 bp, D. melanogaster
ttaatgagtgaaa

SEQ ID NO: 662972 - DNA, 13 bp, D. melanogaster
ttaatgagttcaa

SEQ ID NO: 662973 - DNA, 13 bp, D. melanogaster
ttaatgataatga

SEQ ID NO: 662974 - DNA, 13 bp, D. melanogaster
ttaatgataatgc

SEQ ID NO: 662975 - DNA, 13 bp, D. melanogaster
ttaatgatatgca

SEQ ID NO: 662976 - DNA, 13 bp, D. melanogaster
ttaatgatgatga

SEQ ID NO: 662977 - DNA, 13 bp, D. melanogaster
ttaatgatgttac

SEQ ID NO: 662978 - DNA, 13 bp, D. melanogaster
ttaatgatttaca

SEQ ID NO: 662979 - DNA, 13 bp, D. melanogaster
ttaatgatttatg

SEQ ID NO: 662980 - DNA, 13 bp, D. melanogaster
ttaatgattttct

SEQ ID NO: 662981 - DNA, 13 bp, D. melanogaster
ttaatgcaaaaca

SEQ ID NO: 662982 - DNA, 13 bp, D. melanogaster
ttaatgcaaaagt

SEQ ID NO: 662983 - DNA, 13 bp, D. melanogaster
ttaatgcaaaata

SEQ ID NO: 662984 - DNA, 13 bp, D. melanogaster
ttaatgcaaatcg

SEQ ID NO: 662985 - DNA, 13 bp, D. melanogaster
ttaatgcaaatga

SEQ ID NO: 662986 - DNA, 13 bp, D. melanogaster
ttaatgcaaatta

SEQ ID NO: 662987 - DNA, 13 bp, D. melanogaster
ttaatgcaaattg

SEQ ID NO: 662988 - DNA, 13 bp, D. melanogaster
ttaatgcaaattt

SEQ ID NO: 662989 - DNA, 13 bp, D. melanogaster
ttaatgcaataca

SEQ ID NO: 662990 - DNA, 13 bp, D. melanogaster
ttaatgcaatcaa

SEQ ID NO: 662991 - DNA, 13 bp, D. melanogaster
ttaatgcaatgca

SEQ ID NO: 662992 - DNA, 14 bp, D. melanogaster
ttaatgcaattatt

SEQ ID NO: 662993 - DNA, 13 bp, D. melanogaster
ttaatgcaatttt

SEQ ID NO: 662994 - DNA, 13 bp, D. melanogaster
ttaatgcactttc

SEQ ID NO: 662995 - DNA, 13 bp, D. melanogaster
ttaatgcagattt

SEQ ID NO: 662996 - DNA, 13 bp, D. melanogaster
ttaatgcagtttt

SEQ ID NO: 662997 - DNA, 13 bp, D. melanogaster
ttaatgcatatta

SEQ ID NO: 662998 - DNA, 13 bp, D. melanogaster
ttaatgcattgga

SEQ ID NO: 662999 - DNA, 13 bp, D. melanogaster
ttaatgcatttat

SEQ ID NO: 663000 - DNA, 13 bp, D. melanogaster
ttaatgcatttta

SEQ ID NO: 663001 - DNA, 14 bp, D. melanogaster
ttaatgcattttaa

SEQ ID NO: 663002 - DNA, 13 bp, D. melanogaster
ttaatgccaatta

SEQ ID NO: 663003 - DNA, 13 bp, D. melanogaster
ttaatgccacaca

SEQ ID NO: 663004 - DNA, 13 bp, D. melanogaster
ttaatgccctaat

SEQ ID NO: 663005 - DNA, 13 bp, D. melanogaster
ttaatgcgaaaat

SEQ ID NO: 663006 - DNA, 13 bp, D. melanogaster
ttaatgcgaattt

SEQ ID NO: 663007 - DNA, 13 bp, D. melanogaster
ttaatgcgatttc

SEQ ID NO: 663008 - DNA, 13 bp, D. melanogaster
ttaatgcgatttt

SEQ ID NO: 663009 - DNA, 13 bp, D. melanogaster
ttaatgctaatta

SEQ ID NO: 663010 - DNA, 13 bp, D. melanogaster
ttaatgctgaaaa

SEQ ID NO: 663011 - DNA, 13 bp, D. melanogaster
ttaatgctgctgc

SEQ ID NO: 663012 - DNA, 13 bp, D. melanogaster
ttaatgctggtgc

SEQ ID NO: 663013 - DNA, 13 bp, D. melanogaster
ttaatgcttaatg

SEQ ID NO: 663014 - DNA, 13 bp, D. melanogaster
ttaatgctttgtt

SEQ ID NO: 663015 - DNA, 14 bp, D. melanogaster
ttaatggaaaagtt

SEQ ID NO: 663016 - DNA, 13 bp, D. melanogaster
ttaatggaaaata

SEQ ID NO: 663017 - DNA, 13 bp, D. melanogaster
ttaatggaaaatg

SEQ ID NO: 663018 - DNA, 13 bp, D. melanogaster
ttaatggaaaatt

SEQ ID NO: 663019 - DNA, 13 bp, D. melanogaster
ttaatggaaattt

SEQ ID NO: 663020 - DNA, 13 bp, D. melanogaster
ttaatggaagcgt

SEQ ID NO: 663021 - DNA, 13 bp, D. melanogaster
ttaatggaatttc

SEQ ID NO: 663022 - DNA, 13 bp, D. melanogaster
ttaatggagcacg

SEQ ID NO: 663023 - DNA, 13 bp, D. melanogaster
ttaatggagtttt

SEQ ID NO: 663024 - DNA, 13 bp, D. melanogaster
ttaatggcaaaca

SEQ ID NO: 663025 - DNA, 13 bp, D. melanogaster
ttaatggcatttt

SEQ ID NO: 663026 - DNA, 13 bp, D. melanogaster
ttaatggccaaga

SEQ ID NO: 663027 - DNA, 13 bp, D. melanogaster
ttaatggccaatt

SEQ ID NO: 663028 - DNA, 13 bp, D. melanogaster
ttaatggcccaaa

SEQ ID NO: 663029 - DNA, 13 bp, D. melanogaster
ttaatggccttaa

SEQ ID NO: 663030 - DNA, 13 bp, D. melanogaster
ttaatggctgcaa

SEQ ID NO: 663031 - DNA, 13 bp, D. melanogaster
ttaatggcttaaa

SEQ ID NO: 663032 - DNA, 13 bp, D. melanogaster
ttaatgggatttt

SEQ ID NO: 663033 - DNA, 13 bp, D. melanogaster
ttaatggggtttt

SEQ ID NO: 663034 - DNA, 13 bp, D. melanogaster
ttaatggtaattt

SEQ ID NO: 663035 - DNA, 13 bp, D. melanogaster
ttaatggtgaaat

SEQ ID NO: 663036 - DNA, 13 bp, D. melanogaster
ttaatggtttaat

SEQ ID NO: 663037 - DNA, 13 bp, D. melanogaster
ttaatgtaaaatg

SEQ ID NO: 663038 - DNA, 13 bp, D. melanogaster
ttaatgtaaacaa

SEQ ID NO: 663039 - DNA, 13 bp, D. melanogaster
ttaatgtaaatgt

SEQ ID NO: 663040 - DNA, 13 bp, D. melanogaster
ttaatgtaatcaa

SEQ ID NO: 663041 - DNA, 13 bp, D. melanogaster
ttaatgtaattgc

SEQ ID NO: 663042 - DNA, 13 bp, D. melanogaster
ttaatgtacattt

SEQ ID NO: 663043 - DNA, 13 bp, D. melanogaster
ttaatgtactttt

SEQ ID NO: 663044 - DNA, 13 bp, D. melanogaster
ttaatgtattgta

SEQ ID NO: 663045 - DNA, 13 bp, D. melanogaster
ttaatgtattttc

SEQ ID NO: 663046 - DNA, 13 bp, D. melanogaster
ttaatgtcatttt

SEQ ID NO: 663047 - DNA, 13 bp, D. melanogaster
ttaatgtgaaaaa

SEQ ID NO: 663048 - DNA, 13 bp, D. melanogaster
ttaatgtgaattt

SEQ ID NO: 663049 - DNA, 13 bp, D. melanogaster
ttaatgtggaaat

SEQ ID NO: 663050 - DNA, 13 bp, D. melanogaster
ttaatgtggcctt

SEQ ID NO: 663051 - DNA, 13 bp, D. melanogaster
ttaatgtggcttc

SEQ ID NO: 663052 - DNA, 13 bp, D. melanogaster
ttaatgtgtaaaa

SEQ ID NO: 663053 - DNA, 13 bp, D. melanogaster
ttaatgtgtaatt

SEQ ID NO: 663054 - DNA, 13 bp, D. melanogaster
ttaatgttaaaca

SEQ ID NO: 663055 - DNA, 14 bp, D. melanogaster
ttaatgttaatact

SEQ ID NO: 663056 - DNA, 13 bp, D. melanogaster
ttaatgttaatga

SEQ ID NO: 663057 - DNA, 13 bp, D. melanogaster
ttaatgttaatgt

SEQ ID NO: 663058 - DNA, 13 bp, D. melanogaster
ttaatgttcaatt

SEQ ID NO: 663059 - DNA, 13 bp, D. melanogaster
ttaatgttcattt

SEQ ID NO: 663060 - DNA, 13 bp, D. melanogaster
ttaatgttgatca

SEQ ID NO: 663061 - DNA, 14 bp, D. melanogaster
ttaatgtttacatt

SEQ ID NO: 663062 - DNA, 13 bp, D. melanogaster
ttaatgtttgctt

SEQ ID NO: 663063 - DNA, 13 bp, D. melanogaster
ttaatgttttcaa

SEQ ID NO: 663064 - DNA, 13 bp, D. melanogaster
ttaattaaaaagc

SEQ ID NO: 663065 - DNA, 13 bp, D. melanogaster
ttaattaaaaagg

SEQ ID NO: 663066 - DNA, 13 bp, D. melanogaster
ttaattaaaagca

SEQ ID NO: 663067 - DNA, 14 bp, D. melanogaster
ttaattaaaatgca

SEQ ID NO: 663068 - DNA, 13 bp, D. melanogaster
ttaattaaacaca

SEQ ID NO: 663069 - DNA, 13 bp, D. melanogaster
ttaattaaacaga

SEQ ID NO: 663070 - DNA, 13 bp, D. melanogaster
ttaattaaacatg

SEQ ID NO: 663071 - DNA, 13 bp, D. melanogaster
ttaattaaactca

SEQ ID NO: 663072 - DNA, 13 bp, D. melanogaster
ttaattaaactgc

SEQ ID NO: 663073 - DNA, 13 bp, D. melanogaster
ttaattaaactgt

SEQ ID NO: 663074 - DNA, 13 bp, D. melanogaster
ttaattaaatgca

SEQ ID NO: 663075 - DNA, 14 bp, D. melanogaster
ttaattaaatgttg

SEQ ID NO: 663076 - DNA, 13 bp, D. melanogaster
ttaattaacaaca

SEQ ID NO: 663077 - DNA, 13 bp, D. melanogaster
ttaattaacaagc

SEQ ID NO: 663078 - DNA, 13 bp, D. melanogaster
ttaattaagaaca

SEQ ID NO: 663079 - DNA, 13 bp, D. melanogaster
ttaattaagcaaa

SEQ ID NO: 663080 - DNA, 14 bp, D. melanogaster
ttaattaagcaaaa

SEQ ID NO: 663081 - DNA, 13 bp, D. melanogaster
ttaattaagcaat

SEQ ID NO: 663082 - DNA, 13 bp, D. melanogaster
ttaattaagcgca

SEQ ID NO: 663083 - DNA, 13 bp, D. melanogaster
ttaattaagctga

SEQ ID NO: 663084 - DNA, 13 bp, D. melanogaster
ttaattaagcttt

SEQ ID NO: 663085 - DNA, 13 bp, D. melanogaster
ttaattaagttgt

SEQ ID NO: 663086 - DNA, 13 bp, D. melanogaster
ttaattaatgaac

SEQ ID NO: 663087 - DNA, 13 bp, D. melanogaster
ttaattaatgagc

SEQ ID NO: 663088 - DNA, 13 bp, D. melanogaster
ttaattaatgcga

SEQ ID NO: 663089 - DNA, 13 bp, D. melanogaster
ttaattaattcgc

SEQ ID NO: 663090 - DNA, 14 bp, D. melanogaster
ttaattaattgcca

SEQ ID NO: 663091 - DNA, 13 bp, D. melanogaster
ttaattaattggc

SEQ ID NO: 663092 - DNA, 13 bp, D. melanogaster
ttaattaattgtg

SEQ ID NO: 663093 - DNA, 13 bp, D. melanogaster
ttaattaatttgc

SEQ ID NO: 663094 - DNA, 13 bp, D. melanogaster
ttaattacaagtt

SEQ ID NO: 663095 - DNA, 14 bp, D. melanogaster
ttaattacaatagg

SEQ ID NO: 663096 - DNA, 13 bp, D. melanogaster
ttaattacctaat

SEQ ID NO: 663097 - DNA, 13 bp, D. melanogaster
ttaattacgaaaa

SEQ ID NO: 663098 - DNA, 13 bp, D. melanogaster
ttaattacgattt

SEQ ID NO: 663099 - DNA, 13 bp, D. melanogaster
ttaattacgccaa

SEQ ID NO: 663100 - DNA, 13 bp, D. melanogaster
ttaattactaaga

SEQ ID NO: 663101 - DNA, 13 bp, D. melanogaster
ttaattactttca

SEQ ID NO: 663102 - DNA, 13 bp, D. melanogaster
ttaattactttgc

SEQ ID NO: 663103 - DNA, 13 bp, D. melanogaster
ttaattagaaagt

SEQ ID NO: 663104 - DNA, 13 bp, D. melanogaster
ttaattagcaaaa

SEQ ID NO: 663105 - DNA, 13 bp, D. melanogaster
ttaattagcaatt

SEQ ID NO: 663106 - DNA, 13 bp, D. melanogaster
ttaattagcagca

SEQ ID NO: 663107 - DNA, 13 bp, D. melanogaster
ttaattagcatat

SEQ ID NO: 663108 - DNA, 13 bp, D. melanogaster
ttaattagccaaa

SEQ ID NO: 663109 - DNA, 13 bp, D. melanogaster
ttaattagccatt

SEQ ID NO: 663110 - DNA, 13 bp, D. melanogaster
ttaattagccgca

SEQ ID NO: 663111 - DNA, 13 bp, D. melanogaster
ttaattagctgag

SEQ ID NO: 663112 - DNA, 14 bp, D. melanogaster
ttaattagctgaga

SEQ ID NO: 663113 - DNA, 13 bp, D. melanogaster
ttaattagcttaa

SEQ ID NO: 663114 - DNA, 13 bp, D. melanogaster
ttaattagctttt

SEQ ID NO: 663115 - DNA, 13 bp, D. melanogaster
ttaattaggaaaa

SEQ ID NO: 663116 - DNA, 13 bp, D. melanogaster
ttaattagtttca

SEQ ID NO: 663117 - DNA, 13 bp, D. melanogaster
ttaattatagcca

SEQ ID NO: 663118 - DNA, 13 bp, D. melanogaster
ttaattatatagc

SEQ ID NO: 663119 - DNA, 15 bp, D. melanogaster
ttaattatctaaagt

SEQ ID NO: 663120 - DNA, 13 bp, D. melanogaster
ttaattatgaatc

SEQ ID NO: 663121 - DNA, 13 bp, D. melanogaster
ttaattatgccat

SEQ ID NO: 663122 - DNA, 13 bp, D. melanogaster
ttaattatttcgt

SEQ ID NO: 663123 - DNA, 13 bp, D. melanogaster
ttaattatttgcc

SEQ ID NO: 663124 - DNA, 14 bp, D. melanogaster
ttaattattttgca

SEQ ID NO: 663125 - DNA, 13 bp, D. melanogaster
ttaattcaatcaa

SEQ ID NO: 663126 - DNA, 13 bp, D. melanogaster
ttaattcaatgcc

SEQ ID NO: 663127 - DNA, 13 bp, D. melanogaster
ttaattcaattac

SEQ ID NO: 663128 - DNA, 13 bp, D. melanogaster
ttaattcaattcg

SEQ ID NO: 663129 - DNA, 14 bp, D. melanogaster
ttaattcaatttgc

SEQ ID NO: 663130 - DNA, 13 bp, D. melanogaster
ttaattcacattt

SEQ ID NO: 663131 - DNA, 13 bp, D. melanogaster
ttaattccaaaat

SEQ ID NO: 663132 - DNA, 13 bp, D. melanogaster
ttaattccattta

SEQ ID NO: 663133 - DNA, 13 bp, D. melanogaster
ttaattccatttg

SEQ ID NO: 663134 - DNA, 13 bp, D. melanogaster
ttaattcccattt

SEQ ID NO: 663135 - DNA, 13 bp, D. melanogaster
ttaattcctttgc

SEQ ID NO: 663136 - DNA, 13 bp, D. melanogaster
ttaattcgaaatt

SEQ ID NO: 663137 - DNA, 13 bp, D. melanogaster
ttaattcgattaa

SEQ ID NO: 663138 - DNA, 13 bp, D. melanogaster
ttaattcgatttt

SEQ ID NO: 663139 - DNA, 13 bp, D. melanogaster
ttaattcgcaatt

SEQ ID NO: 663140 - DNA, 13 bp, D. melanogaster
ttaattcgtaaat

SEQ ID NO: 663141 - DNA, 14 bp, D. melanogaster
ttaattgaaaaatg

SEQ ID NO: 663142 - DNA, 13 bp, D. melanogaster
ttaattgaaaaca

SEQ ID NO: 663143 - DNA, 14 bp, D. melanogaster
ttaattgaaaacaa

SEQ ID NO: 663144 - DNA, 13 bp, D. melanogaster
ttaattgaaaacg

SEQ ID NO: 663145 - DNA, 13 bp, D. melanogaster
ttaattgaaaatg

SEQ ID NO: 663146 - DNA, 13 bp, D. melanogaster
ttaattgaaacaa

SEQ ID NO: 663147 - DNA, 13 bp, D. melanogaster
ttaattgaaacgc

SEQ ID NO: 663148 - DNA, 13 bp, D. melanogaster
ttaattgaaagca

SEQ ID NO: 663149 - DNA, 13 bp, D. melanogaster
ttaattgaaagcc

SEQ ID NO: 663150 - DNA, 13 bp, D. melanogaster
ttaattgaaagtg

SEQ ID NO: 663151 - DNA, 14 bp, D. melanogaster
ttaattgaaatcaa

SEQ ID NO: 663152 - DNA, 13 bp, D. melanogaster
ttaattgaactta

SEQ ID NO: 663153 - DNA, 13 bp, D. melanogaster
ttaattgaatcat

SEQ ID NO: 663154 - DNA, 13 bp, D. melanogaster
ttaattgaattca

SEQ ID NO: 663155 - DNA, 13 bp, D. melanogaster
ttaattgaatttc

SEQ ID NO: 663156 - DNA, 14 bp, D. melanogaster
ttaattgaatttcg

SEQ ID NO: 663157 - DNA, 13 bp, D. melanogaster
ttaattgacaatt

SEQ ID NO: 663158 - DNA, 13 bp, D. melanogaster
ttaattgagcgca

SEQ ID NO: 663159 - DNA, 13 bp, D. melanogaster
ttaattgagtaca

SEQ ID NO: 663160 - DNA, 13 bp, D. melanogaster
ttaattgagtata

SEQ ID NO: 663161 - DNA, 13 bp, D. melanogaster
ttaattgagtttc

SEQ ID NO: 663162 - DNA, 13 bp, D. melanogaster
ttaattgattaac

SEQ ID NO: 663163 - DNA, 13 bp, D. melanogaster
ttaattgattgat

SEQ ID NO: 663164 - DNA, 13 bp, D. melanogaster
ttaattgatttcg

SEQ ID NO: 663165 - DNA, 13 bp, D. melanogaster
ttaattgcaaaag

SEQ ID NO: 663166 - DNA, 13 bp, D. melanogaster
ttaattgcaacaa

SEQ ID NO: 663167 - DNA, 13 bp, D. melanogaster
ttaattgcaacca

SEQ ID NO: 663168 - DNA, 13 bp, D. melanogaster
ttaattgcaatta

SEQ ID NO: 663169 - DNA, 14 bp, D. melanogaster
ttaattgcaattaa

SEQ ID NO: 663170 - DNA, 14 bp, D. melanogaster
ttaattgcaattac

SEQ ID NO: 663171 - DNA, 13 bp, D. melanogaster
ttaattgcacaaa

SEQ ID NO: 663172 - DNA, 13 bp, D. melanogaster
ttaattgcacttt

SEQ ID NO: 663173 - DNA, 14 bp, D. melanogaster
ttaattgcacttta

SEQ ID NO: 663174 - DNA, 13 bp, D. melanogaster
ttaattgcattaa

SEQ ID NO: 663175 - DNA, 13 bp, D. melanogaster
ttaattgcattat

SEQ ID NO: 663176 - DNA, 13 bp, D. melanogaster
ttaattgcattcg

SEQ ID NO: 663177 - DNA, 13 bp, D. melanogaster
ttaattgcattct

SEQ ID NO: 663178 - DNA, 13 bp, D. melanogaster
ttaattgcattgt

SEQ ID NO: 663179 - DNA, 14 bp, D. melanogaster
ttaattgcatttca

SEQ ID NO: 663180 - DNA, 13 bp, D. melanogaster
ttaattgcatttt

SEQ ID NO: 663181 - DNA, 14 bp, D. melanogaster
ttaattgcattttc

SEQ ID NO: 663182 - DNA, 13 bp, D. melanogaster
ttaattgccaaat

SEQ ID NO: 663183 - DNA, 13 bp, D. melanogaster
ttaattgccactt

SEQ ID NO: 663184 - DNA, 13 bp, D. melanogaster
ttaattgccagcc

SEQ ID NO: 663185 - DNA, 13 bp, D. melanogaster
ttaattgccagcg

SEQ ID NO: 663186 - DNA, 13 bp, D. melanogaster
ttaattgccataa

SEQ ID NO: 663187 - DNA, 13 bp, D. melanogaster
ttaattgccattt

SEQ ID NO: 663188 - DNA, 13 bp, D. melanogaster
ttaattgccgagc

SEQ ID NO: 663189 - DNA, 13 bp, D. melanogaster
ttaattgccgcac

SEQ ID NO: 663190 - DNA, 13 bp, D. melanogaster
ttaattgccgcca

SEQ ID NO: 663191 - DNA, 13 bp, D. melanogaster
ttaattgccttaa

SEQ ID NO: 663192 - DNA, 13 bp, D. melanogaster
ttaattgcctttg

SEQ ID NO: 663193 - DNA, 13 bp, D. melanogaster
ttaattgcggtat

SEQ ID NO: 663194 - DNA, 13 bp, D. melanogaster
ttaattgcgtttt

SEQ ID NO: 663195 - DNA, 13 bp, D. melanogaster
ttaattgctattt

SEQ ID NO: 663196 - DNA, 13 bp, D. melanogaster
ttaattgctgcca

SEQ ID NO: 663197 - DNA, 13 bp, D. melanogaster
ttaattgctgttt

SEQ ID NO: 663198 - DNA, 13 bp, D. melanogaster
ttaattgcttcat

SEQ ID NO: 663199 - DNA, 13 bp, D. melanogaster
ttaattgcttgaa

SEQ ID NO: 663200 - DNA, 13 bp, D. melanogaster
ttaattggaaaat

SEQ ID NO: 663201 - DNA, 13 bp, D. melanogaster
ttaattggaaatt

SEQ ID NO: 663202 - DNA, 13 bp, D. melanogaster
ttaattggaatta

SEQ ID NO: 663203 - DNA, 13 bp, D. melanogaster
ttaattggaattg

SEQ ID NO: 663204 - DNA, 13 bp, D. melanogaster
ttaattggatatt

SEQ ID NO: 663205 - DNA, 13 bp, D. melanogaster
ttaattggcaaaa

SEQ ID NO: 663206 - DNA, 13 bp, D. melanogaster
ttaattggcatta

SEQ ID NO: 663207 - DNA, 13 bp, D. melanogaster
ttaattggcattt

SEQ ID NO: 663208 - DNA, 13 bp, D. melanogaster
ttaattggccatt

SEQ ID NO: 663209 - DNA, 13 bp, D. melanogaster
ttaattggcgtgc

SEQ ID NO: 663210 - DNA, 13 bp, D. melanogaster
ttaattggctttt

SEQ ID NO: 663211 - DNA, 13 bp, D. melanogaster
ttaattgggaaat

SEQ ID NO: 663212 - DNA, 14 bp, D. melanogaster
ttaattggtccgat

SEQ ID NO: 663213 - DNA, 13 bp, D. melanogaster
ttaattggtttaa

SEQ ID NO: 663214 - DNA, 13 bp, D. melanogaster
ttaattgtcaata

SEQ ID NO: 663215 - DNA, 13 bp, D. melanogaster
ttaattgtcaatt

SEQ ID NO: 663216 - DNA, 13 bp, D. melanogaster
ttaattgtgaaat

SEQ ID NO: 663217 - DNA, 13 bp, D. melanogaster
ttaattgtgcaaa

SEQ ID NO: 663218 - DNA, 13 bp, D. melanogaster
ttaattgtgcatt

SEQ ID NO: 663219 - DNA, 13 bp, D. melanogaster
ttaattgtgcgcc

SEQ ID NO: 663220 - DNA, 13 bp, D. melanogaster
ttaattgtgctta

SEQ ID NO: 663221 - DNA, 13 bp, D. melanogaster
ttaattgttaatg

SEQ ID NO: 663222 - DNA, 13 bp, D. melanogaster
ttaattgttcaaa

SEQ ID NO: 663223 - DNA, 14 bp, D. melanogaster
ttaattgttcttaa

SEQ ID NO: 663224 - DNA, 13 bp, D. melanogaster
ttaattgttgatc

SEQ ID NO: 663225 - DNA, 14 bp, D. melanogaster
ttaattgttgatcc

SEQ ID NO: 663226 - DNA, 13 bp, D. melanogaster
ttaattgttgcca

SEQ ID NO: 663227 - DNA, 13 bp, D. melanogaster
ttaattgtttact

SEQ ID NO: 663228 - DNA, 13 bp, D. melanogaster
ttaattgtttcaa

SEQ ID NO: 663229 - DNA, 13 bp, D. melanogaster
ttaattgtttcag

SEQ ID NO: 663230 - DNA, 13 bp, D. melanogaster
ttaattgtttgca

SEQ ID NO: 663231 - DNA, 13 bp, D. melanogaster
ttaattgttttca

SEQ ID NO: 663232 - DNA, 13 bp, D. melanogaster
ttaattgttttgc

SEQ ID NO: 663233 - DNA, 13 bp, D. melanogaster
ttaatttacagag

SEQ ID NO: 663234 - DNA, 13 bp, D. melanogaster
ttaatttacgaaa

SEQ ID NO: 663235 - DNA, 13 bp, D. melanogaster
ttaatttacttgc

SEQ ID NO: 663236 - DNA, 13 bp, D. melanogaster
ttaatttactttg

SEQ ID NO: 663237 - DNA, 13 bp, D. melanogaster
ttaatttatggca

SEQ ID NO: 663238 - DNA, 13 bp, D. melanogaster
ttaatttatgtgc

SEQ ID NO: 663239 - DNA, 13 bp, D. melanogaster
ttaatttcaacta

SEQ ID NO: 663240 - DNA, 14 bp, D. melanogaster
ttaatttcaactac

SEQ ID NO: 663241 - DNA, 13 bp, D. melanogaster
ttaatttcacaaa

SEQ ID NO: 663242 - DNA, 14 bp, D. melanogaster
ttaatttcacaatt

SEQ ID NO: 663243 - DNA, 13 bp, D. melanogaster
ttaatttcagttt

SEQ ID NO: 663244 - DNA, 14 bp, D. melanogaster
ttaatttcagtttt

SEQ ID NO: 663245 - DNA, 13 bp, D. melanogaster
ttaatttcatgtt

SEQ ID NO: 663246 - DNA, 13 bp, D. melanogaster
ttaatttcatttg

SEQ ID NO: 663247 - DNA, 13 bp, D. melanogaster
ttaatttccaaca

SEQ ID NO: 663248 - DNA, 13 bp, D. melanogaster
ttaatttccaatg

SEQ ID NO: 663249 - DNA, 13 bp, D. melanogaster
ttaatttccagca

SEQ ID NO: 663250 - DNA, 13 bp, D. melanogaster
ttaatttccataa

SEQ ID NO: 663251 - DNA, 13 bp, D. melanogaster
ttaatttcctaaa

SEQ ID NO: 663252 - DNA, 13 bp, D. melanogaster
ttaatttccttaa

SEQ ID NO: 663253 - DNA, 13 bp, D. melanogaster
ttaatttcgaaat

SEQ ID NO: 663254 - DNA, 13 bp, D. melanogaster
ttaatttcgaatt

SEQ ID NO: 663255 - DNA, 13 bp, D. melanogaster
ttaatttcgagct

SEQ ID NO: 663256 - DNA, 13 bp, D. melanogaster
ttaatttcgcatt

SEQ ID NO: 663257 - DNA, 13 bp, D. melanogaster
ttaatttcggttc

SEQ ID NO: 663258 - DNA, 14 bp, D. melanogaster
ttaatttcgtattt

SEQ ID NO: 663259 - DNA, 13 bp, D. melanogaster
ttaatttcgttaa

SEQ ID NO: 663260 - DNA, 13 bp, D. melanogaster
ttaatttctgtaa

SEQ ID NO: 663261 - DNA, 13 bp, D. melanogaster
ttaatttctttga

SEQ ID NO: 663262 - DNA, 13 bp, D. melanogaster
ttaatttctttgc

SEQ ID NO: 663263 - DNA, 13 bp, D. melanogaster
ttaatttgaaatg

SEQ ID NO: 663264 - DNA, 13 bp, D. melanogaster
ttaatttgattac

SEQ ID NO: 663265 - DNA, 13 bp, D. melanogaster
ttaatttgcaatg

SEQ ID NO: 663266 - DNA, 13 bp, D. melanogaster
ttaatttgcacaa

SEQ ID NO: 663267 - DNA, 13 bp, D. melanogaster
ttaatttgcacac

SEQ ID NO: 663268 - DNA, 13 bp, D. melanogaster
ttaatttgcagca

SEQ ID NO: 663269 - DNA, 13 bp, D. melanogaster
ttaatttgcagtt

SEQ ID NO: 663270 - DNA, 13 bp, D. melanogaster
ttaatttgcatac

SEQ ID NO: 663271 - DNA, 13 bp, D. melanogaster
ttaatttgcattc

SEQ ID NO: 663272 - DNA, 13 bp, D. melanogaster
ttaatttgcattt

SEQ ID NO: 663273 - DNA, 13 bp, D. melanogaster
ttaatttgccaaa

SEQ ID NO: 663274 - DNA, 13 bp, D. melanogaster
ttaatttgccagc

SEQ ID NO: 663275 - DNA, 13 bp, D. melanogaster
ttaatttgccatt

SEQ ID NO: 663276 - DNA, 14 bp, D. melanogaster
ttaatttgccattt

SEQ ID NO: 663277 - DNA, 13 bp, D. melanogaster
ttaatttgccgcc

SEQ ID NO: 663278 - DNA, 13 bp, D. melanogaster
ttaatttgcctaa

SEQ ID NO: 663279 - DNA, 13 bp, D. melanogaster
ttaatttgccttt

SEQ ID NO: 663280 - DNA, 13 bp, D. melanogaster
ttaatttgctcaa

SEQ ID NO: 663281 - DNA, 13 bp, D. melanogaster
ttaatttgctggc

SEQ ID NO: 663282 - DNA, 13 bp, D. melanogaster
ttaatttgcttgt

SEQ ID NO: 663283 - DNA, 13 bp, D. melanogaster
ttaatttggaaaa

SEQ ID NO: 663284 - DNA, 13 bp, D. melanogaster
ttaatttggcaaa

SEQ ID NO: 663285 - DNA, 13 bp, D. melanogaster
ttaatttgtaatg

SEQ ID NO: 663286 - DNA, 13 bp, D. melanogaster
ttaatttgtacag

SEQ ID NO: 663287 - DNA, 13 bp, D. melanogaster
ttaatttgtatgc

SEQ ID NO: 663288 - DNA, 13 bp, D. melanogaster
ttaatttgtattc

SEQ ID NO: 663289 - DNA, 13 bp, D. melanogaster
ttaatttgtcaac

SEQ ID NO: 663290 - DNA, 13 bp, D. melanogaster
ttaatttgtgcat

SEQ ID NO: 663291 - DNA, 13 bp, D. melanogaster
ttaatttgtggca

SEQ ID NO: 663292 - DNA, 13 bp, D. melanogaster
ttaatttgtggcc

SEQ ID NO: 663293 - DNA, 13 bp, D. melanogaster
ttaatttgtttac

SEQ ID NO: 663294 - DNA, 13 bp, D. melanogaster
ttaatttgtttcc

SEQ ID NO: 663295 - DNA, 13 bp, D. melanogaster
ttaattttaaagg

SEQ ID NO: 663296 - DNA, 13 bp, D. melanogaster
ttaattttatgca

SEQ ID NO: 663297 - DNA, 13 bp, D. melanogaster
ttaattttatggc

SEQ ID NO: 663298 - DNA, 13 bp, D. melanogaster
ttaattttcaaca

SEQ ID NO: 663299 - DNA, 13 bp, D. melanogaster
ttaattttcacat

SEQ ID NO: 663300 - DNA, 13 bp, D. melanogaster
ttaattttcagct

SEQ ID NO: 663301 - DNA, 13 bp, D. melanogaster
ttaattttcatca

SEQ ID NO: 663302 - DNA, 13 bp, D. melanogaster
ttaattttcctaa

SEQ ID NO: 663303 - DNA, 14 bp, D. melanogaster
ttaattttcgctta

SEQ ID NO: 663304 - DNA, 13 bp, D. melanogaster
ttaattttctgat

SEQ ID NO: 663305 - DNA, 13 bp, D. melanogaster
ttaattttgaact

SEQ ID NO: 663306 - DNA, 13 bp, D. melanogaster
ttaattttgatga

SEQ ID NO: 663307 - DNA, 14 bp, D. melanogaster
ttaattttgcattt

SEQ ID NO: 663308 - DNA, 13 bp, D. melanogaster
ttaattttgcgaa

SEQ ID NO: 663309 - DNA, 13 bp, D. melanogaster
ttaattttgctgg

SEQ ID NO: 663310 - DNA, 13 bp, D. melanogaster
ttaattttggcaa

SEQ ID NO: 663311 - DNA, 13 bp, D. melanogaster
ttaattttggcca

SEQ ID NO: 663312 - DNA, 13 bp, D. melanogaster
ttaattttgttca

SEQ ID NO: 663313 - DNA, 13 bp, D. melanogaster
ttaattttgttgc

SEQ ID NO: 663314 - DNA, 13 bp, D. melanogaster
ttaatttttagct

SEQ ID NO: 663315 - DNA, 13 bp, D. melanogaster
ttaatttttgtcg

SEQ ID NO: 663316 - DNA, 13 bp, D. melanogaster
ttacaaaaaaagt

SEQ ID NO: 663317 - DNA, 13 bp, D. melanogaster
ttacaaaaacatt

SEQ ID NO: 663318 - DNA, 13 bp, D. melanogaster
ttacaaaaacctt

SEQ ID NO: 663319 - DNA, 13 bp, D. melanogaster
ttacaaaaactca

SEQ ID NO: 663320 - DNA, 13 bp, D. melanogaster
ttacaaaaagttt

SEQ ID NO: 663321 - DNA, 13 bp, D. melanogaster
ttacaaaaccgtt

SEQ ID NO: 663322 - DNA, 13 bp, D. melanogaster
ttacaaaactcaa

SEQ ID NO: 663323 - DNA, 13 bp, D. melanogaster
ttacaaaagcaac

SEQ ID NO: 663324 - DNA, 13 bp, D. melanogaster
ttacaaaaggaga

SEQ ID NO: 663325 - DNA, 13 bp, D. melanogaster
ttacaaaaggcga

SEQ ID NO: 663326 - DNA, 13 bp, D. melanogaster
ttacaaaagtaaa

SEQ ID NO: 663327 - DNA, 13 bp, D. melanogaster
ttacaaaagttgt

SEQ ID NO: 663328 - DNA, 13 bp, D. melanogaster
ttacaaaagttta

SEQ ID NO: 663329 - DNA, 13 bp, D. melanogaster
ttacaaaatattg

SEQ ID NO: 663330 - DNA, 13 bp, D. melanogaster
ttacaaaatctgt

SEQ ID NO: 663331 - DNA, 13 bp, D. melanogaster
ttacaaaatgtat

SEQ ID NO: 663332 - DNA, 13 bp, D. melanogaster
ttacaaaatgttt

SEQ ID NO: 663333 - DNA, 14 bp, D. melanogaster
ttacaaaatgtttt

SEQ ID NO: 663334 - DNA, 13 bp, D. melanogaster
ttacaaaattaca

SEQ ID NO: 663335 - DNA, 13 bp, D. melanogaster
ttacaaaattcaa

SEQ ID NO: 663336 - DNA, 13 bp, D. melanogaster
ttacaaaattctt

SEQ ID NO: 663337 - DNA, 13 bp, D. melanogaster
ttacaaacacatt

SEQ ID NO: 663338 - DNA, 13 bp, D. melanogaster
ttacaaacatttt

SEQ ID NO: 663339 - DNA, 13 bp, D. melanogaster
ttacaaagaaaat

SEQ ID NO: 663340 - DNA, 13 bp, D. melanogaster
ttacaaagaaatt

SEQ ID NO: 663341 - DNA, 13 bp, D. melanogaster
ttacaaagaattt

SEQ ID NO: 663342 - DNA, 13 bp, D. melanogaster
ttacaaagtattt

SEQ ID NO: 663343 - DNA, 13 bp, D. melanogaster
ttacaaatacata

SEQ ID NO: 663344 - DNA, 13 bp, D. melanogaster
ttacaaatacatt

SEQ ID NO: 663345 - DNA, 13 bp, D. melanogaster
ttacaaatataca

SEQ ID NO: 663346 - DNA, 13 bp, D. melanogaster
ttacaaatatgta

SEQ ID NO: 663347 - DNA, 13 bp, D. melanogaster
ttacaaatcaaat

SEQ ID NO: 663348 - DNA, 13 bp, D. melanogaster
ttacaaatcaatt

SEQ ID NO: 663349 - DNA, 14 bp, D. melanogaster
ttacaaatgaagaa

SEQ ID NO: 663350 - DNA, 13 bp, D. melanogaster
ttacaaatgaatt

SEQ ID NO: 663351 - DNA, 13 bp, D. melanogaster
ttacaaatgtatt

SEQ ID NO: 663352 - DNA, 13 bp, D. melanogaster
ttacaaatgtttt

SEQ ID NO: 663353 - DNA, 13 bp, D. melanogaster
ttacaaattacaa

SEQ ID NO: 663354 - DNA, 13 bp, D. melanogaster
ttacaaattggat

SEQ ID NO: 663355 - DNA, 14 bp, D. melanogaster
ttacaaattggatt

SEQ ID NO: 663356 - DNA, 13 bp, D. melanogaster
ttacaaattggtt

SEQ ID NO: 663357 - DNA, 13 bp, D. melanogaster
ttacaaattgtat

SEQ ID NO: 663358 - DNA, 14 bp, D. melanogaster
ttacaaattgtatt

SEQ ID NO: 663359 - DNA, 13 bp, D. melanogaster
ttacaaatttaca

SEQ ID NO: 663360 - DNA, 14 bp, D. melanogaster
ttacaaatttacaa

SEQ ID NO: 663361 - DNA, 13 bp, D. melanogaster
ttacaaatttcaa

SEQ ID NO: 663362 - DNA, 13 bp, D. melanogaster
ttacaaattttgt

SEQ ID NO: 663363 - DNA, 13 bp, D. melanogaster
ttacaacaaaaag

SEQ ID NO: 663364 - DNA, 13 bp, D. melanogaster
ttacaacaaattg

SEQ ID NO: 663365 - DNA, 13 bp, D. melanogaster
ttacaacacatac

SEQ ID NO: 663366 - DNA, 13 bp, D. melanogaster
ttacaacgatttt

SEQ ID NO: 663367 - DNA, 13 bp, D. melanogaster
ttacaactaaaac

SEQ ID NO: 663368 - DNA, 13 bp, D. melanogaster
ttacaactcaaca

SEQ ID NO: 663369 - DNA, 13 bp, D. melanogaster
ttacaacttattt

SEQ ID NO: 663370 - DNA, 13 bp, D. melanogaster
ttacaagaacact

SEQ ID NO: 663371 - DNA, 13 bp, D. melanogaster
ttacaagaatggc

SEQ ID NO: 663372 - DNA, 13 bp, D. melanogaster
ttacaagcaaaaa

SEQ ID NO: 663373 - DNA, 14 bp, D. melanogaster
ttacaagcaaaaat

SEQ ID NO: 663374 - DNA, 13 bp, D. melanogaster
ttacaagcaaatt

SEQ ID NO: 663375 - DNA, 13 bp, D. melanogaster
ttacaagtatttt

SEQ ID NO: 663376 - DNA, 13 bp, D. melanogaster
ttacaagtgcatt

SEQ ID NO: 663377 - DNA, 13 bp, D. melanogaster
ttacaataaatca

SEQ ID NO: 663378 - DNA, 13 bp, D. melanogaster
ttacaataacaat

SEQ ID NO: 663379 - DNA, 13 bp, D. melanogaster
ttacaataattca

SEQ ID NO: 663380 - DNA, 13 bp, D. melanogaster
ttacaatacaatt

SEQ ID NO: 663381 - DNA, 13 bp, D. melanogaster
ttacaatactaat

SEQ ID NO: 663382 - DNA, 14 bp, D. melanogaster
ttacaatatgtttt

SEQ ID NO: 663383 - DNA, 13 bp, D. melanogaster
ttacaatatttgt

SEQ ID NO: 663384 - DNA, 13 bp, D. melanogaster
ttacaatgatcat

SEQ ID NO: 663385 - DNA, 13 bp, D. melanogaster
ttacaatgcattt

SEQ ID NO: 663386 - DNA, 13 bp, D. melanogaster
ttacaatgccaaa

SEQ ID NO: 663387 - DNA, 13 bp, D. melanogaster
ttacaatgttttt

SEQ ID NO: 663388 - DNA, 13 bp, D. melanogaster
ttacaattaaaac

SEQ ID NO: 663389 - DNA, 13 bp, D. melanogaster
ttacaattaagaa

SEQ ID NO: 663390 - DNA, 13 bp, D. melanogaster
ttacaattaattg

SEQ ID NO: 663391 - DNA, 14 bp, D. melanogaster
ttacaattacaatt

SEQ ID NO: 663392 - DNA, 13 bp, D. melanogaster
ttacaattattac

SEQ ID NO: 663393 - DNA, 14 bp, D. melanogaster
ttacaattattaca

SEQ ID NO: 663394 - DNA, 13 bp, D. melanogaster
ttacaattcaaat

SEQ ID NO: 663395 - DNA, 13 bp, D. melanogaster
ttacaattgcatt

SEQ ID NO: 663396 - DNA, 13 bp, D. melanogaster
ttacaattgtaaa

SEQ ID NO: 663397 - DNA, 13 bp, D. melanogaster
ttacaatttaaac

SEQ ID NO: 663398 - DNA, 13 bp, D. melanogaster
ttacaatttacat

SEQ ID NO: 663399 - DNA, 13 bp, D. melanogaster
ttacaatttacgc

SEQ ID NO: 663400 - DNA, 13 bp, D. melanogaster
ttacaatttgatt

SEQ ID NO: 663401 - DNA, 14 bp, D. melanogaster
ttacaatttgattt

SEQ ID NO: 663402 - DNA, 13 bp, D. melanogaster
ttacaatttgtat

SEQ ID NO: 663403 - DNA, 14 bp, D. melanogaster
ttacaatttgtatg

SEQ ID NO: 663404 - DNA, 13 bp, D. melanogaster
ttacaatttgttg

SEQ ID NO: 663405 - DNA, 13 bp, D. melanogaster
ttacaatttgttt

SEQ ID NO: 663406 - DNA, 13 bp, D. melanogaster
ttacaattttgaa

SEQ ID NO: 663407 - DNA, 13 bp, D. melanogaster
ttacaattttgtt

SEQ ID NO: 663408 - DNA, 14 bp, D. melanogaster
ttacacaaatattt

SEQ ID NO: 663409 - DNA, 14 bp, D. melanogaster
ttacacaaattatt

SEQ ID NO: 663410 - DNA, 13 bp, D. melanogaster
ttacacaatattt

SEQ ID NO: 663411 - DNA, 13 bp, D. melanogaster
ttacacaattatt

SEQ ID NO: 663412 - DNA, 13 bp, D. melanogaster
ttacacaattgaa

SEQ ID NO: 663413 - DNA, 13 bp, D. melanogaster
ttacacacaattt

SEQ ID NO: 663414 - DNA, 13 bp, D. melanogaster
ttacacacacaca

SEQ ID NO: 663415 - DNA, 13 bp, D. melanogaster
ttacacacatttt

SEQ ID NO: 663416 - DNA, 13 bp, D. melanogaster
ttacacactcaca

SEQ ID NO: 663417 - DNA, 14 bp, D. melanogaster
ttacacacttttga

SEQ ID NO: 663418 - DNA, 13 bp, D. melanogaster
ttacacagagaaa

SEQ ID NO: 663419 - DNA, 14 bp, D. melanogaster
ttacacagagaaaa

SEQ ID NO: 663420 - DNA, 13 bp, D. melanogaster
ttacacataaaac

SEQ ID NO: 663421 - DNA, 15 bp, D. melanogaster
ttacacataaaacga

SEQ ID NO: 663422 - DNA, 13 bp, D. melanogaster
ttacacatacaca

SEQ ID NO: 663423 - DNA, 13 bp, D. melanogaster
ttacacatacgca

SEQ ID NO: 663424 - DNA, 13 bp, D. melanogaster
ttacacatatctt

SEQ ID NO: 663425 - DNA, 13 bp, D. melanogaster
ttacacatatgta

SEQ ID NO: 663426 - DNA, 13 bp, D. melanogaster
ttacacatttgtt

SEQ ID NO: 663427 - DNA, 13 bp, D. melanogaster
ttacacattttgc

SEQ ID NO: 663428 - DNA, 13 bp, D. melanogaster
ttacaccttttat

SEQ ID NO: 663429 - DNA, 13 bp, D. melanogaster
ttacacgatcttt

SEQ ID NO: 663430 - DNA, 13 bp, D. melanogaster
ttacactcacaca

SEQ ID NO: 663431 - DNA, 14 bp, D. melanogaster
ttacactgaaaaaa

SEQ ID NO: 663432 - DNA, 13 bp, D. melanogaster
ttacactgaaaga

SEQ ID NO: 663433 - DNA, 13 bp, D. melanogaster
ttacactgagaaa

SEQ ID NO: 663434 - DNA, 13 bp, D. melanogaster
ttacactggaaaa

SEQ ID NO: 663435 - DNA, 14 bp, D. melanogaster
ttacactggaggat

SEQ ID NO: 663436 - DNA, 13 bp, D. melanogaster
ttacagaaaattt

SEQ ID NO: 663437 - DNA, 13 bp, D. melanogaster
ttacagaaataaa

SEQ ID NO: 663438 - DNA, 13 bp, D. melanogaster
ttacagaatttta

SEQ ID NO: 663439 - DNA, 13 bp, D. melanogaster
ttacagatatttt

SEQ ID NO: 663440 - DNA, 13 bp, D. melanogaster
ttacagcaaattt

SEQ ID NO: 663441 - DNA, 13 bp, D. melanogaster
ttacagccattaa

SEQ ID NO: 663442 - DNA, 13 bp, D. melanogaster
ttacagggtatca

SEQ ID NO: 663443 - DNA, 13 bp, D. melanogaster
ttacagtttattg

SEQ ID NO: 663444 - DNA, 13 bp, D. melanogaster
ttacagtttctta

SEQ ID NO: 663445 - DNA, 13 bp, D. melanogaster
ttacagtttttaa

SEQ ID NO: 663446 - DNA, 13 bp, D. melanogaster
ttacataaataca

SEQ ID NO: 663447 - DNA, 13 bp, D. melanogaster
ttacataagtttt

SEQ ID NO: 663448 - DNA, 13 bp, D. melanogaster
ttacataatctag

SEQ ID NO: 663449 - DNA, 13 bp, D. melanogaster
ttacataatcttg

SEQ ID NO: 663450 - DNA, 13 bp, D. melanogaster
ttacatacaaatg

SEQ ID NO: 663451 - DNA, 13 bp, D. melanogaster
ttacatacaattt

SEQ ID NO: 663452 - DNA, 13 bp, D. melanogaster
ttacatacataaa

SEQ ID NO: 663453 - DNA, 13 bp, D. melanogaster
ttacatacataca

SEQ ID NO: 663454 - DNA, 15 bp, D. melanogaster
ttacatacatatatg

SEQ ID NO: 663455 - DNA, 13 bp, D. melanogaster
ttacatacatatg

SEQ ID NO: 663456 - DNA, 14 bp, D. melanogaster
ttacatacatatgt

SEQ ID NO: 663457 - DNA, 13 bp, D. melanogaster
ttacatacatatt

SEQ ID NO: 663458 - DNA, 13 bp, D. melanogaster
ttacatacatgta

SEQ ID NO: 663459 - DNA, 13 bp, D. melanogaster
ttacatacatttt

SEQ ID NO: 663460 - DNA, 14 bp, D. melanogaster
ttacatacttttca

SEQ ID NO: 663461 - DNA, 13 bp, D. melanogaster
ttacatataaact

SEQ ID NO: 663462 - DNA, 13 bp, D. melanogaster
ttacatatacaaa

SEQ ID NO: 663463 - DNA, 14 bp, D. melanogaster
ttacatatagacat

SEQ ID NO: 663464 - DNA, 13 bp, D. melanogaster
ttacatatatatc

SEQ ID NO: 663465 - DNA, 13 bp, D. melanogaster
ttacatatatcaa

SEQ ID NO: 663466 - DNA, 14 bp, D. melanogaster
ttacatatatgtat

SEQ ID NO: 663467 - DNA, 13 bp, D. melanogaster
ttacatatattac

SEQ ID NO: 663468 - DNA, 13 bp, D. melanogaster
ttacatatgtaaa

SEQ ID NO: 663469 - DNA, 13 bp, D. melanogaster
ttacatatgtaca

SEQ ID NO: 663470 - DNA, 13 bp, D. melanogaster
ttacatatgtata

SEQ ID NO: 663471 - DNA, 13 bp, D. melanogaster
ttacatatgtatg

SEQ ID NO: 663472 - DNA, 14 bp, D. melanogaster
ttacatatgtatgt

SEQ ID NO: 663473 - DNA, 15 bp, D. melanogaster
ttacatatgtatgta

SEQ ID NO: 663474 - DNA, 13 bp, D. melanogaster
ttacatatgtgtg

SEQ ID NO: 663475 - DNA, 13 bp, D. melanogaster
ttacatattcata

SEQ ID NO: 663476 - DNA, 13 bp, D. melanogaster
ttacatatttgta

SEQ ID NO: 663477 - DNA, 13 bp, D. melanogaster
ttacatgactaat

SEQ ID NO: 663478 - DNA, 14 bp, D. melanogaster
ttacatgtttactt

SEQ ID NO: 663479 - DNA, 14 bp, D. melanogaster
ttacatgtttttga

SEQ ID NO: 663480 - DNA, 13 bp, D. melanogaster
ttacattcaaata

SEQ ID NO: 663481 - DNA, 13 bp, D. melanogaster
ttacattcaatat

SEQ ID NO: 663482 - DNA, 13 bp, D. melanogaster
ttacattcaattt

SEQ ID NO: 663483 - DNA, 13 bp, D. melanogaster
ttacattcacatt

SEQ ID NO: 663484 - DNA, 13 bp, D. melanogaster
ttacattcataaa

SEQ ID NO: 663485 - DNA, 13 bp, D. melanogaster
ttacattgagaaa

SEQ ID NO: 663486 - DNA, 13 bp, D. melanogaster
ttacattgatgac

SEQ ID NO: 663487 - DNA, 13 bp, D. melanogaster
ttacattgatttc

SEQ ID NO: 663488 - DNA, 13 bp, D. melanogaster
ttacattgtacat

SEQ ID NO: 663489 - DNA, 13 bp, D. melanogaster
ttacattgtatat

SEQ ID NO: 663490 - DNA, 13 bp, D. melanogaster
ttacattgttttc

SEQ ID NO: 663491 - DNA, 13 bp, D. melanogaster
ttacatttaaagt

SEQ ID NO: 663492 - DNA, 13 bp, D. melanogaster
ttacatttaaatg

SEQ ID NO: 663493 - DNA, 13 bp, D. melanogaster
ttacatttaacaa

SEQ ID NO: 663494 - DNA, 13 bp, D. melanogaster
ttacatttacatt

SEQ ID NO: 663495 - DNA, 13 bp, D. melanogaster
ttacatttactta

SEQ ID NO: 663496 - DNA, 13 bp, D. melanogaster
ttacatttagttt

SEQ ID NO: 663497 - DNA, 13 bp, D. melanogaster
ttacatttataca

SEQ ID NO: 663498 - DNA, 14 bp, D. melanogaster
ttacatttatacat

SEQ ID NO: 663499 - DNA, 13 bp, D. melanogaster
ttacatttattgg

SEQ ID NO: 663500 - DNA, 13 bp, D. melanogaster
ttacatttcaaag

SEQ ID NO: 663501 - DNA, 13 bp, D. melanogaster
ttacatttcactt

SEQ ID NO: 663502 - DNA, 13 bp, D. melanogaster
ttacatttccaat

SEQ ID NO: 663503 - DNA, 13 bp, D. melanogaster
ttacatttccatc

SEQ ID NO: 663504 - DNA, 13 bp, D. melanogaster
ttacatttccctt

SEQ ID NO: 663505 - DNA, 13 bp, D. melanogaster
ttacatttcgatt

SEQ ID NO: 663506 - DNA, 13 bp, D. melanogaster
ttacatttctgtt

SEQ ID NO: 663507 - DNA, 13 bp, D. melanogaster
ttacatttcttaa

SEQ ID NO: 663508 - DNA, 13 bp, D. melanogaster
ttacatttgaatt

SEQ ID NO: 663509 - DNA, 13 bp, D. melanogaster
ttacatttgcatt

SEQ ID NO: 663510 - DNA, 14 bp, D. melanogaster
ttacatttgcattt

SEQ ID NO: 663511 - DNA, 13 bp, D. melanogaster
ttacatttggttt

SEQ ID NO: 663512 - DNA, 13 bp, D. melanogaster
ttacatttgtgtt

SEQ ID NO: 663513 - DNA, 13 bp, D. melanogaster
ttacatttgttgt

SEQ ID NO: 663514 - DNA, 13 bp, D. melanogaster
ttacatttgttta

SEQ ID NO: 663515 - DNA, 13 bp, D. melanogaster
ttacattttaaag

SEQ ID NO: 663516 - DNA, 13 bp, D. melanogaster
ttacattttagct

SEQ ID NO: 663517 - DNA, 13 bp, D. melanogaster
ttacattttatgc

SEQ ID NO: 663518 - DNA, 13 bp, D. melanogaster
ttacattttcaaa

SEQ ID NO: 663519 - DNA, 13 bp, D. melanogaster
ttacattttccca

SEQ ID NO: 663520 - DNA, 13 bp, D. melanogaster
ttacattttcgtt

SEQ ID NO: 663521 - DNA, 13 bp, D. melanogaster
ttacattttctaa

SEQ ID NO: 663522 - DNA, 13 bp, D. melanogaster
ttacattttgaaa

SEQ ID NO: 663523 - DNA, 14 bp, D. melanogaster
ttacattttgaaaa

SEQ ID NO: 663524 - DNA, 13 bp, D. melanogaster
ttacattttgaga

SEQ ID NO: 663525 - DNA, 13 bp, D. melanogaster
ttacattttgtat

SEQ ID NO: 663526 - DNA, 13 bp, D. melanogaster
ttacatttttgtg

SEQ ID NO: 663527 - DNA, 13 bp, D. melanogaster
ttacattttttcg

SEQ ID NO: 663528 - DNA, 13 bp, D. melanogaster
ttaccaaaaattt

SEQ ID NO: 663529 - DNA, 13 bp, D. melanogaster
ttaccaaaatcaa

SEQ ID NO: 663530 - DNA, 13 bp, D. melanogaster
ttaccaaacggat

SEQ ID NO: 663531 - DNA, 13 bp, D. melanogaster
ttaccaaatattt

SEQ ID NO: 663532 - DNA, 14 bp, D. melanogaster
ttaccaaatatttt

SEQ ID NO: 663533 - DNA, 13 bp, D. melanogaster
ttaccaaatgaac

SEQ ID NO: 663534 - DNA, 14 bp, D. melanogaster
ttaccaaatgaact

SEQ ID NO: 663535 - DNA, 13 bp, D. melanogaster
ttaccaaattaaa

SEQ ID NO: 663536 - DNA, 13 bp, D. melanogaster
ttaccaaatttgt

SEQ ID NO: 663537 - DNA, 13 bp, D. melanogaster
ttaccaaattttc

SEQ ID NO: 663538 - DNA, 13 bp, D. melanogaster
ttaccaacaaatt

SEQ ID NO: 663539 - DNA, 13 bp, D. melanogaster
ttaccaatatctg

SEQ ID NO: 663540 - DNA, 13 bp, D. melanogaster
ttaccaatatttt

SEQ ID NO: 663541 - DNA, 13 bp, D. melanogaster
ttaccaatccgag

SEQ ID NO: 663542 - DNA, 13 bp, D. melanogaster
ttaccaattaatt

SEQ ID NO: 663543 - DNA, 13 bp, D. melanogaster
ttaccacgcccac

SEQ ID NO: 663544 - DNA, 13 bp, D. melanogaster
ttaccacggtggc

SEQ ID NO: 663545 - DNA, 13 bp, D. melanogaster
ttaccacttacca

SEQ ID NO: 663546 - DNA, 13 bp, D. melanogaster
ttaccagaataac

SEQ ID NO: 663547 - DNA, 13 bp, D. melanogaster
ttaccaggctttg

SEQ ID NO: 663548 - DNA, 14 bp, D. melanogaster
ttaccagtgctaac

SEQ ID NO: 663549 - DNA, 14 bp, D. melanogaster
ttaccagttaccag

SEQ ID NO: 663550 - DNA, 13 bp, D. melanogaster
ttaccataaaaat

SEQ ID NO: 663551 - DNA, 13 bp, D. melanogaster
ttaccataaactt

SEQ ID NO: 663552 - DNA, 13 bp, D. melanogaster
ttaccataaatat

SEQ ID NO: 663553 - DNA, 13 bp, D. melanogaster
ttaccatcgaatt

SEQ ID NO: 663554 - DNA, 14 bp, D. melanogaster
ttaccatcgaattc

SEQ ID NO: 663555 - DNA, 13 bp, D. melanogaster
ttaccattaattt

SEQ ID NO: 663556 - DNA, 13 bp, D. melanogaster
ttaccattgccat

SEQ ID NO: 663557 - DNA, 13 bp, D. melanogaster
ttaccatttaaac

SEQ ID NO: 663558 - DNA, 13 bp, D. melanogaster
ttaccatttaatt

SEQ ID NO: 663559 - DNA, 13 bp, D. melanogaster
ttaccatttacca

SEQ ID NO: 663560 - DNA, 14 bp, D. melanogaster
ttaccatttaccat

SEQ ID NO: 663561 - DNA, 13 bp, D. melanogaster
ttaccatttcatt

SEQ ID NO: 663562 - DNA, 13 bp, D. melanogaster
ttaccattttata

SEQ ID NO: 663563 - DNA, 13 bp, D. melanogaster
ttacccagactcc

SEQ ID NO: 663564 - DNA, 13 bp, D. melanogaster
ttacccatgaatt

SEQ ID NO: 663565 - DNA, 13 bp, D. melanogaster
ttacccttcattt

SEQ ID NO: 663566 - DNA, 13 bp, D. melanogaster
ttaccgaaatctg

SEQ ID NO: 663567 - DNA, 14 bp, D. melanogaster
ttacctataagaaa

SEQ ID NO: 663568 - DNA, 13 bp, D. melanogaster
ttacctcgatagt

SEQ ID NO: 663569 - DNA, 13 bp, D. melanogaster
ttacctcggtcta

SEQ ID NO: 663570 - DNA, 13 bp, D. melanogaster
ttacctctaaagt

SEQ ID NO: 663571 - DNA, 13 bp, D. melanogaster
ttacctctaattt

SEQ ID NO: 663572 - DNA, 13 bp, D. melanogaster
ttacctctctgct

SEQ ID NO: 663573 - DNA, 13 bp, D. melanogaster
ttacctgccttat

SEQ ID NO: 663574 - DNA, 13 bp, D. melanogaster
ttacctgtctggc

SEQ ID NO: 663575 - DNA, 13 bp, D. melanogaster
ttaccttaaacaa

SEQ ID NO: 663576 - DNA, 13 bp, D. melanogaster
ttaccttacctta

SEQ ID NO: 663577 - DNA, 13 bp, D. melanogaster
ttacctttaaaaa

SEQ ID NO: 663578 - DNA, 13 bp, D. melanogaster
ttacctttacctt

SEQ ID NO: 663579 - DNA, 13 bp, D. melanogaster
ttacctttggtag

SEQ ID NO: 663580 - DNA, 14 bp, D. melanogaster
ttacctttgtctaa

SEQ ID NO: 663581 - DNA, 14 bp, D. melanogaster
ttacgaaaaatatt

SEQ ID NO: 663582 - DNA, 13 bp, D. melanogaster
ttacgaaaataaa

SEQ ID NO: 663583 - DNA, 13 bp, D. melanogaster
ttacgagcaacag

SEQ ID NO: 663584 - DNA, 13 bp, D. melanogaster
ttacgagtgcact

SEQ ID NO: 663585 - DNA, 13 bp, D. melanogaster
ttacgattacgat

SEQ ID NO: 663586 - DNA, 14 bp, D. melanogaster
ttacgattacgatt

SEQ ID NO: 663587 - DNA, 13 bp, D. melanogaster
ttacgattagctt

SEQ ID NO: 663588 - DNA, 13 bp, D. melanogaster
ttacgatttattt

SEQ ID NO: 663589 - DNA, 13 bp, D. melanogaster
ttacgatttgttt

SEQ ID NO: 663590 - DNA, 13 bp, D. melanogaster
ttacgatttttca

SEQ ID NO: 663591 - DNA, 13 bp, D. melanogaster
ttacgcacaaatt

SEQ ID NO: 663592 - DNA, 14 bp, D. melanogaster
ttacgcagagaatg

SEQ ID NO: 663593 - DNA, 13 bp, D. melanogaster
ttacgcatacgca

SEQ ID NO: 663594 - DNA, 13 bp, D. melanogaster
ttacgcatacgcc

SEQ ID NO: 663595 - DNA, 14 bp, D. melanogaster
ttacgcatacgcca

SEQ ID NO: 663596 - DNA, 14 bp, D. melanogaster
ttacgcatacgccc

SEQ ID NO: 663597 - DNA, 13 bp, D. melanogaster
ttacgcattcgcc

SEQ ID NO: 663598 - DNA, 13 bp, D. melanogaster
ttacgccaaaaac

SEQ ID NO: 663599 - DNA, 13 bp, D. melanogaster
ttacggcccattc

SEQ ID NO: 663600 - DNA, 13 bp, D. melanogaster
ttacgtaatttcg

SEQ ID NO: 663601 - DNA, 13 bp, D. melanogaster
ttacgtatacgca

SEQ ID NO: 663602 - DNA, 13 bp, D. melanogaster
ttacgtccgctgc

SEQ ID NO: 663603 - DNA, 13 bp, D. melanogaster
ttacgttacgtta

SEQ ID NO: 663604 - DNA, 13 bp, D. melanogaster
ttacgttttaatt

SEQ ID NO: 663605 - DNA, 13 bp, D. melanogaster
ttacgttttcatt

SEQ ID NO: 663606 - DNA, 13 bp, D. melanogaster
ttactaaaaatca

SEQ ID NO: 663607 - DNA, 14 bp, D. melanogaster
ttactaaaatttgt

SEQ ID NO: 663608 - DNA, 13 bp, D. melanogaster
ttactaagcacat

SEQ ID NO: 663609 - DNA, 13 bp, D. melanogaster
ttactaatctcca

SEQ ID NO: 663610 - DNA, 14 bp, D. melanogaster
ttactacaatatat

SEQ ID NO: 663611 - DNA, 13 bp, D. melanogaster
ttactacagtacc

SEQ ID NO: 663612 - DNA, 13 bp, D. melanogaster
ttactactactac

SEQ ID NO: 663613 - DNA, 14 bp, D. melanogaster
ttactactactact

SEQ ID NO: 663614 - DNA, 13 bp, D. melanogaster
ttactatactata

SEQ ID NO: 663615 - DNA, 13 bp, D. melanogaster
ttactatggtcga

SEQ ID NO: 663616 - DNA, 13 bp, D. melanogaster
ttactattgtagt

SEQ ID NO: 663617 - DNA, 13 bp, D. melanogaster
ttactcaacattt

SEQ ID NO: 663618 - DNA, 13 bp, D. melanogaster
ttactcaattaat

SEQ ID NO: 663619 - DNA, 14 bp, D. melanogaster
ttactcagctagtg

SEQ ID NO: 663620 - DNA, 13 bp, D. melanogaster
ttactcatacgac

SEQ ID NO: 663621 - DNA, 14 bp, D. melanogaster
ttactcatacgaca

SEQ ID NO: 663622 - DNA, 13 bp, D. melanogaster
ttactccagttac

SEQ ID NO: 663623 - DNA, 13 bp, D. melanogaster
ttactccatgtta

SEQ ID NO: 663624 - DNA, 13 bp, D. melanogaster
ttactccattgct

SEQ ID NO: 663625 - DNA, 13 bp, D. melanogaster
ttactcgcatttt

SEQ ID NO: 663626 - DNA, 13 bp, D. melanogaster
ttactcgtacatt

SEQ ID NO: 663627 - DNA, 13 bp, D. melanogaster
ttactcgtactgc

SEQ ID NO: 663628 - DNA, 14 bp, D. melanogaster
ttactcgtagagta

SEQ ID NO: 663629 - DNA, 13 bp, D. melanogaster
ttactctacgaat

SEQ ID NO: 663630 - DNA, 13 bp, D. melanogaster
ttactgaataaat

SEQ ID NO: 663631 - DNA, 13 bp, D. melanogaster
ttactgcaacacc

SEQ ID NO: 663632 - DNA, 13 bp, D. melanogaster
ttactgcaatttt

SEQ ID NO: 663633 - DNA, 13 bp, D. melanogaster
ttactggaaaaat

SEQ ID NO: 663634 - DNA, 13 bp, D. melanogaster
ttactggttactg

SEQ ID NO: 663635 - DNA, 13 bp, D. melanogaster
ttactgttgttgt

SEQ ID NO: 663636 - DNA, 13 bp, D. melanogaster
ttactgttttgtg

SEQ ID NO: 663637 - DNA, 13 bp, D. melanogaster
ttacttaaaatgt

SEQ ID NO: 663638 - DNA, 13 bp, D. melanogaster
ttacttaaactaa

SEQ ID NO: 663639 - DNA, 13 bp, D. melanogaster
ttacttaaagcaa

SEQ ID NO: 663640 - DNA, 13 bp, D. melanogaster
ttacttaaattac

SEQ ID NO: 663641 - DNA, 13 bp, D. melanogaster
ttacttaaatttc

SEQ ID NO: 663642 - DNA, 13 bp, D. melanogaster
ttacttaacaatt

SEQ ID NO: 663643 - DNA, 14 bp, D. melanogaster
ttacttacttactt

SEQ ID NO: 663644 - DNA, 13 bp, D. melanogaster
ttacttatactta

SEQ ID NO: 663645 - DNA, 13 bp, D. melanogaster
ttacttatcatta

SEQ ID NO: 663646 - DNA, 14 bp, D. melanogaster
ttacttatcattaa

SEQ ID NO: 663647 - DNA, 13 bp, D. melanogaster
ttacttatttgca

SEQ ID NO: 663648 - DNA, 13 bp, D. melanogaster
ttacttcacttca

SEQ ID NO: 663649 - DNA, 13 bp, D. melanogaster
ttacttcaggatt

SEQ ID NO: 663650 - DNA, 13 bp, D. melanogaster
ttacttccaactt

SEQ ID NO: 663651 - DNA, 14 bp, D. melanogaster
ttacttcttcatca

SEQ ID NO: 663652 - DNA, 13 bp, D. melanogaster
ttacttgaatcaa

SEQ ID NO: 663653 - DNA, 13 bp, D. melanogaster
ttacttgcatctg

SEQ ID NO: 663654 - DNA, 13 bp, D. melanogaster
ttactttaaagtt

SEQ ID NO: 663655 - DNA, 13 bp, D. melanogaster
ttactttaaatca

SEQ ID NO: 663656 - DNA, 13 bp, D. melanogaster
ttactttaaattg

SEQ ID NO: 663657 - DNA, 13 bp, D. melanogaster
ttactttaagttt

SEQ ID NO: 663658 - DNA, 13 bp, D. melanogaster
ttactttacggaa

SEQ ID NO: 663659 - DNA, 13 bp, D. melanogaster
ttactttatgatt

SEQ ID NO: 663660 - DNA, 13 bp, D. melanogaster
ttactttcacctt

SEQ ID NO: 663661 - DNA, 13 bp, D. melanogaster
ttactttcattca

SEQ ID NO: 663662 - DNA, 13 bp, D. melanogaster
ttactttccaatt

SEQ ID NO: 663663 - DNA, 13 bp, D. melanogaster
ttactttccttac

SEQ ID NO: 663664 - DNA, 13 bp, D. melanogaster
ttactttctaaaa

SEQ ID NO: 663665 - DNA, 13 bp, D. melanogaster
ttactttgaatat

SEQ ID NO: 663666 - DNA, 14 bp, D. melanogaster
ttactttgaccact

SEQ ID NO: 663667 - DNA, 13 bp, D. melanogaster
ttactttgcaaaa

SEQ ID NO: 663668 - DNA, 13 bp, D. melanogaster
ttactttgcattt

SEQ ID NO: 663669 - DNA, 13 bp, D. melanogaster
ttactttgctttg

SEQ ID NO: 663670 - DNA, 13 bp, D. melanogaster
ttactttggcatt

SEQ ID NO: 663671 - DNA, 13 bp, D. melanogaster
ttactttgtaatt

SEQ ID NO: 663672 - DNA, 13 bp, D. melanogaster
ttacttttaaagg

SEQ ID NO: 663673 - DNA, 13 bp, D. melanogaster
ttacttttaatac

SEQ ID NO: 663674 - DNA, 14 bp, D. melanogaster
ttacttttattcgc

SEQ ID NO: 663675 - DNA, 13 bp, D. melanogaster
ttacttttattgc

SEQ ID NO: 663676 - DNA, 13 bp, D. melanogaster
ttacttttcgatt

SEQ ID NO: 663677 - DNA, 13 bp, D. melanogaster
ttacttttcgcat

SEQ ID NO: 663678 - DNA, 13 bp, D. melanogaster
ttacttttgtgta

SEQ ID NO: 663679 - DNA, 13 bp, D. melanogaster
ttactttttgaaa

SEQ ID NO: 663680 - DNA, 13 bp, D. melanogaster
ttactttttgcct

SEQ ID NO: 663681 - DNA, 14 bp, D. melanogaster
ttagaaaaagcaaa

SEQ ID NO: 663682 - DNA, 13 bp, D. melanogaster
ttagaaaaatcat

SEQ ID NO: 663683 - DNA, 14 bp, D. melanogaster
ttagaaaaatgcca

SEQ ID NO: 663684 - DNA, 14 bp, D. melanogaster
ttagaaaaatgttt

SEQ ID NO: 663685 - DNA, 13 bp, D. melanogaster
ttagaaaacattt

SEQ ID NO: 663686 - DNA, 13 bp, D. melanogaster
ttagaaaaccatt

SEQ ID NO: 663687 - DNA, 13 bp, D. melanogaster
ttagaaaacttaa

SEQ ID NO: 663688 - DNA, 14 bp, D. melanogaster
ttagaaaagaaaca

SEQ ID NO: 663689 - DNA, 14 bp, D. melanogaster
ttagaaaatatatg

SEQ ID NO: 663690 - DNA, 13 bp, D. melanogaster
ttagaaaatctgt

SEQ ID NO: 663691 - DNA, 13 bp, D. melanogaster
ttagaaaatgatt

SEQ ID NO: 663692 - DNA, 13 bp, D. melanogaster
ttagaaagtttaa

SEQ ID NO: 663693 - DNA, 13 bp, D. melanogaster
ttagaaatagtca

SEQ ID NO: 663694 - DNA, 13 bp, D. melanogaster
ttagaaatagttt

SEQ ID NO: 663695 - DNA, 13 bp, D. melanogaster
ttagaaatgaatt

SEQ ID NO: 663696 - DNA, 13 bp, D. melanogaster
ttagaaatgcaaa

SEQ ID NO: 663697 - DNA, 14 bp, D. melanogaster
ttagaaatgtgtat

SEQ ID NO: 663698 - DNA, 13 bp, D. melanogaster
ttagaaattgaag

SEQ ID NO: 663699 - DNA, 13 bp, D. melanogaster
ttagaaattgatt

SEQ ID NO: 663700 - DNA, 14 bp, D. melanogaster
ttagaagctcagag

SEQ ID NO: 663701 - DNA, 13 bp, D. melanogaster
ttagaatccataa

SEQ ID NO: 663702 - DNA, 13 bp, D. melanogaster
ttagaatgcaatt

SEQ ID NO: 663703 - DNA, 14 bp, D. melanogaster
ttagaatgcatact

SEQ ID NO: 663704 - DNA, 13 bp, D. melanogaster
ttagaatgcattt

SEQ ID NO: 663705 - DNA, 14 bp, D. melanogaster
ttagaattagaatt

SEQ ID NO: 663706 - DNA, 13 bp, D. melanogaster
ttagaattcaaaa

SEQ ID NO: 663707 - DNA, 13 bp, D. melanogaster
ttagaatttgaaa

SEQ ID NO: 663708 - DNA, 13 bp, D. melanogaster
ttagaatttggtt

SEQ ID NO: 663709 - DNA, 13 bp, D. melanogaster
ttagacaaatatt

SEQ ID NO: 663710 - DNA, 13 bp, D. melanogaster
ttagactttaaat

SEQ ID NO: 663711 - DNA, 14 bp, D. melanogaster
ttagactttctgaa

SEQ ID NO: 663712 - DNA, 13 bp, D. melanogaster
ttagagattcctc

SEQ ID NO: 663713 - DNA, 13 bp, D. melanogaster
ttagagcatttat

SEQ ID NO: 663714 - DNA, 14 bp, D. melanogaster
ttagagtattcatc

SEQ ID NO: 663715 - DNA, 13 bp, D. melanogaster
ttagagtgtccat

SEQ ID NO: 663716 - DNA, 13 bp, D. melanogaster
ttagagtttcaaa

SEQ ID NO: 663717 - DNA, 14 bp, D. melanogaster
ttagagtttcaaaa

SEQ ID NO: 663718 - DNA, 13 bp, D. melanogaster
ttagatacattta

SEQ ID NO: 663719 - DNA, 13 bp, D. melanogaster
ttagatacccgtt

SEQ ID NO: 663720 - DNA, 13 bp, D. melanogaster
ttagatacgccca

SEQ ID NO: 663721 - DNA, 13 bp, D. melanogaster
ttagatatacata

SEQ ID NO: 663722 - DNA, 13 bp, D. melanogaster
ttagatatagata

SEQ ID NO: 663723 - DNA, 13 bp, D. melanogaster
ttagatatatgta

SEQ ID NO: 663724 - DNA, 14 bp, D. melanogaster
ttagatatgcaaaa

SEQ ID NO: 663725 - DNA, 13 bp, D. melanogaster
ttagatcaattct

SEQ ID NO: 663726 - DNA, 13 bp, D. melanogaster
ttagatcgctact

SEQ ID NO: 663727 - DNA, 13 bp, D. melanogaster
ttagatgtttaag

SEQ ID NO: 663728 - DNA, 13 bp, D. melanogaster
ttagattagattg

SEQ ID NO: 663729 - DNA, 13 bp, D. melanogaster
ttagatttagatt

SEQ ID NO: 663730 - DNA, 13 bp, D. melanogaster
ttagatttcaaat

SEQ ID NO: 663731 - DNA, 13 bp, D. melanogaster
ttagcaaaaacaa

SEQ ID NO: 663732 - DNA, 13 bp, D. melanogaster
ttagcaaaataaa

SEQ ID NO: 663733 - DNA, 13 bp, D. melanogaster
ttagcaaaatgtt

SEQ ID NO: 663734 - DNA, 13 bp, D. melanogaster
ttagcaaaattaa

SEQ ID NO: 663735 - DNA, 13 bp, D. melanogaster
ttagcaaaatttt

SEQ ID NO: 663736 - DNA, 13 bp, D. melanogaster
ttagcaaacaaaa

SEQ ID NO: 663737 - DNA, 13 bp, D. melanogaster
ttagcaaacaatt

SEQ ID NO: 663738 - DNA, 13 bp, D. melanogaster
ttagcaaacccaa

SEQ ID NO: 663739 - DNA, 14 bp, D. melanogaster
ttagcaaacccaat

SEQ ID NO: 663740 - DNA, 13 bp, D. melanogaster
ttagcaaaccctt

SEQ ID NO: 663741 - DNA, 13 bp, D. melanogaster
ttagcaaagcaaa

SEQ ID NO: 663742 - DNA, 13 bp, D. melanogaster
ttagcaaatattg

SEQ ID NO: 663743 - DNA, 13 bp, D. melanogaster
ttagcaaatgcaa

SEQ ID NO: 663744 - DNA, 13 bp, D. melanogaster
ttagcaaattgaa

SEQ ID NO: 663745 - DNA, 14 bp, D. melanogaster
ttagcaacaacaac

SEQ ID NO: 663746 - DNA, 14 bp, D. melanogaster
ttagcaacaacaag

SEQ ID NO: 663747 - DNA, 13 bp, D. melanogaster
ttagcaacatttg

SEQ ID NO: 663748 - DNA, 13 bp, D. melanogaster
ttagcaataaaaa

SEQ ID NO: 663749 - DNA, 13 bp, D. melanogaster
ttagcaatacaca

SEQ ID NO: 663750 - DNA, 13 bp, D. melanogaster
ttagcaatattgt

SEQ ID NO: 663751 - DNA, 13 bp, D. melanogaster
ttagcaatcaatt

SEQ ID NO: 663752 - DNA, 13 bp, D. melanogaster
ttagcaatgaaac

SEQ ID NO: 663753 - DNA, 13 bp, D. melanogaster
ttagcaatgtttt

SEQ ID NO: 663754 - DNA, 13 bp, D. melanogaster
ttagcaatttata

SEQ ID NO: 663755 - DNA, 14 bp, D. melanogaster
ttagcacacacaca

SEQ ID NO: 663756 - DNA, 13 bp, D. melanogaster
ttagcacactttt

SEQ ID NO: 663757 - DNA, 14 bp, D. melanogaster
ttagcagcagcagc

SEQ ID NO: 663758 - DNA, 13 bp, D. melanogaster
ttagcataaaact

SEQ ID NO: 663759 - DNA, 13 bp, D. melanogaster
ttagcatacaaat

SEQ ID NO: 663760 - DNA, 13 bp, D. melanogaster
ttagcatagacta

SEQ ID NO: 663761 - DNA, 13 bp, D. melanogaster
ttagcatataaat

SEQ ID NO: 663762 - DNA, 13 bp, D. melanogaster
ttagcatatatat

SEQ ID NO: 663763 - DNA, 13 bp, D. melanogaster
ttagcatattaat

SEQ ID NO: 663764 - DNA, 13 bp, D. melanogaster
ttagcattaattt

SEQ ID NO: 663765 - DNA, 13 bp, D. melanogaster
ttagcattccaaa

SEQ ID NO: 663766 - DNA, 13 bp, D. melanogaster
ttagcattcggtt

SEQ ID NO: 663767 - DNA, 13 bp, D. melanogaster
ttagcatttaaat

SEQ ID NO: 663768 - DNA, 13 bp, D. melanogaster
ttagcatttaatt

SEQ ID NO: 663769 - DNA, 13 bp, D. melanogaster
ttagcatttagca

SEQ ID NO: 663770 - DNA, 14 bp, D. melanogaster
ttagcattttaatt

SEQ ID NO: 663771 - DNA, 13 bp, D. melanogaster
ttagccaaaaaca

SEQ ID NO: 663772 - DNA, 14 bp, D. melanogaster
ttagccaaaaagtt

SEQ ID NO: 663773 - DNA, 13 bp, D. melanogaster
ttagccaaaaata

SEQ ID NO: 663774 - DNA, 13 bp, D. melanogaster
ttagccaaaagtt

SEQ ID NO: 663775 - DNA, 13 bp, D. melanogaster
ttagccaaaataa

SEQ ID NO: 663776 - DNA, 13 bp, D. melanogaster
ttagccaaataaa

SEQ ID NO: 663777 - DNA, 13 bp, D. melanogaster
ttagccaaatgaa

SEQ ID NO: 663778 - DNA, 13 bp, D. melanogaster
ttagccaaattat

SEQ ID NO: 663779 - DNA, 13 bp, D. melanogaster
ttagccaagcaaa

SEQ ID NO: 663780 - DNA, 13 bp, D. melanogaster
ttagccaaggaaa

SEQ ID NO: 663781 - DNA, 13 bp, D. melanogaster
ttagccaagttaa

SEQ ID NO: 663782 - DNA, 13 bp, D. melanogaster
ttagccaagttat

SEQ ID NO: 663783 - DNA, 13 bp, D. melanogaster
ttagccaagtttt

SEQ ID NO: 663784 - DNA, 13 bp, D. melanogaster
ttagccagcacag

SEQ ID NO: 663785 - DNA, 13 bp, D. melanogaster
ttagccagcattt

SEQ ID NO: 663786 - DNA, 13 bp, D. melanogaster
ttagccagctttt

SEQ ID NO: 663787 - DNA, 13 bp, D. melanogaster
ttagccaggccaa

SEQ ID NO: 663788 - DNA, 13 bp, D. melanogaster
ttagccattgaaa

SEQ ID NO: 663789 - DNA, 14 bp, D. melanogaster
ttagccatttattt

SEQ ID NO: 663790 - DNA, 13 bp, D. melanogaster
ttagccattttgt

SEQ ID NO: 663791 - DNA, 13 bp, D. melanogaster
ttagccgatttgc

SEQ ID NO: 663792 - DNA, 13 bp, D. melanogaster
ttagcctagaact

SEQ ID NO: 663793 - DNA, 13 bp, D. melanogaster
ttagccttaagtt

SEQ ID NO: 663794 - DNA, 13 bp, D. melanogaster
ttagcgatgtaat

SEQ ID NO: 663795 - DNA, 13 bp, D. melanogaster
ttagcgtaagttt

SEQ ID NO: 663796 - DNA, 13 bp, D. melanogaster
ttagctaaaaata

SEQ ID NO: 663797 - DNA, 13 bp, D. melanogaster
ttagctaaacaaa

SEQ ID NO: 663798 - DNA, 13 bp, D. melanogaster
ttagctaatgaaa

SEQ ID NO: 663799 - DNA, 13 bp, D. melanogaster
ttagctaattaat

SEQ ID NO: 663800 - DNA, 13 bp, D. melanogaster
ttagctaatttaa

SEQ ID NO: 663801 - DNA, 13 bp, D. melanogaster
ttagctaccgttt

SEQ ID NO: 663802 - DNA, 13 bp, D. melanogaster
ttagctatagttt

SEQ ID NO: 663803 - DNA, 13 bp, D. melanogaster
ttagctatatata

SEQ ID NO: 663804 - DNA, 13 bp, D. melanogaster
ttagctatttatt

SEQ ID NO: 663805 - DNA, 13 bp, D. melanogaster
ttagctattttta

SEQ ID NO: 663806 - DNA, 13 bp, D. melanogaster
ttagctgaaaaat

SEQ ID NO: 663807 - DNA, 13 bp, D. melanogaster
ttagctgagattt

SEQ ID NO: 663808 - DNA, 13 bp, D. melanogaster
ttagctgcgtttt

SEQ ID NO: 663809 - DNA, 14 bp, D. melanogaster
ttagctgctcaaaa

SEQ ID NO: 663810 - DNA, 13 bp, D. melanogaster
ttagctgctgctg

SEQ ID NO: 663811 - DNA, 13 bp, D. melanogaster
ttagctggaaaaa

SEQ ID NO: 663812 - DNA, 13 bp, D. melanogaster
ttagctggcaaat

SEQ ID NO: 663813 - DNA, 14 bp, D. melanogaster
ttagctgtaagatg

SEQ ID NO: 663814 - DNA, 13 bp, D. melanogaster
ttagcttaaaatt

SEQ ID NO: 663815 - DNA, 13 bp, D. melanogaster
ttagcttaacttt

SEQ ID NO: 663816 - DNA, 13 bp, D. melanogaster
ttagcttaagttc

SEQ ID NO: 663817 - DNA, 14 bp, D. melanogaster
ttagcttcttctac

SEQ ID NO: 663818 - DNA, 13 bp, D. melanogaster
ttagctttaaaaa

SEQ ID NO: 663819 - DNA, 13 bp, D. melanogaster
ttagctttaaagt

SEQ ID NO: 663820 - DNA, 13 bp, D. melanogaster
ttagctttaatga

SEQ ID NO: 663821 - DNA, 13 bp, D. melanogaster
ttagctttagttt

SEQ ID NO: 663822 - DNA, 13 bp, D. melanogaster
ttagctttcattt

SEQ ID NO: 663823 - DNA, 13 bp, D. melanogaster
ttagctttgatta

SEQ ID NO: 663824 - DNA, 13 bp, D. melanogaster
ttagctttggctt

SEQ ID NO: 663825 - DNA, 14 bp, D. melanogaster
ttagcttttatagt

SEQ ID NO: 663826 - DNA, 13 bp, D. melanogaster
ttaggaaaatgaa

SEQ ID NO: 663827 - DNA, 13 bp, D. melanogaster
ttaggaactataa

SEQ ID NO: 663828 - DNA, 13 bp, D. melanogaster
ttaggcaaaacaa

SEQ ID NO: 663829 - DNA, 14 bp, D. melanogaster
ttaggcaaacaaaa

SEQ ID NO: 663830 - DNA, 13 bp, D. melanogaster
ttaggcaaattaa

SEQ ID NO: 663831 - DNA, 13 bp, D. melanogaster
ttaggcaacaaat

SEQ ID NO: 663832 - DNA, 13 bp, D. melanogaster
ttaggccaaatcc

SEQ ID NO: 663833 - DNA, 14 bp, D. melanogaster
ttaggccttcttct

SEQ ID NO: 663834 - DNA, 13 bp, D. melanogaster
ttaggctttaatt

SEQ ID NO: 663835 - DNA, 13 bp, D. melanogaster
ttagggaaattaa

SEQ ID NO: 663836 - DNA, 13 bp, D. melanogaster
ttagggactcttg

SEQ ID NO: 663837 - DNA, 13 bp, D. melanogaster
ttagggctctttt

SEQ ID NO: 663838 - DNA, 13 bp, D. melanogaster
ttaggggaaacaa

SEQ ID NO: 663839 - DNA, 13 bp, D. melanogaster
ttagggtttcgga

SEQ ID NO: 663840 - DNA, 13 bp, D. melanogaster
ttaggtagtgttg

SEQ ID NO: 663841 - DNA, 13 bp, D. melanogaster
ttaggtgatctaa

SEQ ID NO: 663842 - DNA, 13 bp, D. melanogaster
ttagtaaaacaaa

SEQ ID NO: 663843 - DNA, 13 bp, D. melanogaster
ttagtaactatca

SEQ ID NO: 663844 - DNA, 13 bp, D. melanogaster
ttagtaatttagt

SEQ ID NO: 663845 - DNA, 13 bp, D. melanogaster
ttagtacaaagtg

SEQ ID NO: 663846 - DNA, 14 bp, D. melanogaster
ttagtacaaagtga

SEQ ID NO: 663847 - DNA, 13 bp, D. melanogaster
ttagtacattcaa

SEQ ID NO: 663848 - DNA, 13 bp, D. melanogaster
ttagtagaaatat

SEQ ID NO: 663849 - DNA, 14 bp, D. melanogaster
ttagtagaacactt

SEQ ID NO: 663850 - DNA, 13 bp, D. melanogaster
ttagtagtaatag

SEQ ID NO: 663851 - DNA, 13 bp, D. melanogaster
ttagtataacttt

SEQ ID NO: 663852 - DNA, 14 bp, D. melanogaster
ttagtatacccaaa

SEQ ID NO: 663853 - DNA, 13 bp, D. melanogaster
ttagtattttcaa

SEQ ID NO: 663854 - DNA, 13 bp, D. melanogaster
ttagtattttcca

SEQ ID NO: 663855 - DNA, 13 bp, D. melanogaster
ttagtcaaatttt

SEQ ID NO: 663856 - DNA, 13 bp, D. melanogaster
ttagtccaaaatc

SEQ ID NO: 663857 - DNA, 13 bp, D. melanogaster
ttagtcttgtaaa

SEQ ID NO: 663858 - DNA, 14 bp, D. melanogaster
ttagtcttgtaaat

SEQ ID NO: 663859 - DNA, 13 bp, D. melanogaster
ttagtgatacaaa

SEQ ID NO: 663860 - DNA, 14 bp, D. melanogaster
ttagtgatagtttt

SEQ ID NO: 663861 - DNA, 13 bp, D. melanogaster
ttagtgctggtgg

SEQ ID NO: 663862 - DNA, 13 bp, D. melanogaster
ttagtggctttta

SEQ ID NO: 663863 - DNA, 14 bp, D. melanogaster
ttagtgtgtgcgtg

SEQ ID NO: 663864 - DNA, 13 bp, D. melanogaster
ttagttaaacaaa

SEQ ID NO: 663865 - DNA, 13 bp, D. melanogaster
ttagttaaatgaa

SEQ ID NO: 663866 - DNA, 13 bp, D. melanogaster
ttagttaaatgta

SEQ ID NO: 663867 - DNA, 13 bp, D. melanogaster
ttagttaagttaa

SEQ ID NO: 663868 - DNA, 13 bp, D. melanogaster
ttagttaattaac

SEQ ID NO: 663869 - DNA, 13 bp, D. melanogaster
ttagttaattaag

SEQ ID NO: 663870 - DNA, 13 bp, D. melanogaster
ttagttacatttt

SEQ ID NO: 663871 - DNA, 13 bp, D. melanogaster
ttagttactttta

SEQ ID NO: 663872 - DNA, 13 bp, D. melanogaster
ttagttagttaaa

SEQ ID NO: 663873 - DNA, 13 bp, D. melanogaster
ttagttagttaat

SEQ ID NO: 663874 - DNA, 14 bp, D. melanogaster
ttagttagttagtt

SEQ ID NO: 663875 - DNA, 13 bp, D. melanogaster
ttagttagttcat

SEQ ID NO: 663876 - DNA, 14 bp, D. melanogaster
ttagttagttcatt

SEQ ID NO: 663877 - DNA, 13 bp, D. melanogaster
ttagttatcctat

SEQ ID NO: 663878 - DNA, 13 bp, D. melanogaster
ttagttattatca

SEQ ID NO: 663879 - DNA, 13 bp, D. melanogaster
ttagttatttaag

SEQ ID NO: 663880 - DNA, 13 bp, D. melanogaster
ttagttcaattta

SEQ ID NO: 663881 - DNA, 13 bp, D. melanogaster
ttagttcaatttt

SEQ ID NO: 663882 - DNA, 13 bp, D. melanogaster
ttagttcagtttt

SEQ ID NO: 663883 - DNA, 13 bp, D. melanogaster
ttagttcatattc

SEQ ID NO: 663884 - DNA, 13 bp, D. melanogaster
ttagttcatattt

SEQ ID NO: 663885 - DNA, 13 bp, D. melanogaster
ttagttcattatt

SEQ ID NO: 663886 - DNA, 13 bp, D. melanogaster
ttagttcgaacaa

SEQ ID NO: 663887 - DNA, 13 bp, D. melanogaster
ttagttcttaaaa

SEQ ID NO: 663888 - DNA, 13 bp, D. melanogaster
ttagttctttagt

SEQ ID NO: 663889 - DNA, 13 bp, D. melanogaster
ttagttgatttga

SEQ ID NO: 663890 - DNA, 14 bp, D. melanogaster
ttagttgcaaaata

SEQ ID NO: 663891 - DNA, 14 bp, D. melanogaster
ttagttgcattgca

SEQ ID NO: 663892 - DNA, 13 bp, D. melanogaster
ttagttgcatttt

SEQ ID NO: 663893 - DNA, 13 bp, D. melanogaster
ttagttgccattt

SEQ ID NO: 663894 - DNA, 13 bp, D. melanogaster
ttagttggcaaca

SEQ ID NO: 663895 - DNA, 13 bp, D. melanogaster
ttagttgggccgc

SEQ ID NO: 663896 - DNA, 13 bp, D. melanogaster
ttagttgtgcaaa

SEQ ID NO: 663897 - DNA, 13 bp, D. melanogaster
ttagttgttgctg

SEQ ID NO: 663898 - DNA, 13 bp, D. melanogaster
ttagtttaaattg

SEQ ID NO: 663899 - DNA, 13 bp, D. melanogaster
ttagtttaacata

SEQ ID NO: 663900 - DNA, 13 bp, D. melanogaster
ttagtttaattag

SEQ ID NO: 663901 - DNA, 13 bp, D. melanogaster
ttagtttaattgc

SEQ ID NO: 663902 - DNA, 13 bp, D. melanogaster
ttagtttacttaa

SEQ ID NO: 663903 - DNA, 13 bp, D. melanogaster
ttagtttagttaa

SEQ ID NO: 663904 - DNA, 13 bp, D. melanogaster
ttagtttagttag

SEQ ID NO: 663905 - DNA, 13 bp, D. melanogaster
ttagtttagttca

SEQ ID NO: 663906 - DNA, 13 bp, D. melanogaster
ttagtttcaaaaa

SEQ ID NO: 663907 - DNA, 13 bp, D. melanogaster
ttagtttcaataa

SEQ ID NO: 663908 - DNA, 13 bp, D. melanogaster
ttagtttcagttt

SEQ ID NO: 663909 - DNA, 13 bp, D. melanogaster
ttagtttccaatt

SEQ ID NO: 663910 - DNA, 13 bp, D. melanogaster
ttagtttccattt

SEQ ID NO: 663911 - DNA, 13 bp, D. melanogaster
ttagtttccttta

SEQ ID NO: 663912 - DNA, 13 bp, D. melanogaster
ttagtttgaataa

SEQ ID NO: 663913 - DNA, 13 bp, D. melanogaster
ttagtttgctttc

SEQ ID NO: 663914 - DNA, 13 bp, D. melanogaster
ttagtttggataa

SEQ ID NO: 663915 - DNA, 13 bp, D. melanogaster
ttagttttaaaag

SEQ ID NO: 663916 - DNA, 14 bp, D. melanogaster
ttagttttaaaagg

SEQ ID NO: 663917 - DNA, 13 bp, D. melanogaster
ttagttttaaagt

SEQ ID NO: 663918 - DNA, 13 bp, D. melanogaster
ttagttttaagag

SEQ ID NO: 663919 - DNA, 13 bp, D. melanogaster
ttagttttataca

SEQ ID NO: 663920 - DNA, 13 bp, D. melanogaster
ttagttttcaaac

SEQ ID NO: 663921 - DNA, 13 bp, D. melanogaster
ttagttttcatta

SEQ ID NO: 663922 - DNA, 14 bp, D. melanogaster
ttagttttgcattt

SEQ ID NO: 663923 - DNA, 13 bp, D. melanogaster
ttagttttggctt

SEQ ID NO: 663924 - DNA, 13 bp, D. melanogaster
ttagttttgtaaa

SEQ ID NO: 663925 - DNA, 13 bp, D. melanogaster
ttagtttttaaag

SEQ ID NO: 663926 - DNA, 13 bp, D. melanogaster
ttagtttttacaa

SEQ ID NO: 663927 - DNA, 14 bp, D. melanogaster
ttagtttttacaaa

SEQ ID NO: 663928 - DNA, 14 bp, D. melanogaster
ttagtttttatcgt

SEQ ID NO: 663929 - DNA, 13 bp, D. melanogaster
ttagtttttgcat

SEQ ID NO: 663930 - DNA, 13 bp, D. melanogaster
ttagtttttggca

SEQ ID NO: 663931 - DNA, 13 bp, D. melanogaster
ttataaaaaatgc

SEQ ID NO: 663932 - DNA, 13 bp, D. melanogaster
ttataaaaaccat

SEQ ID NO: 663933 - DNA, 13 bp, D. melanogaster
ttataaaaagtca

SEQ ID NO: 663934 - DNA, 13 bp, D. melanogaster
ttataaaacagtt

SEQ ID NO: 663935 - DNA, 13 bp, D. melanogaster
ttataaaacgaaa

SEQ ID NO: 663936 - DNA, 13 bp, D. melanogaster
ttataaaactgtt

SEQ ID NO: 663937 - DNA, 13 bp, D. melanogaster
ttataaaagcaaa

SEQ ID NO: 663938 - DNA, 13 bp, D. melanogaster
ttataaaagcatt

SEQ ID NO: 663939 - DNA, 13 bp, D. melanogaster
ttataaaatcaac

SEQ ID NO: 663940 - DNA, 13 bp, D. melanogaster
ttataaaatccat

SEQ ID NO: 663941 - DNA, 13 bp, D. melanogaster
ttataaaatggaa

SEQ ID NO: 663942 - DNA, 13 bp, D. melanogaster
ttataaaatggtt

SEQ ID NO: 663943 - DNA, 13 bp, D. melanogaster
ttataaaatgttc

SEQ ID NO: 663944 - DNA, 14 bp, D. melanogaster
ttataaacaaattg

SEQ ID NO: 663945 - DNA, 13 bp, D. melanogaster
ttataaacaatgt

SEQ ID NO: 663946 - DNA, 13 bp, D. melanogaster
ttataaacacaca

SEQ ID NO: 663947 - DNA, 13 bp, D. melanogaster
ttataaacattga

SEQ ID NO: 663948 - DNA, 13 bp, D. melanogaster
ttataaaccattt

SEQ ID NO: 663949 - DNA, 13 bp, D. melanogaster
ttataaagaactt

SEQ ID NO: 663950 - DNA, 13 bp, D. melanogaster
ttataaagtgcaa

SEQ ID NO: 663951 - DNA, 13 bp, D. melanogaster
ttataaataaagc

SEQ ID NO: 663952 - DNA, 13 bp, D. melanogaster
ttataaatacaac

SEQ ID NO: 663953 - DNA, 13 bp, D. melanogaster
ttataaatagttg

SEQ ID NO: 663954 - DNA, 13 bp, D. melanogaster
ttataaatatgca

SEQ ID NO: 663955 - DNA, 13 bp, D. melanogaster
ttataaatattcc

SEQ ID NO: 663956 - DNA, 13 bp, D. melanogaster
ttataaatattgc

SEQ ID NO: 663957 - DNA, 14 bp, D. melanogaster
ttataaatattgcc

SEQ ID NO: 663958 - DNA, 13 bp, D. melanogaster
ttataaatccttt

SEQ ID NO: 663959 - DNA, 13 bp, D. melanogaster
ttataaatgacaa

SEQ ID NO: 663960 - DNA, 13 bp, D. melanogaster
ttataaatgcatt

SEQ ID NO: 663961 - DNA, 13 bp, D. melanogaster
ttataaatgtaca

SEQ ID NO: 663962 - DNA, 13 bp, D. melanogaster
ttataaattgtgt

SEQ ID NO: 663963 - DNA, 13 bp, D. melanogaster
ttataaatttcga

SEQ ID NO: 663964 - DNA, 13 bp, D. melanogaster
ttataacagtagt

SEQ ID NO: 663965 - DNA, 13 bp, D. melanogaster
ttataaccatttt

SEQ ID NO: 663966 - DNA, 13 bp, D. melanogaster
ttataacgatttt

SEQ ID NO: 663967 - DNA, 13 bp, D. melanogaster
ttataactccatt

SEQ ID NO: 663968 - DNA, 13 bp, D. melanogaster
ttataactgatct

SEQ ID NO: 663969 - DNA, 13 bp, D. melanogaster
ttataacttttgt

SEQ ID NO: 663970 - DNA, 13 bp, D. melanogaster
ttataagaaaact

SEQ ID NO: 663971 - DNA, 13 bp, D. melanogaster
ttataagcatttt

SEQ ID NO: 663972 - DNA, 13 bp, D. melanogaster
ttataagcctgat

SEQ ID NO: 663973 - DNA, 13 bp, D. melanogaster
ttataagctagca

SEQ ID NO: 663974 - DNA, 13 bp, D. melanogaster
ttataagtaaaca

SEQ ID NO: 663975 - DNA, 13 bp, D. melanogaster
ttataagtgaatt

SEQ ID NO: 663976 - DNA, 13 bp, D. melanogaster
ttataagtgttat

SEQ ID NO: 663977 - DNA, 13 bp, D. melanogaster
ttataataaaagc

SEQ ID NO: 663978 - DNA, 13 bp, D. melanogaster
ttataatattcag

SEQ ID NO: 663979 - DNA, 13 bp, D. melanogaster
ttataatatttcc

SEQ ID NO: 663980 - DNA, 13 bp, D. melanogaster
ttataatctgtat

SEQ ID NO: 663981 - DNA, 13 bp, D. melanogaster
ttataatgatgat

SEQ ID NO: 663982 - DNA, 13 bp, D. melanogaster
ttataatgcaaat

SEQ ID NO: 663983 - DNA, 13 bp, D. melanogaster
ttataatgcctac

SEQ ID NO: 663984 - DNA, 13 bp, D. melanogaster
ttataatgcgaat

SEQ ID NO: 663985 - DNA, 13 bp, D. melanogaster
ttataatggaaac

SEQ ID NO: 663986 - DNA, 14 bp, D. melanogaster
ttataatggaaaca

SEQ ID NO: 663987 - DNA, 13 bp, D. melanogaster
ttataattcccaa

SEQ ID NO: 663988 - DNA, 14 bp, D. melanogaster
ttataattgctttt

SEQ ID NO: 663989 - DNA, 13 bp, D. melanogaster
ttataattggatt

SEQ ID NO: 663990 - DNA, 13 bp, D. melanogaster
ttataatttctgt

SEQ ID NO: 663991 - DNA, 13 bp, D. melanogaster
ttataatttgcat

SEQ ID NO: 663992 - DNA, 13 bp, D. melanogaster
ttataattttgag

SEQ ID NO: 663993 - DNA, 13 bp, D. melanogaster
ttatacaaaatac

SEQ ID NO: 663994 - DNA, 13 bp, D. melanogaster
ttatacaaaattc

SEQ ID NO: 663995 - DNA, 13 bp, D. melanogaster
ttatacaaagcta

SEQ ID NO: 663996 - DNA, 13 bp, D. melanogaster
ttatacaaagtat

SEQ ID NO: 663997 - DNA, 13 bp, D. melanogaster
ttatacaaatcaa

SEQ ID NO: 663998 - DNA, 13 bp, D. melanogaster
ttatacaaatttg

SEQ ID NO: 663999 - DNA, 13 bp, D. melanogaster
ttatacaacaaat

SEQ ID NO: 664000 - DNA, 13 bp, D. melanogaster
ttatacacaatct

SEQ ID NO: 664001 - DNA, 14 bp, D. melanogaster
ttatacacacacac

SEQ ID NO: 664002 - DNA, 13 bp, D. melanogaster
ttatacacataca

SEQ ID NO: 664003 - DNA, 13 bp, D. melanogaster
ttatacacatata

SEQ ID NO: 664004 - DNA, 14 bp, D. melanogaster
ttatacacatatat

SEQ ID NO: 664005 - DNA, 13 bp, D. melanogaster
ttatacacatatg

SEQ ID NO: 664006 - DNA, 14 bp, D. melanogaster
ttatacaccctgta

SEQ ID NO: 664007 - DNA, 13 bp, D. melanogaster
ttatacagaaaat

SEQ ID NO: 664008 - DNA, 13 bp, D. melanogaster
ttatacatacata

SEQ ID NO: 664009 - DNA, 16 bp, D. melanogaster
ttatacatacatatat

SEQ ID NO: 664010 - DNA, 14 bp, D. melanogaster
ttatacatatatgt

SEQ ID NO: 664011 - DNA, 13 bp, D. melanogaster
ttatacatatgtg

SEQ ID NO: 664012 - DNA, 13 bp, D. melanogaster
ttatacccaatca

SEQ ID NO: 664013 - DNA, 13 bp, D. melanogaster
ttataccccattt

SEQ ID NO: 664014 - DNA, 14 bp, D. melanogaster
ttatacccgttact

SEQ ID NO: 664015 - DNA, 13 bp, D. melanogaster
ttataccctttac

SEQ ID NO: 664016 - DNA, 13 bp, D. melanogaster
ttatacgaacaca

SEQ ID NO: 664017 - DNA, 13 bp, D. melanogaster
ttatacgaatttt

SEQ ID NO: 664018 - DNA, 14 bp, D. melanogaster
ttatacggacggac

SEQ ID NO: 664019 - DNA, 13 bp, D. melanogaster
ttatacgtatgta

SEQ ID NO: 664020 - DNA, 13 bp, D. melanogaster
ttatactattaac

SEQ ID NO: 664021 - DNA, 13 bp, D. melanogaster
ttatacttatact

SEQ ID NO: 664022 - DNA, 14 bp, D. melanogaster
ttatactttgtggc

SEQ ID NO: 664023 - DNA, 13 bp, D. melanogaster
ttatagaagtcct

SEQ ID NO: 664024 - DNA, 13 bp, D. melanogaster
ttatagatacaat

SEQ ID NO: 664025 - DNA, 13 bp, D. melanogaster
ttatagcaaaaat

SEQ ID NO: 664026 - DNA, 14 bp, D. melanogaster
ttatagcatacttt

SEQ ID NO: 664027 - DNA, 13 bp, D. melanogaster
ttatagccaaaaa

SEQ ID NO: 664028 - DNA, 14 bp, D. melanogaster
ttatagccaaaaaa

SEQ ID NO: 664029 - DNA, 13 bp, D. melanogaster
ttatagccaatta

SEQ ID NO: 664030 - DNA, 13 bp, D. melanogaster
ttatagcttatat

SEQ ID NO: 664031 - DNA, 13 bp, D. melanogaster
ttataggatatct

SEQ ID NO: 664032 - DNA, 13 bp, D. melanogaster
ttataggattttc

SEQ ID NO: 664033 - DNA, 13 bp, D. melanogaster
ttatagtgaatct

SEQ ID NO: 664034 - DNA, 13 bp, D. melanogaster
ttatagtgacaaa

SEQ ID NO: 664035 - DNA, 13 bp, D. melanogaster
ttatagtgacaat

SEQ ID NO: 664036 - DNA, 13 bp, D. melanogaster
ttatagttatagt

SEQ ID NO: 664037 - DNA, 13 bp, D. melanogaster
ttatagtttatac

SEQ ID NO: 664038 - DNA, 13 bp, D. melanogaster
ttatataaagtca

SEQ ID NO: 664039 - DNA, 13 bp, D. melanogaster
ttatataaatgca

SEQ ID NO: 664040 - DNA, 13 bp, D. melanogaster
ttatataagagaa

SEQ ID NO: 664041 - DNA, 13 bp, D. melanogaster
ttatataagcata

SEQ ID NO: 664042 - DNA, 13 bp, D. melanogaster
ttatatacacaca

SEQ ID NO: 664043 - DNA, 13 bp, D. melanogaster
ttatatacatttg

SEQ ID NO: 664044 - DNA, 13 bp, D. melanogaster
ttatatacgtata

SEQ ID NO: 664045 - DNA, 13 bp, D. melanogaster
ttatatagagagc

SEQ ID NO: 664046 - DNA, 13 bp, D. melanogaster
ttatatagcatat

SEQ ID NO: 664047 - DNA, 13 bp, D. melanogaster
ttatataggagaa

SEQ ID NO: 664048 - DNA, 13 bp, D. melanogaster
ttatatagggtat

SEQ ID NO: 664049 - DNA, 14 bp, D. melanogaster
ttatatagggtatg

SEQ ID NO: 664050 - DNA, 13 bp, D. melanogaster
ttatatagtcgga

SEQ ID NO: 664051 - DNA, 13 bp, D. melanogaster
ttatatatacgtt

SEQ ID NO: 664052 - DNA, 13 bp, D. melanogaster
ttatatatatgct

SEQ ID NO: 664053 - DNA, 14 bp, D. melanogaster
ttatatatatgtag

SEQ ID NO: 664054 - DNA, 13 bp, D. melanogaster
ttatatatcgatg

SEQ ID NO: 664055 - DNA, 14 bp, D. melanogaster
ttatatatgtacat

SEQ ID NO: 664056 - DNA, 13 bp, D. melanogaster
ttatatattccaa

SEQ ID NO: 664057 - DNA, 13 bp, D. melanogaster
ttatatcacattt

SEQ ID NO: 664058 - DNA, 13 bp, D. melanogaster
ttatatcagtttt

SEQ ID NO: 664059 - DNA, 13 bp, D. melanogaster
ttatatctacata

SEQ ID NO: 664060 - DNA, 13 bp, D. melanogaster
ttatatctgggat

SEQ ID NO: 664061 - DNA, 13 bp, D. melanogaster
ttatatgaaagct

SEQ ID NO: 664062 - DNA, 13 bp, D. melanogaster
ttatatgcaaaca

SEQ ID NO: 664063 - DNA, 13 bp, D. melanogaster
ttatatgcaaatg

SEQ ID NO: 664064 - DNA, 13 bp, D. melanogaster
ttatatgcaatat

SEQ ID NO: 664065 - DNA, 13 bp, D. melanogaster
ttatatgcataaa

SEQ ID NO: 664066 - DNA, 14 bp, D. melanogaster
ttatatgcatatat

SEQ ID NO: 664067 - DNA, 13 bp, D. melanogaster
ttatatggatatt

SEQ ID NO: 664068 - DNA, 13 bp, D. melanogaster
ttatatggccaaa

SEQ ID NO: 664069 - DNA, 14 bp, D. melanogaster
ttatatggccaaac

SEQ ID NO: 664070 - DNA, 13 bp, D. melanogaster
ttatatggtcgaa

SEQ ID NO: 664071 - DNA, 13 bp, D. melanogaster
ttatatggtcgga

SEQ ID NO: 664072 - DNA, 13 bp, D. melanogaster
ttatatgtaaatg

SEQ ID NO: 664073 - DNA, 13 bp, D. melanogaster
ttatatgtacata

SEQ ID NO: 664074 - DNA, 15 bp, D. melanogaster
ttatatgtatatgta

SEQ ID NO: 664075 - DNA, 13 bp, D. melanogaster
ttatatgtatgca

SEQ ID NO: 664076 - DNA, 14 bp, D. melanogaster
ttatatgtatgtac

SEQ ID NO: 664077 - DNA, 14 bp, D. melanogaster
ttatatgtggactt

SEQ ID NO: 664078 - DNA, 14 bp, D. melanogaster
ttatatgtgtgtgt

SEQ ID NO: 664079 - DNA, 14 bp, D. melanogaster
ttatattaacatga

SEQ ID NO: 664080 - DNA, 13 bp, D. melanogaster
ttatattataacc

SEQ ID NO: 664081 - DNA, 13 bp, D. melanogaster
ttatattattgca

SEQ ID NO: 664082 - DNA, 13 bp, D. melanogaster
ttatattatttgc

SEQ ID NO: 664083 - DNA, 13 bp, D. melanogaster
ttatattcaagat

SEQ ID NO: 664084 - DNA, 13 bp, D. melanogaster
ttatattcacatt

SEQ ID NO: 664085 - DNA, 13 bp, D. melanogaster
ttatattcagaca

SEQ ID NO: 664086 - DNA, 14 bp, D. melanogaster
ttatattcagacat

SEQ ID NO: 664087 - DNA, 13 bp, D. melanogaster
ttatattcctcta

SEQ ID NO: 664088 - DNA, 13 bp, D. melanogaster
ttatattcctttg

SEQ ID NO: 664089 - DNA, 14 bp, D. melanogaster
ttatattcttcttg

SEQ ID NO: 664090 - DNA, 13 bp, D. melanogaster
ttatattgcttat

SEQ ID NO: 664091 - DNA, 13 bp, D. melanogaster
ttatattgtacat

SEQ ID NO: 664092 - DNA, 13 bp, D. melanogaster
ttatattgtggta

SEQ ID NO: 664093 - DNA, 13 bp, D. melanogaster
ttatatttaacag

SEQ ID NO: 664094 - DNA, 13 bp, D. melanogaster
ttatatttagctt

SEQ ID NO: 664095 - DNA, 13 bp, D. melanogaster
ttatatttatgga

SEQ ID NO: 664096 - DNA, 14 bp, D. melanogaster
ttatatttatgttc

SEQ ID NO: 664097 - DNA, 14 bp, D. melanogaster
ttatatttcaaatg

SEQ ID NO: 664098 - DNA, 13 bp, D. melanogaster
ttatatttcacat

SEQ ID NO: 664099 - DNA, 13 bp, D. melanogaster
ttatatttccaat

SEQ ID NO: 664100 - DNA, 13 bp, D. melanogaster
ttatatttgactt

SEQ ID NO: 664101 - DNA, 13 bp, D. melanogaster
ttatatttggaat

SEQ ID NO: 664102 - DNA, 14 bp, D. melanogaster
ttatattttcacaa

SEQ ID NO: 664103 - DNA, 13 bp, D. melanogaster
ttatattttccca

SEQ ID NO: 664104 - DNA, 13 bp, D. melanogaster
ttatattttcggt

SEQ ID NO: 664105 - DNA, 13 bp, D. melanogaster
ttatattttgaag

SEQ ID NO: 664106 - DNA, 13 bp, D. melanogaster
ttatattttgcca

SEQ ID NO: 664107 - DNA, 13 bp, D. melanogaster
ttatattttgtac

SEQ ID NO: 664108 - DNA, 13 bp, D. melanogaster
ttatatttttggc

SEQ ID NO: 664109 - DNA, 13 bp, D. melanogaster
ttatcaaaaagaa

SEQ ID NO: 664110 - DNA, 13 bp, D. melanogaster
ttatcaaaaagtt

SEQ ID NO: 664111 - DNA, 13 bp, D. melanogaster
ttatcaaaactaa

SEQ ID NO: 664112 - DNA, 13 bp, D. melanogaster
ttatcaaaacttt

SEQ ID NO: 664113 - DNA, 13 bp, D. melanogaster
ttatcaaaagcaa

SEQ ID NO: 664114 - DNA, 13 bp, D. melanogaster
ttatcaaaatgca

SEQ ID NO: 664115 - DNA, 15 bp, D. melanogaster
ttatcaaaatttgtt

SEQ ID NO: 664116 - DNA, 13 bp, D. melanogaster
ttatcaaacattt

SEQ ID NO: 664117 - DNA, 13 bp, D. melanogaster
ttatcaaagcaac

SEQ ID NO: 664118 - DNA, 13 bp, D. melanogaster
ttatcaaatcaaa

SEQ ID NO: 664119 - DNA, 13 bp, D. melanogaster
ttatcaaatgaaa

SEQ ID NO: 664120 - DNA, 13 bp, D. melanogaster
ttatcaaatgatt

SEQ ID NO: 664121 - DNA, 13 bp, D. melanogaster
ttatcaaatgctg

SEQ ID NO: 664122 - DNA, 13 bp, D. melanogaster
ttatcaaattgtt

SEQ ID NO: 664123 - DNA, 13 bp, D. melanogaster
ttatcaaatttgt

SEQ ID NO: 664124 - DNA, 13 bp, D. melanogaster
ttatcaacaaaat

SEQ ID NO: 664125 - DNA, 13 bp, D. melanogaster
ttatcaacaaaca

SEQ ID NO: 664126 - DNA, 13 bp, D. melanogaster
ttatcaacaacaa

SEQ ID NO: 664127 - DNA, 13 bp, D. melanogaster
ttatcaacaataa

SEQ ID NO: 664128 - DNA, 13 bp, D. melanogaster
ttatcaacaattt

SEQ ID NO: 664129 - DNA, 13 bp, D. melanogaster
ttatcaagaaata

SEQ ID NO: 664130 - DNA, 14 bp, D. melanogaster
ttatcaagaaatac

SEQ ID NO: 664131 - DNA, 13 bp, D. melanogaster
ttatcaatacctt

SEQ ID NO: 664132 - DNA, 13 bp, D. melanogaster
ttatcaatgaaat

SEQ ID NO: 664133 - DNA, 13 bp, D. melanogaster
ttatcaattatca

SEQ ID NO: 664134 - DNA, 13 bp, D. melanogaster
ttatcaattccaa

SEQ ID NO: 664135 - DNA, 13 bp, D. melanogaster
ttatcaatttgct

SEQ ID NO: 664136 - DNA, 13 bp, D. melanogaster
ttatcaatttgta

SEQ ID NO: 664137 - DNA, 13 bp, D. melanogaster
ttatcacaagcag

SEQ ID NO: 664138 - DNA, 13 bp, D. melanogaster
ttatcacgcagca

SEQ ID NO: 664139 - DNA, 13 bp, D. melanogaster
ttatcactcctca

SEQ ID NO: 664140 - DNA, 13 bp, D. melanogaster
ttatcagaattcg

SEQ ID NO: 664141 - DNA, 13 bp, D. melanogaster
ttatcagaattta

SEQ ID NO: 664142 - DNA, 13 bp, D. melanogaster
ttatcagcaaaaa

SEQ ID NO: 664143 - DNA, 13 bp, D. melanogaster
ttatcagcaattt

SEQ ID NO: 664144 - DNA, 13 bp, D. melanogaster
ttatcagctaatt

SEQ ID NO: 664145 - DNA, 13 bp, D. melanogaster
ttatcagtatctt

SEQ ID NO: 664146 - DNA, 13 bp, D. melanogaster
ttatcatatttgt

SEQ ID NO: 664147 - DNA, 13 bp, D. melanogaster
ttatcatcatcgt

SEQ ID NO: 664148 - DNA, 13 bp, D. melanogaster
ttatcatcattat

SEQ ID NO: 664149 - DNA, 13 bp, D. melanogaster
ttatcattatcat

SEQ ID NO: 664150 - DNA, 13 bp, D. melanogaster
ttatcattctctc

SEQ ID NO: 664151 - DNA, 13 bp, D. melanogaster
ttatcattgttat

SEQ ID NO: 664152 - DNA, 13 bp, D. melanogaster
ttatcatttatca

SEQ ID NO: 664153 - DNA, 13 bp, D. melanogaster
ttatcatttcaat

SEQ ID NO: 664154 - DNA, 13 bp, D. melanogaster
ttatcatttgaaa

SEQ ID NO: 664155 - DNA, 13 bp, D. melanogaster
ttatcatttgaat

SEQ ID NO: 664156 - DNA, 13 bp, D. melanogaster
ttatcattttatg

SEQ ID NO: 664157 - DNA, 13 bp, D. melanogaster
ttatccaaaaaat

SEQ ID NO: 664158 - DNA, 14 bp, D. melanogaster
ttatccaaaaaatg

SEQ ID NO: 664159 - DNA, 13 bp, D. melanogaster
ttatccaaaatat

SEQ ID NO: 664160 - DNA, 13 bp, D. melanogaster
ttatccaaaattt

SEQ ID NO: 664161 - DNA, 13 bp, D. melanogaster
ttatccaaacaca

SEQ ID NO: 664162 - DNA, 13 bp, D. melanogaster
ttatccaacatca

SEQ ID NO: 664163 - DNA, 13 bp, D. melanogaster
ttatccaataata

SEQ ID NO: 664164 - DNA, 13 bp, D. melanogaster
ttatccaattaaa

SEQ ID NO: 664165 - DNA, 13 bp, D. melanogaster
ttatccagaaaat

SEQ ID NO: 664166 - DNA, 13 bp, D. melanogaster
ttatccagtttgg

SEQ ID NO: 664167 - DNA, 13 bp, D. melanogaster
ttatccattaatt

SEQ ID NO: 664168 - DNA, 13 bp, D. melanogaster
ttatccgaaacca

SEQ ID NO: 664169 - DNA, 13 bp, D. melanogaster
ttatcgaaataac

SEQ ID NO: 664170 - DNA, 13 bp, D. melanogaster
ttatcgaaataat

SEQ ID NO: 664171 - DNA, 13 bp, D. melanogaster
ttatcgaaattat

SEQ ID NO: 664172 - DNA, 13 bp, D. melanogaster
ttatcgacaatca

SEQ ID NO: 664173 - DNA, 13 bp, D. melanogaster
ttatcgataacaa

SEQ ID NO: 664174 - DNA, 13 bp, D. melanogaster
ttatcgatagttt

SEQ ID NO: 664175 - DNA, 14 bp, D. melanogaster
ttatcgattataga

SEQ ID NO: 664176 - DNA, 13 bp, D. melanogaster
ttatcgatttgca

SEQ ID NO: 664177 - DNA, 13 bp, D. melanogaster
ttatcgcaaattt

SEQ ID NO: 664178 - DNA, 13 bp, D. melanogaster
ttatcgcacccat

SEQ ID NO: 664179 - DNA, 13 bp, D. melanogaster
ttatcgcatttta

SEQ ID NO: 664180 - DNA, 15 bp, D. melanogaster
ttatcgctctcgatt

SEQ ID NO: 664181 - DNA, 13 bp, D. melanogaster
ttatcgctgcaga

SEQ ID NO: 664182 - DNA, 13 bp, D. melanogaster
ttatcgctgcatc

SEQ ID NO: 664183 - DNA, 13 bp, D. melanogaster
ttatcgctggttt

SEQ ID NO: 664184 - DNA, 13 bp, D. melanogaster
ttatcgtcgatga

SEQ ID NO: 664185 - DNA, 13 bp, D. melanogaster
ttatcgttgcctt

SEQ ID NO: 664186 - DNA, 13 bp, D. melanogaster
ttatcgttgttgt

SEQ ID NO: 664187 - DNA, 14 bp, D. melanogaster
ttatcgtttgccca

SEQ ID NO: 664188 - DNA, 13 bp, D. melanogaster
ttatctaacaaat

SEQ ID NO: 664189 - DNA, 13 bp, D. melanogaster
ttatctacattaa

SEQ ID NO: 664190 - DNA, 13 bp, D. melanogaster
ttatctagtgaat

SEQ ID NO: 664191 - DNA, 13 bp, D. melanogaster
ttatctattgaaa

SEQ ID NO: 664192 - DNA, 13 bp, D. melanogaster
ttatctcacaaac

SEQ ID NO: 664193 - DNA, 13 bp, D. melanogaster
ttatctctaaagc

SEQ ID NO: 664194 - DNA, 13 bp, D. melanogaster
ttatctctggaat

SEQ ID NO: 664195 - DNA, 13 bp, D. melanogaster
ttatctgaattaa

SEQ ID NO: 664196 - DNA, 13 bp, D. melanogaster
ttatctgagtgag

SEQ ID NO: 664197 - DNA, 13 bp, D. melanogaster
ttatctgcaagtt

SEQ ID NO: 664198 - DNA, 13 bp, D. melanogaster
ttatctggcttta

SEQ ID NO: 664199 - DNA, 13 bp, D. melanogaster
ttatctgtaatct

SEQ ID NO: 664200 - DNA, 13 bp, D. melanogaster
ttatctgtgtgtt

SEQ ID NO: 664201 - DNA, 13 bp, D. melanogaster
ttatcttagcttt

SEQ ID NO: 664202 - DNA, 13 bp, D. melanogaster
ttatcttatcagc

SEQ ID NO: 664203 - DNA, 13 bp, D. melanogaster
ttatcttatcgcc

SEQ ID NO: 664204 - DNA, 13 bp, D. melanogaster
ttatcttatcgct

SEQ ID NO: 664205 - DNA, 13 bp, D. melanogaster
ttatctttaagtt

SEQ ID NO: 664206 - DNA, 13 bp, D. melanogaster
ttatctttatgaa

SEQ ID NO: 664207 - DNA, 13 bp, D. melanogaster
ttatctttcgctg

SEQ ID NO: 664208 - DNA, 13 bp, D. melanogaster
ttatctttgaaat

SEQ ID NO: 664209 - DNA, 13 bp, D. melanogaster
ttatgaaaaacca

SEQ ID NO: 664210 - DNA, 13 bp, D. melanogaster
ttatgaaaacata

SEQ ID NO: 664211 - DNA, 13 bp, D. melanogaster
ttatgaaaacttt

SEQ ID NO: 664212 - DNA, 13 bp, D. melanogaster
ttatgaaaagttt

SEQ ID NO: 664213 - DNA, 13 bp, D. melanogaster
ttatgaaaatgca

SEQ ID NO: 664214 - DNA, 13 bp, D. melanogaster
ttatgaaacaatt

SEQ ID NO: 664215 - DNA, 13 bp, D. melanogaster
ttatgaaaccaaa

SEQ ID NO: 664216 - DNA, 13 bp, D. melanogaster
ttatgaaagaggt

SEQ ID NO: 664217 - DNA, 13 bp, D. melanogaster
ttatgaaatcaaa

SEQ ID NO: 664218 - DNA, 13 bp, D. melanogaster
ttatgaaatctat

SEQ ID NO: 664219 - DNA, 13 bp, D. melanogaster
ttatgaaattagt

SEQ ID NO: 664220 - DNA, 13 bp, D. melanogaster
ttatgaaattgta

SEQ ID NO: 664221 - DNA, 13 bp, D. melanogaster
ttatgaaattgtt

SEQ ID NO: 664222 - DNA, 13 bp, D. melanogaster
ttatgaaattttc

SEQ ID NO: 664223 - DNA, 14 bp, D. melanogaster
ttatgaaattttca

SEQ ID NO: 664224 - DNA, 13 bp, D. melanogaster
ttatgaacgaaaa

SEQ ID NO: 664225 - DNA, 13 bp, D. melanogaster
ttatgaacgcgat

SEQ ID NO: 664226 - DNA, 13 bp, D. melanogaster
ttatgaacttttt

SEQ ID NO: 664227 - DNA, 13 bp, D. melanogaster
ttatgaagaggaa

SEQ ID NO: 664228 - DNA, 13 bp, D. melanogaster
ttatgaatatttg

SEQ ID NO: 664229 - DNA, 13 bp, D. melanogaster
ttatgaatcattt

SEQ ID NO: 664230 - DNA, 13 bp, D. melanogaster
ttatgaatgaaaa

SEQ ID NO: 664231 - DNA, 14 bp, D. melanogaster
ttatgaatgaaaat

SEQ ID NO: 664232 - DNA, 13 bp, D. melanogaster
ttatgaatgaaac

SEQ ID NO: 664233 - DNA, 13 bp, D. melanogaster
ttatgaatggaaa

SEQ ID NO: 664234 - DNA, 13 bp, D. melanogaster
ttatgaatgtatt

SEQ ID NO: 664235 - DNA, 13 bp, D. melanogaster
ttatgaattattg

SEQ ID NO: 664236 - DNA, 13 bp, D. melanogaster
ttatgaattcaaa

SEQ ID NO: 664237 - DNA, 13 bp, D. melanogaster
ttatgacaaagtg

SEQ ID NO: 664238 - DNA, 13 bp, D. melanogaster
ttatgacaattta

SEQ ID NO: 664239 - DNA, 13 bp, D. melanogaster
ttatgacacacac

SEQ ID NO: 664240 - DNA, 13 bp, D. melanogaster
ttatgacattcat

SEQ ID NO: 664241 - DNA, 13 bp, D. melanogaster
ttatgacattttc

SEQ ID NO: 664242 - DNA, 13 bp, D. melanogaster
ttatgacattttt

SEQ ID NO: 664243 - DNA, 13 bp, D. melanogaster
ttatgaccaaaat

SEQ ID NO: 664244 - DNA, 13 bp, D. melanogaster
ttatgacgaaaat

SEQ ID NO: 664245 - DNA, 13 bp, D. melanogaster
ttatgacttatat

SEQ ID NO: 664246 - DNA, 13 bp, D. melanogaster
ttatgagcattta

SEQ ID NO: 664247 - DNA, 13 bp, D. melanogaster
ttatgagcggagt

SEQ ID NO: 664248 - DNA, 14 bp, D. melanogaster
ttatgagctgattt

SEQ ID NO: 664249 - DNA, 13 bp, D. melanogaster
ttatgatattatg

SEQ ID NO: 664250 - DNA, 13 bp, D. melanogaster
ttatgatcaaaat

SEQ ID NO: 664251 - DNA, 13 bp, D. melanogaster
ttatgatcagttt

SEQ ID NO: 664252 - DNA, 13 bp, D. melanogaster
ttatgatcatttt

SEQ ID NO: 664253 - DNA, 13 bp, D. melanogaster
ttatgatcttcat

SEQ ID NO: 664254 - DNA, 13 bp, D. melanogaster
ttatgatgaaaaa

SEQ ID NO: 664255 - DNA, 13 bp, D. melanogaster
ttatgatgatgac

SEQ ID NO: 664256 - DNA, 13 bp, D. melanogaster
ttatgatgcattt

SEQ ID NO: 664257 - DNA, 13 bp, D. melanogaster
ttatgattacgaa

SEQ ID NO: 664258 - DNA, 13 bp, D. melanogaster
ttatgattatcat

SEQ ID NO: 664259 - DNA, 13 bp, D. melanogaster
ttatgattatgaa

SEQ ID NO: 664260 - DNA, 13 bp, D. melanogaster
ttatgattcattt

SEQ ID NO: 664261 - DNA, 13 bp, D. melanogaster
ttatgattttcca

SEQ ID NO: 664262 - DNA, 13 bp, D. melanogaster
ttatgattttcta

SEQ ID NO: 664263 - DNA, 13 bp, D. melanogaster
ttatgcaaaaatc

SEQ ID NO: 664264 - DNA, 13 bp, D. melanogaster
ttatgcaaaagaa

SEQ ID NO: 664265 - DNA, 13 bp, D. melanogaster
ttatgcaaaagtt

SEQ ID NO: 664266 - DNA, 14 bp, D. melanogaster
ttatgcaaaatgca

SEQ ID NO: 664267 - DNA, 13 bp, D. melanogaster
ttatgcaaacaca

SEQ ID NO: 664268 - DNA, 13 bp, D. melanogaster
ttatgcaaagttt

SEQ ID NO: 664269 - DNA, 13 bp, D. melanogaster
ttatgcaaatatt

SEQ ID NO: 664270 - DNA, 13 bp, D. melanogaster
ttatgcaaatcaa

SEQ ID NO: 664271 - DNA, 13 bp, D. melanogaster
ttatgcaaatcga

SEQ ID NO: 664272 - DNA, 13 bp, D. melanogaster
ttatgcaaatgat

SEQ ID NO: 664273 - DNA, 13 bp, D. melanogaster
ttatgcaaatgca

SEQ ID NO: 664274 - DNA, 14 bp, D. melanogaster
ttatgcaaatgcaa

SEQ ID NO: 664275 - DNA, 13 bp, D. melanogaster
ttatgcaaatgcg

SEQ ID NO: 664276 - DNA, 13 bp, D. melanogaster
ttatgcaaatgga

SEQ ID NO: 664277 - DNA, 13 bp, D. melanogaster
ttatgcaaatgtc

SEQ ID NO: 664278 - DNA, 13 bp, D. melanogaster
ttatgcaaattgc

SEQ ID NO: 664279 - DNA, 13 bp, D. melanogaster
ttatgcaacactt

SEQ ID NO: 664280 - DNA, 13 bp, D. melanogaster
ttatgcaacattt

SEQ ID NO: 664281 - DNA, 13 bp, D. melanogaster
ttatgcaataaat

SEQ ID NO: 664282 - DNA, 14 bp, D. melanogaster
ttatgcaataaata

SEQ ID NO: 664283 - DNA, 13 bp, D. melanogaster
ttatgcaataata

SEQ ID NO: 664284 - DNA, 13 bp, D. melanogaster
ttatgcaatatat

SEQ ID NO: 664285 - DNA, 13 bp, D. melanogaster
ttatgcaatattt

SEQ ID NO: 664286 - DNA, 14 bp, D. melanogaster
ttatgcaatatttg

SEQ ID NO: 664287 - DNA, 13 bp, D. melanogaster
ttatgcaatcaat

SEQ ID NO: 664288 - DNA, 13 bp, D. melanogaster
ttatgcaatgcaa

SEQ ID NO: 664289 - DNA, 14 bp, D. melanogaster
ttatgcaattaaat

SEQ ID NO: 664290 - DNA, 13 bp, D. melanogaster
ttatgcaattgaa

SEQ ID NO: 664291 - DNA, 13 bp, D. melanogaster
ttatgcaatttct

SEQ ID NO: 664292 - DNA, 13 bp, D. melanogaster
ttatgcaatttgc

SEQ ID NO: 664293 - DNA, 13 bp, D. melanogaster
ttatgcaatttgt

SEQ ID NO: 664294 - DNA, 13 bp, D. melanogaster
ttatgcacctttt

SEQ ID NO: 664295 - DNA, 13 bp, D. melanogaster
ttatgcagatttt

SEQ ID NO: 664296 - DNA, 13 bp, D. melanogaster
ttatgcagcaatt

SEQ ID NO: 664297 - DNA, 14 bp, D. melanogaster
ttatgcaggcagtt

SEQ ID NO: 664298 - DNA, 13 bp, D. melanogaster
ttatgcataaaat

SEQ ID NO: 664299 - DNA, 13 bp, D. melanogaster
ttatgcataaatt

SEQ ID NO: 664300 - DNA, 13 bp, D. melanogaster
ttatgcataatta

SEQ ID NO: 664301 - DNA, 13 bp, D. melanogaster
ttatgcataattt

SEQ ID NO: 664302 - DNA, 13 bp, D. melanogaster
ttatgcatacaaa

SEQ ID NO: 664303 - DNA, 13 bp, D. melanogaster
ttatgcatacata

SEQ ID NO: 664304 - DNA, 13 bp, D. melanogaster
ttatgcatatatg

SEQ ID NO: 664305 - DNA, 14 bp, D. melanogaster
ttatgcatatattt

SEQ ID NO: 664306 - DNA, 13 bp, D. melanogaster
ttatgcatatttt

SEQ ID NO: 664307 - DNA, 13 bp, D. melanogaster
ttatgcatttggc

SEQ ID NO: 664308 - DNA, 13 bp, D. melanogaster
ttatgcattttaa

SEQ ID NO: 664309 - DNA, 14 bp, D. melanogaster
ttatgcattttaaa

SEQ ID NO: 664310 - DNA, 14 bp, D. melanogaster
ttatgcattttatt

SEQ ID NO: 664311 - DNA, 13 bp, D. melanogaster
ttatgcattttga

SEQ ID NO: 664312 - DNA, 13 bp, D. melanogaster
ttatgcatttttc

SEQ ID NO: 664313 - DNA, 14 bp, D. melanogaster
ttatgccaaaaaaa

SEQ ID NO: 664314 - DNA, 13 bp, D. melanogaster
ttatgccacaaat

SEQ ID NO: 664315 - DNA, 13 bp, D. melanogaster
ttatgccacattt

SEQ ID NO: 664316 - DNA, 13 bp, D. melanogaster
ttatgccactaag

SEQ ID NO: 664317 - DNA, 13 bp, D. melanogaster
ttatgccatatat

SEQ ID NO: 664318 - DNA, 14 bp, D. melanogaster
ttatgcgaaataaa

SEQ ID NO: 664319 - DNA, 13 bp, D. melanogaster
ttatgcgaaatat

SEQ ID NO: 664320 - DNA, 13 bp, D. melanogaster
ttatgcgaatatt

SEQ ID NO: 664321 - DNA, 13 bp, D. melanogaster
ttatgcgatttat

SEQ ID NO: 664322 - DNA, 13 bp, D. melanogaster
ttatgcgattttt

SEQ ID NO: 664323 - DNA, 13 bp, D. melanogaster
ttatgcgcaaatt

SEQ ID NO: 664324 - DNA, 13 bp, D. melanogaster
ttatgcggaattt

SEQ ID NO: 664325 - DNA, 13 bp, D. melanogaster
ttatgcgttttgt

SEQ ID NO: 664326 - DNA, 13 bp, D. melanogaster
ttatgctaatgaa

SEQ ID NO: 664327 - DNA, 13 bp, D. melanogaster
ttatgctaattga

SEQ ID NO: 664328 - DNA, 13 bp, D. melanogaster
ttatgctaatttt

SEQ ID NO: 664329 - DNA, 13 bp, D. melanogaster
ttatgctcatcgc

SEQ ID NO: 664330 - DNA, 14 bp, D. melanogaster
ttatgctcatcgcc

SEQ ID NO: 664331 - DNA, 13 bp, D. melanogaster
ttatgctcgccga

SEQ ID NO: 664332 - DNA, 13 bp, D. melanogaster
ttatgctgcaatt

SEQ ID NO: 664333 - DNA, 13 bp, D. melanogaster
ttatgctgctgtt

SEQ ID NO: 664334 - DNA, 13 bp, D. melanogaster
ttatgcttaaaaa

SEQ ID NO: 664335 - DNA, 13 bp, D. melanogaster
ttatgcttcattt

SEQ ID NO: 664336 - DNA, 13 bp, D. melanogaster
ttatgcttttgat

SEQ ID NO: 664337 - DNA, 13 bp, D. melanogaster
ttatggaaaatta

SEQ ID NO: 664338 - DNA, 15 bp, D. melanogaster
ttatggaaaattact

SEQ ID NO: 664339 - DNA, 13 bp, D. melanogaster
ttatggaaataat

SEQ ID NO: 664340 - DNA, 13 bp, D. melanogaster
ttatggaaatata

SEQ ID NO: 664341 - DNA, 13 bp, D. melanogaster
ttatggaaatgtt

SEQ ID NO: 664342 - DNA, 13 bp, D. melanogaster
ttatggaactttt

SEQ ID NO: 664343 - DNA, 13 bp, D. melanogaster
ttatggaatttat

SEQ ID NO: 664344 - DNA, 13 bp, D. melanogaster
ttatggactatct

SEQ ID NO: 664345 - DNA, 13 bp, D. melanogaster
ttatggatttggc

SEQ ID NO: 664346 - DNA, 13 bp, D. melanogaster
ttatggattttaa

SEQ ID NO: 664347 - DNA, 13 bp, D. melanogaster
ttatggatttttc

SEQ ID NO: 664348 - DNA, 13 bp, D. melanogaster
ttatggcaaaaaa

SEQ ID NO: 664349 - DNA, 13 bp, D. melanogaster
ttatggcaaaata

SEQ ID NO: 664350 - DNA, 13 bp, D. melanogaster
ttatggcaaatgc

SEQ ID NO: 664351 - DNA, 13 bp, D. melanogaster
ttatggcaaattt

SEQ ID NO: 664352 - DNA, 13 bp, D. melanogaster
ttatggcacattt

SEQ ID NO: 664353 - DNA, 14 bp, D. melanogaster
ttatggcagcactt

SEQ ID NO: 664354 - DNA, 13 bp, D. melanogaster
ttatggcatgaga

SEQ ID NO: 664355 - DNA, 13 bp, D. melanogaster
ttatggccaaaaa

SEQ ID NO: 664356 - DNA, 14 bp, D. melanogaster
ttatggccaaaaaa

SEQ ID NO: 664357 - DNA, 13 bp, D. melanogaster
ttatggccaaaac

SEQ ID NO: 664358 - DNA, 13 bp, D. melanogaster
ttatggccaaaag

SEQ ID NO: 664359 - DNA, 13 bp, D. melanogaster
ttatggccaaatg

SEQ ID NO: 664360 - DNA, 13 bp, D. melanogaster
ttatggccaacag

SEQ ID NO: 664361 - DNA, 13 bp, D. melanogaster
ttatggccaactg

SEQ ID NO: 664362 - DNA, 13 bp, D. melanogaster
ttatggccaactt

SEQ ID NO: 664363 - DNA, 13 bp, D. melanogaster
ttatggccaagtc

SEQ ID NO: 664364 - DNA, 13 bp, D. melanogaster
ttatggccaatta

SEQ ID NO: 664365 - DNA, 13 bp, D. melanogaster
ttatggccacaaa

SEQ ID NO: 664366 - DNA, 13 bp, D. melanogaster
ttatggccacgtt

SEQ ID NO: 664367 - DNA, 13 bp, D. melanogaster
ttatggccagcag

SEQ ID NO: 664368 - DNA, 13 bp, D. melanogaster
ttatggccagcca

SEQ ID NO: 664369 - DNA, 13 bp, D. melanogaster
ttatggccataaa

SEQ ID NO: 664370 - DNA, 13 bp, D. melanogaster
ttatggccatgtt

SEQ ID NO: 664371 - DNA, 13 bp, D. melanogaster
ttatggccattaa

SEQ ID NO: 664372 - DNA, 13 bp, D. melanogaster
ttatggccattta

SEQ ID NO: 664373 - DNA, 13 bp, D. melanogaster
ttatggccatttt

SEQ ID NO: 664374 - DNA, 13 bp, D. melanogaster
ttatggcccaaaa

SEQ ID NO: 664375 - DNA, 13 bp, D. melanogaster
ttatggctaattt

SEQ ID NO: 664376 - DNA, 14 bp, D. melanogaster
ttatggctaattta

SEQ ID NO: 664377 - DNA, 13 bp, D. melanogaster
ttatggctgcacc

SEQ ID NO: 664378 - DNA, 13 bp, D. melanogaster
ttatggctgctca

SEQ ID NO: 664379 - DNA, 13 bp, D. melanogaster
ttatggctttaaa

SEQ ID NO: 664380 - DNA, 13 bp, D. melanogaster
ttatggctttaat

SEQ ID NO: 664381 - DNA, 13 bp, D. melanogaster
ttatggctttgtt

SEQ ID NO: 664382 - DNA, 13 bp, D. melanogaster
ttatggtattata

SEQ ID NO: 664383 - DNA, 13 bp, D. melanogaster
ttatggtcttgag

SEQ ID NO: 664384 - DNA, 13 bp, D. melanogaster
ttatggttatggc

SEQ ID NO: 664385 - DNA, 13 bp, D. melanogaster
ttatgtaaactta

SEQ ID NO: 664386 - DNA, 13 bp, D. melanogaster
ttatgtaaatgaa

SEQ ID NO: 664387 - DNA, 13 bp, D. melanogaster
ttatgtaaattca

SEQ ID NO: 664388 - DNA, 13 bp, D. melanogaster
ttatgtaaatttc

SEQ ID NO: 664389 - DNA, 13 bp, D. melanogaster
ttatgtaatgtaa

SEQ ID NO: 664390 - DNA, 13 bp, D. melanogaster
ttatgtacaaaat

SEQ ID NO: 664391 - DNA, 13 bp, D. melanogaster
ttatgtacaaatt

SEQ ID NO: 664392 - DNA, 13 bp, D. melanogaster
ttatgtacaatat

SEQ ID NO: 664393 - DNA, 13 bp, D. melanogaster
ttatgtacatatg

SEQ ID NO: 664394 - DNA, 14 bp, D. melanogaster
ttatgtacatatgt

SEQ ID NO: 664395 - DNA, 13 bp, D. melanogaster
ttatgtacattaa

SEQ ID NO: 664396 - DNA, 14 bp, D. melanogaster
ttatgtacattaaa

SEQ ID NO: 664397 - DNA, 13 bp, D. melanogaster
ttatgtactattt

SEQ ID NO: 664398 - DNA, 13 bp, D. melanogaster
ttatgtagattta

SEQ ID NO: 664399 - DNA, 14 bp, D. melanogaster
ttatgtatatatac

SEQ ID NO: 664400 - DNA, 13 bp, D. melanogaster
ttatgtatatatg

SEQ ID NO: 664401 - DNA, 13 bp, D. melanogaster
ttatgtatatctt

SEQ ID NO: 664402 - DNA, 13 bp, D. melanogaster
ttatgtatatttc

SEQ ID NO: 664403 - DNA, 13 bp, D. melanogaster
ttatgtatctgta

SEQ ID NO: 664404 - DNA, 13 bp, D. melanogaster
ttatgtatgattg

SEQ ID NO: 664405 - DNA, 13 bp, D. melanogaster
ttatgtatgctat

SEQ ID NO: 664406 - DNA, 16 bp, D. melanogaster
ttatgtatgctattat

SEQ ID NO: 664407 - DNA, 13 bp, D. melanogaster
ttatgtatgtata

SEQ ID NO: 664408 - DNA, 13 bp, D. melanogaster
ttatgtatgtgta

SEQ ID NO: 664409 - DNA, 13 bp, D. melanogaster
ttatgtatgtgtg

SEQ ID NO: 664410 - DNA, 13 bp, D. melanogaster
ttatgtatttact

SEQ ID NO: 664411 - DNA, 13 bp, D. melanogaster
ttatgtatttgct

SEQ ID NO: 664412 - DNA, 13 bp, D. melanogaster
ttatgtcatgtac

SEQ ID NO: 664413 - DNA, 13 bp, D. melanogaster
ttatgtcccattt

SEQ ID NO: 664414 - DNA, 13 bp, D. melanogaster
ttatgtgaaattt

SEQ ID NO: 664415 - DNA, 13 bp, D. melanogaster
ttatgtgacattt

SEQ ID NO: 664416 - DNA, 14 bp, D. melanogaster
ttatgtgcaatttt

SEQ ID NO: 664417 - DNA, 13 bp, D. melanogaster
ttatgtgcatgta

SEQ ID NO: 664418 - DNA, 13 bp, D. melanogaster
ttatgtgcgtgtg

SEQ ID NO: 664419 - DNA, 13 bp, D. melanogaster
ttatgtggattct

SEQ ID NO: 664420 - DNA, 14 bp, D. melanogaster
ttatgtggattctg

SEQ ID NO: 664421 - DNA, 13 bp, D. melanogaster
ttatgtgtataaa

SEQ ID NO: 664422 - DNA, 13 bp, D. melanogaster
ttatgtgtgaaat

SEQ ID NO: 664423 - DNA, 14 bp, D. melanogaster
ttatgtgtttgaaa

SEQ ID NO: 664424 - DNA, 13 bp, D. melanogaster
ttatgttaagcat

SEQ ID NO: 664425 - DNA, 13 bp, D. melanogaster
ttatgttcataaa

SEQ ID NO: 664426 - DNA, 13 bp, D. melanogaster
ttatgttcatatt

SEQ ID NO: 664427 - DNA, 13 bp, D. melanogaster
ttatgttcttcag

SEQ ID NO: 664428 - DNA, 14 bp, D. melanogaster
ttatgttcttcagt

SEQ ID NO: 664429 - DNA, 13 bp, D. melanogaster
ttatgttctttaa

SEQ ID NO: 664430 - DNA, 13 bp, D. melanogaster
ttatgttgcagga

SEQ ID NO: 664431 - DNA, 13 bp, D. melanogaster
ttatgttgcatac

SEQ ID NO: 664432 - DNA, 13 bp, D. melanogaster
ttatgttggccca

SEQ ID NO: 664433 - DNA, 14 bp, D. melanogaster
ttatgtttaacttt

SEQ ID NO: 664434 - DNA, 13 bp, D. melanogaster
ttatgtttaattc

SEQ ID NO: 664435 - DNA, 13 bp, D. melanogaster
ttatgtttacatt

SEQ ID NO: 664436 - DNA, 13 bp, D. melanogaster
ttatgtttacgtt

SEQ ID NO: 664437 - DNA, 13 bp, D. melanogaster
ttatgtttataag

SEQ ID NO: 664438 - DNA, 13 bp, D. melanogaster
ttatgtttatgaa

SEQ ID NO: 664439 - DNA, 13 bp, D. melanogaster
ttatgtttatggc

SEQ ID NO: 664440 - DNA, 13 bp, D. melanogaster
ttatgtttcaatt

SEQ ID NO: 664441 - DNA, 13 bp, D. melanogaster
ttatgtttgctca

SEQ ID NO: 664442 - DNA, 13 bp, D. melanogaster
ttatgtttttcaa

SEQ ID NO: 664443 - DNA, 13 bp, D. melanogaster
ttatgtttttggc

SEQ ID NO: 664444 - DNA, 13 bp, D. melanogaster
ttattaaaaaacg

SEQ ID NO: 664445 - DNA, 13 bp, D. melanogaster
ttattaaaaagca

SEQ ID NO: 664446 - DNA, 13 bp, D. melanogaster
ttattaaaaggaa

SEQ ID NO: 664447 - DNA, 13 bp, D. melanogaster
ttattaaagctaa

SEQ ID NO: 664448 - DNA, 13 bp, D. melanogaster
ttattaaaggcag

SEQ ID NO: 664449 - DNA, 13 bp, D. melanogaster
ttattaaagttgc

SEQ ID NO: 664450 - DNA, 14 bp, D. melanogaster
ttattaaatgcaaa

SEQ ID NO: 664451 - DNA, 13 bp, D. melanogaster
ttattaaatgcca

SEQ ID NO: 664452 - DNA, 14 bp, D. melanogaster
ttattaaatggaga

SEQ ID NO: 664453 - DNA, 13 bp, D. melanogaster
ttattaaatttcc

SEQ ID NO: 664454 - DNA, 13 bp, D. melanogaster
ttattaaatttcg

SEQ ID NO: 664455 - DNA, 13 bp, D. melanogaster
ttattaacaacaa

SEQ ID NO: 664456 - DNA, 13 bp, D. melanogaster
ttattaacattgt

SEQ ID NO: 664457 - DNA, 13 bp, D. melanogaster
ttattaactacat

SEQ ID NO: 664458 - DNA, 13 bp, D. melanogaster
ttattaagaaaca

SEQ ID NO: 664459 - DNA, 14 bp, D. melanogaster
ttattaagaaacaa

SEQ ID NO: 664460 - DNA, 13 bp, D. melanogaster
ttattaagcattt

SEQ ID NO: 664461 - DNA, 13 bp, D. melanogaster
ttattaagctttc

SEQ ID NO: 664462 - DNA, 13 bp, D. melanogaster
ttattaaggcata

SEQ ID NO: 664463 - DNA, 14 bp, D. melanogaster
ttattaaggcatac

SEQ ID NO: 664464 - DNA, 13 bp, D. melanogaster
ttattaagttcaa

SEQ ID NO: 664465 - DNA, 13 bp, D. melanogaster
ttattaataagct

SEQ ID NO: 664466 - DNA, 13 bp, D. melanogaster
ttattaattgctt

SEQ ID NO: 664467 - DNA, 13 bp, D. melanogaster
ttattaatttgtc

SEQ ID NO: 664468 - DNA, 14 bp, D. melanogaster
ttattaatttgtca

SEQ ID NO: 664469 - DNA, 13 bp, D. melanogaster
ttattacaatttc

SEQ ID NO: 664470 - DNA, 13 bp, D. melanogaster
ttattacatggcg

SEQ ID NO: 664471 - DNA, 13 bp, D. melanogaster
ttattaccacttt

SEQ ID NO: 664472 - DNA, 13 bp, D. melanogaster
ttattaccattta

SEQ ID NO: 664473 - DNA, 13 bp, D. melanogaster
ttattacgaattc

SEQ ID NO: 664474 - DNA, 13 bp, D. melanogaster
ttattactattac

SEQ ID NO: 664475 - DNA, 13 bp, D. melanogaster
ttattacttttga

SEQ ID NO: 664476 - DNA, 13 bp, D. melanogaster
ttattacttttgc

SEQ ID NO: 664477 - DNA, 13 bp, D. melanogaster
ttattagacattt

SEQ ID NO: 664478 - DNA, 13 bp, D. melanogaster
ttattagcaattt

SEQ ID NO: 664479 - DNA, 13 bp, D. melanogaster
ttattagcatatt

SEQ ID NO: 664480 - DNA, 13 bp, D. melanogaster
ttattagccaatt

SEQ ID NO: 664481 - DNA, 13 bp, D. melanogaster
ttattagccattt

SEQ ID NO: 664482 - DNA, 13 bp, D. melanogaster
ttattagctattt

SEQ ID NO: 664483 - DNA, 13 bp, D. melanogaster
ttattagctgata

SEQ ID NO: 664484 - DNA, 14 bp, D. melanogaster
ttattagctgatat

SEQ ID NO: 664485 - DNA, 13 bp, D. melanogaster
ttattagcttctt

SEQ ID NO: 664486 - DNA, 13 bp, D. melanogaster
ttattatacacaa

SEQ ID NO: 664487 - DNA, 13 bp, D. melanogaster
ttattatatgtac

SEQ ID NO: 664488 - DNA, 13 bp, D. melanogaster
ttattatcgcaaa

SEQ ID NO: 664489 - DNA, 13 bp, D. melanogaster
ttattatgaaagg

SEQ ID NO: 664490 - DNA, 13 bp, D. melanogaster
ttattatgacaaa

SEQ ID NO: 664491 - DNA, 13 bp, D. melanogaster
ttattatgacttt

SEQ ID NO: 664492 - DNA, 13 bp, D. melanogaster
ttattatgatgat

SEQ ID NO: 664493 - DNA, 13 bp, D. melanogaster
ttattatgattac

SEQ ID NO: 664494 - DNA, 13 bp, D. melanogaster
ttattatgcatta

SEQ ID NO: 664495 - DNA, 13 bp, D. melanogaster
ttattatgccagc

SEQ ID NO: 664496 - DNA, 13 bp, D. melanogaster
ttattatggaaat

SEQ ID NO: 664497 - DNA, 13 bp, D. melanogaster
ttattatgtactt

SEQ ID NO: 664498 - DNA, 13 bp, D. melanogaster
ttattattaagca

SEQ ID NO: 664499 - DNA, 13 bp, D. melanogaster
ttattattaagtg

SEQ ID NO: 664500 - DNA, 13 bp, D. melanogaster
ttattattatacc

SEQ ID NO: 664501 - DNA, 14 bp, D. melanogaster
ttattattattgca

SEQ ID NO: 664502 - DNA, 13 bp, D. melanogaster
ttattattgcaat

SEQ ID NO: 664503 - DNA, 13 bp, D. melanogaster
ttattattgcatt

SEQ ID NO: 664504 - DNA, 14 bp, D. melanogaster
ttattattgcattt

SEQ ID NO: 664505 - DNA, 13 bp, D. melanogaster
ttattattgccat

SEQ ID NO: 664506 - DNA, 13 bp, D. melanogaster
ttattattgctaa

SEQ ID NO: 664507 - DNA, 14 bp, D. melanogaster
ttattattgctgtt

SEQ ID NO: 664508 - DNA, 13 bp, D. melanogaster
ttattattgtcat

SEQ ID NO: 664509 - DNA, 13 bp, D. melanogaster
ttattatttactg

SEQ ID NO: 664510 - DNA, 13 bp, D. melanogaster
ttattatttagct

SEQ ID NO: 664511 - DNA, 13 bp, D. melanogaster
ttattatttcgaa

SEQ ID NO: 664512 - DNA, 13 bp, D. melanogaster
ttattatttcgat

SEQ ID NO: 664513 - DNA, 14 bp, D. melanogaster
ttattatttcgttc

SEQ ID NO: 664514 - DNA, 13 bp, D. melanogaster
ttattatttgccc

SEQ ID NO: 664515 - DNA, 13 bp, D. melanogaster
ttattattttgca

SEQ ID NO: 664516 - DNA, 13 bp, D. melanogaster
ttattcaaaatgt

SEQ ID NO: 664517 - DNA, 13 bp, D. melanogaster
ttattcaaaattg

SEQ ID NO: 664518 - DNA, 13 bp, D. melanogaster
ttattcaaacgca

SEQ ID NO: 664519 - DNA, 13 bp, D. melanogaster
ttattcaaatgaa

SEQ ID NO: 664520 - DNA, 13 bp, D. melanogaster
ttattcaaatgcc

SEQ ID NO: 664521 - DNA, 13 bp, D. melanogaster
ttattcaacaaat

SEQ ID NO: 664522 - DNA, 13 bp, D. melanogaster
ttattcaagacca

SEQ ID NO: 664523 - DNA, 13 bp, D. melanogaster
ttattcaatatca

SEQ ID NO: 664524 - DNA, 13 bp, D. melanogaster
ttattcaatcaaa

SEQ ID NO: 664525 - DNA, 13 bp, D. melanogaster
ttattcaatttcc

SEQ ID NO: 664526 - DNA, 13 bp, D. melanogaster
ttattcaatttgt

SEQ ID NO: 664527 - DNA, 13 bp, D. melanogaster
ttattcacaaaaa

SEQ ID NO: 664528 - DNA, 14 bp, D. melanogaster
ttattcacaaaaag

SEQ ID NO: 664529 - DNA, 13 bp, D. melanogaster
ttattcacaaaat

SEQ ID NO: 664530 - DNA, 13 bp, D. melanogaster
ttattcacataaa

SEQ ID NO: 664531 - DNA, 13 bp, D. melanogaster
ttattcagcattt

SEQ ID NO: 664532 - DNA, 13 bp, D. melanogaster
ttattcagttatt

SEQ ID NO: 664533 - DNA, 13 bp, D. melanogaster
ttattcagtttat

SEQ ID NO: 664534 - DNA, 13 bp, D. melanogaster
ttattcatagttt

SEQ ID NO: 664535 - DNA, 13 bp, D. melanogaster
ttattcattagtt

SEQ ID NO: 664536 - DNA, 13 bp, D. melanogaster
ttattcattcaac

SEQ ID NO: 664537 - DNA, 13 bp, D. melanogaster
ttattcattgatt

SEQ ID NO: 664538 - DNA, 13 bp, D. melanogaster
ttattccatcaca

SEQ ID NO: 664539 - DNA, 14 bp, D. melanogaster
ttattccatcacat

SEQ ID NO: 664540 - DNA, 13 bp, D. melanogaster
ttattcccattat

SEQ ID NO: 664541 - DNA, 13 bp, D. melanogaster
ttattcgaaattt

SEQ ID NO: 664542 - DNA, 13 bp, D. melanogaster
ttattcgaattaa

SEQ ID NO: 664543 - DNA, 13 bp, D. melanogaster
ttattcgactttt

SEQ ID NO: 664544 - DNA, 13 bp, D. melanogaster
ttattcgatattt

SEQ ID NO: 664545 - DNA, 13 bp, D. melanogaster
ttattcgattatt

SEQ ID NO: 664546 - DNA, 13 bp, D. melanogaster
ttattcgcatttt

SEQ ID NO: 664547 - DNA, 13 bp, D. melanogaster
ttattcggaaaat

SEQ ID NO: 664548 - DNA, 13 bp, D. melanogaster
ttattcgtagagt

SEQ ID NO: 664549 - DNA, 13 bp, D. melanogaster
ttattctaatgaa

SEQ ID NO: 664550 - DNA, 15 bp, D. melanogaster
ttattctaatgaatt

SEQ ID NO: 664551 - DNA, 13 bp, D. melanogaster
ttattctagttaa

SEQ ID NO: 664552 - DNA, 13 bp, D. melanogaster
ttattctcagtgc

SEQ ID NO: 664553 - DNA, 13 bp, D. melanogaster
ttattctgcttct

SEQ ID NO: 664554 - DNA, 13 bp, D. melanogaster
ttattctgtccaa

SEQ ID NO: 664555 - DNA, 13 bp, D. melanogaster
ttattcttatcaa

SEQ ID NO: 664556 - DNA, 13 bp, D. melanogaster
ttattcttgataa

SEQ ID NO: 664557 - DNA, 13 bp, D. melanogaster
ttattctttggat

SEQ ID NO: 664558 - DNA, 13 bp, D. melanogaster
ttattgaaaacat

SEQ ID NO: 664559 - DNA, 13 bp, D. melanogaster
ttattgaaaatgc

SEQ ID NO: 664560 - DNA, 13 bp, D. melanogaster
ttattgaaaatgt

SEQ ID NO: 664561 - DNA, 13 bp, D. melanogaster
ttattgaaacaaa

SEQ ID NO: 664562 - DNA, 13 bp, D. melanogaster
ttattgaaagaaa

SEQ ID NO: 664563 - DNA, 13 bp, D. melanogaster
ttattgaaatact

SEQ ID NO: 664564 - DNA, 13 bp, D. melanogaster
ttattgaaatgaa

SEQ ID NO: 664565 - DNA, 13 bp, D. melanogaster
ttattgaaattct

SEQ ID NO: 664566 - DNA, 13 bp, D. melanogaster
ttattgaaattga

SEQ ID NO: 664567 - DNA, 13 bp, D. melanogaster
ttattgaaattgc

SEQ ID NO: 664568 - DNA, 13 bp, D. melanogaster
ttattgaacaatt

SEQ ID NO: 664569 - DNA, 13 bp, D. melanogaster
ttattgaagaaac

SEQ ID NO: 664570 - DNA, 13 bp, D. melanogaster
ttattgaagaggt

SEQ ID NO: 664571 - DNA, 13 bp, D. melanogaster
ttattgaatgatt

SEQ ID NO: 664572 - DNA, 13 bp, D. melanogaster
ttattgaatttcc

SEQ ID NO: 664573 - DNA, 13 bp, D. melanogaster
ttattgaatttgc

SEQ ID NO: 664574 - DNA, 13 bp, D. melanogaster
ttattgacaaaca

SEQ ID NO: 664575 - DNA, 13 bp, D. melanogaster
ttattgacaactt

SEQ ID NO: 664576 - DNA, 13 bp, D. melanogaster
ttattgatttcga

SEQ ID NO: 664577 - DNA, 13 bp, D. melanogaster
ttattgatttgct

SEQ ID NO: 664578 - DNA, 13 bp, D. melanogaster
ttattgattttcc

SEQ ID NO: 664579 - DNA, 13 bp, D. melanogaster
ttattgcaaaact

SEQ ID NO: 664580 - DNA, 13 bp, D. melanogaster
ttattgcaaacaa

SEQ ID NO: 664581 - DNA, 13 bp, D. melanogaster
ttattgcaaatat

SEQ ID NO: 664582 - DNA, 14 bp, D. melanogaster
ttattgcaaattaa

SEQ ID NO: 664583 - DNA, 14 bp, D. melanogaster
ttattgcaaattta

SEQ ID NO: 664584 - DNA, 13 bp, D. melanogaster
ttattgcaacaaa

SEQ ID NO: 664585 - DNA, 13 bp, D. melanogaster
ttattgcaatatt

SEQ ID NO: 664586 - DNA, 13 bp, D. melanogaster
ttattgcaatttt

SEQ ID NO: 664587 - DNA, 13 bp, D. melanogaster
ttattgcacattt

SEQ ID NO: 664588 - DNA, 14 bp, D. melanogaster
ttattgcactaata

SEQ ID NO: 664589 - DNA, 13 bp, D. melanogaster
ttattgcataata

SEQ ID NO: 664590 - DNA, 13 bp, D. melanogaster
ttattgcataatt

SEQ ID NO: 664591 - DNA, 14 bp, D. melanogaster
ttattgcatacttt

SEQ ID NO: 664592 - DNA, 13 bp, D. melanogaster
ttattgcatattt

SEQ ID NO: 664593 - DNA, 13 bp, D. melanogaster
ttattgcattcat

SEQ ID NO: 664594 - DNA, 13 bp, D. melanogaster
ttattgcatttat

SEQ ID NO: 664595 - DNA, 13 bp, D. melanogaster
ttattgcatttca

SEQ ID NO: 664596 - DNA, 13 bp, D. melanogaster
ttattgcattttg

SEQ ID NO: 664597 - DNA, 13 bp, D. melanogaster
ttattgccaaaaa

SEQ ID NO: 664598 - DNA, 13 bp, D. melanogaster
ttattgccaaaca

SEQ ID NO: 664599 - DNA, 13 bp, D. melanogaster
ttattgccaattg

SEQ ID NO: 664600 - DNA, 13 bp, D. melanogaster
ttattgccaattt

SEQ ID NO: 664601 - DNA, 13 bp, D. melanogaster
ttattgccattgc

SEQ ID NO: 664602 - DNA, 13 bp, D. melanogaster
ttattgccctgca

SEQ ID NO: 664603 - DNA, 14 bp, D. melanogaster
ttattgccctgcaa

SEQ ID NO: 664604 - DNA, 13 bp, D. melanogaster
ttattgcctactt

SEQ ID NO: 664605 - DNA, 13 bp, D. melanogaster
ttattgcctttat

SEQ ID NO: 664606 - DNA, 14 bp, D. melanogaster
ttattgctattatt

SEQ ID NO: 664607 - DNA, 14 bp, D. melanogaster
ttattgctattgtt

SEQ ID NO: 664608 - DNA, 13 bp, D. melanogaster
ttattgctattta

SEQ ID NO: 664609 - DNA, 13 bp, D. melanogaster
ttattgctgaaaa

SEQ ID NO: 664610 - DNA, 13 bp, D. melanogaster
ttattgctgcatt

SEQ ID NO: 664611 - DNA, 13 bp, D. melanogaster
ttattgctgctgc

SEQ ID NO: 664612 - DNA, 13 bp, D. melanogaster
ttattgctgttgg

SEQ ID NO: 664613 - DNA, 13 bp, D. melanogaster
ttattgctgttgt

SEQ ID NO: 664614 - DNA, 14 bp, D. melanogaster
ttattgctgttgtt

SEQ ID NO: 664615 - DNA, 13 bp, D. melanogaster
ttattgcttaatt

SEQ ID NO: 664616 - DNA, 13 bp, D. melanogaster
ttattggaattag

SEQ ID NO: 664617 - DNA, 13 bp, D. melanogaster
ttattggattaca

SEQ ID NO: 664618 - DNA, 13 bp, D. melanogaster
ttattggatttaa

SEQ ID NO: 664619 - DNA, 13 bp, D. melanogaster
ttattggattttc

SEQ ID NO: 664620 - DNA, 13 bp, D. melanogaster
ttattggcattat

SEQ ID NO: 664621 - DNA, 13 bp, D. melanogaster
ttattggcattta

SEQ ID NO: 664622 - DNA, 13 bp, D. melanogaster
ttattggccaatt

SEQ ID NO: 664623 - DNA, 13 bp, D. melanogaster
ttattggccacaa

SEQ ID NO: 664624 - DNA, 13 bp, D. melanogaster
ttattggccactt

SEQ ID NO: 664625 - DNA, 13 bp, D. melanogaster
ttattggccataa

SEQ ID NO: 664626 - DNA, 13 bp, D. melanogaster
ttattggccattg

SEQ ID NO: 664627 - DNA, 13 bp, D. melanogaster
ttattggccattt

SEQ ID NO: 664628 - DNA, 14 bp, D. melanogaster
ttattggctacaaa

SEQ ID NO: 664629 - DNA, 13 bp, D. melanogaster
ttattggctttaa

SEQ ID NO: 664630 - DNA, 13 bp, D. melanogaster
ttattgggaattt

SEQ ID NO: 664631 - DNA, 13 bp, D. melanogaster
ttattggtaaatt

SEQ ID NO: 664632 - DNA, 13 bp, D. melanogaster
ttattggtctgta

SEQ ID NO: 664633 - DNA, 13 bp, D. melanogaster
ttattgtaaaaag

SEQ ID NO: 664634 - DNA, 13 bp, D. melanogaster
ttattgtaatgta

SEQ ID NO: 664635 - DNA, 13 bp, D. melanogaster
ttattgtacttaa

SEQ ID NO: 664636 - DNA, 13 bp, D. melanogaster
ttattgtagattg

SEQ ID NO: 664637 - DNA, 13 bp, D. melanogaster
ttattgtcaaaaa

SEQ ID NO: 664638 - DNA, 13 bp, D. melanogaster
ttattgtcaagtt

SEQ ID NO: 664639 - DNA, 13 bp, D. melanogaster
ttattgtgataaa

SEQ ID NO: 664640 - DNA, 13 bp, D. melanogaster
ttattgttaaatc

SEQ ID NO: 664641 - DNA, 13 bp, D. melanogaster
ttattgttaaggc

SEQ ID NO: 664642 - DNA, 13 bp, D. melanogaster
ttattgttagaga

SEQ ID NO: 664643 - DNA, 14 bp, D. melanogaster
ttattgttagagaa

SEQ ID NO: 664644 - DNA, 13 bp, D. melanogaster
ttattgttagtct

SEQ ID NO: 664645 - DNA, 15 bp, D. melanogaster
ttattgttagttctt

SEQ ID NO: 664646 - DNA, 13 bp, D. melanogaster
ttattgttatcaa

SEQ ID NO: 664647 - DNA, 13 bp, D. melanogaster
ttattgttatgct

SEQ ID NO: 664648 - DNA, 13 bp, D. melanogaster
ttattgttatggc

SEQ ID NO: 664649 - DNA, 13 bp, D. melanogaster
ttattgttccatt

SEQ ID NO: 664650 - DNA, 13 bp, D. melanogaster
ttattgttgctgc

SEQ ID NO: 664651 - DNA, 14 bp, D. melanogaster
ttattgttgctgcg

SEQ ID NO: 664652 - DNA, 13 bp, D. melanogaster
ttattgttgttgc

SEQ ID NO: 664653 - DNA, 14 bp, D. melanogaster
ttattgttgttgct

SEQ ID NO: 664654 - DNA, 13 bp, D. melanogaster
ttattgtttggct

SEQ ID NO: 664655 - DNA, 14 bp, D. melanogaster
ttatttaaaatctg

SEQ ID NO: 664656 - DNA, 14 bp, D. melanogaster
ttatttaaaatgca

SEQ ID NO: 664657 - DNA, 13 bp, D. melanogaster
ttatttaaaccat

SEQ ID NO: 664658 - DNA, 13 bp, D. melanogaster
ttatttaaagcaa

SEQ ID NO: 664659 - DNA, 13 bp, D. melanogaster
ttatttaaagtac

SEQ ID NO: 664660 - DNA, 13 bp, D. melanogaster
ttatttaaatgct

SEQ ID NO: 664661 - DNA, 13 bp, D. melanogaster
ttatttaaatgga

SEQ ID NO: 664662 - DNA, 13 bp, D. melanogaster
ttatttaaattgc

SEQ ID NO: 664663 - DNA, 13 bp, D. melanogaster
ttatttaacaagc

SEQ ID NO: 664664 - DNA, 13 bp, D. melanogaster
ttatttaaccatt

SEQ ID NO: 664665 - DNA, 14 bp, D. melanogaster
ttatttaagaaagt

SEQ ID NO: 664666 - DNA, 13 bp, D. melanogaster
ttatttaagccaa

SEQ ID NO: 664667 - DNA, 13 bp, D. melanogaster
ttatttaagctta

SEQ ID NO: 664668 - DNA, 13 bp, D. melanogaster
ttatttaagcttg

SEQ ID NO: 664669 - DNA, 13 bp, D. melanogaster
ttatttaaggaaa

SEQ ID NO: 664670 - DNA, 13 bp, D. melanogaster
ttatttaataggt

SEQ ID NO: 664671 - DNA, 13 bp, D. melanogaster
ttatttaatcaac

SEQ ID NO: 664672 - DNA, 13 bp, D. melanogaster
ttatttaatgcaa

SEQ ID NO: 664673 - DNA, 14 bp, D. melanogaster
ttatttaatgcaat

SEQ ID NO: 664674 - DNA, 13 bp, D. melanogaster
ttatttaatggaa

SEQ ID NO: 664675 - DNA, 13 bp, D. melanogaster
ttatttaatggat

SEQ ID NO: 664676 - DNA, 13 bp, D. melanogaster
ttatttaattgac

SEQ ID NO: 664677 - DNA, 13 bp, D. melanogaster
ttatttaattgcc

SEQ ID NO: 664678 - DNA, 13 bp, D. melanogaster
ttatttacaaaca

SEQ ID NO: 664679 - DNA, 14 bp, D. melanogaster
ttatttacaaacaa

SEQ ID NO: 664680 - DNA, 13 bp, D. melanogaster
ttatttacaacat

SEQ ID NO: 664681 - DNA, 13 bp, D. melanogaster
ttatttacaagtg

SEQ ID NO: 664682 - DNA, 13 bp, D. melanogaster
ttatttacaatct

SEQ ID NO: 664683 - DNA, 13 bp, D. melanogaster
ttatttacaatgt

SEQ ID NO: 664684 - DNA, 14 bp, D. melanogaster
ttatttacaatgtt

SEQ ID NO: 664685 - DNA, 13 bp, D. melanogaster
ttatttacacaca

SEQ ID NO: 664686 - DNA, 14 bp, D. melanogaster
ttatttacccgcaa

SEQ ID NO: 664687 - DNA, 13 bp, D. melanogaster
ttatttacgccag

SEQ ID NO: 664688 - DNA, 13 bp, D. melanogaster
ttatttactaatg

SEQ ID NO: 664689 - DNA, 13 bp, D. melanogaster
ttatttactattg

SEQ ID NO: 664690 - DNA, 13 bp, D. melanogaster
ttatttactttga

SEQ ID NO: 664691 - DNA, 13 bp, D. melanogaster
ttatttagataca

SEQ ID NO: 664692 - DNA, 13 bp, D. melanogaster
ttatttagcattt

SEQ ID NO: 664693 - DNA, 13 bp, D. melanogaster
ttatttaggacca

SEQ ID NO: 664694 - DNA, 13 bp, D. melanogaster
ttatttataaacg

SEQ ID NO: 664695 - DNA, 13 bp, D. melanogaster
ttatttataaagc

SEQ ID NO: 664696 - DNA, 13 bp, D. melanogaster
ttatttatacaca

SEQ ID NO: 664697 - DNA, 13 bp, D. melanogaster
ttatttatatgct

SEQ ID NO: 664698 - DNA, 13 bp, D. melanogaster
ttatttatccaaa

SEQ ID NO: 664699 - DNA, 13 bp, D. melanogaster
ttatttatctgct

SEQ ID NO: 664700 - DNA, 13 bp, D. melanogaster
ttatttatgatct

SEQ ID NO: 664701 - DNA, 13 bp, D. melanogaster
ttatttatgcaat

SEQ ID NO: 664702 - DNA, 13 bp, D. melanogaster
ttatttatgcatt

SEQ ID NO: 664703 - DNA, 14 bp, D. melanogaster
ttatttatgcattt

SEQ ID NO: 664704 - DNA, 13 bp, D. melanogaster
ttatttatgccaa

SEQ ID NO: 664705 - DNA, 13 bp, D. melanogaster
ttatttatgcgac

SEQ ID NO: 664706 - DNA, 13 bp, D. melanogaster
ttatttatgctta

SEQ ID NO: 664707 - DNA, 13 bp, D. melanogaster
ttatttatggctc

SEQ ID NO: 664708 - DNA, 13 bp, D. melanogaster
ttatttatggctt

SEQ ID NO: 664709 - DNA, 13 bp, D. melanogaster
ttatttatgtgaa

SEQ ID NO: 664710 - DNA, 13 bp, D. melanogaster
ttatttatgtgcc

SEQ ID NO: 664711 - DNA, 13 bp, D. melanogaster
ttatttatgtggc

SEQ ID NO: 664712 - DNA, 13 bp, D. melanogaster
ttatttattcgct

SEQ ID NO: 664713 - DNA, 13 bp, D. melanogaster
ttatttattgcac

SEQ ID NO: 664714 - DNA, 14 bp, D. melanogaster
ttatttattgcaca

SEQ ID NO: 664715 - DNA, 13 bp, D. melanogaster
ttatttattgcag

SEQ ID NO: 664716 - DNA, 13 bp, D. melanogaster
ttatttattgcca

SEQ ID NO: 664717 - DNA, 13 bp, D. melanogaster
ttatttattgcct

SEQ ID NO: 664718 - DNA, 13 bp, D. melanogaster
ttatttattggaa

SEQ ID NO: 664719 - DNA, 13 bp, D. melanogaster
ttatttattggcc

SEQ ID NO: 664720 - DNA, 13 bp, D. melanogaster
ttatttatttacg

SEQ ID NO: 664721 - DNA, 14 bp, D. melanogaster
ttatttatttacga

SEQ ID NO: 664722 - DNA, 13 bp, D. melanogaster
ttatttatttcga

SEQ ID NO: 664723 - DNA, 14 bp, D. melanogaster
ttatttatttgctg

SEQ ID NO: 664724 - DNA, 14 bp, D. melanogaster
ttatttatttgtgc

SEQ ID NO: 664725 - DNA, 14 bp, D. melanogaster
ttatttcaaaaaac

SEQ ID NO: 664726 - DNA, 13 bp, D. melanogaster
ttatttcaaaaac

SEQ ID NO: 664727 - DNA, 13 bp, D. melanogaster
ttatttcaaagaa

SEQ ID NO: 664728 - DNA, 13 bp, D. melanogaster
ttatttcacaaat

SEQ ID NO: 664729 - DNA, 14 bp, D. melanogaster
ttatttcacaaatt

SEQ ID NO: 664730 - DNA, 13 bp, D. melanogaster
ttatttcaccaaa

SEQ ID NO: 664731 - DNA, 13 bp, D. melanogaster
ttatttcactgtt

SEQ ID NO: 664732 - DNA, 13 bp, D. melanogaster
ttatttcatgatt

SEQ ID NO: 664733 - DNA, 13 bp, D. melanogaster
ttatttcatttcg

SEQ ID NO: 664734 - DNA, 13 bp, D. melanogaster
ttatttcatttgc

SEQ ID NO: 664735 - DNA, 13 bp, D. melanogaster
ttatttccattca

SEQ ID NO: 664736 - DNA, 13 bp, D. melanogaster
ttatttccattgt

SEQ ID NO: 664737 - DNA, 13 bp, D. melanogaster
ttatttcccaatt

SEQ ID NO: 664738 - DNA, 13 bp, D. melanogaster
ttatttcgaaaag

SEQ ID NO: 664739 - DNA, 13 bp, D. melanogaster
ttatttcgaaaca

SEQ ID NO: 664740 - DNA, 13 bp, D. melanogaster
ttatttcgaattg

SEQ ID NO: 664741 - DNA, 13 bp, D. melanogaster
ttatttcgatatt

SEQ ID NO: 664742 - DNA, 14 bp, D. melanogaster
ttatttcgattttg

SEQ ID NO: 664743 - DNA, 13 bp, D. melanogaster
ttatttcgccatt

SEQ ID NO: 664744 - DNA, 13 bp, D. melanogaster
ttatttcgctttg

SEQ ID NO: 664745 - DNA, 13 bp, D. melanogaster
ttatttcggaaaa

SEQ ID NO: 664746 - DNA, 13 bp, D. melanogaster
ttatttcgtttcc

SEQ ID NO: 664747 - DNA, 13 bp, D. melanogaster
ttatttcgtttcg

SEQ ID NO: 664748 - DNA, 13 bp, D. melanogaster
ttatttcgtttgc

SEQ ID NO: 664749 - DNA, 14 bp, D. melanogaster
ttatttcgtttgcc

SEQ ID NO: 664750 - DNA, 13 bp, D. melanogaster
ttatttctctaaa

SEQ ID NO: 664751 - DNA, 13 bp, D. melanogaster
ttatttctggctt

SEQ ID NO: 664752 - DNA, 13 bp, D. melanogaster
ttatttcttacaa

SEQ ID NO: 664753 - DNA, 13 bp, D. melanogaster
ttatttcttcaaa

SEQ ID NO: 664754 - DNA, 13 bp, D. melanogaster
ttatttgaaatac

SEQ ID NO: 664755 - DNA, 14 bp, D. melanogaster
ttatttgaacattt

SEQ ID NO: 664756 - DNA, 13 bp, D. melanogaster
ttatttgaattca

SEQ ID NO: 664757 - DNA, 13 bp, D. melanogaster
ttatttgatttac

SEQ ID NO: 664758 - DNA, 13 bp, D. melanogaster
ttatttgatttgc

SEQ ID NO: 664759 - DNA, 13 bp, D. melanogaster
ttatttgcaattg

SEQ ID NO: 664760 - DNA, 13 bp, D. melanogaster
ttatttgcacctc

SEQ ID NO: 664761 - DNA, 13 bp, D. melanogaster
ttatttgcataac

SEQ ID NO: 664762 - DNA, 13 bp, D. melanogaster
ttatttgcataag

SEQ ID NO: 664763 - DNA, 13 bp, D. melanogaster
ttatttgcatgca

SEQ ID NO: 664764 - DNA, 13 bp, D. melanogaster
ttatttgcatgcc

SEQ ID NO: 664765 - DNA, 13 bp, D. melanogaster
ttatttgcattaa

SEQ ID NO: 664766 - DNA, 13 bp, D. melanogaster
ttatttgccaagt

SEQ ID NO: 664767 - DNA, 13 bp, D. melanogaster
ttatttgccagca

SEQ ID NO: 664768 - DNA, 13 bp, D. melanogaster
ttatttgccagcc

SEQ ID NO: 664769 - DNA, 13 bp, D. melanogaster
ttatttgccagtt

SEQ ID NO: 664770 - DNA, 13 bp, D. melanogaster
ttatttgccattc

SEQ ID NO: 664771 - DNA, 13 bp, D. melanogaster
ttatttgcccagc

SEQ ID NO: 664772 - DNA, 13 bp, D. melanogaster
ttatttgcctggc

SEQ ID NO: 664773 - DNA, 13 bp, D. melanogaster
ttatttgcgattt

SEQ ID NO: 664774 - DNA, 13 bp, D. melanogaster
ttatttgctaaaa

SEQ ID NO: 664775 - DNA, 13 bp, D. melanogaster
ttatttgctcatt

SEQ ID NO: 664776 - DNA, 13 bp, D. melanogaster
ttatttgctttgc

SEQ ID NO: 664777 - DNA, 14 bp, D. melanogaster
ttatttgctttgct

SEQ ID NO: 664778 - DNA, 14 bp, D. melanogaster
ttatttggagcatt

SEQ ID NO: 664779 - DNA, 13 bp, D. melanogaster
ttatttggcaatt

SEQ ID NO: 664780 - DNA, 13 bp, D. melanogaster
ttatttggcactt

SEQ ID NO: 664781 - DNA, 13 bp, D. melanogaster
ttatttggccaaa

SEQ ID NO: 664782 - DNA, 13 bp, D. melanogaster
ttatttggccaac

SEQ ID NO: 664783 - DNA, 13 bp, D. melanogaster
ttatttggcgata

SEQ ID NO: 664784 - DNA, 13 bp, D. melanogaster
ttatttggcgttc

SEQ ID NO: 664785 - DNA, 14 bp, D. melanogaster
ttatttggcgttca

SEQ ID NO: 664786 - DNA, 13 bp, D. melanogaster
ttatttggcttaa

SEQ ID NO: 664787 - DNA, 13 bp, D. melanogaster
ttatttggctttc

SEQ ID NO: 664788 - DNA, 13 bp, D. melanogaster
ttatttgggaaat

SEQ ID NO: 664789 - DNA, 14 bp, D. melanogaster
ttatttgtaagctt

SEQ ID NO: 664790 - DNA, 13 bp, D. melanogaster
ttatttgtacaca

SEQ ID NO: 664791 - DNA, 13 bp, D. melanogaster
ttatttgtatatc

SEQ ID NO: 664792 - DNA, 14 bp, D. melanogaster
ttatttgtatatca

SEQ ID NO: 664793 - DNA, 13 bp, D. melanogaster
ttatttgtattcc

SEQ ID NO: 664794 - DNA, 13 bp, D. melanogaster
ttatttgtgtgcc

SEQ ID NO: 664795 - DNA, 13 bp, D. melanogaster
ttatttgttgcat

SEQ ID NO: 664796 - DNA, 13 bp, D. melanogaster
ttattttaaaacc

SEQ ID NO: 664797 - DNA, 13 bp, D. melanogaster
ttattttaaaccc

SEQ ID NO: 664798 - DNA, 13 bp, D. melanogaster
ttattttaagcaa

SEQ ID NO: 664799 - DNA, 13 bp, D. melanogaster
ttattttaagcac

SEQ ID NO: 664800 - DNA, 14 bp, D. melanogaster
ttattttaatttgc

SEQ ID NO: 664801 - DNA, 13 bp, D. melanogaster
ttattttacaaca

SEQ ID NO: 664802 - DNA, 13 bp, D. melanogaster
ttattttaccgca

SEQ ID NO: 664803 - DNA, 13 bp, D. melanogaster
ttattttagcatt

SEQ ID NO: 664804 - DNA, 14 bp, D. melanogaster
ttattttatttgcc

SEQ ID NO: 664805 - DNA, 13 bp, D. melanogaster
ttattttcaagat

SEQ ID NO: 664806 - DNA, 13 bp, D. melanogaster
ttattttcaagta

SEQ ID NO: 664807 - DNA, 13 bp, D. melanogaster
ttattttcagctc

SEQ ID NO: 664808 - DNA, 13 bp, D. melanogaster
ttattttcagtgt

SEQ ID NO: 664809 - DNA, 14 bp, D. melanogaster
ttattttcagtgta

SEQ ID NO: 664810 - DNA, 13 bp, D. melanogaster
ttattttcataca

SEQ ID NO: 664811 - DNA, 13 bp, D. melanogaster
ttattttcattga

SEQ ID NO: 664812 - DNA, 13 bp, D. melanogaster
ttattttccaaaa

SEQ ID NO: 664813 - DNA, 13 bp, D. melanogaster
ttattttccaaat

SEQ ID NO: 664814 - DNA, 13 bp, D. melanogaster
ttattttccaata

SEQ ID NO: 664815 - DNA, 13 bp, D. melanogaster
ttattttccacct

SEQ ID NO: 664816 - DNA, 13 bp, D. melanogaster
ttattttccactc

SEQ ID NO: 664817 - DNA, 13 bp, D. melanogaster
ttattttcccatc

SEQ ID NO: 664818 - DNA, 13 bp, D. melanogaster
ttattttccccat

SEQ ID NO: 664819 - DNA, 13 bp, D. melanogaster
ttattttccctgt

SEQ ID NO: 664820 - DNA, 13 bp, D. melanogaster
ttattttccgctg

SEQ ID NO: 664821 - DNA, 13 bp, D. melanogaster
ttattttcgaatt

SEQ ID NO: 664822 - DNA, 13 bp, D. melanogaster
ttattttcgccaa

SEQ ID NO: 664823 - DNA, 13 bp, D. melanogaster
ttattttcggagt

SEQ ID NO: 664824 - DNA, 13 bp, D. melanogaster
ttattttcggatt

SEQ ID NO: 664825 - DNA, 13 bp, D. melanogaster
ttattttcgtaaa

SEQ ID NO: 664826 - DNA, 13 bp, D. melanogaster
ttattttcgtaat

SEQ ID NO: 664827 - DNA, 13 bp, D. melanogaster
ttattttcgtggc

SEQ ID NO: 664828 - DNA, 13 bp, D. melanogaster
ttattttcgttca

SEQ ID NO: 664829 - DNA, 13 bp, D. melanogaster
ttattttcgttgc

SEQ ID NO: 664830 - DNA, 13 bp, D. melanogaster
ttattttctacaa

SEQ ID NO: 664831 - DNA, 13 bp, D. melanogaster
ttattttgaacag

SEQ ID NO: 664832 - DNA, 14 bp, D. melanogaster
ttattttgaacagg

SEQ ID NO: 664833 - DNA, 13 bp, D. melanogaster
ttattttgaccaa

SEQ ID NO: 664834 - DNA, 13 bp, D. melanogaster
ttattttgattac

SEQ ID NO: 664835 - DNA, 13 bp, D. melanogaster
ttattttgcaatt

SEQ ID NO: 664836 - DNA, 13 bp, D. melanogaster
ttattttgcacaa

SEQ ID NO: 664837 - DNA, 13 bp, D. melanogaster
ttattttgcactc

SEQ ID NO: 664838 - DNA, 13 bp, D. melanogaster
ttattttgcagct

SEQ ID NO: 664839 - DNA, 13 bp, D. melanogaster
ttattttgcataa

SEQ ID NO: 664840 - DNA, 13 bp, D. melanogaster
ttattttgccatt

SEQ ID NO: 664841 - DNA, 13 bp, D. melanogaster
ttattttgcggtt

SEQ ID NO: 664842 - DNA, 13 bp, D. melanogaster
ttattttgctggc

SEQ ID NO: 664843 - DNA, 13 bp, D. melanogaster
ttattttggaata

SEQ ID NO: 664844 - DNA, 13 bp, D. melanogaster
ttattttggcaat

SEQ ID NO: 664845 - DNA, 13 bp, D. melanogaster
ttattttggccaa

SEQ ID NO: 664846 - DNA, 13 bp, D. melanogaster
ttattttggccac

SEQ ID NO: 664847 - DNA, 13 bp, D. melanogaster
ttattttggctgc

SEQ ID NO: 664848 - DNA, 13 bp, D. melanogaster
ttattttgggcaa

SEQ ID NO: 664849 - DNA, 13 bp, D. melanogaster
ttattttgtaaac

SEQ ID NO: 664850 - DNA, 13 bp, D. melanogaster
ttattttgtaaga

SEQ ID NO: 664851 - DNA, 13 bp, D. melanogaster
ttattttgtgatc

SEQ ID NO: 664852 - DNA, 13 bp, D. melanogaster
ttattttgtggcc

SEQ ID NO: 664853 - DNA, 13 bp, D. melanogaster
ttatttttaaggc

SEQ ID NO: 664854 - DNA, 13 bp, D. melanogaster
ttatttttaagtc

SEQ ID NO: 664855 - DNA, 13 bp, D. melanogaster
ttatttttagacg

SEQ ID NO: 664856 - DNA, 13 bp, D. melanogaster
ttatttttagact

SEQ ID NO: 664857 - DNA, 13 bp, D. melanogaster
ttatttttagccc

SEQ ID NO: 664858 - DNA, 13 bp, D. melanogaster
ttatttttagccg

SEQ ID NO: 664859 - DNA, 13 bp, D. melanogaster
ttatttttatgcg

SEQ ID NO: 664860 - DNA, 14 bp, D. melanogaster
ttatttttatggcc

SEQ ID NO: 664861 - DNA, 14 bp, D. melanogaster
ttatttttatgtgc

SEQ ID NO: 664862 - DNA, 13 bp, D. melanogaster
ttatttttcaaca

SEQ ID NO: 664863 - DNA, 13 bp, D. melanogaster
ttatttttcaaga

SEQ ID NO: 664864 - DNA, 14 bp, D. melanogaster
ttatttttccaaaa

SEQ ID NO: 664865 - DNA, 13 bp, D. melanogaster
ttatttttccacc

SEQ ID NO: 664866 - DNA, 13 bp, D. melanogaster
ttatttttcccca

SEQ ID NO: 664867 - DNA, 13 bp, D. melanogaster
ttatttttcgcaa

SEQ ID NO: 664868 - DNA, 13 bp, D. melanogaster
ttatttttcgcat

SEQ ID NO: 664869 - DNA, 13 bp, D. melanogaster
ttatttttcgcca

SEQ ID NO: 664870 - DNA, 13 bp, D. melanogaster
ttatttttctcag

SEQ ID NO: 664871 - DNA, 13 bp, D. melanogaster
ttatttttgcata

SEQ ID NO: 664872 - DNA, 13 bp, D. melanogaster
ttatttttgcgaa

SEQ ID NO: 664873 - DNA, 13 bp, D. melanogaster
ttatttttgctaa

SEQ ID NO: 664874 - DNA, 13 bp, D. melanogaster
ttatttttgctgc

SEQ ID NO: 664875 - DNA, 13 bp, D. melanogaster
ttattttttacag

SEQ ID NO: 664876 - DNA, 13 bp, D. melanogaster
ttattttttcaga

SEQ ID NO: 664877 - DNA, 13 bp, D. melanogaster
ttattttttcgca

SEQ ID NO: 664878 - DNA, 13 bp, D. melanogaster
ttattttttggca

SEQ ID NO: 664879 - DNA, 14 bp, D. melanogaster
ttattttttggcaa

SEQ ID NO: 664880 - DNA, 13 bp, D. melanogaster
ttcaaaaaaggtt

SEQ ID NO: 664881 - DNA, 14 bp, D. melanogaster
ttcaaaaaatactt

SEQ ID NO: 664882 - DNA, 13 bp, D. melanogaster
ttcaaaaaattca

SEQ ID NO: 664883 - DNA, 13 bp, D. melanogaster
ttcaaaaacaatt

SEQ ID NO: 664884 - DNA, 13 bp, D. melanogaster
ttcaaaaaccaac

SEQ ID NO: 664885 - DNA, 13 bp, D. melanogaster
ttcaaaaacttta

SEQ ID NO: 664886 - DNA, 14 bp, D. melanogaster
ttcaaaaagtattt

SEQ ID NO: 664887 - DNA, 13 bp, D. melanogaster
ttcaaaaagtgtt

SEQ ID NO: 664888 - DNA, 13 bp, D. melanogaster
ttcaaaaataact

SEQ ID NO: 664889 - DNA, 14 bp, D. melanogaster
ttcaaaaataatct

SEQ ID NO: 664890 - DNA, 13 bp, D. melanogaster
ttcaaaaatagtt

SEQ ID NO: 664891 - DNA, 13 bp, D. melanogaster
ttcaaaaatattc

SEQ ID NO: 664892 - DNA, 14 bp, D. melanogaster
ttcaaaaatatttg

SEQ ID NO: 664893 - DNA, 13 bp, D. melanogaster
ttcaaaaatgcaa

SEQ ID NO: 664894 - DNA, 13 bp, D. melanogaster
ttcaaaaatggaa

SEQ ID NO: 664895 - DNA, 14 bp, D. melanogaster
ttcaaaaatggaaa

SEQ ID NO: 664896 - DNA, 13 bp, D. melanogaster
ttcaaaaatgtaa

SEQ ID NO: 664897 - DNA, 13 bp, D. melanogaster
ttcaaaaatgtat

SEQ ID NO: 664898 - DNA, 14 bp, D. melanogaster
ttcaaaaatgtatt

SEQ ID NO: 664899 - DNA, 13 bp, D. melanogaster
ttcaaaaatgtgg

SEQ ID NO: 664900 - DNA, 13 bp, D. melanogaster
ttcaaaaatgtgt

SEQ ID NO: 664901 - DNA, 13 bp, D. melanogaster
ttcaaaaatgttt

SEQ ID NO: 664902 - DNA, 14 bp, D. melanogaster
ttcaaaaattcgat

SEQ ID NO: 664903 - DNA, 13 bp, D. melanogaster
ttcaaaaattgaa

SEQ ID NO: 664904 - DNA, 13 bp, D. melanogaster
ttcaaaaattgat

SEQ ID NO: 664905 - DNA, 13 bp, D. melanogaster
ttcaaaaattggt

SEQ ID NO: 664906 - DNA, 13 bp, D. melanogaster
ttcaaaaatttgt

SEQ ID NO: 664907 - DNA, 13 bp, D. melanogaster
ttcaaaaattttc

SEQ ID NO: 664908 - DNA, 13 bp, D. melanogaster
ttcaaaacaagtt

SEQ ID NO: 664909 - DNA, 13 bp, D. melanogaster
ttcaaaacaatat

SEQ ID NO: 664910 - DNA, 13 bp, D. melanogaster
ttcaaaacatttt

SEQ ID NO: 664911 - DNA, 13 bp, D. melanogaster
ttcaaaaccaatt

SEQ ID NO: 664912 - DNA, 13 bp, D. melanogaster
ttcaaaaccattt

SEQ ID NO: 664913 - DNA, 13 bp, D. melanogaster
ttcaaaacgaaaa

SEQ ID NO: 664914 - DNA, 13 bp, D. melanogaster
ttcaaaacgaaag

SEQ ID NO: 664915 - DNA, 13 bp, D. melanogaster
ttcaaaactaatt

SEQ ID NO: 664916 - DNA, 13 bp, D. melanogaster
ttcaaaactatat

SEQ ID NO: 664917 - DNA, 13 bp, D. melanogaster
ttcaaaactattt

SEQ ID NO: 664918 - DNA, 13 bp, D. melanogaster
ttcaaaagaaatt

SEQ ID NO: 664919 - DNA, 13 bp, D. melanogaster
ttcaaaagaatat

SEQ ID NO: 664920 - DNA, 13 bp, D. melanogaster
ttcaaaagcagta

SEQ ID NO: 664921 - DNA, 13 bp, D. melanogaster
ttcaaaagcattt

SEQ ID NO: 664922 - DNA, 13 bp, D. melanogaster
ttcaaaagccgga

SEQ ID NO: 664923 - DNA, 13 bp, D. melanogaster
ttcaaaagctttt

SEQ ID NO: 664924 - DNA, 14 bp, D. melanogaster
ttcaaaaggaggga

SEQ ID NO: 664925 - DNA, 13 bp, D. melanogaster
ttcaaaaggtttt

SEQ ID NO: 664926 - DNA, 13 bp, D. melanogaster
ttcaaaagtcttt

SEQ ID NO: 664927 - DNA, 13 bp, D. melanogaster
ttcaaaagtgtgg

SEQ ID NO: 664928 - DNA, 13 bp, D. melanogaster
ttcaaaagtgttg

SEQ ID NO: 664929 - DNA, 13 bp, D. melanogaster
ttcaaaagtgttt

SEQ ID NO: 664930 - DNA, 13 bp, D. melanogaster
ttcaaaagttaat

SEQ ID NO: 664931 - DNA, 14 bp, D. melanogaster
ttcaaaagttaatc

SEQ ID NO: 664932 - DNA, 13 bp, D. melanogaster
ttcaaaagttatt

SEQ ID NO: 664933 - DNA, 13 bp, D. melanogaster
ttcaaaagttctt

SEQ ID NO: 664934 - DNA, 13 bp, D. melanogaster
ttcaaaataaaag

SEQ ID NO: 664935 - DNA, 13 bp, D. melanogaster
ttcaaaataaact

SEQ ID NO: 664936 - DNA, 13 bp, D. melanogaster
ttcaaaataatca

SEQ ID NO: 664937 - DNA, 13 bp, D. melanogaster
ttcaaaatagaac

SEQ ID NO: 664938 - DNA, 13 bp, D. melanogaster
ttcaaaatataag

SEQ ID NO: 664939 - DNA, 13 bp, D. melanogaster
ttcaaaatatgat

SEQ ID NO: 664940 - DNA, 14 bp, D. melanogaster
ttcaaaatatgatt

SEQ ID NO: 664941 - DNA, 13 bp, D. melanogaster
ttcaaaatatgtt

SEQ ID NO: 664942 - DNA, 13 bp, D. melanogaster
ttcaaaatattca

SEQ ID NO: 664943 - DNA, 14 bp, D. melanogaster
ttcaaaatatttga

SEQ ID NO: 664944 - DNA, 14 bp, D. melanogaster
ttcaaaatcaaatc

SEQ ID NO: 664945 - DNA, 13 bp, D. melanogaster
ttcaaaatcaatt

SEQ ID NO: 664946 - DNA, 13 bp, D. melanogaster
ttcaaaatcattg

SEQ ID NO: 664947 - DNA, 13 bp, D. melanogaster
ttcaaaatcattt

SEQ ID NO: 664948 - DNA, 13 bp, D. melanogaster
ttcaaaatcccca

SEQ ID NO: 664949 - DNA, 13 bp, D. melanogaster
ttcaaaatgaaaa

SEQ ID NO: 664950 - DNA, 13 bp, D. melanogaster
ttcaaaatgaaat

SEQ ID NO: 664951 - DNA, 13 bp, D. melanogaster
ttcaaaatgatgt

SEQ ID NO: 664952 - DNA, 13 bp, D. melanogaster
ttcaaaatgccaa

SEQ ID NO: 664953 - DNA, 13 bp, D. melanogaster
ttcaaaatggaaa

SEQ ID NO: 664954 - DNA, 13 bp, D. melanogaster
ttcaaaatgtcaa

SEQ ID NO: 664955 - DNA, 13 bp, D. melanogaster
ttcaaaatgttca

SEQ ID NO: 664956 - DNA, 13 bp, D. melanogaster
ttcaaaatgtttt

SEQ ID NO: 664957 - DNA, 13 bp, D. melanogaster
ttcaaaattaacc

SEQ ID NO: 664958 - DNA, 13 bp, D. melanogaster
ttcaaaattaact

SEQ ID NO: 664959 - DNA, 14 bp, D. melanogaster
ttcaaaattcattt

SEQ ID NO: 664960 - DNA, 13 bp, D. melanogaster
ttcaaaattctaa

SEQ ID NO: 664961 - DNA, 14 bp, D. melanogaster
ttcaaaattctaaa

SEQ ID NO: 664962 - DNA, 14 bp, D. melanogaster
ttcaaaattgaaat

SEQ ID NO: 664963 - DNA, 13 bp, D. melanogaster
ttcaaaattgaag

SEQ ID NO: 664964 - DNA, 13 bp, D. melanogaster
ttcaaaattgatt

SEQ ID NO: 664965 - DNA, 14 bp, D. melanogaster
ttcaaaattgattt

SEQ ID NO: 664966 - DNA, 13 bp, D. melanogaster
ttcaaaattgttc

SEQ ID NO: 664967 - DNA, 13 bp, D. melanogaster
ttcaaaattgttg

SEQ ID NO: 664968 - DNA, 13 bp, D. melanogaster
ttcaaaatttatg

SEQ ID NO: 664969 - DNA, 13 bp, D. melanogaster
ttcaaaatttcaa

SEQ ID NO: 664970 - DNA, 13 bp, D. melanogaster
ttcaaaatttgca

SEQ ID NO: 664971 - DNA, 13 bp, D. melanogaster
ttcaaaatttgtg

SEQ ID NO: 664972 - DNA, 14 bp, D. melanogaster
ttcaaaatttgttt

SEQ ID NO: 664973 - DNA, 14 bp, D. melanogaster
ttcaaacaaatatt

SEQ ID NO: 664974 - DNA, 13 bp, D. melanogaster
ttcaaacaaattc

SEQ ID NO: 664975 - DNA, 13 bp, D. melanogaster
ttcaaacaagttt

SEQ ID NO: 664976 - DNA, 13 bp, D. melanogaster
ttcaaacaatata

SEQ ID NO: 664977 - DNA, 13 bp, D. melanogaster
ttcaaacacaatt

SEQ ID NO: 664978 - DNA, 13 bp, D. melanogaster
ttcaaacacacac

SEQ ID NO: 664979 - DNA, 14 bp, D. melanogaster
ttcaaacacacaca

SEQ ID NO: 664980 - DNA, 13 bp, D. melanogaster
ttcaaacaccaaa

SEQ ID NO: 664981 - DNA, 13 bp, D. melanogaster
ttcaaacagttct

SEQ ID NO: 664982 - DNA, 13 bp, D. melanogaster
ttcaaacatttaa

SEQ ID NO: 664983 - DNA, 13 bp, D. melanogaster
ttcaaacatttca

SEQ ID NO: 664984 - DNA, 13 bp, D. melanogaster
ttcaaaccaaaat

SEQ ID NO: 664985 - DNA, 13 bp, D. melanogaster
ttcaaaccagtca

SEQ ID NO: 664986 - DNA, 13 bp, D. melanogaster
ttcaaaccatttt

SEQ ID NO: 664987 - DNA, 13 bp, D. melanogaster
ttcaaacgaaaaa

SEQ ID NO: 664988 - DNA, 13 bp, D. melanogaster
ttcaaacgaaatt

SEQ ID NO: 664989 - DNA, 13 bp, D. melanogaster
ttcaaacgcaaaa

SEQ ID NO: 664990 - DNA, 13 bp, D. melanogaster
ttcaaacggaatt

SEQ ID NO: 664991 - DNA, 13 bp, D. melanogaster
ttcaaacgtattt

SEQ ID NO: 664992 - DNA, 13 bp, D. melanogaster
ttcaaactcaaaa

SEQ ID NO: 664993 - DNA, 14 bp, D. melanogaster
ttcaaactcaaaat

SEQ ID NO: 664994 - DNA, 13 bp, D. melanogaster
ttcaaactcaaat

SEQ ID NO: 664995 - DNA, 13 bp, D. melanogaster
ttcaaactcattt

SEQ ID NO: 664996 - DNA, 13 bp, D. melanogaster
ttcaaactcctcc

SEQ ID NO: 664997 - DNA, 13 bp, D. melanogaster
ttcaaactgaaac

SEQ ID NO: 664998 - DNA, 13 bp, D. melanogaster
ttcaaactgattt

SEQ ID NO: 664999 - DNA, 13 bp, D. melanogaster
ttcaaactgcaac

SEQ ID NO: 665000 - DNA, 13 bp, D. melanogaster
ttcaaactttatt

SEQ ID NO: 665001 - DNA, 13 bp, D. melanogaster
ttcaaacttttgt

SEQ ID NO: 665002 - DNA, 13 bp, D. melanogaster
ttcaaagaaaaac

SEQ ID NO: 665003 - DNA, 13 bp, D. melanogaster
ttcaaagaaatca

SEQ ID NO: 665004 - DNA, 13 bp, D. melanogaster
ttcaaagaaatta

SEQ ID NO: 665005 - DNA, 13 bp, D. melanogaster
ttcaaagaatatt

SEQ ID NO: 665006 - DNA, 13 bp, D. melanogaster
ttcaaagacccca

SEQ ID NO: 665007 - DNA, 13 bp, D. melanogaster
ttcaaagactttt

SEQ ID NO: 665008 - DNA, 13 bp, D. melanogaster
ttcaaagattaaa

SEQ ID NO: 665009 - DNA, 13 bp, D. melanogaster
ttcaaagatttaa

SEQ ID NO: 665010 - DNA, 13 bp, D. melanogaster
ttcaaagatttca

SEQ ID NO: 665011 - DNA, 13 bp, D. melanogaster
ttcaaagattttt

SEQ ID NO: 665012 - DNA, 13 bp, D. melanogaster
ttcaaagccattt

SEQ ID NO: 665013 - DNA, 13 bp, D. melanogaster
ttcaaagcgtttt

SEQ ID NO: 665014 - DNA, 13 bp, D. melanogaster
ttcaaagctgttt

SEQ ID NO: 665015 - DNA, 13 bp, D. melanogaster
ttcaaagcttttt

SEQ ID NO: 665016 - DNA, 13 bp, D. melanogaster
ttcaaaggaggat

SEQ ID NO: 665017 - DNA, 13 bp, D. melanogaster
ttcaaaggcattt

SEQ ID NO: 665018 - DNA, 13 bp, D. melanogaster
ttcaaaggccttt

SEQ ID NO: 665019 - DNA, 13 bp, D. melanogaster
ttcaaaggctaag

SEQ ID NO: 665020 - DNA, 13 bp, D. melanogaster
ttcaaaggcttaa

SEQ ID NO: 665021 - DNA, 13 bp, D. melanogaster
ttcaaagggaaaa

SEQ ID NO: 665022 - DNA, 13 bp, D. melanogaster
ttcaaagtaattt

SEQ ID NO: 665023 - DNA, 13 bp, D. melanogaster
ttcaaagtcaaaa

SEQ ID NO: 665024 - DNA, 13 bp, D. melanogaster
ttcaaagtgaaat

SEQ ID NO: 665025 - DNA, 13 bp, D. melanogaster
ttcaaagtgaatt

SEQ ID NO: 665026 - DNA, 13 bp, D. melanogaster
ttcaaagtgattt

SEQ ID NO: 665027 - DNA, 13 bp, D. melanogaster
ttcaaagtgtcaa

SEQ ID NO: 665028 - DNA, 13 bp, D. melanogaster
ttcaaagttaatt

SEQ ID NO: 665029 - DNA, 13 bp, D. melanogaster
ttcaaagttattt

SEQ ID NO: 665030 - DNA, 13 bp, D. melanogaster
ttcaaagttctca

SEQ ID NO: 665031 - DNA, 13 bp, D. melanogaster
ttcaaagtttgtt

SEQ ID NO: 665032 - DNA, 13 bp, D. melanogaster
ttcaaataaatca

SEQ ID NO: 665033 - DNA, 13 bp, D. melanogaster
ttcaaataaatga

SEQ ID NO: 665034 - DNA, 13 bp, D. melanogaster
ttcaaataaatgc

SEQ ID NO: 665035 - DNA, 13 bp, D. melanogaster
ttcaaatacattt

SEQ ID NO: 665036 - DNA, 13 bp, D. melanogaster
ttcaaatactttt

SEQ ID NO: 665037 - DNA, 13 bp, D. melanogaster
ttcaaatagattt

SEQ ID NO: 665038 - DNA, 14 bp, D. melanogaster
ttcaaatatagctt

SEQ ID NO: 665039 - DNA, 13 bp, D. melanogaster
ttcaaatatatgt

SEQ ID NO: 665040 - DNA, 13 bp, D. melanogaster
ttcaaatatattc

SEQ ID NO: 665041 - DNA, 13 bp, D. melanogaster
ttcaaatatgaat

SEQ ID NO: 665042 - DNA, 13 bp, D. melanogaster
ttcaaatattaac

SEQ ID NO: 665043 - DNA, 13 bp, D. melanogaster
ttcaaatattcaa

SEQ ID NO: 665044 - DNA, 14 bp, D. melanogaster
ttcaaatattcaaa

SEQ ID NO: 665045 - DNA, 14 bp, D. melanogaster
ttcaaatatttgaa

SEQ ID NO: 665046 - DNA, 13 bp, D. melanogaster
ttcaaatatttgc

SEQ ID NO: 665047 - DNA, 13 bp, D. melanogaster
ttcaaatcaaaac

SEQ ID NO: 665048 - DNA, 13 bp, D. melanogaster
ttcaaatcaaaat

SEQ ID NO: 665049 - DNA, 13 bp, D. melanogaster
ttcaaatcaaagt

SEQ ID NO: 665050 - DNA, 14 bp, D. melanogaster
ttcaaatcaaatca

SEQ ID NO: 665051 - DNA, 13 bp, D. melanogaster
ttcaaatcaaatt

SEQ ID NO: 665052 - DNA, 13 bp, D. melanogaster
ttcaaatcaatca

SEQ ID NO: 665053 - DNA, 13 bp, D. melanogaster
ttcaaatcatttt

SEQ ID NO: 665054 - DNA, 13 bp, D. melanogaster
ttcaaatccaaat

SEQ ID NO: 665055 - DNA, 13 bp, D. melanogaster
ttcaaatccaatt

SEQ ID NO: 665056 - DNA, 13 bp, D. melanogaster
ttcaaatccattt

SEQ ID NO: 665057 - DNA, 13 bp, D. melanogaster
ttcaaatcgaaat

SEQ ID NO: 665058 - DNA, 13 bp, D. melanogaster
ttcaaatctattt

SEQ ID NO: 665059 - DNA, 13 bp, D. melanogaster
ttcaaatctgaca

SEQ ID NO: 665060 - DNA, 13 bp, D. melanogaster
ttcaaatcttaat

SEQ ID NO: 665061 - DNA, 13 bp, D. melanogaster
ttcaaatgaaagc

SEQ ID NO: 665062 - DNA, 14 bp, D. melanogaster
ttcaaatgaaatat

SEQ ID NO: 665063 - DNA, 13 bp, D. melanogaster
ttcaaatgaaatt

SEQ ID NO: 665064 - DNA, 13 bp, D. melanogaster
ttcaaatgaacaa

SEQ ID NO: 665065 - DNA, 13 bp, D. melanogaster
ttcaaatgaagtg

SEQ ID NO: 665066 - DNA, 13 bp, D. melanogaster
ttcaaatgaataa

SEQ ID NO: 665067 - DNA, 13 bp, D. melanogaster
ttcaaatgaatat

SEQ ID NO: 665068 - DNA, 13 bp, D. melanogaster
ttcaaatgaattg

SEQ ID NO: 665069 - DNA, 13 bp, D. melanogaster
ttcaaatgaattt

SEQ ID NO: 665070 - DNA, 13 bp, D. melanogaster
ttcaaatgacatt

SEQ ID NO: 665071 - DNA, 13 bp, D. melanogaster
ttcaaatgagttt

SEQ ID NO: 665072 - DNA, 13 bp, D. melanogaster
ttcaaatgcaaat

SEQ ID NO: 665073 - DNA, 13 bp, D. melanogaster
ttcaaatgcaagt

SEQ ID NO: 665074 - DNA, 13 bp, D. melanogaster
ttcaaatgcattt

SEQ ID NO: 665075 - DNA, 13 bp, D. melanogaster
ttcaaatgccaca

SEQ ID NO: 665076 - DNA, 13 bp, D. melanogaster
ttcaaatgcgaat

SEQ ID NO: 665077 - DNA, 13 bp, D. melanogaster
ttcaaatgcgaca

SEQ ID NO: 665078 - DNA, 13 bp, D. melanogaster
ttcaaatgctgaa

SEQ ID NO: 665079 - DNA, 13 bp, D. melanogaster
ttcaaatgctgcc

SEQ ID NO: 665080 - DNA, 14 bp, D. melanogaster
ttcaaatggaaaat

SEQ ID NO: 665081 - DNA, 14 bp, D. melanogaster
ttcaaatggaaatt

SEQ ID NO: 665082 - DNA, 13 bp, D. melanogaster
ttcaaatggaaca

SEQ ID NO: 665083 - DNA, 13 bp, D. melanogaster
ttcaaatggaatt

SEQ ID NO: 665084 - DNA, 13 bp, D. melanogaster
ttcaaatggatat

SEQ ID NO: 665085 - DNA, 13 bp, D. melanogaster
ttcaaatggcttt

SEQ ID NO: 665086 - DNA, 13 bp, D. melanogaster
ttcaaatggtgga

SEQ ID NO: 665087 - DNA, 13 bp, D. melanogaster
ttcaaatggtttt

SEQ ID NO: 665088 - DNA, 13 bp, D. melanogaster
ttcaaatgtaaat

SEQ ID NO: 665089 - DNA, 13 bp, D. melanogaster
ttcaaatgtaatt

SEQ ID NO: 665090 - DNA, 13 bp, D. melanogaster
ttcaaatgtattt

SEQ ID NO: 665091 - DNA, 14 bp, D. melanogaster
ttcaaatgtatttt

SEQ ID NO: 665092 - DNA, 13 bp, D. melanogaster
ttcaaatgtggaa

SEQ ID NO: 665093 - DNA, 13 bp, D. melanogaster
ttcaaatgttgat

SEQ ID NO: 665094 - DNA, 13 bp, D. melanogaster
ttcaaattaaaga

SEQ ID NO: 665095 - DNA, 13 bp, D. melanogaster
ttcaaattaaatc

SEQ ID NO: 665096 - DNA, 13 bp, D. melanogaster
ttcaaattactta

SEQ ID NO: 665097 - DNA, 13 bp, D. melanogaster
ttcaaattagttt

SEQ ID NO: 665098 - DNA, 14 bp, D. melanogaster
ttcaaattagtttt

SEQ ID NO: 665099 - DNA, 13 bp, D. melanogaster
ttcaaattatttg

SEQ ID NO: 665100 - DNA, 13 bp, D. melanogaster
ttcaaattcaaaa

SEQ ID NO: 665101 - DNA, 13 bp, D. melanogaster
ttcaaattcaaat

SEQ ID NO: 665102 - DNA, 14 bp, D. melanogaster
ttcaaattcaaata

SEQ ID NO: 665103 - DNA, 13 bp, D. melanogaster
ttcaaattcaata

SEQ ID NO: 665104 - DNA, 13 bp, D. melanogaster
ttcaaattcaatt

SEQ ID NO: 665105 - DNA, 13 bp, D. melanogaster
ttcaaattcagat

SEQ ID NO: 665106 - DNA, 13 bp, D. melanogaster
ttcaaattcctca

SEQ ID NO: 665107 - DNA, 13 bp, D. melanogaster
ttcaaattccttt

SEQ ID NO: 665108 - DNA, 13 bp, D. melanogaster
ttcaaattcgaaa

SEQ ID NO: 665109 - DNA, 14 bp, D. melanogaster
ttcaaattcgaaat

SEQ ID NO: 665110 - DNA, 13 bp, D. melanogaster
ttcaaattcgatt

SEQ ID NO: 665111 - DNA, 13 bp, D. melanogaster
ttcaaattcgcaa

SEQ ID NO: 665112 - DNA, 13 bp, D. melanogaster
ttcaaattgaaaa

SEQ ID NO: 665113 - DNA, 14 bp, D. melanogaster
ttcaaattgaaaat

SEQ ID NO: 665114 - DNA, 13 bp, D. melanogaster
ttcaaattgaaca

SEQ ID NO: 665115 - DNA, 13 bp, D. melanogaster
ttcaaattgaata

SEQ ID NO: 665116 - DNA, 13 bp, D. melanogaster
ttcaaattgaatg

SEQ ID NO: 665117 - DNA, 14 bp, D. melanogaster
ttcaaattgaattt

SEQ ID NO: 665118 - DNA, 13 bp, D. melanogaster
ttcaaattgatat

SEQ ID NO: 665119 - DNA, 13 bp, D. melanogaster
ttcaaattgatta

SEQ ID NO: 665120 - DNA, 13 bp, D. melanogaster
ttcaaattgattg

SEQ ID NO: 665121 - DNA, 13 bp, D. melanogaster
ttcaaattgattt

SEQ ID NO: 665122 - DNA, 13 bp, D. melanogaster
ttcaaattgcaat

SEQ ID NO: 665123 - DNA, 13 bp, D. melanogaster
ttcaaattgctga

SEQ ID NO: 665124 - DNA, 13 bp, D. melanogaster
ttcaaattggaaa

SEQ ID NO: 665125 - DNA, 13 bp, D. melanogaster
ttcaaattggatt

SEQ ID NO: 665126 - DNA, 13 bp, D. melanogaster
ttcaaattggcaa

SEQ ID NO: 665127 - DNA, 13 bp, D. melanogaster
ttcaaattgtttt

SEQ ID NO: 665128 - DNA, 14 bp, D. melanogaster
ttcaaatttaaatg

SEQ ID NO: 665129 - DNA, 13 bp, D. melanogaster
ttcaaatttaaca

SEQ ID NO: 665130 - DNA, 13 bp, D. melanogaster
ttcaaatttactt

SEQ ID NO: 665131 - DNA, 13 bp, D. melanogaster
ttcaaatttattc

SEQ ID NO: 665132 - DNA, 13 bp, D. melanogaster
ttcaaatttcaaa

SEQ ID NO: 665133 - DNA, 14 bp, D. melanogaster
ttcaaatttcaaaa

SEQ ID NO: 665134 - DNA, 14 bp, D. melanogaster
ttcaaatttcaatt

SEQ ID NO: 665135 - DNA, 13 bp, D. melanogaster
ttcaaatttccca

SEQ ID NO: 665136 - DNA, 13 bp, D. melanogaster
ttcaaatttcgaa

SEQ ID NO: 665137 - DNA, 13 bp, D. melanogaster
ttcaaatttcgat

SEQ ID NO: 665138 - DNA, 13 bp, D. melanogaster
ttcaaatttgaaa

SEQ ID NO: 665139 - DNA, 13 bp, D. melanogaster
ttcaaatttgatt

SEQ ID NO: 665140 - DNA, 13 bp, D. melanogaster
ttcaaatttgcat

SEQ ID NO: 665141 - DNA, 13 bp, D. melanogaster
ttcaaatttggta

SEQ ID NO: 665142 - DNA, 13 bp, D. melanogaster
ttcaaattttatg

SEQ ID NO: 665143 - DNA, 14 bp, D. melanogaster
ttcaaattttcaaa

SEQ ID NO: 665144 - DNA, 13 bp, D. melanogaster
ttcaaattttcac

SEQ ID NO: 665145 - DNA, 13 bp, D. melanogaster
ttcaaattttcag

SEQ ID NO: 665146 - DNA, 13 bp, D. melanogaster
ttcaaattttctg

SEQ ID NO: 665147 - DNA, 13 bp, D. melanogaster
ttcaaattttgat

SEQ ID NO: 665148 - DNA, 13 bp, D. melanogaster
ttcaaattttgtc

SEQ ID NO: 665149 - DNA, 14 bp, D. melanogaster
ttcaaatttttaac

SEQ ID NO: 665150 - DNA, 13 bp, D. melanogaster
ttcaaatttttag

SEQ ID NO: 665151 - DNA, 13 bp, D. melanogaster
ttcaaatttttgt

SEQ ID NO: 665152 - DNA, 13 bp, D. melanogaster
ttcaaattttttg

SEQ ID NO: 665153 - DNA, 13 bp, D. melanogaster
ttcaacaaaaagt

SEQ ID NO: 665154 - DNA, 13 bp, D. melanogaster
ttcaacaaaaatt

SEQ ID NO: 665155 - DNA, 13 bp, D. melanogaster
ttcaacaaaatat

SEQ ID NO: 665156 - DNA, 13 bp, D. melanogaster
ttcaacaaaatta

SEQ ID NO: 665157 - DNA, 13 bp, D. melanogaster
ttcaacaaacaat

SEQ ID NO: 665158 - DNA, 13 bp, D. melanogaster
ttcaacaaatatt

SEQ ID NO: 665159 - DNA, 13 bp, D. melanogaster
ttcaacaaattat

SEQ ID NO: 665160 - DNA, 13 bp, D. melanogaster
ttcaacaaattga

SEQ ID NO: 665161 - DNA, 13 bp, D. melanogaster
ttcaacaacaatt

SEQ ID NO: 665162 - DNA, 13 bp, D. melanogaster
ttcaacaactttt

SEQ ID NO: 665163 - DNA, 13 bp, D. melanogaster
ttcaacaagaaat

SEQ ID NO: 665164 - DNA, 13 bp, D. melanogaster
ttcaacaaggtat

SEQ ID NO: 665165 - DNA, 13 bp, D. melanogaster
ttcaacaagtttt

SEQ ID NO: 665166 - DNA, 13 bp, D. melanogaster
ttcaacaatattt

SEQ ID NO: 665167 - DNA, 13 bp, D. melanogaster
ttcaacaatttat

SEQ ID NO: 665168 - DNA, 13 bp, D. melanogaster
ttcaacaatttca

SEQ ID NO: 665169 - DNA, 13 bp, D. melanogaster
ttcaacaatttgt

SEQ ID NO: 665170 - DNA, 14 bp, D. melanogaster
ttcaacaatttgtt

SEQ ID NO: 665171 - DNA, 13 bp, D. melanogaster
ttcaacaattttc

SEQ ID NO: 665172 - DNA, 13 bp, D. melanogaster
ttcaacacgaccc

SEQ ID NO: 665173 - DNA, 13 bp, D. melanogaster
ttcaacaggcatt

SEQ ID NO: 665174 - DNA, 13 bp, D. melanogaster
ttcaacatatatt

SEQ ID NO: 665175 - DNA, 13 bp, D. melanogaster
ttcaacatttcca

SEQ ID NO: 665176 - DNA, 13 bp, D. melanogaster
ttcaacattttaa

SEQ ID NO: 665177 - DNA, 13 bp, D. melanogaster
ttcaacattttat

SEQ ID NO: 665178 - DNA, 13 bp, D. melanogaster
ttcaacattttct

SEQ ID NO: 665179 - DNA, 13 bp, D. melanogaster
ttcaacattttgc

SEQ ID NO: 665180 - DNA, 13 bp, D. melanogaster
ttcaacatttttc

SEQ ID NO: 665181 - DNA, 13 bp, D. melanogaster
ttcaaccaaaaat

SEQ ID NO: 665182 - DNA, 13 bp, D. melanogaster
ttcaaccaaatca

SEQ ID NO: 665183 - DNA, 13 bp, D. melanogaster
ttcaacccgaaaa

SEQ ID NO: 665184 - DNA, 13 bp, D. melanogaster
ttcaacctgacga

SEQ ID NO: 665185 - DNA, 13 bp, D. melanogaster
ttcaacgaattta

SEQ ID NO: 665186 - DNA, 14 bp, D. melanogaster
ttcaacgaatttag

SEQ ID NO: 665187 - DNA, 13 bp, D. melanogaster
ttcaacgaatttt

SEQ ID NO: 665188 - DNA, 13 bp, D. melanogaster
ttcaacgaggtat

SEQ ID NO: 665189 - DNA, 13 bp, D. melanogaster
ttcaacgatcttt

SEQ ID NO: 665190 - DNA, 13 bp, D. melanogaster
ttcaacgattttt

SEQ ID NO: 665191 - DNA, 13 bp, D. melanogaster
ttcaactaatttg

SEQ ID NO: 665192 - DNA, 13 bp, D. melanogaster
ttcaactatattt

SEQ ID NO: 665193 - DNA, 13 bp, D. melanogaster
ttcaactatttaa

SEQ ID NO: 665194 - DNA, 13 bp, D. melanogaster
ttcaactcaattt

SEQ ID NO: 665195 - DNA, 13 bp, D. melanogaster
ttcaactgcaact

SEQ ID NO: 665196 - DNA, 13 bp, D. melanogaster
ttcaacttattta

SEQ ID NO: 665197 - DNA, 13 bp, D. melanogaster
ttcaacttcaact

SEQ ID NO: 665198 - DNA, 14 bp, D. melanogaster
ttcaacttcaactt

SEQ ID NO: 665199 - DNA, 13 bp, D. melanogaster
ttcaacttcacct

SEQ ID NO: 665200 - DNA, 13 bp, D. melanogaster
ttcaacttcattt

SEQ ID NO: 665201 - DNA, 13 bp, D. melanogaster
ttcaacttcgact

SEQ ID NO: 665202 - DNA, 13 bp, D. melanogaster
ttcaacttcgatg

SEQ ID NO: 665203 - DNA, 14 bp, D. melanogaster
ttcaacttcgatgc

SEQ ID NO: 665204 - DNA, 13 bp, D. melanogaster
ttcaacttcttgt

SEQ ID NO: 665205 - DNA, 14 bp, D. melanogaster
ttcaacttcttgta

SEQ ID NO: 665206 - DNA, 13 bp, D. melanogaster
ttcaacttgaact

SEQ ID NO: 665207 - DNA, 13 bp, D. melanogaster
ttcaacttggatt

SEQ ID NO: 665208 - DNA, 13 bp, D. melanogaster
ttcaacttgttta

SEQ ID NO: 665209 - DNA, 13 bp, D. melanogaster
ttcaactttaaaa

SEQ ID NO: 665210 - DNA, 13 bp, D. melanogaster
ttcaactttaact

SEQ ID NO: 665211 - DNA, 13 bp, D. melanogaster
ttcaactttcaaa

SEQ ID NO: 665212 - DNA, 13 bp, D. melanogaster
ttcaactttgatt

SEQ ID NO: 665213 - DNA, 13 bp, D. melanogaster
ttcaactttgtgt

SEQ ID NO: 665214 - DNA, 14 bp, D. melanogaster
ttcaactttgtgtg

SEQ ID NO: 665215 - DNA, 13 bp, D. melanogaster
ttcaacttttcat

SEQ ID NO: 665216 - DNA, 13 bp, D. melanogaster
ttcaacttttcca

SEQ ID NO: 665217 - DNA, 13 bp, D. melanogaster
ttcaacttttgtt

SEQ ID NO: 665218 - DNA, 13 bp, D. melanogaster
ttcaactttttgc

SEQ ID NO: 665219 - DNA, 13 bp, D. melanogaster
ttcaacttttttg

SEQ ID NO: 665220 - DNA, 13 bp, D. melanogaster
ttcaagaaaagat

SEQ ID NO: 665221 - DNA, 13 bp, D. melanogaster
ttcaagaaaatat

SEQ ID NO: 665222 - DNA, 13 bp, D. melanogaster
ttcaagaaattaa

SEQ ID NO: 665223 - DNA, 13 bp, D. melanogaster
ttcaagaaattta

SEQ ID NO: 665224 - DNA, 13 bp, D. melanogaster
ttcaagaactttt

SEQ ID NO: 665225 - DNA, 13 bp, D. melanogaster
ttcaagaagcttt

SEQ ID NO: 665226 - DNA, 13 bp, D. melanogaster
ttcaagaagtttt

SEQ ID NO: 665227 - DNA, 13 bp, D. melanogaster
ttcaagaatatat

SEQ ID NO: 665228 - DNA, 13 bp, D. melanogaster
ttcaagaccaaaa

SEQ ID NO: 665229 - DNA, 13 bp, D. melanogaster
ttcaagaccagaa

SEQ ID NO: 665230 - DNA, 14 bp, D. melanogaster
ttcaagaccagaaa

SEQ ID NO: 665231 - DNA, 13 bp, D. melanogaster
ttcaagagtttcc

SEQ ID NO: 665232 - DNA, 13 bp, D. melanogaster
ttcaagcaaactt

SEQ ID NO: 665233 - DNA, 14 bp, D. melanogaster
ttcaagcaggcatt

SEQ ID NO: 665234 - DNA, 13 bp, D. melanogaster
ttcaagcatttca

SEQ ID NO: 665235 - DNA, 13 bp, D. melanogaster
ttcaagcattttg

SEQ ID NO: 665236 - DNA, 13 bp, D. melanogaster
ttcaagccatcgc

SEQ ID NO: 665237 - DNA, 13 bp, D. melanogaster
ttcaagcggttaa

SEQ ID NO: 665238 - DNA, 13 bp, D. melanogaster
ttcaagctatctg

SEQ ID NO: 665239 - DNA, 13 bp, D. melanogaster
ttcaagctcaatc

SEQ ID NO: 665240 - DNA, 13 bp, D. melanogaster
ttcaagctgaaaa

SEQ ID NO: 665241 - DNA, 13 bp, D. melanogaster
ttcaaggatatat

SEQ ID NO: 665242 - DNA, 13 bp, D. melanogaster
ttcaagggaaatt

SEQ ID NO: 665243 - DNA, 13 bp, D. melanogaster
ttcaaggtcccct

SEQ ID NO: 665244 - DNA, 13 bp, D. melanogaster
ttcaaggtttaat

SEQ ID NO: 665245 - DNA, 13 bp, D. melanogaster
ttcaagtatttat

SEQ ID NO: 665246 - DNA, 13 bp, D. melanogaster
ttcaagtgcaaaa

SEQ ID NO: 665247 - DNA, 13 bp, D. melanogaster
ttcaagtgcaaat

SEQ ID NO: 665248 - DNA, 13 bp, D. melanogaster
ttcaagtgcaact

SEQ ID NO: 665249 - DNA, 13 bp, D. melanogaster
ttcaagtgcaagt

SEQ ID NO: 665250 - DNA, 13 bp, D. melanogaster
ttcaagtgcaatt

SEQ ID NO: 665251 - DNA, 13 bp, D. melanogaster
ttcaagtgcagca

SEQ ID NO: 665252 - DNA, 13 bp, D. melanogaster
ttcaagtgcagtt

SEQ ID NO: 665253 - DNA, 13 bp, D. melanogaster
ttcaagtgccaaa

SEQ ID NO: 665254 - DNA, 13 bp, D. melanogaster
ttcaagtggaaaa

SEQ ID NO: 665255 - DNA, 13 bp, D. melanogaster
ttcaagtggattt

SEQ ID NO: 665256 - DNA, 13 bp, D. melanogaster
ttcaagtggcaaa

SEQ ID NO: 665257 - DNA, 13 bp, D. melanogaster
ttcaagtggcaca

SEQ ID NO: 665258 - DNA, 13 bp, D. melanogaster
ttcaagtggcagc

SEQ ID NO: 665259 - DNA, 13 bp, D. melanogaster
ttcaagtggcttt

SEQ ID NO: 665260 - DNA, 13 bp, D. melanogaster
ttcaagtggtttt

SEQ ID NO: 665261 - DNA, 13 bp, D. melanogaster
ttcaagtgtcatt

SEQ ID NO: 665262 - DNA, 13 bp, D. melanogaster
ttcaagtgtttaa

SEQ ID NO: 665263 - DNA, 13 bp, D. melanogaster
ttcaagttaaatg

SEQ ID NO: 665264 - DNA, 13 bp, D. melanogaster
ttcaagttattta

SEQ ID NO: 665265 - DNA, 14 bp, D. melanogaster
ttcaagttatttaa

SEQ ID NO: 665266 - DNA, 13 bp, D. melanogaster
ttcaagttatttt

SEQ ID NO: 665267 - DNA, 13 bp, D. melanogaster
ttcaagttcaaaa

SEQ ID NO: 665268 - DNA, 13 bp, D. melanogaster
ttcaagttcaagt

SEQ ID NO: 665269 - DNA, 13 bp, D. melanogaster
ttcaagttcatta

SEQ ID NO: 665270 - DNA, 13 bp, D. melanogaster
ttcaagttgaaaa

SEQ ID NO: 665271 - DNA, 13 bp, D. melanogaster
ttcaagttgaagt

SEQ ID NO: 665272 - DNA, 13 bp, D. melanogaster
ttcaagttgattt

SEQ ID NO: 665273 - DNA, 13 bp, D. melanogaster
ttcaagttgccgc

SEQ ID NO: 665274 - DNA, 14 bp, D. melanogaster
ttcaagttgccgct

SEQ ID NO: 665275 - DNA, 13 bp, D. melanogaster
ttcaagttgtttg

SEQ ID NO: 665276 - DNA, 13 bp, D. melanogaster
ttcaagtttattg

SEQ ID NO: 665277 - DNA, 13 bp, D. melanogaster
ttcaagtttgtcg

SEQ ID NO: 665278 - DNA, 13 bp, D. melanogaster
ttcaagtttgttt

SEQ ID NO: 665279 - DNA, 13 bp, D. melanogaster
ttcaagttttaaa

SEQ ID NO: 665280 - DNA, 13 bp, D. melanogaster
ttcaagttttaag

SEQ ID NO: 665281 - DNA, 13 bp, D. melanogaster
ttcaagttttaat

SEQ ID NO: 665282 - DNA, 13 bp, D. melanogaster
ttcaataaaaagt

SEQ ID NO: 665283 - DNA, 13 bp, D. melanogaster
ttcaataaacatt

SEQ ID NO: 665284 - DNA, 13 bp, D. melanogaster
ttcaataaacttt

SEQ ID NO: 665285 - DNA, 14 bp, D. melanogaster
ttcaataaactttt

SEQ ID NO: 665286 - DNA, 13 bp, D. melanogaster
ttcaataaagaaa

SEQ ID NO: 665287 - DNA, 13 bp, D. melanogaster
ttcaataaagaat

SEQ ID NO: 665288 - DNA, 13 bp, D. melanogaster
ttcaataaataca

SEQ ID NO: 665289 - DNA, 13 bp, D. melanogaster
ttcaataaatgta

SEQ ID NO: 665290 - DNA, 13 bp, D. melanogaster
ttcaataagcgtt

SEQ ID NO: 665291 - DNA, 13 bp, D. melanogaster
ttcaataagttct

SEQ ID NO: 665292 - DNA, 13 bp, D. melanogaster
ttcaataatcttt

SEQ ID NO: 665293 - DNA, 13 bp, D. melanogaster
ttcaataattcat

SEQ ID NO: 665294 - DNA, 13 bp, D. melanogaster
ttcaataattgaa

SEQ ID NO: 665295 - DNA, 13 bp, D. melanogaster
ttcaataatttcc

SEQ ID NO: 665296 - DNA, 13 bp, D. melanogaster
ttcaatagaaaaa

SEQ ID NO: 665297 - DNA, 13 bp, D. melanogaster
ttcaatatcaaaa

SEQ ID NO: 665298 - DNA, 13 bp, D. melanogaster
ttcaatatgaaat

SEQ ID NO: 665299 - DNA, 13 bp, D. melanogaster
ttcaatatgaatt

SEQ ID NO: 665300 - DNA, 13 bp, D. melanogaster
ttcaatatgatgt

SEQ ID NO: 665301 - DNA, 13 bp, D. melanogaster
ttcaatatgcaaa

SEQ ID NO: 665302 - DNA, 13 bp, D. melanogaster
ttcaatatgtttg

SEQ ID NO: 665303 - DNA, 13 bp, D. melanogaster
ttcaatattcaaa

SEQ ID NO: 665304 - DNA, 13 bp, D. melanogaster
ttcaatattgaaa

SEQ ID NO: 665305 - DNA, 13 bp, D. melanogaster
ttcaatattgaat

SEQ ID NO: 665306 - DNA, 13 bp, D. melanogaster
ttcaatattgttt

SEQ ID NO: 665307 - DNA, 13 bp, D. melanogaster
ttcaatatttaca

SEQ ID NO: 665308 - DNA, 13 bp, D. melanogaster
ttcaatatttatg

SEQ ID NO: 665309 - DNA, 13 bp, D. melanogaster
ttcaatatttcaa

SEQ ID NO: 665310 - DNA, 14 bp, D. melanogaster
ttcaatatttcaaa

SEQ ID NO: 665311 - DNA, 13 bp, D. melanogaster
ttcaatatttgcc

SEQ ID NO: 665312 - DNA, 13 bp, D. melanogaster
ttcaatatttgtg

SEQ ID NO: 665313 - DNA, 13 bp, D. melanogaster
ttcaatatttgtt

SEQ ID NO: 665314 - DNA, 13 bp, D. melanogaster
ttcaatattttgc

SEQ ID NO: 665315 - DNA, 13 bp, D. melanogaster
ttcaatattttgt

SEQ ID NO: 665316 - DNA, 13 bp, D. melanogaster
ttcaatatttttg

SEQ ID NO: 665317 - DNA, 13 bp, D. melanogaster
ttcaatcaaaatc

SEQ ID NO: 665318 - DNA, 13 bp, D. melanogaster
ttcaatcaaaatg

SEQ ID NO: 665319 - DNA, 13 bp, D. melanogaster
ttcaatcaacatt

SEQ ID NO: 665320 - DNA, 13 bp, D. melanogaster
ttcaatcaacttt

SEQ ID NO: 665321 - DNA, 13 bp, D. melanogaster
ttcaatcaatatt

SEQ ID NO: 665322 - DNA, 13 bp, D. melanogaster
ttcaatcaatcaa

SEQ ID NO: 665323 - DNA, 13 bp, D. melanogaster
ttcaatcaatgca

SEQ ID NO: 665324 - DNA, 13 bp, D. melanogaster
ttcaatcaattca

SEQ ID NO: 665325 - DNA, 13 bp, D. melanogaster
ttcaatcactttt

SEQ ID NO: 665326 - DNA, 13 bp, D. melanogaster
ttcaatcgaaata

SEQ ID NO: 665327 - DNA, 13 bp, D. melanogaster
ttcaatcgatttg

SEQ ID NO: 665328 - DNA, 13 bp, D. melanogaster
ttcaatcgatttt

SEQ ID NO: 665329 - DNA, 14 bp, D. melanogaster
ttcaatcgttcaaa

SEQ ID NO: 665330 - DNA, 13 bp, D. melanogaster
ttcaatcgttttt

SEQ ID NO: 665331 - DNA, 14 bp, D. melanogaster
ttcaatgaaaatgt

SEQ ID NO: 665332 - DNA, 13 bp, D. melanogaster
ttcaatgaaatgc

SEQ ID NO: 665333 - DNA, 13 bp, D. melanogaster
ttcaatgaaatgg

SEQ ID NO: 665334 - DNA, 13 bp, D. melanogaster
ttcaatgaaattt

SEQ ID NO: 665335 - DNA, 13 bp, D. melanogaster
ttcaatgaacttt

SEQ ID NO: 665336 - DNA, 13 bp, D. melanogaster
ttcaatgactttt

SEQ ID NO: 665337 - DNA, 13 bp, D. melanogaster
ttcaatgagaaac

SEQ ID NO: 665338 - DNA, 13 bp, D. melanogaster
ttcaatgagataa

SEQ ID NO: 665339 - DNA, 13 bp, D. melanogaster
ttcaatgagcatt

SEQ ID NO: 665340 - DNA, 13 bp, D. melanogaster
ttcaatgagtttt

SEQ ID NO: 665341 - DNA, 13 bp, D. melanogaster
ttcaatgatttta

SEQ ID NO: 665342 - DNA, 13 bp, D. melanogaster
ttcaatgattttc

SEQ ID NO: 665343 - DNA, 13 bp, D. melanogaster
ttcaatgattttt

SEQ ID NO: 665344 - DNA, 13 bp, D. melanogaster
ttcaatgcaaata

SEQ ID NO: 665345 - DNA, 13 bp, D. melanogaster
ttcaatgcaattc

SEQ ID NO: 665346 - DNA, 13 bp, D. melanogaster
ttcaatgcaattt

SEQ ID NO: 665347 - DNA, 13 bp, D. melanogaster
ttcaatgcattta

SEQ ID NO: 665348 - DNA, 13 bp, D. melanogaster
ttcaatgccaaat

SEQ ID NO: 665349 - DNA, 13 bp, D. melanogaster
ttcaatgccattt

SEQ ID NO: 665350 - DNA, 13 bp, D. melanogaster
ttcaatgcgattt

SEQ ID NO: 665351 - DNA, 13 bp, D. melanogaster
ttcaatgcttgct

SEQ ID NO: 665352 - DNA, 13 bp, D. melanogaster
ttcaatggaaaaa

SEQ ID NO: 665353 - DNA, 13 bp, D. melanogaster
ttcaatggatttt

SEQ ID NO: 665354 - DNA, 13 bp, D. melanogaster
ttcaatggcaaaa

SEQ ID NO: 665355 - DNA, 13 bp, D. melanogaster
ttcaatggcaaat

SEQ ID NO: 665356 - DNA, 13 bp, D. melanogaster
ttcaatggcagca

SEQ ID NO: 665357 - DNA, 13 bp, D. melanogaster
ttcaatgtactta

SEQ ID NO: 665358 - DNA, 13 bp, D. melanogaster
ttcaatgtgaaat

SEQ ID NO: 665359 - DNA, 13 bp, D. melanogaster
ttcaatgtgtttt

SEQ ID NO: 665360 - DNA, 13 bp, D. melanogaster
ttcaatgttaata

SEQ ID NO: 665361 - DNA, 13 bp, D. melanogaster
ttcaatgttaatt

SEQ ID NO: 665362 - DNA, 13 bp, D. melanogaster
ttcaatgttcaat

SEQ ID NO: 665363 - DNA, 13 bp, D. melanogaster
ttcaatgttcgca

SEQ ID NO: 665364 - DNA, 13 bp, D. melanogaster
ttcaatgttgttt

SEQ ID NO: 665365 - DNA, 13 bp, D. melanogaster
ttcaatgtttaat

SEQ ID NO: 665366 - DNA, 14 bp, D. melanogaster
ttcaatgttttgat

SEQ ID NO: 665367 - DNA, 13 bp, D. melanogaster
ttcaattaaaaac

SEQ ID NO: 665368 - DNA, 14 bp, D. melanogaster
ttcaattaaaaatg

SEQ ID NO: 665369 - DNA, 13 bp, D. melanogaster
ttcaattaaaaca

SEQ ID NO: 665370 - DNA, 13 bp, D. melanogaster
ttcaattaaaacg

SEQ ID NO: 665371 - DNA, 13 bp, D. melanogaster
ttcaattaaacta

SEQ ID NO: 665372 - DNA, 13 bp, D. melanogaster
ttcaattaaagta

SEQ ID NO: 665373 - DNA, 13 bp, D. melanogaster
ttcaattaaatgc

SEQ ID NO: 665374 - DNA, 14 bp, D. melanogaster
ttcaattaaatgca

SEQ ID NO: 665375 - DNA, 13 bp, D. melanogaster
ttcaattaacaat

SEQ ID NO: 665376 - DNA, 14 bp, D. melanogaster
ttcaattaacaatt

SEQ ID NO: 665377 - DNA, 13 bp, D. melanogaster
ttcaattaactgc

SEQ ID NO: 665378 - DNA, 13 bp, D. melanogaster
ttcaattaagcaa

SEQ ID NO: 665379 - DNA, 13 bp, D. melanogaster
ttcaattaagctg

SEQ ID NO: 665380 - DNA, 13 bp, D. melanogaster
ttcaattaattgg

SEQ ID NO: 665381 - DNA, 13 bp, D. melanogaster
ttcaattaattgt

SEQ ID NO: 665382 - DNA, 13 bp, D. melanogaster
ttcaattacaaaa

SEQ ID NO: 665383 - DNA, 13 bp, D. melanogaster
ttcaattacaata

SEQ ID NO: 665384 - DNA, 13 bp, D. melanogaster
ttcaattacattt

SEQ ID NO: 665385 - DNA, 13 bp, D. melanogaster
ttcaattacttta

SEQ ID NO: 665386 - DNA, 13 bp, D. melanogaster
ttcaattagaaaa

SEQ ID NO: 665387 - DNA, 13 bp, D. melanogaster
ttcaattagagca

SEQ ID NO: 665388 - DNA, 13 bp, D. melanogaster
ttcaattaggttt

SEQ ID NO: 665389 - DNA, 13 bp, D. melanogaster
ttcaattagtaaa

SEQ ID NO: 665390 - DNA, 13 bp, D. melanogaster
ttcaattagtttg

SEQ ID NO: 665391 - DNA, 13 bp, D. melanogaster
ttcaattagtttt

SEQ ID NO: 665392 - DNA, 13 bp, D. melanogaster
ttcaattatgaat

SEQ ID NO: 665393 - DNA, 13 bp, D. melanogaster
ttcaattatgtgc

SEQ ID NO: 665394 - DNA, 14 bp, D. melanogaster
ttcaattattcaaa

SEQ ID NO: 665395 - DNA, 13 bp, D. melanogaster
ttcaattatttga

SEQ ID NO: 665396 - DNA, 13 bp, D. melanogaster
ttcaattattttg

SEQ ID NO: 665397 - DNA, 13 bp, D. melanogaster
ttcaattcaaaaa

SEQ ID NO: 665398 - DNA, 13 bp, D. melanogaster
ttcaattcaaaat

SEQ ID NO: 665399 - DNA, 13 bp, D. melanogaster
ttcaattcaaaca

SEQ ID NO: 665400 - DNA, 13 bp, D. melanogaster
ttcaattcaaatc

SEQ ID NO: 665401 - DNA, 13 bp, D. melanogaster
ttcaattcaacaa

SEQ ID NO: 665402 - DNA, 13 bp, D. melanogaster
ttcaattcaatca

SEQ ID NO: 665403 - DNA, 13 bp, D. melanogaster
ttcaattcaatta

SEQ ID NO: 665404 - DNA, 14 bp, D. melanogaster
ttcaattcaattcg

SEQ ID NO: 665405 - DNA, 13 bp, D. melanogaster
ttcaattcaattt

SEQ ID NO: 665406 - DNA, 14 bp, D. melanogaster
ttcaattcaatttg

SEQ ID NO: 665407 - DNA, 13 bp, D. melanogaster
ttcaattcacaaa

SEQ ID NO: 665408 - DNA, 13 bp, D. melanogaster
ttcaattcagttt

SEQ ID NO: 665409 - DNA, 13 bp, D. melanogaster
ttcaattcatatt

SEQ ID NO: 665410 - DNA, 13 bp, D. melanogaster
ttcaattcattaa

SEQ ID NO: 665411 - DNA, 13 bp, D. melanogaster
ttcaattcattga

SEQ ID NO: 665412 - DNA, 14 bp, D. melanogaster
ttcaattcattttc

SEQ ID NO: 665413 - DNA, 13 bp, D. melanogaster
ttcaattccattc

SEQ ID NO: 665414 - DNA, 13 bp, D. melanogaster
ttcaattccgttt

SEQ ID NO: 665415 - DNA, 13 bp, D. melanogaster
ttcaattccttaa

SEQ ID NO: 665416 - DNA, 13 bp, D. melanogaster
ttcaattcgaatt

SEQ ID NO: 665417 - DNA, 13 bp, D. melanogaster
ttcaattcgattc

SEQ ID NO: 665418 - DNA, 14 bp, D. melanogaster
ttcaattcgattcg

SEQ ID NO: 665419 - DNA, 13 bp, D. melanogaster
ttcaattcgattt

SEQ ID NO: 665420 - DNA, 13 bp, D. melanogaster
ttcaattctaatt

SEQ ID NO: 665421 - DNA, 13 bp, D. melanogaster
ttcaattctttaa

SEQ ID NO: 665422 - DNA, 14 bp, D. melanogaster
ttcaattctttggt

SEQ ID NO: 665423 - DNA, 13 bp, D. melanogaster
ttcaattgaaaac

SEQ ID NO: 665424 - DNA, 13 bp, D. melanogaster
ttcaattgaaatc

SEQ ID NO: 665425 - DNA, 13 bp, D. melanogaster
ttcaattgaaatt

SEQ ID NO: 665426 - DNA, 13 bp, D. melanogaster
ttcaattgaagtt

SEQ ID NO: 665427 - DNA, 13 bp, D. melanogaster
ttcaattgaattc

SEQ ID NO: 665428 - DNA, 13 bp, D. melanogaster
ttcaattgaattg

SEQ ID NO: 665429 - DNA, 13 bp, D. melanogaster
ttcaattgaattt

SEQ ID NO: 665430 - DNA, 13 bp, D. melanogaster
ttcaattgacaaa

SEQ ID NO: 665431 - DNA, 13 bp, D. melanogaster
ttcaattgacttt

SEQ ID NO: 665432 - DNA, 13 bp, D. melanogaster
ttcaattgagttg

SEQ ID NO: 665433 - DNA, 13 bp, D. melanogaster
ttcaattgataaa

SEQ ID NO: 665434 - DNA, 13 bp, D. melanogaster
ttcaattgatatt

SEQ ID NO: 665435 - DNA, 13 bp, D. melanogaster
ttcaattgatttg

SEQ ID NO: 665436 - DNA, 13 bp, D. melanogaster
ttcaattgcaaat

SEQ ID NO: 665437 - DNA, 14 bp, D. melanogaster
ttcaattgcaaatt

SEQ ID NO: 665438 - DNA, 13 bp, D. melanogaster
ttcaattgcaatc

SEQ ID NO: 665439 - DNA, 13 bp, D. melanogaster
ttcaattgcaatt

SEQ ID NO: 665440 - DNA, 13 bp, D. melanogaster
ttcaattgcagct

SEQ ID NO: 665441 - DNA, 13 bp, D. melanogaster
ttcaattgcagtt

SEQ ID NO: 665442 - DNA, 13 bp, D. melanogaster
ttcaattgcattt

SEQ ID NO: 665443 - DNA, 14 bp, D. melanogaster
ttcaattgcatttt

SEQ ID NO: 665444 - DNA, 13 bp, D. melanogaster
ttcaattgctttc

SEQ ID NO: 665445 - DNA, 13 bp, D. melanogaster
ttcaattgctttg

SEQ ID NO: 665446 - DNA, 13 bp, D. melanogaster
ttcaattggattg

SEQ ID NO: 665447 - DNA, 13 bp, D. melanogaster
ttcaattggcaaa

SEQ ID NO: 665448 - DNA, 13 bp, D. melanogaster
ttcaattggcaat

SEQ ID NO: 665449 - DNA, 13 bp, D. melanogaster
ttcaattggcatt

SEQ ID NO: 665450 - DNA, 13 bp, D. melanogaster
ttcaattggtttt

SEQ ID NO: 665451 - DNA, 13 bp, D. melanogaster
ttcaattgtaaat

SEQ ID NO: 665452 - DNA, 13 bp, D. melanogaster
ttcaattgtcttt

SEQ ID NO: 665453 - DNA, 13 bp, D. melanogaster
ttcaattgtgtaa

SEQ ID NO: 665454 - DNA, 13 bp, D. melanogaster
ttcaattgtgttt

SEQ ID NO: 665455 - DNA, 13 bp, D. melanogaster
ttcaattgttgcc

SEQ ID NO: 665456 - DNA, 13 bp, D. melanogaster
ttcaattgtttaa

SEQ ID NO: 665457 - DNA, 14 bp, D. melanogaster
ttcaattgtttaaa

SEQ ID NO: 665458 - DNA, 13 bp, D. melanogaster
ttcaattgtttat

SEQ ID NO: 665459 - DNA, 13 bp, D. melanogaster
ttcaattgtttcc

SEQ ID NO: 665460 - DNA, 13 bp, D. melanogaster
ttcaattgttttc

SEQ ID NO: 665461 - DNA, 13 bp, D. melanogaster
ttcaatttaaaac

SEQ ID NO: 665462 - DNA, 13 bp, D. melanogaster
ttcaatttaaaca

SEQ ID NO: 665463 - DNA, 14 bp, D. melanogaster
ttcaatttaaacaa

SEQ ID NO: 665464 - DNA, 13 bp, D. melanogaster
ttcaatttaaatg

SEQ ID NO: 665465 - DNA, 13 bp, D. melanogaster
ttcaatttacgtt

SEQ ID NO: 665466 - DNA, 13 bp, D. melanogaster
ttcaatttactaa

SEQ ID NO: 665467 - DNA, 13 bp, D. melanogaster
ttcaatttagaaa

SEQ ID NO: 665468 - DNA, 13 bp, D. melanogaster
ttcaatttagcaa

SEQ ID NO: 665469 - DNA, 13 bp, D. melanogaster
ttcaatttagttt

SEQ ID NO: 665470 - DNA, 13 bp, D. melanogaster
ttcaatttatgtt

SEQ ID NO: 665471 - DNA, 13 bp, D. melanogaster
ttcaatttatttg

SEQ ID NO: 665472 - DNA, 14 bp, D. melanogaster
ttcaatttatttgc

SEQ ID NO: 665473 - DNA, 14 bp, D. melanogaster
ttcaatttattttg

SEQ ID NO: 665474 - DNA, 13 bp, D. melanogaster
ttcaatttcaaaa

SEQ ID NO: 665475 - DNA, 13 bp, D. melanogaster
ttcaatttcaaag

SEQ ID NO: 665476 - DNA, 13 bp, D. melanogaster
ttcaatttcaaat

SEQ ID NO: 665477 - DNA, 13 bp, D. melanogaster
ttcaatttcaagt

SEQ ID NO: 665478 - DNA, 14 bp, D. melanogaster
ttcaatttcaataa

SEQ ID NO: 665479 - DNA, 13 bp, D. melanogaster
ttcaatttcaatt

SEQ ID NO: 665480 - DNA, 13 bp, D. melanogaster
ttcaatttcactt

SEQ ID NO: 665481 - DNA, 13 bp, D. melanogaster
ttcaatttcattg

SEQ ID NO: 665482 - DNA, 14 bp, D. melanogaster
ttcaatttcatttc

SEQ ID NO: 665483 - DNA, 14 bp, D. melanogaster
ttcaatttcatttg

SEQ ID NO: 665484 - DNA, 13 bp, D. melanogaster
ttcaatttccagc

SEQ ID NO: 665485 - DNA, 13 bp, D. melanogaster
ttcaatttcccca

SEQ ID NO: 665486 - DNA, 13 bp, D. melanogaster
ttcaatttccccc

SEQ ID NO: 665487 - DNA, 13 bp, D. melanogaster
ttcaatttcgaaa

SEQ ID NO: 665488 - DNA, 13 bp, D. melanogaster
ttcaatttcgatt

SEQ ID NO: 665489 - DNA, 13 bp, D. melanogaster
ttcaatttcgcat

SEQ ID NO: 665490 - DNA, 13 bp, D. melanogaster
ttcaatttcgtta

SEQ ID NO: 665491 - DNA, 13 bp, D. melanogaster
ttcaatttcgttc

SEQ ID NO: 665492 - DNA, 16 bp, D. melanogaster
ttcaatttctaaattt

SEQ ID NO: 665493 - DNA, 13 bp, D. melanogaster
ttcaatttgaaag

SEQ ID NO: 665494 - DNA, 13 bp, D. melanogaster
ttcaatttgaagc

SEQ ID NO: 665495 - DNA, 13 bp, D. melanogaster
ttcaatttgaagt

SEQ ID NO: 665496 - DNA, 13 bp, D. melanogaster
ttcaatttgaata

SEQ ID NO: 665497 - DNA, 14 bp, D. melanogaster
ttcaatttgaatat

SEQ ID NO: 665498 - DNA, 13 bp, D. melanogaster
ttcaatttgaatg

SEQ ID NO: 665499 - DNA, 13 bp, D. melanogaster
ttcaatttgacaa

SEQ ID NO: 665500 - DNA, 13 bp, D. melanogaster
ttcaatttgagca

SEQ ID NO: 665501 - DNA, 13 bp, D. melanogaster
ttcaatttgatgc

SEQ ID NO: 665502 - DNA, 13 bp, D. melanogaster
ttcaatttgattg

SEQ ID NO: 665503 - DNA, 13 bp, D. melanogaster
ttcaatttgcaat

SEQ ID NO: 665504 - DNA, 13 bp, D. melanogaster
ttcaatttgcatg

SEQ ID NO: 665505 - DNA, 13 bp, D. melanogaster
ttcaatttgccaa

SEQ ID NO: 665506 - DNA, 14 bp, D. melanogaster
ttcaatttgccagc

SEQ ID NO: 665507 - DNA, 13 bp, D. melanogaster
ttcaatttgccgc

SEQ ID NO: 665508 - DNA, 13 bp, D. melanogaster
ttcaatttgctgc

SEQ ID NO: 665509 - DNA, 14 bp, D. melanogaster
ttcaatttgctgca

SEQ ID NO: 665510 - DNA, 14 bp, D. melanogaster
ttcaatttgctgcc

SEQ ID NO: 665511 - DNA, 13 bp, D. melanogaster
ttcaatttgctgg

SEQ ID NO: 665512 - DNA, 13 bp, D. melanogaster
ttcaatttggaaa

SEQ ID NO: 665513 - DNA, 13 bp, D. melanogaster
ttcaatttggcat

SEQ ID NO: 665514 - DNA, 13 bp, D. melanogaster
ttcaatttggcca

SEQ ID NO: 665515 - DNA, 13 bp, D. melanogaster
ttcaatttggctt

SEQ ID NO: 665516 - DNA, 13 bp, D. melanogaster
ttcaatttgggtt

SEQ ID NO: 665517 - DNA, 13 bp, D. melanogaster
ttcaatttggttt

SEQ ID NO: 665518 - DNA, 13 bp, D. melanogaster
ttcaatttgtgcg

SEQ ID NO: 665519 - DNA, 14 bp, D. melanogaster
ttcaatttgttaaa

SEQ ID NO: 665520 - DNA, 13 bp, D. melanogaster
ttcaatttgttgc

SEQ ID NO: 665521 - DNA, 14 bp, D. melanogaster
ttcaatttgttgtt

SEQ ID NO: 665522 - DNA, 13 bp, D. melanogaster
ttcaatttgtttg

SEQ ID NO: 665523 - DNA, 14 bp, D. melanogaster
ttcaatttgtttgt

SEQ ID NO: 665524 - DNA, 14 bp, D. melanogaster
ttcaatttgttttg

SEQ ID NO: 665525 - DNA, 13 bp, D. melanogaster
ttcaattttaaag

SEQ ID NO: 665526 - DNA, 13 bp, D. melanogaster
ttcaattttaaca

SEQ ID NO: 665527 - DNA, 13 bp, D. melanogaster
ttcaattttaatc

SEQ ID NO: 665528 - DNA, 13 bp, D. melanogaster
ttcaattttagtt

SEQ ID NO: 665529 - DNA, 13 bp, D. melanogaster
ttcaattttatga

SEQ ID NO: 665530 - DNA, 13 bp, D. melanogaster
ttcaattttcaac

SEQ ID NO: 665531 - DNA, 13 bp, D. melanogaster
ttcaattttcata

SEQ ID NO: 665532 - DNA, 13 bp, D. melanogaster
ttcaattttccac

SEQ ID NO: 665533 - DNA, 13 bp, D. melanogaster
ttcaattttccag

SEQ ID NO: 665534 - DNA, 13 bp, D. melanogaster
ttcaattttccgc

SEQ ID NO: 665535 - DNA, 13 bp, D. melanogaster
ttcaattttcgaa

SEQ ID NO: 665536 - DNA, 13 bp, D. melanogaster
ttcaattttctgc

SEQ ID NO: 665537 - DNA, 13 bp, D. melanogaster
ttcaattttgaaa

SEQ ID NO: 665538 - DNA, 13 bp, D. melanogaster
ttcaattttgtga

SEQ ID NO: 665539 - DNA, 13 bp, D. melanogaster
ttcaattttgtta

SEQ ID NO: 665540 - DNA, 13 bp, D. melanogaster
ttcaatttttcaa

SEQ ID NO: 665541 - DNA, 13 bp, D. melanogaster
ttcaatttttcgc

SEQ ID NO: 665542 - DNA, 13 bp, D. melanogaster
ttcaatttttgat

SEQ ID NO: 665543 - DNA, 13 bp, D. melanogaster
ttcaatttttgtg

SEQ ID NO: 665544 - DNA, 13 bp, D. melanogaster
ttcaattttttgc

SEQ ID NO: 665545 - DNA, 13 bp, D. melanogaster
ttcacaaaaaatc

SEQ ID NO: 665546 - DNA, 13 bp, D. melanogaster
ttcacaaaaatat

SEQ ID NO: 665547 - DNA, 13 bp, D. melanogaster
ttcacaaaattat

SEQ ID NO: 665548 - DNA, 13 bp, D. melanogaster
ttcacaaacacaa

SEQ ID NO: 665549 - DNA, 14 bp, D. melanogaster
ttcacaaacacaat

SEQ ID NO: 665550 - DNA, 13 bp, D. melanogaster
ttcacaaacatga

SEQ ID NO: 665551 - DNA, 13 bp, D. melanogaster
ttcacaaacgcca

SEQ ID NO: 665552 - DNA, 13 bp, D. melanogaster
ttcacaaactttt

SEQ ID NO: 665553 - DNA, 13 bp, D. melanogaster
ttcacaaataaat

SEQ ID NO: 665554 - DNA, 13 bp, D. melanogaster
ttcacaaattaat

SEQ ID NO: 665555 - DNA, 13 bp, D. melanogaster
ttcacaaatttat

SEQ ID NO: 665556 - DNA, 13 bp, D. melanogaster
ttcacaaatttcc

SEQ ID NO: 665557 - DNA, 13 bp, D. melanogaster
ttcacaacttcaa

SEQ ID NO: 665558 - DNA, 13 bp, D. melanogaster
ttcacaactttta

SEQ ID NO: 665559 - DNA, 13 bp, D. melanogaster
ttcacaagaaggt

SEQ ID NO: 665560 - DNA, 13 bp, D. melanogaster
ttcacaagtcgcg

SEQ ID NO: 665561 - DNA, 13 bp, D. melanogaster
ttcacaattcaaa

SEQ ID NO: 665562 - DNA, 13 bp, D. melanogaster
ttcacaattcaca

SEQ ID NO: 665563 - DNA, 13 bp, D. melanogaster
ttcacaatttaat

SEQ ID NO: 665564 - DNA, 13 bp, D. melanogaster
ttcacaatttata

SEQ ID NO: 665565 - DNA, 14 bp, D. melanogaster
ttcacaattttaat

SEQ ID NO: 665566 - DNA, 13 bp, D. melanogaster
ttcacaattttca

SEQ ID NO: 665567 - DNA, 13 bp, D. melanogaster
ttcacaattttct

SEQ ID NO: 665568 - DNA, 13 bp, D. melanogaster
ttcacaattttga

SEQ ID NO: 665569 - DNA, 13 bp, D. melanogaster
ttcacacaaaaat

SEQ ID NO: 665570 - DNA, 13 bp, D. melanogaster
ttcacacaatttt

SEQ ID NO: 665571 - DNA, 13 bp, D. melanogaster
ttcacacacaaac

SEQ ID NO: 665572 - DNA, 13 bp, D. melanogaster
ttcacacacacaa

SEQ ID NO: 665573 - DNA, 13 bp, D. melanogaster
ttcacacatttca

SEQ ID NO: 665574 - DNA, 13 bp, D. melanogaster
ttcacacattttc

SEQ ID NO: 665575 - DNA, 13 bp, D. melanogaster
ttcacacgccgca

SEQ ID NO: 665576 - DNA, 13 bp, D. melanogaster
ttcacacttttct

SEQ ID NO: 665577 - DNA, 13 bp, D. melanogaster
ttcacagaagtcg

SEQ ID NO: 665578 - DNA, 13 bp, D. melanogaster
ttcacagtacaat

SEQ ID NO: 665579 - DNA, 13 bp, D. melanogaster
ttcacagtttttc

SEQ ID NO: 665580 - DNA, 13 bp, D. melanogaster
ttcacataataat

SEQ ID NO: 665581 - DNA, 13 bp, D. melanogaster
ttcacatacaaaa

SEQ ID NO: 665582 - DNA, 13 bp, D. melanogaster
ttcacatatttca

SEQ ID NO: 665583 - DNA, 14 bp, D. melanogaster
ttcacatccacatc

SEQ ID NO: 665584 - DNA, 13 bp, D. melanogaster
ttcacatcgacat

SEQ ID NO: 665585 - DNA, 14 bp, D. melanogaster
ttcacatctactat

SEQ ID NO: 665586 - DNA, 13 bp, D. melanogaster
ttcacatgcacat

SEQ ID NO: 665587 - DNA, 13 bp, D. melanogaster
ttcacattcgcat

SEQ ID NO: 665588 - DNA, 14 bp, D. melanogaster
ttcacattgtcgct

SEQ ID NO: 665589 - DNA, 13 bp, D. melanogaster
ttcacatttccac

SEQ ID NO: 665590 - DNA, 13 bp, D. melanogaster
ttcacatttccca

SEQ ID NO: 665591 - DNA, 13 bp, D. melanogaster
ttcacatttgttt

SEQ ID NO: 665592 - DNA, 13 bp, D. melanogaster
ttcacattttccc

SEQ ID NO: 665593 - DNA, 13 bp, D. melanogaster
ttcacatttttgt

SEQ ID NO: 665594 - DNA, 13 bp, D. melanogaster
ttcacattttttg

SEQ ID NO: 665595 - DNA, 14 bp, D. melanogaster
ttcaccaacaagat

SEQ ID NO: 665596 - DNA, 13 bp, D. melanogaster
ttcaccaatatct

SEQ ID NO: 665597 - DNA, 13 bp, D. melanogaster
ttcaccatcactt

SEQ ID NO: 665598 - DNA, 14 bp, D. melanogaster
ttcaccatcgagaa

SEQ ID NO: 665599 - DNA, 13 bp, D. melanogaster
ttcaccattcacc

SEQ ID NO: 665600 - DNA, 13 bp, D. melanogaster
ttcaccatttcca

SEQ ID NO: 665601 - DNA, 13 bp, D. melanogaster
ttcaccatttccc

SEQ ID NO: 665602 - DNA, 13 bp, D. melanogaster
ttcaccattttct

SEQ ID NO: 665603 - DNA, 13 bp, D. melanogaster
ttcacccacacac

SEQ ID NO: 665604 - DNA, 13 bp, D. melanogaster
ttcacccactttc

SEQ ID NO: 665605 - DNA, 13 bp, D. melanogaster
ttcacccactttt

SEQ ID NO: 665606 - DNA, 13 bp, D. melanogaster
ttcacccattttc

SEQ ID NO: 665607 - DNA, 13 bp, D. melanogaster
ttcaccgtctttt

SEQ ID NO: 665608 - DNA, 13 bp, D. melanogaster
ttcacctccgccg

SEQ ID NO: 665609 - DNA, 13 bp, D. melanogaster
ttcacctggccaa

SEQ ID NO: 665610 - DNA, 13 bp, D. melanogaster
ttcaccttgagtg

SEQ ID NO: 665611 - DNA, 13 bp, D. melanogaster
ttcacctttgctt

SEQ ID NO: 665612 - DNA, 13 bp, D. melanogaster
ttcacgactttat

SEQ ID NO: 665613 - DNA, 13 bp, D. melanogaster
ttcacgcgattgc

SEQ ID NO: 665614 - DNA, 13 bp, D. melanogaster
ttcacgcttttca

SEQ ID NO: 665615 - DNA, 13 bp, D. melanogaster
ttcacggatttgc

SEQ ID NO: 665616 - DNA, 13 bp, D. melanogaster
ttcacgttttctg

SEQ ID NO: 665617 - DNA, 13 bp, D. melanogaster
ttcactaacttct

SEQ ID NO: 665618 - DNA, 13 bp, D. melanogaster
ttcactacatttt

SEQ ID NO: 665619 - DNA, 13 bp, D. melanogaster
ttcactattttag

SEQ ID NO: 665620 - DNA, 14 bp, D. melanogaster
ttcactattttagc

SEQ ID NO: 665621 - DNA, 13 bp, D. melanogaster
ttcactcactcac

SEQ ID NO: 665622 - DNA, 13 bp, D. melanogaster
ttcactcattcat

SEQ ID NO: 665623 - DNA, 13 bp, D. melanogaster
ttcactctgaccc

SEQ ID NO: 665624 - DNA, 13 bp, D. melanogaster
ttcactgagaaca

SEQ ID NO: 665625 - DNA, 13 bp, D. melanogaster
ttcactgcatttt

SEQ ID NO: 665626 - DNA, 13 bp, D. melanogaster
ttcactgctttaa

SEQ ID NO: 665627 - DNA, 13 bp, D. melanogaster
ttcactgttaatt

SEQ ID NO: 665628 - DNA, 13 bp, D. melanogaster
ttcacttaaaatt

SEQ ID NO: 665629 - DNA, 14 bp, D. melanogaster
ttcacttaaaatta

SEQ ID NO: 665630 - DNA, 13 bp, D. melanogaster
ttcacttaagaaa

SEQ ID NO: 665631 - DNA, 13 bp, D. melanogaster
ttcacttaatttc

SEQ ID NO: 665632 - DNA, 13 bp, D. melanogaster
ttcacttagtgat

SEQ ID NO: 665633 - DNA, 13 bp, D. melanogaster
ttcacttataaat

SEQ ID NO: 665634 - DNA, 13 bp, D. melanogaster
ttcacttcaagtt

SEQ ID NO: 665635 - DNA, 13 bp, D. melanogaster
ttcacttcaatta

SEQ ID NO: 665636 - DNA, 13 bp, D. melanogaster
ttcacttcagttc

SEQ ID NO: 665637 - DNA, 13 bp, D. melanogaster
ttcacttccactt

SEQ ID NO: 665638 - DNA, 13 bp, D. melanogaster
ttcacttgaaaaa

SEQ ID NO: 665639 - DNA, 13 bp, D. melanogaster
ttcacttgccaca

SEQ ID NO: 665640 - DNA, 13 bp, D. melanogaster
ttcacttggcttt

SEQ ID NO: 665641 - DNA, 13 bp, D. melanogaster
ttcacttgttgtt

SEQ ID NO: 665642 - DNA, 13 bp, D. melanogaster
ttcacttgttttc

SEQ ID NO: 665643 - DNA, 13 bp, D. melanogaster
ttcactttaaaat

SEQ ID NO: 665644 - DNA, 13 bp, D. melanogaster
ttcactttattgt

SEQ ID NO: 665645 - DNA, 13 bp, D. melanogaster
ttcactttcgatt

SEQ ID NO: 665646 - DNA, 13 bp, D. melanogaster
ttcactttcgttt

SEQ ID NO: 665647 - DNA, 13 bp, D. melanogaster
ttcactttgaaaa

SEQ ID NO: 665648 - DNA, 13 bp, D. melanogaster
ttcactttgaggc

SEQ ID NO: 665649 - DNA, 13 bp, D. melanogaster
ttcactttgccac

SEQ ID NO: 665650 - DNA, 14 bp, D. melanogaster
ttcactttgccacc

SEQ ID NO: 665651 - DNA, 13 bp, D. melanogaster
ttcactttgcttt

SEQ ID NO: 665652 - DNA, 13 bp, D. melanogaster
ttcactttggcca

SEQ ID NO: 665653 - DNA, 13 bp, D. melanogaster
ttcactttggttt

SEQ ID NO: 665654 - DNA, 13 bp, D. melanogaster
ttcacttttaatg

SEQ ID NO: 665655 - DNA, 13 bp, D. melanogaster
ttcacttttcacc

SEQ ID NO: 665656 - DNA, 13 bp, D. melanogaster
ttcacttttcagc

SEQ ID NO: 665657 - DNA, 13 bp, D. melanogaster
ttcacttttcgct

SEQ ID NO: 665658 - DNA, 13 bp, D. melanogaster
ttcacttttcgtg

SEQ ID NO: 665659 - DNA, 13 bp, D. melanogaster
ttcacttttgatt

SEQ ID NO: 665660 - DNA, 13 bp, D. melanogaster
ttcacttttggcc

SEQ ID NO: 665661 - DNA, 13 bp, D. melanogaster
ttcactttttctg

SEQ ID NO: 665662 - DNA, 13 bp, D. melanogaster
ttcagaaaaacat

SEQ ID NO: 665663 - DNA, 13 bp, D. melanogaster
ttcagaaaattaa

SEQ ID NO: 665664 - DNA, 13 bp, D. melanogaster
ttcagaaaattca

SEQ ID NO: 665665 - DNA, 13 bp, D. melanogaster
ttcagaaagtcta

SEQ ID NO: 665666 - DNA, 13 bp, D. melanogaster
ttcagaaataaaa

SEQ ID NO: 665667 - DNA, 13 bp, D. melanogaster
ttcagaaatttaa

SEQ ID NO: 665668 - DNA, 14 bp, D. melanogaster
ttcagaacgccacg

SEQ ID NO: 665669 - DNA, 13 bp, D. melanogaster
ttcagaatgtttt

SEQ ID NO: 665670 - DNA, 13 bp, D. melanogaster
ttcagaatttgaa

SEQ ID NO: 665671 - DNA, 14 bp, D. melanogaster
ttcagacaacggaa

SEQ ID NO: 665672 - DNA, 14 bp, D. melanogaster
ttcagacgcatttt

SEQ ID NO: 665673 - DNA, 13 bp, D. melanogaster
ttcagagaagtca

SEQ ID NO: 665674 - DNA, 13 bp, D. melanogaster
ttcagagcccaac

SEQ ID NO: 665675 - DNA, 13 bp, D. melanogaster
ttcagagcctcaa

SEQ ID NO: 665676 - DNA, 13 bp, D. melanogaster
ttcagaggagagg

SEQ ID NO: 665677 - DNA, 13 bp, D. melanogaster
ttcagataatgtc

SEQ ID NO: 665678 - DNA, 13 bp, D. melanogaster
ttcagatacagat

SEQ ID NO: 665679 - DNA, 13 bp, D. melanogaster
ttcagatacattt

SEQ ID NO: 665680 - DNA, 13 bp, D. melanogaster
ttcagatactttc

SEQ ID NO: 665681 - DNA, 13 bp, D. melanogaster
ttcagatactttt

SEQ ID NO: 665682 - DNA, 14 bp, D. melanogaster
ttcagatacttttt

SEQ ID NO: 665683 - DNA, 13 bp, D. melanogaster
ttcagatccagat

SEQ ID NO: 665684 - DNA, 13 bp, D. melanogaster
ttcagatctataa

SEQ ID NO: 665685 - DNA, 13 bp, D. melanogaster
ttcagatctttta

SEQ ID NO: 665686 - DNA, 13 bp, D. melanogaster
ttcagatgcagat

SEQ ID NO: 665687 - DNA, 13 bp, D. melanogaster
ttcagatgcgaaa

SEQ ID NO: 665688 - DNA, 13 bp, D. melanogaster
ttcagatggaaaa

SEQ ID NO: 665689 - DNA, 13 bp, D. melanogaster
ttcagattcagac

SEQ ID NO: 665690 - DNA, 13 bp, D. melanogaster
ttcagattcagat

SEQ ID NO: 665691 - DNA, 13 bp, D. melanogaster
ttcagattcagtt

SEQ ID NO: 665692 - DNA, 13 bp, D. melanogaster
ttcagattcattt

SEQ ID NO: 665693 - DNA, 13 bp, D. melanogaster
ttcagatttaaat

SEQ ID NO: 665694 - DNA, 13 bp, D. melanogaster
ttcagatttcaga

SEQ ID NO: 665695 - DNA, 13 bp, D. melanogaster
ttcagattttcaa

SEQ ID NO: 665696 - DNA, 13 bp, D. melanogaster
ttcagcaaacaat

SEQ ID NO: 665697 - DNA, 13 bp, D. melanogaster
ttcagcaaagaat

SEQ ID NO: 665698 - DNA, 13 bp, D. melanogaster
ttcagcaagcgtt

SEQ ID NO: 665699 - DNA, 13 bp, D. melanogaster
ttcagcacacaga

SEQ ID NO: 665700 - DNA, 13 bp, D. melanogaster
ttcagcacacttt

SEQ ID NO: 665701 - DNA, 15 bp, D. melanogaster
ttcagcacactttga

SEQ ID NO: 665702 - DNA, 13 bp, D. melanogaster
ttcagcacttttt

SEQ ID NO: 665703 - DNA, 13 bp, D. melanogaster
ttcagcagcaaca

SEQ ID NO: 665704 - DNA, 13 bp, D. melanogaster
ttcagcagcactg

SEQ ID NO: 665705 - DNA, 13 bp, D. melanogaster
ttcagcatgtacg

SEQ ID NO: 665706 - DNA, 13 bp, D. melanogaster
ttcagcattaatt

SEQ ID NO: 665707 - DNA, 13 bp, D. melanogaster
ttcagcatttaaa

SEQ ID NO: 665708 - DNA, 13 bp, D. melanogaster
ttcagcatttcat

SEQ ID NO: 665709 - DNA, 13 bp, D. melanogaster
ttcagcatttgaa

SEQ ID NO: 665710 - DNA, 13 bp, D. melanogaster
ttcagcattttct

SEQ ID NO: 665711 - DNA, 13 bp, D. melanogaster
ttcagcattttta

SEQ ID NO: 665712 - DNA, 13 bp, D. melanogaster
ttcagcatttttg

SEQ ID NO: 665713 - DNA, 13 bp, D. melanogaster
ttcagcatttttt

SEQ ID NO: 665714 - DNA, 13 bp, D. melanogaster
ttcagccattttc

SEQ ID NO: 665715 - DNA, 13 bp, D. melanogaster
ttcagcgagcaca

SEQ ID NO: 665716 - DNA, 14 bp, D. melanogaster
ttcagcgagcacaa

SEQ ID NO: 665717 - DNA, 13 bp, D. melanogaster
ttcagcgattttc

SEQ ID NO: 665718 - DNA, 13 bp, D. melanogaster
ttcagcgcaacaa

SEQ ID NO: 665719 - DNA, 13 bp, D. melanogaster
ttcagcgtaaatt

SEQ ID NO: 665720 - DNA, 13 bp, D. melanogaster
ttcagctatttgt

SEQ ID NO: 665721 - DNA, 13 bp, D. melanogaster
ttcagctcagact

SEQ ID NO: 665722 - DNA, 13 bp, D. melanogaster
ttcagctcagctc

SEQ ID NO: 665723 - DNA, 13 bp, D. melanogaster
ttcagctcagttc

SEQ ID NO: 665724 - DNA, 13 bp, D. melanogaster
ttcagctccaact

SEQ ID NO: 665725 - DNA, 13 bp, D. melanogaster
ttcagctccagct

SEQ ID NO: 665726 - DNA, 14 bp, D. melanogaster
ttcagctccagctc

SEQ ID NO: 665727 - DNA, 15 bp, D. melanogaster
ttcagctcctatttg

SEQ ID NO: 665728 - DNA, 13 bp, D. melanogaster
ttcagctcggttt

SEQ ID NO: 665729 - DNA, 13 bp, D. melanogaster
ttcagctcttttt

SEQ ID NO: 665730 - DNA, 13 bp, D. melanogaster
ttcagctgcattt

SEQ ID NO: 665731 - DNA, 13 bp, D. melanogaster
ttcagctgccaaa

SEQ ID NO: 665732 - DNA, 13 bp, D. melanogaster
ttcagctgcctgc

SEQ ID NO: 665733 - DNA, 13 bp, D. melanogaster
ttcagctggaaaa

SEQ ID NO: 665734 - DNA, 13 bp, D. melanogaster
ttcagctggagaa

SEQ ID NO: 665735 - DNA, 13 bp, D. melanogaster
ttcagctggcagc

SEQ ID NO: 665736 - DNA, 13 bp, D. melanogaster
ttcagcttattca

SEQ ID NO: 665737 - DNA, 13 bp, D. melanogaster
ttcagcttcagct

SEQ ID NO: 665738 - DNA, 13 bp, D. melanogaster
ttcagcttcagtt

SEQ ID NO: 665739 - DNA, 13 bp, D. melanogaster
ttcagcttcggct

SEQ ID NO: 665740 - DNA, 13 bp, D. melanogaster
ttcagcttctgct

SEQ ID NO: 665741 - DNA, 13 bp, D. melanogaster
ttcagcttctgtt

SEQ ID NO: 665742 - DNA, 13 bp, D. melanogaster
ttcagcttgaaaa

SEQ ID NO: 665743 - DNA, 13 bp, D. melanogaster
ttcagctttagca

SEQ ID NO: 665744 - DNA, 13 bp, D. melanogaster
ttcagctttattt

SEQ ID NO: 665745 - DNA, 13 bp, D. melanogaster
ttcagctttcagc

SEQ ID NO: 665746 - DNA, 13 bp, D. melanogaster
ttcagcttttcag

SEQ ID NO: 665747 - DNA, 13 bp, D. melanogaster
ttcagctttttgt

SEQ ID NO: 665748 - DNA, 13 bp, D. melanogaster
ttcagcttttttc

SEQ ID NO: 665749 - DNA, 14 bp, D. melanogaster
ttcaggatgttcta

SEQ ID NO: 665750 - DNA, 13 bp, D. melanogaster
ttcaggatttgtc

SEQ ID NO: 665751 - DNA, 13 bp, D. melanogaster
ttcaggccacatc

SEQ ID NO: 665752 - DNA, 13 bp, D. melanogaster
ttcagggagacac

SEQ ID NO: 665753 - DNA, 13 bp, D. melanogaster
ttcaggtatgtta

SEQ ID NO: 665754 - DNA, 13 bp, D. melanogaster
ttcaggtgatcat

SEQ ID NO: 665755 - DNA, 13 bp, D. melanogaster
ttcaggttttaaa

SEQ ID NO: 665756 - DNA, 14 bp, D. melanogaster
ttcagtaaaggaga

SEQ ID NO: 665757 - DNA, 13 bp, D. melanogaster
ttcagtaattttt

SEQ ID NO: 665758 - DNA, 13 bp, D. melanogaster
ttcagtacaaata

SEQ ID NO: 665759 - DNA, 13 bp, D. melanogaster
ttcagtatatttt

SEQ ID NO: 665760 - DNA, 13 bp, D. melanogaster
ttcagtattgagt

SEQ ID NO: 665761 - DNA, 13 bp, D. melanogaster
ttcagtatttaaa

SEQ ID NO: 665762 - DNA, 13 bp, D. melanogaster
ttcagtcagtcag

SEQ ID NO: 665763 - DNA, 13 bp, D. melanogaster
ttcagtcattcag

SEQ ID NO: 665764 - DNA, 13 bp, D. melanogaster
ttcagtcgacatc

SEQ ID NO: 665765 - DNA, 13 bp, D. melanogaster
ttcagtcttaagc

SEQ ID NO: 665766 - DNA, 14 bp, D. melanogaster
ttcagtcttaagct

SEQ ID NO: 665767 - DNA, 13 bp, D. melanogaster
ttcagtgaaaatt

SEQ ID NO: 665768 - DNA, 13 bp, D. melanogaster
ttcagtgcactca

SEQ ID NO: 665769 - DNA, 13 bp, D. melanogaster
ttcagtgcacttt

SEQ ID NO: 665770 - DNA, 13 bp, D. melanogaster
ttcagtgtatcca

SEQ ID NO: 665771 - DNA, 14 bp, D. melanogaster
ttcagtgtatccac

SEQ ID NO: 665772 - DNA, 13 bp, D. melanogaster
ttcagtgttcagt

SEQ ID NO: 665773 - DNA, 13 bp, D. melanogaster
ttcagttaataaa

SEQ ID NO: 665774 - DNA, 13 bp, D. melanogaster
ttcagttaattat

SEQ ID NO: 665775 - DNA, 13 bp, D. melanogaster
ttcagttatttat

SEQ ID NO: 665776 - DNA, 13 bp, D. melanogaster
ttcagttcaatta

SEQ ID NO: 665777 - DNA, 13 bp, D. melanogaster
ttcagttcaattt

SEQ ID NO: 665778 - DNA, 13 bp, D. melanogaster
ttcagttcacttc

SEQ ID NO: 665779 - DNA, 13 bp, D. melanogaster
ttcagttcagctc

SEQ ID NO: 665780 - DNA, 13 bp, D. melanogaster
ttcagttccagct

SEQ ID NO: 665781 - DNA, 13 bp, D. melanogaster
ttcagttcctttt

SEQ ID NO: 665782 - DNA, 13 bp, D. melanogaster
ttcagttcgaaat

SEQ ID NO: 665783 - DNA, 13 bp, D. melanogaster
ttcagttcgattc

SEQ ID NO: 665784 - DNA, 13 bp, D. melanogaster
ttcagttcgattt

SEQ ID NO: 665785 - DNA, 13 bp, D. melanogaster
ttcagttcgcgat

SEQ ID NO: 665786 - DNA, 13 bp, D. melanogaster
ttcagttcgcttt

SEQ ID NO: 665787 - DNA, 13 bp, D. melanogaster
ttcagttcggttc

SEQ ID NO: 665788 - DNA, 13 bp, D. melanogaster
ttcagttcggttt

SEQ ID NO: 665789 - DNA, 13 bp, D. melanogaster
ttcagttcgtttc

SEQ ID NO: 665790 - DNA, 14 bp, D. melanogaster
ttcagttcgtttcg

SEQ ID NO: 665791 - DNA, 13 bp, D. melanogaster
ttcagttctattt

SEQ ID NO: 665792 - DNA, 14 bp, D. melanogaster
ttcagttctatttt

SEQ ID NO: 665793 - DNA, 13 bp, D. melanogaster
ttcagttgaattt

SEQ ID NO: 665794 - DNA, 13 bp, D. melanogaster
ttcagttgagttt

SEQ ID NO: 665795 - DNA, 13 bp, D. melanogaster
ttcagttgatttt

SEQ ID NO: 665796 - DNA, 13 bp, D. melanogaster
ttcagttgcaatt

SEQ ID NO: 665797 - DNA, 13 bp, D. melanogaster
ttcagttgcattt

SEQ ID NO: 665798 - DNA, 13 bp, D. melanogaster
ttcagttgctctt

SEQ ID NO: 665799 - DNA, 13 bp, D. melanogaster
ttcagttgctgtt

SEQ ID NO: 665800 - DNA, 13 bp, D. melanogaster
ttcagttggaaaa

SEQ ID NO: 665801 - DNA, 13 bp, D. melanogaster
ttcagttggattt

SEQ ID NO: 665802 - DNA, 13 bp, D. melanogaster
ttcagttggcagc

SEQ ID NO: 665803 - DNA, 13 bp, D. melanogaster
ttcagttggcatt

SEQ ID NO: 665804 - DNA, 13 bp, D. melanogaster
ttcagttggcttt

SEQ ID NO: 665805 - DNA, 13 bp, D. melanogaster
ttcagttgttgct

SEQ ID NO: 665806 - DNA, 13 bp, D. melanogaster
ttcagttgttgga

SEQ ID NO: 665807 - DNA, 13 bp, D. melanogaster
ttcagtttaaatt

SEQ ID NO: 665808 - DNA, 13 bp, D. melanogaster
ttcagtttattca

SEQ ID NO: 665809 - DNA, 13 bp, D. melanogaster
ttcagtttattgt

SEQ ID NO: 665810 - DNA, 14 bp, D. melanogaster
ttcagtttatttat

SEQ ID NO: 665811 - DNA, 13 bp, D. melanogaster
ttcagtttcaatt

SEQ ID NO: 665812 - DNA, 13 bp, D. melanogaster
ttcagtttcagtt

SEQ ID NO: 665813 - DNA, 14 bp, D. melanogaster
ttcagtttcagttt

SEQ ID NO: 665814 - DNA, 13 bp, D. melanogaster
ttcagtttcataa

SEQ ID NO: 665815 - DNA, 14 bp, D. melanogaster
ttcagtttcatttt

SEQ ID NO: 665816 - DNA, 14 bp, D. melanogaster
ttcagtttccagtt

SEQ ID NO: 665817 - DNA, 13 bp, D. melanogaster
ttcagtttcgatt

SEQ ID NO: 665818 - DNA, 13 bp, D. melanogaster
ttcagtttcggat

SEQ ID NO: 665819 - DNA, 13 bp, D. melanogaster
ttcagtttcggtt

SEQ ID NO: 665820 - DNA, 14 bp, D. melanogaster
ttcagtttcggttt

SEQ ID NO: 665821 - DNA, 13 bp, D. melanogaster
ttcagtttcgttg

SEQ ID NO: 665822 - DNA, 13 bp, D. melanogaster
ttcagtttcgttt

SEQ ID NO: 665823 - DNA, 13 bp, D. melanogaster
ttcagtttgaaat

SEQ ID NO: 665824 - DNA, 13 bp, D. melanogaster
ttcagtttgaatt

SEQ ID NO: 665825 - DNA, 13 bp, D. melanogaster
ttcagtttgcagc

SEQ ID NO: 665826 - DNA, 13 bp, D. melanogaster
ttcagtttgggtt

SEQ ID NO: 665827 - DNA, 13 bp, D. melanogaster
ttcagtttggttc

SEQ ID NO: 665828 - DNA, 13 bp, D. melanogaster
ttcagtttggttt

SEQ ID NO: 665829 - DNA, 13 bp, D. melanogaster
ttcagtttgtatt

SEQ ID NO: 665830 - DNA, 13 bp, D. melanogaster
ttcagttttaata

SEQ ID NO: 665831 - DNA, 13 bp, D. melanogaster
ttcagttttagct

SEQ ID NO: 665832 - DNA, 13 bp, D. melanogaster
ttcagttttatat

SEQ ID NO: 665833 - DNA, 13 bp, D. melanogaster
ttcagttttatta

SEQ ID NO: 665834 - DNA, 13 bp, D. melanogaster
ttcagttttcagt

SEQ ID NO: 665835 - DNA, 13 bp, D. melanogaster
ttcagttttccga

SEQ ID NO: 665836 - DNA, 13 bp, D. melanogaster
ttcagttttcctt

SEQ ID NO: 665837 - DNA, 13 bp, D. melanogaster
ttcagttttcgtt

SEQ ID NO: 665838 - DNA, 14 bp, D. melanogaster
ttcagttttcgttc

SEQ ID NO: 665839 - DNA, 13 bp, D. melanogaster
ttcagttttcttg

SEQ ID NO: 665840 - DNA, 13 bp, D. melanogaster
ttcagttttgaaa

SEQ ID NO: 665841 - DNA, 13 bp, D. melanogaster
ttcagttttgagt

SEQ ID NO: 665842 - DNA, 13 bp, D. melanogaster
ttcagttttgtat

SEQ ID NO: 665843 - DNA, 13 bp, D. melanogaster
ttcagtttttagt

SEQ ID NO: 665844 - DNA, 13 bp, D. melanogaster
ttcagtttttcac

SEQ ID NO: 665845 - DNA, 13 bp, D. melanogaster
ttcagtttttgct

SEQ ID NO: 665846 - DNA, 13 bp, D. melanogaster
ttcataaaaaagg

SEQ ID NO: 665847 - DNA, 13 bp, D. melanogaster
ttcataaacaaat

SEQ ID NO: 665848 - DNA, 13 bp, D. melanogaster
ttcataaacaatt

SEQ ID NO: 665849 - DNA, 13 bp, D. melanogaster
ttcataaacattt

SEQ ID NO: 665850 - DNA, 13 bp, D. melanogaster
ttcataaatatgc

SEQ ID NO: 665851 - DNA, 13 bp, D. melanogaster
ttcataaatattc

SEQ ID NO: 665852 - DNA, 13 bp, D. melanogaster
ttcataaatcaaa

SEQ ID NO: 665853 - DNA, 13 bp, D. melanogaster
ttcataaatcatt

SEQ ID NO: 665854 - DNA, 13 bp, D. melanogaster
ttcataaatgtat

SEQ ID NO: 665855 - DNA, 13 bp, D. melanogaster
ttcataaattgca

SEQ ID NO: 665856 - DNA, 13 bp, D. melanogaster
ttcataaattgta

SEQ ID NO: 665857 - DNA, 13 bp, D. melanogaster
ttcataaatttgc

SEQ ID NO: 665858 - DNA, 13 bp, D. melanogaster
ttcataacgaaat

SEQ ID NO: 665859 - DNA, 13 bp, D. melanogaster
ttcataacttaaa

SEQ ID NO: 665860 - DNA, 13 bp, D. melanogaster
ttcataataaaac

SEQ ID NO: 665861 - DNA, 14 bp, D. melanogaster
ttcataataaaact

SEQ ID NO: 665862 - DNA, 13 bp, D. melanogaster
ttcataatcaaat

SEQ ID NO: 665863 - DNA, 13 bp, D. melanogaster
ttcataattaatg

SEQ ID NO: 665864 - DNA, 13 bp, D. melanogaster
ttcataattgttt

SEQ ID NO: 665865 - DNA, 13 bp, D. melanogaster
ttcataatttatg

SEQ ID NO: 665866 - DNA, 13 bp, D. melanogaster
ttcataatttcta

SEQ ID NO: 665867 - DNA, 13 bp, D. melanogaster
ttcatacacatat

SEQ ID NO: 665868 - DNA, 13 bp, D. melanogaster
ttcatacatatcg

SEQ ID NO: 665869 - DNA, 14 bp, D. melanogaster
ttcatacatatgta

SEQ ID NO: 665870 - DNA, 14 bp, D. melanogaster
ttcatacatttaca

SEQ ID NO: 665871 - DNA, 13 bp, D. melanogaster
ttcatacattttc

SEQ ID NO: 665872 - DNA, 13 bp, D. melanogaster
ttcatacggacag

SEQ ID NO: 665873 - DNA, 14 bp, D. melanogaster
ttcatacggacaga

SEQ ID NO: 665874 - DNA, 13 bp, D. melanogaster
ttcatacttcaat

SEQ ID NO: 665875 - DNA, 13 bp, D. melanogaster
ttcatagaaattt

SEQ ID NO: 665876 - DNA, 13 bp, D. melanogaster
ttcatagtttata

SEQ ID NO: 665877 - DNA, 13 bp, D. melanogaster
ttcatataaattg

SEQ ID NO: 665878 - DNA, 13 bp, D. melanogaster
ttcatatacaaaa

SEQ ID NO: 665879 - DNA, 13 bp, D. melanogaster
ttcatatacatat

SEQ ID NO: 665880 - DNA, 14 bp, D. melanogaster
ttcatatacatata

SEQ ID NO: 665881 - DNA, 13 bp, D. melanogaster
ttcatatatacat

SEQ ID NO: 665882 - DNA, 14 bp, D. melanogaster
ttcatatatataca

SEQ ID NO: 665883 - DNA, 14 bp, D. melanogaster
ttcatatatatgta

SEQ ID NO: 665884 - DNA, 13 bp, D. melanogaster
ttcatatatgtac

SEQ ID NO: 665885 - DNA, 13 bp, D. melanogaster
ttcatatattgat

SEQ ID NO: 665886 - DNA, 13 bp, D. melanogaster
ttcatatatttac

SEQ ID NO: 665887 - DNA, 13 bp, D. melanogaster
ttcatatcaaata

SEQ ID NO: 665888 - DNA, 13 bp, D. melanogaster
ttcatatctatat

SEQ ID NO: 665889 - DNA, 13 bp, D. melanogaster
ttcatatgaaaat

SEQ ID NO: 665890 - DNA, 13 bp, D. melanogaster
ttcatatgaaatt

SEQ ID NO: 665891 - DNA, 13 bp, D. melanogaster
ttcatatgaatat

SEQ ID NO: 665892 - DNA, 13 bp, D. melanogaster
ttcatatgatttt

SEQ ID NO: 665893 - DNA, 13 bp, D. melanogaster
ttcatatgcaaat

SEQ ID NO: 665894 - DNA, 13 bp, D. melanogaster
ttcatatgcacat

SEQ ID NO: 665895 - DNA, 13 bp, D. melanogaster
ttcatatgcatat

SEQ ID NO: 665896 - DNA, 13 bp, D. melanogaster
ttcatatgtaaat

SEQ ID NO: 665897 - DNA, 13 bp, D. melanogaster
ttcatatgtacat

SEQ ID NO: 665898 - DNA, 14 bp, D. melanogaster
ttcatatgtatata

SEQ ID NO: 665899 - DNA, 13 bp, D. melanogaster
ttcatattcacat

SEQ ID NO: 665900 - DNA, 13 bp, D. melanogaster
ttcatattcatat

SEQ ID NO: 665901 - DNA, 13 bp, D. melanogaster
ttcatattccatt

SEQ ID NO: 665902 - DNA, 13 bp, D. melanogaster
ttcatattcggaa

SEQ ID NO: 665903 - DNA, 13 bp, D. melanogaster
ttcatatttaatg

SEQ ID NO: 665904 - DNA, 13 bp, D. melanogaster
ttcatatttattg

SEQ ID NO: 665905 - DNA, 13 bp, D. melanogaster
ttcatatttctgt

SEQ ID NO: 665906 - DNA, 13 bp, D. melanogaster
ttcatatttgtgt

SEQ ID NO: 665907 - DNA, 13 bp, D. melanogaster
ttcatattttcca

SEQ ID NO: 665908 - DNA, 13 bp, D. melanogaster
ttcatcaaaattg

SEQ ID NO: 665909 - DNA, 14 bp, D. melanogaster
ttcatcaaatcgaa

SEQ ID NO: 665910 - DNA, 13 bp, D. melanogaster
ttcatcaaatgaa

SEQ ID NO: 665911 - DNA, 14 bp, D. melanogaster
ttcatcaaatgaat

SEQ ID NO: 665912 - DNA, 13 bp, D. melanogaster
ttcatcaagaagt

SEQ ID NO: 665913 - DNA, 13 bp, D. melanogaster
ttcatcaattatt

SEQ ID NO: 665914 - DNA, 13 bp, D. melanogaster
ttcatcaatttta

SEQ ID NO: 665915 - DNA, 13 bp, D. melanogaster
ttcatcactcact

SEQ ID NO: 665916 - DNA, 13 bp, D. melanogaster
ttcatcagccgca

SEQ ID NO: 665917 - DNA, 13 bp, D. melanogaster
ttcatcaggtggc

SEQ ID NO: 665918 - DNA, 13 bp, D. melanogaster
ttcatcatattaa

SEQ ID NO: 665919 - DNA, 13 bp, D. melanogaster
ttcatcatcagat

SEQ ID NO: 665920 - DNA, 13 bp, D. melanogaster
ttcatcatcgtca

SEQ ID NO: 665921 - DNA, 14 bp, D. melanogaster
ttcatcatcgtcat

SEQ ID NO: 665922 - DNA, 13 bp, D. melanogaster
ttcatcatctatt

SEQ ID NO: 665923 - DNA, 13 bp, D. melanogaster
ttcatcattatca

SEQ ID NO: 665924 - DNA, 13 bp, D. melanogaster
ttcatcatttgtt

SEQ ID NO: 665925 - DNA, 13 bp, D. melanogaster
ttcatcattttgt

SEQ ID NO: 665926 - DNA, 13 bp, D. melanogaster
ttcatccattcat

SEQ ID NO: 665927 - DNA, 14 bp, D. melanogaster
ttcatccgccacca

SEQ ID NO: 665928 - DNA, 14 bp, D. melanogaster
ttcatcgacaacaa

SEQ ID NO: 665929 - DNA, 13 bp, D. melanogaster
ttcatcgatttga

SEQ ID NO: 665930 - DNA, 13 bp, D. melanogaster
ttcatcggccaaa

SEQ ID NO: 665931 - DNA, 13 bp, D. melanogaster
ttcatcgtttttg

SEQ ID NO: 665932 - DNA, 13 bp, D. melanogaster
ttcatcttcatca

SEQ ID NO: 665933 - DNA, 13 bp, D. melanogaster
ttcatcttcatct

SEQ ID NO: 665934 - DNA, 13 bp, D. melanogaster
ttcatcttgcggc

SEQ ID NO: 665935 - DNA, 13 bp, D. melanogaster
ttcatcttggcca

SEQ ID NO: 665936 - DNA, 13 bp, D. melanogaster
ttcatctttaaaa

SEQ ID NO: 665937 - DNA, 13 bp, D. melanogaster
ttcatgaattatt

SEQ ID NO: 665938 - DNA, 13 bp, D. melanogaster
ttcatgaattcat

SEQ ID NO: 665939 - DNA, 13 bp, D. melanogaster
ttcatgaatttca

SEQ ID NO: 665940 - DNA, 14 bp, D. melanogaster
ttcatgaatttcat

SEQ ID NO: 665941 - DNA, 13 bp, D. melanogaster
ttcatgattttaa

SEQ ID NO: 665942 - DNA, 13 bp, D. melanogaster
ttcatgcaaaata

SEQ ID NO: 665943 - DNA, 13 bp, D. melanogaster
ttcatgcaccttt

SEQ ID NO: 665944 - DNA, 14 bp, D. melanogaster
ttcatgcacctttg

SEQ ID NO: 665945 - DNA, 13 bp, D. melanogaster
ttcatgcatattt

SEQ ID NO: 665946 - DNA, 13 bp, D. melanogaster
ttcatgccaagcg

SEQ ID NO: 665947 - DNA, 13 bp, D. melanogaster
ttcatgccgattt

SEQ ID NO: 665948 - DNA, 13 bp, D. melanogaster
ttcatggaattct

SEQ ID NO: 665949 - DNA, 13 bp, D. melanogaster
ttcatggattgga

SEQ ID NO: 665950 - DNA, 13 bp, D. melanogaster
ttcatgtatttat

SEQ ID NO: 665951 - DNA, 13 bp, D. melanogaster
ttcatgtatttta

SEQ ID NO: 665952 - DNA, 13 bp, D. melanogaster
ttcatgtggcact

SEQ ID NO: 665953 - DNA, 13 bp, D. melanogaster
ttcatgttatcct

SEQ ID NO: 665954 - DNA, 13 bp, D. melanogaster
ttcatgttcatgt

SEQ ID NO: 665955 - DNA, 14 bp, D. melanogaster
ttcatgttcatgtt

SEQ ID NO: 665956 - DNA, 13 bp, D. melanogaster
ttcatgttcattt

SEQ ID NO: 665957 - DNA, 13 bp, D. melanogaster
ttcatgttttaat

SEQ ID NO: 665958 - DNA, 13 bp, D. melanogaster
ttcattaaaaaac

SEQ ID NO: 665959 - DNA, 13 bp, D. melanogaster
ttcattaaaaact

SEQ ID NO: 665960 - DNA, 13 bp, D. melanogaster
ttcattaaaaaga

SEQ ID NO: 665961 - DNA, 14 bp, D. melanogaster
ttcattaaaaagat

SEQ ID NO: 665962 - DNA, 14 bp, D. melanogaster
ttcattaaaaagtt

SEQ ID NO: 665963 - DNA, 13 bp, D. melanogaster
ttcattaaaaatg

SEQ ID NO: 665964 - DNA, 13 bp, D. melanogaster
ttcattaaaacaa

SEQ ID NO: 665965 - DNA, 13 bp, D. melanogaster
ttcattaaaactt

SEQ ID NO: 665966 - DNA, 13 bp, D. melanogaster
ttcattaaaagtt

SEQ ID NO: 665967 - DNA, 13 bp, D. melanogaster
ttcattaaaatgc

SEQ ID NO: 665968 - DNA, 13 bp, D. melanogaster
ttcattaaactaa

SEQ ID NO: 665969 - DNA, 13 bp, D. melanogaster
ttcattaaactca

SEQ ID NO: 665970 - DNA, 13 bp, D. melanogaster
ttcattaaagaaa

SEQ ID NO: 665971 - DNA, 13 bp, D. melanogaster
ttcattaaatcaa

SEQ ID NO: 665972 - DNA, 13 bp, D. melanogaster
ttcattaaccaag

SEQ ID NO: 665973 - DNA, 13 bp, D. melanogaster
ttcattaacttta

SEQ ID NO: 665974 - DNA, 13 bp, D. melanogaster
ttcattaactttg

SEQ ID NO: 665975 - DNA, 14 bp, D. melanogaster
ttcattaagacaaa

SEQ ID NO: 665976 - DNA, 13 bp, D. melanogaster
ttcattaatattc

SEQ ID NO: 665977 - DNA, 13 bp, D. melanogaster
ttcattaatcaaa

SEQ ID NO: 665978 - DNA, 13 bp, D. melanogaster
ttcattaattctg

SEQ ID NO: 665979 - DNA, 13 bp, D. melanogaster
ttcattaattgaa

SEQ ID NO: 665980 - DNA, 13 bp, D. melanogaster
ttcattacacaaa

SEQ ID NO: 665981 - DNA, 13 bp, D. melanogaster
ttcattagaaatt

SEQ ID NO: 665982 - DNA, 13 bp, D. melanogaster
ttcattagcaaca

SEQ ID NO: 665983 - DNA, 13 bp, D. melanogaster
ttcattagcattt

SEQ ID NO: 665984 - DNA, 13 bp, D. melanogaster
ttcattagctgcc

SEQ ID NO: 665985 - DNA, 13 bp, D. melanogaster
ttcattaggtttt

SEQ ID NO: 665986 - DNA, 13 bp, D. melanogaster
ttcattagtttta

SEQ ID NO: 665987 - DNA, 13 bp, D. melanogaster
ttcattatcaatt

SEQ ID NO: 665988 - DNA, 14 bp, D. melanogaster
ttcattatcatctt

SEQ ID NO: 665989 - DNA, 13 bp, D. melanogaster
ttcattatgaaaa

SEQ ID NO: 665990 - DNA, 13 bp, D. melanogaster
ttcattatgaatt

SEQ ID NO: 665991 - DNA, 13 bp, D. melanogaster
ttcattatgattt

SEQ ID NO: 665992 - DNA, 13 bp, D. melanogaster
ttcattattcaat

SEQ ID NO: 665993 - DNA, 13 bp, D. melanogaster
ttcattcaaaaaa

SEQ ID NO: 665994 - DNA, 13 bp, D. melanogaster
ttcattcaaaatt

SEQ ID NO: 665995 - DNA, 13 bp, D. melanogaster
ttcattcaactgc

SEQ ID NO: 665996 - DNA, 13 bp, D. melanogaster
ttcattcaacttt

SEQ ID NO: 665997 - DNA, 13 bp, D. melanogaster
ttcattcaattca

SEQ ID NO: 665998 - DNA, 13 bp, D. melanogaster
ttcattcaatttg

SEQ ID NO: 665999 - DNA, 13 bp, D. melanogaster
ttcattcacaaaa

SEQ ID NO: 666000 - DNA, 13 bp, D. melanogaster
ttcattcacaatt

SEQ ID NO: 666001 - DNA, 13 bp, D. melanogaster
ttcattcacattt

SEQ ID NO: 666002 - DNA, 13 bp, D. melanogaster
ttcattcactcaa

SEQ ID NO: 666003 - DNA, 13 bp, D. melanogaster
ttcattcactcac

SEQ ID NO: 666004 - DNA, 13 bp, D. melanogaster
ttcattcagaaaa

SEQ ID NO: 666005 - DNA, 14 bp, D. melanogaster
ttcattcaggtgat

SEQ ID NO: 666006 - DNA, 13 bp, D. melanogaster
ttcattcagtttt

SEQ ID NO: 666007 - DNA, 13 bp, D. melanogaster
ttcattcataaaa

SEQ ID NO: 666008 - DNA, 13 bp, D. melanogaster
ttcattcataaac

SEQ ID NO: 666009 - DNA, 13 bp, D. melanogaster
ttcattcatgaaa

SEQ ID NO: 666010 - DNA, 13 bp, D. melanogaster
ttcattcatgatt

SEQ ID NO: 666011 - DNA, 13 bp, D. melanogaster
ttcattcatgcca

SEQ ID NO: 666012 - DNA, 13 bp, D. melanogaster
ttcattcattcac

SEQ ID NO: 666013 - DNA, 13 bp, D. melanogaster
ttcattcattcag

SEQ ID NO: 666014 - DNA, 14 bp, D. melanogaster
ttcattcattcagt

SEQ ID NO: 666015 - DNA, 13 bp, D. melanogaster
ttcattcatttgt

SEQ ID NO: 666016 - DNA, 14 bp, D. melanogaster
ttcattcattttca

SEQ ID NO: 666017 - DNA, 13 bp, D. melanogaster
ttcattccaatta

SEQ ID NO: 666018 - DNA, 14 bp, D. melanogaster
ttcattccatcaat

SEQ ID NO: 666019 - DNA, 13 bp, D. melanogaster
ttcattccattct

SEQ ID NO: 666020 - DNA, 13 bp, D. melanogaster
ttcattccatttc

SEQ ID NO: 666021 - DNA, 13 bp, D. melanogaster
ttcattcccattt

SEQ ID NO: 666022 - DNA, 13 bp, D. melanogaster
ttcattcgaaatt

SEQ ID NO: 666023 - DNA, 13 bp, D. melanogaster
ttcattcgaattt

SEQ ID NO: 666024 - DNA, 13 bp, D. melanogaster
ttcattcgattcg

SEQ ID NO: 666025 - DNA, 13 bp, D. melanogaster
ttcattcgatttg

SEQ ID NO: 666026 - DNA, 13 bp, D. melanogaster
ttcattcgatttt

SEQ ID NO: 666027 - DNA, 13 bp, D. melanogaster
ttcattctccatt

SEQ ID NO: 666028 - DNA, 13 bp, D. melanogaster
ttcattctcgttt

SEQ ID NO: 666029 - DNA, 13 bp, D. melanogaster
ttcattctctaac

SEQ ID NO: 666030 - DNA, 13 bp, D. melanogaster
ttcattctgcaac

SEQ ID NO: 666031 - DNA, 14 bp, D. melanogaster
ttcattcttttgtg

SEQ ID NO: 666032 - DNA, 13 bp, D. melanogaster
ttcattgaaaaaa

SEQ ID NO: 666033 - DNA, 13 bp, D. melanogaster
ttcattgaaaagt

SEQ ID NO: 666034 - DNA, 13 bp, D. melanogaster
ttcattgaaaata

SEQ ID NO: 666035 - DNA, 13 bp, D. melanogaster
ttcattgaaattg

SEQ ID NO: 666036 - DNA, 13 bp, D. melanogaster
ttcattgaacttt

SEQ ID NO: 666037 - DNA, 13 bp, D. melanogaster
ttcattgaatgtt

SEQ ID NO: 666038 - DNA, 13 bp, D. melanogaster
ttcattgaattca

SEQ ID NO: 666039 - DNA, 13 bp, D. melanogaster
ttcattgaattga

SEQ ID NO: 666040 - DNA, 13 bp, D. melanogaster
ttcattgactttg

SEQ ID NO: 666041 - DNA, 13 bp, D. melanogaster
ttcattgactttt

SEQ ID NO: 666042 - DNA, 13 bp, D. melanogaster
ttcattgagcaaa

SEQ ID NO: 666043 - DNA, 13 bp, D. melanogaster
ttcattgagtttt

SEQ ID NO: 666044 - DNA, 13 bp, D. melanogaster
ttcattgattaaa

SEQ ID NO: 666045 - DNA, 14 bp, D. melanogaster
ttcattgattattt

SEQ ID NO: 666046 - DNA, 13 bp, D. melanogaster
ttcattgattttc

SEQ ID NO: 666047 - DNA, 13 bp, D. melanogaster
ttcattgcaattg

SEQ ID NO: 666048 - DNA, 13 bp, D. melanogaster
ttcattgcagcag

SEQ ID NO: 666049 - DNA, 13 bp, D. melanogaster
ttcattgcattta

SEQ ID NO: 666050 - DNA, 13 bp, D. melanogaster
ttcattgccattg

SEQ ID NO: 666051 - DNA, 13 bp, D. melanogaster
ttcattgcgtttt

SEQ ID NO: 666052 - DNA, 13 bp, D. melanogaster
ttcattgctaaaa

SEQ ID NO: 666053 - DNA, 13 bp, D. melanogaster
ttcattggaaatt

SEQ ID NO: 666054 - DNA, 13 bp, D. melanogaster
ttcattggatttt

SEQ ID NO: 666055 - DNA, 13 bp, D. melanogaster
ttcattggcaaat

SEQ ID NO: 666056 - DNA, 13 bp, D. melanogaster
ttcattgggcaat

SEQ ID NO: 666057 - DNA, 14 bp, D. melanogaster
ttcattgggcaatt

SEQ ID NO: 666058 - DNA, 13 bp, D. melanogaster
ttcattgtcaact

SEQ ID NO: 666059 - DNA, 14 bp, D. melanogaster
ttcattgtcaactg

SEQ ID NO: 666060 - DNA, 13 bp, D. melanogaster
ttcattgtcattg

SEQ ID NO: 666061 - DNA, 13 bp, D. melanogaster
ttcattgtgcaaa

SEQ ID NO: 666062 - DNA, 13 bp, D. melanogaster
ttcattgtttgct

SEQ ID NO: 666063 - DNA, 14 bp, D. melanogaster
ttcatttaaatgat

SEQ ID NO: 666064 - DNA, 14 bp, D. melanogaster
ttcatttaaatgca

SEQ ID NO: 666065 - DNA, 14 bp, D. melanogaster
ttcatttaaattca

SEQ ID NO: 666066 - DNA, 13 bp, D. melanogaster
ttcatttaagtta

SEQ ID NO: 666067 - DNA, 14 bp, D. melanogaster
ttcatttacaaaag

SEQ ID NO: 666068 - DNA, 13 bp, D. melanogaster
ttcatttacaaat

SEQ ID NO: 666069 - DNA, 13 bp, D. melanogaster
ttcatttacatta

SEQ ID NO: 666070 - DNA, 13 bp, D. melanogaster
ttcatttacgaaa

SEQ ID NO: 666071 - DNA, 13 bp, D. melanogaster
ttcatttagcatt

SEQ ID NO: 666072 - DNA, 13 bp, D. melanogaster
ttcatttagcttt

SEQ ID NO: 666073 - DNA, 13 bp, D. melanogaster
ttcatttatattg

SEQ ID NO: 666074 - DNA, 13 bp, D. melanogaster
ttcatttatcaat

SEQ ID NO: 666075 - DNA, 13 bp, D. melanogaster
ttcatttatttga

SEQ ID NO: 666076 - DNA, 14 bp, D. melanogaster
ttcatttattttgc

SEQ ID NO: 666077 - DNA, 15 bp, D. melanogaster
ttcatttattttgca

SEQ ID NO: 666078 - DNA, 13 bp, D. melanogaster
ttcatttcaaaag

SEQ ID NO: 666079 - DNA, 13 bp, D. melanogaster
ttcatttcaaaat

SEQ ID NO: 666080 - DNA, 13 bp, D. melanogaster
ttcatttcaaata

SEQ ID NO: 666081 - DNA, 13 bp, D. melanogaster
ttcatttcaatat

SEQ ID NO: 666082 - DNA, 13 bp, D. melanogaster
ttcatttcaatga

SEQ ID NO: 666083 - DNA, 13 bp, D. melanogaster
ttcatttcacaca

SEQ ID NO: 666084 - DNA, 13 bp, D. melanogaster
ttcatttcacttg

SEQ ID NO: 666085 - DNA, 13 bp, D. melanogaster
ttcatttcagttt

SEQ ID NO: 666086 - DNA, 13 bp, D. melanogaster
ttcatttcattca

SEQ ID NO: 666087 - DNA, 14 bp, D. melanogaster
ttcatttcattcat

SEQ ID NO: 666088 - DNA, 13 bp, D. melanogaster
ttcatttcattcc

SEQ ID NO: 666089 - DNA, 13 bp, D. melanogaster
ttcatttcattga

SEQ ID NO: 666090 - DNA, 14 bp, D. melanogaster
ttcatttcatttcg

SEQ ID NO: 666091 - DNA, 13 bp, D. melanogaster
ttcatttcatttg

SEQ ID NO: 666092 - DNA, 14 bp, D. melanogaster
ttcatttcatttgt

SEQ ID NO: 666093 - DNA, 14 bp, D. melanogaster
ttcatttcattttg

SEQ ID NO: 666094 - DNA, 13 bp, D. melanogaster
ttcatttccaact

SEQ ID NO: 666095 - DNA, 13 bp, D. melanogaster
ttcatttccatct

SEQ ID NO: 666096 - DNA, 13 bp, D. melanogaster
ttcatttccatta

SEQ ID NO: 666097 - DNA, 13 bp, D. melanogaster
ttcatttccattc

SEQ ID NO: 666098 - DNA, 14 bp, D. melanogaster
ttcatttccattca

SEQ ID NO: 666099 - DNA, 13 bp, D. melanogaster
ttcatttcccaat

SEQ ID NO: 666100 - DNA, 13 bp, D. melanogaster
ttcatttccctgc

SEQ ID NO: 666101 - DNA, 13 bp, D. melanogaster
ttcatttccgttc

SEQ ID NO: 666102 - DNA, 13 bp, D. melanogaster
ttcatttccgttt

SEQ ID NO: 666103 - DNA, 14 bp, D. melanogaster
ttcatttccgtttt

SEQ ID NO: 666104 - DNA, 13 bp, D. melanogaster
ttcatttcctcgt

SEQ ID NO: 666105 - DNA, 13 bp, D. melanogaster
ttcatttcctggg

SEQ ID NO: 666106 - DNA, 13 bp, D. melanogaster
ttcatttcgaaaa

SEQ ID NO: 666107 - DNA, 13 bp, D. melanogaster
ttcatttcgaatt

SEQ ID NO: 666108 - DNA, 13 bp, D. melanogaster
ttcatttcgattc

SEQ ID NO: 666109 - DNA, 14 bp, D. melanogaster
ttcatttcgatttt

SEQ ID NO: 666110 - DNA, 13 bp, D. melanogaster
ttcatttcgcatt

SEQ ID NO: 666111 - DNA, 13 bp, D. melanogaster
ttcatttcgccca

SEQ ID NO: 666112 - DNA, 13 bp, D. melanogaster
ttcatttcgctga

SEQ ID NO: 666113 - DNA, 13 bp, D. melanogaster
ttcatttcgctgc

SEQ ID NO: 666114 - DNA, 13 bp, D. melanogaster
ttcatttcgctgg

SEQ ID NO: 666115 - DNA, 13 bp, D. melanogaster
ttcatttcgcttc

SEQ ID NO: 666116 - DNA, 13 bp, D. melanogaster
ttcatttcggaca

SEQ ID NO: 666117 - DNA, 13 bp, D. melanogaster
ttcatttcggttc

SEQ ID NO: 666118 - DNA, 13 bp, D. melanogaster
ttcatttcgttcg

SEQ ID NO: 666119 - DNA, 13 bp, D. melanogaster
ttcatttgaaatt

SEQ ID NO: 666120 - DNA, 13 bp, D. melanogaster
ttcatttgaagtt

SEQ ID NO: 666121 - DNA, 13 bp, D. melanogaster
ttcatttgaatac

SEQ ID NO: 666122 - DNA, 14 bp, D. melanogaster
ttcatttgaatatt

SEQ ID NO: 666123 - DNA, 13 bp, D. melanogaster
ttcatttgaattt

SEQ ID NO: 666124 - DNA, 14 bp, D. melanogaster
ttcatttgaattta

SEQ ID NO: 666125 - DNA, 14 bp, D. melanogaster
ttcatttgaatttc

SEQ ID NO: 666126 - DNA, 13 bp, D. melanogaster
ttcatttgacgag

SEQ ID NO: 666127 - DNA, 13 bp, D. melanogaster
ttcatttgagttt

SEQ ID NO: 666128 - DNA, 13 bp, D. melanogaster
ttcatttgataaa

SEQ ID NO: 666129 - DNA, 13 bp, D. melanogaster
ttcatttgatatt

SEQ ID NO: 666130 - DNA, 13 bp, D. melanogaster
ttcatttgatgaa

SEQ ID NO: 666131 - DNA, 14 bp, D. melanogaster
ttcatttgatgaaa

SEQ ID NO: 666132 - DNA, 13 bp, D. melanogaster
ttcatttgattat

SEQ ID NO: 666133 - DNA, 13 bp, D. melanogaster
ttcatttgattca

SEQ ID NO: 666134 - DNA, 14 bp, D. melanogaster
ttcatttgatttta

SEQ ID NO: 666135 - DNA, 13 bp, D. melanogaster
ttcatttgcaaaa

SEQ ID NO: 666136 - DNA, 13 bp, D. melanogaster
ttcatttgcaatg

SEQ ID NO: 666137 - DNA, 13 bp, D. melanogaster
ttcatttgcacaa

SEQ ID NO: 666138 - DNA, 13 bp, D. melanogaster
ttcatttgcactt

SEQ ID NO: 666139 - DNA, 13 bp, D. melanogaster
ttcatttgcattc

SEQ ID NO: 666140 - DNA, 14 bp, D. melanogaster
ttcatttgcattcg

SEQ ID NO: 666141 - DNA, 13 bp, D. melanogaster
ttcatttgcattt

SEQ ID NO: 666142 - DNA, 14 bp, D. melanogaster
ttcatttgcatttg

SEQ ID NO: 666143 - DNA, 13 bp, D. melanogaster
ttcatttgccaaa

SEQ ID NO: 666144 - DNA, 13 bp, D. melanogaster
ttcatttgccagc

SEQ ID NO: 666145 - DNA, 13 bp, D. melanogaster
ttcatttgccgtt

SEQ ID NO: 666146 - DNA, 13 bp, D. melanogaster
ttcatttgccttt

SEQ ID NO: 666147 - DNA, 13 bp, D. melanogaster
ttcatttgctcat

SEQ ID NO: 666148 - DNA, 13 bp, D. melanogaster
ttcatttgctctt

SEQ ID NO: 666149 - DNA, 13 bp, D. melanogaster
ttcatttgctgca

SEQ ID NO: 666150 - DNA, 13 bp, D. melanogaster
ttcatttgctggc

SEQ ID NO: 666151 - DNA, 13 bp, D. melanogaster
ttcatttgcttct

SEQ ID NO: 666152 - DNA, 13 bp, D. melanogaster
ttcatttgctttc

SEQ ID NO: 666153 - DNA, 13 bp, D. melanogaster
ttcatttgctttg

SEQ ID NO: 666154 - DNA, 13 bp, D. melanogaster
ttcatttggattt

SEQ ID NO: 666155 - DNA, 13 bp, D. melanogaster
ttcatttggcaaa

SEQ ID NO: 666156 - DNA, 13 bp, D. melanogaster
ttcatttggcaca

SEQ ID NO: 666157 - DNA, 13 bp, D. melanogaster
ttcatttggcagc

SEQ ID NO: 666158 - DNA, 13 bp, D. melanogaster
ttcatttggcatg

SEQ ID NO: 666159 - DNA, 13 bp, D. melanogaster
ttcatttggccaa

SEQ ID NO: 666160 - DNA, 13 bp, D. melanogaster
ttcatttggctgc

SEQ ID NO: 666161 - DNA, 13 bp, D. melanogaster
ttcatttggcttt

SEQ ID NO: 666162 - DNA, 13 bp, D. melanogaster
ttcatttgggttt

SEQ ID NO: 666163 - DNA, 14 bp, D. melanogaster
ttcatttggtactt

SEQ ID NO: 666164 - DNA, 13 bp, D. melanogaster
ttcatttgtatta

SEQ ID NO: 666165 - DNA, 13 bp, D. melanogaster
ttcatttgttaaa

SEQ ID NO: 666166 - DNA, 13 bp, D. melanogaster
ttcatttgttata

SEQ ID NO: 666167 - DNA, 14 bp, D. melanogaster
ttcatttgttgttg

SEQ ID NO: 666168 - DNA, 14 bp, D. melanogaster
ttcatttgtttgcc

SEQ ID NO: 666169 - DNA, 13 bp, D. melanogaster
ttcattttaaatg

SEQ ID NO: 666170 - DNA, 13 bp, D. melanogaster
ttcattttacaat

SEQ ID NO: 666171 - DNA, 13 bp, D. melanogaster
ttcattttatgaa

SEQ ID NO: 666172 - DNA, 13 bp, D. melanogaster
ttcattttattgg

SEQ ID NO: 666173 - DNA, 13 bp, D. melanogaster
ttcattttcaaaa

SEQ ID NO: 666174 - DNA, 13 bp, D. melanogaster
ttcattttcaaca

SEQ ID NO: 666175 - DNA, 13 bp, D. melanogaster
ttcattttcaact

SEQ ID NO: 666176 - DNA, 13 bp, D. melanogaster
ttcattttcaatg

SEQ ID NO: 666177 - DNA, 13 bp, D. melanogaster
ttcattttcacac

SEQ ID NO: 666178 - DNA, 13 bp, D. melanogaster
ttcattttcagca

SEQ ID NO: 666179 - DNA, 13 bp, D. melanogaster
ttcattttcagcc

SEQ ID NO: 666180 - DNA, 13 bp, D. melanogaster
ttcattttcagtt

SEQ ID NO: 666181 - DNA, 14 bp, D. melanogaster
ttcattttcagttt

SEQ ID NO: 666182 - DNA, 14 bp, D. melanogaster
ttcattttcattca

SEQ ID NO: 666183 - DNA, 13 bp, D. melanogaster
ttcattttccagc

SEQ ID NO: 666184 - DNA, 13 bp, D. melanogaster
ttcattttcctgc

SEQ ID NO: 666185 - DNA, 13 bp, D. melanogaster
ttcattttcgaat

SEQ ID NO: 666186 - DNA, 13 bp, D. melanogaster
ttcattttcgata

SEQ ID NO: 666187 - DNA, 14 bp, D. melanogaster
ttcattttcgataa

SEQ ID NO: 666188 - DNA, 14 bp, D. melanogaster
ttcattttcgattt

SEQ ID NO: 666189 - DNA, 13 bp, D. melanogaster
ttcattttcgctg

SEQ ID NO: 666190 - DNA, 13 bp, D. melanogaster
ttcattttgaatt

SEQ ID NO: 666191 - DNA, 14 bp, D. melanogaster
ttcattttgaatta

SEQ ID NO: 666192 - DNA, 13 bp, D. melanogaster
ttcattttgactt

SEQ ID NO: 666193 - DNA, 13 bp, D. melanogaster
ttcattttgattg

SEQ ID NO: 666194 - DNA, 13 bp, D. melanogaster
ttcattttgcaca

SEQ ID NO: 666195 - DNA, 14 bp, D. melanogaster
ttcattttgcattt

SEQ ID NO: 666196 - DNA, 13 bp, D. melanogaster
ttcattttgcctt

SEQ ID NO: 666197 - DNA, 13 bp, D. melanogaster
ttcattttggatt

SEQ ID NO: 666198 - DNA, 13 bp, D. melanogaster
ttcattttggcca

SEQ ID NO: 666199 - DNA, 14 bp, D. melanogaster
ttcattttggcttt

SEQ ID NO: 666200 - DNA, 13 bp, D. melanogaster
ttcattttgtaat

SEQ ID NO: 666201 - DNA, 13 bp, D. melanogaster
ttcatttttaacg

SEQ ID NO: 666202 - DNA, 13 bp, D. melanogaster
ttcatttttatga

SEQ ID NO: 666203 - DNA, 13 bp, D. melanogaster
ttcatttttatgg

SEQ ID NO: 666204 - DNA, 13 bp, D. melanogaster
ttcatttttcaac

SEQ ID NO: 666205 - DNA, 13 bp, D. melanogaster
ttcatttttcaca

SEQ ID NO: 666206 - DNA, 13 bp, D. melanogaster
ttcatttttcagt

SEQ ID NO: 666207 - DNA, 13 bp, D. melanogaster
ttcatttttggcc

SEQ ID NO: 666208 - DNA, 13 bp, D. melanogaster
ttcattttttggc

SEQ ID NO: 666209 - DNA, 13 bp, D. melanogaster
ttccaaaaatact

SEQ ID NO: 666210 - DNA, 13 bp, D. melanogaster
ttccaaaaatagt

SEQ ID NO: 666211 - DNA, 13 bp, D. melanogaster
ttccaaaaccaaa

SEQ ID NO: 666212 - DNA, 13 bp, D. melanogaster
ttccaaaatacaa

SEQ ID NO: 666213 - DNA, 14 bp, D. melanogaster
ttccaaaatacaat

SEQ ID NO: 666214 - DNA, 13 bp, D. melanogaster
ttccaaaatatat

SEQ ID NO: 666215 - DNA, 13 bp, D. melanogaster
ttccaaaatcgac

SEQ ID NO: 666216 - DNA, 13 bp, D. melanogaster
ttccaaaattatt

SEQ ID NO: 666217 - DNA, 13 bp, D. melanogaster
ttccaaaattgtt

SEQ ID NO: 666218 - DNA, 13 bp, D. melanogaster
ttccaaacaaatt

SEQ ID NO: 666219 - DNA, 13 bp, D. melanogaster
ttccaaacacaca

SEQ ID NO: 666220 - DNA, 13 bp, D. melanogaster
ttccaaacacttt

SEQ ID NO: 666221 - DNA, 14 bp, D. melanogaster
ttccaaacataaat

SEQ ID NO: 666222 - DNA, 13 bp, D. melanogaster
ttccaaagaaacc

SEQ ID NO: 666223 - DNA, 13 bp, D. melanogaster
ttccaaaggaatt

SEQ ID NO: 666224 - DNA, 13 bp, D. melanogaster
ttccaaataaaac

SEQ ID NO: 666225 - DNA, 13 bp, D. melanogaster
ttccaaataaaat

SEQ ID NO: 666226 - DNA, 13 bp, D. melanogaster
ttccaaataatac

SEQ ID NO: 666227 - DNA, 13 bp, D. melanogaster
ttccaaatatgga

SEQ ID NO: 666228 - DNA, 13 bp, D. melanogaster
ttccaaatattcc

SEQ ID NO: 666229 - DNA, 13 bp, D. melanogaster
ttccaaatcattt

SEQ ID NO: 666230 - DNA, 13 bp, D. melanogaster
ttccaaatcgcgt

SEQ ID NO: 666231 - DNA, 13 bp, D. melanogaster
ttccaaattattt

SEQ ID NO: 666232 - DNA, 13 bp, D. melanogaster
ttccaaatttaat

SEQ ID NO: 666233 - DNA, 13 bp, D. melanogaster
ttccaaattttcc

SEQ ID NO: 666234 - DNA, 13 bp, D. melanogaster
ttccaacaatttt

SEQ ID NO: 666235 - DNA, 13 bp, D. melanogaster
ttccaacaccaaa

SEQ ID NO: 666236 - DNA, 13 bp, D. melanogaster
ttccaacgcaaac

SEQ ID NO: 666237 - DNA, 13 bp, D. melanogaster
ttccaacgctttt

SEQ ID NO: 666238 - DNA, 13 bp, D. melanogaster
ttccaactaattt

SEQ ID NO: 666239 - DNA, 13 bp, D. melanogaster
ttccaactctttt

SEQ ID NO: 666240 - DNA, 13 bp, D. melanogaster
ttccaactttaaa

SEQ ID NO: 666241 - DNA, 13 bp, D. melanogaster
ttccaagtagatt

SEQ ID NO: 666242 - DNA, 13 bp, D. melanogaster
ttccaagttccaa

SEQ ID NO: 666243 - DNA, 13 bp, D. melanogaster
ttccaataaataa

SEQ ID NO: 666244 - DNA, 13 bp, D. melanogaster
ttccaataatttc

SEQ ID NO: 666245 - DNA, 13 bp, D. melanogaster
ttccaatatctat

SEQ ID NO: 666246 - DNA, 13 bp, D. melanogaster
ttccaatatggtt

SEQ ID NO: 666247 - DNA, 13 bp, D. melanogaster
ttccaatcaaaat

SEQ ID NO: 666248 - DNA, 13 bp, D. melanogaster
ttccaatcagcag

SEQ ID NO: 666249 - DNA, 14 bp, D. melanogaster
ttccaatcgatttg

SEQ ID NO: 666250 - DNA, 13 bp, D. melanogaster
ttccaatgaattt

SEQ ID NO: 666251 - DNA, 13 bp, D. melanogaster
ttccaattaaact

SEQ ID NO: 666252 - DNA, 13 bp, D. melanogaster
ttccaattaataa

SEQ ID NO: 666253 - DNA, 13 bp, D. melanogaster
ttccaattaattt

SEQ ID NO: 666254 - DNA, 13 bp, D. melanogaster
ttccaattaccaa

SEQ ID NO: 666255 - DNA, 13 bp, D. melanogaster
ttccaattcaatt

SEQ ID NO: 666256 - DNA, 13 bp, D. melanogaster
ttccaattccaat

SEQ ID NO: 666257 - DNA, 13 bp, D. melanogaster
ttccaattccatt

SEQ ID NO: 666258 - DNA, 14 bp, D. melanogaster
ttccaattccattt

SEQ ID NO: 666259 - DNA, 13 bp, D. melanogaster
ttccaattcccca

SEQ ID NO: 666260 - DNA, 13 bp, D. melanogaster
ttccaattcgaat

SEQ ID NO: 666261 - DNA, 13 bp, D. melanogaster
ttccaattcggtt

SEQ ID NO: 666262 - DNA, 14 bp, D. melanogaster
ttccaattgaaaat

SEQ ID NO: 666263 - DNA, 13 bp, D. melanogaster
ttccaattgaaat

SEQ ID NO: 666264 - DNA, 13 bp, D. melanogaster
ttccaattgcatt

SEQ ID NO: 666265 - DNA, 13 bp, D. melanogaster
ttccaattggaaa

SEQ ID NO: 666266 - DNA, 13 bp, D. melanogaster
ttccaattggaat

SEQ ID NO: 666267 - DNA, 13 bp, D. melanogaster
ttccaattgtttt

SEQ ID NO: 666268 - DNA, 13 bp, D. melanogaster
ttccaatttcaat

SEQ ID NO: 666269 - DNA, 13 bp, D. melanogaster
ttccaatttccca

SEQ ID NO: 666270 - DNA, 13 bp, D. melanogaster
ttccaatttctat

SEQ ID NO: 666271 - DNA, 13 bp, D. melanogaster
ttccaatttgtat

SEQ ID NO: 666272 - DNA, 13 bp, D. melanogaster
ttccaatttgttt

SEQ ID NO: 666273 - DNA, 13 bp, D. melanogaster
ttccaattttaaa

SEQ ID NO: 666274 - DNA, 13 bp, D. melanogaster
ttccaattttcat

SEQ ID NO: 666275 - DNA, 13 bp, D. melanogaster
ttccaatttttcc

SEQ ID NO: 666276 - DNA, 13 bp, D. melanogaster
ttccacaaaaaca

SEQ ID NO: 666277 - DNA, 13 bp, D. melanogaster
ttccacaaaattt

SEQ ID NO: 666278 - DNA, 13 bp, D. melanogaster
ttccacaaatctg

SEQ ID NO: 666279 - DNA, 13 bp, D. melanogaster
ttccacaacagca

SEQ ID NO: 666280 - DNA, 13 bp, D. melanogaster
ttccacaacgatg

SEQ ID NO: 666281 - DNA, 13 bp, D. melanogaster
ttccacaattaaa

SEQ ID NO: 666282 - DNA, 13 bp, D. melanogaster
ttccacaattttc

SEQ ID NO: 666283 - DNA, 13 bp, D. melanogaster
ttccacaattttt

SEQ ID NO: 666284 - DNA, 13 bp, D. melanogaster
ttccacacaaaag

SEQ ID NO: 666285 - DNA, 13 bp, D. melanogaster
ttccacacacaaa

SEQ ID NO: 666286 - DNA, 13 bp, D. melanogaster
ttccacacacaca

SEQ ID NO: 666287 - DNA, 14 bp, D. melanogaster
ttccacacacacac

SEQ ID NO: 666288 - DNA, 13 bp, D. melanogaster
ttccacacacttt

SEQ ID NO: 666289 - DNA, 13 bp, D. melanogaster
ttccacaccactt

SEQ ID NO: 666290 - DNA, 13 bp, D. melanogaster
ttccacacttttt

SEQ ID NO: 666291 - DNA, 13 bp, D. melanogaster
ttccacatccttt

SEQ ID NO: 666292 - DNA, 13 bp, D. melanogaster
ttccacatttaat

SEQ ID NO: 666293 - DNA, 13 bp, D. melanogaster
ttccacatttccc

SEQ ID NO: 666294 - DNA, 13 bp, D. melanogaster
ttccacatttgaa

SEQ ID NO: 666295 - DNA, 14 bp, D. melanogaster
ttccacattttccc

SEQ ID NO: 666296 - DNA, 13 bp, D. melanogaster
ttccaccaaaaat

SEQ ID NO: 666297 - DNA, 13 bp, D. melanogaster
ttccaccatttcc

SEQ ID NO: 666298 - DNA, 13 bp, D. melanogaster
ttccaccattttc

SEQ ID NO: 666299 - DNA, 13 bp, D. melanogaster
ttccacccaaaaa

SEQ ID NO: 666300 - DNA, 13 bp, D. melanogaster
ttccacccacaaa

SEQ ID NO: 666301 - DNA, 13 bp, D. melanogaster
ttccaccgctttt

SEQ ID NO: 666302 - DNA, 13 bp, D. melanogaster
ttccacgcccact

SEQ ID NO: 666303 - DNA, 13 bp, D. melanogaster
ttccacgcttttc

SEQ ID NO: 666304 - DNA, 14 bp, D. melanogaster
ttccacgcttttcc

SEQ ID NO: 666305 - DNA, 13 bp, D. melanogaster
ttccacggaaaaa

SEQ ID NO: 666306 - DNA, 13 bp, D. melanogaster
ttccactccactc

SEQ ID NO: 666307 - DNA, 13 bp, D. melanogaster
ttccactcttatt

SEQ ID NO: 666308 - DNA, 13 bp, D. melanogaster
ttccactgcactt

SEQ ID NO: 666309 - DNA, 13 bp, D. melanogaster
ttccactgccact

SEQ ID NO: 666310 - DNA, 13 bp, D. melanogaster
ttccactgctttt

SEQ ID NO: 666311 - DNA, 13 bp, D. melanogaster
ttccacttaaaat

SEQ ID NO: 666312 - DNA, 13 bp, D. melanogaster
ttccacttaaatg

SEQ ID NO: 666313 - DNA, 13 bp, D. melanogaster
ttccacttcaatt

SEQ ID NO: 666314 - DNA, 13 bp, D. melanogaster
ttccacttccaag

SEQ ID NO: 666315 - DNA, 13 bp, D. melanogaster
ttccacttccaat

SEQ ID NO: 666316 - DNA, 14 bp, D. melanogaster
ttccacttccactt

SEQ ID NO: 666317 - DNA, 13 bp, D. melanogaster
ttccacttccagt

SEQ ID NO: 666318 - DNA, 14 bp, D. melanogaster
ttccacttcccagt

SEQ ID NO: 666319 - DNA, 15 bp, D. melanogaster
ttccacttgactatg

SEQ ID NO: 666320 - DNA, 13 bp, D. melanogaster
ttccacttggcag

SEQ ID NO: 666321 - DNA, 13 bp, D. melanogaster
ttccacttggcca

SEQ ID NO: 666322 - DNA, 13 bp, D. melanogaster
ttccactttaaat

SEQ ID NO: 666323 - DNA, 13 bp, D. melanogaster
ttccactttcact

SEQ ID NO: 666324 - DNA, 13 bp, D. melanogaster
ttccactttccac

SEQ ID NO: 666325 - DNA, 13 bp, D. melanogaster
ttccacttttata

SEQ ID NO: 666326 - DNA, 14 bp, D. melanogaster
ttccacttttatat

SEQ ID NO: 666327 - DNA, 13 bp, D. melanogaster
ttccacttttcca

SEQ ID NO: 666328 - DNA, 14 bp, D. melanogaster
ttccacttttccac

SEQ ID NO: 666329 - DNA, 13 bp, D. melanogaster
ttccacttttgca

SEQ ID NO: 666330 - DNA, 13 bp, D. melanogaster
ttccacttttggc

SEQ ID NO: 666331 - DNA, 13 bp, D. melanogaster
ttccactttttgt

SEQ ID NO: 666332 - DNA, 13 bp, D. melanogaster
ttccagcaattat

SEQ ID NO: 666333 - DNA, 14 bp, D. melanogaster
ttccagcattttcc

SEQ ID NO: 666334 - DNA, 13 bp, D. melanogaster
ttccagcattttt

SEQ ID NO: 666335 - DNA, 13 bp, D. melanogaster
ttccagccaaaaa

SEQ ID NO: 666336 - DNA, 13 bp, D. melanogaster
ttccagccagcca

SEQ ID NO: 666337 - DNA, 13 bp, D. melanogaster
ttccagcgatttt

SEQ ID NO: 666338 - DNA, 13 bp, D. melanogaster
ttccagctatttt

SEQ ID NO: 666339 - DNA, 14 bp, D. melanogaster
ttccagctccagct

SEQ ID NO: 666340 - DNA, 13 bp, D. melanogaster
ttccagctgctgc

SEQ ID NO: 666341 - DNA, 13 bp, D. melanogaster
ttccagctgcttt

SEQ ID NO: 666342 - DNA, 13 bp, D. melanogaster
ttccagctggaaa

SEQ ID NO: 666343 - DNA, 13 bp, D. melanogaster
ttccagcttccaa

SEQ ID NO: 666344 - DNA, 13 bp, D. melanogaster
ttccagctttttc

SEQ ID NO: 666345 - DNA, 13 bp, D. melanogaster
ttccagctttttt

SEQ ID NO: 666346 - DNA, 13 bp, D. melanogaster
ttccaggaaaacg

SEQ ID NO: 666347 - DNA, 13 bp, D. melanogaster
ttccaggagtcat

SEQ ID NO: 666348 - DNA, 13 bp, D. melanogaster
ttccagggcgata

SEQ ID NO: 666349 - DNA, 13 bp, D. melanogaster
ttccaggttacaa

SEQ ID NO: 666350 - DNA, 13 bp, D. melanogaster
ttccagtgcactg

SEQ ID NO: 666351 - DNA, 13 bp, D. melanogaster
ttccagtgcctcc

SEQ ID NO: 666352 - DNA, 13 bp, D. melanogaster
ttccagtgtgtgt

SEQ ID NO: 666353 - DNA, 13 bp, D. melanogaster
ttccagttcccag

SEQ ID NO: 666354 - DNA, 13 bp, D. melanogaster
ttccagttgccgt

SEQ ID NO: 666355 - DNA, 14 bp, D. melanogaster
ttccagttgccgtc

SEQ ID NO: 666356 - DNA, 13 bp, D. melanogaster
ttccagtttccag

SEQ ID NO: 666357 - DNA, 13 bp, D. melanogaster
ttccagttttccc

SEQ ID NO: 666358 - DNA, 13 bp, D. melanogaster
ttccagttttctt

SEQ ID NO: 666359 - DNA, 13 bp, D. melanogaster
ttccataaattta

SEQ ID NO: 666360 - DNA, 13 bp, D. melanogaster
ttccataaatttt

SEQ ID NO: 666361 - DNA, 13 bp, D. melanogaster
ttccatacaaata

SEQ ID NO: 666362 - DNA, 13 bp, D. melanogaster
ttccatagcttcc

SEQ ID NO: 666363 - DNA, 13 bp, D. melanogaster
ttccatatacata

SEQ ID NO: 666364 - DNA, 13 bp, D. melanogaster
ttccatatatgag

SEQ ID NO: 666365 - DNA, 13 bp, D. melanogaster
ttccatatattta

SEQ ID NO: 666366 - DNA, 13 bp, D. melanogaster
ttccatatccatt

SEQ ID NO: 666367 - DNA, 13 bp, D. melanogaster
ttccatatgcaaa

SEQ ID NO: 666368 - DNA, 13 bp, D. melanogaster
ttccatattccat

SEQ ID NO: 666369 - DNA, 13 bp, D. melanogaster
ttccatatttaat

SEQ ID NO: 666370 - DNA, 13 bp, D. melanogaster
ttccatatttgga

SEQ ID NO: 666371 - DNA, 13 bp, D. melanogaster
ttccatattttac

SEQ ID NO: 666372 - DNA, 13 bp, D. melanogaster
ttccatattttgt

SEQ ID NO: 666373 - DNA, 13 bp, D. melanogaster
ttccatcaaatag

SEQ ID NO: 666374 - DNA, 13 bp, D. melanogaster
ttccatcacatgg

SEQ ID NO: 666375 - DNA, 13 bp, D. melanogaster
ttccatcatgctc

SEQ ID NO: 666376 - DNA, 13 bp, D. melanogaster
ttccatcccatcc

SEQ ID NO: 666377 - DNA, 13 bp, D. melanogaster
ttccatcgatttg

SEQ ID NO: 666378 - DNA, 14 bp, D. melanogaster
ttccatcgcttttc

SEQ ID NO: 666379 - DNA, 13 bp, D. melanogaster
ttccatcgttatt

SEQ ID NO: 666380 - DNA, 13 bp, D. melanogaster
ttccatcgttttt

SEQ ID NO: 666381 - DNA, 13 bp, D. melanogaster
ttccatctcattt

SEQ ID NO: 666382 - DNA, 13 bp, D. melanogaster
ttccatctcgctc

SEQ ID NO: 666383 - DNA, 13 bp, D. melanogaster
ttccatctgacca

SEQ ID NO: 666384 - DNA, 13 bp, D. melanogaster
ttccatggcattt

SEQ ID NO: 666385 - DNA, 13 bp, D. melanogaster
ttccatgtatgta

SEQ ID NO: 666386 - DNA, 13 bp, D. melanogaster
ttccatgtttcat

SEQ ID NO: 666387 - DNA, 14 bp, D. melanogaster
ttccatgtttcatt

SEQ ID NO: 666388 - DNA, 13 bp, D. melanogaster
ttccattaaaaac

SEQ ID NO: 666389 - DNA, 13 bp, D. melanogaster
ttccattaaaaat

SEQ ID NO: 666390 - DNA, 13 bp, D. melanogaster
ttccattaaagtt

SEQ ID NO: 666391 - DNA, 14 bp, D. melanogaster
ttccattaaatacc

SEQ ID NO: 666392 - DNA, 13 bp, D. melanogaster
ttccattaattta

SEQ ID NO: 666393 - DNA, 13 bp, D. melanogaster
ttccattacaaaa

SEQ ID NO: 666394 - DNA, 13 bp, D. melanogaster
ttccattaccatt

SEQ ID NO: 666395 - DNA, 13 bp, D. melanogaster
ttccattacggca

SEQ ID NO: 666396 - DNA, 13 bp, D. melanogaster
ttccattcaaaat

SEQ ID NO: 666397 - DNA, 13 bp, D. melanogaster
ttccattcaaatg

SEQ ID NO: 666398 - DNA, 13 bp, D. melanogaster
ttccattcaaatt

SEQ ID NO: 666399 - DNA, 13 bp, D. melanogaster
ttccattcacatt

SEQ ID NO: 666400 - DNA, 14 bp, D. melanogaster
ttccattcatattt

SEQ ID NO: 666401 - DNA, 13 bp, D. melanogaster
ttccattccaatt

SEQ ID NO: 666402 - DNA, 13 bp, D. melanogaster
ttccattccattc

SEQ ID NO: 666403 - DNA, 14 bp, D. melanogaster
ttccattccatttc

SEQ ID NO: 666404 - DNA, 13 bp, D. melanogaster
ttccattcccatt

SEQ ID NO: 666405 - DNA, 13 bp, D. melanogaster
ttccattccgttt

SEQ ID NO: 666406 - DNA, 13 bp, D. melanogaster
ttccattcgaatt

SEQ ID NO: 666407 - DNA, 14 bp, D. melanogaster
ttccattcgagtgg

SEQ ID NO: 666408 - DNA, 13 bp, D. melanogaster
ttccattcgattc

SEQ ID NO: 666409 - DNA, 13 bp, D. melanogaster
ttccattcgattt

SEQ ID NO: 666410 - DNA, 13 bp, D. melanogaster
ttccattcgcttt

SEQ ID NO: 666411 - DNA, 13 bp, D. melanogaster
ttccattgaaatt

SEQ ID NO: 666412 - DNA, 13 bp, D. melanogaster
ttccattgaactt

SEQ ID NO: 666413 - DNA, 13 bp, D. melanogaster
ttccattgaattt

SEQ ID NO: 666414 - DNA, 13 bp, D. melanogaster
ttccattgaccac

SEQ ID NO: 666415 - DNA, 13 bp, D. melanogaster
ttccattgcaaat

SEQ ID NO: 666416 - DNA, 13 bp, D. melanogaster
ttccattgccatt

SEQ ID NO: 666417 - DNA, 13 bp, D. melanogaster
ttccattgctttg

SEQ ID NO: 666418 - DNA, 13 bp, D. melanogaster
ttccattggccat

SEQ ID NO: 666419 - DNA, 13 bp, D. melanogaster
ttccattggcttt

SEQ ID NO: 666420 - DNA, 13 bp, D. melanogaster
ttccattggttcg

SEQ ID NO: 666421 - DNA, 14 bp, D. melanogaster
ttccatttaaaaat

SEQ ID NO: 666422 - DNA, 13 bp, D. melanogaster
ttccatttacatt

SEQ ID NO: 666423 - DNA, 13 bp, D. melanogaster
ttccatttattcc

SEQ ID NO: 666424 - DNA, 14 bp, D. melanogaster
ttccatttcaattt

SEQ ID NO: 666425 - DNA, 13 bp, D. melanogaster
ttccatttcacat

SEQ ID NO: 666426 - DNA, 13 bp, D. melanogaster
ttccatttccaaa

SEQ ID NO: 666427 - DNA, 14 bp, D. melanogaster
ttccatttccaatt

SEQ ID NO: 666428 - DNA, 13 bp, D. melanogaster
ttccatttccaca

SEQ ID NO: 666429 - DNA, 13 bp, D. melanogaster
ttccatttccacc

SEQ ID NO: 666430 - DNA, 13 bp, D. melanogaster
ttccatttccacg

SEQ ID NO: 666431 - DNA, 13 bp, D. melanogaster
ttccatttccact

SEQ ID NO: 666432 - DNA, 14 bp, D. melanogaster
ttccatttccattc

SEQ ID NO: 666433 - DNA, 13 bp, D. melanogaster
ttccatttcgaat

SEQ ID NO: 666434 - DNA, 13 bp, D. melanogaster
ttccatttcgatg

SEQ ID NO: 666435 - DNA, 13 bp, D. melanogaster
ttccatttcgatt

SEQ ID NO: 666436 - DNA, 13 bp, D. melanogaster
ttccatttcgcag

SEQ ID NO: 666437 - DNA, 13 bp, D. melanogaster
ttccatttcgcca

SEQ ID NO: 666438 - DNA, 13 bp, D. melanogaster
ttccatttcgctt

SEQ ID NO: 666439 - DNA, 13 bp, D. melanogaster
ttccatttcgttg

SEQ ID NO: 666440 - DNA, 13 bp, D. melanogaster
ttccatttcgttt

SEQ ID NO: 666441 - DNA, 13 bp, D. melanogaster
ttccatttctcca

SEQ ID NO: 666442 - DNA, 13 bp, D. melanogaster
ttccatttctttg

SEQ ID NO: 666443 - DNA, 13 bp, D. melanogaster
ttccatttgaaat

SEQ ID NO: 666444 - DNA, 13 bp, D. melanogaster
ttccatttgaatg

SEQ ID NO: 666445 - DNA, 14 bp, D. melanogaster
ttccatttgaatgg

SEQ ID NO: 666446 - DNA, 13 bp, D. melanogaster
ttccatttgaatt

SEQ ID NO: 666447 - DNA, 14 bp, D. melanogaster
ttccatttgaattt

SEQ ID NO: 666448 - DNA, 13 bp, D. melanogaster
ttccatttgataa

SEQ ID NO: 666449 - DNA, 13 bp, D. melanogaster
ttccatttgatat

SEQ ID NO: 666450 - DNA, 13 bp, D. melanogaster
ttccatttgcaat

SEQ ID NO: 666451 - DNA, 13 bp, D. melanogaster
ttccatttgcata

SEQ ID NO: 666452 - DNA, 13 bp, D. melanogaster
ttccatttgcatt

SEQ ID NO: 666453 - DNA, 14 bp, D. melanogaster
ttccatttgcattt

SEQ ID NO: 666454 - DNA, 13 bp, D. melanogaster
ttccatttgccac

SEQ ID NO: 666455 - DNA, 13 bp, D. melanogaster
ttccatttgccat

SEQ ID NO: 666456 - DNA, 13 bp, D. melanogaster
ttccatttgccca

SEQ ID NO: 666457 - DNA, 13 bp, D. melanogaster
ttccatttggatt

SEQ ID NO: 666458 - DNA, 13 bp, D. melanogaster
ttccatttggccc

SEQ ID NO: 666459 - DNA, 13 bp, D. melanogaster
ttccatttgtaaa

SEQ ID NO: 666460 - DNA, 13 bp, D. melanogaster
ttccatttgtatt

SEQ ID NO: 666461 - DNA, 13 bp, D. melanogaster
ttccattttaaag

SEQ ID NO: 666462 - DNA, 13 bp, D. melanogaster
ttccattttaata

SEQ ID NO: 666463 - DNA, 13 bp, D. melanogaster
ttccattttcact

SEQ ID NO: 666464 - DNA, 14 bp, D. melanogaster
ttccattttccact

SEQ ID NO: 666465 - DNA, 13 bp, D. melanogaster
ttccattttccag

SEQ ID NO: 666466 - DNA, 13 bp, D. melanogaster
ttccattttctgt

SEQ ID NO: 666467 - DNA, 13 bp, D. melanogaster
ttccattttgatt

SEQ ID NO: 666468 - DNA, 14 bp, D. melanogaster
ttccattttgattt

SEQ ID NO: 666469 - DNA, 13 bp, D. melanogaster
ttccattttgcat

SEQ ID NO: 666470 - DNA, 13 bp, D. melanogaster
ttccattttggca

SEQ ID NO: 666471 - DNA, 13 bp, D. melanogaster
ttccattttgttg

SEQ ID NO: 666472 - DNA, 13 bp, D. melanogaster
ttccatttttccg

SEQ ID NO: 666473 - DNA, 13 bp, D. melanogaster
ttccatttttcgt

SEQ ID NO: 666474 - DNA, 13 bp, D. melanogaster
ttccatttttgag

SEQ ID NO: 666475 - DNA, 13 bp, D. melanogaster
ttccatttttgca

SEQ ID NO: 666476 - DNA, 13 bp, D. melanogaster
ttccatttttggg

SEQ ID NO: 666477 - DNA, 14 bp, D. melanogaster
ttccattttttctg

SEQ ID NO: 666478 - DNA, 13 bp, D. melanogaster
ttcccaaaaacaa

SEQ ID NO: 666479 - DNA, 13 bp, D. melanogaster
ttcccaaaaagct

SEQ ID NO: 666480 - DNA, 13 bp, D. melanogaster
ttcccaaaaatat

SEQ ID NO: 666481 - DNA, 13 bp, D. melanogaster
ttcccaaaactaa

SEQ ID NO: 666482 - DNA, 13 bp, D. melanogaster
ttcccaaaataaa

SEQ ID NO: 666483 - DNA, 13 bp, D. melanogaster
ttcccaaaatgaa

SEQ ID NO: 666484 - DNA, 13 bp, D. melanogaster
ttcccaaataaat

SEQ ID NO: 666485 - DNA, 13 bp, D. melanogaster
ttcccaaatcgaa

SEQ ID NO: 666486 - DNA, 13 bp, D. melanogaster
ttcccaaatttga

SEQ ID NO: 666487 - DNA, 14 bp, D. melanogaster
ttcccaaatttgaa

SEQ ID NO: 666488 - DNA, 13 bp, D. melanogaster
ttcccaactattt

SEQ ID NO: 666489 - DNA, 13 bp, D. melanogaster
ttcccaatcccaa

SEQ ID NO: 666490 - DNA, 14 bp, D. melanogaster
ttcccaatcccaat

SEQ ID NO: 666491 - DNA, 13 bp, D. melanogaster
ttcccaatcccat

SEQ ID NO: 666492 - DNA, 14 bp, D. melanogaster
ttcccaatcccatt

SEQ ID NO: 666493 - DNA, 13 bp, D. melanogaster
ttcccaatcccca

SEQ ID NO: 666494 - DNA, 13 bp, D. melanogaster
ttcccaattaatt

SEQ ID NO: 666495 - DNA, 13 bp, D. melanogaster
ttcccaattccca

SEQ ID NO: 666496 - DNA, 13 bp, D. melanogaster
ttcccaatttggt

SEQ ID NO: 666497 - DNA, 13 bp, D. melanogaster
ttcccaattttcc

SEQ ID NO: 666498 - DNA, 13 bp, D. melanogaster
ttcccacactttt

SEQ ID NO: 666499 - DNA, 14 bp, D. melanogaster
ttcccacatatgaa

SEQ ID NO: 666500 - DNA, 13 bp, D. melanogaster
ttcccacccactt

SEQ ID NO: 666501 - DNA, 13 bp, D. melanogaster
ttcccacttccca

SEQ ID NO: 666502 - DNA, 13 bp, D. melanogaster
ttcccagaaaatt

SEQ ID NO: 666503 - DNA, 13 bp, D. melanogaster
ttcccagattttt

SEQ ID NO: 666504 - DNA, 13 bp, D. melanogaster
ttcccagcatatt

SEQ ID NO: 666505 - DNA, 13 bp, D. melanogaster
ttcccagttggct

SEQ ID NO: 666506 - DNA, 13 bp, D. melanogaster
ttcccagtttccc

SEQ ID NO: 666507 - DNA, 14 bp, D. melanogaster
ttcccagtttccca

SEQ ID NO: 666508 - DNA, 13 bp, D. melanogaster
ttcccagttttca

SEQ ID NO: 666509 - DNA, 13 bp, D. melanogaster
ttcccagttttcc

SEQ ID NO: 666510 - DNA, 13 bp, D. melanogaster
ttcccataaaaaa

SEQ ID NO: 666511 - DNA, 13 bp, D. melanogaster
ttcccatacccat

SEQ ID NO: 666512 - DNA, 13 bp, D. melanogaster
ttcccatcatcat

SEQ ID NO: 666513 - DNA, 13 bp, D. melanogaster
ttcccatctccat

SEQ ID NO: 666514 - DNA, 13 bp, D. melanogaster
ttcccatgcccat

SEQ ID NO: 666515 - DNA, 13 bp, D. melanogaster
ttcccattcaaaa

SEQ ID NO: 666516 - DNA, 14 bp, D. melanogaster
ttcccattcaaaat

SEQ ID NO: 666517 - DNA, 13 bp, D. melanogaster
ttcccattcaaat

SEQ ID NO: 666518 - DNA, 13 bp, D. melanogaster
ttcccattcacat

SEQ ID NO: 666519 - DNA, 13 bp, D. melanogaster
ttcccattccaat

SEQ ID NO: 666520 - DNA, 13 bp, D. melanogaster
ttcccattcccaa

SEQ ID NO: 666521 - DNA, 13 bp, D. melanogaster
ttcccattcccag

SEQ ID NO: 666522 - DNA, 13 bp, D. melanogaster
ttcccattccccg

SEQ ID NO: 666523 - DNA, 13 bp, D. melanogaster
ttcccattcccgt

SEQ ID NO: 666524 - DNA, 14 bp, D. melanogaster
ttcccattcccgtt

SEQ ID NO: 666525 - DNA, 13 bp, D. melanogaster
ttcccattcgaat

SEQ ID NO: 666526 - DNA, 13 bp, D. melanogaster
ttcccattcgcag

SEQ ID NO: 666527 - DNA, 14 bp, D. melanogaster
ttcccattcgcatt

SEQ ID NO: 666528 - DNA, 13 bp, D. melanogaster
ttcccattctcat

SEQ ID NO: 666529 - DNA, 13 bp, D. melanogaster
ttcccattgccat

SEQ ID NO: 666530 - DNA, 14 bp, D. melanogaster
ttcccattgccatt

SEQ ID NO: 666531 - DNA, 13 bp, D. melanogaster
ttcccattgttgt

SEQ ID NO: 666532 - DNA, 13 bp, D. melanogaster
ttcccattgtttt

SEQ ID NO: 666533 - DNA, 13 bp, D. melanogaster
ttcccatttaaat

SEQ ID NO: 666534 - DNA, 14 bp, D. melanogaster
ttcccatttcaatt

SEQ ID NO: 666535 - DNA, 13 bp, D. melanogaster
ttcccatttccac

SEQ ID NO: 666536 - DNA, 14 bp, D. melanogaster
ttcccatttccact

SEQ ID NO: 666537 - DNA, 13 bp, D. melanogaster
ttcccatttccat

SEQ ID NO: 666538 - DNA, 14 bp, D. melanogaster
ttcccatttccatt

SEQ ID NO: 666539 - DNA, 13 bp, D. melanogaster
ttcccatttccca

SEQ ID NO: 666540 - DNA, 14 bp, D. melanogaster
ttcccatttcccac

SEQ ID NO: 666541 - DNA, 13 bp, D. melanogaster
ttcccatttcgaa

SEQ ID NO: 666542 - DNA, 13 bp, D. melanogaster
ttcccatttcgca

SEQ ID NO: 666543 - DNA, 13 bp, D. melanogaster
ttcccatttgcag

SEQ ID NO: 666544 - DNA, 13 bp, D. melanogaster
ttcccatttgcat

SEQ ID NO: 666545 - DNA, 13 bp, D. melanogaster
ttcccatttgcct

SEQ ID NO: 666546 - DNA, 13 bp, D. melanogaster
ttcccatttggca

SEQ ID NO: 666547 - DNA, 13 bp, D. melanogaster
ttcccatttgttt

SEQ ID NO: 666548 - DNA, 13 bp, D. melanogaster
ttcccattttaat

SEQ ID NO: 666549 - DNA, 13 bp, D. melanogaster
ttcccattttagt

SEQ ID NO: 666550 - DNA, 13 bp, D. melanogaster
ttcccattttcaa

SEQ ID NO: 666551 - DNA, 13 bp, D. melanogaster
ttcccattttccg

SEQ ID NO: 666552 - DNA, 14 bp, D. melanogaster
ttcccattttccgc

SEQ ID NO: 666553 - DNA, 13 bp, D. melanogaster
ttcccatttttcg

SEQ ID NO: 666554 - DNA, 13 bp, D. melanogaster
ttccccaaacaac

SEQ ID NO: 666555 - DNA, 13 bp, D. melanogaster
ttccccaacattt

SEQ ID NO: 666556 - DNA, 13 bp, D. melanogaster
ttccccaactttt

SEQ ID NO: 666557 - DNA, 13 bp, D. melanogaster
ttccccaatatca

SEQ ID NO: 666558 - DNA, 14 bp, D. melanogaster
ttccccaatttccc

SEQ ID NO: 666559 - DNA, 13 bp, D. melanogaster
ttccccatcgacc

SEQ ID NO: 666560 - DNA, 13 bp, D. melanogaster
ttccccattccca

SEQ ID NO: 666561 - DNA, 13 bp, D. melanogaster
ttccccattttgt

SEQ ID NO: 666562 - DNA, 13 bp, D. melanogaster
ttcccccatttcg

SEQ ID NO: 666563 - DNA, 13 bp, D. melanogaster
ttccccgattccc

SEQ ID NO: 666564 - DNA, 13 bp, D. melanogaster
ttccccgatttcc

SEQ ID NO: 666565 - DNA, 13 bp, D. melanogaster
ttccccgattttc

SEQ ID NO: 666566 - DNA, 13 bp, D. melanogaster
ttccccgcatctt

SEQ ID NO: 666567 - DNA, 13 bp, D. melanogaster
ttccccgcccact

SEQ ID NO: 666568 - DNA, 13 bp, D. melanogaster
ttccccttttggc

SEQ ID NO: 666569 - DNA, 13 bp, D. melanogaster
ttcccctttttga

SEQ ID NO: 666570 - DNA, 13 bp, D. melanogaster
ttcccgagatctc

SEQ ID NO: 666571 - DNA, 13 bp, D. melanogaster
ttcccgagtccat

SEQ ID NO: 666572 - DNA, 13 bp, D. melanogaster
ttcccgattcccc

SEQ ID NO: 666573 - DNA, 13 bp, D. melanogaster
ttcccgcccattt

SEQ ID NO: 666574 - DNA, 13 bp, D. melanogaster
ttcccgtctccgg

SEQ ID NO: 666575 - DNA, 14 bp, D. melanogaster
ttcccgttcccgtt

SEQ ID NO: 666576 - DNA, 14 bp, D. melanogaster
ttccctacttgttt

SEQ ID NO: 666577 - DNA, 13 bp, D. melanogaster
ttccctcagatga

SEQ ID NO: 666578 - DNA, 13 bp, D. melanogaster
ttccctgcattta

SEQ ID NO: 666579 - DNA, 13 bp, D. melanogaster
ttccctggaaaat

SEQ ID NO: 666580 - DNA, 13 bp, D. melanogaster
ttccctggctttt

SEQ ID NO: 666581 - DNA, 13 bp, D. melanogaster
ttccctgttgatc

SEQ ID NO: 666582 - DNA, 13 bp, D. melanogaster
ttcccttcgatgg

SEQ ID NO: 666583 - DNA, 13 bp, D. melanogaster
ttcccttcgattt

SEQ ID NO: 666584 - DNA, 13 bp, D. melanogaster
ttcccttgctgtt

SEQ ID NO: 666585 - DNA, 13 bp, D. melanogaster
ttccctttaaaaa

SEQ ID NO: 666586 - DNA, 13 bp, D. melanogaster
ttccctttgattt

SEQ ID NO: 666587 - DNA, 13 bp, D. melanogaster
ttccctttgctat

SEQ ID NO: 666588 - DNA, 13 bp, D. melanogaster
ttccctttggctt

SEQ ID NO: 666589 - DNA, 13 bp, D. melanogaster
ttcccttttcggc

SEQ ID NO: 666590 - DNA, 13 bp, D. melanogaster
ttccgaaaaacac

SEQ ID NO: 666591 - DNA, 13 bp, D. melanogaster
ttccgaaatcggg

SEQ ID NO: 666592 - DNA, 14 bp, D. melanogaster
ttccgaaatcggga

SEQ ID NO: 666593 - DNA, 13 bp, D. melanogaster
ttccgaatgcaca

SEQ ID NO: 666594 - DNA, 13 bp, D. melanogaster
ttccgaatgtcat

SEQ ID NO: 666595 - DNA, 13 bp, D. melanogaster
ttccgacaaattc

SEQ ID NO: 666596 - DNA, 13 bp, D. melanogaster
ttccgagctcaga

SEQ ID NO: 666597 - DNA, 13 bp, D. melanogaster
ttccgattcagat

SEQ ID NO: 666598 - DNA, 13 bp, D. melanogaster
ttccgattccaat

SEQ ID NO: 666599 - DNA, 13 bp, D. melanogaster
ttccgattccgag

SEQ ID NO: 666600 - DNA, 13 bp, D. melanogaster
ttccgatttcaat

SEQ ID NO: 666601 - DNA, 13 bp, D. melanogaster
ttccgatttcggt

SEQ ID NO: 666602 - DNA, 13 bp, D. melanogaster
ttccgcaaaaaaa

SEQ ID NO: 666603 - DNA, 13 bp, D. melanogaster
ttccgcacttttt

SEQ ID NO: 666604 - DNA, 13 bp, D. melanogaster
ttccgcatttaat

SEQ ID NO: 666605 - DNA, 13 bp, D. melanogaster
ttccgcatttcgc

SEQ ID NO: 666606 - DNA, 13 bp, D. melanogaster
ttccgcattttcc

SEQ ID NO: 666607 - DNA, 13 bp, D. melanogaster
ttccgcccacttt

SEQ ID NO: 666608 - DNA, 13 bp, D. melanogaster
ttccgcctcagct

SEQ ID NO: 666609 - DNA, 13 bp, D. melanogaster
ttccgctcgctcc

SEQ ID NO: 666610 - DNA, 13 bp, D. melanogaster
ttccgctggcaaa

SEQ ID NO: 666611 - DNA, 13 bp, D. melanogaster
ttccgctggcttt

SEQ ID NO: 666612 - DNA, 13 bp, D. melanogaster
ttccgcttccgtt

SEQ ID NO: 666613 - DNA, 13 bp, D. melanogaster
ttccgctttccca

SEQ ID NO: 666614 - DNA, 13 bp, D. melanogaster
ttccgcttttatt

SEQ ID NO: 666615 - DNA, 13 bp, D. melanogaster
ttccgcttttcca

SEQ ID NO: 666616 - DNA, 14 bp, D. melanogaster
ttccgcttttccac

SEQ ID NO: 666617 - DNA, 13 bp, D. melanogaster
ttccgcttttgtg

SEQ ID NO: 666618 - DNA, 13 bp, D. melanogaster
ttccggaagccat

SEQ ID NO: 666619 - DNA, 13 bp, D. melanogaster
ttccgggattttg

SEQ ID NO: 666620 - DNA, 13 bp, D. melanogaster
ttccggtggaaat

SEQ ID NO: 666621 - DNA, 13 bp, D. melanogaster
ttccggtgtcagg

SEQ ID NO: 666622 - DNA, 13 bp, D. melanogaster
ttccggttccggt

SEQ ID NO: 666623 - DNA, 13 bp, D. melanogaster
ttccggttgcagc

SEQ ID NO: 666624 - DNA, 14 bp, D. melanogaster
ttccggttgcagca

SEQ ID NO: 666625 - DNA, 13 bp, D. melanogaster
ttccgtaaagtaa

SEQ ID NO: 666626 - DNA, 13 bp, D. melanogaster
ttccgtatgaaat

SEQ ID NO: 666627 - DNA, 13 bp, D. melanogaster
ttccgtatttatt

SEQ ID NO: 666628 - DNA, 13 bp, D. melanogaster
ttccgtgattgcg

SEQ ID NO: 666629 - DNA, 13 bp, D. melanogaster
ttccgtggctttc

SEQ ID NO: 666630 - DNA, 14 bp, D. melanogaster
ttccgtggctttcg

SEQ ID NO: 666631 - DNA, 13 bp, D. melanogaster
ttccgttcagttt

SEQ ID NO: 666632 - DNA, 13 bp, D. melanogaster
ttccgttccgttc

SEQ ID NO: 666633 - DNA, 14 bp, D. melanogaster
ttccgttccgttcc

SEQ ID NO: 666634 - DNA, 13 bp, D. melanogaster
ttccgttccgttt

SEQ ID NO: 666635 - DNA, 14 bp, D. melanogaster
ttccgttccgtttc

SEQ ID NO: 666636 - DNA, 13 bp, D. melanogaster
ttccgttctattt

SEQ ID NO: 666637 - DNA, 13 bp, D. melanogaster
ttccgttgcaaga

SEQ ID NO: 666638 - DNA, 13 bp, D. melanogaster
ttccgtttaaatt

SEQ ID NO: 666639 - DNA, 13 bp, D. melanogaster
ttccgtttcaatt

SEQ ID NO: 666640 - DNA, 13 bp, D. melanogaster
ttccgtttcagtt

SEQ ID NO: 666641 - DNA, 13 bp, D. melanogaster
ttccgtttcattt

SEQ ID NO: 666642 - DNA, 13 bp, D. melanogaster
ttccgtttccgct

SEQ ID NO: 666643 - DNA, 14 bp, D. melanogaster
ttccgtttccgctt

SEQ ID NO: 666644 - DNA, 13 bp, D. melanogaster
ttccgtttccggc

SEQ ID NO: 666645 - DNA, 14 bp, D. melanogaster
ttccgtttccggtt

SEQ ID NO: 666646 - DNA, 13 bp, D. melanogaster
ttccgtttccgtt

SEQ ID NO: 666647 - DNA, 13 bp, D. melanogaster
ttccgtttcctgc

SEQ ID NO: 666648 - DNA, 13 bp, D. melanogaster
ttccgtttcctgt

SEQ ID NO: 666649 - DNA, 13 bp, D. melanogaster
ttccgtttcgctt

SEQ ID NO: 666650 - DNA, 13 bp, D. melanogaster
ttccgtttggcat

SEQ ID NO: 666651 - DNA, 13 bp, D. melanogaster
ttccgttttccgc

SEQ ID NO: 666652 - DNA, 13 bp, D. melanogaster
ttccgttttctga

SEQ ID NO: 666653 - DNA, 14 bp, D. melanogaster
ttccgttttctgat

SEQ ID NO: 666654 - DNA, 13 bp, D. melanogaster
ttccgttttgcat

SEQ ID NO: 666655 - DNA, 13 bp, D. melanogaster
ttcctaattattg

SEQ ID NO: 666656 - DNA, 13 bp, D. melanogaster
ttcctaattgaaa

SEQ ID NO: 666657 - DNA, 13 bp, D. melanogaster
ttcctaattgaat

SEQ ID NO: 666658 - DNA, 13 bp, D. melanogaster
ttcctacaaatcg

SEQ ID NO: 666659 - DNA, 13 bp, D. melanogaster
ttcctacattttc

SEQ ID NO: 666660 - DNA, 13 bp, D. melanogaster
ttcctactttgtt

SEQ ID NO: 666661 - DNA, 13 bp, D. melanogaster
ttcctatccaata

SEQ ID NO: 666662 - DNA, 13 bp, D. melanogaster
ttcctattccgat

SEQ ID NO: 666663 - DNA, 13 bp, D. melanogaster
ttcctattgattt

SEQ ID NO: 666664 - DNA, 13 bp, D. melanogaster
ttcctcaaggaag

SEQ ID NO: 666665 - DNA, 13 bp, D. melanogaster
ttcctcagggttc

SEQ ID NO: 666666 - DNA, 13 bp, D. melanogaster
ttcctcgatttcc

SEQ ID NO: 666667 - DNA, 13 bp, D. melanogaster
ttcctcgattttc

SEQ ID NO: 666668 - DNA, 13 bp, D. melanogaster
ttcctcgcatttc

SEQ ID NO: 666669 - DNA, 13 bp, D. melanogaster
ttcctctgcgcca

SEQ ID NO: 666670 - DNA, 13 bp, D. melanogaster
ttcctcttggcca

SEQ ID NO: 666671 - DNA, 13 bp, D. melanogaster
ttcctgagatcga

SEQ ID NO: 666672 - DNA, 14 bp, D. melanogaster
ttcctgagatcgag

SEQ ID NO: 666673 - DNA, 13 bp, D. melanogaster
ttcctgatttata

SEQ ID NO: 666674 - DNA, 13 bp, D. melanogaster
ttcctgattttcc

SEQ ID NO: 666675 - DNA, 13 bp, D. melanogaster
ttcctgcactttt

SEQ ID NO: 666676 - DNA, 13 bp, D. melanogaster
ttcctgccatttg

SEQ ID NO: 666677 - DNA, 13 bp, D. melanogaster
ttcctgcgaattc

SEQ ID NO: 666678 - DNA, 13 bp, D. melanogaster
ttcctgctcctgc

SEQ ID NO: 666679 - DNA, 13 bp, D. melanogaster
ttcctgctgcctt

SEQ ID NO: 666680 - DNA, 13 bp, D. melanogaster
ttcctgctgctta

SEQ ID NO: 666681 - DNA, 13 bp, D. melanogaster
ttcctgctgcttt

SEQ ID NO: 666682 - DNA, 14 bp, D. melanogaster
ttcctggaagaacg

SEQ ID NO: 666683 - DNA, 13 bp, D. melanogaster
ttcctggaattac

SEQ ID NO: 666684 - DNA, 13 bp, D. melanogaster
ttcctggagagtt

SEQ ID NO: 666685 - DNA, 13 bp, D. melanogaster
ttcctggccaaaa

SEQ ID NO: 666686 - DNA, 13 bp, D. melanogaster
ttcctggccaact

SEQ ID NO: 666687 - DNA, 13 bp, D. melanogaster
ttcctggcttttc

SEQ ID NO: 666688 - DNA, 13 bp, D. melanogaster
ttcctgggctatg

SEQ ID NO: 666689 - DNA, 13 bp, D. melanogaster
ttcctggtttgga

SEQ ID NO: 666690 - DNA, 13 bp, D. melanogaster
ttcctgtacttgg

SEQ ID NO: 666691 - DNA, 13 bp, D. melanogaster
ttcctgtttagct

SEQ ID NO: 666692 - DNA, 13 bp, D. melanogaster
ttccttaaaaaaa

SEQ ID NO: 666693 - DNA, 13 bp, D. melanogaster
ttccttaagaagc

SEQ ID NO: 666694 - DNA, 13 bp, D. melanogaster
ttccttaagttcc

SEQ ID NO: 666695 - DNA, 13 bp, D. melanogaster
ttccttaataaat

SEQ ID NO: 666696 - DNA, 13 bp, D. melanogaster
ttccttacctttg

SEQ ID NO: 666697 - DNA, 13 bp, D. melanogaster
ttccttcagtgta

SEQ ID NO: 666698 - DNA, 13 bp, D. melanogaster
ttccttcgatgac

SEQ ID NO: 666699 - DNA, 13 bp, D. melanogaster
ttccttcgcagcc

SEQ ID NO: 666700 - DNA, 14 bp, D. melanogaster
ttccttcgcagcca

SEQ ID NO: 666701 - DNA, 13 bp, D. melanogaster
ttccttctcaatt

SEQ ID NO: 666702 - DNA, 13 bp, D. melanogaster
ttccttctctggc

SEQ ID NO: 666703 - DNA, 14 bp, D. melanogaster
ttccttctctggca

SEQ ID NO: 666704 - DNA, 13 bp, D. melanogaster
ttccttctgctgc

SEQ ID NO: 666705 - DNA, 13 bp, D. melanogaster
ttccttgactttt

SEQ ID NO: 666706 - DNA, 13 bp, D. melanogaster
ttccttggcattt

SEQ ID NO: 666707 - DNA, 13 bp, D. melanogaster
ttcctttaaagtt

SEQ ID NO: 666708 - DNA, 13 bp, D. melanogaster
ttcctttaagtta

SEQ ID NO: 666709 - DNA, 14 bp, D. melanogaster
ttcctttatgttta

SEQ ID NO: 666710 - DNA, 14 bp, D. melanogaster
ttcctttcgatggc

SEQ ID NO: 666711 - DNA, 13 bp, D. melanogaster
ttcctttcgattt

SEQ ID NO: 666712 - DNA, 13 bp, D. melanogaster
ttcctttgaaatt

SEQ ID NO: 666713 - DNA, 13 bp, D. melanogaster
ttcctttgatttc

SEQ ID NO: 666714 - DNA, 13 bp, D. melanogaster
ttcctttgcattt

SEQ ID NO: 666715 - DNA, 14 bp, D. melanogaster
ttcctttgctttgg

SEQ ID NO: 666716 - DNA, 13 bp, D. melanogaster
ttcctttgtagcg

SEQ ID NO: 666717 - DNA, 13 bp, D. melanogaster
ttcctttgtatat

SEQ ID NO: 666718 - DNA, 14 bp, D. melanogaster
ttcctttgtatata

SEQ ID NO: 666719 - DNA, 14 bp, D. melanogaster
ttccttttaaacaa

SEQ ID NO: 666720 - DNA, 13 bp, D. melanogaster
ttccttttcaaat

SEQ ID NO: 666721 - DNA, 13 bp, D. melanogaster
ttccttttcgctg

SEQ ID NO: 666722 - DNA, 13 bp, D. melanogaster
ttccttttcggcc

SEQ ID NO: 666723 - DNA, 13 bp, D. melanogaster
ttccttttgaaat

SEQ ID NO: 666724 - DNA, 13 bp, D. melanogaster
ttccttttgaatg

SEQ ID NO: 666725 - DNA, 13 bp, D. melanogaster
ttccttttgccag

SEQ ID NO: 666726 - DNA, 13 bp, D. melanogaster
ttccttttgcctg

SEQ ID NO: 666727 - DNA, 13 bp, D. melanogaster
ttccttttgtgac

SEQ ID NO: 666728 - DNA, 13 bp, D. melanogaster
ttcctttttggca

SEQ ID NO: 666729 - DNA, 14 bp, D. melanogaster
ttcgaaaaaaaaat

SEQ ID NO: 666730 - DNA, 13 bp, D. melanogaster
ttcgaaaaaaatt

SEQ ID NO: 666731 - DNA, 13 bp, D. melanogaster
ttcgaaaaaatat

SEQ ID NO: 666732 - DNA, 13 bp, D. melanogaster
ttcgaaaaagaaa

SEQ ID NO: 666733 - DNA, 13 bp, D. melanogaster
ttcgaaaaagttc

SEQ ID NO: 666734 - DNA, 14 bp, D. melanogaster
ttcgaaaaagttcg

SEQ ID NO: 666735 - DNA, 13 bp, D. melanogaster
ttcgaaaaatata

SEQ ID NO: 666736 - DNA, 13 bp, D. melanogaster
ttcgaaaaatatt

SEQ ID NO: 666737 - DNA, 13 bp, D. melanogaster
ttcgaaaaatcaa

SEQ ID NO: 666738 - DNA, 13 bp, D. melanogaster
ttcgaaaaatggt

SEQ ID NO: 666739 - DNA, 13 bp, D. melanogaster
ttcgaaaaatgtt

SEQ ID NO: 666740 - DNA, 13 bp, D. melanogaster
ttcgaaaacattt

SEQ ID NO: 666741 - DNA, 13 bp, D. melanogaster
ttcgaaaacgttt

SEQ ID NO: 666742 - DNA, 13 bp, D. melanogaster
ttcgaaaagtttc

SEQ ID NO: 666743 - DNA, 13 bp, D. melanogaster
ttcgaaaataaat

SEQ ID NO: 666744 - DNA, 13 bp, D. melanogaster
ttcgaaaataatt

SEQ ID NO: 666745 - DNA, 13 bp, D. melanogaster
ttcgaaaatatca

SEQ ID NO: 666746 - DNA, 14 bp, D. melanogaster
ttcgaaaatatcac

SEQ ID NO: 666747 - DNA, 13 bp, D. melanogaster
ttcgaaaatattt

SEQ ID NO: 666748 - DNA, 13 bp, D. melanogaster
ttcgaaaatcaaa

SEQ ID NO: 666749 - DNA, 14 bp, D. melanogaster
ttcgaaaatcaaaa

SEQ ID NO: 666750 - DNA, 13 bp, D. melanogaster
ttcgaaaatcttt

SEQ ID NO: 666751 - DNA, 13 bp, D. melanogaster
ttcgaaaatgttt

SEQ ID NO: 666752 - DNA, 13 bp, D. melanogaster
ttcgaaaattcat

SEQ ID NO: 666753 - DNA, 13 bp, D. melanogaster
ttcgaaaatttgt

SEQ ID NO: 666754 - DNA, 13 bp, D. melanogaster
ttcgaaaattttc

SEQ ID NO: 666755 - DNA, 14 bp, D. melanogaster
ttcgaaaattttcg

SEQ ID NO: 666756 - DNA, 13 bp, D. melanogaster
ttcgaaacgaaaa

SEQ ID NO: 666757 - DNA, 13 bp, D. melanogaster
ttcgaaactattt

SEQ ID NO: 666758 - DNA, 13 bp, D. melanogaster
ttcgaaactgttt

SEQ ID NO: 666759 - DNA, 13 bp, D. melanogaster
ttcgaaagattca

SEQ ID NO: 666760 - DNA, 13 bp, D. melanogaster
ttcgaaagcaatt

SEQ ID NO: 666761 - DNA, 13 bp, D. melanogaster
ttcgaaagttttc

SEQ ID NO: 666762 - DNA, 13 bp, D. melanogaster
ttcgaaatattca

SEQ ID NO: 666763 - DNA, 13 bp, D. melanogaster
ttcgaaatatttt

SEQ ID NO: 666764 - DNA, 13 bp, D. melanogaster
ttcgaaatcaaat

SEQ ID NO: 666765 - DNA, 13 bp, D. melanogaster
ttcgaaatcgaaa

SEQ ID NO: 666766 - DNA, 13 bp, D. melanogaster
ttcgaaatgaaca

SEQ ID NO: 666767 - DNA, 13 bp, D. melanogaster
ttcgaaatgaaga

SEQ ID NO: 666768 - DNA, 14 bp, D. melanogaster
ttcgaaatgcaaat

SEQ ID NO: 666769 - DNA, 13 bp, D. melanogaster
ttcgaaatgcaat

SEQ ID NO: 666770 - DNA, 13 bp, D. melanogaster
ttcgaaatggcaa

SEQ ID NO: 666771 - DNA, 13 bp, D. melanogaster
ttcgaaatgtttt

SEQ ID NO: 666772 - DNA, 13 bp, D. melanogaster
ttcgaaattattt

SEQ ID NO: 666773 - DNA, 13 bp, D. melanogaster
ttcgaaattcaaa

SEQ ID NO: 666774 - DNA, 13 bp, D. melanogaster
ttcgaaattcatt

SEQ ID NO: 666775 - DNA, 13 bp, D. melanogaster
ttcgaaattcgaa

SEQ ID NO: 666776 - DNA, 13 bp, D. melanogaster
ttcgaaatttata

SEQ ID NO: 666777 - DNA, 14 bp, D. melanogaster
ttcgaaatttattt

SEQ ID NO: 666778 - DNA, 13 bp, D. melanogaster
ttcgaaatttgat

SEQ ID NO: 666779 - DNA, 13 bp, D. melanogaster
ttcgaaatttgta

SEQ ID NO: 666780 - DNA, 13 bp, D. melanogaster
ttcgaaatttgtt

SEQ ID NO: 666781 - DNA, 13 bp, D. melanogaster
ttcgaaccggata

SEQ ID NO: 666782 - DNA, 13 bp, D. melanogaster
ttcgaactcttcg

SEQ ID NO: 666783 - DNA, 14 bp, D. melanogaster
ttcgaagaagaaat

SEQ ID NO: 666784 - DNA, 13 bp, D. melanogaster
ttcgaagttcgaa

SEQ ID NO: 666785 - DNA, 13 bp, D. melanogaster
ttcgaatacgaat

SEQ ID NO: 666786 - DNA, 13 bp, D. melanogaster
ttcgaatatgttt

SEQ ID NO: 666787 - DNA, 13 bp, D. melanogaster
ttcgaatatttaa

SEQ ID NO: 666788 - DNA, 13 bp, D. melanogaster
ttcgaatcaagac

SEQ ID NO: 666789 - DNA, 13 bp, D. melanogaster
ttcgaatcgaatg

SEQ ID NO: 666790 - DNA, 13 bp, D. melanogaster
ttcgaatcgaatt

SEQ ID NO: 666791 - DNA, 13 bp, D. melanogaster
ttcgaatcgtttt

SEQ ID NO: 666792 - DNA, 13 bp, D. melanogaster
ttcgaatgaaaaa

SEQ ID NO: 666793 - DNA, 13 bp, D. melanogaster
ttcgaatgcatca

SEQ ID NO: 666794 - DNA, 13 bp, D. melanogaster
ttcgaatgcattt

SEQ ID NO: 666795 - DNA, 13 bp, D. melanogaster
ttcgaatgccatt

SEQ ID NO: 666796 - DNA, 14 bp, D. melanogaster
ttcgaatgccattt

SEQ ID NO: 666797 - DNA, 13 bp, D. melanogaster
ttcgaatgcgttt

SEQ ID NO: 666798 - DNA, 13 bp, D. melanogaster
ttcgaatggaatt

SEQ ID NO: 666799 - DNA, 13 bp, D. melanogaster
ttcgaatgtaatt

SEQ ID NO: 666800 - DNA, 13 bp, D. melanogaster
ttcgaattaaaaa

SEQ ID NO: 666801 - DNA, 13 bp, D. melanogaster
ttcgaattgaaaa

SEQ ID NO: 666802 - DNA, 13 bp, D. melanogaster
ttcgaattgaaca

SEQ ID NO: 666803 - DNA, 13 bp, D. melanogaster
ttcgaattggaaa

SEQ ID NO: 666804 - DNA, 13 bp, D. melanogaster
ttcgaattggaat

SEQ ID NO: 666805 - DNA, 13 bp, D. melanogaster
ttcgaattggatt

SEQ ID NO: 666806 - DNA, 13 bp, D. melanogaster
ttcgaatttaaaa

SEQ ID NO: 666807 - DNA, 13 bp, D. melanogaster
ttcgaatttaatt

SEQ ID NO: 666808 - DNA, 13 bp, D. melanogaster
ttcgaatttcaat

SEQ ID NO: 666809 - DNA, 13 bp, D. melanogaster
ttcgaatttcgaa

SEQ ID NO: 666810 - DNA, 13 bp, D. melanogaster
ttcgaatttcttt

SEQ ID NO: 666811 - DNA, 13 bp, D. melanogaster
ttcgaatttgttt

SEQ ID NO: 666812 - DNA, 14 bp, D. melanogaster
ttcgaattttcagc

SEQ ID NO: 666813 - DNA, 13 bp, D. melanogaster
ttcgaattttcca

SEQ ID NO: 666814 - DNA, 13 bp, D. melanogaster
ttcgaattttctt

SEQ ID NO: 666815 - DNA, 13 bp, D. melanogaster
ttcgaattttgtt

SEQ ID NO: 666816 - DNA, 13 bp, D. melanogaster
ttcgaatttttaa

SEQ ID NO: 666817 - DNA, 13 bp, D. melanogaster
ttcgacgaaattc

SEQ ID NO: 666818 - DNA, 13 bp, D. melanogaster
ttcgactcgatca

SEQ ID NO: 666819 - DNA, 13 bp, D. melanogaster
ttcgactgcattt

SEQ ID NO: 666820 - DNA, 13 bp, D. melanogaster
ttcgactgcgact

SEQ ID NO: 666821 - DNA, 13 bp, D. melanogaster
ttcgacttcgact

SEQ ID NO: 666822 - DNA, 14 bp, D. melanogaster
ttcgacttctaaat

SEQ ID NO: 666823 - DNA, 13 bp, D. melanogaster
ttcgacttggact

SEQ ID NO: 666824 - DNA, 13 bp, D. melanogaster
ttcgacttggcca

SEQ ID NO: 666825 - DNA, 13 bp, D. melanogaster
ttcgactttagca

SEQ ID NO: 666826 - DNA, 13 bp, D. melanogaster
ttcgactttatga

SEQ ID NO: 666827 - DNA, 13 bp, D. melanogaster
ttcgagacgaaaa

SEQ ID NO: 666828 - DNA, 14 bp, D. melanogaster
ttcgagcactggac

SEQ ID NO: 666829 - DNA, 13 bp, D. melanogaster
ttcgagcagtcaa

SEQ ID NO: 666830 - DNA, 13 bp, D. melanogaster
ttcgagcgcaaaa

SEQ ID NO: 666831 - DNA, 13 bp, D. melanogaster
ttcgagctgctgc

SEQ ID NO: 666832 - DNA, 14 bp, D. melanogaster
ttcgaggcagagag

SEQ ID NO: 666833 - DNA, 13 bp, D. melanogaster
ttcgagtagcaga

SEQ ID NO: 666834 - DNA, 13 bp, D. melanogaster
ttcgagtgcattt

SEQ ID NO: 666835 - DNA, 13 bp, D. melanogaster
ttcgagtggaaaa

SEQ ID NO: 666836 - DNA, 13 bp, D. melanogaster
ttcgagtggacag

SEQ ID NO: 666837 - DNA, 13 bp, D. melanogaster
ttcgagtggcaaa

SEQ ID NO: 666838 - DNA, 13 bp, D. melanogaster
ttcgagtgggtga

SEQ ID NO: 666839 - DNA, 13 bp, D. melanogaster
ttcgagtgtgcgt

SEQ ID NO: 666840 - DNA, 14 bp, D. melanogaster
ttcgagtgtgtgtg

SEQ ID NO: 666841 - DNA, 13 bp, D. melanogaster
ttcgagtttcgag

SEQ ID NO: 666842 - DNA, 13 bp, D. melanogaster
ttcgagttttatt

SEQ ID NO: 666843 - DNA, 13 bp, D. melanogaster
ttcgataaataaa

SEQ ID NO: 666844 - DNA, 13 bp, D. melanogaster
ttcgataatattg

SEQ ID NO: 666845 - DNA, 13 bp, D. melanogaster
ttcgatatatgta

SEQ ID NO: 666846 - DNA, 13 bp, D. melanogaster
ttcgatatcaacg

SEQ ID NO: 666847 - DNA, 13 bp, D. melanogaster
ttcgatatcgata

SEQ ID NO: 666848 - DNA, 13 bp, D. melanogaster
ttcgatatctaaa

SEQ ID NO: 666849 - DNA, 13 bp, D. melanogaster
ttcgatattaaat

SEQ ID NO: 666850 - DNA, 13 bp, D. melanogaster
ttcgatatttatt

SEQ ID NO: 666851 - DNA, 13 bp, D. melanogaster
ttcgatatttgat

SEQ ID NO: 666852 - DNA, 13 bp, D. melanogaster
ttcgatattttat

SEQ ID NO: 666853 - DNA, 13 bp, D. melanogaster
ttcgatattttca

SEQ ID NO: 666854 - DNA, 13 bp, D. melanogaster
ttcgatcgatcga

SEQ ID NO: 666855 - DNA, 13 bp, D. melanogaster
ttcgatcgccgac

SEQ ID NO: 666856 - DNA, 13 bp, D. melanogaster
ttcgatctcgatc

SEQ ID NO: 666857 - DNA, 13 bp, D. melanogaster
ttcgatcttatat

SEQ ID NO: 666858 - DNA, 13 bp, D. melanogaster
ttcgatgatgatg

SEQ ID NO: 666859 - DNA, 13 bp, D. melanogaster
ttcgatgcgattc

SEQ ID NO: 666860 - DNA, 13 bp, D. melanogaster
ttcgatgggaaat

SEQ ID NO: 666861 - DNA, 13 bp, D. melanogaster
ttcgatggtttaa

SEQ ID NO: 666862 - DNA, 13 bp, D. melanogaster
ttcgatgtctctt

SEQ ID NO: 666863 - DNA, 13 bp, D. melanogaster
ttcgattaaaaca

SEQ ID NO: 666864 - DNA, 13 bp, D. melanogaster
ttcgattaaaatt

SEQ ID NO: 666865 - DNA, 13 bp, D. melanogaster
ttcgattcaatta

SEQ ID NO: 666866 - DNA, 13 bp, D. melanogaster
ttcgattcaattt

SEQ ID NO: 666867 - DNA, 13 bp, D. melanogaster
ttcgattcagttt

SEQ ID NO: 666868 - DNA, 13 bp, D. melanogaster
ttcgattccgttt

SEQ ID NO: 666869 - DNA, 13 bp, D. melanogaster
ttcgattcgaaat

SEQ ID NO: 666870 - DNA, 13 bp, D. melanogaster
ttcgattcgaatc

SEQ ID NO: 666871 - DNA, 13 bp, D. melanogaster
ttcgattcgaatg

SEQ ID NO: 666872 - DNA, 13 bp, D. melanogaster
ttcgattcgaatt

SEQ ID NO: 666873 - DNA, 14 bp, D. melanogaster
ttcgattcgattcg

SEQ ID NO: 666874 - DNA, 13 bp, D. melanogaster
ttcgattcgattg

SEQ ID NO: 666875 - DNA, 14 bp, D. melanogaster
ttcgattcgatttg

SEQ ID NO: 666876 - DNA, 14 bp, D. melanogaster
ttcgattcgatttt

SEQ ID NO: 666877 - DNA, 13 bp, D. melanogaster
ttcgattcggatt

SEQ ID NO: 666878 - DNA, 13 bp, D. melanogaster
ttcgattcggttt

SEQ ID NO: 666879 - DNA, 13 bp, D. melanogaster
ttcgattcgttcg

SEQ ID NO: 666880 - DNA, 14 bp, D. melanogaster
ttcgattcgtttcg

SEQ ID NO: 666881 - DNA, 13 bp, D. melanogaster
ttcgattgaaaaa

SEQ ID NO: 666882 - DNA, 13 bp, D. melanogaster
ttcgattgaaaat

SEQ ID NO: 666883 - DNA, 13 bp, D. melanogaster
ttcgattgattta

SEQ ID NO: 666884 - DNA, 13 bp, D. melanogaster
ttcgattgatttt

SEQ ID NO: 666885 - DNA, 13 bp, D. melanogaster
ttcgattgcaatt

SEQ ID NO: 666886 - DNA, 13 bp, D. melanogaster
ttcgattgcattt

SEQ ID NO: 666887 - DNA, 13 bp, D. melanogaster
ttcgattgctttt

SEQ ID NO: 666888 - DNA, 13 bp, D. melanogaster
ttcgattggaaat

SEQ ID NO: 666889 - DNA, 14 bp, D. melanogaster
ttcgattggaaatt

SEQ ID NO: 666890 - DNA, 13 bp, D. melanogaster
ttcgattggattg

SEQ ID NO: 666891 - DNA, 13 bp, D. melanogaster
ttcgattggcaat

SEQ ID NO: 666892 - DNA, 13 bp, D. melanogaster
ttcgattgggttt

SEQ ID NO: 666893 - DNA, 13 bp, D. melanogaster
ttcgattggtttt

SEQ ID NO: 666894 - DNA, 13 bp, D. melanogaster
ttcgattgtaaaa

SEQ ID NO: 666895 - DNA, 13 bp, D. melanogaster
ttcgattgttttc

SEQ ID NO: 666896 - DNA, 13 bp, D. melanogaster
ttcgatttaaaag

SEQ ID NO: 666897 - DNA, 13 bp, D. melanogaster
ttcgatttaaagt

SEQ ID NO: 666898 - DNA, 13 bp, D. melanogaster
ttcgatttaaatg

SEQ ID NO: 666899 - DNA, 13 bp, D. melanogaster
ttcgatttaaatt

SEQ ID NO: 666900 - DNA, 13 bp, D. melanogaster
ttcgatttaagtt

SEQ ID NO: 666901 - DNA, 13 bp, D. melanogaster
ttcgatttagttt

SEQ ID NO: 666902 - DNA, 13 bp, D. melanogaster
ttcgatttcaaaa

SEQ ID NO: 666903 - DNA, 13 bp, D. melanogaster
ttcgatttcaact

SEQ ID NO: 666904 - DNA, 13 bp, D. melanogaster
ttcgatttcaagt

SEQ ID NO: 666905 - DNA, 13 bp, D. melanogaster
ttcgatttcaatt

SEQ ID NO: 666906 - DNA, 14 bp, D. melanogaster
ttcgatttcaattt

SEQ ID NO: 666907 - DNA, 13 bp, D. melanogaster
ttcgatttcattt

SEQ ID NO: 666908 - DNA, 14 bp, D. melanogaster
ttcgatttcatttg

SEQ ID NO: 666909 - DNA, 14 bp, D. melanogaster
ttcgatttccattt

SEQ ID NO: 666910 - DNA, 13 bp, D. melanogaster
ttcgatttccgac

SEQ ID NO: 666911 - DNA, 13 bp, D. melanogaster
ttcgatttcgaaa

SEQ ID NO: 666912 - DNA, 14 bp, D. melanogaster
ttcgatttcgaaat

SEQ ID NO: 666913 - DNA, 13 bp, D. melanogaster
ttcgatttcgagt

SEQ ID NO: 666914 - DNA, 13 bp, D. melanogaster
ttcgatttcgatg

SEQ ID NO: 666915 - DNA, 13 bp, D. melanogaster
ttcgatttcgatt

SEQ ID NO: 666916 - DNA, 14 bp, D. melanogaster
ttcgatttcgattt

SEQ ID NO: 666917 - DNA, 14 bp, D. melanogaster
ttcgatttcggttt

SEQ ID NO: 666918 - DNA, 13 bp, D. melanogaster
ttcgatttcgtgt

SEQ ID NO: 666919 - DNA, 14 bp, D. melanogaster
ttcgatttcgtgtg

SEQ ID NO: 666920 - DNA, 13 bp, D. melanogaster
ttcgatttcgttg

SEQ ID NO: 666921 - DNA, 13 bp, D. melanogaster
ttcgatttcgttt

SEQ ID NO: 666922 - DNA, 14 bp, D. melanogaster
ttcgatttcgtttt

SEQ ID NO: 666923 - DNA, 13 bp, D. melanogaster
ttcgatttctgtt

SEQ ID NO: 666924 - DNA, 13 bp, D. melanogaster
ttcgatttctttc

SEQ ID NO: 666925 - DNA, 13 bp, D. melanogaster
ttcgatttgatga

SEQ ID NO: 666926 - DNA, 13 bp, D. melanogaster
ttcgatttgatta

SEQ ID NO: 666927 - DNA, 13 bp, D. melanogaster
ttcgatttgattg

SEQ ID NO: 666928 - DNA, 13 bp, D. melanogaster
ttcgatttgcatg

SEQ ID NO: 666929 - DNA, 14 bp, D. melanogaster
ttcgatttgcattt

SEQ ID NO: 666930 - DNA, 13 bp, D. melanogaster
ttcgatttgcttt

SEQ ID NO: 666931 - DNA, 13 bp, D. melanogaster
ttcgatttggaat

SEQ ID NO: 666932 - DNA, 13 bp, D. melanogaster
ttcgatttggttt

SEQ ID NO: 666933 - DNA, 14 bp, D. melanogaster
ttcgatttggtttt

SEQ ID NO: 666934 - DNA, 13 bp, D. melanogaster
ttcgatttgtaaa

SEQ ID NO: 666935 - DNA, 13 bp, D. melanogaster
ttcgatttgtatt

SEQ ID NO: 666936 - DNA, 13 bp, D. melanogaster
ttcgatttgttgc

SEQ ID NO: 666937 - DNA, 13 bp, D. melanogaster
ttcgatttgtttc

SEQ ID NO: 666938 - DNA, 13 bp, D. melanogaster
ttcgattttaaac

SEQ ID NO: 666939 - DNA, 13 bp, D. melanogaster
ttcgattttaaag

SEQ ID NO: 666940 - DNA, 13 bp, D. melanogaster
ttcgattttaata

SEQ ID NO: 666941 - DNA, 13 bp, D. melanogaster
ttcgattttaatg

SEQ ID NO: 666942 - DNA, 13 bp, D. melanogaster
ttcgattttccac

SEQ ID NO: 666943 - DNA, 13 bp, D. melanogaster
ttcgattttccca

SEQ ID NO: 666944 - DNA, 13 bp, D. melanogaster
ttcgattttcccg

SEQ ID NO: 666945 - DNA, 13 bp, D. melanogaster
ttcgattttgaaa

SEQ ID NO: 666946 - DNA, 13 bp, D. melanogaster
ttcgattttgata

SEQ ID NO: 666947 - DNA, 13 bp, D. melanogaster
ttcgattttgatt

SEQ ID NO: 666948 - DNA, 14 bp, D. melanogaster
ttcgattttgattt

SEQ ID NO: 666949 - DNA, 14 bp, D. melanogaster
ttcgatttttaatt

SEQ ID NO: 666950 - DNA, 13 bp, D. melanogaster
ttcgatttttata

SEQ ID NO: 666951 - DNA, 13 bp, D. melanogaster
ttcgatttttcac

SEQ ID NO: 666952 - DNA, 13 bp, D. melanogaster
ttcgatttttccc

SEQ ID NO: 666953 - DNA, 13 bp, D. melanogaster
ttcgatttttgat

SEQ ID NO: 666954 - DNA, 13 bp, D. melanogaster
ttcgattttttcg

SEQ ID NO: 666955 - DNA, 13 bp, D. melanogaster
ttcgattttttgg

SEQ ID NO: 666956 - DNA, 13 bp, D. melanogaster
ttcgcaaaataaa

SEQ ID NO: 666957 - DNA, 13 bp, D. melanogaster
ttcgcaaactttc

SEQ ID NO: 666958 - DNA, 13 bp, D. melanogaster
ttcgcaaattaat

SEQ ID NO: 666959 - DNA, 13 bp, D. melanogaster
ttcgcaaattttg

SEQ ID NO: 666960 - DNA, 13 bp, D. melanogaster
ttcgcaacaacaa

SEQ ID NO: 666961 - DNA, 13 bp, D. melanogaster
ttcgcaacatttt

SEQ ID NO: 666962 - DNA, 14 bp, D. melanogaster
ttcgcaagcatttc

SEQ ID NO: 666963 - DNA, 13 bp, D. melanogaster
ttcgcaattattt

SEQ ID NO: 666964 - DNA, 13 bp, D. melanogaster
ttcgcaattcgca

SEQ ID NO: 666965 - DNA, 13 bp, D. melanogaster
ttcgcaattgttt

SEQ ID NO: 666966 - DNA, 13 bp, D. melanogaster
ttcgcaatttaat

SEQ ID NO: 666967 - DNA, 13 bp, D. melanogaster
ttcgcaatttgca

SEQ ID NO: 666968 - DNA, 13 bp, D. melanogaster
ttcgcaatttgtt

SEQ ID NO: 666969 - DNA, 13 bp, D. melanogaster
ttcgcaattttcc

SEQ ID NO: 666970 - DNA, 13 bp, D. melanogaster
ttcgcacacacac

SEQ ID NO: 666971 - DNA, 14 bp, D. melanogaster
ttcgcacacacaca

SEQ ID NO: 666972 - DNA, 13 bp, D. melanogaster
ttcgcacataaat

SEQ ID NO: 666973 - DNA, 13 bp, D. melanogaster
ttcgcactcacac

SEQ ID NO: 666974 - DNA, 13 bp, D. melanogaster
ttcgcacttaatt

SEQ ID NO: 666975 - DNA, 13 bp, D. melanogaster
ttcgcacttttcc

SEQ ID NO: 666976 - DNA, 13 bp, D. melanogaster
ttcgcagcaacaa

SEQ ID NO: 666977 - DNA, 13 bp, D. melanogaster
ttcgcagcgccag

SEQ ID NO: 666978 - DNA, 13 bp, D. melanogaster
ttcgcagtgcact

SEQ ID NO: 666979 - DNA, 13 bp, D. melanogaster
ttcgcagttacga

SEQ ID NO: 666980 - DNA, 13 bp, D. melanogaster
ttcgcatagtttt

SEQ ID NO: 666981 - DNA, 13 bp, D. melanogaster
ttcgcatgcattt

SEQ ID NO: 666982 - DNA, 13 bp, D. melanogaster
ttcgcatggtgcc

SEQ ID NO: 666983 - DNA, 13 bp, D. melanogaster
ttcgcattaataa

SEQ ID NO: 666984 - DNA, 13 bp, D. melanogaster
ttcgcattaatta

SEQ ID NO: 666985 - DNA, 14 bp, D. melanogaster
ttcgcattaggttt

SEQ ID NO: 666986 - DNA, 13 bp, D. melanogaster
ttcgcattattat

SEQ ID NO: 666987 - DNA, 13 bp, D. melanogaster
ttcgcattcaatt

SEQ ID NO: 666988 - DNA, 13 bp, D. melanogaster
ttcgcattcacac

SEQ ID NO: 666989 - DNA, 13 bp, D. melanogaster
ttcgcattcgcac

SEQ ID NO: 666990 - DNA, 13 bp, D. melanogaster
ttcgcattcgcag

SEQ ID NO: 666991 - DNA, 14 bp, D. melanogaster
ttcgcattcgcatt

SEQ ID NO: 666992 - DNA, 14 bp, D. melanogaster
ttcgcattcggatt

SEQ ID NO: 666993 - DNA, 13 bp, D. melanogaster
ttcgcattcgtat

SEQ ID NO: 666994 - DNA, 13 bp, D. melanogaster
ttcgcattgcaat

SEQ ID NO: 666995 - DNA, 13 bp, D. melanogaster
ttcgcatttaatt

SEQ ID NO: 666996 - DNA, 13 bp, D. melanogaster
ttcgcatttattt

SEQ ID NO: 666997 - DNA, 13 bp, D. melanogaster
ttcgcatttccca

SEQ ID NO: 666998 - DNA, 13 bp, D. melanogaster
ttcgcatttcgca

SEQ ID NO: 666999 - DNA, 13 bp, D. melanogaster
ttcgcatttgaat

SEQ ID NO: 667000 - DNA, 13 bp, D. melanogaster
ttcgcatttgatt

SEQ ID NO: 667001 - DNA, 13 bp, D. melanogaster
ttcgcatttgcat

SEQ ID NO: 667002 - DNA, 13 bp, D. melanogaster
ttcgcatttgttt

SEQ ID NO: 667003 - DNA, 14 bp, D. melanogaster
ttcgcatttgttta

SEQ ID NO: 667004 - DNA, 13 bp, D. melanogaster
ttcgcattttcca

SEQ ID NO: 667005 - DNA, 13 bp, D. melanogaster
ttcgcattttccc

SEQ ID NO: 667006 - DNA, 13 bp, D. melanogaster
ttcgcattttcgc

SEQ ID NO: 667007 - DNA, 13 bp, D. melanogaster
ttcgcattttgca

SEQ ID NO: 667008 - DNA, 13 bp, D. melanogaster
ttcgcatttttgg

SEQ ID NO: 667009 - DNA, 14 bp, D. melanogaster
ttcgcattttttat

SEQ ID NO: 667010 - DNA, 13 bp, D. melanogaster
ttcgccaaaaaca

SEQ ID NO: 667011 - DNA, 13 bp, D. melanogaster
ttcgccaagtttt

SEQ ID NO: 667012 - DNA, 13 bp, D. melanogaster
ttcgccagcaaat

SEQ ID NO: 667013 - DNA, 13 bp, D. melanogaster
ttcgccagccagc

SEQ ID NO: 667014 - DNA, 13 bp, D. melanogaster
ttcgccagcgaaa

SEQ ID NO: 667015 - DNA, 13 bp, D. melanogaster
ttcgccagctttt

SEQ ID NO: 667016 - DNA, 13 bp, D. melanogaster
ttcgccagtcaga

SEQ ID NO: 667017 - DNA, 13 bp, D. melanogaster
ttcgccagttttc

SEQ ID NO: 667018 - DNA, 13 bp, D. melanogaster
ttcgccataaaaa

SEQ ID NO: 667019 - DNA, 13 bp, D. melanogaster
ttcgccattcgcc

SEQ ID NO: 667020 - DNA, 14 bp, D. melanogaster
ttcgccattcgcca

SEQ ID NO: 667021 - DNA, 13 bp, D. melanogaster
ttcgccatttatt

SEQ ID NO: 667022 - DNA, 13 bp, D. melanogaster
ttcgccatttccc

SEQ ID NO: 667023 - DNA, 13 bp, D. melanogaster
ttcgccatttggc

SEQ ID NO: 667024 - DNA, 13 bp, D. melanogaster
ttcgccattttcc

SEQ ID NO: 667025 - DNA, 13 bp, D. melanogaster
ttcgccatttttc

SEQ ID NO: 667026 - DNA, 13 bp, D. melanogaster
ttcgcccactttt

SEQ ID NO: 667027 - DNA, 13 bp, D. melanogaster
ttcgcccagtgca

SEQ ID NO: 667028 - DNA, 13 bp, D. melanogaster
ttcgcccattttc

SEQ ID NO: 667029 - DNA, 13 bp, D. melanogaster
ttcgcccgctttt

SEQ ID NO: 667030 - DNA, 13 bp, D. melanogaster
ttcgccgcctttt

SEQ ID NO: 667031 - DNA, 14 bp, D. melanogaster
ttcgccgctgaaga

SEQ ID NO: 667032 - DNA, 13 bp, D. melanogaster
ttcgccgcttttc

SEQ ID NO: 667033 - DNA, 13 bp, D. melanogaster
ttcgccggagacg

SEQ ID NO: 667034 - DNA, 13 bp, D. melanogaster
ttcgccgtggctc

SEQ ID NO: 667035 - DNA, 14 bp, D. melanogaster
ttcgccgtggctct

SEQ ID NO: 667036 - DNA, 13 bp, D. melanogaster
ttcgcctgcattt

SEQ ID NO: 667037 - DNA, 13 bp, D. melanogaster
ttcgcctgctttt

SEQ ID NO: 667038 - DNA, 13 bp, D. melanogaster
ttcgcctggtaat

SEQ ID NO: 667039 - DNA, 14 bp, D. melanogaster
ttcgccttcgcctt

SEQ ID NO: 667040 - DNA, 13 bp, D. melanogaster
ttcgccttcttca

SEQ ID NO: 667041 - DNA, 13 bp, D. melanogaster
ttcgccttgcttg

SEQ ID NO: 667042 - DNA, 13 bp, D. melanogaster
ttcgccttggcca

SEQ ID NO: 667043 - DNA, 13 bp, D. melanogaster
ttcgcctttaact

SEQ ID NO: 667044 - DNA, 13 bp, D. melanogaster
ttcgcctttgatt

SEQ ID NO: 667045 - DNA, 13 bp, D. melanogaster
ttcgcctttgcct

SEQ ID NO: 667046 - DNA, 13 bp, D. melanogaster
ttcgcctttgctg

SEQ ID NO: 667047 - DNA, 13 bp, D. melanogaster
ttcgccttttgtc

SEQ ID NO: 667048 - DNA, 13 bp, D. melanogaster
ttcgcctttttgg

SEQ ID NO: 667049 - DNA, 13 bp, D. melanogaster
ttcgcgagaagtt

SEQ ID NO: 667050 - DNA, 13 bp, D. melanogaster
ttcgcgcagtgta

SEQ ID NO: 667051 - DNA, 13 bp, D. melanogaster
ttcgctattcgaa

SEQ ID NO: 667052 - DNA, 14 bp, D. melanogaster
ttcgctcagtgtac

SEQ ID NO: 667053 - DNA, 13 bp, D. melanogaster
ttcgctcgaaaat

SEQ ID NO: 667054 - DNA, 14 bp, D. melanogaster
ttcgctcgaaaata

SEQ ID NO: 667055 - DNA, 13 bp, D. melanogaster
ttcgctcgctttt

SEQ ID NO: 667056 - DNA, 13 bp, D. melanogaster
ttcgctctctcgc

SEQ ID NO: 667057 - DNA, 13 bp, D. melanogaster
ttcgctcttctgg

SEQ ID NO: 667058 - DNA, 13 bp, D. melanogaster
ttcgctgaaaagt

SEQ ID NO: 667059 - DNA, 13 bp, D. melanogaster
ttcgctgatgata

SEQ ID NO: 667060 - DNA, 13 bp, D. melanogaster
ttcgctgcagtca

SEQ ID NO: 667061 - DNA, 13 bp, D. melanogaster
ttcgctgcatttg

SEQ ID NO: 667062 - DNA, 13 bp, D. melanogaster
ttcgctgcatttt

SEQ ID NO: 667063 - DNA, 14 bp, D. melanogaster
ttcgctgccatgga

SEQ ID NO: 667064 - DNA, 13 bp, D. melanogaster
ttcgctgccattt

SEQ ID NO: 667065 - DNA, 13 bp, D. melanogaster
ttcgctgctcatt

SEQ ID NO: 667066 - DNA, 13 bp, D. melanogaster
ttcgctgctcttt

SEQ ID NO: 667067 - DNA, 13 bp, D. melanogaster
ttcgctgctgctg

SEQ ID NO: 667068 - DNA, 13 bp, D. melanogaster
ttcgctgctgttg

SEQ ID NO: 667069 - DNA, 13 bp, D. melanogaster
ttcgctgcttttc

SEQ ID NO: 667070 - DNA, 13 bp, D. melanogaster
ttcgctggaattt

SEQ ID NO: 667071 - DNA, 13 bp, D. melanogaster
ttcgctggcaaat

SEQ ID NO: 667072 - DNA, 13 bp, D. melanogaster
ttcgctggcattt

SEQ ID NO: 667073 - DNA, 13 bp, D. melanogaster
ttcgctggccaaa

SEQ ID NO: 667074 - DNA, 13 bp, D. melanogaster
ttcgctggcgaaa

SEQ ID NO: 667075 - DNA, 13 bp, D. melanogaster
ttcgctggctttt

SEQ ID NO: 667076 - DNA, 13 bp, D. melanogaster
ttcgctggtccct

SEQ ID NO: 667077 - DNA, 13 bp, D. melanogaster
ttcgctgtagcgc

SEQ ID NO: 667078 - DNA, 13 bp, D. melanogaster
ttcgctgtttgcc

SEQ ID NO: 667079 - DNA, 13 bp, D. melanogaster
ttcgcttaatttg

SEQ ID NO: 667080 - DNA, 13 bp, D. melanogaster
ttcgcttaatttt

SEQ ID NO: 667081 - DNA, 13 bp, D. melanogaster
ttcgcttcatttg

SEQ ID NO: 667082 - DNA, 13 bp, D. melanogaster
ttcgcttccgttt

SEQ ID NO: 667083 - DNA, 13 bp, D. melanogaster
ttcgcttcgtttc

SEQ ID NO: 667084 - DNA, 14 bp, D. melanogaster
ttcgcttcgtttcg

SEQ ID NO: 667085 - DNA, 13 bp, D. melanogaster
ttcgcttgaaaaa

SEQ ID NO: 667086 - DNA, 13 bp, D. melanogaster
ttcgcttgcattt

SEQ ID NO: 667087 - DNA, 13 bp, D. melanogaster
ttcgcttgccatt

SEQ ID NO: 667088 - DNA, 13 bp, D. melanogaster
ttcgcttggattt

SEQ ID NO: 667089 - DNA, 13 bp, D. melanogaster
ttcgcttggcttt

SEQ ID NO: 667090 - DNA, 13 bp, D. melanogaster
ttcgctttagatg

SEQ ID NO: 667091 - DNA, 13 bp, D. melanogaster
ttcgctttattgt

SEQ ID NO: 667092 - DNA, 13 bp, D. melanogaster
ttcgctttcaatt

SEQ ID NO: 667093 - DNA, 13 bp, D. melanogaster
ttcgctttcgctt

SEQ ID NO: 667094 - DNA, 13 bp, D. melanogaster
ttcgctttcggct

SEQ ID NO: 667095 - DNA, 13 bp, D. melanogaster
ttcgctttgaatt

SEQ ID NO: 667096 - DNA, 13 bp, D. melanogaster
ttcgctttgattt

SEQ ID NO: 667097 - DNA, 13 bp, D. melanogaster
ttcgctttgggtt

SEQ ID NO: 667098 - DNA, 14 bp, D. melanogaster
ttcgcttttaatta

SEQ ID NO: 667099 - DNA, 13 bp, D. melanogaster
ttcgcttttattg

SEQ ID NO: 667100 - DNA, 13 bp, D. melanogaster
ttcgcttttcaat

SEQ ID NO: 667101 - DNA, 13 bp, D. melanogaster
ttcgcttttcaca

SEQ ID NO: 667102 - DNA, 14 bp, D. melanogaster
ttcgcttttcattt

SEQ ID NO: 667103 - DNA, 13 bp, D. melanogaster
ttcgcttttggca

SEQ ID NO: 667104 - DNA, 13 bp, D. melanogaster
ttcgcttttgtgg

SEQ ID NO: 667105 - DNA, 13 bp, D. melanogaster
ttcgctttttatg

SEQ ID NO: 667106 - DNA, 13 bp, D. melanogaster
ttcgctttttcgg

SEQ ID NO: 667107 - DNA, 13 bp, D. melanogaster
ttcggaaaataga

SEQ ID NO: 667108 - DNA, 13 bp, D. melanogaster
ttcggaaaatgtt

SEQ ID NO: 667109 - DNA, 13 bp, D. melanogaster
ttcggaaaatttt

SEQ ID NO: 667110 - DNA, 13 bp, D. melanogaster
ttcggaaattaaa

SEQ ID NO: 667111 - DNA, 13 bp, D. melanogaster
ttcggaaattcaa

SEQ ID NO: 667112 - DNA, 13 bp, D. melanogaster
ttcggaaatttgt

SEQ ID NO: 667113 - DNA, 13 bp, D. melanogaster
ttcggaacgaaaa

SEQ ID NO: 667114 - DNA, 14 bp, D. melanogaster
ttcggaatcggaat

SEQ ID NO: 667115 - DNA, 14 bp, D. melanogaster
ttcggaatgagcag

SEQ ID NO: 667116 - DNA, 13 bp, D. melanogaster
ttcggaattttaa

SEQ ID NO: 667117 - DNA, 13 bp, D. melanogaster
ttcggacaacttg

SEQ ID NO: 667118 - DNA, 13 bp, D. melanogaster
ttcggacattatc

SEQ ID NO: 667119 - DNA, 14 bp, D. melanogaster
ttcggactcggatt

SEQ ID NO: 667120 - DNA, 13 bp, D. melanogaster
ttcggagtggcat

SEQ ID NO: 667121 - DNA, 13 bp, D. melanogaster
ttcggataatttt

SEQ ID NO: 667122 - DNA, 13 bp, D. melanogaster
ttcggatatggtc

SEQ ID NO: 667123 - DNA, 13 bp, D. melanogaster
ttcggatatttgg

SEQ ID NO: 667124 - DNA, 14 bp, D. melanogaster
ttcggatcggatcg

SEQ ID NO: 667125 - DNA, 13 bp, D. melanogaster
ttcggatgcggat

SEQ ID NO: 667126 - DNA, 13 bp, D. melanogaster
ttcggattccgat

SEQ ID NO: 667127 - DNA, 14 bp, D. melanogaster
ttcggattccgatt

SEQ ID NO: 667128 - DNA, 13 bp, D. melanogaster
ttcggattcggaa

SEQ ID NO: 667129 - DNA, 13 bp, D. melanogaster
ttcggattcggag

SEQ ID NO: 667130 - DNA, 13 bp, D. melanogaster
ttcggattcggtt

SEQ ID NO: 667131 - DNA, 13 bp, D. melanogaster
ttcggattggatt

SEQ ID NO: 667132 - DNA, 13 bp, D. melanogaster
ttcggatttgcat

SEQ ID NO: 667133 - DNA, 13 bp, D. melanogaster
ttcggatttggat

SEQ ID NO: 667134 - DNA, 14 bp, D. melanogaster
ttcggatttggatt

SEQ ID NO: 667135 - DNA, 13 bp, D. melanogaster
ttcggcaacagga

SEQ ID NO: 667136 - DNA, 13 bp, D. melanogaster
ttcggcagaaact

SEQ ID NO: 667137 - DNA, 13 bp, D. melanogaster
ttcggcagcaatt

SEQ ID NO: 667138 - DNA, 13 bp, D. melanogaster
ttcggcattcggc

SEQ ID NO: 667139 - DNA, 13 bp, D. melanogaster
ttcggcatttatt

SEQ ID NO: 667140 - DNA, 13 bp, D. melanogaster
ttcggccctcctg

SEQ ID NO: 667141 - DNA, 13 bp, D. melanogaster
ttcggctaataaa

SEQ ID NO: 667142 - DNA, 14 bp, D. melanogaster
ttcggctttctttg

SEQ ID NO: 667143 - DNA, 13 bp, D. melanogaster
ttcggctttgatt

SEQ ID NO: 667144 - DNA, 13 bp, D. melanogaster
ttcggcttttggc

SEQ ID NO: 667145 - DNA, 13 bp, D. melanogaster
ttcggctttttgg

SEQ ID NO: 667146 - DNA, 13 bp, D. melanogaster
ttcgggaactctg

SEQ ID NO: 667147 - DNA, 13 bp, D. melanogaster
ttcgggcatcttt

SEQ ID NO: 667148 - DNA, 13 bp, D. melanogaster
ttcgggccaagtt

SEQ ID NO: 667149 - DNA, 13 bp, D. melanogaster
ttcgggcccacat

SEQ ID NO: 667150 - DNA, 13 bp, D. melanogaster
ttcgggcgccagt

SEQ ID NO: 667151 - DNA, 13 bp, D. melanogaster
ttcggggaaattt

SEQ ID NO: 667152 - DNA, 13 bp, D. melanogaster
ttcgggggaaatt

SEQ ID NO: 667153 - DNA, 13 bp, D. melanogaster
ttcgggggctcct

SEQ ID NO: 667154 - DNA, 13 bp, D. melanogaster
ttcgggttgaaaa

SEQ ID NO: 667155 - DNA, 13 bp, D. melanogaster
ttcgggtttattt

SEQ ID NO: 667156 - DNA, 13 bp, D. melanogaster
ttcggtctcatac

SEQ ID NO: 667157 - DNA, 13 bp, D. melanogaster
ttcggtgagcagg

SEQ ID NO: 667158 - DNA, 13 bp, D. melanogaster
ttcggtggccaaa

SEQ ID NO: 667159 - DNA, 13 bp, D. melanogaster
ttcggtggcttct

SEQ ID NO: 667160 - DNA, 13 bp, D. melanogaster
ttcggttcagttc

SEQ ID NO: 667161 - DNA, 13 bp, D. melanogaster
ttcggttcgattt

SEQ ID NO: 667162 - DNA, 13 bp, D. melanogaster
ttcggttcgcttt

SEQ ID NO: 667163 - DNA, 13 bp, D. melanogaster
ttcggttcggttc

SEQ ID NO: 667164 - DNA, 14 bp, D. melanogaster
ttcggttcggttcg

SEQ ID NO: 667165 - DNA, 13 bp, D. melanogaster
ttcggttcggttt

SEQ ID NO: 667166 - DNA, 14 bp, D. melanogaster
ttcggttcggtttg

SEQ ID NO: 667167 - DNA, 13 bp, D. melanogaster
ttcggttggattt

SEQ ID NO: 667168 - DNA, 13 bp, D. melanogaster
ttcggttggccaa

SEQ ID NO: 667169 - DNA, 13 bp, D. melanogaster
ttcggttggcgaa

SEQ ID NO: 667170 - DNA, 13 bp, D. melanogaster
ttcggtttcaatt

SEQ ID NO: 667171 - DNA, 13 bp, D. melanogaster
ttcggtttcactt

SEQ ID NO: 667172 - DNA, 14 bp, D. melanogaster
ttcggtttcacttt

SEQ ID NO: 667173 - DNA, 13 bp, D. melanogaster
ttcggtttcagtt

SEQ ID NO: 667174 - DNA, 14 bp, D. melanogaster
ttcggtttcagttt

SEQ ID NO: 667175 - DNA, 13 bp, D. melanogaster
ttcggtttcgatt

SEQ ID NO: 667176 - DNA, 13 bp, D. melanogaster
ttcggtttcggat

SEQ ID NO: 667177 - DNA, 13 bp, D. melanogaster
ttcggtttcggcc

SEQ ID NO: 667178 - DNA, 13 bp, D. melanogaster
ttcggtttctgct

SEQ ID NO: 667179 - DNA, 13 bp, D. melanogaster
ttcggtttggctt

SEQ ID NO: 667180 - DNA, 13 bp, D. melanogaster
ttcggttttaaat

SEQ ID NO: 667181 - DNA, 13 bp, D. melanogaster
ttcggttttaatt

SEQ ID NO: 667182 - DNA, 14 bp, D. melanogaster
ttcggttttcagtt

SEQ ID NO: 667183 - DNA, 14 bp, D. melanogaster
ttcggttttcattt

SEQ ID NO: 667184 - DNA, 13 bp, D. melanogaster
ttcggttttccat

SEQ ID NO: 667185 - DNA, 14 bp, D. melanogaster
ttcggttttggcca

SEQ ID NO: 667186 - DNA, 13 bp, D. melanogaster
ttcggttttggct

SEQ ID NO: 667187 - DNA, 13 bp, D. melanogaster
ttcggtttttagt

SEQ ID NO: 667188 - DNA, 14 bp, D. melanogaster
ttcggtttttttga

SEQ ID NO: 667189 - DNA, 13 bp, D. melanogaster
ttcgtaaacaaaa

SEQ ID NO: 667190 - DNA, 13 bp, D. melanogaster
ttcgtaaatatat

SEQ ID NO: 667191 - DNA, 13 bp, D. melanogaster
ttcgtaaatattt

SEQ ID NO: 667192 - DNA, 13 bp, D. melanogaster
ttcgtaataatgt

SEQ ID NO: 667193 - DNA, 13 bp, D. melanogaster
ttcgtaatatttt

SEQ ID NO: 667194 - DNA, 13 bp, D. melanogaster
ttcgtaatcataa

SEQ ID NO: 667195 - DNA, 13 bp, D. melanogaster
ttcgtaattaaat

SEQ ID NO: 667196 - DNA, 13 bp, D. melanogaster
ttcgtacaaattt

SEQ ID NO: 667197 - DNA, 13 bp, D. melanogaster
ttcgtactgcttt

SEQ ID NO: 667198 - DNA, 13 bp, D. melanogaster
ttcgtatataata

SEQ ID NO: 667199 - DNA, 14 bp, D. melanogaster
ttcgtatctgtatc

SEQ ID NO: 667200 - DNA, 13 bp, D. melanogaster
ttcgtatgtattt

SEQ ID NO: 667201 - DNA, 13 bp, D. melanogaster
ttcgtatttatat

SEQ ID NO: 667202 - DNA, 13 bp, D. melanogaster
ttcgtattttata

SEQ ID NO: 667203 - DNA, 14 bp, D. melanogaster
ttcgtcctgcgtcc

SEQ ID NO: 667204 - DNA, 13 bp, D. melanogaster
ttcgtcctggcca

SEQ ID NO: 667205 - DNA, 13 bp, D. melanogaster
ttcgtccttttcg

SEQ ID NO: 667206 - DNA, 13 bp, D. melanogaster
ttcgtccttttgc

SEQ ID NO: 667207 - DNA, 13 bp, D. melanogaster
ttcgtctccaact

SEQ ID NO: 667208 - DNA, 13 bp, D. melanogaster
ttcgtctgcgttt

SEQ ID NO: 667209 - DNA, 13 bp, D. melanogaster
ttcgtcttcgtct

SEQ ID NO: 667210 - DNA, 14 bp, D. melanogaster
ttcgtgcctctgcc

SEQ ID NO: 667211 - DNA, 13 bp, D. melanogaster
ttcgtgctcagca

SEQ ID NO: 667212 - DNA, 13 bp, D. melanogaster
ttcgtgtgcgttt

SEQ ID NO: 667213 - DNA, 13 bp, D. melanogaster
ttcgtgtgtactg

SEQ ID NO: 667214 - DNA, 13 bp, D. melanogaster
ttcgttaaaaaat

SEQ ID NO: 667215 - DNA, 13 bp, D. melanogaster
ttcgttaattaaa

SEQ ID NO: 667216 - DNA, 13 bp, D. melanogaster
ttcgttacgtttc

SEQ ID NO: 667217 - DNA, 13 bp, D. melanogaster
ttcgttatcgctg

SEQ ID NO: 667218 - DNA, 13 bp, D. melanogaster
ttcgttattgaac

SEQ ID NO: 667219 - DNA, 13 bp, D. melanogaster
ttcgttattttca

SEQ ID NO: 667220 - DNA, 13 bp, D. melanogaster
ttcgttcaacttt

SEQ ID NO: 667221 - DNA, 13 bp, D. melanogaster
ttcgttcagtgca

SEQ ID NO: 667222 - DNA, 13 bp, D. melanogaster
ttcgttcagtttg

SEQ ID NO: 667223 - DNA, 13 bp, D. melanogaster
ttcgttcataaac

SEQ ID NO: 667224 - DNA, 13 bp, D. melanogaster
ttcgttccgtttc

SEQ ID NO: 667225 - DNA, 13 bp, D. melanogaster
ttcgttcgattgt

SEQ ID NO: 667226 - DNA, 14 bp, D. melanogaster
ttcgttcgttcgtt

SEQ ID NO: 667227 - DNA, 13 bp, D. melanogaster
ttcgttcgtttcg

SEQ ID NO: 667228 - DNA, 13 bp, D. melanogaster
ttcgttctaagaa

SEQ ID NO: 667229 - DNA, 13 bp, D. melanogaster
ttcgttctattgt

SEQ ID NO: 667230 - DNA, 13 bp, D. melanogaster
ttcgttgaaaagt

SEQ ID NO: 667231 - DNA, 13 bp, D. melanogaster
ttcgttgaaaatt

SEQ ID NO: 667232 - DNA, 13 bp, D. melanogaster
ttcgttgaccaat

SEQ ID NO: 667233 - DNA, 14 bp, D. melanogaster
ttcgttgcatactt

SEQ ID NO: 667234 - DNA, 13 bp, D. melanogaster
ttcgttgccattt

SEQ ID NO: 667235 - DNA, 13 bp, D. melanogaster
ttcgttggcattt

SEQ ID NO: 667236 - DNA, 13 bp, D. melanogaster
ttcgttggcgttg

SEQ ID NO: 667237 - DNA, 13 bp, D. melanogaster
ttcgttgttagtt

SEQ ID NO: 667238 - DNA, 13 bp, D. melanogaster
ttcgtttaaataa

SEQ ID NO: 667239 - DNA, 13 bp, D. melanogaster
ttcgtttaaatta

SEQ ID NO: 667240 - DNA, 13 bp, D. melanogaster
ttcgtttaatttg

SEQ ID NO: 667241 - DNA, 13 bp, D. melanogaster
ttcgtttacattt

SEQ ID NO: 667242 - DNA, 13 bp, D. melanogaster
ttcgtttattata

SEQ ID NO: 667243 - DNA, 13 bp, D. melanogaster
ttcgtttatttcg

SEQ ID NO: 667244 - DNA, 13 bp, D. melanogaster
ttcgtttcaattt

SEQ ID NO: 667245 - DNA, 13 bp, D. melanogaster
ttcgtttcagttt

SEQ ID NO: 667246 - DNA, 13 bp, D. melanogaster
ttcgtttcatttc

SEQ ID NO: 667247 - DNA, 14 bp, D. melanogaster
ttcgtttcatttca

SEQ ID NO: 667248 - DNA, 14 bp, D. melanogaster
ttcgtttcatttcg

SEQ ID NO: 667249 - DNA, 13 bp, D. melanogaster
ttcgtttcatttg

SEQ ID NO: 667250 - DNA, 14 bp, D. melanogaster
ttcgtttcattttc

SEQ ID NO: 667251 - DNA, 13 bp, D. melanogaster
ttcgtttccattc

SEQ ID NO: 667252 - DNA, 13 bp, D. melanogaster
ttcgtttccattt

SEQ ID NO: 667253 - DNA, 13 bp, D. melanogaster
ttcgtttcgattc

SEQ ID NO: 667254 - DNA, 13 bp, D. melanogaster
ttcgtttcgattt

SEQ ID NO: 667255 - DNA, 13 bp, D. melanogaster
ttcgtttcggcca

SEQ ID NO: 667256 - DNA, 13 bp, D. melanogaster
ttcgtttcgggaa

SEQ ID NO: 667257 - DNA, 13 bp, D. melanogaster
ttcgtttcgttgc

SEQ ID NO: 667258 - DNA, 13 bp, D. melanogaster
ttcgtttgaattt

SEQ ID NO: 667259 - DNA, 13 bp, D. melanogaster
ttcgtttgcaatt

SEQ ID NO: 667260 - DNA, 13 bp, D. melanogaster
ttcgtttgcatgg

SEQ ID NO: 667261 - DNA, 13 bp, D. melanogaster
ttcgtttgcattt

SEQ ID NO: 667262 - DNA, 13 bp, D. melanogaster
ttcgtttgctgct

SEQ ID NO: 667263 - DNA, 13 bp, D. melanogaster
ttcgtttggcaat

SEQ ID NO: 667264 - DNA, 13 bp, D. melanogaster
ttcgtttgtcatt

SEQ ID NO: 667265 - DNA, 13 bp, D. melanogaster
ttcgttttaaaat

SEQ ID NO: 667266 - DNA, 13 bp, D. melanogaster
ttcgttttataat

SEQ ID NO: 667267 - DNA, 13 bp, D. melanogaster
ttcgttttcaaat

SEQ ID NO: 667268 - DNA, 13 bp, D. melanogaster
ttcgttttcaatc

SEQ ID NO: 667269 - DNA, 13 bp, D. melanogaster
ttcgttttcaatg

SEQ ID NO: 667270 - DNA, 13 bp, D. melanogaster
ttcgttttcaatt

SEQ ID NO: 667271 - DNA, 14 bp, D. melanogaster
ttcgttttcaattt

SEQ ID NO: 667272 - DNA, 13 bp, D. melanogaster
ttcgttttcactt

SEQ ID NO: 667273 - DNA, 14 bp, D. melanogaster
ttcgttttcacttt

SEQ ID NO: 667274 - DNA, 14 bp, D. melanogaster
ttcgttttcagttt

SEQ ID NO: 667275 - DNA, 13 bp, D. melanogaster
ttcgttttcattc

SEQ ID NO: 667276 - DNA, 14 bp, D. melanogaster
ttcgttttcatttc

SEQ ID NO: 667277 - DNA, 14 bp, D. melanogaster
ttcgttttccattt

SEQ ID NO: 667278 - DNA, 13 bp, D. melanogaster
ttcgttttcgatt

SEQ ID NO: 667279 - DNA, 14 bp, D. melanogaster
ttcgttttcgattt

SEQ ID NO: 667280 - DNA, 13 bp, D. melanogaster
ttcgttttgagtt

SEQ ID NO: 667281 - DNA, 13 bp, D. melanogaster
ttcgttttgattg

SEQ ID NO: 667282 - DNA, 14 bp, D. melanogaster
ttcgttttgcattt

SEQ ID NO: 667283 - DNA, 13 bp, D. melanogaster
ttcgttttggcca

SEQ ID NO: 667284 - DNA, 13 bp, D. melanogaster
ttcgttttgtaaa

SEQ ID NO: 667285 - DNA, 13 bp, D. melanogaster
ttcgttttgtaat

SEQ ID NO: 667286 - DNA, 13 bp, D. melanogaster
ttcgtttttggcc

SEQ ID NO: 667287 - DNA, 13 bp, D. melanogaster
ttctaaaaatgta

SEQ ID NO: 667288 - DNA, 13 bp, D. melanogaster
ttctaaacaaatt

SEQ ID NO: 667289 - DNA, 13 bp, D. melanogaster
ttctaaacaactt

SEQ ID NO: 667290 - DNA, 13 bp, D. melanogaster
ttctaaacaattt

SEQ ID NO: 667291 - DNA, 13 bp, D. melanogaster
ttctaaatgtttt

SEQ ID NO: 667292 - DNA, 13 bp, D. melanogaster
ttctaaattcaat

SEQ ID NO: 667293 - DNA, 13 bp, D. melanogaster
ttctaaattctaa

SEQ ID NO: 667294 - DNA, 13 bp, D. melanogaster
ttctaacagattt

SEQ ID NO: 667295 - DNA, 13 bp, D. melanogaster
ttctaacttagca

SEQ ID NO: 667296 - DNA, 13 bp, D. melanogaster
ttctaagttggaa

SEQ ID NO: 667297 - DNA, 13 bp, D. melanogaster
ttctaatcaaaat

SEQ ID NO: 667298 - DNA, 13 bp, D. melanogaster
ttctaatctatta

SEQ ID NO: 667299 - DNA, 13 bp, D. melanogaster
ttctaatgaaaca

SEQ ID NO: 667300 - DNA, 13 bp, D. melanogaster
ttctaatgaactc

SEQ ID NO: 667301 - DNA, 13 bp, D. melanogaster
ttctaatgataat

SEQ ID NO: 667302 - DNA, 13 bp, D. melanogaster
ttctaatgcaatt

SEQ ID NO: 667303 - DNA, 13 bp, D. melanogaster
ttctaatgcgttg

SEQ ID NO: 667304 - DNA, 13 bp, D. melanogaster
ttctaattaaaag

SEQ ID NO: 667305 - DNA, 13 bp, D. melanogaster
ttctaattacacg

SEQ ID NO: 667306 - DNA, 13 bp, D. melanogaster
ttctaattagtta

SEQ ID NO: 667307 - DNA, 13 bp, D. melanogaster
ttctaattagttt

SEQ ID NO: 667308 - DNA, 13 bp, D. melanogaster
ttctaattctaat

SEQ ID NO: 667309 - DNA, 13 bp, D. melanogaster
ttctaattctatg

SEQ ID NO: 667310 - DNA, 13 bp, D. melanogaster
ttctaattgaaaa

SEQ ID NO: 667311 - DNA, 13 bp, D. melanogaster
ttctaattgtgat

SEQ ID NO: 667312 - DNA, 14 bp, D. melanogaster
ttctaattgtgatt

SEQ ID NO: 667313 - DNA, 13 bp, D. melanogaster
ttctaatttccaa

SEQ ID NO: 667314 - DNA, 13 bp, D. melanogaster
ttctaatttgatt

SEQ ID NO: 667315 - DNA, 13 bp, D. melanogaster
ttctacaaacaaa

SEQ ID NO: 667316 - DNA, 13 bp, D. melanogaster
ttctacaataaat

SEQ ID NO: 667317 - DNA, 13 bp, D. melanogaster
ttctacacaattt

SEQ ID NO: 667318 - DNA, 13 bp, D. melanogaster
ttctacatagaaa

SEQ ID NO: 667319 - DNA, 14 bp, D. melanogaster
ttctacatttttgg

SEQ ID NO: 667320 - DNA, 13 bp, D. melanogaster
ttctaccgaaaac

SEQ ID NO: 667321 - DNA, 13 bp, D. melanogaster
ttctactactact

SEQ ID NO: 667322 - DNA, 13 bp, D. melanogaster
ttctacttaaaaa

SEQ ID NO: 667323 - DNA, 13 bp, D. melanogaster
ttctacttccact

SEQ ID NO: 667324 - DNA, 14 bp, D. melanogaster
ttctacttcgattt

SEQ ID NO: 667325 - DNA, 13 bp, D. melanogaster
ttctacttcgtat

SEQ ID NO: 667326 - DNA, 13 bp, D. melanogaster
ttctactttaaaa

SEQ ID NO: 667327 - DNA, 13 bp, D. melanogaster
ttctagatctaga

SEQ ID NO: 667328 - DNA, 13 bp, D. melanogaster
ttctagcatattc

SEQ ID NO: 667329 - DNA, 14 bp, D. melanogaster
ttctagcatattct

SEQ ID NO: 667330 - DNA, 13 bp, D. melanogaster
ttctaggtcaaaa

SEQ ID NO: 667331 - DNA, 13 bp, D. melanogaster
ttctagtgaatct

SEQ ID NO: 667332 - DNA, 13 bp, D. melanogaster
ttctagtgccaca

SEQ ID NO: 667333 - DNA, 14 bp, D. melanogaster
ttctagtgtctttg

SEQ ID NO: 667334 - DNA, 15 bp, D. melanogaster
ttctagtgtctttgg

SEQ ID NO: 667335 - DNA, 13 bp, D. melanogaster
ttctagttaattt

SEQ ID NO: 667336 - DNA, 14 bp, D. melanogaster
ttctagttaattta

SEQ ID NO: 667337 - DNA, 13 bp, D. melanogaster
ttctagttctagt

SEQ ID NO: 667338 - DNA, 13 bp, D. melanogaster
ttctagttgccca

SEQ ID NO: 667339 - DNA, 13 bp, D. melanogaster
ttctataaatatg

SEQ ID NO: 667340 - DNA, 14 bp, D. melanogaster
ttctataacttcat

SEQ ID NO: 667341 - DNA, 13 bp, D. melanogaster
ttctatagaaatt

SEQ ID NO: 667342 - DNA, 13 bp, D. melanogaster
ttctatatatgga

SEQ ID NO: 667343 - DNA, 13 bp, D. melanogaster
ttctatatatgta

SEQ ID NO: 667344 - DNA, 13 bp, D. melanogaster
ttctatatattgt

SEQ ID NO: 667345 - DNA, 13 bp, D. melanogaster
ttctatatcatca

SEQ ID NO: 667346 - DNA, 13 bp, D. melanogaster
ttctatatctata

SEQ ID NO: 667347 - DNA, 13 bp, D. melanogaster
ttctatatgcaaa

SEQ ID NO: 667348 - DNA, 14 bp, D. melanogaster
ttctatatgcatat

SEQ ID NO: 667349 - DNA, 13 bp, D. melanogaster
ttctatatggatg

SEQ ID NO: 667350 - DNA, 13 bp, D. melanogaster
ttctatatgtata

SEQ ID NO: 667351 - DNA, 13 bp, D. melanogaster
ttctatatgtttg

SEQ ID NO: 667352 - DNA, 13 bp, D. melanogaster
ttctatatttaag

SEQ ID NO: 667353 - DNA, 13 bp, D. melanogaster
ttctatatttgcg

SEQ ID NO: 667354 - DNA, 13 bp, D. melanogaster
ttctatcgatttc

SEQ ID NO: 667355 - DNA, 14 bp, D. melanogaster
ttctatctatctat

SEQ ID NO: 667356 - DNA, 13 bp, D. melanogaster
ttctatctgatgg

SEQ ID NO: 667357 - DNA, 13 bp, D. melanogaster
ttctatgctatgt

SEQ ID NO: 667358 - DNA, 13 bp, D. melanogaster
ttctatgtatata

SEQ ID NO: 667359 - DNA, 13 bp, D. melanogaster
ttctatgtgtgct

SEQ ID NO: 667360 - DNA, 13 bp, D. melanogaster
ttctatgtttaaa

SEQ ID NO: 667361 - DNA, 13 bp, D. melanogaster
ttctattaaattc

SEQ ID NO: 667362 - DNA, 13 bp, D. melanogaster
ttctattaattcg

SEQ ID NO: 667363 - DNA, 13 bp, D. melanogaster
ttctattagtgga

SEQ ID NO: 667364 - DNA, 14 bp, D. melanogaster
ttctattatattgt

SEQ ID NO: 667365 - DNA, 13 bp, D. melanogaster
ttctattcgattt

SEQ ID NO: 667366 - DNA, 13 bp, D. melanogaster
ttctattctgttc

SEQ ID NO: 667367 - DNA, 13 bp, D. melanogaster
ttctattcttgga

SEQ ID NO: 667368 - DNA, 14 bp, D. melanogaster
ttctattcttggaa

SEQ ID NO: 667369 - DNA, 13 bp, D. melanogaster
ttctattgaaaat

SEQ ID NO: 667370 - DNA, 13 bp, D. melanogaster
ttctattgaaatt

SEQ ID NO: 667371 - DNA, 13 bp, D. melanogaster
ttctattgtatat

SEQ ID NO: 667372 - DNA, 13 bp, D. melanogaster
ttctattgttgtg

SEQ ID NO: 667373 - DNA, 13 bp, D. melanogaster
ttctattgtttgc

SEQ ID NO: 667374 - DNA, 13 bp, D. melanogaster
ttctatttaagtt

SEQ ID NO: 667375 - DNA, 13 bp, D. melanogaster
ttctatttcggtt

SEQ ID NO: 667376 - DNA, 13 bp, D. melanogaster
ttctatttctgat

SEQ ID NO: 667377 - DNA, 13 bp, D. melanogaster
ttctatttgaaag

SEQ ID NO: 667378 - DNA, 13 bp, D. melanogaster
ttctatttgctta

SEQ ID NO: 667379 - DNA, 13 bp, D. melanogaster
ttctatttgtata

SEQ ID NO: 667380 - DNA, 13 bp, D. melanogaster
ttctattttcgtg

SEQ ID NO: 667381 - DNA, 13 bp, D. melanogaster
ttctatttttgaa

SEQ ID NO: 667382 - DNA, 14 bp, D. melanogaster
ttctatttttgctg

SEQ ID NO: 667383 - DNA, 13 bp, D. melanogaster
ttctcaaaaaacc

SEQ ID NO: 667384 - DNA, 13 bp, D. melanogaster
ttctcaaaaataa

SEQ ID NO: 667385 - DNA, 13 bp, D. melanogaster
ttctcaaaaattt

SEQ ID NO: 667386 - DNA, 13 bp, D. melanogaster
ttctcaaagttaa

SEQ ID NO: 667387 - DNA, 13 bp, D. melanogaster
ttctcaaatattt

SEQ ID NO: 667388 - DNA, 13 bp, D. melanogaster
ttctcaaccagca

SEQ ID NO: 667389 - DNA, 13 bp, D. melanogaster
ttctcaacttcaa

SEQ ID NO: 667390 - DNA, 13 bp, D. melanogaster
ttctcaaggttca

SEQ ID NO: 667391 - DNA, 13 bp, D. melanogaster
ttctcaataaaat

SEQ ID NO: 667392 - DNA, 13 bp, D. melanogaster
ttctcaatgtcga

SEQ ID NO: 667393 - DNA, 13 bp, D. melanogaster
ttctcaattaaat

SEQ ID NO: 667394 - DNA, 13 bp, D. melanogaster
ttctcaattctca

SEQ ID NO: 667395 - DNA, 13 bp, D. melanogaster
ttctcaattctta

SEQ ID NO: 667396 - DNA, 13 bp, D. melanogaster
ttctcaattttca

SEQ ID NO: 667397 - DNA, 13 bp, D. melanogaster
ttctcacagtgca

SEQ ID NO: 667398 - DNA, 13 bp, D. melanogaster
ttctcagaatttg

SEQ ID NO: 667399 - DNA, 13 bp, D. melanogaster
ttctcagatattt

SEQ ID NO: 667400 - DNA, 14 bp, D. melanogaster
ttctcagcagcagt

SEQ ID NO: 667401 - DNA, 13 bp, D. melanogaster
ttctcagtgcaga

SEQ ID NO: 667402 - DNA, 13 bp, D. melanogaster
ttctcagtgtaaa

SEQ ID NO: 667403 - DNA, 13 bp, D. melanogaster
ttctcagttcatt

SEQ ID NO: 667404 - DNA, 14 bp, D. melanogaster
ttctcagttcattt

SEQ ID NO: 667405 - DNA, 13 bp, D. melanogaster
ttctcagttttct

SEQ ID NO: 667406 - DNA, 13 bp, D. melanogaster
ttctcataaaaaa

SEQ ID NO: 667407 - DNA, 13 bp, D. melanogaster
ttctcatccttta

SEQ ID NO: 667408 - DNA, 13 bp, D. melanogaster
ttctcatttccat

SEQ ID NO: 667409 - DNA, 13 bp, D. melanogaster
ttctcatttcgct

SEQ ID NO: 667410 - DNA, 13 bp, D. melanogaster
ttctcatttggtt

SEQ ID NO: 667411 - DNA, 13 bp, D. melanogaster
ttctccaaaagaa

SEQ ID NO: 667412 - DNA, 13 bp, D. melanogaster
ttctccaagtgca

SEQ ID NO: 667413 - DNA, 13 bp, D. melanogaster
ttctccagaagtt

SEQ ID NO: 667414 - DNA, 13 bp, D. melanogaster
ttctccagagccg

SEQ ID NO: 667415 - DNA, 13 bp, D. melanogaster
ttctccagctgaa

SEQ ID NO: 667416 - DNA, 13 bp, D. melanogaster
ttctccataaaat

SEQ ID NO: 667417 - DNA, 13 bp, D. melanogaster
ttctccattttca

SEQ ID NO: 667418 - DNA, 13 bp, D. melanogaster
ttctcccaaaact

SEQ ID NO: 667419 - DNA, 13 bp, D. melanogaster
ttctcccagtgta

SEQ ID NO: 667420 - DNA, 13 bp, D. melanogaster
ttctccgagtgca

SEQ ID NO: 667421 - DNA, 13 bp, D. melanogaster
ttctccgctcagc

SEQ ID NO: 667422 - DNA, 13 bp, D. melanogaster
ttctcctatataa

SEQ ID NO: 667423 - DNA, 13 bp, D. melanogaster
ttctcctcaatcc

SEQ ID NO: 667424 - DNA, 13 bp, D. melanogaster
ttctcctgctgct

SEQ ID NO: 667425 - DNA, 13 bp, D. melanogaster
ttctcgactatca

SEQ ID NO: 667426 - DNA, 13 bp, D. melanogaster
ttctcgacttttt

SEQ ID NO: 667427 - DNA, 14 bp, D. melanogaster
ttctcgatggtgaa

SEQ ID NO: 667428 - DNA, 13 bp, D. melanogaster
ttctcgattctcg

SEQ ID NO: 667429 - DNA, 13 bp, D. melanogaster
ttctcgattttcc

SEQ ID NO: 667430 - DNA, 13 bp, D. melanogaster
ttctcgattttgt

SEQ ID NO: 667431 - DNA, 13 bp, D. melanogaster
ttctcgatttttg

SEQ ID NO: 667432 - DNA, 13 bp, D. melanogaster
ttctcgcgaaatt

SEQ ID NO: 667433 - DNA, 13 bp, D. melanogaster
ttctcgctgtgca

SEQ ID NO: 667434 - DNA, 13 bp, D. melanogaster
ttctcggctgatc

SEQ ID NO: 667435 - DNA, 13 bp, D. melanogaster
ttctcggtgcagc

SEQ ID NO: 667436 - DNA, 13 bp, D. melanogaster
ttctcgttctcgt

SEQ ID NO: 667437 - DNA, 13 bp, D. melanogaster
ttctctaccattg

SEQ ID NO: 667438 - DNA, 14 bp, D. melanogaster
ttctctaccattgt

SEQ ID NO: 667439 - DNA, 13 bp, D. melanogaster
ttctctatgaaaa

SEQ ID NO: 667440 - DNA, 13 bp, D. melanogaster
ttctctcacggct

SEQ ID NO: 667441 - DNA, 13 bp, D. melanogaster
ttctctcagtgcc

SEQ ID NO: 667442 - DNA, 13 bp, D. melanogaster
ttctctcagtgct

SEQ ID NO: 667443 - DNA, 14 bp, D. melanogaster
ttctctcagtgctc

SEQ ID NO: 667444 - DNA, 13 bp, D. melanogaster
ttctctcagtgta

SEQ ID NO: 667445 - DNA, 14 bp, D. melanogaster
ttctctcagtgtag

SEQ ID NO: 667446 - DNA, 13 bp, D. melanogaster
ttctctctgtgta

SEQ ID NO: 667447 - DNA, 13 bp, D. melanogaster
ttctctgagtgca

SEQ ID NO: 667448 - DNA, 14 bp, D. melanogaster
ttctctgagtgcac

SEQ ID NO: 667449 - DNA, 13 bp, D. melanogaster
ttctctgagttcc

SEQ ID NO: 667450 - DNA, 13 bp, D. melanogaster
ttctctgattttc

SEQ ID NO: 667451 - DNA, 13 bp, D. melanogaster
ttctctgcagccg

SEQ ID NO: 667452 - DNA, 13 bp, D. melanogaster
ttctctgccattt

SEQ ID NO: 667453 - DNA, 13 bp, D. melanogaster
ttctctgctttgc

SEQ ID NO: 667454 - DNA, 13 bp, D. melanogaster
ttctctggtcatt

SEQ ID NO: 667455 - DNA, 14 bp, D. melanogaster
ttctctggtcattt

SEQ ID NO: 667456 - DNA, 13 bp, D. melanogaster
ttctcttatataa

SEQ ID NO: 667457 - DNA, 13 bp, D. melanogaster
ttctctttgagaa

SEQ ID NO: 667458 - DNA, 13 bp, D. melanogaster
ttctctttgtgta

SEQ ID NO: 667459 - DNA, 14 bp, D. melanogaster
ttctgaaaaaaaaa

SEQ ID NO: 667460 - DNA, 13 bp, D. melanogaster
ttctgaaaaaatt

SEQ ID NO: 667461 - DNA, 13 bp, D. melanogaster
ttctgaaaaatgt

SEQ ID NO: 667462 - DNA, 13 bp, D. melanogaster
ttctgaaaataaa

SEQ ID NO: 667463 - DNA, 13 bp, D. melanogaster
ttctgaaataaat

SEQ ID NO: 667464 - DNA, 13 bp, D. melanogaster
ttctgaaataatt

SEQ ID NO: 667465 - DNA, 13 bp, D. melanogaster
ttctgaacttgct

SEQ ID NO: 667466 - DNA, 14 bp, D. melanogaster
ttctgaacttgctc

SEQ ID NO: 667467 - DNA, 13 bp, D. melanogaster
ttctgaatgaaat

SEQ ID NO: 667468 - DNA, 13 bp, D. melanogaster
ttctgaattccca

SEQ ID NO: 667469 - DNA, 13 bp, D. melanogaster
ttctgaatttatt

SEQ ID NO: 667470 - DNA, 13 bp, D. melanogaster
ttctgacactttt

SEQ ID NO: 667471 - DNA, 13 bp, D. melanogaster
ttctgactataat

SEQ ID NO: 667472 - DNA, 13 bp, D. melanogaster
ttctgactgttgt

SEQ ID NO: 667473 - DNA, 13 bp, D. melanogaster
ttctgataagcca

SEQ ID NO: 667474 - DNA, 13 bp, D. melanogaster
ttctgatcattca

SEQ ID NO: 667475 - DNA, 13 bp, D. melanogaster
ttctgatgctgct

SEQ ID NO: 667476 - DNA, 13 bp, D. melanogaster
ttctgattcagat

SEQ ID NO: 667477 - DNA, 13 bp, D. melanogaster
ttctgattccgat

SEQ ID NO: 667478 - DNA, 13 bp, D. melanogaster
ttctgattctgaa

SEQ ID NO: 667479 - DNA, 13 bp, D. melanogaster
ttctgatttgatt

SEQ ID NO: 667480 - DNA, 13 bp, D. melanogaster
ttctgatttgtag

SEQ ID NO: 667481 - DNA, 14 bp, D. melanogaster
ttctgattttgatt

SEQ ID NO: 667482 - DNA, 14 bp, D. melanogaster
ttctgcaaagacag

SEQ ID NO: 667483 - DNA, 13 bp, D. melanogaster
ttctgcaacattt

SEQ ID NO: 667484 - DNA, 13 bp, D. melanogaster
ttctgcaatttta

SEQ ID NO: 667485 - DNA, 13 bp, D. melanogaster
ttctgcacctgtg

SEQ ID NO: 667486 - DNA, 13 bp, D. melanogaster
ttctgcagctctc

SEQ ID NO: 667487 - DNA, 13 bp, D. melanogaster
ttctgcagttcgc

SEQ ID NO: 667488 - DNA, 13 bp, D. melanogaster
ttctgcagttgca

SEQ ID NO: 667489 - DNA, 13 bp, D. melanogaster
ttctgcatgcggc

SEQ ID NO: 667490 - DNA, 13 bp, D. melanogaster
ttctgcattctgc

SEQ ID NO: 667491 - DNA, 14 bp, D. melanogaster
ttctgcattctgca

SEQ ID NO: 667492 - DNA, 13 bp, D. melanogaster
ttctgcatttatt

SEQ ID NO: 667493 - DNA, 13 bp, D. melanogaster
ttctgcatttgca

SEQ ID NO: 667494 - DNA, 13 bp, D. melanogaster
ttctgcattttta

SEQ ID NO: 667495 - DNA, 13 bp, D. melanogaster
ttctgccaaaatg

SEQ ID NO: 667496 - DNA, 13 bp, D. melanogaster
ttctgccactttt

SEQ ID NO: 667497 - DNA, 13 bp, D. melanogaster
ttctgccagccag

SEQ ID NO: 667498 - DNA, 13 bp, D. melanogaster
ttctgccatggtt

SEQ ID NO: 667499 - DNA, 13 bp, D. melanogaster
ttctgccattatt

SEQ ID NO: 667500 - DNA, 13 bp, D. melanogaster
ttctgccgctgtc

SEQ ID NO: 667501 - DNA, 13 bp, D. melanogaster
ttctgccgcttct

SEQ ID NO: 667502 - DNA, 13 bp, D. melanogaster
ttctgcctattat

SEQ ID NO: 667503 - DNA, 13 bp, D. melanogaster
ttctgcgctgcgc

SEQ ID NO: 667504 - DNA, 13 bp, D. melanogaster
ttctgcggctgct

SEQ ID NO: 667505 - DNA, 13 bp, D. melanogaster
ttctgcgtcgacg

SEQ ID NO: 667506 - DNA, 13 bp, D. melanogaster
ttctgctacaact

SEQ ID NO: 667507 - DNA, 13 bp, D. melanogaster
ttctgctcctgct

SEQ ID NO: 667508 - DNA, 13 bp, D. melanogaster
ttctgctgatgct

SEQ ID NO: 667509 - DNA, 13 bp, D. melanogaster
ttctgctgatttt

SEQ ID NO: 667510 - DNA, 13 bp, D. melanogaster
ttctgctgcactt

SEQ ID NO: 667511 - DNA, 13 bp, D. melanogaster
ttctgctgcattt

SEQ ID NO: 667512 - DNA, 13 bp, D. melanogaster
ttctgctgccatt

SEQ ID NO: 667513 - DNA, 13 bp, D. melanogaster
ttctgctgccgct

SEQ ID NO: 667514 - DNA, 14 bp, D. melanogaster
ttctgctgccgctg

SEQ ID NO: 667515 - DNA, 13 bp, D. melanogaster
ttctgctgctcct

SEQ ID NO: 667516 - DNA, 14 bp, D. melanogaster
ttctgctgctcctg

SEQ ID NO: 667517 - DNA, 13 bp, D. melanogaster
ttctgctgctgcg

SEQ ID NO: 667518 - DNA, 13 bp, D. melanogaster
ttctgctgctggt

SEQ ID NO: 667519 - DNA, 13 bp, D. melanogaster
ttctgctgctgtt

SEQ ID NO: 667520 - DNA, 14 bp, D. melanogaster
ttctgctgctgttg

SEQ ID NO: 667521 - DNA, 13 bp, D. melanogaster
ttctgctgcttct

SEQ ID NO: 667522 - DNA, 14 bp, D. melanogaster
ttctgctggattca

SEQ ID NO: 667523 - DNA, 13 bp, D. melanogaster
ttctgctggattt

SEQ ID NO: 667524 - DNA, 13 bp, D. melanogaster
ttctgctggcttt

SEQ ID NO: 667525 - DNA, 14 bp, D. melanogaster
ttctgctgttgatg

SEQ ID NO: 667526 - DNA, 13 bp, D. melanogaster
ttctgcttaattt

SEQ ID NO: 667527 - DNA, 13 bp, D. melanogaster
ttctgcttctgct

SEQ ID NO: 667528 - DNA, 13 bp, D. melanogaster
ttctgcttttgcc

SEQ ID NO: 667529 - DNA, 13 bp, D. melanogaster
ttctggagaactt

SEQ ID NO: 667530 - DNA, 13 bp, D. melanogaster
ttctggagcttgt

SEQ ID NO: 667531 - DNA, 13 bp, D. melanogaster
ttctggataacca

SEQ ID NO: 667532 - DNA, 13 bp, D. melanogaster
ttctggatgtaaa

SEQ ID NO: 667533 - DNA, 13 bp, D. melanogaster
ttctggattatga

SEQ ID NO: 667534 - DNA, 13 bp, D. melanogaster
ttctggattccat

SEQ ID NO: 667535 - DNA, 13 bp, D. melanogaster
ttctggattctgg

SEQ ID NO: 667536 - DNA, 14 bp, D. melanogaster
ttctggcactgtgc

SEQ ID NO: 667537 - DNA, 13 bp, D. melanogaster
ttctggcattcgc

SEQ ID NO: 667538 - DNA, 14 bp, D. melanogaster
ttctggccaaaagc

SEQ ID NO: 667539 - DNA, 13 bp, D. melanogaster
ttctggccaaatt

SEQ ID NO: 667540 - DNA, 13 bp, D. melanogaster
ttctggccaactg

SEQ ID NO: 667541 - DNA, 13 bp, D. melanogaster
ttctggccaactt

SEQ ID NO: 667542 - DNA, 13 bp, D. melanogaster
ttctggccaagtg

SEQ ID NO: 667543 - DNA, 13 bp, D. melanogaster
ttctggccaagtt

SEQ ID NO: 667544 - DNA, 13 bp, D. melanogaster
ttctggccatgtt

SEQ ID NO: 667545 - DNA, 13 bp, D. melanogaster
ttctggccgagat

SEQ ID NO: 667546 - DNA, 13 bp, D. melanogaster
ttctggccgaggt

SEQ ID NO: 667547 - DNA, 13 bp, D. melanogaster
ttctggcctggcc

SEQ ID NO: 667548 - DNA, 13 bp, D. melanogaster
ttctggctgcttt

SEQ ID NO: 667549 - DNA, 13 bp, D. melanogaster
ttctggctgggat

SEQ ID NO: 667550 - DNA, 13 bp, D. melanogaster
ttctggcttttaa

SEQ ID NO: 667551 - DNA, 13 bp, D. melanogaster
ttctggcttttcc

SEQ ID NO: 667552 - DNA, 13 bp, D. melanogaster
ttctggcttttga

SEQ ID NO: 667553 - DNA, 13 bp, D. melanogaster
ttctgggaacacc

SEQ ID NO: 667554 - DNA, 13 bp, D. melanogaster
ttctgggaattca

SEQ ID NO: 667555 - DNA, 14 bp, D. melanogaster
ttctgggatatcga

SEQ ID NO: 667556 - DNA, 13 bp, D. melanogaster
ttctggggcaata

SEQ ID NO: 667557 - DNA, 13 bp, D. melanogaster
ttctggttaattt

SEQ ID NO: 667558 - DNA, 14 bp, D. melanogaster
ttctggttaatttt

SEQ ID NO: 667559 - DNA, 14 bp, D. melanogaster
ttctggttataatt

SEQ ID NO: 667560 - DNA, 13 bp, D. melanogaster
ttctggttatcta

SEQ ID NO: 667561 - DNA, 13 bp, D. melanogaster
ttctggtttctgg

SEQ ID NO: 667562 - DNA, 14 bp, D. melanogaster
ttctggtttttcat

SEQ ID NO: 667563 - DNA, 13 bp, D. melanogaster
ttctgtaaaccca

SEQ ID NO: 667564 - DNA, 13 bp, D. melanogaster
ttctgtaattagt

SEQ ID NO: 667565 - DNA, 13 bp, D. melanogaster
ttctgtaattatt

SEQ ID NO: 667566 - DNA, 13 bp, D. melanogaster
ttctgtataattt

SEQ ID NO: 667567 - DNA, 13 bp, D. melanogaster
ttctgtcatagag

SEQ ID NO: 667568 - DNA, 13 bp, D. melanogaster
ttctgtgaaatat

SEQ ID NO: 667569 - DNA, 14 bp, D. melanogaster
ttctgtgtgctctg

SEQ ID NO: 667570 - DNA, 13 bp, D. melanogaster
ttctgtgtgtgcg

SEQ ID NO: 667571 - DNA, 13 bp, D. melanogaster
ttctgttaaaatt

SEQ ID NO: 667572 - DNA, 13 bp, D. melanogaster
ttctgttaaattt

SEQ ID NO: 667573 - DNA, 13 bp, D. melanogaster
ttctgttacattt

SEQ ID NO: 667574 - DNA, 13 bp, D. melanogaster
ttctgttccgttc

SEQ ID NO: 667575 - DNA, 13 bp, D. melanogaster
ttctgttcggttc

SEQ ID NO: 667576 - DNA, 13 bp, D. melanogaster
ttctgttgccttg

SEQ ID NO: 667577 - DNA, 13 bp, D. melanogaster
ttctgttggccta

SEQ ID NO: 667578 - DNA, 13 bp, D. melanogaster
ttctgttgtactc

SEQ ID NO: 667579 - DNA, 13 bp, D. melanogaster
ttctgttgtagtt

SEQ ID NO: 667580 - DNA, 13 bp, D. melanogaster
ttctgtttactta

SEQ ID NO: 667581 - DNA, 13 bp, D. melanogaster
ttctgtttcagtt

SEQ ID NO: 667582 - DNA, 13 bp, D. melanogaster
ttctgtttccatt

SEQ ID NO: 667583 - DNA, 13 bp, D. melanogaster
ttctgtttgcatt

SEQ ID NO: 667584 - DNA, 14 bp, D. melanogaster
ttctgtttgcattt

SEQ ID NO: 667585 - DNA, 13 bp, D. melanogaster
ttctgtttgccat

SEQ ID NO: 667586 - DNA, 13 bp, D. melanogaster
ttctgtttgcctg

SEQ ID NO: 667587 - DNA, 13 bp, D. melanogaster
ttctgttttaaat

SEQ ID NO: 667588 - DNA, 13 bp, D. melanogaster
ttctgttttcagc

SEQ ID NO: 667589 - DNA, 14 bp, D. melanogaster
ttctgttttggcca

SEQ ID NO: 667590 - DNA, 13 bp, D. melanogaster
ttcttaaaaacaa

SEQ ID NO: 667591 - DNA, 13 bp, D. melanogaster
ttcttaaaaattc

SEQ ID NO: 667592 - DNA, 13 bp, D. melanogaster
ttcttaaaatgaa

SEQ ID NO: 667593 - DNA, 13 bp, D. melanogaster
ttcttaaagaaaa

SEQ ID NO: 667594 - DNA, 13 bp, D. melanogaster
ttcttaaatactt

SEQ ID NO: 667595 - DNA, 13 bp, D. melanogaster
ttcttaaatgaaa

SEQ ID NO: 667596 - DNA, 13 bp, D. melanogaster
ttcttaaatggca

SEQ ID NO: 667597 - DNA, 14 bp, D. melanogaster
ttcttaaattatac

SEQ ID NO: 667598 - DNA, 13 bp, D. melanogaster
ttcttaaattgtt

SEQ ID NO: 667599 - DNA, 13 bp, D. melanogaster
ttcttaacaaaat

SEQ ID NO: 667600 - DNA, 13 bp, D. melanogaster
ttcttaacacaaa

SEQ ID NO: 667601 - DNA, 13 bp, D. melanogaster
ttcttaacacttt

SEQ ID NO: 667602 - DNA, 13 bp, D. melanogaster
ttcttaaccaaaa

SEQ ID NO: 667603 - DNA, 13 bp, D. melanogaster
ttcttaactcatt

SEQ ID NO: 667604 - DNA, 13 bp, D. melanogaster
ttcttaagtgaaa

SEQ ID NO: 667605 - DNA, 13 bp, D. melanogaster
ttcttaatcttaa

SEQ ID NO: 667606 - DNA, 13 bp, D. melanogaster
ttcttaatgaaat

SEQ ID NO: 667607 - DNA, 13 bp, D. melanogaster
ttcttaatgcctc

SEQ ID NO: 667608 - DNA, 14 bp, D. melanogaster
ttcttaatgcctca

SEQ ID NO: 667609 - DNA, 13 bp, D. melanogaster
ttcttaattgaat

SEQ ID NO: 667610 - DNA, 13 bp, D. melanogaster
ttcttaattgtaa

SEQ ID NO: 667611 - DNA, 13 bp, D. melanogaster
ttcttaatttgaa

SEQ ID NO: 667612 - DNA, 14 bp, D. melanogaster
ttcttacatctata

SEQ ID NO: 667613 - DNA, 13 bp, D. melanogaster
ttcttacattact

SEQ ID NO: 667614 - DNA, 13 bp, D. melanogaster
ttcttactaaaaa

SEQ ID NO: 667615 - DNA, 13 bp, D. melanogaster
ttcttactacaat

SEQ ID NO: 667616 - DNA, 14 bp, D. melanogaster
ttcttactacaata

SEQ ID NO: 667617 - DNA, 14 bp, D. melanogaster
ttcttactgttttg

SEQ ID NO: 667618 - DNA, 13 bp, D. melanogaster
ttcttagaaattt

SEQ ID NO: 667619 - DNA, 13 bp, D. melanogaster
ttcttagagtgtc

SEQ ID NO: 667620 - DNA, 13 bp, D. melanogaster
ttcttagatattt

SEQ ID NO: 667621 - DNA, 13 bp, D. melanogaster
ttcttagtaaaac

SEQ ID NO: 667622 - DNA, 13 bp, D. melanogaster
ttcttatacaatt

SEQ ID NO: 667623 - DNA, 13 bp, D. melanogaster
ttcttatacccgt

SEQ ID NO: 667624 - DNA, 13 bp, D. melanogaster
ttcttatcagcag

SEQ ID NO: 667625 - DNA, 13 bp, D. melanogaster
ttcttatgtatgc

SEQ ID NO: 667626 - DNA, 13 bp, D. melanogaster
ttcttatttggga

SEQ ID NO: 667627 - DNA, 13 bp, D. melanogaster
ttcttcaaaaagt

SEQ ID NO: 667628 - DNA, 13 bp, D. melanogaster
ttcttcaaaattt

SEQ ID NO: 667629 - DNA, 13 bp, D. melanogaster
ttcttcaaagaaa

SEQ ID NO: 667630 - DNA, 13 bp, D. melanogaster
ttcttcaaatgaa

SEQ ID NO: 667631 - DNA, 13 bp, D. melanogaster
ttcttcaacctga

SEQ ID NO: 667632 - DNA, 14 bp, D. melanogaster
ttcttcaagtaatt

SEQ ID NO: 667633 - DNA, 13 bp, D. melanogaster
ttcttcaagtgca

SEQ ID NO: 667634 - DNA, 13 bp, D. melanogaster
ttcttcaagttcc

SEQ ID NO: 667635 - DNA, 13 bp, D. melanogaster
ttcttcacaaata

SEQ ID NO: 667636 - DNA, 13 bp, D. melanogaster
ttcttcacacctc

SEQ ID NO: 667637 - DNA, 13 bp, D. melanogaster
ttcttcacatctg

SEQ ID NO: 667638 - DNA, 13 bp, D. melanogaster
ttcttcaccgtct

SEQ ID NO: 667639 - DNA, 13 bp, D. melanogaster
ttcttcagactct

SEQ ID NO: 667640 - DNA, 13 bp, D. melanogaster
ttcttcagcatta

SEQ ID NO: 667641 - DNA, 13 bp, D. melanogaster
ttcttcagctttt

SEQ ID NO: 667642 - DNA, 13 bp, D. melanogaster
ttcttcagtgagt

SEQ ID NO: 667643 - DNA, 13 bp, D. melanogaster
ttcttcataattg

SEQ ID NO: 667644 - DNA, 14 bp, D. melanogaster
ttcttcatcatcag

SEQ ID NO: 667645 - DNA, 13 bp, D. melanogaster
ttcttcattaagc

SEQ ID NO: 667646 - DNA, 14 bp, D. melanogaster
ttcttcattgatta

SEQ ID NO: 667647 - DNA, 13 bp, D. melanogaster
ttcttcattttcg

SEQ ID NO: 667648 - DNA, 13 bp, D. melanogaster
ttcttccaggaaa

SEQ ID NO: 667649 - DNA, 13 bp, D. melanogaster
ttcttccatagga

SEQ ID NO: 667650 - DNA, 13 bp, D. melanogaster
ttcttcccaagaa

SEQ ID NO: 667651 - DNA, 13 bp, D. melanogaster
ttcttcctgtgca

SEQ ID NO: 667652 - DNA, 13 bp, D. melanogaster
ttcttcgaaattt

SEQ ID NO: 667653 - DNA, 13 bp, D. melanogaster
ttcttcgaatttt

SEQ ID NO: 667654 - DNA, 13 bp, D. melanogaster
ttcttcgagtgca

SEQ ID NO: 667655 - DNA, 13 bp, D. melanogaster
ttcttcgcatttt

SEQ ID NO: 667656 - DNA, 13 bp, D. melanogaster
ttcttctacagac

SEQ ID NO: 667657 - DNA, 13 bp, D. melanogaster
ttcttctaccaac

SEQ ID NO: 667658 - DNA, 13 bp, D. melanogaster
ttcttctacctgt

SEQ ID NO: 667659 - DNA, 13 bp, D. melanogaster
ttcttctcaactg

SEQ ID NO: 667660 - DNA, 13 bp, D. melanogaster
ttcttctgcattt

SEQ ID NO: 667661 - DNA, 13 bp, D. melanogaster
ttcttctgccagc

SEQ ID NO: 667662 - DNA, 14 bp, D. melanogaster
ttcttctgccagcc

SEQ ID NO: 667663 - DNA, 13 bp, D. melanogaster
ttcttctgctgct

SEQ ID NO: 667664 - DNA, 13 bp, D. melanogaster
ttcttctggaccc

SEQ ID NO: 667665 - DNA, 13 bp, D. melanogaster
ttcttcttcaagc

SEQ ID NO: 667666 - DNA, 13 bp, D. melanogaster
ttcttcttgcaat

SEQ ID NO: 667667 - DNA, 14 bp, D. melanogaster
ttcttcttgcaata

SEQ ID NO: 667668 - DNA, 13 bp, D. melanogaster
ttcttcttggcca

SEQ ID NO: 667669 - DNA, 13 bp, D. melanogaster
ttcttctttaagt

SEQ ID NO: 667670 - DNA, 14 bp, D. melanogaster
ttcttctttaagtt

SEQ ID NO: 667671 - DNA, 13 bp, D. melanogaster
ttcttgaaatttt

SEQ ID NO: 667672 - DNA, 13 bp, D. melanogaster
ttcttgaagcaca

SEQ ID NO: 667673 - DNA, 13 bp, D. melanogaster
ttcttgaagcgta

SEQ ID NO: 667674 - DNA, 13 bp, D. melanogaster
ttcttgaataaat

SEQ ID NO: 667675 - DNA, 13 bp, D. melanogaster
ttcttgacaaccc

SEQ ID NO: 667676 - DNA, 13 bp, D. melanogaster
ttcttgagaattt

SEQ ID NO: 667677 - DNA, 13 bp, D. melanogaster
ttcttgaggatct

SEQ ID NO: 667678 - DNA, 13 bp, D. melanogaster
ttcttgataaaat

SEQ ID NO: 667679 - DNA, 14 bp, D. melanogaster
ttcttgataaaatc

SEQ ID NO: 667680 - DNA, 13 bp, D. melanogaster
ttcttgatgaatg

SEQ ID NO: 667681 - DNA, 14 bp, D. melanogaster
ttcttgatttgttg

SEQ ID NO: 667682 - DNA, 13 bp, D. melanogaster
ttcttgcagctcc

SEQ ID NO: 667683 - DNA, 14 bp, D. melanogaster
ttcttgcagctcct

SEQ ID NO: 667684 - DNA, 13 bp, D. melanogaster
ttcttgcagtgta

SEQ ID NO: 667685 - DNA, 13 bp, D. melanogaster
ttcttgcagtgtg

SEQ ID NO: 667686 - DNA, 13 bp, D. melanogaster
ttcttgcatttaa

SEQ ID NO: 667687 - DNA, 13 bp, D. melanogaster
ttcttgccaaatt

SEQ ID NO: 667688 - DNA, 14 bp, D. melanogaster
ttcttgccatcttt

SEQ ID NO: 667689 - DNA, 13 bp, D. melanogaster
ttcttgccatttt

SEQ ID NO: 667690 - DNA, 13 bp, D. melanogaster
ttcttgctgtgca

SEQ ID NO: 667691 - DNA, 13 bp, D. melanogaster
ttcttggaatttg

SEQ ID NO: 667692 - DNA, 13 bp, D. melanogaster
ttcttggcaaact

SEQ ID NO: 667693 - DNA, 13 bp, D. melanogaster
ttcttggccaaaa

SEQ ID NO: 667694 - DNA, 13 bp, D. melanogaster
ttcttggccaaat

SEQ ID NO: 667695 - DNA, 13 bp, D. melanogaster
ttcttggccaact

SEQ ID NO: 667696 - DNA, 13 bp, D. melanogaster
ttcttggccaagt

SEQ ID NO: 667697 - DNA, 13 bp, D. melanogaster
ttcttggccagca

SEQ ID NO: 667698 - DNA, 13 bp, D. melanogaster
ttcttggccagct

SEQ ID NO: 667699 - DNA, 13 bp, D. melanogaster
ttcttggccaggc

SEQ ID NO: 667700 - DNA, 13 bp, D. melanogaster
ttcttggccagtt

SEQ ID NO: 667701 - DNA, 13 bp, D. melanogaster
ttcttgggaagaa

SEQ ID NO: 667702 - DNA, 14 bp, D. melanogaster
ttcttgggaagaag

SEQ ID NO: 667703 - DNA, 13 bp, D. melanogaster
ttcttgggcattt

SEQ ID NO: 667704 - DNA, 13 bp, D. melanogaster
ttcttggtcacat

SEQ ID NO: 667705 - DNA, 13 bp, D. melanogaster
ttcttgtaaattt

SEQ ID NO: 667706 - DNA, 13 bp, D. melanogaster
ttcttgtattgca

SEQ ID NO: 667707 - DNA, 13 bp, D. melanogaster
ttcttgttaaaat

SEQ ID NO: 667708 - DNA, 13 bp, D. melanogaster
ttcttgttgaaaa

SEQ ID NO: 667709 - DNA, 13 bp, D. melanogaster
ttctttaaaaagt

SEQ ID NO: 667710 - DNA, 13 bp, D. melanogaster
ttctttaaaacaa

SEQ ID NO: 667711 - DNA, 13 bp, D. melanogaster
ttctttaaaatgt

SEQ ID NO: 667712 - DNA, 13 bp, D. melanogaster
ttctttaaatgaa

SEQ ID NO: 667713 - DNA, 13 bp, D. melanogaster
ttctttaaattga

SEQ ID NO: 667714 - DNA, 13 bp, D. melanogaster
ttctttaacataa

SEQ ID NO: 667715 - DNA, 13 bp, D. melanogaster
ttctttaagaact

SEQ ID NO: 667716 - DNA, 14 bp, D. melanogaster
ttctttaagaactt

SEQ ID NO: 667717 - DNA, 13 bp, D. melanogaster
ttctttaagattt

SEQ ID NO: 667718 - DNA, 13 bp, D. melanogaster
ttctttaagcaag

SEQ ID NO: 667719 - DNA, 14 bp, D. melanogaster
ttctttaattgaga

SEQ ID NO: 667720 - DNA, 13 bp, D. melanogaster
ttctttaattgta

SEQ ID NO: 667721 - DNA, 13 bp, D. melanogaster
ttctttagtgcct

SEQ ID NO: 667722 - DNA, 13 bp, D. melanogaster
ttctttattgaat

SEQ ID NO: 667723 - DNA, 13 bp, D. melanogaster
ttctttcactgca

SEQ ID NO: 667724 - DNA, 13 bp, D. melanogaster
ttctttcagtgca

SEQ ID NO: 667725 - DNA, 14 bp, D. melanogaster
ttctttcagtgcaa

SEQ ID NO: 667726 - DNA, 13 bp, D. melanogaster
ttctttcagtgta

SEQ ID NO: 667727 - DNA, 14 bp, D. melanogaster
ttctttcagtgtac

SEQ ID NO: 667728 - DNA, 14 bp, D. melanogaster
ttctttcataaaga

SEQ ID NO: 667729 - DNA, 13 bp, D. melanogaster
ttctttccgtgta

SEQ ID NO: 667730 - DNA, 13 bp, D. melanogaster
ttctttcgattta

SEQ ID NO: 667731 - DNA, 13 bp, D. melanogaster
ttctttgaaaaat

SEQ ID NO: 667732 - DNA, 13 bp, D. melanogaster
ttctttgaaaata

SEQ ID NO: 667733 - DNA, 13 bp, D. melanogaster
ttctttgaaataa

SEQ ID NO: 667734 - DNA, 13 bp, D. melanogaster
ttctttgaagttt

SEQ ID NO: 667735 - DNA, 14 bp, D. melanogaster
ttctttgaatctcc

SEQ ID NO: 667736 - DNA, 13 bp, D. melanogaster
ttctttgacattt

SEQ ID NO: 667737 - DNA, 14 bp, D. melanogaster
ttctttgacgcttt

SEQ ID NO: 667738 - DNA, 13 bp, D. melanogaster
ttctttgattcct

SEQ ID NO: 667739 - DNA, 13 bp, D. melanogaster
ttctttgatttca

SEQ ID NO: 667740 - DNA, 13 bp, D. melanogaster
ttctttgatttcc

SEQ ID NO: 667741 - DNA, 13 bp, D. melanogaster
ttctttgcattta

SEQ ID NO: 667742 - DNA, 13 bp, D. melanogaster
ttctttgccagtt

SEQ ID NO: 667743 - DNA, 13 bp, D. melanogaster
ttctttgctcatt

SEQ ID NO: 667744 - DNA, 13 bp, D. melanogaster
ttctttgctggcc

SEQ ID NO: 667745 - DNA, 13 bp, D. melanogaster
ttctttggaaatt

SEQ ID NO: 667746 - DNA, 13 bp, D. melanogaster
ttctttggaacca

SEQ ID NO: 667747 - DNA, 13 bp, D. melanogaster
ttctttggaagat

SEQ ID NO: 667748 - DNA, 14 bp, D. melanogaster
ttctttggaatgaa

SEQ ID NO: 667749 - DNA, 13 bp, D. melanogaster
ttctttggcttta

SEQ ID NO: 667750 - DNA, 14 bp, D. melanogaster
ttctttgtgtcatt

SEQ ID NO: 667751 - DNA, 13 bp, D. melanogaster
ttctttgtttaaa

SEQ ID NO: 667752 - DNA, 13 bp, D. melanogaster
ttcttttaaaagt

SEQ ID NO: 667753 - DNA, 13 bp, D. melanogaster
ttcttttacagtt

SEQ ID NO: 667754 - DNA, 13 bp, D. melanogaster
ttcttttcaaaaa

SEQ ID NO: 667755 - DNA, 13 bp, D. melanogaster
ttcttttcaaata

SEQ ID NO: 667756 - DNA, 13 bp, D. melanogaster
ttcttttcaagtt

SEQ ID NO: 667757 - DNA, 13 bp, D. melanogaster
ttcttttctaaaa

SEQ ID NO: 667758 - DNA, 13 bp, D. melanogaster
ttcttttgaaatt

SEQ ID NO: 667759 - DNA, 13 bp, D. melanogaster
ttcttttgaatat

SEQ ID NO: 667760 - DNA, 13 bp, D. melanogaster
ttcttttgcaatt

SEQ ID NO: 667761 - DNA, 13 bp, D. melanogaster
ttcttttgcactt

SEQ ID NO: 667762 - DNA, 13 bp, D. melanogaster
ttcttttgctgcc

SEQ ID NO: 667763 - DNA, 13 bp, D. melanogaster
ttcttttggagaa

SEQ ID NO: 667764 - DNA, 13 bp, D. melanogaster
ttcttttggccaa

SEQ ID NO: 667765 - DNA, 13 bp, D. melanogaster
ttcttttggctgc

SEQ ID NO: 667766 - DNA, 13 bp, D. melanogaster
ttcttttgggcca

SEQ ID NO: 667767 - DNA, 13 bp, D. melanogaster
ttctttttaaacc

SEQ ID NO: 667768 - DNA, 13 bp, D. melanogaster
ttctttttccaca

SEQ ID NO: 667769 - DNA, 13 bp, D. melanogaster
ttctttttcgcca

SEQ ID NO: 667770 - DNA, 13 bp, D. melanogaster
ttctttttcggcc

SEQ ID NO: 667771 - DNA, 13 bp, D. melanogaster
ttctttttgcaaa

SEQ ID NO: 667772 - DNA, 13 bp, D. melanogaster
ttctttttgccaa

SEQ ID NO: 667773 - DNA, 13 bp, D. melanogaster
ttctttttggcca

SEQ ID NO: 667774 - DNA, 13 bp, D. melanogaster
ttctttttgtaaa

SEQ ID NO: 667775 - DNA, 14 bp, D. melanogaster
ttcttttttaaatg

SEQ ID NO: 667776 - DNA, 13 bp, D. melanogaster
ttcttttttaagc

SEQ ID NO: 667777 - DNA, 13 bp, D. melanogaster
ttcttttttcgca

SEQ ID NO: 667778 - DNA, 13 bp, D. melanogaster
ttcttttttggaa

SEQ ID NO: 667779 - DNA, 13 bp, D. melanogaster
ttcttttttggca

SEQ ID NO: 667780 - DNA, 13 bp, D. melanogaster
ttgaaaaaaatac

SEQ ID NO: 667781 - DNA, 13 bp, D. melanogaster
ttgaaaaaacttg

SEQ ID NO: 667782 - DNA, 14 bp, D. melanogaster
ttgaaaaaacttgg

SEQ ID NO: 667783 - DNA, 13 bp, D. melanogaster
ttgaaaaaacttt

SEQ ID NO: 667784 - DNA, 13 bp, D. melanogaster
ttgaaaaaagttc

SEQ ID NO: 667785 - DNA, 13 bp, D. melanogaster
ttgaaaaaatcga

SEQ ID NO: 667786 - DNA, 14 bp, D. melanogaster
ttgaaaaaatcgat

SEQ ID NO: 667787 - DNA, 13 bp, D. melanogaster
ttgaaaaaatgtt

SEQ ID NO: 667788 - DNA, 13 bp, D. melanogaster
ttgaaaaaatttc

SEQ ID NO: 667789 - DNA, 14 bp, D. melanogaster
ttgaaaaacaaaat

SEQ ID NO: 667790 - DNA, 13 bp, D. melanogaster
ttgaaaaacactt

SEQ ID NO: 667791 - DNA, 13 bp, D. melanogaster
ttgaaaaacataa

SEQ ID NO: 667792 - DNA, 13 bp, D. melanogaster
ttgaaaaacattc

SEQ ID NO: 667793 - DNA, 13 bp, D. melanogaster
ttgaaaaacattt

SEQ ID NO: 667794 - DNA, 13 bp, D. melanogaster
ttgaaaaaccttt

SEQ ID NO: 667795 - DNA, 13 bp, D. melanogaster
ttgaaaaacgttt

SEQ ID NO: 667796 - DNA, 14 bp, D. melanogaster
ttgaaaaactgcag

SEQ ID NO: 667797 - DNA, 13 bp, D. melanogaster
ttgaaaaactttc

SEQ ID NO: 667798 - DNA, 13 bp, D. melanogaster
ttgaaaaactttt

SEQ ID NO: 667799 - DNA, 13 bp, D. melanogaster
ttgaaaaagaaca

SEQ ID NO: 667800 - DNA, 13 bp, D. melanogaster
ttgaaaaagaatt

SEQ ID NO: 667801 - DNA, 14 bp, D. melanogaster
ttgaaaaagatgtt

SEQ ID NO: 667802 - DNA, 13 bp, D. melanogaster
ttgaaaaagtatt

SEQ ID NO: 667803 - DNA, 13 bp, D. melanogaster
ttgaaaaagtgca

SEQ ID NO: 667804 - DNA, 13 bp, D. melanogaster
ttgaaaaagttgc

SEQ ID NO: 667805 - DNA, 13 bp, D. melanogaster
ttgaaaaagttgt

SEQ ID NO: 667806 - DNA, 13 bp, D. melanogaster
ttgaaaaagtttc

SEQ ID NO: 667807 - DNA, 13 bp, D. melanogaster
ttgaaaaatatga

SEQ ID NO: 667808 - DNA, 13 bp, D. melanogaster
ttgaaaaatatgg

SEQ ID NO: 667809 - DNA, 14 bp, D. melanogaster
ttgaaaaatatgta

SEQ ID NO: 667810 - DNA, 13 bp, D. melanogaster
ttgaaaaatccat

SEQ ID NO: 667811 - DNA, 13 bp, D. melanogaster
ttgaaaaatgatt

SEQ ID NO: 667812 - DNA, 13 bp, D. melanogaster
ttgaaaaatgtat

SEQ ID NO: 667813 - DNA, 14 bp, D. melanogaster
ttgaaaaatgtatt

SEQ ID NO: 667814 - DNA, 13 bp, D. melanogaster
ttgaaaaattcgt

SEQ ID NO: 667815 - DNA, 13 bp, D. melanogaster
ttgaaaaattctt

SEQ ID NO: 667816 - DNA, 13 bp, D. melanogaster
ttgaaaaattgca

SEQ ID NO: 667817 - DNA, 13 bp, D. melanogaster
ttgaaaaattggc

SEQ ID NO: 667818 - DNA, 13 bp, D. melanogaster
ttgaaaaatttac

SEQ ID NO: 667819 - DNA, 13 bp, D. melanogaster
ttgaaaaatttct

SEQ ID NO: 667820 - DNA, 13 bp, D. melanogaster
ttgaaaaatttgt

SEQ ID NO: 667821 - DNA, 13 bp, D. melanogaster
ttgaaaacaaaat

SEQ ID NO: 667822 - DNA, 13 bp, D. melanogaster
ttgaaaacaaagc

SEQ ID NO: 667823 - DNA, 13 bp, D. melanogaster
ttgaaaacaaagt

SEQ ID NO: 667824 - DNA, 13 bp, D. melanogaster
ttgaaaacaaata

SEQ ID NO: 667825 - DNA, 13 bp, D. melanogaster
ttgaaaacaagtt

SEQ ID NO: 667826 - DNA, 13 bp, D. melanogaster
ttgaaaacaattg

SEQ ID NO: 667827 - DNA, 13 bp, D. melanogaster
ttgaaaacaattt

SEQ ID NO: 667828 - DNA, 14 bp, D. melanogaster
ttgaaaacaatttt

SEQ ID NO: 667829 - DNA, 13 bp, D. melanogaster
ttgaaaacacaat

SEQ ID NO: 667830 - DNA, 13 bp, D. melanogaster
ttgaaaacacaca

SEQ ID NO: 667831 - DNA, 13 bp, D. melanogaster
ttgaaaacaggca

SEQ ID NO: 667832 - DNA, 14 bp, D. melanogaster
ttgaaaacaggcag

SEQ ID NO: 667833 - DNA, 13 bp, D. melanogaster
ttgaaaacagttt

SEQ ID NO: 667834 - DNA, 13 bp, D. melanogaster
ttgaaaacattta

SEQ ID NO: 667835 - DNA, 13 bp, D. melanogaster
ttgaaaacatttg

SEQ ID NO: 667836 - DNA, 13 bp, D. melanogaster
ttgaaaacatttt

SEQ ID NO: 667837 - DNA, 14 bp, D. melanogaster
ttgaaaacatttta

SEQ ID NO: 667838 - DNA, 13 bp, D. melanogaster
ttgaaaaccaaac

SEQ ID NO: 667839 - DNA, 13 bp, D. melanogaster
ttgaaaaccaaat

SEQ ID NO: 667840 - DNA, 13 bp, D. melanogaster
ttgaaaaccaatt

SEQ ID NO: 667841 - DNA, 13 bp, D. melanogaster
ttgaaaaccgaaa

SEQ ID NO: 667842 - DNA, 13 bp, D. melanogaster
ttgaaaacctttt

SEQ ID NO: 667843 - DNA, 13 bp, D. melanogaster
ttgaaaacgaaaa

SEQ ID NO: 667844 - DNA, 14 bp, D. melanogaster
ttgaaaacgaaaat

SEQ ID NO: 667845 - DNA, 13 bp, D. melanogaster
ttgaaaacgaatt

SEQ ID NO: 667846 - DNA, 13 bp, D. melanogaster
ttgaaaacgattt

SEQ ID NO: 667847 - DNA, 13 bp, D. melanogaster
ttgaaaacgttga

SEQ ID NO: 667848 - DNA, 13 bp, D. melanogaster
ttgaaaacgtttt

SEQ ID NO: 667849 - DNA, 13 bp, D. melanogaster
ttgaaaactaaat

SEQ ID NO: 667850 - DNA, 13 bp, D. melanogaster
ttgaaaactaagc

SEQ ID NO: 667851 - DNA, 13 bp, D. melanogaster
ttgaaaactattt

SEQ ID NO: 667852 - DNA, 14 bp, D. melanogaster
ttgaaaactatttt

SEQ ID NO: 667853 - DNA, 13 bp, D. melanogaster
ttgaaaactcaaa

SEQ ID NO: 667854 - DNA, 13 bp, D. melanogaster
ttgaaaactgaaa

SEQ ID NO: 667855 - DNA, 13 bp, D. melanogaster
ttgaaaactgcat

SEQ ID NO: 667856 - DNA, 13 bp, D. melanogaster
ttgaaaacttatt

SEQ ID NO: 667857 - DNA, 13 bp, D. melanogaster
ttgaaaacttcaa

SEQ ID NO: 667858 - DNA, 13 bp, D. melanogaster
ttgaaaactttaa

SEQ ID NO: 667859 - DNA, 13 bp, D. melanogaster
ttgaaaactttca

SEQ ID NO: 667860 - DNA, 13 bp, D. melanogaster
ttgaaaactttct

SEQ ID NO: 667861 - DNA, 13 bp, D. melanogaster
ttgaaaagaaaac

SEQ ID NO: 667862 - DNA, 13 bp, D. melanogaster
ttgaaaagaaatt

SEQ ID NO: 667863 - DNA, 14 bp, D. melanogaster
ttgaaaagaaattt

SEQ ID NO: 667864 - DNA, 13 bp, D. melanogaster
ttgaaaagaattt

SEQ ID NO: 667865 - DNA, 13 bp, D. melanogaster
ttgaaaagaggaa

SEQ ID NO: 667866 - DNA, 13 bp, D. melanogaster
ttgaaaagatttc

SEQ ID NO: 667867 - DNA, 13 bp, D. melanogaster
ttgaaaagcaaaa

SEQ ID NO: 667868 - DNA, 13 bp, D. melanogaster
ttgaaaagcataa

SEQ ID NO: 667869 - DNA, 13 bp, D. melanogaster
ttgaaaagccaaa

SEQ ID NO: 667870 - DNA, 14 bp, D. melanogaster
ttgaaaagccaaaa

SEQ ID NO: 667871 - DNA, 13 bp, D. melanogaster
ttgaaaagccaat

SEQ ID NO: 667872 - DNA, 13 bp, D. melanogaster
ttgaaaagccatt

SEQ ID NO: 667873 - DNA, 13 bp, D. melanogaster
ttgaaaagccgca

SEQ ID NO: 667874 - DNA, 13 bp, D. melanogaster
ttgaaaagcgtca

SEQ ID NO: 667875 - DNA, 13 bp, D. melanogaster
ttgaaaagcgttt

SEQ ID NO: 667876 - DNA, 13 bp, D. melanogaster
ttgaaaagctaaa

SEQ ID NO: 667877 - DNA, 13 bp, D. melanogaster
ttgaaaagctatt

SEQ ID NO: 667878 - DNA, 13 bp, D. melanogaster
ttgaaaaggaatt

SEQ ID NO: 667879 - DNA, 13 bp, D. melanogaster
ttgaaaaggacag

SEQ ID NO: 667880 - DNA, 13 bp, D. melanogaster
ttgaaaaggcaaa

SEQ ID NO: 667881 - DNA, 13 bp, D. melanogaster
ttgaaaagtaaat

SEQ ID NO: 667882 - DNA, 13 bp, D. melanogaster
ttgaaaagtataa

SEQ ID NO: 667883 - DNA, 13 bp, D. melanogaster
ttgaaaagtatgt

SEQ ID NO: 667884 - DNA, 13 bp, D. melanogaster
ttgaaaagtattc

SEQ ID NO: 667885 - DNA, 13 bp, D. melanogaster
ttgaaaagtattt

SEQ ID NO: 667886 - DNA, 14 bp, D. melanogaster
ttgaaaagtgaaaa

SEQ ID NO: 667887 - DNA, 13 bp, D. melanogaster
ttgaaaagtgcaa

SEQ ID NO: 667888 - DNA, 13 bp, D. melanogaster
ttgaaaagttgaa

SEQ ID NO: 667889 - DNA, 13 bp, D. melanogaster
ttgaaaagttttt

SEQ ID NO: 667890 - DNA, 13 bp, D. melanogaster
ttgaaaataaatc

SEQ ID NO: 667891 - DNA, 13 bp, D. melanogaster
ttgaaaataactt

SEQ ID NO: 667892 - DNA, 13 bp, D. melanogaster
ttgaaaataagtt

SEQ ID NO: 667893 - DNA, 13 bp, D. melanogaster
ttgaaaatacata

SEQ ID NO: 667894 - DNA, 13 bp, D. melanogaster
ttgaaaatacttt

SEQ ID NO: 667895 - DNA, 13 bp, D. melanogaster
ttgaaaatagttg

SEQ ID NO: 667896 - DNA, 13 bp, D. melanogaster
ttgaaaatagttt

SEQ ID NO: 667897 - DNA, 13 bp, D. melanogaster
ttgaaaatatgtt

SEQ ID NO: 667898 - DNA, 13 bp, D. melanogaster
ttgaaaatattct

SEQ ID NO: 667899 - DNA, 14 bp, D. melanogaster
ttgaaaatattgtt

SEQ ID NO: 667900 - DNA, 13 bp, D. melanogaster
ttgaaaatatttg

SEQ ID NO: 667901 - DNA, 14 bp, D. melanogaster
ttgaaaatcaaaaa

SEQ ID NO: 667902 - DNA, 13 bp, D. melanogaster
ttgaaaatcaaag

SEQ ID NO: 667903 - DNA, 13 bp, D. melanogaster
ttgaaaatcaaat

SEQ ID NO: 667904 - DNA, 14 bp, D. melanogaster
ttgaaaatcaaatt

SEQ ID NO: 667905 - DNA, 13 bp, D. melanogaster
ttgaaaatcaaga

SEQ ID NO: 667906 - DNA, 14 bp, D. melanogaster
ttgaaaatcaataa

SEQ ID NO: 667907 - DNA, 13 bp, D. melanogaster
ttgaaaatcaatt

SEQ ID NO: 667908 - DNA, 14 bp, D. melanogaster
ttgaaaatcaatta

SEQ ID NO: 667909 - DNA, 13 bp, D. melanogaster
ttgaaaatcactt

SEQ ID NO: 667910 - DNA, 13 bp, D. melanogaster
ttgaaaatccatt

SEQ ID NO: 667911 - DNA, 13 bp, D. melanogaster
ttgaaaatccttt

SEQ ID NO: 667912 - DNA, 13 bp, D. melanogaster
ttgaaaatcgaaa

SEQ ID NO: 667913 - DNA, 13 bp, D. melanogaster
ttgaaaatcgaat

SEQ ID NO: 667914 - DNA, 13 bp, D. melanogaster
ttgaaaatcgata

SEQ ID NO: 667915 - DNA, 13 bp, D. melanogaster
ttgaaaatctaaa

SEQ ID NO: 667916 - DNA, 13 bp, D. melanogaster
ttgaaaatcttct

SEQ ID NO: 667917 - DNA, 14 bp, D. melanogaster
ttgaaaatgaaaag

SEQ ID NO: 667918 - DNA, 14 bp, D. melanogaster
ttgaaaatgaaatt

SEQ ID NO: 667919 - DNA, 13 bp, D. melanogaster
ttgaaaatgacgt

SEQ ID NO: 667920 - DNA, 13 bp, D. melanogaster
ttgaaaatgattt

SEQ ID NO: 667921 - DNA, 14 bp, D. melanogaster
ttgaaaatgattta

SEQ ID NO: 667922 - DNA, 14 bp, D. melanogaster
ttgaaaatgatttt

SEQ ID NO: 667923 - DNA, 13 bp, D. melanogaster
ttgaaaatgcagc

SEQ ID NO: 667924 - DNA, 13 bp, D. melanogaster
ttgaaaatgccag

SEQ ID NO: 667925 - DNA, 13 bp, D. melanogaster
ttgaaaatgctgc

SEQ ID NO: 667926 - DNA, 13 bp, D. melanogaster
ttgaaaatgcttt

SEQ ID NO: 667927 - DNA, 13 bp, D. melanogaster
ttgaaaatgtaaa

SEQ ID NO: 667928 - DNA, 13 bp, D. melanogaster
ttgaaaatgtatt

SEQ ID NO: 667929 - DNA, 13 bp, D. melanogaster
ttgaaaatgtcaa

SEQ ID NO: 667930 - DNA, 13 bp, D. melanogaster
ttgaaaatgtgta

SEQ ID NO: 667931 - DNA, 13 bp, D. melanogaster
ttgaaaatgtttt

SEQ ID NO: 667932 - DNA, 13 bp, D. melanogaster
ttgaaaattcaat

SEQ ID NO: 667933 - DNA, 13 bp, D. melanogaster
ttgaaaattcgaa

SEQ ID NO: 667934 - DNA, 14 bp, D. melanogaster
ttgaaaattcgaaa

SEQ ID NO: 667935 - DNA, 13 bp, D. melanogaster
ttgaaaattgaat

SEQ ID NO: 667936 - DNA, 13 bp, D. melanogaster
ttgaaaattgatc

SEQ ID NO: 667937 - DNA, 14 bp, D. melanogaster
ttgaaaattgatca

SEQ ID NO: 667938 - DNA, 13 bp, D. melanogaster
ttgaaaattgatt

SEQ ID NO: 667939 - DNA, 13 bp, D. melanogaster
ttgaaaattgcaa

SEQ ID NO: 667940 - DNA, 13 bp, D. melanogaster
ttgaaaattgttt

SEQ ID NO: 667941 - DNA, 14 bp, D. melanogaster
ttgaaaattgttta

SEQ ID NO: 667942 - DNA, 13 bp, D. melanogaster
ttgaaaatttcat

SEQ ID NO: 667943 - DNA, 13 bp, D. melanogaster
ttgaaaatttcga

SEQ ID NO: 667944 - DNA, 13 bp, D. melanogaster
ttgaaaatttgtt

SEQ ID NO: 667945 - DNA, 13 bp, D. melanogaster
ttgaaaattttcg

SEQ ID NO: 667946 - DNA, 13 bp, D. melanogaster
ttgaaaattttga

SEQ ID NO: 667947 - DNA, 13 bp, D. melanogaster
ttgaaaatttttc

SEQ ID NO: 667948 - DNA, 13 bp, D. melanogaster
ttgaaacaaaaac

SEQ ID NO: 667949 - DNA, 13 bp, D. melanogaster
ttgaaacaaaaga

SEQ ID NO: 667950 - DNA, 13 bp, D. melanogaster
ttgaaacaaacaa

SEQ ID NO: 667951 - DNA, 13 bp, D. melanogaster
ttgaaacaaatta

SEQ ID NO: 667952 - DNA, 13 bp, D. melanogaster
ttgaaacaaattt

SEQ ID NO: 667953 - DNA, 13 bp, D. melanogaster
ttgaaacaatttg

SEQ ID NO: 667954 - DNA, 13 bp, D. melanogaster
ttgaaacacattt

SEQ ID NO: 667955 - DNA, 13 bp, D. melanogaster
ttgaaacactttt

SEQ ID NO: 667956 - DNA, 13 bp, D. melanogaster
ttgaaacagattt

SEQ ID NO: 667957 - DNA, 13 bp, D. melanogaster
ttgaaacagttgc

SEQ ID NO: 667958 - DNA, 13 bp, D. melanogaster
ttgaaacataaat

SEQ ID NO: 667959 - DNA, 13 bp, D. melanogaster
ttgaaacatttac

SEQ ID NO: 667960 - DNA, 13 bp, D. melanogaster
ttgaaacattttg

SEQ ID NO: 667961 - DNA, 13 bp, D. melanogaster
ttgaaacattttt

SEQ ID NO: 667962 - DNA, 14 bp, D. melanogaster
ttgaaacatttttc

SEQ ID NO: 667963 - DNA, 13 bp, D. melanogaster
ttgaaaccaataa

SEQ ID NO: 667964 - DNA, 13 bp, D. melanogaster
ttgaaaccctttt

SEQ ID NO: 667965 - DNA, 13 bp, D. melanogaster
ttgaaaccgaaaa

SEQ ID NO: 667966 - DNA, 13 bp, D. melanogaster
ttgaaaccgaaac

SEQ ID NO: 667967 - DNA, 13 bp, D. melanogaster
ttgaaaccgaaat

SEQ ID NO: 667968 - DNA, 13 bp, D. melanogaster
ttgaaacgaaaaa

SEQ ID NO: 667969 - DNA, 13 bp, D. melanogaster
ttgaaacgaattt

SEQ ID NO: 667970 - DNA, 13 bp, D. melanogaster
ttgaaactaaatt

SEQ ID NO: 667971 - DNA, 13 bp, D. melanogaster
ttgaaactaattt

SEQ ID NO: 667972 - DNA, 13 bp, D. melanogaster
ttgaaactatttg

SEQ ID NO: 667973 - DNA, 13 bp, D. melanogaster
ttgaaactgaaac

SEQ ID NO: 667974 - DNA, 13 bp, D. melanogaster
ttgaaacttaaca

SEQ ID NO: 667975 - DNA, 13 bp, D. melanogaster
ttgaaacttgaaa

SEQ ID NO: 667976 - DNA, 13 bp, D. melanogaster
ttgaaactttaaa

SEQ ID NO: 667977 - DNA, 13 bp, D. melanogaster
ttgaaactttatt

SEQ ID NO: 667978 - DNA, 13 bp, D. melanogaster
ttgaaagaaaatt

SEQ ID NO: 667979 - DNA, 13 bp, D. melanogaster
ttgaaagaaacac

SEQ ID NO: 667980 - DNA, 13 bp, D. melanogaster
ttgaaagaaatat

SEQ ID NO: 667981 - DNA, 13 bp, D. melanogaster
ttgaaagaaatgt

SEQ ID NO: 667982 - DNA, 13 bp, D. melanogaster
ttgaaagaaattt

SEQ ID NO: 667983 - DNA, 13 bp, D. melanogaster
ttgaaagaattga

SEQ ID NO: 667984 - DNA, 14 bp, D. melanogaster
ttgaaagaattgat

SEQ ID NO: 667985 - DNA, 13 bp, D. melanogaster
ttgaaagataaga

SEQ ID NO: 667986 - DNA, 13 bp, D. melanogaster
ttgaaagatttta

SEQ ID NO: 667987 - DNA, 13 bp, D. melanogaster
ttgaaagcaattt

SEQ ID NO: 667988 - DNA, 13 bp, D. melanogaster
ttgaaagccaaat

SEQ ID NO: 667989 - DNA, 13 bp, D. melanogaster
ttgaaagctaaaa

SEQ ID NO: 667990 - DNA, 13 bp, D. melanogaster
ttgaaagctaatt

SEQ ID NO: 667991 - DNA, 13 bp, D. melanogaster
ttgaaagctggaa

SEQ ID NO: 667992 - DNA, 13 bp, D. melanogaster
ttgaaaggaaaat

SEQ ID NO: 667993 - DNA, 13 bp, D. melanogaster
ttgaaaggcaaaa

SEQ ID NO: 667994 - DNA, 13 bp, D. melanogaster
ttgaaaggcattt

SEQ ID NO: 667995 - DNA, 13 bp, D. melanogaster
ttgaaaggtagaa

SEQ ID NO: 667996 - DNA, 13 bp, D. melanogaster
ttgaaagtaaaag

SEQ ID NO: 667997 - DNA, 13 bp, D. melanogaster
ttgaaagtgaaaa

SEQ ID NO: 667998 - DNA, 13 bp, D. melanogaster
ttgaaagtgaaag

SEQ ID NO: 667999 - DNA, 13 bp, D. melanogaster
ttgaaagtgattt

SEQ ID NO: 668000 - DNA, 13 bp, D. melanogaster
ttgaaagtgcgtg

SEQ ID NO: 668001 - DNA, 13 bp, D. melanogaster
ttgaaagtggcaa

SEQ ID NO: 668002 - DNA, 13 bp, D. melanogaster
ttgaaagttattt

SEQ ID NO: 668003 - DNA, 13 bp, D. melanogaster
ttgaaagttcttt

SEQ ID NO: 668004 - DNA, 14 bp, D. melanogaster
ttgaaagttgctgg

SEQ ID NO: 668005 - DNA, 13 bp, D. melanogaster
ttgaaagtttgtc

SEQ ID NO: 668006 - DNA, 13 bp, D. melanogaster
ttgaaataaaaac

SEQ ID NO: 668007 - DNA, 13 bp, D. melanogaster
ttgaaataaaaca

SEQ ID NO: 668008 - DNA, 13 bp, D. melanogaster
ttgaaataaaatg

SEQ ID NO: 668009 - DNA, 13 bp, D. melanogaster
ttgaaataaatag

SEQ ID NO: 668010 - DNA, 13 bp, D. melanogaster
ttgaaataaatgg

SEQ ID NO: 668011 - DNA, 13 bp, D. melanogaster
ttgaaataaattc

SEQ ID NO: 668012 - DNA, 13 bp, D. melanogaster
ttgaaataatcaa

SEQ ID NO: 668013 - DNA, 13 bp, D. melanogaster
ttgaaatacaaat

SEQ ID NO: 668014 - DNA, 13 bp, D. melanogaster
ttgaaatacaata

SEQ ID NO: 668015 - DNA, 13 bp, D. melanogaster
ttgaaatacatat

SEQ ID NO: 668016 - DNA, 13 bp, D. melanogaster
ttgaaatacattt

SEQ ID NO: 668017 - DNA, 13 bp, D. melanogaster
ttgaaatacttta

SEQ ID NO: 668018 - DNA, 13 bp, D. melanogaster
ttgaaatactttc

SEQ ID NO: 668019 - DNA, 13 bp, D. melanogaster
ttgaaatactttt

SEQ ID NO: 668020 - DNA, 13 bp, D. melanogaster
ttgaaatatacaa

SEQ ID NO: 668021 - DNA, 13 bp, D. melanogaster
ttgaaatatatct

SEQ ID NO: 668022 - DNA, 14 bp, D. melanogaster
ttgaaatatatgta

SEQ ID NO: 668023 - DNA, 13 bp, D. melanogaster
ttgaaatatattc

SEQ ID NO: 668024 - DNA, 13 bp, D. melanogaster
ttgaaatatcaat

SEQ ID NO: 668025 - DNA, 13 bp, D. melanogaster
ttgaaatatcttt

SEQ ID NO: 668026 - DNA, 13 bp, D. melanogaster
ttgaaatatgctt

SEQ ID NO: 668027 - DNA, 13 bp, D. melanogaster
ttgaaatatgttt

SEQ ID NO: 668028 - DNA, 14 bp, D. melanogaster
ttgaaatatttatg

SEQ ID NO: 668029 - DNA, 13 bp, D. melanogaster
ttgaaatatttca

SEQ ID NO: 668030 - DNA, 14 bp, D. melanogaster
ttgaaatatttgaa

SEQ ID NO: 668031 - DNA, 13 bp, D. melanogaster
ttgaaatattttc

SEQ ID NO: 668032 - DNA, 14 bp, D. melanogaster
ttgaaatattttct

SEQ ID NO: 668033 - DNA, 13 bp, D. melanogaster
ttgaaatcaaaac

SEQ ID NO: 668034 - DNA, 13 bp, D. melanogaster
ttgaaatcaacgt

SEQ ID NO: 668035 - DNA, 13 bp, D. melanogaster
ttgaaatcaataa

SEQ ID NO: 668036 - DNA, 13 bp, D. melanogaster
ttgaaatcacttt

SEQ ID NO: 668037 - DNA, 13 bp, D. melanogaster
ttgaaatcatatt

SEQ ID NO: 668038 - DNA, 13 bp, D. melanogaster
ttgaaatcattca

SEQ ID NO: 668039 - DNA, 13 bp, D. melanogaster
ttgaaatcattta

SEQ ID NO: 668040 - DNA, 13 bp, D. melanogaster
ttgaaatccaaat

SEQ ID NO: 668041 - DNA, 13 bp, D. melanogaster
ttgaaatccaatt

SEQ ID NO: 668042 - DNA, 14 bp, D. melanogaster
ttgaaatcgaaaaa

SEQ ID NO: 668043 - DNA, 13 bp, D. melanogaster
ttgaaatcgacta

SEQ ID NO: 668044 - DNA, 13 bp, D. melanogaster
ttgaaatcgtttt

SEQ ID NO: 668045 - DNA, 13 bp, D. melanogaster
ttgaaatctattt

SEQ ID NO: 668046 - DNA, 13 bp, D. melanogaster
ttgaaatcttttt

SEQ ID NO: 668047 - DNA, 13 bp, D. melanogaster
ttgaaatgaaaac

SEQ ID NO: 668048 - DNA, 13 bp, D. melanogaster
ttgaaatgaaaat

SEQ ID NO: 668049 - DNA, 14 bp, D. melanogaster
ttgaaatgaaattg

SEQ ID NO: 668050 - DNA, 14 bp, D. melanogaster
ttgaaatgaaattt

SEQ ID NO: 668051 - DNA, 13 bp, D. melanogaster
ttgaaatgaatgt

SEQ ID NO: 668052 - DNA, 13 bp, D. melanogaster
ttgaaatgcaaat

SEQ ID NO: 668053 - DNA, 13 bp, D. melanogaster
ttgaaatgcactt

SEQ ID NO: 668054 - DNA, 13 bp, D. melanogaster
ttgaaatgcagaa

SEQ ID NO: 668055 - DNA, 13 bp, D. melanogaster
ttgaaatgcgatc

SEQ ID NO: 668056 - DNA, 13 bp, D. melanogaster
ttgaaatgcgttt

SEQ ID NO: 668057 - DNA, 13 bp, D. melanogaster
ttgaaatgctttt

SEQ ID NO: 668058 - DNA, 13 bp, D. melanogaster
ttgaaatggaaat

SEQ ID NO: 668059 - DNA, 14 bp, D. melanogaster
ttgaaatggaaatg

SEQ ID NO: 668060 - DNA, 13 bp, D. melanogaster
ttgaaatggaatt

SEQ ID NO: 668061 - DNA, 13 bp, D. melanogaster
ttgaaatggcatt

SEQ ID NO: 668062 - DNA, 13 bp, D. melanogaster
ttgaaatggcttt

SEQ ID NO: 668063 - DNA, 13 bp, D. melanogaster
ttgaaatggtttc

SEQ ID NO: 668064 - DNA, 13 bp, D. melanogaster
ttgaaatggtttt

SEQ ID NO: 668065 - DNA, 13 bp, D. melanogaster
ttgaaatgtattc

SEQ ID NO: 668066 - DNA, 13 bp, D. melanogaster
ttgaaatgtattt

SEQ ID NO: 668067 - DNA, 13 bp, D. melanogaster
ttgaaatgtcaac

SEQ ID NO: 668068 - DNA, 13 bp, D. melanogaster
ttgaaatgtgaaa

SEQ ID NO: 668069 - DNA, 13 bp, D. melanogaster
ttgaaatgtgcaa

SEQ ID NO: 668070 - DNA, 13 bp, D. melanogaster
ttgaaatgtgtaa

SEQ ID NO: 668071 - DNA, 13 bp, D. melanogaster
ttgaaatgtgtgt

SEQ ID NO: 668072 - DNA, 13 bp, D. melanogaster
ttgaaatgttgaa

SEQ ID NO: 668073 - DNA, 13 bp, D. melanogaster
ttgaaatgtttca

SEQ ID NO: 668074 - DNA, 13 bp, D. melanogaster
ttgaaattaaaca

SEQ ID NO: 668075 - DNA, 13 bp, D. melanogaster
ttgaaattaaagt

SEQ ID NO: 668076 - DNA, 13 bp, D. melanogaster
ttgaaattaacaa

SEQ ID NO: 668077 - DNA, 13 bp, D. melanogaster
ttgaaattaagga

SEQ ID NO: 668078 - DNA, 13 bp, D. melanogaster
ttgaaattaagtt

SEQ ID NO: 668079 - DNA, 14 bp, D. melanogaster
ttgaaattaatgaa

SEQ ID NO: 668080 - DNA, 14 bp, D. melanogaster
ttgaaattaggtga

SEQ ID NO: 668081 - DNA, 14 bp, D. melanogaster
ttgaaattattcaa

SEQ ID NO: 668082 - DNA, 13 bp, D. melanogaster
ttgaaattattct

SEQ ID NO: 668083 - DNA, 13 bp, D. melanogaster
ttgaaattatttc

SEQ ID NO: 668084 - DNA, 14 bp, D. melanogaster
ttgaaattcaaaaa

SEQ ID NO: 668085 - DNA, 13 bp, D. melanogaster
ttgaaattcaaat

SEQ ID NO: 668086 - DNA, 13 bp, D. melanogaster
ttgaaattcaaca

SEQ ID NO: 668087 - DNA, 14 bp, D. melanogaster
ttgaaattcaattt

SEQ ID NO: 668088 - DNA, 13 bp, D. melanogaster
ttgaaattcagtt

SEQ ID NO: 668089 - DNA, 13 bp, D. melanogaster
ttgaaattcattt

SEQ ID NO: 668090 - DNA, 13 bp, D. melanogaster
ttgaaattccaat

SEQ ID NO: 668091 - DNA, 13 bp, D. melanogaster
ttgaaattccttg

SEQ ID NO: 668092 - DNA, 13 bp, D. melanogaster
ttgaaattcgaaa

SEQ ID NO: 668093 - DNA, 13 bp, D. melanogaster
ttgaaattcgttt

SEQ ID NO: 668094 - DNA, 13 bp, D. melanogaster
ttgaaattctaaa

SEQ ID NO: 668095 - DNA, 13 bp, D. melanogaster
ttgaaattctaat

SEQ ID NO: 668096 - DNA, 13 bp, D. melanogaster
ttgaaattctatt

SEQ ID NO: 668097 - DNA, 13 bp, D. melanogaster
ttgaaattcttaa

SEQ ID NO: 668098 - DNA, 13 bp, D. melanogaster
ttgaaattcttct

SEQ ID NO: 668099 - DNA, 13 bp, D. melanogaster
ttgaaattcttta

SEQ ID NO: 668100 - DNA, 13 bp, D. melanogaster
ttgaaattctttt

SEQ ID NO: 668101 - DNA, 14 bp, D. melanogaster
ttgaaattgaaaat

SEQ ID NO: 668102 - DNA, 13 bp, D. melanogaster
ttgaaattgaaac

SEQ ID NO: 668103 - DNA, 13 bp, D. melanogaster
ttgaaattgaaag

SEQ ID NO: 668104 - DNA, 13 bp, D. melanogaster
ttgaaattgaaat

SEQ ID NO: 668105 - DNA, 14 bp, D. melanogaster
ttgaaattgaaata

SEQ ID NO: 668106 - DNA, 13 bp, D. melanogaster
ttgaaattgaaga

SEQ ID NO: 668107 - DNA, 13 bp, D. melanogaster
ttgaaattgaata

SEQ ID NO: 668108 - DNA, 13 bp, D. melanogaster
ttgaaattgaatg

SEQ ID NO: 668109 - DNA, 13 bp, D. melanogaster
ttgaaattgaatt

SEQ ID NO: 668110 - DNA, 14 bp, D. melanogaster
ttgaaattgaatta

SEQ ID NO: 668111 - DNA, 14 bp, D. melanogaster
ttgaaattgaattg

SEQ ID NO: 668112 - DNA, 14 bp, D. melanogaster
ttgaaattgaattt

SEQ ID NO: 668113 - DNA, 13 bp, D. melanogaster
ttgaaattgataa

SEQ ID NO: 668114 - DNA, 13 bp, D. melanogaster
ttgaaattgatat

SEQ ID NO: 668115 - DNA, 13 bp, D. melanogaster
ttgaaattgattt

SEQ ID NO: 668116 - DNA, 14 bp, D. melanogaster
ttgaaattgatttc

SEQ ID NO: 668117 - DNA, 13 bp, D. melanogaster
ttgaaattgcaaa

SEQ ID NO: 668118 - DNA, 13 bp, D. melanogaster
ttgaaattgcagc

SEQ ID NO: 668119 - DNA, 13 bp, D. melanogaster
ttgaaattgcttt

SEQ ID NO: 668120 - DNA, 14 bp, D. melanogaster
ttgaaattggaaaa

SEQ ID NO: 668121 - DNA, 13 bp, D. melanogaster
ttgaaattggcaa

SEQ ID NO: 668122 - DNA, 13 bp, D. melanogaster
ttgaaattggcca

SEQ ID NO: 668123 - DNA, 13 bp, D. melanogaster
ttgaaattggttt

SEQ ID NO: 668124 - DNA, 13 bp, D. melanogaster
ttgaaattgtcgt

SEQ ID NO: 668125 - DNA, 13 bp, D. melanogaster
ttgaaattgttga

SEQ ID NO: 668126 - DNA, 13 bp, D. melanogaster
ttgaaattgttgg

SEQ ID NO: 668127 - DNA, 13 bp, D. melanogaster
ttgaaattgttgt

SEQ ID NO: 668128 - DNA, 14 bp, D. melanogaster
ttgaaattgttttg

SEQ ID NO: 668129 - DNA, 13 bp, D. melanogaster
ttgaaatttattg

SEQ ID NO: 668130 - DNA, 13 bp, D. melanogaster
ttgaaatttccaa

SEQ ID NO: 668131 - DNA, 13 bp, D. melanogaster
ttgaaatttcttt

SEQ ID NO: 668132 - DNA, 13 bp, D. melanogaster
ttgaaatttgcat

SEQ ID NO: 668133 - DNA, 13 bp, D. melanogaster
ttgaaatttgttg

SEQ ID NO: 668134 - DNA, 13 bp, D. melanogaster
ttgaaattttatg

SEQ ID NO: 668135 - DNA, 13 bp, D. melanogaster
ttgaaattttctt

SEQ ID NO: 668136 - DNA, 13 bp, D. melanogaster
ttgaaattttgat

SEQ ID NO: 668137 - DNA, 13 bp, D. melanogaster
ttgaaatttttag

SEQ ID NO: 668138 - DNA, 13 bp, D. melanogaster
ttgaaatttttcc

SEQ ID NO: 668139 - DNA, 13 bp, D. melanogaster
ttgaacaaaaatt

SEQ ID NO: 668140 - DNA, 13 bp, D. melanogaster
ttgaacaaaacaa

SEQ ID NO: 668141 - DNA, 13 bp, D. melanogaster
ttgaacaaacaaa

SEQ ID NO: 668142 - DNA, 13 bp, D. melanogaster
ttgaacaaattaa

SEQ ID NO: 668143 - DNA, 13 bp, D. melanogaster
ttgaacaaattgt

SEQ ID NO: 668144 - DNA, 13 bp, D. melanogaster
ttgaacaacaata

SEQ ID NO: 668145 - DNA, 13 bp, D. melanogaster
ttgaacaacattt

SEQ ID NO: 668146 - DNA, 13 bp, D. melanogaster
ttgaacaactttt

SEQ ID NO: 668147 - DNA, 13 bp, D. melanogaster
ttgaacaagtttt

SEQ ID NO: 668148 - DNA, 13 bp, D. melanogaster
ttgaacaataaat

SEQ ID NO: 668149 - DNA, 13 bp, D. melanogaster
ttgaacaatattt

SEQ ID NO: 668150 - DNA, 14 bp, D. melanogaster
ttgaacaatatttg

SEQ ID NO: 668151 - DNA, 13 bp, D. melanogaster
ttgaacaatttaa

SEQ ID NO: 668152 - DNA, 14 bp, D. melanogaster
ttgaacaattttaa

SEQ ID NO: 668153 - DNA, 13 bp, D. melanogaster
ttgaacaattttc

SEQ ID NO: 668154 - DNA, 13 bp, D. melanogaster
ttgaacaattttt

SEQ ID NO: 668155 - DNA, 14 bp, D. melanogaster
ttgaacaatttttt

SEQ ID NO: 668156 - DNA, 13 bp, D. melanogaster
ttgaacacgtttc

SEQ ID NO: 668157 - DNA, 13 bp, D. melanogaster
ttgaacacttttt

SEQ ID NO: 668158 - DNA, 13 bp, D. melanogaster
ttgaacaggcgta

SEQ ID NO: 668159 - DNA, 13 bp, D. melanogaster
ttgaacaggtgaa

SEQ ID NO: 668160 - DNA, 13 bp, D. melanogaster
ttgaacatatttt

SEQ ID NO: 668161 - DNA, 14 bp, D. melanogaster
ttgaacatattttt

SEQ ID NO: 668162 - DNA, 13 bp, D. melanogaster
ttgaacatcgaga

SEQ ID NO: 668163 - DNA, 13 bp, D. melanogaster
ttgaacattttaa

SEQ ID NO: 668164 - DNA, 13 bp, D. melanogaster
ttgaacattttca

SEQ ID NO: 668165 - DNA, 13 bp, D. melanogaster
ttgaaccaagcta

SEQ ID NO: 668166 - DNA, 13 bp, D. melanogaster
ttgaaccttatca

SEQ ID NO: 668167 - DNA, 13 bp, D. melanogaster
ttgaacgaatttt

SEQ ID NO: 668168 - DNA, 13 bp, D. melanogaster
ttgaacgcatttt

SEQ ID NO: 668169 - DNA, 13 bp, D. melanogaster
ttgaacggagaaa

SEQ ID NO: 668170 - DNA, 13 bp, D. melanogaster
ttgaactacattt

SEQ ID NO: 668171 - DNA, 13 bp, D. melanogaster
ttgaactattttt

SEQ ID NO: 668172 - DNA, 13 bp, D. melanogaster
ttgaactcgtaat

SEQ ID NO: 668173 - DNA, 13 bp, D. melanogaster
ttgaactgaactg

SEQ ID NO: 668174 - DNA, 13 bp, D. melanogaster
ttgaacttaaatt

SEQ ID NO: 668175 - DNA, 13 bp, D. melanogaster
ttgaacttcaaga

SEQ ID NO: 668176 - DNA, 13 bp, D. melanogaster
ttgaacttcaatt

SEQ ID NO: 668177 - DNA, 13 bp, D. melanogaster
ttgaacttgaaac

SEQ ID NO: 668178 - DNA, 13 bp, D. melanogaster
ttgaacttgaact

SEQ ID NO: 668179 - DNA, 13 bp, D. melanogaster
ttgaacttgaatt

SEQ ID NO: 668180 - DNA, 13 bp, D. melanogaster
ttgaacttggcca

SEQ ID NO: 668181 - DNA, 14 bp, D. melanogaster
ttgaacttggccaa

SEQ ID NO: 668182 - DNA, 13 bp, D. melanogaster
ttgaacttgtttg

SEQ ID NO: 668183 - DNA, 13 bp, D. melanogaster
ttgaactttaact

SEQ ID NO: 668184 - DNA, 13 bp, D. melanogaster
ttgaactttgaat

SEQ ID NO: 668185 - DNA, 13 bp, D. melanogaster
ttgaactttgaca

SEQ ID NO: 668186 - DNA, 13 bp, D. melanogaster
ttgaactttgacc

SEQ ID NO: 668187 - DNA, 13 bp, D. melanogaster
ttgaacttttgaa

SEQ ID NO: 668188 - DNA, 13 bp, D. melanogaster
ttgaacttttgcc

SEQ ID NO: 668189 - DNA, 13 bp, D. melanogaster
ttgaactttttcg

SEQ ID NO: 668190 - DNA, 13 bp, D. melanogaster
ttgaacttttttc

SEQ ID NO: 668191 - DNA, 13 bp, D. melanogaster
ttgaagaaaaaca

SEQ ID NO: 668192 - DNA, 13 bp, D. melanogaster
ttgaagaaaatca

SEQ ID NO: 668193 - DNA, 13 bp, D. melanogaster
ttgaagaaattaa

SEQ ID NO: 668194 - DNA, 13 bp, D. melanogaster
ttgaagaactttt

SEQ ID NO: 668195 - DNA, 13 bp, D. melanogaster
ttgaagaagaact

SEQ ID NO: 668196 - DNA, 13 bp, D. melanogaster
ttgaagaagaaga

SEQ ID NO: 668197 - DNA, 13 bp, D. melanogaster
ttgaagattattt

SEQ ID NO: 668198 - DNA, 13 bp, D. melanogaster
ttgaagcattgga

SEQ ID NO: 668199 - DNA, 13 bp, D. melanogaster
ttgaagctcattt

SEQ ID NO: 668200 - DNA, 13 bp, D. melanogaster
ttgaaggatttag

SEQ ID NO: 668201 - DNA, 13 bp, D. melanogaster
ttgaagtaaacaa

SEQ ID NO: 668202 - DNA, 13 bp, D. melanogaster
ttgaagtacattt

SEQ ID NO: 668203 - DNA, 13 bp, D. melanogaster
ttgaagtatattt

SEQ ID NO: 668204 - DNA, 13 bp, D. melanogaster
ttgaagtgcaaat

SEQ ID NO: 668205 - DNA, 13 bp, D. melanogaster
ttgaagtgcaatt

SEQ ID NO: 668206 - DNA, 13 bp, D. melanogaster
ttgaagtggaaaa

SEQ ID NO: 668207 - DNA, 13 bp, D. melanogaster
ttgaagttaattt

SEQ ID NO: 668208 - DNA, 13 bp, D. melanogaster
ttgaagttattca

SEQ ID NO: 668209 - DNA, 13 bp, D. melanogaster
ttgaagttcaaaa

SEQ ID NO: 668210 - DNA, 13 bp, D. melanogaster
ttgaagttcaatt

SEQ ID NO: 668211 - DNA, 13 bp, D. melanogaster
ttgaagttgaaaa

SEQ ID NO: 668212 - DNA, 13 bp, D. melanogaster
ttgaagttgaatt

SEQ ID NO: 668213 - DNA, 13 bp, D. melanogaster
ttgaagttgagaa

SEQ ID NO: 668214 - DNA, 13 bp, D. melanogaster
ttgaagttgagtt

SEQ ID NO: 668215 - DNA, 13 bp, D. melanogaster
ttgaagttgcagt

SEQ ID NO: 668216 - DNA, 13 bp, D. melanogaster
ttgaagttggtca

SEQ ID NO: 668217 - DNA, 13 bp, D. melanogaster
ttgaagttttcct

SEQ ID NO: 668218 - DNA, 13 bp, D. melanogaster
ttgaagttttctt

SEQ ID NO: 668219 - DNA, 13 bp, D. melanogaster
ttgaagtttttca

SEQ ID NO: 668220 - DNA, 13 bp, D. melanogaster
ttgaataaaattc

SEQ ID NO: 668221 - DNA, 13 bp, D. melanogaster
ttgaataaacaat

SEQ ID NO: 668222 - DNA, 13 bp, D. melanogaster
ttgaataaactgt

SEQ ID NO: 668223 - DNA, 13 bp, D. melanogaster
ttgaataaacttt

SEQ ID NO: 668224 - DNA, 13 bp, D. melanogaster
ttgaataaatatg

SEQ ID NO: 668225 - DNA, 13 bp, D. melanogaster
ttgaataaatcaa

SEQ ID NO: 668226 - DNA, 13 bp, D. melanogaster
ttgaataacttta

SEQ ID NO: 668227 - DNA, 13 bp, D. melanogaster
ttgaataagtaaa

SEQ ID NO: 668228 - DNA, 13 bp, D. melanogaster
ttgaataatattc

SEQ ID NO: 668229 - DNA, 13 bp, D. melanogaster
ttgaataatgaaa

SEQ ID NO: 668230 - DNA, 13 bp, D. melanogaster
ttgaataattcat

SEQ ID NO: 668231 - DNA, 13 bp, D. melanogaster
ttgaataattgca

SEQ ID NO: 668232 - DNA, 13 bp, D. melanogaster
ttgaataattgta

SEQ ID NO: 668233 - DNA, 13 bp, D. melanogaster
ttgaatacaaaat

SEQ ID NO: 668234 - DNA, 13 bp, D. melanogaster
ttgaatacaataa

SEQ ID NO: 668235 - DNA, 13 bp, D. melanogaster
ttgaatacaattt

SEQ ID NO: 668236 - DNA, 13 bp, D. melanogaster
ttgaatacatttg

SEQ ID NO: 668237 - DNA, 13 bp, D. melanogaster
ttgaatacatttt

SEQ ID NO: 668238 - DNA, 14 bp, D. melanogaster
ttgaatacattttt

SEQ ID NO: 668239 - DNA, 13 bp, D. melanogaster
ttgaatactattt

SEQ ID NO: 668240 - DNA, 13 bp, D. melanogaster
ttgaatactttaa

SEQ ID NO: 668241 - DNA, 13 bp, D. melanogaster
ttgaatagcaatt

SEQ ID NO: 668242 - DNA, 13 bp, D. melanogaster
ttgaatagttatt

SEQ ID NO: 668243 - DNA, 13 bp, D. melanogaster
ttgaatataaatg

SEQ ID NO: 668244 - DNA, 14 bp, D. melanogaster
ttgaatatattatc

SEQ ID NO: 668245 - DNA, 13 bp, D. melanogaster
ttgaatatatttg

SEQ ID NO: 668246 - DNA, 13 bp, D. melanogaster
ttgaatatcaaat

SEQ ID NO: 668247 - DNA, 13 bp, D. melanogaster
ttgaatatcaaga

SEQ ID NO: 668248 - DNA, 13 bp, D. melanogaster
ttgaatatctcaa

SEQ ID NO: 668249 - DNA, 13 bp, D. melanogaster
ttgaatatgcaaa

SEQ ID NO: 668250 - DNA, 13 bp, D. melanogaster
ttgaatatggaat

SEQ ID NO: 668251 - DNA, 13 bp, D. melanogaster
ttgaatatgtaaa

SEQ ID NO: 668252 - DNA, 13 bp, D. melanogaster
ttgaatatgttct

SEQ ID NO: 668253 - DNA, 13 bp, D. melanogaster
ttgaatattatgt

SEQ ID NO: 668254 - DNA, 13 bp, D. melanogaster
ttgaatattgaaa

SEQ ID NO: 668255 - DNA, 13 bp, D. melanogaster
ttgaatattgcaa

SEQ ID NO: 668256 - DNA, 13 bp, D. melanogaster
ttgaatatttatc

SEQ ID NO: 668257 - DNA, 13 bp, D. melanogaster
ttgaatatttatg

SEQ ID NO: 668258 - DNA, 14 bp, D. melanogaster
ttgaatatttcaaa

SEQ ID NO: 668259 - DNA, 13 bp, D. melanogaster
ttgaatatttgaa

SEQ ID NO: 668260 - DNA, 14 bp, D. melanogaster
ttgaatatttgaaa

SEQ ID NO: 668261 - DNA, 13 bp, D. melanogaster
ttgaatattttcc

SEQ ID NO: 668262 - DNA, 13 bp, D. melanogaster
ttgaatattttct

SEQ ID NO: 668263 - DNA, 13 bp, D. melanogaster
ttgaatccaactt

SEQ ID NO: 668264 - DNA, 14 bp, D. melanogaster
ttgaatccaacttt

SEQ ID NO: 668265 - DNA, 13 bp, D. melanogaster
ttgaatccgaaac

SEQ ID NO: 668266 - DNA, 14 bp, D. melanogaster
ttgaatccgaaaca

SEQ ID NO: 668267 - DNA, 13 bp, D. melanogaster
ttgaatctttaaa

SEQ ID NO: 668268 - DNA, 13 bp, D. melanogaster
ttgaatctttcga

SEQ ID NO: 668269 - DNA, 14 bp, D. melanogaster
ttgaatctttcgaa

SEQ ID NO: 668270 - DNA, 13 bp, D. melanogaster
ttgaatgaaaaat

SEQ ID NO: 668271 - DNA, 13 bp, D. melanogaster
ttgaatgaaaaca

SEQ ID NO: 668272 - DNA, 13 bp, D. melanogaster
ttgaatgaaatgc

SEQ ID NO: 668273 - DNA, 13 bp, D. melanogaster
ttgaatgaaatta

SEQ ID NO: 668274 - DNA, 13 bp, D. melanogaster
ttgaatgaatatt

SEQ ID NO: 668275 - DNA, 13 bp, D. melanogaster
ttgaatgaattga

SEQ ID NO: 668276 - DNA, 13 bp, D. melanogaster
ttgaatgatttat

SEQ ID NO: 668277 - DNA, 13 bp, D. melanogaster
ttgaatgcaaatg

SEQ ID NO: 668278 - DNA, 13 bp, D. melanogaster
ttgaatgcaattt

SEQ ID NO: 668279 - DNA, 14 bp, D. melanogaster
ttgaatgcaatttg

SEQ ID NO: 668280 - DNA, 13 bp, D. melanogaster
ttgaatgccaaat

SEQ ID NO: 668281 - DNA, 13 bp, D. melanogaster
ttgaatgccaatc

SEQ ID NO: 668282 - DNA, 13 bp, D. melanogaster
ttgaatgcgaaaa

SEQ ID NO: 668283 - DNA, 13 bp, D. melanogaster
ttgaatgcgaaat

SEQ ID NO: 668284 - DNA, 13 bp, D. melanogaster
ttgaatgcttttc

SEQ ID NO: 668285 - DNA, 13 bp, D. melanogaster
ttgaatggaaaac

SEQ ID NO: 668286 - DNA, 13 bp, D. melanogaster
ttgaatggaaatt

SEQ ID NO: 668287 - DNA, 13 bp, D. melanogaster
ttgaatggaatgg

SEQ ID NO: 668288 - DNA, 13 bp, D. melanogaster
ttgaatggcaatt

SEQ ID NO: 668289 - DNA, 13 bp, D. melanogaster
ttgaatggcattt

SEQ ID NO: 668290 - DNA, 13 bp, D. melanogaster
ttgaatgtgaatt

SEQ ID NO: 668291 - DNA, 13 bp, D. melanogaster
ttgaattaaatgt

SEQ ID NO: 668292 - DNA, 13 bp, D. melanogaster
ttgaattaaattc

SEQ ID NO: 668293 - DNA, 13 bp, D. melanogaster
ttgaattaaattg

SEQ ID NO: 668294 - DNA, 13 bp, D. melanogaster
ttgaattacaaaa

SEQ ID NO: 668295 - DNA, 13 bp, D. melanogaster
ttgaattacaaat

SEQ ID NO: 668296 - DNA, 13 bp, D. melanogaster
ttgaattacattt

SEQ ID NO: 668297 - DNA, 13 bp, D. melanogaster
ttgaattactttt

SEQ ID NO: 668298 - DNA, 13 bp, D. melanogaster
ttgaattattgaa

SEQ ID NO: 668299 - DNA, 14 bp, D. melanogaster
ttgaattatttact

SEQ ID NO: 668300 - DNA, 13 bp, D. melanogaster
ttgaattattttc

SEQ ID NO: 668301 - DNA, 13 bp, D. melanogaster
ttgaattcaaatt

SEQ ID NO: 668302 - DNA, 13 bp, D. melanogaster
ttgaattcaatat

SEQ ID NO: 668303 - DNA, 13 bp, D. melanogaster
ttgaattcaattt

SEQ ID NO: 668304 - DNA, 14 bp, D. melanogaster
ttgaattcaattta

SEQ ID NO: 668305 - DNA, 13 bp, D. melanogaster
ttgaattcagttt

SEQ ID NO: 668306 - DNA, 13 bp, D. melanogaster
ttgaattcataaa

SEQ ID NO: 668307 - DNA, 13 bp, D. melanogaster
ttgaattcatcat

SEQ ID NO: 668308 - DNA, 13 bp, D. melanogaster
ttgaattccattt

SEQ ID NO: 668309 - DNA, 13 bp, D. melanogaster
ttgaattcgattt

SEQ ID NO: 668310 - DNA, 13 bp, D. melanogaster
ttgaattcgcagg

SEQ ID NO: 668311 - DNA, 13 bp, D. melanogaster
ttgaattcggttt

SEQ ID NO: 668312 - DNA, 13 bp, D. melanogaster
ttgaattcgtagc

SEQ ID NO: 668313 - DNA, 13 bp, D. melanogaster
ttgaattgaaatc

SEQ ID NO: 668314 - DNA, 13 bp, D. melanogaster
ttgaattgaactt

SEQ ID NO: 668315 - DNA, 13 bp, D. melanogaster
ttgaattgaatat

SEQ ID NO: 668316 - DNA, 13 bp, D. melanogaster
ttgaattgaatga

SEQ ID NO: 668317 - DNA, 13 bp, D. melanogaster
ttgaattgaatgc

SEQ ID NO: 668318 - DNA, 13 bp, D. melanogaster
ttgaattgaattc

SEQ ID NO: 668319 - DNA, 13 bp, D. melanogaster
ttgaattgaattg

SEQ ID NO: 668320 - DNA, 14 bp, D. melanogaster
ttgaattgaattga

SEQ ID NO: 668321 - DNA, 13 bp, D. melanogaster
ttgaattgaattt

SEQ ID NO: 668322 - DNA, 13 bp, D. melanogaster
ttgaattgatatt

SEQ ID NO: 668323 - DNA, 13 bp, D. melanogaster
ttgaattgcaaaa

SEQ ID NO: 668324 - DNA, 13 bp, D. melanogaster
ttgaattgcaggc

SEQ ID NO: 668325 - DNA, 13 bp, D. melanogaster
ttgaattgcatat

SEQ ID NO: 668326 - DNA, 13 bp, D. melanogaster
ttgaattgcattt

SEQ ID NO: 668327 - DNA, 13 bp, D. melanogaster
ttgaattgccaaa

SEQ ID NO: 668328 - DNA, 13 bp, D. melanogaster
ttgaattgctttc

SEQ ID NO: 668329 - DNA, 13 bp, D. melanogaster
ttgaattggaaaa

SEQ ID NO: 668330 - DNA, 13 bp, D. melanogaster
ttgaattggattg

SEQ ID NO: 668331 - DNA, 13 bp, D. melanogaster
ttgaattgggatt

SEQ ID NO: 668332 - DNA, 14 bp, D. melanogaster
ttgaattgtaaatt

SEQ ID NO: 668333 - DNA, 13 bp, D. melanogaster
ttgaattgtttag

SEQ ID NO: 668334 - DNA, 13 bp, D. melanogaster
ttgaattgtttga

SEQ ID NO: 668335 - DNA, 15 bp, D. melanogaster
ttgaattgtttgatt

SEQ ID NO: 668336 - DNA, 13 bp, D. melanogaster
ttgaatttaagtt

SEQ ID NO: 668337 - DNA, 13 bp, D. melanogaster
ttgaatttacata

SEQ ID NO: 668338 - DNA, 13 bp, D. melanogaster
ttgaatttatcta

SEQ ID NO: 668339 - DNA, 13 bp, D. melanogaster
ttgaatttatgaa

SEQ ID NO: 668340 - DNA, 13 bp, D. melanogaster
ttgaatttcaaat

SEQ ID NO: 668341 - DNA, 13 bp, D. melanogaster
ttgaatttcaaca

SEQ ID NO: 668342 - DNA, 13 bp, D. melanogaster
ttgaatttcaatt

SEQ ID NO: 668343 - DNA, 14 bp, D. melanogaster
ttgaatttcaattt

SEQ ID NO: 668344 - DNA, 13 bp, D. melanogaster
ttgaatttcacaa

SEQ ID NO: 668345 - DNA, 13 bp, D. melanogaster
ttgaatttcatca

SEQ ID NO: 668346 - DNA, 13 bp, D. melanogaster
ttgaatttcattg

SEQ ID NO: 668347 - DNA, 13 bp, D. melanogaster
ttgaatttccctt

SEQ ID NO: 668348 - DNA, 13 bp, D. melanogaster
ttgaatttccgaa

SEQ ID NO: 668349 - DNA, 13 bp, D. melanogaster
ttgaatttcgaaa

SEQ ID NO: 668350 - DNA, 13 bp, D. melanogaster
ttgaatttcgaat

SEQ ID NO: 668351 - DNA, 13 bp, D. melanogaster
ttgaatttcgagt

SEQ ID NO: 668352 - DNA, 13 bp, D. melanogaster
ttgaatttctgtt

SEQ ID NO: 668353 - DNA, 13 bp, D. melanogaster
ttgaatttgaaac

SEQ ID NO: 668354 - DNA, 13 bp, D. melanogaster
ttgaatttgaaat

SEQ ID NO: 668355 - DNA, 14 bp, D. melanogaster
ttgaatttgaaatt

SEQ ID NO: 668356 - DNA, 13 bp, D. melanogaster
ttgaatttgaagc

SEQ ID NO: 668357 - DNA, 13 bp, D. melanogaster
ttgaatttgaagt

SEQ ID NO: 668358 - DNA, 14 bp, D. melanogaster
ttgaatttgaatat

SEQ ID NO: 668359 - DNA, 13 bp, D. melanogaster
ttgaatttgaatt

SEQ ID NO: 668360 - DNA, 14 bp, D. melanogaster
ttgaatttgaatta

SEQ ID NO: 668361 - DNA, 13 bp, D. melanogaster
ttgaatttgattg

SEQ ID NO: 668362 - DNA, 13 bp, D. melanogaster
ttgaatttgcaca

SEQ ID NO: 668363 - DNA, 14 bp, D. melanogaster
ttgaatttgcattt

SEQ ID NO: 668364 - DNA, 13 bp, D. melanogaster
ttgaatttgcttt

SEQ ID NO: 668365 - DNA, 13 bp, D. melanogaster
ttgaatttggaat

SEQ ID NO: 668366 - DNA, 13 bp, D. melanogaster
ttgaatttggatt

SEQ ID NO: 668367 - DNA, 13 bp, D. melanogaster
ttgaattttaagt

SEQ ID NO: 668368 - DNA, 14 bp, D. melanogaster
ttgaattttatgaa

SEQ ID NO: 668369 - DNA, 13 bp, D. melanogaster
ttgaattttcaat

SEQ ID NO: 668370 - DNA, 13 bp, D. melanogaster
ttgaattttccgc

SEQ ID NO: 668371 - DNA, 13 bp, D. melanogaster
ttgaattttcgca

SEQ ID NO: 668372 - DNA, 13 bp, D. melanogaster
ttgaattttggca

SEQ ID NO: 668373 - DNA, 13 bp, D. melanogaster
ttgaatttttcac

SEQ ID NO: 668374 - DNA, 14 bp, D. melanogaster
ttgaatttttcatt

SEQ ID NO: 668375 - DNA, 13 bp, D. melanogaster
ttgaatttttgaa

SEQ ID NO: 668376 - DNA, 13 bp, D. melanogaster
ttgaatttttgca

SEQ ID NO: 668377 - DNA, 13 bp, D. melanogaster
ttgacaaaaaatt

SEQ ID NO: 668378 - DNA, 13 bp, D. melanogaster
ttgacaaaaagaa

SEQ ID NO: 668379 - DNA, 13 bp, D. melanogaster
ttgacaaaattcc

SEQ ID NO: 668380 - DNA, 13 bp, D. melanogaster
ttgacaaacaaaa

SEQ ID NO: 668381 - DNA, 13 bp, D. melanogaster
ttgacaaacaaac

SEQ ID NO: 668382 - DNA, 13 bp, D. melanogaster
ttgacaaacaaat

SEQ ID NO: 668383 - DNA, 13 bp, D. melanogaster
ttgacaaactgta

SEQ ID NO: 668384 - DNA, 14 bp, D. melanogaster
ttgacaaactgtat

SEQ ID NO: 668385 - DNA, 13 bp, D. melanogaster
ttgacaaagaaaa

SEQ ID NO: 668386 - DNA, 13 bp, D. melanogaster
ttgacaaataaac

SEQ ID NO: 668387 - DNA, 13 bp, D. melanogaster
ttgacaaataatt

SEQ ID NO: 668388 - DNA, 13 bp, D. melanogaster
ttgacaaatattt

SEQ ID NO: 668389 - DNA, 14 bp, D. melanogaster
ttgacaaatattta

SEQ ID NO: 668390 - DNA, 13 bp, D. melanogaster
ttgacaaattgaa

SEQ ID NO: 668391 - DNA, 14 bp, D. melanogaster
ttgacaaattttga

SEQ ID NO: 668392 - DNA, 13 bp, D. melanogaster
ttgacaacattct

SEQ ID NO: 668393 - DNA, 13 bp, D. melanogaster
ttgacaacatttg

SEQ ID NO: 668394 - DNA, 13 bp, D. melanogaster
ttgacaacatttt

SEQ ID NO: 668395 - DNA, 13 bp, D. melanogaster
ttgacaacttcat

SEQ ID NO: 668396 - DNA, 13 bp, D. melanogaster
ttgacaataaata

SEQ ID NO: 668397 - DNA, 13 bp, D. melanogaster
ttgacaataatta

SEQ ID NO: 668398 - DNA, 13 bp, D. melanogaster
ttgacaatgacaa

SEQ ID NO: 668399 - DNA, 13 bp, D. melanogaster
ttgacaatgcaat

SEQ ID NO: 668400 - DNA, 13 bp, D. melanogaster
ttgacaattaaat

SEQ ID NO: 668401 - DNA, 13 bp, D. melanogaster
ttgacaattaatt

SEQ ID NO: 668402 - DNA, 13 bp, D. melanogaster
ttgacaattattt

SEQ ID NO: 668403 - DNA, 13 bp, D. melanogaster
ttgacaattgaca

SEQ ID NO: 668404 - DNA, 13 bp, D. melanogaster
ttgacaattttca

SEQ ID NO: 668405 - DNA, 13 bp, D. melanogaster
ttgacacattttc

SEQ ID NO: 668406 - DNA, 13 bp, D. melanogaster
ttgacacgcccac

SEQ ID NO: 668407 - DNA, 13 bp, D. melanogaster
ttgacactaatta

SEQ ID NO: 668408 - DNA, 13 bp, D. melanogaster
ttgacactttgaa

SEQ ID NO: 668409 - DNA, 13 bp, D. melanogaster
ttgacagcatttt

SEQ ID NO: 668410 - DNA, 13 bp, D. melanogaster
ttgacagcggcac

SEQ ID NO: 668411 - DNA, 13 bp, D. melanogaster
ttgacagtttcaa

SEQ ID NO: 668412 - DNA, 13 bp, D. melanogaster
ttgacagtttttc

SEQ ID NO: 668413 - DNA, 13 bp, D. melanogaster
ttgacataaaaga

SEQ ID NO: 668414 - DNA, 13 bp, D. melanogaster
ttgacatatttat

SEQ ID NO: 668415 - DNA, 14 bp, D. melanogaster
ttgacatatttatt

SEQ ID NO: 668416 - DNA, 13 bp, D. melanogaster
ttgacatcattca

SEQ ID NO: 668417 - DNA, 13 bp, D. melanogaster
ttgacattaatga

SEQ ID NO: 668418 - DNA, 13 bp, D. melanogaster
ttgacattaatta

SEQ ID NO: 668419 - DNA, 13 bp, D. melanogaster
ttgacattcatct

SEQ ID NO: 668420 - DNA, 13 bp, D. melanogaster
ttgacattgaaat

SEQ ID NO: 668421 - DNA, 13 bp, D. melanogaster
ttgacattgaact

SEQ ID NO: 668422 - DNA, 13 bp, D. melanogaster
ttgacattgacac

SEQ ID NO: 668423 - DNA, 13 bp, D. melanogaster
ttgacattgacat

SEQ ID NO: 668424 - DNA, 14 bp, D. melanogaster
ttgacattgacatt

SEQ ID NO: 668425 - DNA, 13 bp, D. melanogaster
ttgacattgtttt

SEQ ID NO: 668426 - DNA, 13 bp, D. melanogaster
ttgacatttaaat

SEQ ID NO: 668427 - DNA, 13 bp, D. melanogaster
ttgacatttaatt

SEQ ID NO: 668428 - DNA, 13 bp, D. melanogaster
ttgacatttattg

SEQ ID NO: 668429 - DNA, 13 bp, D. melanogaster
ttgacatttcctt

SEQ ID NO: 668430 - DNA, 13 bp, D. melanogaster
ttgacatttgcat

SEQ ID NO: 668431 - DNA, 13 bp, D. melanogaster
ttgacatttgcca

SEQ ID NO: 668432 - DNA, 13 bp, D. melanogaster
ttgacatttggca

SEQ ID NO: 668433 - DNA, 13 bp, D. melanogaster
ttgacattttatt

SEQ ID NO: 668434 - DNA, 14 bp, D. melanogaster
ttgacattttattt

SEQ ID NO: 668435 - DNA, 13 bp, D. melanogaster
ttgacattttcat

SEQ ID NO: 668436 - DNA, 14 bp, D. melanogaster
ttgacattttcatt

SEQ ID NO: 668437 - DNA, 13 bp, D. melanogaster
ttgacattttgcc

SEQ ID NO: 668438 - DNA, 13 bp, D. melanogaster
ttgacattttgct

SEQ ID NO: 668439 - DNA, 13 bp, D. melanogaster
ttgacatttttct

SEQ ID NO: 668440 - DNA, 13 bp, D. melanogaster
ttgacatttttgc

SEQ ID NO: 668441 - DNA, 13 bp, D. melanogaster
ttgaccaaaaaaa

SEQ ID NO: 668442 - DNA, 13 bp, D. melanogaster
ttgaccaaaaaat

SEQ ID NO: 668443 - DNA, 13 bp, D. melanogaster
ttgaccaaaaatg

SEQ ID NO: 668444 - DNA, 13 bp, D. melanogaster
ttgaccaaacaaa

SEQ ID NO: 668445 - DNA, 13 bp, D. melanogaster
ttgaccaaagctg

SEQ ID NO: 668446 - DNA, 13 bp, D. melanogaster
ttgaccaactttt

SEQ ID NO: 668447 - DNA, 13 bp, D. melanogaster
ttgaccaatttcc

SEQ ID NO: 668448 - DNA, 13 bp, D. melanogaster
ttgaccacagctg

SEQ ID NO: 668449 - DNA, 13 bp, D. melanogaster
ttgaccacattgg

SEQ ID NO: 668450 - DNA, 13 bp, D. melanogaster
ttgaccattcaaa

SEQ ID NO: 668451 - DNA, 13 bp, D. melanogaster
ttgaccattgtga

SEQ ID NO: 668452 - DNA, 13 bp, D. melanogaster
ttgaccatttact

SEQ ID NO: 668453 - DNA, 13 bp, D. melanogaster
ttgaccgcagctg

SEQ ID NO: 668454 - DNA, 14 bp, D. melanogaster
ttgaccgctgctgt

SEQ ID NO: 668455 - DNA, 13 bp, D. melanogaster
ttgaccttcacca

SEQ ID NO: 668456 - DNA, 14 bp, D. melanogaster
ttgaccttggccaa

SEQ ID NO: 668457 - DNA, 13 bp, D. melanogaster
ttgacgaaaacaa

SEQ ID NO: 668458 - DNA, 13 bp, D. melanogaster
ttgacgacgatga

SEQ ID NO: 668459 - DNA, 13 bp, D. melanogaster
ttgacgttcatac

SEQ ID NO: 668460 - DNA, 13 bp, D. melanogaster
ttgactaaggaca

SEQ ID NO: 668461 - DNA, 13 bp, D. melanogaster
ttgactaatttat

SEQ ID NO: 668462 - DNA, 13 bp, D. melanogaster
ttgactacactaa

SEQ ID NO: 668463 - DNA, 13 bp, D. melanogaster
ttgactatgagga

SEQ ID NO: 668464 - DNA, 13 bp, D. melanogaster
ttgactattattt

SEQ ID NO: 668465 - DNA, 13 bp, D. melanogaster
ttgactattttat

SEQ ID NO: 668466 - DNA, 13 bp, D. melanogaster
ttgactgtgctcg

SEQ ID NO: 668467 - DNA, 13 bp, D. melanogaster
ttgacttccttct

SEQ ID NO: 668468 - DNA, 13 bp, D. melanogaster
ttgacttgatgtc

SEQ ID NO: 668469 - DNA, 13 bp, D. melanogaster
ttgacttgatttt

SEQ ID NO: 668470 - DNA, 13 bp, D. melanogaster
ttgacttggctgc

SEQ ID NO: 668471 - DNA, 13 bp, D. melanogaster
ttgactttaattg

SEQ ID NO: 668472 - DNA, 13 bp, D. melanogaster
ttgactttataaa

SEQ ID NO: 668473 - DNA, 14 bp, D. melanogaster
ttgactttataaaa

SEQ ID NO: 668474 - DNA, 13 bp, D. melanogaster
ttgactttcatta

SEQ ID NO: 668475 - DNA, 13 bp, D. melanogaster
ttgactttgaaat

SEQ ID NO: 668476 - DNA, 13 bp, D. melanogaster
ttgactttgacat

SEQ ID NO: 668477 - DNA, 13 bp, D. melanogaster
ttgactttgactt

SEQ ID NO: 668478 - DNA, 14 bp, D. melanogaster
ttgactttgacttt

SEQ ID NO: 668479 - DNA, 13 bp, D. melanogaster
ttgactttgattt

SEQ ID NO: 668480 - DNA, 13 bp, D. melanogaster
ttgactttgccac

SEQ ID NO: 668481 - DNA, 13 bp, D. melanogaster
ttgactttgctgc

SEQ ID NO: 668482 - DNA, 13 bp, D. melanogaster
ttgactttgctgt

SEQ ID NO: 668483 - DNA, 13 bp, D. melanogaster
ttgactttgcttg

SEQ ID NO: 668484 - DNA, 13 bp, D. melanogaster
ttgactttggcca

SEQ ID NO: 668485 - DNA, 13 bp, D. melanogaster
ttgacttttatgc

SEQ ID NO: 668486 - DNA, 13 bp, D. melanogaster
ttgacttttatta

SEQ ID NO: 668487 - DNA, 13 bp, D. melanogaster
ttgacttttgctt

SEQ ID NO: 668488 - DNA, 13 bp, D. melanogaster
ttgacttttgttg

SEQ ID NO: 668489 - DNA, 13 bp, D. melanogaster
ttgagaaaagttt

SEQ ID NO: 668490 - DNA, 13 bp, D. melanogaster
ttgagaaaataca

SEQ ID NO: 668491 - DNA, 13 bp, D. melanogaster
ttgagaaaccagt

SEQ ID NO: 668492 - DNA, 13 bp, D. melanogaster
ttgagaaaggaca

SEQ ID NO: 668493 - DNA, 13 bp, D. melanogaster
ttgagaaattaaa

SEQ ID NO: 668494 - DNA, 13 bp, D. melanogaster
ttgagaaattgaa

SEQ ID NO: 668495 - DNA, 13 bp, D. melanogaster
ttgagaaatttaa

SEQ ID NO: 668496 - DNA, 13 bp, D. melanogaster
ttgagaaatttca

SEQ ID NO: 668497 - DNA, 13 bp, D. melanogaster
ttgagaaggaaat

SEQ ID NO: 668498 - DNA, 13 bp, D. melanogaster
ttgagaagtggct

SEQ ID NO: 668499 - DNA, 13 bp, D. melanogaster
ttgagaatgatgt

SEQ ID NO: 668500 - DNA, 13 bp, D. melanogaster
ttgagacattttt

SEQ ID NO: 668501 - DNA, 13 bp, D. melanogaster
ttgagactttatt

SEQ ID NO: 668502 - DNA, 13 bp, D. melanogaster
ttgagagtttatt

SEQ ID NO: 668503 - DNA, 13 bp, D. melanogaster
ttgagatacattt

SEQ ID NO: 668504 - DNA, 13 bp, D. melanogaster
ttgagatactttc

SEQ ID NO: 668505 - DNA, 13 bp, D. melanogaster
ttgagatactttt

SEQ ID NO: 668506 - DNA, 13 bp, D. melanogaster
ttgagatgatttc

SEQ ID NO: 668507 - DNA, 13 bp, D. melanogaster
ttgagattaaatg

SEQ ID NO: 668508 - DNA, 13 bp, D. melanogaster
ttgagattaagca

SEQ ID NO: 668509 - DNA, 13 bp, D. melanogaster
ttgagattcagca

SEQ ID NO: 668510 - DNA, 14 bp, D. melanogaster
ttgagattcagcat

SEQ ID NO: 668511 - DNA, 14 bp, D. melanogaster
ttgagattgagatt

SEQ ID NO: 668512 - DNA, 13 bp, D. melanogaster
ttgagcaaaaaat

SEQ ID NO: 668513 - DNA, 13 bp, D. melanogaster
ttgagcaaaataa

SEQ ID NO: 668514 - DNA, 13 bp, D. melanogaster
ttgagcaaacaaa

SEQ ID NO: 668515 - DNA, 13 bp, D. melanogaster
ttgagcaaataaa

SEQ ID NO: 668516 - DNA, 13 bp, D. melanogaster
ttgagcaaatatt

SEQ ID NO: 668517 - DNA, 13 bp, D. melanogaster
ttgagcaaatgaa

SEQ ID NO: 668518 - DNA, 13 bp, D. melanogaster
ttgagcaacgttt

SEQ ID NO: 668519 - DNA, 13 bp, D. melanogaster
ttgagcaatcaaa

SEQ ID NO: 668520 - DNA, 13 bp, D. melanogaster
ttgagcaatgcac

SEQ ID NO: 668521 - DNA, 13 bp, D. melanogaster
ttgagcaatttaa

SEQ ID NO: 668522 - DNA, 13 bp, D. melanogaster
ttgagcaattttt

SEQ ID NO: 668523 - DNA, 13 bp, D. melanogaster
ttgagcagcaaca

SEQ ID NO: 668524 - DNA, 13 bp, D. melanogaster
ttgagcagctatt

SEQ ID NO: 668525 - DNA, 13 bp, D. melanogaster
ttgagcaggtgtc

SEQ ID NO: 668526 - DNA, 13 bp, D. melanogaster
ttgagcatgagct

SEQ ID NO: 668527 - DNA, 13 bp, D. melanogaster
ttgagcatttgcc

SEQ ID NO: 668528 - DNA, 13 bp, D. melanogaster
ttgagccaaaaag

SEQ ID NO: 668529 - DNA, 13 bp, D. melanogaster
ttgagccattttt

SEQ ID NO: 668530 - DNA, 13 bp, D. melanogaster
ttgagcgacaatc

SEQ ID NO: 668531 - DNA, 14 bp, D. melanogaster
ttgagcggcgagga

SEQ ID NO: 668532 - DNA, 13 bp, D. melanogaster
ttgagctggaatt

SEQ ID NO: 668533 - DNA, 13 bp, D. melanogaster
ttgagcttgaacc

SEQ ID NO: 668534 - DNA, 13 bp, D. melanogaster
ttgagcttgagct

SEQ ID NO: 668535 - DNA, 13 bp, D. melanogaster
ttgaggaaattca

SEQ ID NO: 668536 - DNA, 13 bp, D. melanogaster
ttgagggactttt

SEQ ID NO: 668537 - DNA, 13 bp, D. melanogaster
ttgagggctgagc

SEQ ID NO: 668538 - DNA, 13 bp, D. melanogaster
ttgaggtcattaa

SEQ ID NO: 668539 - DNA, 13 bp, D. melanogaster
ttgagtaaacaaa

SEQ ID NO: 668540 - DNA, 14 bp, D. melanogaster
ttgagtaacgggta

SEQ ID NO: 668541 - DNA, 13 bp, D. melanogaster
ttgagtacaaatt

SEQ ID NO: 668542 - DNA, 13 bp, D. melanogaster
ttgagtgcaattt

SEQ ID NO: 668543 - DNA, 13 bp, D. melanogaster
ttgagtgcacttt

SEQ ID NO: 668544 - DNA, 13 bp, D. melanogaster
ttgagtgcatttc

SEQ ID NO: 668545 - DNA, 13 bp, D. melanogaster
ttgagtgcatttg

SEQ ID NO: 668546 - DNA, 13 bp, D. melanogaster
ttgagtggcaaaa

SEQ ID NO: 668547 - DNA, 13 bp, D. melanogaster
ttgagtgtctaat

SEQ ID NO: 668548 - DNA, 13 bp, D. melanogaster
ttgagtgtggcaa

SEQ ID NO: 668549 - DNA, 13 bp, D. melanogaster
ttgagtgtgtgcg

SEQ ID NO: 668550 - DNA, 13 bp, D. melanogaster
ttgagttcatgta

SEQ ID NO: 668551 - DNA, 13 bp, D. melanogaster
ttgagttcgagtt

SEQ ID NO: 668552 - DNA, 13 bp, D. melanogaster
ttgagttcttgtg

SEQ ID NO: 668553 - DNA, 13 bp, D. melanogaster
ttgagttgaaatt

SEQ ID NO: 668554 - DNA, 13 bp, D. melanogaster
ttgagttgagtgg

SEQ ID NO: 668555 - DNA, 13 bp, D. melanogaster
ttgagttgagttc

SEQ ID NO: 668556 - DNA, 13 bp, D. melanogaster
ttgagttgagttt

SEQ ID NO: 668557 - DNA, 13 bp, D. melanogaster
ttgagttgattta

SEQ ID NO: 668558 - DNA, 13 bp, D. melanogaster
ttgagttgcattt

SEQ ID NO: 668559 - DNA, 13 bp, D. melanogaster
ttgagttggaaaa

SEQ ID NO: 668560 - DNA, 13 bp, D. melanogaster
ttgagttgtttgc

SEQ ID NO: 668561 - DNA, 13 bp, D. melanogaster
ttgagtttaatta

SEQ ID NO: 668562 - DNA, 13 bp, D. melanogaster
ttgagtttcattt

SEQ ID NO: 668563 - DNA, 13 bp, D. melanogaster
ttgagtttcgttt

SEQ ID NO: 668564 - DNA, 13 bp, D. melanogaster
ttgagtttgagtt

SEQ ID NO: 668565 - DNA, 13 bp, D. melanogaster
ttgagtttggaaa

SEQ ID NO: 668566 - DNA, 13 bp, D. melanogaster
ttgagtttggctt

SEQ ID NO: 668567 - DNA, 13 bp, D. melanogaster
ttgagttttcaaa

SEQ ID NO: 668568 - DNA, 13 bp, D. melanogaster
ttgagttttgtaa

SEQ ID NO: 668569 - DNA, 13 bp, D. melanogaster
ttgagtttttcaa

SEQ ID NO: 668570 - DNA, 13 bp, D. melanogaster
ttgagtttttgaa

SEQ ID NO: 668571 - DNA, 13 bp, D. melanogaster
ttgagtttttgag

SEQ ID NO: 668572 - DNA, 14 bp, D. melanogaster
ttgataaaacgtct

SEQ ID NO: 668573 - DNA, 13 bp, D. melanogaster
ttgataaaagctt

SEQ ID NO: 668574 - DNA, 13 bp, D. melanogaster
ttgataaaatgtt

SEQ ID NO: 668575 - DNA, 13 bp, D. melanogaster
ttgataaacaaaa

SEQ ID NO: 668576 - DNA, 14 bp, D. melanogaster
ttgataaacaaatt

SEQ ID NO: 668577 - DNA, 13 bp, D. melanogaster
ttgataaactaat

SEQ ID NO: 668578 - DNA, 14 bp, D. melanogaster
ttgataaactaatt

SEQ ID NO: 668579 - DNA, 13 bp, D. melanogaster
ttgataaactttt

SEQ ID NO: 668580 - DNA, 13 bp, D. melanogaster
ttgataaatttgt

SEQ ID NO: 668581 - DNA, 13 bp, D. melanogaster
ttgataacaaaat

SEQ ID NO: 668582 - DNA, 13 bp, D. melanogaster
ttgataacaaatt

SEQ ID NO: 668583 - DNA, 13 bp, D. melanogaster
ttgataactgcta

SEQ ID NO: 668584 - DNA, 13 bp, D. melanogaster
ttgataagaaaat

SEQ ID NO: 668585 - DNA, 13 bp, D. melanogaster
ttgataagaataa

SEQ ID NO: 668586 - DNA, 13 bp, D. melanogaster
ttgataagcaaaa

SEQ ID NO: 668587 - DNA, 13 bp, D. melanogaster
ttgataaggaagt

SEQ ID NO: 668588 - DNA, 13 bp, D. melanogaster
ttgataagtaaat

SEQ ID NO: 668589 - DNA, 13 bp, D. melanogaster
ttgataatagaac

SEQ ID NO: 668590 - DNA, 13 bp, D. melanogaster
ttgataatccaac

SEQ ID NO: 668591 - DNA, 13 bp, D. melanogaster
ttgataatgataa

SEQ ID NO: 668592 - DNA, 13 bp, D. melanogaster
ttgataatgccac

SEQ ID NO: 668593 - DNA, 13 bp, D. melanogaster
ttgataatttgaa

SEQ ID NO: 668594 - DNA, 13 bp, D. melanogaster
ttgatacattttg

SEQ ID NO: 668595 - DNA, 13 bp, D. melanogaster
ttgataccctgta

SEQ ID NO: 668596 - DNA, 13 bp, D. melanogaster
ttgatacgtttgt

SEQ ID NO: 668597 - DNA, 13 bp, D. melanogaster
ttgatagaaaata

SEQ ID NO: 668598 - DNA, 13 bp, D. melanogaster
ttgatagaaattt

SEQ ID NO: 668599 - DNA, 13 bp, D. melanogaster
ttgatatacaaat

SEQ ID NO: 668600 - DNA, 13 bp, D. melanogaster
ttgatatacatat

SEQ ID NO: 668601 - DNA, 13 bp, D. melanogaster
ttgatatatatgt

SEQ ID NO: 668602 - DNA, 13 bp, D. melanogaster
ttgatatattact

SEQ ID NO: 668603 - DNA, 13 bp, D. melanogaster
ttgatatcctttt

SEQ ID NO: 668604 - DNA, 13 bp, D. melanogaster
ttgatatgaatgg

SEQ ID NO: 668605 - DNA, 13 bp, D. melanogaster
ttgatattaaagt

SEQ ID NO: 668606 - DNA, 13 bp, D. melanogaster
ttgatattaagca

SEQ ID NO: 668607 - DNA, 13 bp, D. melanogaster
ttgatattaattg

SEQ ID NO: 668608 - DNA, 13 bp, D. melanogaster
ttgatattatttc

SEQ ID NO: 668609 - DNA, 13 bp, D. melanogaster
ttgatattcattt

SEQ ID NO: 668610 - DNA, 13 bp, D. melanogaster
ttgatattgtaat

SEQ ID NO: 668611 - DNA, 13 bp, D. melanogaster
ttgatattttcaa

SEQ ID NO: 668612 - DNA, 13 bp, D. melanogaster
ttgatattttcat

SEQ ID NO: 668613 - DNA, 13 bp, D. melanogaster
ttgatcaaaaagg

SEQ ID NO: 668614 - DNA, 13 bp, D. melanogaster
ttgatcaaaaata

SEQ ID NO: 668615 - DNA, 14 bp, D. melanogaster
ttgatcaaaaataa

SEQ ID NO: 668616 - DNA, 13 bp, D. melanogaster
ttgatcaaaacat

SEQ ID NO: 668617 - DNA, 14 bp, D. melanogaster
ttgatcaaaatacc

SEQ ID NO: 668618 - DNA, 13 bp, D. melanogaster
ttgatcaaacaaa

SEQ ID NO: 668619 - DNA, 13 bp, D. melanogaster
ttgatcaaataat

SEQ ID NO: 668620 - DNA, 13 bp, D. melanogaster
ttgatcaactggt

SEQ ID NO: 668621 - DNA, 13 bp, D. melanogaster
ttgatcaagaata

SEQ ID NO: 668622 - DNA, 13 bp, D. melanogaster
ttgatcaataaaa

SEQ ID NO: 668623 - DNA, 13 bp, D. melanogaster
ttgatcaattaaa

SEQ ID NO: 668624 - DNA, 13 bp, D. melanogaster
ttgatcaattggc

SEQ ID NO: 668625 - DNA, 13 bp, D. melanogaster
ttgatcaatttaa

SEQ ID NO: 668626 - DNA, 13 bp, D. melanogaster
ttgatcaatttca

SEQ ID NO: 668627 - DNA, 13 bp, D. melanogaster
ttgatcagcaaaa

SEQ ID NO: 668628 - DNA, 13 bp, D. melanogaster
ttgatccaacaaa

SEQ ID NO: 668629 - DNA, 13 bp, D. melanogaster
ttgatcgtgtttt

SEQ ID NO: 668630 - DNA, 13 bp, D. melanogaster
ttgatctaatttt

SEQ ID NO: 668631 - DNA, 13 bp, D. melanogaster
ttgatctgtcctt

SEQ ID NO: 668632 - DNA, 13 bp, D. melanogaster
ttgatctgttttg

SEQ ID NO: 668633 - DNA, 13 bp, D. melanogaster
ttgatcttttagg

SEQ ID NO: 668634 - DNA, 13 bp, D. melanogaster
ttgatgaaaacct

SEQ ID NO: 668635 - DNA, 13 bp, D. melanogaster
ttgatgaaaatga

SEQ ID NO: 668636 - DNA, 13 bp, D. melanogaster
ttgatgaaataat

SEQ ID NO: 668637 - DNA, 13 bp, D. melanogaster
ttgatgaaattat

SEQ ID NO: 668638 - DNA, 13 bp, D. melanogaster
ttgatgaatgaaa

SEQ ID NO: 668639 - DNA, 13 bp, D. melanogaster
ttgatgaatggcg

SEQ ID NO: 668640 - DNA, 14 bp, D. melanogaster
ttgatgaatggcgc

SEQ ID NO: 668641 - DNA, 13 bp, D. melanogaster
ttgatgacatttt

SEQ ID NO: 668642 - DNA, 13 bp, D. melanogaster
ttgatgacgatga

SEQ ID NO: 668643 - DNA, 13 bp, D. melanogaster
ttgatgacgtcat

SEQ ID NO: 668644 - DNA, 13 bp, D. melanogaster
ttgatgaggctgc

SEQ ID NO: 668645 - DNA, 14 bp, D. melanogaster
ttgatgaggctgct

SEQ ID NO: 668646 - DNA, 13 bp, D. melanogaster
ttgatgatattat

SEQ ID NO: 668647 - DNA, 13 bp, D. melanogaster
ttgatgatgacaa

SEQ ID NO: 668648 - DNA, 13 bp, D. melanogaster
ttgatgatgatgc

SEQ ID NO: 668649 - DNA, 13 bp, D. melanogaster
ttgatgatgatgg

SEQ ID NO: 668650 - DNA, 13 bp, D. melanogaster
ttgatgatgctca

SEQ ID NO: 668651 - DNA, 13 bp, D. melanogaster
ttgatgatttgat

SEQ ID NO: 668652 - DNA, 13 bp, D. melanogaster
ttgatgattttaa

SEQ ID NO: 668653 - DNA, 13 bp, D. melanogaster
ttgatgatttttc

SEQ ID NO: 668654 - DNA, 13 bp, D. melanogaster
ttgatgccaaaaa

SEQ ID NO: 668655 - DNA, 14 bp, D. melanogaster
ttgatgccaaaaaa

SEQ ID NO: 668656 - DNA, 13 bp, D. melanogaster
ttgatgccatttg

SEQ ID NO: 668657 - DNA, 13 bp, D. melanogaster
ttgatgctgctgc

SEQ ID NO: 668658 - DNA, 13 bp, D. melanogaster
ttgatggcagcgg

SEQ ID NO: 668659 - DNA, 13 bp, D. melanogaster
ttgatggctgcaa

SEQ ID NO: 668660 - DNA, 14 bp, D. melanogaster
ttgatggctgcaag

SEQ ID NO: 668661 - DNA, 13 bp, D. melanogaster
ttgatggcttctt

SEQ ID NO: 668662 - DNA, 14 bp, D. melanogaster
ttgatggcttcttc

SEQ ID NO: 668663 - DNA, 13 bp, D. melanogaster
ttgatggtttaat

SEQ ID NO: 668664 - DNA, 13 bp, D. melanogaster
ttgatgtattggc

SEQ ID NO: 668665 - DNA, 14 bp, D. melanogaster
ttgatgtattggcc

SEQ ID NO: 668666 - DNA, 13 bp, D. melanogaster
ttgatgtcctcta

SEQ ID NO: 668667 - DNA, 13 bp, D. melanogaster
ttgatgttgatgc

SEQ ID NO: 668668 - DNA, 13 bp, D. melanogaster
ttgatgttgcagc

SEQ ID NO: 668669 - DNA, 13 bp, D. melanogaster
ttgatgttgctgc

SEQ ID NO: 668670 - DNA, 13 bp, D. melanogaster
ttgatgttggcta

SEQ ID NO: 668671 - DNA, 13 bp, D. melanogaster
ttgatgtttgctt

SEQ ID NO: 668672 - DNA, 13 bp, D. melanogaster
ttgattaaaaatg

SEQ ID NO: 668673 - DNA, 13 bp, D. melanogaster
ttgattaaatcat

SEQ ID NO: 668674 - DNA, 13 bp, D. melanogaster
ttgattaacaaaa

SEQ ID NO: 668675 - DNA, 13 bp, D. melanogaster
ttgattaacttaa

SEQ ID NO: 668676 - DNA, 13 bp, D. melanogaster
ttgattaactttt

SEQ ID NO: 668677 - DNA, 13 bp, D. melanogaster
ttgattaagttaa

SEQ ID NO: 668678 - DNA, 13 bp, D. melanogaster
ttgattaatcaaa

SEQ ID NO: 668679 - DNA, 13 bp, D. melanogaster
ttgattaatgctc

SEQ ID NO: 668680 - DNA, 13 bp, D. melanogaster
ttgattacaaatt

SEQ ID NO: 668681 - DNA, 13 bp, D. melanogaster
ttgattacaattt

SEQ ID NO: 668682 - DNA, 13 bp, D. melanogaster
ttgattacagctg

SEQ ID NO: 668683 - DNA, 13 bp, D. melanogaster
ttgattacctcaa

SEQ ID NO: 668684 - DNA, 13 bp, D. melanogaster
ttgattactttaa

SEQ ID NO: 668685 - DNA, 13 bp, D. melanogaster
ttgattactttta

SEQ ID NO: 668686 - DNA, 13 bp, D. melanogaster
ttgattagctttc

SEQ ID NO: 668687 - DNA, 13 bp, D. melanogaster
ttgattagtttaa

SEQ ID NO: 668688 - DNA, 13 bp, D. melanogaster
ttgattatgaata

SEQ ID NO: 668689 - DNA, 13 bp, D. melanogaster
ttgattattgaaa

SEQ ID NO: 668690 - DNA, 13 bp, D. melanogaster
ttgattatttcat

SEQ ID NO: 668691 - DNA, 13 bp, D. melanogaster
ttgattattttcc

SEQ ID NO: 668692 - DNA, 14 bp, D. melanogaster
ttgattcaagtaaa

SEQ ID NO: 668693 - DNA, 13 bp, D. melanogaster
ttgattcatcatt

SEQ ID NO: 668694 - DNA, 13 bp, D. melanogaster
ttgattcatttaa

SEQ ID NO: 668695 - DNA, 13 bp, D. melanogaster
ttgattccattta

SEQ ID NO: 668696 - DNA, 13 bp, D. melanogaster
ttgattccatttc

SEQ ID NO: 668697 - DNA, 14 bp, D. melanogaster
ttgattcgcatttg

SEQ ID NO: 668698 - DNA, 13 bp, D. melanogaster
ttgattcggattt

SEQ ID NO: 668699 - DNA, 13 bp, D. melanogaster
ttgattctgatca

SEQ ID NO: 668700 - DNA, 13 bp, D. melanogaster
ttgattctggtgc

SEQ ID NO: 668701 - DNA, 13 bp, D. melanogaster
ttgattctggtgt

SEQ ID NO: 668702 - DNA, 13 bp, D. melanogaster
ttgattcttgaaa

SEQ ID NO: 668703 - DNA, 13 bp, D. melanogaster
ttgattgaaatcg

SEQ ID NO: 668704 - DNA, 13 bp, D. melanogaster
ttgattgaaatgc

SEQ ID NO: 668705 - DNA, 13 bp, D. melanogaster
ttgattgaagaag

SEQ ID NO: 668706 - DNA, 14 bp, D. melanogaster
ttgattgaattgaa

SEQ ID NO: 668707 - DNA, 13 bp, D. melanogaster
ttgattgaattta

SEQ ID NO: 668708 - DNA, 13 bp, D. melanogaster
ttgattgacgatt

SEQ ID NO: 668709 - DNA, 13 bp, D. melanogaster
ttgattgattgac

SEQ ID NO: 668710 - DNA, 14 bp, D. melanogaster
ttgattgattgatt

SEQ ID NO: 668711 - DNA, 13 bp, D. melanogaster
ttgattgattggt

SEQ ID NO: 668712 - DNA, 13 bp, D. melanogaster
ttgattgatttgc

SEQ ID NO: 668713 - DNA, 13 bp, D. melanogaster
ttgattgcaaata

SEQ ID NO: 668714 - DNA, 13 bp, D. melanogaster
ttgattgcattaa

SEQ ID NO: 668715 - DNA, 13 bp, D. melanogaster
ttgattgcatttt

SEQ ID NO: 668716 - DNA, 14 bp, D. melanogaster
ttgattgcattttt

SEQ ID NO: 668717 - DNA, 13 bp, D. melanogaster
ttgattgccaaac

SEQ ID NO: 668718 - DNA, 13 bp, D. melanogaster
ttgattgcccttt

SEQ ID NO: 668719 - DNA, 13 bp, D. melanogaster
ttgattgcctttt

SEQ ID NO: 668720 - DNA, 13 bp, D. melanogaster
ttgattgctttat

SEQ ID NO: 668721 - DNA, 13 bp, D. melanogaster
ttgattggaaatt

SEQ ID NO: 668722 - DNA, 14 bp, D. melanogaster
ttgattggaaattt

SEQ ID NO: 668723 - DNA, 13 bp, D. melanogaster
ttgattggaattt

SEQ ID NO: 668724 - DNA, 13 bp, D. melanogaster
ttgattggatttg

SEQ ID NO: 668725 - DNA, 13 bp, D. melanogaster
ttgattggcaaat

SEQ ID NO: 668726 - DNA, 13 bp, D. melanogaster
ttgattggcattt

SEQ ID NO: 668727 - DNA, 13 bp, D. melanogaster
ttgattgtaattg

SEQ ID NO: 668728 - DNA, 13 bp, D. melanogaster
ttgattgtgaaat

SEQ ID NO: 668729 - DNA, 13 bp, D. melanogaster
ttgattgtggcca

SEQ ID NO: 668730 - DNA, 13 bp, D. melanogaster
ttgattgttttgc

SEQ ID NO: 668731 - DNA, 13 bp, D. melanogaster
ttgatttaaaccg

SEQ ID NO: 668732 - DNA, 13 bp, D. melanogaster
ttgatttaaagtt

SEQ ID NO: 668733 - DNA, 13 bp, D. melanogaster
ttgatttaaatga

SEQ ID NO: 668734 - DNA, 13 bp, D. melanogaster
ttgatttaaattc

SEQ ID NO: 668735 - DNA, 13 bp, D. melanogaster
ttgatttaagcca

SEQ ID NO: 668736 - DNA, 13 bp, D. melanogaster
ttgatttaagttg

SEQ ID NO: 668737 - DNA, 13 bp, D. melanogaster
ttgatttaatgtg

SEQ ID NO: 668738 - DNA, 13 bp, D. melanogaster
ttgatttaattca

SEQ ID NO: 668739 - DNA, 13 bp, D. melanogaster
ttgatttacaatt

SEQ ID NO: 668740 - DNA, 13 bp, D. melanogaster
ttgatttacattt

SEQ ID NO: 668741 - DNA, 14 bp, D. melanogaster
ttgatttagggaca

SEQ ID NO: 668742 - DNA, 13 bp, D. melanogaster
ttgatttataagt

SEQ ID NO: 668743 - DNA, 13 bp, D. melanogaster
ttgatttatgaca

SEQ ID NO: 668744 - DNA, 13 bp, D. melanogaster
ttgatttatgcaa

SEQ ID NO: 668745 - DNA, 13 bp, D. melanogaster
ttgatttatgcat

SEQ ID NO: 668746 - DNA, 13 bp, D. melanogaster
ttgatttatgcca

SEQ ID NO: 668747 - DNA, 13 bp, D. melanogaster
ttgatttatgcgt

SEQ ID NO: 668748 - DNA, 13 bp, D. melanogaster
ttgatttatggcc

SEQ ID NO: 668749 - DNA, 13 bp, D. melanogaster
ttgatttatggct

SEQ ID NO: 668750 - DNA, 13 bp, D. melanogaster
ttgatttattatc

SEQ ID NO: 668751 - DNA, 13 bp, D. melanogaster
ttgatttattgac

SEQ ID NO: 668752 - DNA, 13 bp, D. melanogaster
ttgatttattggc

SEQ ID NO: 668753 - DNA, 13 bp, D. melanogaster
ttgatttatttca

SEQ ID NO: 668754 - DNA, 13 bp, D. melanogaster
ttgatttcaaaag

SEQ ID NO: 668755 - DNA, 14 bp, D. melanogaster
ttgatttcaagttt

SEQ ID NO: 668756 - DNA, 13 bp, D. melanogaster
ttgatttcaataa

SEQ ID NO: 668757 - DNA, 13 bp, D. melanogaster
ttgatttcaatca

SEQ ID NO: 668758 - DNA, 14 bp, D. melanogaster
ttgatttcaattaa

SEQ ID NO: 668759 - DNA, 13 bp, D. melanogaster
ttgatttcaattc

SEQ ID NO: 668760 - DNA, 13 bp, D. melanogaster
ttgatttcaattt

SEQ ID NO: 668761 - DNA, 14 bp, D. melanogaster
ttgatttcaatttt

SEQ ID NO: 668762 - DNA, 13 bp, D. melanogaster
ttgatttcacttc

SEQ ID NO: 668763 - DNA, 13 bp, D. melanogaster
ttgatttcattaa

SEQ ID NO: 668764 - DNA, 13 bp, D. melanogaster
ttgatttcattca

SEQ ID NO: 668765 - DNA, 13 bp, D. melanogaster
ttgatttcattta

SEQ ID NO: 668766 - DNA, 13 bp, D. melanogaster
ttgatttccatat

SEQ ID NO: 668767 - DNA, 13 bp, D. melanogaster
ttgatttccattt

SEQ ID NO: 668768 - DNA, 13 bp, D. melanogaster
ttgatttcccagc

SEQ ID NO: 668769 - DNA, 13 bp, D. melanogaster
ttgatttccgatt

SEQ ID NO: 668770 - DNA, 13 bp, D. melanogaster
ttgatttcgaaat

SEQ ID NO: 668771 - DNA, 13 bp, D. melanogaster
ttgatttcgaatt

SEQ ID NO: 668772 - DNA, 13 bp, D. melanogaster
ttgatttcgattc

SEQ ID NO: 668773 - DNA, 14 bp, D. melanogaster
ttgatttcgatttc

SEQ ID NO: 668774 - DNA, 13 bp, D. melanogaster
ttgatttcgcttt

SEQ ID NO: 668775 - DNA, 13 bp, D. melanogaster
ttgatttcggttt

SEQ ID NO: 668776 - DNA, 13 bp, D. melanogaster
ttgatttcgttta

SEQ ID NO: 668777 - DNA, 13 bp, D. melanogaster
ttgatttcttggc

SEQ ID NO: 668778 - DNA, 13 bp, D. melanogaster
ttgatttctttgg

SEQ ID NO: 668779 - DNA, 14 bp, D. melanogaster
ttgatttgaaaata

SEQ ID NO: 668780 - DNA, 13 bp, D. melanogaster
ttgatttgaaatg

SEQ ID NO: 668781 - DNA, 13 bp, D. melanogaster
ttgatttgacttt

SEQ ID NO: 668782 - DNA, 13 bp, D. melanogaster
ttgatttgagttg

SEQ ID NO: 668783 - DNA, 13 bp, D. melanogaster
ttgatttgataat

SEQ ID NO: 668784 - DNA, 13 bp, D. melanogaster
ttgatttgattga

SEQ ID NO: 668785 - DNA, 14 bp, D. melanogaster
ttgatttgattgat

SEQ ID NO: 668786 - DNA, 14 bp, D. melanogaster
ttgatttgatttca

SEQ ID NO: 668787 - DNA, 14 bp, D. melanogaster
ttgatttgattttc

SEQ ID NO: 668788 - DNA, 13 bp, D. melanogaster
ttgatttgcaatt

SEQ ID NO: 668789 - DNA, 13 bp, D. melanogaster
ttgatttgccaaa

SEQ ID NO: 668790 - DNA, 13 bp, D. melanogaster
ttgatttgctgct

SEQ ID NO: 668791 - DNA, 13 bp, D. melanogaster
ttgatttgctggc

SEQ ID NO: 668792 - DNA, 13 bp, D. melanogaster
ttgatttgcttac

SEQ ID NO: 668793 - DNA, 13 bp, D. melanogaster
ttgatttggatgt

SEQ ID NO: 668794 - DNA, 13 bp, D. melanogaster
ttgatttggccaa

SEQ ID NO: 668795 - DNA, 13 bp, D. melanogaster
ttgatttggtttc

SEQ ID NO: 668796 - DNA, 13 bp, D. melanogaster
ttgatttgtaaat

SEQ ID NO: 668797 - DNA, 13 bp, D. melanogaster
ttgatttgtggct

SEQ ID NO: 668798 - DNA, 13 bp, D. melanogaster
ttgatttgtgtag

SEQ ID NO: 668799 - DNA, 13 bp, D. melanogaster
ttgatttgttgcc

SEQ ID NO: 668800 - DNA, 13 bp, D. melanogaster
ttgatttgtttac

SEQ ID NO: 668801 - DNA, 13 bp, D. melanogaster
ttgattttagagt

SEQ ID NO: 668802 - DNA, 13 bp, D. melanogaster
ttgattttatcaa

SEQ ID NO: 668803 - DNA, 13 bp, D. melanogaster
ttgattttattca

SEQ ID NO: 668804 - DNA, 13 bp, D. melanogaster
ttgattttcaagt

SEQ ID NO: 668805 - DNA, 13 bp, D. melanogaster
ttgattttcacaa

SEQ ID NO: 668806 - DNA, 13 bp, D. melanogaster
ttgattttcagtt

SEQ ID NO: 668807 - DNA, 14 bp, D. melanogaster
ttgattttcagttg

SEQ ID NO: 668808 - DNA, 13 bp, D. melanogaster
ttgattttccagc

SEQ ID NO: 668809 - DNA, 13 bp, D. melanogaster
ttgattttcccgc

SEQ ID NO: 668810 - DNA, 13 bp, D. melanogaster
ttgattttcctgc

SEQ ID NO: 668811 - DNA, 13 bp, D. melanogaster
ttgattttcgtta

SEQ ID NO: 668812 - DNA, 13 bp, D. melanogaster
ttgattttctaaa

SEQ ID NO: 668813 - DNA, 13 bp, D. melanogaster
ttgattttctgag

SEQ ID NO: 668814 - DNA, 13 bp, D. melanogaster
ttgattttctgca

SEQ ID NO: 668815 - DNA, 13 bp, D. melanogaster
ttgattttgaact

SEQ ID NO: 668816 - DNA, 14 bp, D. melanogaster
ttgattttgattga

SEQ ID NO: 668817 - DNA, 13 bp, D. melanogaster
ttgattttgcaat

SEQ ID NO: 668818 - DNA, 13 bp, D. melanogaster
ttgattttgccac

SEQ ID NO: 668819 - DNA, 13 bp, D. melanogaster
ttgattttgccag

SEQ ID NO: 668820 - DNA, 13 bp, D. melanogaster
ttgattttgctgc

SEQ ID NO: 668821 - DNA, 13 bp, D. melanogaster
ttgattttggaat

SEQ ID NO: 668822 - DNA, 13 bp, D. melanogaster
ttgattttggccc

SEQ ID NO: 668823 - DNA, 13 bp, D. melanogaster
ttgattttggctt

SEQ ID NO: 668824 - DNA, 14 bp, D. melanogaster
ttgattttggttaa

SEQ ID NO: 668825 - DNA, 13 bp, D. melanogaster
ttgattttgtgca

SEQ ID NO: 668826 - DNA, 13 bp, D. melanogaster
ttgattttgtggc

SEQ ID NO: 668827 - DNA, 13 bp, D. melanogaster
ttgattttgttgc

SEQ ID NO: 668828 - DNA, 13 bp, D. melanogaster
ttgatttttaagg

SEQ ID NO: 668829 - DNA, 13 bp, D. melanogaster
ttgatttttcaag

SEQ ID NO: 668830 - DNA, 14 bp, D. melanogaster
ttgatttttccatt

SEQ ID NO: 668831 - DNA, 13 bp, D. melanogaster
ttgatttttgaca

SEQ ID NO: 668832 - DNA, 13 bp, D. melanogaster
ttgatttttgact

SEQ ID NO: 668833 - DNA, 13 bp, D. melanogaster
ttgatttttgcca

SEQ ID NO: 668834 - DNA, 13 bp, D. melanogaster
ttgcaaaaaaatg

SEQ ID NO: 668835 - DNA, 13 bp, D. melanogaster
ttgcaaaaaatgg

SEQ ID NO: 668836 - DNA, 13 bp, D. melanogaster
ttgcaaaaaattg

SEQ ID NO: 668837 - DNA, 14 bp, D. melanogaster
ttgcaaaaaattga

SEQ ID NO: 668838 - DNA, 13 bp, D. melanogaster
ttgcaaaaacaaa

SEQ ID NO: 668839 - DNA, 14 bp, D. melanogaster
ttgcaaaaacaaaa

SEQ ID NO: 668840 - DNA, 13 bp, D. melanogaster
ttgcaaaaacatt

SEQ ID NO: 668841 - DNA, 13 bp, D. melanogaster
ttgcaaaaacttt

SEQ ID NO: 668842 - DNA, 13 bp, D. melanogaster
ttgcaaaaagaaa

SEQ ID NO: 668843 - DNA, 13 bp, D. melanogaster
ttgcaaaaataaa

SEQ ID NO: 668844 - DNA, 14 bp, D. melanogaster
ttgcaaaaataaaa

SEQ ID NO: 668845 - DNA, 14 bp, D. melanogaster
ttgcaaaaataatt

SEQ ID NO: 668846 - DNA, 13 bp, D. melanogaster
ttgcaaaaatatt

SEQ ID NO: 668847 - DNA, 13 bp, D. melanogaster
ttgcaaaaatgaa

SEQ ID NO: 668848 - DNA, 13 bp, D. melanogaster
ttgcaaaaatgca

SEQ ID NO: 668849 - DNA, 13 bp, D. melanogaster
ttgcaaaaattgt

SEQ ID NO: 668850 - DNA, 13 bp, D. melanogaster
ttgcaaaacaaac

SEQ ID NO: 668851 - DNA, 13 bp, D. melanogaster
ttgcaaaacaaat

SEQ ID NO: 668852 - DNA, 13 bp, D. melanogaster
ttgcaaaacaaca

SEQ ID NO: 668853 - DNA, 13 bp, D. melanogaster
ttgcaaaacaatt

SEQ ID NO: 668854 - DNA, 13 bp, D. melanogaster
ttgcaaaacctta

SEQ ID NO: 668855 - DNA, 13 bp, D. melanogaster
ttgcaaaacttaa

SEQ ID NO: 668856 - DNA, 14 bp, D. melanogaster
ttgcaaaacttgaa

SEQ ID NO: 668857 - DNA, 13 bp, D. melanogaster
ttgcaaaagcaaa

SEQ ID NO: 668858 - DNA, 13 bp, D. melanogaster
ttgcaaaagttat

SEQ ID NO: 668859 - DNA, 13 bp, D. melanogaster
ttgcaaaagtttt

SEQ ID NO: 668860 - DNA, 13 bp, D. melanogaster
ttgcaaaataaaa

SEQ ID NO: 668861 - DNA, 13 bp, D. melanogaster
ttgcaaaataaat

SEQ ID NO: 668862 - DNA, 13 bp, D. melanogaster
ttgcaaaataatt

SEQ ID NO: 668863 - DNA, 13 bp, D. melanogaster
ttgcaaaatacaa

SEQ ID NO: 668864 - DNA, 13 bp, D. melanogaster
ttgcaaaatatat

SEQ ID NO: 668865 - DNA, 13 bp, D. melanogaster
ttgcaaaatattg

SEQ ID NO: 668866 - DNA, 13 bp, D. melanogaster
ttgcaaaatgaag

SEQ ID NO: 668867 - DNA, 13 bp, D. melanogaster
ttgcaaaatggca

SEQ ID NO: 668868 - DNA, 13 bp, D. melanogaster
ttgcaaaattaat

SEQ ID NO: 668869 - DNA, 14 bp, D. melanogaster
ttgcaaaattccaa

SEQ ID NO: 668870 - DNA, 13 bp, D. melanogaster
ttgcaaaatttat

SEQ ID NO: 668871 - DNA, 13 bp, D. melanogaster
ttgcaaacactct

SEQ ID NO: 668872 - DNA, 13 bp, D. melanogaster
ttgcaaacataaa

SEQ ID NO: 668873 - DNA, 13 bp, D. melanogaster
ttgcaaacatttc

SEQ ID NO: 668874 - DNA, 13 bp, D. melanogaster
ttgcaaacatttt

SEQ ID NO: 668875 - DNA, 14 bp, D. melanogaster
ttgcaaacattttt

SEQ ID NO: 668876 - DNA, 13 bp, D. melanogaster
ttgcaaacgtttt

SEQ ID NO: 668877 - DNA, 13 bp, D. melanogaster
ttgcaaactcatt

SEQ ID NO: 668878 - DNA, 13 bp, D. melanogaster
ttgcaaacttttg

SEQ ID NO: 668879 - DNA, 13 bp, D. melanogaster
ttgcaaacttttt

SEQ ID NO: 668880 - DNA, 13 bp, D. melanogaster
ttgcaaagaaaaa

SEQ ID NO: 668881 - DNA, 13 bp, D. melanogaster
ttgcaaagaaatt

SEQ ID NO: 668882 - DNA, 13 bp, D. melanogaster
ttgcaaagcaaaa

SEQ ID NO: 668883 - DNA, 13 bp, D. melanogaster
ttgcaaagcgaac

SEQ ID NO: 668884 - DNA, 13 bp, D. melanogaster
ttgcaaaggcaaa

SEQ ID NO: 668885 - DNA, 13 bp, D. melanogaster
ttgcaaagtaaaa

SEQ ID NO: 668886 - DNA, 13 bp, D. melanogaster
ttgcaaagttttt

SEQ ID NO: 668887 - DNA, 13 bp, D. melanogaster
ttgcaaataaaac

SEQ ID NO: 668888 - DNA, 13 bp, D. melanogaster
ttgcaaataaaag

SEQ ID NO: 668889 - DNA, 13 bp, D. melanogaster
ttgcaaataaatt

SEQ ID NO: 668890 - DNA, 14 bp, D. melanogaster
ttgcaaataaattg

SEQ ID NO: 668891 - DNA, 13 bp, D. melanogaster
ttgcaaataacaa

SEQ ID NO: 668892 - DNA, 13 bp, D. melanogaster
ttgcaaataattt

SEQ ID NO: 668893 - DNA, 13 bp, D. melanogaster
ttgcaaatcaaat

SEQ ID NO: 668894 - DNA, 13 bp, D. melanogaster
ttgcaaatcaatt

SEQ ID NO: 668895 - DNA, 14 bp, D. melanogaster
ttgcaaatccaatt

SEQ ID NO: 668896 - DNA, 13 bp, D. melanogaster
ttgcaaatcgata

SEQ ID NO: 668897 - DNA, 13 bp, D. melanogaster
ttgcaaatgaaaa

SEQ ID NO: 668898 - DNA, 13 bp, D. melanogaster
ttgcaaatgcaat

SEQ ID NO: 668899 - DNA, 13 bp, D. melanogaster
ttgcaaatggcag

SEQ ID NO: 668900 - DNA, 13 bp, D. melanogaster
ttgcaaatgtttc

SEQ ID NO: 668901 - DNA, 13 bp, D. melanogaster
ttgcaaatgtttt

SEQ ID NO: 668902 - DNA, 13 bp, D. melanogaster
ttgcaaattaatt

SEQ ID NO: 668903 - DNA, 13 bp, D. melanogaster
ttgcaaattactt

SEQ ID NO: 668904 - DNA, 13 bp, D. melanogaster
ttgcaaattcaaa

SEQ ID NO: 668905 - DNA, 14 bp, D. melanogaster
ttgcaaattgcaac

SEQ ID NO: 668906 - DNA, 13 bp, D. melanogaster
ttgcaaattgcag

SEQ ID NO: 668907 - DNA, 13 bp, D. melanogaster
ttgcaaattgcat

SEQ ID NO: 668908 - DNA, 13 bp, D. melanogaster
ttgcaaattgttt

SEQ ID NO: 668909 - DNA, 13 bp, D. melanogaster
ttgcaaatttaaa

SEQ ID NO: 668910 - DNA, 14 bp, D. melanogaster
ttgcaaatttaatt

SEQ ID NO: 668911 - DNA, 13 bp, D. melanogaster
ttgcaaatttatt

SEQ ID NO: 668912 - DNA, 13 bp, D. melanogaster
ttgcaaattttaa

SEQ ID NO: 668913 - DNA, 14 bp, D. melanogaster
ttgcaaatttttat

SEQ ID NO: 668914 - DNA, 13 bp, D. melanogaster
ttgcaaatttttt

SEQ ID NO: 668915 - DNA, 13 bp, D. melanogaster
ttgcaacaaaaaa

SEQ ID NO: 668916 - DNA, 14 bp, D. melanogaster
ttgcaacaaaaact

SEQ ID NO: 668917 - DNA, 13 bp, D. melanogaster
ttgcaacaaaatg

SEQ ID NO: 668918 - DNA, 13 bp, D. melanogaster
ttgcaacaaagaa

SEQ ID NO: 668919 - DNA, 13 bp, D. melanogaster
ttgcaacaaattt

SEQ ID NO: 668920 - DNA, 13 bp, D. melanogaster
ttgcaacaacaat

SEQ ID NO: 668921 - DNA, 13 bp, D. melanogaster
ttgcaacaacagc

SEQ ID NO: 668922 - DNA, 13 bp, D. melanogaster
ttgcaacaacttt

SEQ ID NO: 668923 - DNA, 13 bp, D. melanogaster
ttgcaacaagtgg

SEQ ID NO: 668924 - DNA, 13 bp, D. melanogaster
ttgcaacaatatt

SEQ ID NO: 668925 - DNA, 13 bp, D. melanogaster
ttgcaacaattaa

SEQ ID NO: 668926 - DNA, 13 bp, D. melanogaster
ttgcaacaattgc

SEQ ID NO: 668927 - DNA, 13 bp, D. melanogaster
ttgcaacaattgt

SEQ ID NO: 668928 - DNA, 13 bp, D. melanogaster
ttgcaacaattta

SEQ ID NO: 668929 - DNA, 13 bp, D. melanogaster
ttgcaacaatttc

SEQ ID NO: 668930 - DNA, 13 bp, D. melanogaster
ttgcaacacaaaa

SEQ ID NO: 668931 - DNA, 13 bp, D. melanogaster
ttgcaacacaaat

SEQ ID NO: 668932 - DNA, 13 bp, D. melanogaster
ttgcaacactgac

SEQ ID NO: 668933 - DNA, 13 bp, D. melanogaster
ttgcaacagaaat

SEQ ID NO: 668934 - DNA, 14 bp, D. melanogaster
ttgcaacagcaaca

SEQ ID NO: 668935 - DNA, 13 bp, D. melanogaster
ttgcaacagcagc

SEQ ID NO: 668936 - DNA, 14 bp, D. melanogaster
ttgcaacagcagca

SEQ ID NO: 668937 - DNA, 13 bp, D. melanogaster
ttgcaacatttgc

SEQ ID NO: 668938 - DNA, 13 bp, D. melanogaster
ttgcaacatttta

SEQ ID NO: 668939 - DNA, 14 bp, D. melanogaster
ttgcaacatttttg

SEQ ID NO: 668940 - DNA, 13 bp, D. melanogaster
ttgcaaccaaaaa

SEQ ID NO: 668941 - DNA, 13 bp, D. melanogaster
ttgcaaccagatc

SEQ ID NO: 668942 - DNA, 13 bp, D. melanogaster
ttgcaaccatttg

SEQ ID NO: 668943 - DNA, 13 bp, D. melanogaster
ttgcaacgcccac

SEQ ID NO: 668944 - DNA, 14 bp, D. melanogaster
ttgcaacgctttca

SEQ ID NO: 668945 - DNA, 13 bp, D. melanogaster
ttgcaacggaacg

SEQ ID NO: 668946 - DNA, 13 bp, D. melanogaster
ttgcaactatttt

SEQ ID NO: 668947 - DNA, 13 bp, D. melanogaster
ttgcaactcaatt

SEQ ID NO: 668948 - DNA, 13 bp, D. melanogaster
ttgcaactgaaaa

SEQ ID NO: 668949 - DNA, 13 bp, D. melanogaster
ttgcaactgcaac

SEQ ID NO: 668950 - DNA, 14 bp, D. melanogaster
ttgcaactgcaaca

SEQ ID NO: 668951 - DNA, 14 bp, D. melanogaster
ttgcaactgcaact

SEQ ID NO: 668952 - DNA, 13 bp, D. melanogaster
ttgcaactgcaga

SEQ ID NO: 668953 - DNA, 13 bp, D. melanogaster
ttgcaactgcagt

SEQ ID NO: 668954 - DNA, 13 bp, D. melanogaster
ttgcaactgcatt

SEQ ID NO: 668955 - DNA, 13 bp, D. melanogaster
ttgcaactggcaa

SEQ ID NO: 668956 - DNA, 14 bp, D. melanogaster
ttgcaactggcaac

SEQ ID NO: 668957 - DNA, 13 bp, D. melanogaster
ttgcaactgttgc

SEQ ID NO: 668958 - DNA, 13 bp, D. melanogaster
ttgcaactgtttg

SEQ ID NO: 668959 - DNA, 13 bp, D. melanogaster
ttgcaactgtttt

SEQ ID NO: 668960 - DNA, 13 bp, D. melanogaster
ttgcaacttgcaa

SEQ ID NO: 668961 - DNA, 14 bp, D. melanogaster
ttgcaacttgcaac

SEQ ID NO: 668962 - DNA, 13 bp, D. melanogaster
ttgcaactttgtg

SEQ ID NO: 668963 - DNA, 13 bp, D. melanogaster
ttgcaacttttat

SEQ ID NO: 668964 - DNA, 13 bp, D. melanogaster
ttgcaacttttgg

SEQ ID NO: 668965 - DNA, 13 bp, D. melanogaster
ttgcaagaaaaat

SEQ ID NO: 668966 - DNA, 13 bp, D. melanogaster
ttgcaagaacagc

SEQ ID NO: 668967 - DNA, 13 bp, D. melanogaster
ttgcaagaagaat

SEQ ID NO: 668968 - DNA, 14 bp, D. melanogaster
ttgcaagcaggcca

SEQ ID NO: 668969 - DNA, 13 bp, D. melanogaster
ttgcaagccaaaa

SEQ ID NO: 668970 - DNA, 13 bp, D. melanogaster
ttgcaagtgaaat

SEQ ID NO: 668971 - DNA, 13 bp, D. melanogaster
ttgcaagtgcaac

SEQ ID NO: 668972 - DNA, 13 bp, D. melanogaster
ttgcaagtgcatt

SEQ ID NO: 668973 - DNA, 13 bp, D. melanogaster
ttgcaagttaatt

SEQ ID NO: 668974 - DNA, 13 bp, D. melanogaster
ttgcaagttgcac

SEQ ID NO: 668975 - DNA, 13 bp, D. melanogaster
ttgcaagtttttc

SEQ ID NO: 668976 - DNA, 13 bp, D. melanogaster
ttgcaagtttttt

SEQ ID NO: 668977 - DNA, 13 bp, D. melanogaster
ttgcaataaaaac

SEQ ID NO: 668978 - DNA, 13 bp, D. melanogaster
ttgcaataaaact

SEQ ID NO: 668979 - DNA, 14 bp, D. melanogaster
ttgcaataaatatt

SEQ ID NO: 668980 - DNA, 13 bp, D. melanogaster
ttgcaataaattg

SEQ ID NO: 668981 - DNA, 13 bp, D. melanogaster
ttgcaataacttt

SEQ ID NO: 668982 - DNA, 13 bp, D. melanogaster
ttgcaataataaa

SEQ ID NO: 668983 - DNA, 14 bp, D. melanogaster
ttgcaataattaaa

SEQ ID NO: 668984 - DNA, 13 bp, D. melanogaster
ttgcaataatttt

SEQ ID NO: 668985 - DNA, 13 bp, D. melanogaster
ttgcaatacaaat

SEQ ID NO: 668986 - DNA, 13 bp, D. melanogaster
ttgcaatactttt

SEQ ID NO: 668987 - DNA, 13 bp, D. melanogaster
ttgcaatagttta

SEQ ID NO: 668988 - DNA, 13 bp, D. melanogaster
ttgcaatatatat

SEQ ID NO: 668989 - DNA, 13 bp, D. melanogaster
ttgcaatatttaa

SEQ ID NO: 668990 - DNA, 14 bp, D. melanogaster
ttgcaatatttata

SEQ ID NO: 668991 - DNA, 14 bp, D. melanogaster
ttgcaatatttttt

SEQ ID NO: 668992 - DNA, 13 bp, D. melanogaster
ttgcaatcatttt

SEQ ID NO: 668993 - DNA, 13 bp, D. melanogaster
ttgcaatcctttt

SEQ ID NO: 668994 - DNA, 13 bp, D. melanogaster
ttgcaatcgaatt

SEQ ID NO: 668995 - DNA, 14 bp, D. melanogaster
ttgcaatcttcctc

SEQ ID NO: 668996 - DNA, 13 bp, D. melanogaster
ttgcaatgaaatt

SEQ ID NO: 668997 - DNA, 13 bp, D. melanogaster
ttgcaatgaattt

SEQ ID NO: 668998 - DNA, 13 bp, D. melanogaster
ttgcaatgcattt

SEQ ID NO: 668999 - DNA, 13 bp, D. melanogaster
ttgcaatgcgaaa

SEQ ID NO: 669000 - DNA, 13 bp, D. melanogaster
ttgcaatggaaaa

SEQ ID NO: 669001 - DNA, 13 bp, D. melanogaster
ttgcaatggcaaa

SEQ ID NO: 669002 - DNA, 13 bp, D. melanogaster
ttgcaattaaata

SEQ ID NO: 669003 - DNA, 13 bp, D. melanogaster
ttgcaattaaatc

SEQ ID NO: 669004 - DNA, 13 bp, D. melanogaster
ttgcaattaaatg

SEQ ID NO: 669005 - DNA, 14 bp, D. melanogaster
ttgcaattaaatgc

SEQ ID NO: 669006 - DNA, 13 bp, D. melanogaster
ttgcaattaaatt

SEQ ID NO: 669007 - DNA, 13 bp, D. melanogaster
ttgcaattaataa

SEQ ID NO: 669008 - DNA, 13 bp, D. melanogaster
ttgcaattaattt

SEQ ID NO: 669009 - DNA, 13 bp, D. melanogaster
ttgcaattactaa

SEQ ID NO: 669010 - DNA, 13 bp, D. melanogaster
ttgcaattacttt

SEQ ID NO: 669011 - DNA, 13 bp, D. melanogaster
ttgcaattagttt

SEQ ID NO: 669012 - DNA, 13 bp, D. melanogaster
ttgcaattattgt

SEQ ID NO: 669013 - DNA, 13 bp, D. melanogaster
ttgcaattattta

SEQ ID NO: 669014 - DNA, 13 bp, D. melanogaster
ttgcaattatttg

SEQ ID NO: 669015 - DNA, 13 bp, D. melanogaster
ttgcaattcaatt

SEQ ID NO: 669016 - DNA, 13 bp, D. melanogaster
ttgcaattcattt

SEQ ID NO: 669017 - DNA, 13 bp, D. melanogaster
ttgcaattgaaaa

SEQ ID NO: 669018 - DNA, 13 bp, D. melanogaster
ttgcaattgattt

SEQ ID NO: 669019 - DNA, 14 bp, D. melanogaster
ttgcaattgcaact

SEQ ID NO: 669020 - DNA, 13 bp, D. melanogaster
ttgcaattgcaat

SEQ ID NO: 669021 - DNA, 13 bp, D. melanogaster
ttgcaattgcatt

SEQ ID NO: 669022 - DNA, 13 bp, D. melanogaster
ttgcaattgccat

SEQ ID NO: 669023 - DNA, 13 bp, D. melanogaster
ttgcaattgcgaa

SEQ ID NO: 669024 - DNA, 13 bp, D. melanogaster
ttgcaattgcgat

SEQ ID NO: 669025 - DNA, 13 bp, D. melanogaster
ttgcaattgctgg

SEQ ID NO: 669026 - DNA, 13 bp, D. melanogaster
ttgcaattgcttt

SEQ ID NO: 669027 - DNA, 13 bp, D. melanogaster
ttgcaattggaaa

SEQ ID NO: 669028 - DNA, 13 bp, D. melanogaster
ttgcaattggaat

SEQ ID NO: 669029 - DNA, 14 bp, D. melanogaster
ttgcaattggaatt

SEQ ID NO: 669030 - DNA, 13 bp, D. melanogaster
ttgcaattgttgc

SEQ ID NO: 669031 - DNA, 13 bp, D. melanogaster
ttgcaattgttgt

SEQ ID NO: 669032 - DNA, 13 bp, D. melanogaster
ttgcaattgttta

SEQ ID NO: 669033 - DNA, 13 bp, D. melanogaster
ttgcaattgtttt

SEQ ID NO: 669034 - DNA, 13 bp, D. melanogaster
ttgcaatttaaat

SEQ ID NO: 669035 - DNA, 13 bp, D. melanogaster
ttgcaatttaatt

SEQ ID NO: 669036 - DNA, 14 bp, D. melanogaster
ttgcaatttaattt

SEQ ID NO: 669037 - DNA, 13 bp, D. melanogaster
ttgcaatttatat

SEQ ID NO: 669038 - DNA, 13 bp, D. melanogaster
ttgcaatttatca

SEQ ID NO: 669039 - DNA, 13 bp, D. melanogaster
ttgcaatttattc

SEQ ID NO: 669040 - DNA, 13 bp, D. melanogaster
ttgcaatttcatg

SEQ ID NO: 669041 - DNA, 14 bp, D. melanogaster
ttgcaatttgattt

SEQ ID NO: 669042 - DNA, 13 bp, D. melanogaster
ttgcaatttgcaa

SEQ ID NO: 669043 - DNA, 13 bp, D. melanogaster
ttgcaatttgcac

SEQ ID NO: 669044 - DNA, 13 bp, D. melanogaster
ttgcaatttgctg

SEQ ID NO: 669045 - DNA, 13 bp, D. melanogaster
ttgcaatttgttg

SEQ ID NO: 669046 - DNA, 13 bp, D. melanogaster
ttgcaatttgttt

SEQ ID NO: 669047 - DNA, 14 bp, D. melanogaster
ttgcaatttgtttg

SEQ ID NO: 669048 - DNA, 13 bp, D. melanogaster
ttgcaattttaaa

SEQ ID NO: 669049 - DNA, 13 bp, D. melanogaster
ttgcaattttaat

SEQ ID NO: 669050 - DNA, 14 bp, D. melanogaster
ttgcaattttacaa

SEQ ID NO: 669051 - DNA, 13 bp, D. melanogaster
ttgcaattttata

SEQ ID NO: 669052 - DNA, 13 bp, D. melanogaster
ttgcaattttatg

SEQ ID NO: 669053 - DNA, 14 bp, D. melanogaster
ttgcaattttattt

SEQ ID NO: 669054 - DNA, 13 bp, D. melanogaster
ttgcaattttgaa

SEQ ID NO: 669055 - DNA, 13 bp, D. melanogaster
ttgcaattttgca

SEQ ID NO: 669056 - DNA, 13 bp, D. melanogaster
ttgcaatttttat

SEQ ID NO: 669057 - DNA, 13 bp, D. melanogaster
ttgcaattttttg

SEQ ID NO: 669058 - DNA, 13 bp, D. melanogaster
ttgcacaaaaaaa

SEQ ID NO: 669059 - DNA, 13 bp, D. melanogaster
ttgcacaaaagtt

SEQ ID NO: 669060 - DNA, 13 bp, D. melanogaster
ttgcacaaaattt

SEQ ID NO: 669061 - DNA, 14 bp, D. melanogaster
ttgcacaaatattt

SEQ ID NO: 669062 - DNA, 13 bp, D. melanogaster
ttgcacaaatgca

SEQ ID NO: 669063 - DNA, 13 bp, D. melanogaster
ttgcacaaattgt

SEQ ID NO: 669064 - DNA, 13 bp, D. melanogaster
ttgcacaacaatt

SEQ ID NO: 669065 - DNA, 13 bp, D. melanogaster
ttgcacaactttt

SEQ ID NO: 669066 - DNA, 13 bp, D. melanogaster
ttgcacaataaaa

SEQ ID NO: 669067 - DNA, 13 bp, D. melanogaster
ttgcacaatattt

SEQ ID NO: 669068 - DNA, 13 bp, D. melanogaster
ttgcacaattatt

SEQ ID NO: 669069 - DNA, 13 bp, D. melanogaster
ttgcacaatttat

SEQ ID NO: 669070 - DNA, 13 bp, D. melanogaster
ttgcacacaattt

SEQ ID NO: 669071 - DNA, 13 bp, D. melanogaster
ttgcacacactca

SEQ ID NO: 669072 - DNA, 13 bp, D. melanogaster
ttgcacacatttt

SEQ ID NO: 669073 - DNA, 13 bp, D. melanogaster
ttgcacacttttt

SEQ ID NO: 669074 - DNA, 13 bp, D. melanogaster
ttgcacagaaaaa

SEQ ID NO: 669075 - DNA, 14 bp, D. melanogaster
ttgcacagaaaaaa

SEQ ID NO: 669076 - DNA, 13 bp, D. melanogaster
ttgcacagaaaat

SEQ ID NO: 669077 - DNA, 13 bp, D. melanogaster
ttgcacagcacat

SEQ ID NO: 669078 - DNA, 13 bp, D. melanogaster
ttgcacagcattt

SEQ ID NO: 669079 - DNA, 13 bp, D. melanogaster
ttgcacatacgcc

SEQ ID NO: 669080 - DNA, 13 bp, D. melanogaster
ttgcacatatata

SEQ ID NO: 669081 - DNA, 13 bp, D. melanogaster
ttgcacatatttt

SEQ ID NO: 669082 - DNA, 13 bp, D. melanogaster
ttgcacatgcaaa

SEQ ID NO: 669083 - DNA, 13 bp, D. melanogaster
ttgcacatttatt

SEQ ID NO: 669084 - DNA, 13 bp, D. melanogaster
ttgcacatttgca

SEQ ID NO: 669085 - DNA, 13 bp, D. melanogaster
ttgcacattttct

SEQ ID NO: 669086 - DNA, 13 bp, D. melanogaster
ttgcacattttgc

SEQ ID NO: 669087 - DNA, 13 bp, D. melanogaster
ttgcacatttttc

SEQ ID NO: 669088 - DNA, 13 bp, D. melanogaster
ttgcacatttttt

SEQ ID NO: 669089 - DNA, 13 bp, D. melanogaster
ttgcaccacccac

SEQ ID NO: 669090 - DNA, 13 bp, D. melanogaster
ttgcaccagctgc

SEQ ID NO: 669091 - DNA, 13 bp, D. melanogaster
ttgcaccattttt

SEQ ID NO: 669092 - DNA, 14 bp, D. melanogaster
ttgcacgcacacac

SEQ ID NO: 669093 - DNA, 14 bp, D. melanogaster
ttgcacgttttatt

SEQ ID NO: 669094 - DNA, 13 bp, D. melanogaster
ttgcactattttt

SEQ ID NO: 669095 - DNA, 13 bp, D. melanogaster
ttgcactcacaca

SEQ ID NO: 669096 - DNA, 13 bp, D. melanogaster
ttgcactcagaaa

SEQ ID NO: 669097 - DNA, 13 bp, D. melanogaster
ttgcactcgcaca

SEQ ID NO: 669098 - DNA, 13 bp, D. melanogaster
ttgcactgcactt

SEQ ID NO: 669099 - DNA, 13 bp, D. melanogaster
ttgcactgccact

SEQ ID NO: 669100 - DNA, 13 bp, D. melanogaster
ttgcactgcgtct

SEQ ID NO: 669101 - DNA, 13 bp, D. melanogaster
ttgcacttaaaat

SEQ ID NO: 669102 - DNA, 14 bp, D. melanogaster
ttgcacttaaaatt

SEQ ID NO: 669103 - DNA, 13 bp, D. melanogaster
ttgcacttaaatt

SEQ ID NO: 669104 - DNA, 13 bp, D. melanogaster
ttgcacttcaatt

SEQ ID NO: 669105 - DNA, 13 bp, D. melanogaster
ttgcacttcactt

SEQ ID NO: 669106 - DNA, 13 bp, D. melanogaster
ttgcacttgaaat

SEQ ID NO: 669107 - DNA, 13 bp, D. melanogaster
ttgcacttgcaac

SEQ ID NO: 669108 - DNA, 13 bp, D. melanogaster
ttgcacttgcact

SEQ ID NO: 669109 - DNA, 13 bp, D. melanogaster
ttgcacttgcagt

SEQ ID NO: 669110 - DNA, 13 bp, D. melanogaster
ttgcacttggaaa

SEQ ID NO: 669111 - DNA, 13 bp, D. melanogaster
ttgcacttggcac

SEQ ID NO: 669112 - DNA, 13 bp, D. melanogaster
ttgcactttaaat

SEQ ID NO: 669113 - DNA, 13 bp, D. melanogaster
ttgcactttaatt

SEQ ID NO: 669114 - DNA, 13 bp, D. melanogaster
ttgcactttccat

SEQ ID NO: 669115 - DNA, 13 bp, D. melanogaster
ttgcactttgatt

SEQ ID NO: 669116 - DNA, 13 bp, D. melanogaster
ttgcactttgcac

SEQ ID NO: 669117 - DNA, 13 bp, D. melanogaster
ttgcactttgctc

SEQ ID NO: 669118 - DNA, 13 bp, D. melanogaster
ttgcacttttaat

SEQ ID NO: 669119 - DNA, 13 bp, D. melanogaster
ttgcacttttgtt

SEQ ID NO: 669120 - DNA, 13 bp, D. melanogaster
ttgcactttttcc

SEQ ID NO: 669121 - DNA, 13 bp, D. melanogaster
ttgcactttttta

SEQ ID NO: 669122 - DNA, 14 bp, D. melanogaster
ttgcacttttttat

SEQ ID NO: 669123 - DNA, 13 bp, D. melanogaster
ttgcagaaaagtt

SEQ ID NO: 669124 - DNA, 13 bp, D. melanogaster
ttgcagaaacaaa

SEQ ID NO: 669125 - DNA, 13 bp, D. melanogaster
ttgcagaaagttg

SEQ ID NO: 669126 - DNA, 13 bp, D. melanogaster
ttgcagaataaaa

SEQ ID NO: 669127 - DNA, 13 bp, D. melanogaster
ttgcagaatgaat

SEQ ID NO: 669128 - DNA, 14 bp, D. melanogaster
ttgcagacggactt

SEQ ID NO: 669129 - DNA, 13 bp, D. melanogaster
ttgcagatacaaa

SEQ ID NO: 669130 - DNA, 14 bp, D. melanogaster
ttgcagatacattt

SEQ ID NO: 669131 - DNA, 13 bp, D. melanogaster
ttgcagatacttt

SEQ ID NO: 669132 - DNA, 13 bp, D. melanogaster
ttgcagatgcaaa

SEQ ID NO: 669133 - DNA, 13 bp, D. melanogaster
ttgcagcaaaaat

SEQ ID NO: 669134 - DNA, 13 bp, D. melanogaster
ttgcagcaaatgc

SEQ ID NO: 669135 - DNA, 14 bp, D. melanogaster
ttgcagcaacaaca

SEQ ID NO: 669136 - DNA, 13 bp, D. melanogaster
ttgcagcaattaa

SEQ ID NO: 669137 - DNA, 13 bp, D. melanogaster
ttgcagcaatttg

SEQ ID NO: 669138 - DNA, 13 bp, D. melanogaster
ttgcagcaccttt

SEQ ID NO: 669139 - DNA, 13 bp, D. melanogaster
ttgcagcagcaac

SEQ ID NO: 669140 - DNA, 13 bp, D. melanogaster
ttgcagcagctgc

SEQ ID NO: 669141 - DNA, 13 bp, D. melanogaster
ttgcagcaggcga

SEQ ID NO: 669142 - DNA, 13 bp, D. melanogaster
ttgcagcatgtgc

SEQ ID NO: 669143 - DNA, 13 bp, D. melanogaster
ttgcagcatttgc

SEQ ID NO: 669144 - DNA, 13 bp, D. melanogaster
ttgcagccaattg

SEQ ID NO: 669145 - DNA, 13 bp, D. melanogaster
ttgcagccataaa

SEQ ID NO: 669146 - DNA, 13 bp, D. melanogaster
ttgcagccatcaa

SEQ ID NO: 669147 - DNA, 14 bp, D. melanogaster
ttgcagccatcaat

SEQ ID NO: 669148 - DNA, 13 bp, D. melanogaster
ttgcagccgaaac

SEQ ID NO: 669149 - DNA, 13 bp, D. melanogaster
ttgcagctaaaat

SEQ ID NO: 669150 - DNA, 13 bp, D. melanogaster
ttgcagctcaagt

SEQ ID NO: 669151 - DNA, 13 bp, D. melanogaster
ttgcagctcattt

SEQ ID NO: 669152 - DNA, 13 bp, D. melanogaster
ttgcagctgacaa

SEQ ID NO: 669153 - DNA, 13 bp, D. melanogaster
ttgcagctgcaac

SEQ ID NO: 669154 - DNA, 13 bp, D. melanogaster
ttgcagctgcaat

SEQ ID NO: 669155 - DNA, 13 bp, D. melanogaster
ttgcagctgcatt

SEQ ID NO: 669156 - DNA, 14 bp, D. melanogaster
ttgcagctgccaca

SEQ ID NO: 669157 - DNA, 13 bp, D. melanogaster
ttgcagctgctgc

SEQ ID NO: 669158 - DNA, 13 bp, D. melanogaster
ttgcagctgctgt

SEQ ID NO: 669159 - DNA, 13 bp, D. melanogaster
ttgcagctgcttt

SEQ ID NO: 669160 - DNA, 13 bp, D. melanogaster
ttgcagctggaaa

SEQ ID NO: 669161 - DNA, 13 bp, D. melanogaster
ttgcagctggagt

SEQ ID NO: 669162 - DNA, 13 bp, D. melanogaster
ttgcagcttaaag

SEQ ID NO: 669163 - DNA, 13 bp, D. melanogaster
ttgcagcttaatg

SEQ ID NO: 669164 - DNA, 13 bp, D. melanogaster
ttgcagcttgcaa

SEQ ID NO: 669165 - DNA, 13 bp, D. melanogaster
ttgcagcttgcag

SEQ ID NO: 669166 - DNA, 13 bp, D. melanogaster
ttgcagctttaaa

SEQ ID NO: 669167 - DNA, 14 bp, D. melanogaster
ttgcagggcaataa

SEQ ID NO: 669168 - DNA, 13 bp, D. melanogaster
ttgcaggggctac

SEQ ID NO: 669169 - DNA, 13 bp, D. melanogaster
ttgcaggtgcact

SEQ ID NO: 669170 - DNA, 13 bp, D. melanogaster
ttgcaggttgctg

SEQ ID NO: 669171 - DNA, 13 bp, D. melanogaster
ttgcagtcgaaaa

SEQ ID NO: 669172 - DNA, 13 bp, D. melanogaster
ttgcagtcgcatt

SEQ ID NO: 669173 - DNA, 13 bp, D. melanogaster
ttgcagtgcaaat

SEQ ID NO: 669174 - DNA, 13 bp, D. melanogaster
ttgcagtgcactt

SEQ ID NO: 669175 - DNA, 13 bp, D. melanogaster
ttgcagtgcattg

SEQ ID NO: 669176 - DNA, 13 bp, D. melanogaster
ttgcagtgccaaa

SEQ ID NO: 669177 - DNA, 13 bp, D. melanogaster
ttgcagtggaaaa

SEQ ID NO: 669178 - DNA, 14 bp, D. melanogaster
ttgcagtggccaag

SEQ ID NO: 669179 - DNA, 13 bp, D. melanogaster
ttgcagttaatta

SEQ ID NO: 669180 - DNA, 13 bp, D. melanogaster
ttgcagttcgctt

SEQ ID NO: 669181 - DNA, 13 bp, D. melanogaster
ttgcagttgaaat

SEQ ID NO: 669182 - DNA, 14 bp, D. melanogaster
ttgcagttgaaata

SEQ ID NO: 669183 - DNA, 13 bp, D. melanogaster
ttgcagttgcaat

SEQ ID NO: 669184 - DNA, 14 bp, D. melanogaster
ttgcagttgcaatt

SEQ ID NO: 669185 - DNA, 13 bp, D. melanogaster
ttgcagttgcact

SEQ ID NO: 669186 - DNA, 14 bp, D. melanogaster
ttgcagttgcagct

SEQ ID NO: 669187 - DNA, 14 bp, D. melanogaster
ttgcagttgcagtc

SEQ ID NO: 669188 - DNA, 13 bp, D. melanogaster
ttgcagttgcatg

SEQ ID NO: 669189 - DNA, 13 bp, D. melanogaster
ttgcagttgcatt

SEQ ID NO: 669190 - DNA, 13 bp, D. melanogaster
ttgcagttgccaa

SEQ ID NO: 669191 - DNA, 14 bp, D. melanogaster
ttgcagttgctgct

SEQ ID NO: 669192 - DNA, 14 bp, D. melanogaster
ttgcagttggggat

SEQ ID NO: 669193 - DNA, 13 bp, D. melanogaster
ttgcagttgttgc

SEQ ID NO: 669194 - DNA, 14 bp, D. melanogaster
ttgcagttgttgca

SEQ ID NO: 669195 - DNA, 14 bp, D. melanogaster
ttgcagttgttgct

SEQ ID NO: 669196 - DNA, 13 bp, D. melanogaster
ttgcagttgttgt

SEQ ID NO: 669197 - DNA, 14 bp, D. melanogaster
ttgcagttgttttt

SEQ ID NO: 669198 - DNA, 13 bp, D. melanogaster
ttgcagtttaatg

SEQ ID NO: 669199 - DNA, 13 bp, D. melanogaster
ttgcagtttcagt

SEQ ID NO: 669200 - DNA, 14 bp, D. melanogaster
ttgcagtttgtttt

SEQ ID NO: 669201 - DNA, 13 bp, D. melanogaster
ttgcagttttctt

SEQ ID NO: 669202 - DNA, 13 bp, D. melanogaster
ttgcagtttttgg

SEQ ID NO: 669203 - DNA, 13 bp, D. melanogaster
ttgcataaaaaac

SEQ ID NO: 669204 - DNA, 13 bp, D. melanogaster
ttgcataaaatgc

SEQ ID NO: 669205 - DNA, 13 bp, D. melanogaster
ttgcataaaatta

SEQ ID NO: 669206 - DNA, 14 bp, D. melanogaster
ttgcataaacattt

SEQ ID NO: 669207 - DNA, 14 bp, D. melanogaster
ttgcataaataaat

SEQ ID NO: 669208 - DNA, 13 bp, D. melanogaster
ttgcataaatatt

SEQ ID NO: 669209 - DNA, 14 bp, D. melanogaster
ttgcataaatatta

SEQ ID NO: 669210 - DNA, 13 bp, D. melanogaster
ttgcataaatgaa

SEQ ID NO: 669211 - DNA, 13 bp, D. melanogaster
ttgcataaatgtt

SEQ ID NO: 669212 - DNA, 13 bp, D. melanogaster
ttgcataaattaa

SEQ ID NO: 669213 - DNA, 13 bp, D. melanogaster
ttgcataaattat

SEQ ID NO: 669214 - DNA, 13 bp, D. melanogaster
ttgcataaattca

SEQ ID NO: 669215 - DNA, 13 bp, D. melanogaster
ttgcataaattcc

SEQ ID NO: 669216 - DNA, 13 bp, D. melanogaster
ttgcataaattta

SEQ ID NO: 669217 - DNA, 13 bp, D. melanogaster
ttgcataaatttc

SEQ ID NO: 669218 - DNA, 13 bp, D. melanogaster
ttgcataaatttg

SEQ ID NO: 669219 - DNA, 13 bp, D. melanogaster
ttgcataaatttt

SEQ ID NO: 669220 - DNA, 13 bp, D. melanogaster
ttgcataacaaag

SEQ ID NO: 669221 - DNA, 13 bp, D. melanogaster
ttgcataacaaat

SEQ ID NO: 669222 - DNA, 13 bp, D. melanogaster
ttgcataacaaca

SEQ ID NO: 669223 - DNA, 13 bp, D. melanogaster
ttgcataacaatt

SEQ ID NO: 669224 - DNA, 13 bp, D. melanogaster
ttgcataacattt

SEQ ID NO: 669225 - DNA, 13 bp, D. melanogaster
ttgcataagaaat

SEQ ID NO: 669226 - DNA, 13 bp, D. melanogaster
ttgcataagcaaa

SEQ ID NO: 669227 - DNA, 14 bp, D. melanogaster
ttgcataataataa

SEQ ID NO: 669228 - DNA, 13 bp, D. melanogaster
ttgcataataatt

SEQ ID NO: 669229 - DNA, 13 bp, D. melanogaster
ttgcataatatat

SEQ ID NO: 669230 - DNA, 13 bp, D. melanogaster
ttgcataatcaaa

SEQ ID NO: 669231 - DNA, 13 bp, D. melanogaster
ttgcataattgtt

SEQ ID NO: 669232 - DNA, 13 bp, D. melanogaster
ttgcataatttaa

SEQ ID NO: 669233 - DNA, 13 bp, D. melanogaster
ttgcataatttac

SEQ ID NO: 669234 - DNA, 13 bp, D. melanogaster
ttgcataatttat

SEQ ID NO: 669235 - DNA, 14 bp, D. melanogaster
ttgcataatttatt

SEQ ID NO: 669236 - DNA, 13 bp, D. melanogaster
ttgcatacaattt

SEQ ID NO: 669237 - DNA, 14 bp, D. melanogaster
ttgcatacaatttg

SEQ ID NO: 669238 - DNA, 13 bp, D. melanogaster
ttgcatacatttc

SEQ ID NO: 669239 - DNA, 13 bp, D. melanogaster
ttgcatacatttg

SEQ ID NO: 669240 - DNA, 13 bp, D. melanogaster
ttgcataccaaaa

SEQ ID NO: 669241 - DNA, 13 bp, D. melanogaster
ttgcatacgaaat

SEQ ID NO: 669242 - DNA, 13 bp, D. melanogaster
ttgcatacgctcc

SEQ ID NO: 669243 - DNA, 13 bp, D. melanogaster
ttgcatacttatg

SEQ ID NO: 669244 - DNA, 13 bp, D. melanogaster
ttgcatacttgtg

SEQ ID NO: 669245 - DNA, 13 bp, D. melanogaster
ttgcatactttcg

SEQ ID NO: 669246 - DNA, 13 bp, D. melanogaster
ttgcatagttttt

SEQ ID NO: 669247 - DNA, 13 bp, D. melanogaster
ttgcatataaaat

SEQ ID NO: 669248 - DNA, 13 bp, D. melanogaster
ttgcatatacata

SEQ ID NO: 669249 - DNA, 13 bp, D. melanogaster
ttgcatatatatt

SEQ ID NO: 669250 - DNA, 13 bp, D. melanogaster
ttgcatatatttt

SEQ ID NO: 669251 - DNA, 13 bp, D. melanogaster
ttgcatatcaaaa

SEQ ID NO: 669252 - DNA, 13 bp, D. melanogaster
ttgcatatcgata

SEQ ID NO: 669253 - DNA, 13 bp, D. melanogaster
ttgcatatgaaaa

SEQ ID NO: 669254 - DNA, 13 bp, D. melanogaster
ttgcatatgtttt

SEQ ID NO: 669255 - DNA, 13 bp, D. melanogaster
ttgcatattaatg

SEQ ID NO: 669256 - DNA, 13 bp, D. melanogaster
ttgcatattattt

SEQ ID NO: 669257 - DNA, 13 bp, D. melanogaster
ttgcatattcatt

SEQ ID NO: 669258 - DNA, 13 bp, D. melanogaster
ttgcatattgttt

SEQ ID NO: 669259 - DNA, 13 bp, D. melanogaster
ttgcatatttaat

SEQ ID NO: 669260 - DNA, 13 bp, D. melanogaster
ttgcatatttata

SEQ ID NO: 669261 - DNA, 14 bp, D. melanogaster
ttgcatatttattg

SEQ ID NO: 669262 - DNA, 14 bp, D. melanogaster
ttgcatatttattt

SEQ ID NO: 669263 - DNA, 13 bp, D. melanogaster
ttgcatatttctg

SEQ ID NO: 669264 - DNA, 13 bp, D. melanogaster
ttgcatatttctt

SEQ ID NO: 669265 - DNA, 13 bp, D. melanogaster
ttgcatattttaa

SEQ ID NO: 669266 - DNA, 13 bp, D. melanogaster
ttgcatattttat

SEQ ID NO: 669267 - DNA, 13 bp, D. melanogaster
ttgcatattttca

SEQ ID NO: 669268 - DNA, 13 bp, D. melanogaster
ttgcatattttgc

SEQ ID NO: 669269 - DNA, 13 bp, D. melanogaster
ttgcatatttttc

SEQ ID NO: 669270 - DNA, 13 bp, D. melanogaster
ttgcatccacatc

SEQ ID NO: 669271 - DNA, 13 bp, D. melanogaster
ttgcatccttttt

SEQ ID NO: 669272 - DNA, 13 bp, D. melanogaster
ttgcatctgattt

SEQ ID NO: 669273 - DNA, 13 bp, D. melanogaster
ttgcatctgcaag

SEQ ID NO: 669274 - DNA, 13 bp, D. melanogaster
ttgcatctgtatc

SEQ ID NO: 669275 - DNA, 13 bp, D. melanogaster
ttgcatgaaaaat

SEQ ID NO: 669276 - DNA, 13 bp, D. melanogaster
ttgcatgattttt

SEQ ID NO: 669277 - DNA, 13 bp, D. melanogaster
ttgcatgcaaaca

SEQ ID NO: 669278 - DNA, 13 bp, D. melanogaster
ttgcatgcaaata

SEQ ID NO: 669279 - DNA, 13 bp, D. melanogaster
ttgcatgcaaatt

SEQ ID NO: 669280 - DNA, 14 bp, D. melanogaster
ttgcatgcaaattt

SEQ ID NO: 669281 - DNA, 13 bp, D. melanogaster
ttgcatgcaacac

SEQ ID NO: 669282 - DNA, 13 bp, D. melanogaster
ttgcatgcaactt

SEQ ID NO: 669283 - DNA, 13 bp, D. melanogaster
ttgcatgcataat

SEQ ID NO: 669284 - DNA, 13 bp, D. melanogaster
ttgcatgcatatt

SEQ ID NO: 669285 - DNA, 13 bp, D. melanogaster
ttgcatgcatttc

SEQ ID NO: 669286 - DNA, 13 bp, D. melanogaster
ttgcatgcatttg

SEQ ID NO: 669287 - DNA, 13 bp, D. melanogaster
ttgcatgcatttt

SEQ ID NO: 669288 - DNA, 13 bp, D. melanogaster
ttgcatgccaaac

SEQ ID NO: 669289 - DNA, 13 bp, D. melanogaster
ttgcatgccacaa

SEQ ID NO: 669290 - DNA, 13 bp, D. melanogaster
ttgcatgcgaaaa

SEQ ID NO: 669291 - DNA, 13 bp, D. melanogaster
ttgcatgcgaatt

SEQ ID NO: 669292 - DNA, 13 bp, D. melanogaster
ttgcatgcgattt

SEQ ID NO: 669293 - DNA, 13 bp, D. melanogaster
ttgcatggaaatt

SEQ ID NO: 669294 - DNA, 13 bp, D. melanogaster
ttgcatggaggga

SEQ ID NO: 669295 - DNA, 13 bp, D. melanogaster
ttgcatgtacata

SEQ ID NO: 669296 - DNA, 13 bp, D. melanogaster
ttgcatgtgaaat

SEQ ID NO: 669297 - DNA, 13 bp, D. melanogaster
ttgcatgtgcatt

SEQ ID NO: 669298 - DNA, 13 bp, D. melanogaster
ttgcatgtgccac

SEQ ID NO: 669299 - DNA, 13 bp, D. melanogaster
ttgcatgtggcag

SEQ ID NO: 669300 - DNA, 13 bp, D. melanogaster
ttgcatgtgtgcg

SEQ ID NO: 669301 - DNA, 13 bp, D. melanogaster
ttgcatgttaatt

SEQ ID NO: 669302 - DNA, 13 bp, D. melanogaster
ttgcattaaaatt

SEQ ID NO: 669303 - DNA, 14 bp, D. melanogaster
ttgcattaaaatta

SEQ ID NO: 669304 - DNA, 14 bp, D. melanogaster
ttgcattaaaattg

SEQ ID NO: 669305 - DNA, 13 bp, D. melanogaster
ttgcattaaacat

SEQ ID NO: 669306 - DNA, 13 bp, D. melanogaster
ttgcattaaatga

SEQ ID NO: 669307 - DNA, 13 bp, D. melanogaster
ttgcattaagtgc

SEQ ID NO: 669308 - DNA, 13 bp, D. melanogaster
ttgcattacattt

SEQ ID NO: 669309 - DNA, 13 bp, D. melanogaster
ttgcattatgatt

SEQ ID NO: 669310 - DNA, 13 bp, D. melanogaster
ttgcattattatt

SEQ ID NO: 669311 - DNA, 13 bp, D. melanogaster
ttgcattatttgt

SEQ ID NO: 669312 - DNA, 13 bp, D. melanogaster
ttgcattcaaatt

SEQ ID NO: 669313 - DNA, 14 bp, D. melanogaster
ttgcattcaaattg

SEQ ID NO: 669314 - DNA, 13 bp, D. melanogaster
ttgcattcaagtt

SEQ ID NO: 669315 - DNA, 14 bp, D. melanogaster
ttgcattcaagttt

SEQ ID NO: 669316 - DNA, 13 bp, D. melanogaster
ttgcattcaattt

SEQ ID NO: 669317 - DNA, 13 bp, D. melanogaster
ttgcattcatttt

SEQ ID NO: 669318 - DNA, 13 bp, D. melanogaster
ttgcattccaatt

SEQ ID NO: 669319 - DNA, 13 bp, D. melanogaster
ttgcattccactt

SEQ ID NO: 669320 - DNA, 13 bp, D. melanogaster
ttgcattccattt

SEQ ID NO: 669321 - DNA, 13 bp, D. melanogaster
ttgcattcgcaat

SEQ ID NO: 669322 - DNA, 13 bp, D. melanogaster
ttgcattcgcatt

SEQ ID NO: 669323 - DNA, 13 bp, D. melanogaster
ttgcattcgcttg

SEQ ID NO: 669324 - DNA, 13 bp, D. melanogaster
ttgcattcggttt

SEQ ID NO: 669325 - DNA, 13 bp, D. melanogaster
ttgcattgaaaac

SEQ ID NO: 669326 - DNA, 13 bp, D. melanogaster
ttgcattgaaaag

SEQ ID NO: 669327 - DNA, 13 bp, D. melanogaster
ttgcattgacatt

SEQ ID NO: 669328 - DNA, 13 bp, D. melanogaster
ttgcattgattaa

SEQ ID NO: 669329 - DNA, 13 bp, D. melanogaster
ttgcattgatttt

SEQ ID NO: 669330 - DNA, 13 bp, D. melanogaster
ttgcattgcaaat

SEQ ID NO: 669331 - DNA, 14 bp, D. melanogaster
ttgcattgcaaatt

SEQ ID NO: 669332 - DNA, 13 bp, D. melanogaster
ttgcattgcaatg

SEQ ID NO: 669333 - DNA, 13 bp, D. melanogaster
ttgcattgcataa

SEQ ID NO: 669334 - DNA, 13 bp, D. melanogaster
ttgcattgcattg

SEQ ID NO: 669335 - DNA, 13 bp, D. melanogaster
ttgcattgcccaa

SEQ ID NO: 669336 - DNA, 13 bp, D. melanogaster
ttgcattggaaaa

SEQ ID NO: 669337 - DNA, 13 bp, D. melanogaster
ttgcattggaaat

SEQ ID NO: 669338 - DNA, 13 bp, D. melanogaster
ttgcattggaatt

SEQ ID NO: 669339 - DNA, 13 bp, D. melanogaster
ttgcattggcatt

SEQ ID NO: 669340 - DNA, 13 bp, D. melanogaster
ttgcattgtattg

SEQ ID NO: 669341 - DNA, 13 bp, D. melanogaster
ttgcattgtctgc

SEQ ID NO: 669342 - DNA, 13 bp, D. melanogaster
ttgcattgtttgc

SEQ ID NO: 669343 - DNA, 14 bp, D. melanogaster
ttgcattgtttttg

SEQ ID NO: 669344 - DNA, 13 bp, D. melanogaster
ttgcatttaaaaa

SEQ ID NO: 669345 - DNA, 13 bp, D. melanogaster
ttgcatttaaatg

SEQ ID NO: 669346 - DNA, 14 bp, D. melanogaster
ttgcatttaaatgt

SEQ ID NO: 669347 - DNA, 13 bp, D. melanogaster
ttgcatttaagtt

SEQ ID NO: 669348 - DNA, 13 bp, D. melanogaster
ttgcatttaattg

SEQ ID NO: 669349 - DNA, 14 bp, D. melanogaster
ttgcatttaatttg

SEQ ID NO: 669350 - DNA, 13 bp, D. melanogaster
ttgcatttacaat

SEQ ID NO: 669351 - DNA, 13 bp, D. melanogaster
ttgcatttacata

SEQ ID NO: 669352 - DNA, 13 bp, D. melanogaster
ttgcatttacatt

SEQ ID NO: 669353 - DNA, 14 bp, D. melanogaster
ttgcatttacattt

SEQ ID NO: 669354 - DNA, 13 bp, D. melanogaster
ttgcatttacttt

SEQ ID NO: 669355 - DNA, 13 bp, D. melanogaster
ttgcatttagcat

SEQ ID NO: 669356 - DNA, 13 bp, D. melanogaster
ttgcatttataac

SEQ ID NO: 669357 - DNA, 13 bp, D. melanogaster
ttgcatttatatt

SEQ ID NO: 669358 - DNA, 14 bp, D. melanogaster
ttgcatttatattt

SEQ ID NO: 669359 - DNA, 13 bp, D. melanogaster
ttgcatttatgca

SEQ ID NO: 669360 - DNA, 14 bp, D. melanogaster
ttgcatttattttc

SEQ ID NO: 669361 - DNA, 13 bp, D. melanogaster
ttgcatttcaaag

SEQ ID NO: 669362 - DNA, 13 bp, D. melanogaster
ttgcatttcaatg

SEQ ID NO: 669363 - DNA, 13 bp, D. melanogaster
ttgcatttcacat

SEQ ID NO: 669364 - DNA, 13 bp, D. melanogaster
ttgcatttcagca

SEQ ID NO: 669365 - DNA, 13 bp, D. melanogaster
ttgcatttcatat

SEQ ID NO: 669366 - DNA, 13 bp, D. melanogaster
ttgcatttcatta

SEQ ID NO: 669367 - DNA, 13 bp, D. melanogaster
ttgcatttcattc

SEQ ID NO: 669368 - DNA, 13 bp, D. melanogaster
ttgcatttcattg

SEQ ID NO: 669369 - DNA, 13 bp, D. melanogaster
ttgcatttcattt

SEQ ID NO: 669370 - DNA, 13 bp, D. melanogaster
ttgcatttccaat

SEQ ID NO: 669371 - DNA, 13 bp, D. melanogaster
ttgcatttcccaa

SEQ ID NO: 669372 - DNA, 13 bp, D. melanogaster
ttgcatttcccat

SEQ ID NO: 669373 - DNA, 13 bp, D. melanogaster
ttgcatttccgct

SEQ ID NO: 669374 - DNA, 13 bp, D. melanogaster
ttgcatttcctgc

SEQ ID NO: 669375 - DNA, 13 bp, D. melanogaster
ttgcatttccttt

SEQ ID NO: 669376 - DNA, 13 bp, D. melanogaster
ttgcatttcgagc

SEQ ID NO: 669377 - DNA, 13 bp, D. melanogaster
ttgcatttcgatt

SEQ ID NO: 669378 - DNA, 14 bp, D. melanogaster
ttgcatttcgcatt

SEQ ID NO: 669379 - DNA, 13 bp, D. melanogaster
ttgcatttctcat

SEQ ID NO: 669380 - DNA, 13 bp, D. melanogaster
ttgcatttctcgt

SEQ ID NO: 669381 - DNA, 13 bp, D. melanogaster
ttgcatttctctt

SEQ ID NO: 669382 - DNA, 13 bp, D. melanogaster
ttgcatttcttgg

SEQ ID NO: 669383 - DNA, 13 bp, D. melanogaster
ttgcatttcttgt

SEQ ID NO: 669384 - DNA, 13 bp, D. melanogaster
ttgcatttgaaaa

SEQ ID NO: 669385 - DNA, 13 bp, D. melanogaster
ttgcatttgaatg

SEQ ID NO: 669386 - DNA, 13 bp, D. melanogaster
ttgcatttgacaa

SEQ ID NO: 669387 - DNA, 13 bp, D. melanogaster
ttgcatttgatta

SEQ ID NO: 669388 - DNA, 13 bp, D. melanogaster
ttgcatttgattt

SEQ ID NO: 669389 - DNA, 14 bp, D. melanogaster
ttgcatttgatttg

SEQ ID NO: 669390 - DNA, 14 bp, D. melanogaster
ttgcatttgcaatt

SEQ ID NO: 669391 - DNA, 13 bp, D. melanogaster
ttgcatttgcatc

SEQ ID NO: 669392 - DNA, 14 bp, D. melanogaster
ttgcatttgcatct

SEQ ID NO: 669393 - DNA, 14 bp, D. melanogaster
ttgcatttgcattt

SEQ ID NO: 669394 - DNA, 13 bp, D. melanogaster
ttgcatttgccaa

SEQ ID NO: 669395 - DNA, 13 bp, D. melanogaster
ttgcatttgccag

SEQ ID NO: 669396 - DNA, 13 bp, D. melanogaster
ttgcatttgctga

SEQ ID NO: 669397 - DNA, 13 bp, D. melanogaster
ttgcatttgctgc

SEQ ID NO: 669398 - DNA, 13 bp, D. melanogaster
ttgcatttgctgg

SEQ ID NO: 669399 - DNA, 14 bp, D. melanogaster
ttgcatttgctttt

SEQ ID NO: 669400 - DNA, 13 bp, D. melanogaster
ttgcatttggcag

SEQ ID NO: 669401 - DNA, 14 bp, D. melanogaster
ttgcatttggcatt

SEQ ID NO: 669402 - DNA, 13 bp, D. melanogaster
ttgcatttggctg

SEQ ID NO: 669403 - DNA, 13 bp, D. melanogaster
ttgcatttgtgca

SEQ ID NO: 669404 - DNA, 13 bp, D. melanogaster
ttgcatttgtggc

SEQ ID NO: 669405 - DNA, 13 bp, D. melanogaster
ttgcatttgtgtt

SEQ ID NO: 669406 - DNA, 14 bp, D. melanogaster
ttgcatttgttatt

SEQ ID NO: 669407 - DNA, 14 bp, D. melanogaster
ttgcatttgttgtt

SEQ ID NO: 669408 - DNA, 13 bp, D. melanogaster
ttgcatttgttta

SEQ ID NO: 669409 - DNA, 13 bp, D. melanogaster
ttgcattttaaac

SEQ ID NO: 669410 - DNA, 13 bp, D. melanogaster
ttgcattttaaag

SEQ ID NO: 669411 - DNA, 13 bp, D. melanogaster
ttgcattttaagc

SEQ ID NO: 669412 - DNA, 13 bp, D. melanogaster
ttgcattttaatg

SEQ ID NO: 669413 - DNA, 13 bp, D. melanogaster
ttgcattttaatt

SEQ ID NO: 669414 - DNA, 13 bp, D. melanogaster
ttgcattttacag

SEQ ID NO: 669415 - DNA, 13 bp, D. melanogaster
ttgcattttagtt

SEQ ID NO: 669416 - DNA, 13 bp, D. melanogaster
ttgcattttataa

SEQ ID NO: 669417 - DNA, 13 bp, D. melanogaster
ttgcattttatat

SEQ ID NO: 669418 - DNA, 13 bp, D. melanogaster
ttgcattttatgt

SEQ ID NO: 669419 - DNA, 13 bp, D. melanogaster
ttgcattttattc

SEQ ID NO: 669420 - DNA, 13 bp, D. melanogaster
ttgcattttcaac

SEQ ID NO: 669421 - DNA, 14 bp, D. melanogaster
ttgcattttcaatt

SEQ ID NO: 669422 - DNA, 13 bp, D. melanogaster
ttgcattttcata

SEQ ID NO: 669423 - DNA, 13 bp, D. melanogaster
ttgcattttcatg

SEQ ID NO: 669424 - DNA, 13 bp, D. melanogaster
ttgcattttcatt

SEQ ID NO: 669425 - DNA, 13 bp, D. melanogaster
ttgcattttcctg

SEQ ID NO: 669426 - DNA, 13 bp, D. melanogaster
ttgcattttcctt

SEQ ID NO: 669427 - DNA, 14 bp, D. melanogaster
ttgcattttgattt

SEQ ID NO: 669428 - DNA, 13 bp, D. melanogaster
ttgcattttgcag

SEQ ID NO: 669429 - DNA, 13 bp, D. melanogaster
ttgcattttgctg

SEQ ID NO: 669430 - DNA, 13 bp, D. melanogaster
ttgcattttgtat

SEQ ID NO: 669431 - DNA, 13 bp, D. melanogaster
ttgcattttgtta

SEQ ID NO: 669432 - DNA, 13 bp, D. melanogaster
ttgcattttgttg

SEQ ID NO: 669433 - DNA, 13 bp, D. melanogaster
ttgcatttttaac

SEQ ID NO: 669434 - DNA, 13 bp, D. melanogaster
ttgcatttttacg

SEQ ID NO: 669435 - DNA, 13 bp, D. melanogaster
ttgcatttttcca

SEQ ID NO: 669436 - DNA, 13 bp, D. melanogaster
ttgcatttttcct

SEQ ID NO: 669437 - DNA, 13 bp, D. melanogaster
ttgcatttttgaa

SEQ ID NO: 669438 - DNA, 14 bp, D. melanogaster
ttgcattttttata

SEQ ID NO: 669439 - DNA, 14 bp, D. melanogaster
ttgcattttttgtg

SEQ ID NO: 669440 - DNA, 13 bp, D. melanogaster
ttgccaaaaaaat

SEQ ID NO: 669441 - DNA, 14 bp, D. melanogaster
ttgccaaaaaatca

SEQ ID NO: 669442 - DNA, 13 bp, D. melanogaster
ttgccaaaaaatg

SEQ ID NO: 669443 - DNA, 13 bp, D. melanogaster
ttgccaaaaacaa

SEQ ID NO: 669444 - DNA, 14 bp, D. melanogaster
ttgccaaaaacaat

SEQ ID NO: 669445 - DNA, 13 bp, D. melanogaster
ttgccaaaaactt

SEQ ID NO: 669446 - DNA, 14 bp, D. melanogaster
ttgccaaaaacttt

SEQ ID NO: 669447 - DNA, 13 bp, D. melanogaster
ttgccaaaaagaa

SEQ ID NO: 669448 - DNA, 13 bp, D. melanogaster
ttgccaaaaagtt

SEQ ID NO: 669449 - DNA, 14 bp, D. melanogaster
ttgccaaaaataaa

SEQ ID NO: 669450 - DNA, 13 bp, D. melanogaster
ttgccaaaaatcg

SEQ ID NO: 669451 - DNA, 13 bp, D. melanogaster
ttgccaaaaatct

SEQ ID NO: 669452 - DNA, 13 bp, D. melanogaster
ttgccaaaaattg

SEQ ID NO: 669453 - DNA, 13 bp, D. melanogaster
ttgccaaaaattt

SEQ ID NO: 669454 - DNA, 13 bp, D. melanogaster
ttgccaaaacgaa

SEQ ID NO: 669455 - DNA, 13 bp, D. melanogaster
ttgccaaaagaaa

SEQ ID NO: 669456 - DNA, 13 bp, D. melanogaster
ttgccaaaagcaa

SEQ ID NO: 669457 - DNA, 13 bp, D. melanogaster
ttgccaaaagcag

SEQ ID NO: 669458 - DNA, 13 bp, D. melanogaster
ttgccaaaaggcg

SEQ ID NO: 669459 - DNA, 13 bp, D. melanogaster
ttgccaaaatata

SEQ ID NO: 669460 - DNA, 13 bp, D. melanogaster
ttgccaaaatatt

SEQ ID NO: 669461 - DNA, 14 bp, D. melanogaster
ttgccaaaatgaaa

SEQ ID NO: 669462 - DNA, 13 bp, D. melanogaster
ttgccaaaatgca

SEQ ID NO: 669463 - DNA, 13 bp, D. melanogaster
ttgccaaaatgcc

SEQ ID NO: 669464 - DNA, 13 bp, D. melanogaster
ttgccaaaatgtt

SEQ ID NO: 669465 - DNA, 13 bp, D. melanogaster
ttgccaaaattaa

SEQ ID NO: 669466 - DNA, 14 bp, D. melanogaster
ttgccaaaattaaa

SEQ ID NO: 669467 - DNA, 13 bp, D. melanogaster
ttgccaaaattca

SEQ ID NO: 669468 - DNA, 14 bp, D. melanogaster
ttgccaaaattcaa

SEQ ID NO: 669469 - DNA, 13 bp, D. melanogaster
ttgccaaacaaaa

SEQ ID NO: 669470 - DNA, 13 bp, D. melanogaster
ttgccaaacaaat

SEQ ID NO: 669471 - DNA, 14 bp, D. melanogaster
ttgccaaacaaatt

SEQ ID NO: 669472 - DNA, 13 bp, D. melanogaster
ttgccaaacaact

SEQ ID NO: 669473 - DNA, 13 bp, D. melanogaster
ttgccaaacattt

SEQ ID NO: 669474 - DNA, 14 bp, D. melanogaster
ttgccaaacatttt

SEQ ID NO: 669475 - DNA, 13 bp, D. melanogaster
ttgccaaacgaaa

SEQ ID NO: 669476 - DNA, 13 bp, D. melanogaster
ttgccaaactgaa

SEQ ID NO: 669477 - DNA, 13 bp, D. melanogaster
ttgccaaagaaat

SEQ ID NO: 669478 - DNA, 13 bp, D. melanogaster
ttgccaaagcaaa

SEQ ID NO: 669479 - DNA, 13 bp, D. melanogaster
ttgccaaagccaa

SEQ ID NO: 669480 - DNA, 13 bp, D. melanogaster
ttgccaaagctga

SEQ ID NO: 669481 - DNA, 13 bp, D. melanogaster
ttgccaaagcttt

SEQ ID NO: 669482 - DNA, 13 bp, D. melanogaster
ttgccaaagtttt

SEQ ID NO: 669483 - DNA, 13 bp, D. melanogaster
ttgccaaatattg

SEQ ID NO: 669484 - DNA, 13 bp, D. melanogaster
ttgccaaatcaaa

SEQ ID NO: 669485 - DNA, 13 bp, D. melanogaster
ttgccaaatcgaa

SEQ ID NO: 669486 - DNA, 13 bp, D. melanogaster
ttgccaaatcgat

SEQ ID NO: 669487 - DNA, 14 bp, D. melanogaster
ttgccaaatcgatt

SEQ ID NO: 669488 - DNA, 13 bp, D. melanogaster
ttgccaaatgcaa

SEQ ID NO: 669489 - DNA, 13 bp, D. melanogaster
ttgccaaatgcag

SEQ ID NO: 669490 - DNA, 13 bp, D. melanogaster
ttgccaaatggcc

SEQ ID NO: 669491 - DNA, 13 bp, D. melanogaster
ttgccaaatgttg

SEQ ID NO: 669492 - DNA, 13 bp, D. melanogaster
ttgccaaattaaa

SEQ ID NO: 669493 - DNA, 13 bp, D. melanogaster
ttgccaaattaat

SEQ ID NO: 669494 - DNA, 13 bp, D. melanogaster
ttgccaaattgaa

SEQ ID NO: 669495 - DNA, 13 bp, D. melanogaster
ttgccaaattgat

SEQ ID NO: 669496 - DNA, 13 bp, D. melanogaster
ttgccaaattgct

SEQ ID NO: 669497 - DNA, 13 bp, D. melanogaster
ttgccaaatttgt

SEQ ID NO: 669498 - DNA, 13 bp, D. melanogaster
ttgccaaattttt

SEQ ID NO: 669499 - DNA, 13 bp, D. melanogaster
ttgccaacaaaaa

SEQ ID NO: 669500 - DNA, 13 bp, D. melanogaster
ttgccaacaacaa

SEQ ID NO: 669501 - DNA, 13 bp, D. melanogaster
ttgccaacaatta

SEQ ID NO: 669502 - DNA, 13 bp, D. melanogaster
ttgccaacaattt

SEQ ID NO: 669503 - DNA, 13 bp, D. melanogaster
ttgccaacacttt

SEQ ID NO: 669504 - DNA, 13 bp, D. melanogaster
ttgccaactaatt

SEQ ID NO: 669505 - DNA, 13 bp, D. melanogaster
ttgccaactattt

SEQ ID NO: 669506 - DNA, 13 bp, D. melanogaster
ttgccaactcatt

SEQ ID NO: 669507 - DNA, 13 bp, D. melanogaster
ttgccaactggca

SEQ ID NO: 669508 - DNA, 13 bp, D. melanogaster
ttgccaactgttt

SEQ ID NO: 669509 - DNA, 13 bp, D. melanogaster
ttgccaacttggc

SEQ ID NO: 669510 - DNA, 13 bp, D. melanogaster
ttgccaacttgtt

SEQ ID NO: 669511 - DNA, 13 bp, D. melanogaster
ttgccaactttgc

SEQ ID NO: 669512 - DNA, 13 bp, D. melanogaster
ttgccaacttttt

SEQ ID NO: 669513 - DNA, 13 bp, D. melanogaster
ttgccaagaaaaa

SEQ ID NO: 669514 - DNA, 13 bp, D. melanogaster
ttgccaagaaaat

SEQ ID NO: 669515 - DNA, 13 bp, D. melanogaster
ttgccaagcaaaa

SEQ ID NO: 669516 - DNA, 13 bp, D. melanogaster
ttgccaagcaaat

SEQ ID NO: 669517 - DNA, 13 bp, D. melanogaster
ttgccaagctaaa

SEQ ID NO: 669518 - DNA, 13 bp, D. melanogaster
ttgccaaggaaaa

SEQ ID NO: 669519 - DNA, 13 bp, D. melanogaster
ttgccaaggcaaa

SEQ ID NO: 669520 - DNA, 13 bp, D. melanogaster
ttgccaaggctgg

SEQ ID NO: 669521 - DNA, 13 bp, D. melanogaster
ttgccaagtgcaa

SEQ ID NO: 669522 - DNA, 13 bp, D. melanogaster
ttgccaagtgcag

SEQ ID NO: 669523 - DNA, 13 bp, D. melanogaster
ttgccaagtggca

SEQ ID NO: 669524 - DNA, 13 bp, D. melanogaster
ttgccaagttgcc

SEQ ID NO: 669525 - DNA, 13 bp, D. melanogaster
ttgccaagttggc

SEQ ID NO: 669526 - DNA, 13 bp, D. melanogaster
ttgccaagtttat

SEQ ID NO: 669527 - DNA, 13 bp, D. melanogaster
ttgccaataaatc

SEQ ID NO: 669528 - DNA, 13 bp, D. melanogaster
ttgccaatatgct

SEQ ID NO: 669529 - DNA, 13 bp, D. melanogaster
ttgccaatgcatt

SEQ ID NO: 669530 - DNA, 13 bp, D. melanogaster
ttgccaatgccaa

SEQ ID NO: 669531 - DNA, 14 bp, D. melanogaster
ttgccaatgccatt

SEQ ID NO: 669532 - DNA, 13 bp, D. melanogaster
ttgccaatggcaa

SEQ ID NO: 669533 - DNA, 13 bp, D. melanogaster
ttgccaattaaaa

SEQ ID NO: 669534 - DNA, 13 bp, D. melanogaster
ttgccaattattt

SEQ ID NO: 669535 - DNA, 13 bp, D. melanogaster
ttgccaattgaaa

SEQ ID NO: 669536 - DNA, 13 bp, D. melanogaster
ttgccaattggct

SEQ ID NO: 669537 - DNA, 13 bp, D. melanogaster
ttgccaattgtaa

SEQ ID NO: 669538 - DNA, 13 bp, D. melanogaster
ttgccaatttaat

SEQ ID NO: 669539 - DNA, 14 bp, D. melanogaster
ttgccaatttaatt

SEQ ID NO: 669540 - DNA, 13 bp, D. melanogaster
ttgccaatttata

SEQ ID NO: 669541 - DNA, 13 bp, D. melanogaster
ttgccaatttatt

SEQ ID NO: 669542 - DNA, 13 bp, D. melanogaster
ttgccaatttcct

SEQ ID NO: 669543 - DNA, 13 bp, D. melanogaster
ttgccaatttcta

SEQ ID NO: 669544 - DNA, 14 bp, D. melanogaster
ttgccaatttctat

SEQ ID NO: 669545 - DNA, 13 bp, D. melanogaster
ttgccaatttgaa

SEQ ID NO: 669546 - DNA, 13 bp, D. melanogaster
ttgccaatttgtt

SEQ ID NO: 669547 - DNA, 13 bp, D. melanogaster
ttgccaattttaa

SEQ ID NO: 669548 - DNA, 13 bp, D. melanogaster
ttgccaattttca

SEQ ID NO: 669549 - DNA, 13 bp, D. melanogaster
ttgccaattttcg

SEQ ID NO: 669550 - DNA, 13 bp, D. melanogaster
ttgccaatttttg

SEQ ID NO: 669551 - DNA, 13 bp, D. melanogaster
ttgccaatttttt

SEQ ID NO: 669552 - DNA, 13 bp, D. melanogaster
ttgccacaaaact

SEQ ID NO: 669553 - DNA, 13 bp, D. melanogaster
ttgccacaaaagt

SEQ ID NO: 669554 - DNA, 13 bp, D. melanogaster
ttgccacaaaata

SEQ ID NO: 669555 - DNA, 13 bp, D. melanogaster
ttgccacaaaatg

SEQ ID NO: 669556 - DNA, 13 bp, D. melanogaster
ttgccacaacttt

SEQ ID NO: 669557 - DNA, 13 bp, D. melanogaster
ttgccacacaaat

SEQ ID NO: 669558 - DNA, 14 bp, D. melanogaster
ttgccacacccact

SEQ ID NO: 669559 - DNA, 13 bp, D. melanogaster
ttgccacagcaca

SEQ ID NO: 669560 - DNA, 13 bp, D. melanogaster
ttgccacagctgc

SEQ ID NO: 669561 - DNA, 13 bp, D. melanogaster
ttgccacatattt

SEQ ID NO: 669562 - DNA, 13 bp, D. melanogaster
ttgccacatgcat

SEQ ID NO: 669563 - DNA, 13 bp, D. melanogaster
ttgccacatttca

SEQ ID NO: 669564 - DNA, 13 bp, D. melanogaster
ttgccaccaaaaa

SEQ ID NO: 669565 - DNA, 13 bp, D. melanogaster
ttgccaccaccac

SEQ ID NO: 669566 - DNA, 13 bp, D. melanogaster
ttgccaccaccca

SEQ ID NO: 669567 - DNA, 13 bp, D. melanogaster
ttgccacccacaa

SEQ ID NO: 669568 - DNA, 13 bp, D. melanogaster
ttgccacccactc

SEQ ID NO: 669569 - DNA, 13 bp, D. melanogaster
ttgccaccttttc

SEQ ID NO: 669570 - DNA, 13 bp, D. melanogaster
ttgccacgcccaa

SEQ ID NO: 669571 - DNA, 14 bp, D. melanogaster
ttgccacgcccacc

SEQ ID NO: 669572 - DNA, 13 bp, D. melanogaster
ttgccacgccccc

SEQ ID NO: 669573 - DNA, 13 bp, D. melanogaster
ttgccacgcccct

SEQ ID NO: 669574 - DNA, 13 bp, D. melanogaster
ttgccacgccctc

SEQ ID NO: 669575 - DNA, 14 bp, D. melanogaster
ttgccacgcctact

SEQ ID NO: 669576 - DNA, 13 bp, D. melanogaster
ttgccacgtccac

SEQ ID NO: 669577 - DNA, 13 bp, D. melanogaster
ttgccactatttt

SEQ ID NO: 669578 - DNA, 13 bp, D. melanogaster
ttgccactcgact

SEQ ID NO: 669579 - DNA, 13 bp, D. melanogaster
ttgccactgcaat

SEQ ID NO: 669580 - DNA, 13 bp, D. melanogaster
ttgccactgccgc

SEQ ID NO: 669581 - DNA, 13 bp, D. melanogaster
ttgccactgctgc

SEQ ID NO: 669582 - DNA, 13 bp, D. melanogaster
ttgccacttcatt

SEQ ID NO: 669583 - DNA, 14 bp, D. melanogaster
ttgccacttgccac

SEQ ID NO: 669584 - DNA, 13 bp, D. melanogaster
ttgccacttgttt

SEQ ID NO: 669585 - DNA, 13 bp, D. melanogaster
ttgccactttcaa

SEQ ID NO: 669586 - DNA, 13 bp, D. melanogaster
ttgccactttcca

SEQ ID NO: 669587 - DNA, 13 bp, D. melanogaster
ttgccactttgca

SEQ ID NO: 669588 - DNA, 13 bp, D. melanogaster
ttgccactttgcc

SEQ ID NO: 669589 - DNA, 13 bp, D. melanogaster
ttgccacttttat

SEQ ID NO: 669590 - DNA, 13 bp, D. melanogaster
ttgccagagaaaa

SEQ ID NO: 669591 - DNA, 13 bp, D. melanogaster
ttgccagatgaca

SEQ ID NO: 669592 - DNA, 14 bp, D. melanogaster
ttgccagatgacaa

SEQ ID NO: 669593 - DNA, 13 bp, D. melanogaster
ttgccagcaaaaa

SEQ ID NO: 669594 - DNA, 13 bp, D. melanogaster
ttgccagcaaatt

SEQ ID NO: 669595 - DNA, 13 bp, D. melanogaster
ttgccagcaacat

SEQ ID NO: 669596 - DNA, 13 bp, D. melanogaster
ttgccagcaatta

SEQ ID NO: 669597 - DNA, 13 bp, D. melanogaster
ttgccagcaattt

SEQ ID NO: 669598 - DNA, 13 bp, D. melanogaster
ttgccagcacaaa

SEQ ID NO: 669599 - DNA, 13 bp, D. melanogaster
ttgccagcacttt

SEQ ID NO: 669600 - DNA, 13 bp, D. melanogaster
ttgccagcagctg

SEQ ID NO: 669601 - DNA, 13 bp, D. melanogaster
ttgccagcatttc

SEQ ID NO: 669602 - DNA, 13 bp, D. melanogaster
ttgccagccaact

SEQ ID NO: 669603 - DNA, 14 bp, D. melanogaster
ttgccagccaactc

SEQ ID NO: 669604 - DNA, 13 bp, D. melanogaster
ttgccagccaagt

SEQ ID NO: 669605 - DNA, 13 bp, D. melanogaster
ttgccagccagcc

SEQ ID NO: 669606 - DNA, 13 bp, D. melanogaster
ttgccagccattc

SEQ ID NO: 669607 - DNA, 13 bp, D. melanogaster
ttgccagcccaag

SEQ ID NO: 669608 - DNA, 13 bp, D. melanogaster
ttgccagccttct

SEQ ID NO: 669609 - DNA, 13 bp, D. melanogaster
ttgccagcggcaa

SEQ ID NO: 669610 - DNA, 13 bp, D. melanogaster
ttgccagctcagc

SEQ ID NO: 669611 - DNA, 13 bp, D. melanogaster
ttgccagctgctg

SEQ ID NO: 669612 - DNA, 13 bp, D. melanogaster
ttgccagcttgcc

SEQ ID NO: 669613 - DNA, 13 bp, D. melanogaster
ttgccagcttttc

SEQ ID NO: 669614 - DNA, 13 bp, D. melanogaster
ttgccagcttttt

SEQ ID NO: 669615 - DNA, 13 bp, D. melanogaster
ttgccaggacaac

SEQ ID NO: 669616 - DNA, 13 bp, D. melanogaster
ttgccaggacatg

SEQ ID NO: 669617 - DNA, 13 bp, D. melanogaster
ttgccaggacctg

SEQ ID NO: 669618 - DNA, 14 bp, D. melanogaster
ttgccaggacctgg

SEQ ID NO: 669619 - DNA, 13 bp, D. melanogaster
ttgccaggcagct

SEQ ID NO: 669620 - DNA, 13 bp, D. melanogaster
ttgccagtcgcat

SEQ ID NO: 669621 - DNA, 13 bp, D. melanogaster
ttgccagtgcatt

SEQ ID NO: 669622 - DNA, 13 bp, D. melanogaster
ttgccagttgcaa

SEQ ID NO: 669623 - DNA, 13 bp, D. melanogaster
ttgccagttgcca

SEQ ID NO: 669624 - DNA, 13 bp, D. melanogaster
ttgccagttgctg

SEQ ID NO: 669625 - DNA, 13 bp, D. melanogaster
ttgccagttggcc

SEQ ID NO: 669626 - DNA, 13 bp, D. melanogaster
ttgccagtttgtt

SEQ ID NO: 669627 - DNA, 13 bp, D. melanogaster
ttgccagttttcc

SEQ ID NO: 669628 - DNA, 13 bp, D. melanogaster
ttgccagtttttg

SEQ ID NO: 669629 - DNA, 13 bp, D. melanogaster
ttgccataaaatc

SEQ ID NO: 669630 - DNA, 14 bp, D. melanogaster
ttgccataaataaa

SEQ ID NO: 669631 - DNA, 13 bp, D. melanogaster
ttgccataaattt

SEQ ID NO: 669632 - DNA, 13 bp, D. melanogaster
ttgccataccaat

SEQ ID NO: 669633 - DNA, 13 bp, D. melanogaster
ttgccatagtttg

SEQ ID NO: 669634 - DNA, 13 bp, D. melanogaster
ttgccatatatgt

SEQ ID NO: 669635 - DNA, 14 bp, D. melanogaster
ttgccatatatgta

SEQ ID NO: 669636 - DNA, 13 bp, D. melanogaster
ttgccatatttgt

SEQ ID NO: 669637 - DNA, 13 bp, D. melanogaster
ttgccatattttt

SEQ ID NO: 669638 - DNA, 13 bp, D. melanogaster
ttgccatcaatta

SEQ ID NO: 669639 - DNA, 13 bp, D. melanogaster
ttgccatcaattt

SEQ ID NO: 669640 - DNA, 13 bp, D. melanogaster
ttgccatcatcat

SEQ ID NO: 669641 - DNA, 13 bp, D. melanogaster
ttgccatccattt

SEQ ID NO: 669642 - DNA, 13 bp, D. melanogaster
ttgccatcgaaat

SEQ ID NO: 669643 - DNA, 13 bp, D. melanogaster
ttgccatcgattt

SEQ ID NO: 669644 - DNA, 14 bp, D. melanogaster
ttgccatcgccatc

SEQ ID NO: 669645 - DNA, 13 bp, D. melanogaster
ttgccatgcaatt

SEQ ID NO: 669646 - DNA, 13 bp, D. melanogaster
ttgccatgcccac

SEQ ID NO: 669647 - DNA, 13 bp, D. melanogaster
ttgccatggaaat

SEQ ID NO: 669648 - DNA, 13 bp, D. melanogaster
ttgccatggcagc

SEQ ID NO: 669649 - DNA, 13 bp, D. melanogaster
ttgccatggccaa

SEQ ID NO: 669650 - DNA, 13 bp, D. melanogaster
ttgccattaaaaa

SEQ ID NO: 669651 - DNA, 13 bp, D. melanogaster
ttgccattaatta

SEQ ID NO: 669652 - DNA, 13 bp, D. melanogaster
ttgccattaccat

SEQ ID NO: 669653 - DNA, 13 bp, D. melanogaster
ttgccattattat

SEQ ID NO: 669654 - DNA, 13 bp, D. melanogaster
ttgccattatttt

SEQ ID NO: 669655 - DNA, 13 bp, D. melanogaster
ttgccattcaatt

SEQ ID NO: 669656 - DNA, 13 bp, D. melanogaster
ttgccattcccat

SEQ ID NO: 669657 - DNA, 13 bp, D. melanogaster
ttgccattcgatt

SEQ ID NO: 669658 - DNA, 13 bp, D. melanogaster
ttgccattcgcca

SEQ ID NO: 669659 - DNA, 13 bp, D. melanogaster
ttgccattcgttt

SEQ ID NO: 669660 - DNA, 13 bp, D. melanogaster
ttgccattctctg

SEQ ID NO: 669661 - DNA, 13 bp, D. melanogaster
ttgccattgaatt

SEQ ID NO: 669662 - DNA, 13 bp, D. melanogaster
ttgccattgcaat

SEQ ID NO: 669663 - DNA, 13 bp, D. melanogaster
ttgccattgcatt

SEQ ID NO: 669664 - DNA, 13 bp, D. melanogaster
ttgccattgccac

SEQ ID NO: 669665 - DNA, 13 bp, D. melanogaster
ttgccattgccag

SEQ ID NO: 669666 - DNA, 13 bp, D. melanogaster
ttgccattgccat

SEQ ID NO: 669667 - DNA, 13 bp, D. melanogaster
ttgccattgcccc

SEQ ID NO: 669668 - DNA, 13 bp, D. melanogaster
ttgccattgccgt

SEQ ID NO: 669669 - DNA, 14 bp, D. melanogaster
ttgccattgccgtt

SEQ ID NO: 669670 - DNA, 13 bp, D. melanogaster
ttgccattgcctt

SEQ ID NO: 669671 - DNA, 14 bp, D. melanogaster
ttgccattgccttt

SEQ ID NO: 669672 - DNA, 13 bp, D. melanogaster
ttgccattgctgt

SEQ ID NO: 669673 - DNA, 13 bp, D. melanogaster
ttgccattggcat

SEQ ID NO: 669674 - DNA, 13 bp, D. melanogaster
ttgccattgtcct

SEQ ID NO: 669675 - DNA, 13 bp, D. melanogaster
ttgccattgtggc

SEQ ID NO: 669676 - DNA, 13 bp, D. melanogaster
ttgccattgttgt

SEQ ID NO: 669677 - DNA, 13 bp, D. melanogaster
ttgccatttaaat

SEQ ID NO: 669678 - DNA, 13 bp, D. melanogaster
ttgccatttacca

SEQ ID NO: 669679 - DNA, 13 bp, D. melanogaster
ttgccatttagtt

SEQ ID NO: 669680 - DNA, 13 bp, D. melanogaster
ttgccatttcgaa

SEQ ID NO: 669681 - DNA, 13 bp, D. melanogaster
ttgccatttcgca

SEQ ID NO: 669682 - DNA, 13 bp, D. melanogaster
ttgccatttctga

SEQ ID NO: 669683 - DNA, 14 bp, D. melanogaster
ttgccatttgattt

SEQ ID NO: 669684 - DNA, 13 bp, D. melanogaster
ttgccatttgccg

SEQ ID NO: 669685 - DNA, 13 bp, D. melanogaster
ttgccatttgcct

SEQ ID NO: 669686 - DNA, 13 bp, D. melanogaster
ttgccatttggca

SEQ ID NO: 669687 - DNA, 13 bp, D. melanogaster
ttgccatttggcg

SEQ ID NO: 669688 - DNA, 13 bp, D. melanogaster
ttgccatttgttg

SEQ ID NO: 669689 - DNA, 13 bp, D. melanogaster
ttgccatttgttt

SEQ ID NO: 669690 - DNA, 14 bp, D. melanogaster
ttgccattttcttt

SEQ ID NO: 669691 - DNA, 13 bp, D. melanogaster
ttgccattttggc

SEQ ID NO: 669692 - DNA, 14 bp, D. melanogaster
ttgccattttggcc

SEQ ID NO: 669693 - DNA, 13 bp, D. melanogaster
ttgccattttgtg

SEQ ID NO: 669694 - DNA, 13 bp, D. melanogaster
ttgccatttttgt

SEQ ID NO: 669695 - DNA, 14 bp, D. melanogaster
ttgccatttttgtt

SEQ ID NO: 669696 - DNA, 13 bp, D. melanogaster
ttgccattttttg

SEQ ID NO: 669697 - DNA, 13 bp, D. melanogaster
ttgcccaaaaaga

SEQ ID NO: 669698 - DNA, 13 bp, D. melanogaster
ttgcccaaaaata

SEQ ID NO: 669699 - DNA, 13 bp, D. melanogaster
ttgcccaaaaatg

SEQ ID NO: 669700 - DNA, 13 bp, D. melanogaster
ttgcccaaccatt

SEQ ID NO: 669701 - DNA, 13 bp, D. melanogaster
ttgcccaactacg

SEQ ID NO: 669702 - DNA, 13 bp, D. melanogaster
ttgcccaactttg

SEQ ID NO: 669703 - DNA, 13 bp, D. melanogaster
ttgcccaactttt

SEQ ID NO: 669704 - DNA, 13 bp, D. melanogaster
ttgcccaaggaga

SEQ ID NO: 669705 - DNA, 13 bp, D. melanogaster
ttgcccaatacct

SEQ ID NO: 669706 - DNA, 13 bp, D. melanogaster
ttgcccaatctgt

SEQ ID NO: 669707 - DNA, 13 bp, D. melanogaster
ttgcccacattta

SEQ ID NO: 669708 - DNA, 13 bp, D. melanogaster
ttgcccaccaatt

SEQ ID NO: 669709 - DNA, 13 bp, D. melanogaster
ttgcccactcgaa

SEQ ID NO: 669710 - DNA, 13 bp, D. melanogaster
ttgcccagcaatt

SEQ ID NO: 669711 - DNA, 13 bp, D. melanogaster
ttgcccagctttt

SEQ ID NO: 669712 - DNA, 13 bp, D. melanogaster
ttgcccagtgaat

SEQ ID NO: 669713 - DNA, 13 bp, D. melanogaster
ttgcccataaaaa

SEQ ID NO: 669714 - DNA, 13 bp, D. melanogaster
ttgcccatatttt

SEQ ID NO: 669715 - DNA, 14 bp, D. melanogaster
ttgcccatattttt

SEQ ID NO: 669716 - DNA, 13 bp, D. melanogaster
ttgcccatcaaat

SEQ ID NO: 669717 - DNA, 13 bp, D. melanogaster
ttgcccatctctt

SEQ ID NO: 669718 - DNA, 13 bp, D. melanogaster
ttgcccattaaaa

SEQ ID NO: 669719 - DNA, 13 bp, D. melanogaster
ttgcccattgccc

SEQ ID NO: 669720 - DNA, 13 bp, D. melanogaster
ttgcccattgttt

SEQ ID NO: 669721 - DNA, 13 bp, D. melanogaster
ttgcccatttccc

SEQ ID NO: 669722 - DNA, 13 bp, D. melanogaster
ttgcccattttgg

SEQ ID NO: 669723 - DNA, 13 bp, D. melanogaster
ttgcccatttttt

SEQ ID NO: 669724 - DNA, 14 bp, D. melanogaster
ttgcccattttttg

SEQ ID NO: 669725 - DNA, 13 bp, D. melanogaster
ttgccccaaaaag

SEQ ID NO: 669726 - DNA, 13 bp, D. melanogaster
ttgccccaaaatg

SEQ ID NO: 669727 - DNA, 13 bp, D. melanogaster
ttgccccacagct

SEQ ID NO: 669728 - DNA, 14 bp, D. melanogaster
ttgccccactgtgc

SEQ ID NO: 669729 - DNA, 13 bp, D. melanogaster
ttgccccatctca

SEQ ID NO: 669730 - DNA, 13 bp, D. melanogaster
ttgccccattccc

SEQ ID NO: 669731 - DNA, 13 bp, D. melanogaster
ttgccccgccaac

SEQ ID NO: 669732 - DNA, 13 bp, D. melanogaster
ttgccccttttgc

SEQ ID NO: 669733 - DNA, 13 bp, D. melanogaster
ttgcccgcttttc

SEQ ID NO: 669734 - DNA, 13 bp, D. melanogaster
ttgcccgcttttg

SEQ ID NO: 669735 - DNA, 13 bp, D. melanogaster
ttgccctgccatt

SEQ ID NO: 669736 - DNA, 13 bp, D. melanogaster
ttgcccttcatta

SEQ ID NO: 669737 - DNA, 14 bp, D. melanogaster
ttgccgaaaaaaaa

SEQ ID NO: 669738 - DNA, 13 bp, D. melanogaster
ttgccgaaaggca

SEQ ID NO: 669739 - DNA, 13 bp, D. melanogaster
ttgccgactggag

SEQ ID NO: 669740 - DNA, 14 bp, D. melanogaster
ttgccgagaaaaat

SEQ ID NO: 669741 - DNA, 13 bp, D. melanogaster
ttgccgataagga

SEQ ID NO: 669742 - DNA, 13 bp, D. melanogaster
ttgccgatgacgt

SEQ ID NO: 669743 - DNA, 13 bp, D. melanogaster
ttgccgatgcagc

SEQ ID NO: 669744 - DNA, 13 bp, D. melanogaster
ttgccgatttgat

SEQ ID NO: 669745 - DNA, 14 bp, D. melanogaster
ttgccgatttgatt

SEQ ID NO: 669746 - DNA, 13 bp, D. melanogaster
ttgccgcaaactt

SEQ ID NO: 669747 - DNA, 14 bp, D. melanogaster
ttgccgcaaactta

SEQ ID NO: 669748 - DNA, 13 bp, D. melanogaster
ttgccgcaatttg

SEQ ID NO: 669749 - DNA, 13 bp, D. melanogaster
ttgccgcacacac

SEQ ID NO: 669750 - DNA, 13 bp, D. melanogaster
ttgccgccgccgc

SEQ ID NO: 669751 - DNA, 13 bp, D. melanogaster
ttgccgccgctgc

SEQ ID NO: 669752 - DNA, 13 bp, D. melanogaster
ttgccgccgtctt

SEQ ID NO: 669753 - DNA, 13 bp, D. melanogaster
ttgccgccttttg

SEQ ID NO: 669754 - DNA, 13 bp, D. melanogaster
ttgccgctgcctt

SEQ ID NO: 669755 - DNA, 13 bp, D. melanogaster
ttgccgctgctgc

SEQ ID NO: 669756 - DNA, 13 bp, D. melanogaster
ttgccgctgcttt

SEQ ID NO: 669757 - DNA, 13 bp, D. melanogaster
ttgccgctgtcat

SEQ ID NO: 669758 - DNA, 13 bp, D. melanogaster
ttgccgctgtttg

SEQ ID NO: 669759 - DNA, 13 bp, D. melanogaster
ttgccgcttttgt

SEQ ID NO: 669760 - DNA, 13 bp, D. melanogaster
ttgccggcaaaca

SEQ ID NO: 669761 - DNA, 13 bp, D. melanogaster
ttgccggcatttt

SEQ ID NO: 669762 - DNA, 13 bp, D. melanogaster
ttgccggctaatt

SEQ ID NO: 669763 - DNA, 14 bp, D. melanogaster
ttgccgtcttcagt

SEQ ID NO: 669764 - DNA, 14 bp, D. melanogaster
ttgccgttgccttt

SEQ ID NO: 669765 - DNA, 13 bp, D. melanogaster
ttgccgttgctgc

SEQ ID NO: 669766 - DNA, 13 bp, D. melanogaster
ttgccgttgttgg

SEQ ID NO: 669767 - DNA, 13 bp, D. melanogaster
ttgccgtttgccg

SEQ ID NO: 669768 - DNA, 13 bp, D. melanogaster
ttgcctaaaaata

SEQ ID NO: 669769 - DNA, 13 bp, D. melanogaster
ttgcctaaacaaa

SEQ ID NO: 669770 - DNA, 13 bp, D. melanogaster
ttgcctaacgcag

SEQ ID NO: 669771 - DNA, 13 bp, D. melanogaster
ttgcctaatttaa

SEQ ID NO: 669772 - DNA, 13 bp, D. melanogaster
ttgcctactttgc

SEQ ID NO: 669773 - DNA, 13 bp, D. melanogaster
ttgcctactttta

SEQ ID NO: 669774 - DNA, 14 bp, D. melanogaster
ttgcctactttttg

SEQ ID NO: 669775 - DNA, 13 bp, D. melanogaster
ttgcctataaata

SEQ ID NO: 669776 - DNA, 13 bp, D. melanogaster
ttgcctattaaat

SEQ ID NO: 669777 - DNA, 13 bp, D. melanogaster
ttgcctcactttt

SEQ ID NO: 669778 - DNA, 13 bp, D. melanogaster
ttgcctctggcca

SEQ ID NO: 669779 - DNA, 13 bp, D. melanogaster
ttgcctctgtgtg

SEQ ID NO: 669780 - DNA, 13 bp, D. melanogaster
ttgcctgcaattt

SEQ ID NO: 669781 - DNA, 13 bp, D. melanogaster
ttgcctgcagaac

SEQ ID NO: 669782 - DNA, 13 bp, D. melanogaster
ttgcctgccattt

SEQ ID NO: 669783 - DNA, 13 bp, D. melanogaster
ttgcctgcctgat

SEQ ID NO: 669784 - DNA, 13 bp, D. melanogaster
ttgcctggaaaaa

SEQ ID NO: 669785 - DNA, 13 bp, D. melanogaster
ttgcctggcattt

SEQ ID NO: 669786 - DNA, 13 bp, D. melanogaster
ttgcctggctggc

SEQ ID NO: 669787 - DNA, 13 bp, D. melanogaster
ttgcctgggaaaa

SEQ ID NO: 669788 - DNA, 13 bp, D. melanogaster
ttgcctgtgtgtg

SEQ ID NO: 669789 - DNA, 13 bp, D. melanogaster
ttgcctgtttacc

SEQ ID NO: 669790 - DNA, 13 bp, D. melanogaster
ttgcctgtttgcc

SEQ ID NO: 669791 - DNA, 13 bp, D. melanogaster
ttgcctgtttgct

SEQ ID NO: 669792 - DNA, 13 bp, D. melanogaster
ttgccttaatgaa

SEQ ID NO: 669793 - DNA, 13 bp, D. melanogaster
ttgccttcaactt

SEQ ID NO: 669794 - DNA, 13 bp, D. melanogaster
ttgccttcaatta

SEQ ID NO: 669795 - DNA, 13 bp, D. melanogaster
ttgccttcatcac

SEQ ID NO: 669796 - DNA, 13 bp, D. melanogaster
ttgccttcgagtg

SEQ ID NO: 669797 - DNA, 13 bp, D. melanogaster
ttgccttcgcctt

SEQ ID NO: 669798 - DNA, 13 bp, D. melanogaster
ttgccttcggatc

SEQ ID NO: 669799 - DNA, 13 bp, D. melanogaster
ttgccttgaaagc

SEQ ID NO: 669800 - DNA, 13 bp, D. melanogaster
ttgccttgccaaa

SEQ ID NO: 669801 - DNA, 13 bp, D. melanogaster
ttgccttgccatt

SEQ ID NO: 669802 - DNA, 13 bp, D. melanogaster
ttgccttgccttg

SEQ ID NO: 669803 - DNA, 13 bp, D. melanogaster
ttgccttggcaaa

SEQ ID NO: 669804 - DNA, 13 bp, D. melanogaster
ttgccttggcatt

SEQ ID NO: 669805 - DNA, 13 bp, D. melanogaster
ttgccttggccag

SEQ ID NO: 669806 - DNA, 13 bp, D. melanogaster
ttgccttggcttc

SEQ ID NO: 669807 - DNA, 13 bp, D. melanogaster
ttgccttggcttt

SEQ ID NO: 669808 - DNA, 13 bp, D. melanogaster
ttgccttgtggtt

SEQ ID NO: 669809 - DNA, 13 bp, D. melanogaster
ttgcctttcactc

SEQ ID NO: 669810 - DNA, 13 bp, D. melanogaster
ttgcctttgattt

SEQ ID NO: 669811 - DNA, 13 bp, D. melanogaster
ttgcctttgccac

SEQ ID NO: 669812 - DNA, 13 bp, D. melanogaster
ttgcctttgccat

SEQ ID NO: 669813 - DNA, 14 bp, D. melanogaster
ttgcctttgccatt

SEQ ID NO: 669814 - DNA, 13 bp, D. melanogaster
ttgcctttgcctc

SEQ ID NO: 669815 - DNA, 14 bp, D. melanogaster
ttgcctttggcttt

SEQ ID NO: 669816 - DNA, 13 bp, D. melanogaster
ttgcctttgtcat

SEQ ID NO: 669817 - DNA, 13 bp, D. melanogaster
ttgcctttgtgtg

SEQ ID NO: 669818 - DNA, 13 bp, D. melanogaster
ttgccttttgatt

SEQ ID NO: 669819 - DNA, 13 bp, D. melanogaster
ttgccttttgcac

SEQ ID NO: 669820 - DNA, 13 bp, D. melanogaster
ttgccttttgccc

SEQ ID NO: 669821 - DNA, 13 bp, D. melanogaster
ttgccttttggca

SEQ ID NO: 669822 - DNA, 14 bp, D. melanogaster
ttgccttttggcca

SEQ ID NO: 669823 - DNA, 13 bp, D. melanogaster
ttgccttttgtat

SEQ ID NO: 669824 - DNA, 13 bp, D. melanogaster
ttgcctttttata

SEQ ID NO: 669825 - DNA, 13 bp, D. melanogaster
ttgcctttttatg

SEQ ID NO: 669826 - DNA, 13 bp, D. melanogaster
ttgcctttttcca

SEQ ID NO: 669827 - DNA, 13 bp, D. melanogaster
ttgcctttttggc

SEQ ID NO: 669828 - DNA, 13 bp, D. melanogaster
ttgcgaaaaaaat

SEQ ID NO: 669829 - DNA, 13 bp, D. melanogaster
ttgcgaaaatcag

SEQ ID NO: 669830 - DNA, 13 bp, D. melanogaster
ttgcgaaacattt

SEQ ID NO: 669831 - DNA, 13 bp, D. melanogaster
ttgcgaaagtgaa

SEQ ID NO: 669832 - DNA, 13 bp, D. melanogaster
ttgcgaaatggaa

SEQ ID NO: 669833 - DNA, 13 bp, D. melanogaster
ttgcgaaatttaa

SEQ ID NO: 669834 - DNA, 14 bp, D. melanogaster
ttgcgaaatttaaa

SEQ ID NO: 669835 - DNA, 13 bp, D. melanogaster
ttgcgaataattt

SEQ ID NO: 669836 - DNA, 13 bp, D. melanogaster
ttgcgagtgtttt

SEQ ID NO: 669837 - DNA, 13 bp, D. melanogaster
ttgcgagtttccc

SEQ ID NO: 669838 - DNA, 13 bp, D. melanogaster
ttgcgatgacgct

SEQ ID NO: 669839 - DNA, 13 bp, D. melanogaster
ttgcgatggcaaa

SEQ ID NO: 669840 - DNA, 13 bp, D. melanogaster
ttgcgattattat

SEQ ID NO: 669841 - DNA, 13 bp, D. melanogaster
ttgcgattcaatt

SEQ ID NO: 669842 - DNA, 13 bp, D. melanogaster
ttgcgattcgatt

SEQ ID NO: 669843 - DNA, 13 bp, D. melanogaster
ttgcgattgcatt

SEQ ID NO: 669844 - DNA, 13 bp, D. melanogaster
ttgcgatttattt

SEQ ID NO: 669845 - DNA, 13 bp, D. melanogaster
ttgcgatttgcat

SEQ ID NO: 669846 - DNA, 13 bp, D. melanogaster
ttgcgattttatt

SEQ ID NO: 669847 - DNA, 13 bp, D. melanogaster
ttgcgatttttat

SEQ ID NO: 669848 - DNA, 13 bp, D. melanogaster
ttgcgcaaacaca

SEQ ID NO: 669849 - DNA, 13 bp, D. melanogaster
ttgcgcaacaatt

SEQ ID NO: 669850 - DNA, 13 bp, D. melanogaster
ttgcgcaatcgaa

SEQ ID NO: 669851 - DNA, 13 bp, D. melanogaster
ttgcgcagcaggc

SEQ ID NO: 669852 - DNA, 14 bp, D. melanogaster
ttgcgcataaattt

SEQ ID NO: 669853 - DNA, 13 bp, D. melanogaster
ttgcgcatacgca

SEQ ID NO: 669854 - DNA, 14 bp, D. melanogaster
ttgcgcatacgcac

SEQ ID NO: 669855 - DNA, 13 bp, D. melanogaster
ttgcgcatacgcc

SEQ ID NO: 669856 - DNA, 14 bp, D. melanogaster
ttgcgcatacgccc

SEQ ID NO: 669857 - DNA, 14 bp, D. melanogaster
ttgcgcatacgccg

SEQ ID NO: 669858 - DNA, 13 bp, D. melanogaster
ttgcgcatgcgca

SEQ ID NO: 669859 - DNA, 13 bp, D. melanogaster
ttgcgcctgcgca

SEQ ID NO: 669860 - DNA, 13 bp, D. melanogaster
ttgcgcgtgtgtg

SEQ ID NO: 669861 - DNA, 13 bp, D. melanogaster
ttgcgctctcttt

SEQ ID NO: 669862 - DNA, 13 bp, D. melanogaster
ttgcgctgcagtt

SEQ ID NO: 669863 - DNA, 14 bp, D. melanogaster
ttgcgctgcagttt

SEQ ID NO: 669864 - DNA, 13 bp, D. melanogaster
ttgcgctttaatt

SEQ ID NO: 669865 - DNA, 13 bp, D. melanogaster
ttgcggatggcca

SEQ ID NO: 669866 - DNA, 13 bp, D. melanogaster
ttgcggcactcca

SEQ ID NO: 669867 - DNA, 13 bp, D. melanogaster
ttgcggcatttta

SEQ ID NO: 669868 - DNA, 13 bp, D. melanogaster
ttgcggcattttg

SEQ ID NO: 669869 - DNA, 13 bp, D. melanogaster
ttgcggccaaaac

SEQ ID NO: 669870 - DNA, 14 bp, D. melanogaster
ttgcggcgtgtgaa

SEQ ID NO: 669871 - DNA, 13 bp, D. melanogaster
ttgcggctgccat

SEQ ID NO: 669872 - DNA, 13 bp, D. melanogaster
ttgcggctgccta

SEQ ID NO: 669873 - DNA, 13 bp, D. melanogaster
ttgcggctgcttt

SEQ ID NO: 669874 - DNA, 13 bp, D. melanogaster
ttgcggttgctgc

SEQ ID NO: 669875 - DNA, 13 bp, D. melanogaster
ttgcggttgcttt

SEQ ID NO: 669876 - DNA, 13 bp, D. melanogaster
ttgcgtaattaaa

SEQ ID NO: 669877 - DNA, 13 bp, D. melanogaster
ttgcgtatacgac

SEQ ID NO: 669878 - DNA, 13 bp, D. melanogaster
ttgcgtatacgca

SEQ ID NO: 669879 - DNA, 13 bp, D. melanogaster
ttgcgtatacgcc

SEQ ID NO: 669880 - DNA, 14 bp, D. melanogaster
ttgcgtatacgcca

SEQ ID NO: 669881 - DNA, 14 bp, D. melanogaster
ttgcgtatacgccg

SEQ ID NO: 669882 - DNA, 13 bp, D. melanogaster
ttgcgtatgcgta

SEQ ID NO: 669883 - DNA, 13 bp, D. melanogaster
ttgcgtatttatt

SEQ ID NO: 669884 - DNA, 13 bp, D. melanogaster
ttgcgtcagctgg

SEQ ID NO: 669885 - DNA, 13 bp, D. melanogaster
ttgcgtctgtgtg

SEQ ID NO: 669886 - DNA, 13 bp, D. melanogaster
ttgcgtgcgtgtg

SEQ ID NO: 669887 - DNA, 13 bp, D. melanogaster
ttgcgttccaaat

SEQ ID NO: 669888 - DNA, 13 bp, D. melanogaster
ttgcgttgcattt

SEQ ID NO: 669889 - DNA, 13 bp, D. melanogaster
ttgcgttgccttt

SEQ ID NO: 669890 - DNA, 13 bp, D. melanogaster
ttgcgttgtttcg

SEQ ID NO: 669891 - DNA, 13 bp, D. melanogaster
ttgcgtttatggt

SEQ ID NO: 669892 - DNA, 13 bp, D. melanogaster
ttgcgtttgcatt

SEQ ID NO: 669893 - DNA, 13 bp, D. melanogaster
ttgcgttttaaaa

SEQ ID NO: 669894 - DNA, 13 bp, D. melanogaster
ttgcgttttaatt

SEQ ID NO: 669895 - DNA, 13 bp, D. melanogaster
ttgcgttttccat

SEQ ID NO: 669896 - DNA, 13 bp, D. melanogaster
ttgctaaaaaaaa

SEQ ID NO: 669897 - DNA, 13 bp, D. melanogaster
ttgctaaaaataa

SEQ ID NO: 669898 - DNA, 13 bp, D. melanogaster
ttgctaaaaatgt

SEQ ID NO: 669899 - DNA, 13 bp, D. melanogaster
ttgctaaaagcca

SEQ ID NO: 669900 - DNA, 13 bp, D. melanogaster
ttgctaaaataat

SEQ ID NO: 669901 - DNA, 13 bp, D. melanogaster
ttgctaaacaaaa

SEQ ID NO: 669902 - DNA, 13 bp, D. melanogaster
ttgctaaatataa

SEQ ID NO: 669903 - DNA, 13 bp, D. melanogaster
ttgctaaatattt

SEQ ID NO: 669904 - DNA, 13 bp, D. melanogaster
ttgctaaattatt

SEQ ID NO: 669905 - DNA, 13 bp, D. melanogaster
ttgctaaatttat

SEQ ID NO: 669906 - DNA, 13 bp, D. melanogaster
ttgctaacatttt

SEQ ID NO: 669907 - DNA, 13 bp, D. melanogaster
ttgctaacgtttt

SEQ ID NO: 669908 - DNA, 14 bp, D. melanogaster
ttgctaacgtttta

SEQ ID NO: 669909 - DNA, 13 bp, D. melanogaster
ttgctaagttaat

SEQ ID NO: 669910 - DNA, 13 bp, D. melanogaster
ttgctaataaaaa

SEQ ID NO: 669911 - DNA, 13 bp, D. melanogaster
ttgctaataaaat

SEQ ID NO: 669912 - DNA, 13 bp, D. melanogaster
ttgctaataaata

SEQ ID NO: 669913 - DNA, 13 bp, D. melanogaster
ttgctaatgaaaa

SEQ ID NO: 669914 - DNA, 13 bp, D. melanogaster
ttgctaattaaaa

SEQ ID NO: 669915 - DNA, 14 bp, D. melanogaster
ttgctaattaattt

SEQ ID NO: 669916 - DNA, 13 bp, D. melanogaster
ttgctaattattt

SEQ ID NO: 669917 - DNA, 13 bp, D. melanogaster
ttgctaattgaat

SEQ ID NO: 669918 - DNA, 13 bp, D. melanogaster
ttgctaattgttt

SEQ ID NO: 669919 - DNA, 14 bp, D. melanogaster
ttgctaatttcgtt

SEQ ID NO: 669920 - DNA, 13 bp, D. melanogaster
ttgctaatttgca

SEQ ID NO: 669921 - DNA, 14 bp, D. melanogaster
ttgctacctttttt

SEQ ID NO: 669922 - DNA, 13 bp, D. melanogaster
ttgctactgacac

SEQ ID NO: 669923 - DNA, 13 bp, D. melanogaster
ttgctactgctgc

SEQ ID NO: 669924 - DNA, 13 bp, D. melanogaster
ttgctatacttaa

SEQ ID NO: 669925 - DNA, 13 bp, D. melanogaster
ttgctatcaaaat

SEQ ID NO: 669926 - DNA, 13 bp, D. melanogaster
ttgctatcgattt

SEQ ID NO: 669927 - DNA, 13 bp, D. melanogaster
ttgctatcggcaa

SEQ ID NO: 669928 - DNA, 13 bp, D. melanogaster
ttgctatggtatt

SEQ ID NO: 669929 - DNA, 13 bp, D. melanogaster
ttgctattaaaaa

SEQ ID NO: 669930 - DNA, 13 bp, D. melanogaster
ttgctattaaaat

SEQ ID NO: 669931 - DNA, 13 bp, D. melanogaster
ttgctattgattt

SEQ ID NO: 669932 - DNA, 14 bp, D. melanogaster
ttgctattgccatt

SEQ ID NO: 669933 - DNA, 14 bp, D. melanogaster
ttgctattgctgtt

SEQ ID NO: 669934 - DNA, 13 bp, D. melanogaster
ttgctattgcttt

SEQ ID NO: 669935 - DNA, 14 bp, D. melanogaster
ttgctattgctttt

SEQ ID NO: 669936 - DNA, 13 bp, D. melanogaster
ttgctattgttat

SEQ ID NO: 669937 - DNA, 13 bp, D. melanogaster
ttgctattgttgt

SEQ ID NO: 669938 - DNA, 13 bp, D. melanogaster
ttgctatttaatt

SEQ ID NO: 669939 - DNA, 13 bp, D. melanogaster
ttgctatttgcta

SEQ ID NO: 669940 - DNA, 13 bp, D. melanogaster
ttgctatttttgc

SEQ ID NO: 669941 - DNA, 13 bp, D. melanogaster
ttgctcaaaaaca

SEQ ID NO: 669942 - DNA, 13 bp, D. melanogaster
ttgctcaaataaa

SEQ ID NO: 669943 - DNA, 13 bp, D. melanogaster
ttgctcaacaaat

SEQ ID NO: 669944 - DNA, 13 bp, D. melanogaster
ttgctcaactttt

SEQ ID NO: 669945 - DNA, 13 bp, D. melanogaster
ttgctcaagtttt

SEQ ID NO: 669946 - DNA, 13 bp, D. melanogaster
ttgctcaataaaa

SEQ ID NO: 669947 - DNA, 13 bp, D. melanogaster
ttgctcaattatt

SEQ ID NO: 669948 - DNA, 13 bp, D. melanogaster
ttgctcacatttt

SEQ ID NO: 669949 - DNA, 13 bp, D. melanogaster
ttgctcatgaaaa

SEQ ID NO: 669950 - DNA, 13 bp, D. melanogaster
ttgctcatttggc

SEQ ID NO: 669951 - DNA, 13 bp, D. melanogaster
ttgctccagactg

SEQ ID NO: 669952 - DNA, 13 bp, D. melanogaster
ttgctcccatttt

SEQ ID NO: 669953 - DNA, 13 bp, D. melanogaster
ttgctcctgctcc

SEQ ID NO: 669954 - DNA, 13 bp, D. melanogaster
ttgctcctgctgc

SEQ ID NO: 669955 - DNA, 14 bp, D. melanogaster
ttgctcctgctgct

SEQ ID NO: 669956 - DNA, 13 bp, D. melanogaster
ttgctccttctgc

SEQ ID NO: 669957 - DNA, 13 bp, D. melanogaster
ttgctcgaccaag

SEQ ID NO: 669958 - DNA, 13 bp, D. melanogaster
ttgctcgatttgt

SEQ ID NO: 669959 - DNA, 14 bp, D. melanogaster
ttgctcgatttgta

SEQ ID NO: 669960 - DNA, 13 bp, D. melanogaster
ttgctcggcattt

SEQ ID NO: 669961 - DNA, 13 bp, D. melanogaster
ttgctctgatgag

SEQ ID NO: 669962 - DNA, 13 bp, D. melanogaster
ttgctctgtttgc

SEQ ID NO: 669963 - DNA, 14 bp, D. melanogaster
ttgctcttcaaagc

SEQ ID NO: 669964 - DNA, 13 bp, D. melanogaster
ttgctcttgctct

SEQ ID NO: 669965 - DNA, 13 bp, D. melanogaster
ttgctcttggatt

SEQ ID NO: 669966 - DNA, 13 bp, D. melanogaster
ttgctcttgttgc

SEQ ID NO: 669967 - DNA, 13 bp, D. melanogaster
ttgctctttgata

SEQ ID NO: 669968 - DNA, 13 bp, D. melanogaster
ttgctctttttaa

SEQ ID NO: 669969 - DNA, 13 bp, D. melanogaster
ttgctgaaaaaat

SEQ ID NO: 669970 - DNA, 13 bp, D. melanogaster
ttgctgaaaaatg

SEQ ID NO: 669971 - DNA, 13 bp, D. melanogaster
ttgctgaaaagtg

SEQ ID NO: 669972 - DNA, 13 bp, D. melanogaster
ttgctgaaatctg

SEQ ID NO: 669973 - DNA, 13 bp, D. melanogaster
ttgctgaggcaaa

SEQ ID NO: 669974 - DNA, 13 bp, D. melanogaster
ttgctgataaaat

SEQ ID NO: 669975 - DNA, 13 bp, D. melanogaster
ttgctgatatcga

SEQ ID NO: 669976 - DNA, 13 bp, D. melanogaster
ttgctgatatttt

SEQ ID NO: 669977 - DNA, 13 bp, D. melanogaster
ttgctgatgctct

SEQ ID NO: 669978 - DNA, 13 bp, D. melanogaster
ttgctgatgttgc

SEQ ID NO: 669979 - DNA, 13 bp, D. melanogaster
ttgctgattttcc

SEQ ID NO: 669980 - DNA, 13 bp, D. melanogaster
ttgctgcaaataa

SEQ ID NO: 669981 - DNA, 13 bp, D. melanogaster
ttgctgcaacttt

SEQ ID NO: 669982 - DNA, 13 bp, D. melanogaster
ttgctgcaattgt

SEQ ID NO: 669983 - DNA, 13 bp, D. melanogaster
ttgctgcaatttt

SEQ ID NO: 669984 - DNA, 13 bp, D. melanogaster
ttgctgcacaaat

SEQ ID NO: 669985 - DNA, 13 bp, D. melanogaster
ttgctgcactgca

SEQ ID NO: 669986 - DNA, 13 bp, D. melanogaster
ttgctgcactttc

SEQ ID NO: 669987 - DNA, 13 bp, D. melanogaster
ttgctgcagcagc

SEQ ID NO: 669988 - DNA, 13 bp, D. melanogaster
ttgctgcagctgc

SEQ ID NO: 669989 - DNA, 14 bp, D. melanogaster
ttgctgcagttgtt

SEQ ID NO: 669990 - DNA, 13 bp, D. melanogaster
ttgctgcagtttg

SEQ ID NO: 669991 - DNA, 13 bp, D. melanogaster
ttgctgcatactt

SEQ ID NO: 669992 - DNA, 13 bp, D. melanogaster
ttgctgcatcgca

SEQ ID NO: 669993 - DNA, 13 bp, D. melanogaster
ttgctgcattgtt

SEQ ID NO: 669994 - DNA, 13 bp, D. melanogaster
ttgctgcatttgc

SEQ ID NO: 669995 - DNA, 13 bp, D. melanogaster
ttgctgcattttt

SEQ ID NO: 669996 - DNA, 13 bp, D. melanogaster
ttgctgccaaaaa

SEQ ID NO: 669997 - DNA, 13 bp, D. melanogaster
ttgctgccaactt

SEQ ID NO: 669998 - DNA, 13 bp, D. melanogaster
ttgctgccacaaa

SEQ ID NO: 669999 - DNA, 13 bp, D. melanogaster
ttgctgccactga

SEQ ID NO: 670000 - DNA, 13 bp, D. melanogaster
ttgctgccatttt

SEQ ID NO: 670001 - DNA, 13 bp, D. melanogaster
ttgctgccgcagc

SEQ ID NO: 670002 - DNA, 14 bp, D. melanogaster
ttgctgccgctgcc

SEQ ID NO: 670003 - DNA, 14 bp, D. melanogaster
ttgctgccgctgct

SEQ ID NO: 670004 - DNA, 13 bp, D. melanogaster
ttgctgccgctgt

SEQ ID NO: 670005 - DNA, 13 bp, D. melanogaster
ttgctgcctgcct

SEQ ID NO: 670006 - DNA, 13 bp, D. melanogaster
ttgctgcgaagag

SEQ ID NO: 670007 - DNA, 13 bp, D. melanogaster
ttgctgcgctttt

SEQ ID NO: 670008 - DNA, 13 bp, D. melanogaster
ttgctgctcaaca

SEQ ID NO: 670009 - DNA, 14 bp, D. melanogaster
ttgctgctcctgct

SEQ ID NO: 670010 - DNA, 13 bp, D. melanogaster
ttgctgctctgct

SEQ ID NO: 670011 - DNA, 13 bp, D. melanogaster
ttgctgctctgtt

SEQ ID NO: 670012 - DNA, 14 bp, D. melanogaster
ttgctgctgcaagt

SEQ ID NO: 670013 - DNA, 13 bp, D. melanogaster
ttgctgctgcagc

SEQ ID NO: 670014 - DNA, 14 bp, D. melanogaster
ttgctgctgcagtt

SEQ ID NO: 670015 - DNA, 13 bp, D. melanogaster
ttgctgctgccaa

SEQ ID NO: 670016 - DNA, 13 bp, D. melanogaster
ttgctgctgccac

SEQ ID NO: 670017 - DNA, 14 bp, D. melanogaster
ttgctgctgccgct

SEQ ID NO: 670018 - DNA, 14 bp, D. melanogaster
ttgctgctgcggct

SEQ ID NO: 670019 - DNA, 13 bp, D. melanogaster
ttgctgctgcggt

SEQ ID NO: 670020 - DNA, 13 bp, D. melanogaster
ttgctgctgctct

SEQ ID NO: 670021 - DNA, 14 bp, D. melanogaster
ttgctgctgctgat

SEQ ID NO: 670022 - DNA, 14 bp, D. melanogaster
ttgctgctgctgca

SEQ ID NO: 670023 - DNA, 14 bp, D. melanogaster
ttgctgctgctgcc

SEQ ID NO: 670024 - DNA, 14 bp, D. melanogaster
ttgctgctgctgcg

SEQ ID NO: 670025 - DNA, 14 bp, D. melanogaster
ttgctgctgctggt

SEQ ID NO: 670026 - DNA, 13 bp, D. melanogaster
ttgctgctgctgt

SEQ ID NO: 670027 - DNA, 14 bp, D. melanogaster
ttgctgctgctgtc

SEQ ID NO: 670028 - DNA, 14 bp, D. melanogaster
ttgctgctgctgtt

SEQ ID NO: 670029 - DNA, 13 bp, D. melanogaster
ttgctgctggcat

SEQ ID NO: 670030 - DNA, 13 bp, D. melanogaster
ttgctgctggctg

SEQ ID NO: 670031 - DNA, 13 bp, D. melanogaster
ttgctgctgtcgc

SEQ ID NO: 670032 - DNA, 13 bp, D. melanogaster
ttgctgctgtcgt

SEQ ID NO: 670033 - DNA, 13 bp, D. melanogaster
ttgctgctgtgct

SEQ ID NO: 670034 - DNA, 13 bp, D. melanogaster
ttgctgctgttga

SEQ ID NO: 670035 - DNA, 15 bp, D. melanogaster
ttgctgctgttgcta

SEQ ID NO: 670036 - DNA, 15 bp, D. melanogaster
ttgctgcttctgctg

SEQ ID NO: 670037 - DNA, 13 bp, D. melanogaster
ttgctgctttgct

SEQ ID NO: 670038 - DNA, 13 bp, D. melanogaster
ttgctgcttttgc

SEQ ID NO: 670039 - DNA, 14 bp, D. melanogaster
ttgctgcttttgct

SEQ ID NO: 670040 - DNA, 13 bp, D. melanogaster
ttgctggaaaatg

SEQ ID NO: 670041 - DNA, 13 bp, D. melanogaster
ttgctggaaatta

SEQ ID NO: 670042 - DNA, 13 bp, D. melanogaster
ttgctggaatgca

SEQ ID NO: 670043 - DNA, 13 bp, D. melanogaster
ttgctggattatg

SEQ ID NO: 670044 - DNA, 13 bp, D. melanogaster
ttgctggcaaaag

SEQ ID NO: 670045 - DNA, 13 bp, D. melanogaster
ttgctggcaaaat

SEQ ID NO: 670046 - DNA, 13 bp, D. melanogaster
ttgctggcaacaa

SEQ ID NO: 670047 - DNA, 13 bp, D. melanogaster
ttgctggcaactt

SEQ ID NO: 670048 - DNA, 13 bp, D. melanogaster
ttgctggcaatta

SEQ ID NO: 670049 - DNA, 13 bp, D. melanogaster
ttgctggcacttt

SEQ ID NO: 670050 - DNA, 13 bp, D. melanogaster
ttgctggcattgt

SEQ ID NO: 670051 - DNA, 13 bp, D. melanogaster
ttgctggccaaat

SEQ ID NO: 670052 - DNA, 13 bp, D. melanogaster
ttgctggccaaca

SEQ ID NO: 670053 - DNA, 13 bp, D. melanogaster
ttgctggccaagc

SEQ ID NO: 670054 - DNA, 13 bp, D. melanogaster
ttgctggccaagt

SEQ ID NO: 670055 - DNA, 13 bp, D. melanogaster
ttgctggccacaa

SEQ ID NO: 670056 - DNA, 13 bp, D. melanogaster
ttgctggccactt

SEQ ID NO: 670057 - DNA, 13 bp, D. melanogaster
ttgctggccataa

SEQ ID NO: 670058 - DNA, 13 bp, D. melanogaster
ttgctggcccaaa

SEQ ID NO: 670059 - DNA, 13 bp, D. melanogaster
ttgctggcccttt

SEQ ID NO: 670060 - DNA, 13 bp, D. melanogaster
ttgctggccgtta

SEQ ID NO: 670061 - DNA, 13 bp, D. melanogaster
ttgctggcgctgc

SEQ ID NO: 670062 - DNA, 13 bp, D. melanogaster
ttgctggcgtttc

SEQ ID NO: 670063 - DNA, 13 bp, D. melanogaster
ttgctggctgttt

SEQ ID NO: 670064 - DNA, 13 bp, D. melanogaster
ttgctggcttctt

SEQ ID NO: 670065 - DNA, 13 bp, D. melanogaster
ttgctggcttttg

SEQ ID NO: 670066 - DNA, 13 bp, D. melanogaster
ttgctgggaaaat

SEQ ID NO: 670067 - DNA, 13 bp, D. melanogaster
ttgctgggaaatt

SEQ ID NO: 670068 - DNA, 13 bp, D. melanogaster
ttgctggtttatt

SEQ ID NO: 670069 - DNA, 13 bp, D. melanogaster
ttgctgtaatttg

SEQ ID NO: 670070 - DNA, 13 bp, D. melanogaster
ttgctgtcaccaa

SEQ ID NO: 670071 - DNA, 13 bp, D. melanogaster
ttgctgtgcaatt

SEQ ID NO: 670072 - DNA, 13 bp, D. melanogaster
ttgctgtgcattt

SEQ ID NO: 670073 - DNA, 13 bp, D. melanogaster
ttgctgtgcgacc

SEQ ID NO: 670074 - DNA, 13 bp, D. melanogaster
ttgctgtgctgct

SEQ ID NO: 670075 - DNA, 13 bp, D. melanogaster
ttgctgtgtactt

SEQ ID NO: 670076 - DNA, 13 bp, D. melanogaster
ttgctgttcaatt

SEQ ID NO: 670077 - DNA, 14 bp, D. melanogaster
ttgctgttgatttt

SEQ ID NO: 670078 - DNA, 13 bp, D. melanogaster
ttgctgttgcaca

SEQ ID NO: 670079 - DNA, 13 bp, D. melanogaster
ttgctgttgcatg

SEQ ID NO: 670080 - DNA, 13 bp, D. melanogaster
ttgctgttgcatt

SEQ ID NO: 670081 - DNA, 14 bp, D. melanogaster
ttgctgttgcattt

SEQ ID NO: 670082 - DNA, 13 bp, D. melanogaster
ttgctgttgccag

SEQ ID NO: 670083 - DNA, 14 bp, D. melanogaster
ttgctgttgccatt

SEQ ID NO: 670084 - DNA, 13 bp, D. melanogaster
ttgctgttgccgt

SEQ ID NO: 670085 - DNA, 14 bp, D. melanogaster
ttgctgttgccgtt

SEQ ID NO: 670086 - DNA, 13 bp, D. melanogaster
ttgctgttgcggc

SEQ ID NO: 670087 - DNA, 13 bp, D. melanogaster
ttgctgttgctat

SEQ ID NO: 670088 - DNA, 13 bp, D. melanogaster
ttgctgttgctgg

SEQ ID NO: 670089 - DNA, 13 bp, D. melanogaster
ttgctgttgttat

SEQ ID NO: 670090 - DNA, 14 bp, D. melanogaster
ttgctgttgttgca

SEQ ID NO: 670091 - DNA, 13 bp, D. melanogaster
ttgctgtttatat

SEQ ID NO: 670092 - DNA, 13 bp, D. melanogaster
ttgctgtttctgc

SEQ ID NO: 670093 - DNA, 13 bp, D. melanogaster
ttgctgtttgctg

SEQ ID NO: 670094 - DNA, 13 bp, D. melanogaster
ttgcttaaaaata

SEQ ID NO: 670095 - DNA, 13 bp, D. melanogaster
ttgcttaaaactt

SEQ ID NO: 670096 - DNA, 13 bp, D. melanogaster
ttgcttaaacaaa

SEQ ID NO: 670097 - DNA, 13 bp, D. melanogaster
ttgcttaaacttt

SEQ ID NO: 670098 - DNA, 13 bp, D. melanogaster
ttgcttaaattta

SEQ ID NO: 670099 - DNA, 13 bp, D. melanogaster
ttgcttaacaaac

SEQ ID NO: 670100 - DNA, 14 bp, D. melanogaster
ttgcttaacaaaca

SEQ ID NO: 670101 - DNA, 13 bp, D. melanogaster
ttgcttaactttt

SEQ ID NO: 670102 - DNA, 13 bp, D. melanogaster
ttgcttaatttaa

SEQ ID NO: 670103 - DNA, 13 bp, D. melanogaster
ttgcttaatttat

SEQ ID NO: 670104 - DNA, 14 bp, D. melanogaster
ttgcttaatttatt

SEQ ID NO: 670105 - DNA, 13 bp, D. melanogaster
ttgcttaatttta

SEQ ID NO: 670106 - DNA, 13 bp, D. melanogaster
ttgcttacaaaat

SEQ ID NO: 670107 - DNA, 13 bp, D. melanogaster
ttgcttacaaatt

SEQ ID NO: 670108 - DNA, 13 bp, D. melanogaster
ttgcttacttttc

SEQ ID NO: 670109 - DNA, 13 bp, D. melanogaster
ttgcttataaaaa

SEQ ID NO: 670110 - DNA, 14 bp, D. melanogaster
ttgcttatatctat

SEQ ID NO: 670111 - DNA, 13 bp, D. melanogaster
ttgcttatcaatt

SEQ ID NO: 670112 - DNA, 13 bp, D. melanogaster
ttgcttatgattt

SEQ ID NO: 670113 - DNA, 13 bp, D. melanogaster
ttgcttattggat

SEQ ID NO: 670114 - DNA, 13 bp, D. melanogaster
ttgcttatttaat

SEQ ID NO: 670115 - DNA, 13 bp, D. melanogaster
ttgcttatttatg

SEQ ID NO: 670116 - DNA, 14 bp, D. melanogaster
ttgcttattttaaa

SEQ ID NO: 670117 - DNA, 13 bp, D. melanogaster
ttgcttcagtttt

SEQ ID NO: 670118 - DNA, 13 bp, D. melanogaster
ttgcttcatttgt

SEQ ID NO: 670119 - DNA, 13 bp, D. melanogaster
ttgcttcattttc

SEQ ID NO: 670120 - DNA, 13 bp, D. melanogaster
ttgcttctaatta

SEQ ID NO: 670121 - DNA, 13 bp, D. melanogaster
ttgcttcttcatt

SEQ ID NO: 670122 - DNA, 13 bp, D. melanogaster
ttgcttgaaatat

SEQ ID NO: 670123 - DNA, 13 bp, D. melanogaster
ttgcttgaagtgt

SEQ ID NO: 670124 - DNA, 13 bp, D. melanogaster
ttgcttgcaaatt

SEQ ID NO: 670125 - DNA, 13 bp, D. melanogaster
ttgcttgcatttt

SEQ ID NO: 670126 - DNA, 13 bp, D. melanogaster
ttgcttgcttgct

SEQ ID NO: 670127 - DNA, 13 bp, D. melanogaster
ttgcttggccact

SEQ ID NO: 670128 - DNA, 13 bp, D. melanogaster
ttgcttgtaaaat

SEQ ID NO: 670129 - DNA, 14 bp, D. melanogaster
ttgcttgtgaaatt

SEQ ID NO: 670130 - DNA, 13 bp, D. melanogaster
ttgctttaaaaaa

SEQ ID NO: 670131 - DNA, 13 bp, D. melanogaster
ttgctttaaaaac

SEQ ID NO: 670132 - DNA, 13 bp, D. melanogaster
ttgctttaaaata

SEQ ID NO: 670133 - DNA, 14 bp, D. melanogaster
ttgctttaaaatat

SEQ ID NO: 670134 - DNA, 13 bp, D. melanogaster
ttgctttaagtaa

SEQ ID NO: 670135 - DNA, 13 bp, D. melanogaster
ttgctttaagttc

SEQ ID NO: 670136 - DNA, 13 bp, D. melanogaster
ttgctttaatact

SEQ ID NO: 670137 - DNA, 13 bp, D. melanogaster
ttgctttaattaa

SEQ ID NO: 670138 - DNA, 13 bp, D. melanogaster
ttgctttaatttg

SEQ ID NO: 670139 - DNA, 13 bp, D. melanogaster
ttgctttacattt

SEQ ID NO: 670140 - DNA, 13 bp, D. melanogaster
ttgctttatatat

SEQ ID NO: 670141 - DNA, 13 bp, D. melanogaster
ttgctttatctgc

SEQ ID NO: 670142 - DNA, 13 bp, D. melanogaster
ttgctttatggtt

SEQ ID NO: 670143 - DNA, 13 bp, D. melanogaster
ttgctttatttgc

SEQ ID NO: 670144 - DNA, 13 bp, D. melanogaster
ttgctttcaatta

SEQ ID NO: 670145 - DNA, 13 bp, D. melanogaster
ttgctttcaattt

SEQ ID NO: 670146 - DNA, 13 bp, D. melanogaster
ttgctttcacctt

SEQ ID NO: 670147 - DNA, 13 bp, D. melanogaster
ttgctttccattt

SEQ ID NO: 670148 - DNA, 13 bp, D. melanogaster
ttgctttcgattt

SEQ ID NO: 670149 - DNA, 13 bp, D. melanogaster
ttgctttgaactt

SEQ ID NO: 670150 - DNA, 13 bp, D. melanogaster
ttgctttgaattt

SEQ ID NO: 670151 - DNA, 13 bp, D. melanogaster
ttgctttgattgg

SEQ ID NO: 670152 - DNA, 13 bp, D. melanogaster
ttgctttgcattt

SEQ ID NO: 670153 - DNA, 13 bp, D. melanogaster
ttgctttgctgct

SEQ ID NO: 670154 - DNA, 13 bp, D. melanogaster
ttgctttggcagc

SEQ ID NO: 670155 - DNA, 13 bp, D. melanogaster
ttgctttggcatt

SEQ ID NO: 670156 - DNA, 13 bp, D. melanogaster
ttgctttggccaa

SEQ ID NO: 670157 - DNA, 13 bp, D. melanogaster
ttgctttggccat

SEQ ID NO: 670158 - DNA, 13 bp, D. melanogaster
ttgctttggctgc

SEQ ID NO: 670159 - DNA, 13 bp, D. melanogaster
ttgctttggcttg

SEQ ID NO: 670160 - DNA, 14 bp, D. melanogaster
ttgctttgtgtacc

SEQ ID NO: 670161 - DNA, 13 bp, D. melanogaster
ttgcttttaatta

SEQ ID NO: 670162 - DNA, 13 bp, D. melanogaster
ttgcttttagcca

SEQ ID NO: 670163 - DNA, 13 bp, D. melanogaster
ttgcttttagttg

SEQ ID NO: 670164 - DNA, 13 bp, D. melanogaster
ttgcttttattgc

SEQ ID NO: 670165 - DNA, 13 bp, D. melanogaster
ttgcttttcagct

SEQ ID NO: 670166 - DNA, 13 bp, D. melanogaster
ttgcttttcagtt

SEQ ID NO: 670167 - DNA, 13 bp, D. melanogaster
ttgcttttcatat

SEQ ID NO: 670168 - DNA, 13 bp, D. melanogaster
ttgcttttccgct

SEQ ID NO: 670169 - DNA, 13 bp, D. melanogaster
ttgcttttctggc

SEQ ID NO: 670170 - DNA, 13 bp, D. melanogaster
ttgcttttgaatt

SEQ ID NO: 670171 - DNA, 13 bp, D. melanogaster
ttgcttttgactt

SEQ ID NO: 670172 - DNA, 13 bp, D. melanogaster
ttgcttttgcaaa

SEQ ID NO: 670173 - DNA, 13 bp, D. melanogaster
ttgcttttgccca

SEQ ID NO: 670174 - DNA, 13 bp, D. melanogaster
ttgcttttgcgac

SEQ ID NO: 670175 - DNA, 13 bp, D. melanogaster
ttgcttttgctat

SEQ ID NO: 670176 - DNA, 13 bp, D. melanogaster
ttgcttttggcat

SEQ ID NO: 670177 - DNA, 13 bp, D. melanogaster
ttgcttttggcca

SEQ ID NO: 670178 - DNA, 14 bp, D. melanogaster
ttgcttttggccag

SEQ ID NO: 670179 - DNA, 14 bp, D. melanogaster
ttgcttttggccat

SEQ ID NO: 670180 - DNA, 13 bp, D. melanogaster
ttgcttttgggcc

SEQ ID NO: 670181 - DNA, 14 bp, D. melanogaster
ttgcttttgttgcc

SEQ ID NO: 670182 - DNA, 13 bp, D. melanogaster
ttgctttttaaag

SEQ ID NO: 670183 - DNA, 13 bp, D. melanogaster
ttgctttttaagc

SEQ ID NO: 670184 - DNA, 13 bp, D. melanogaster
ttgctttttgcca

SEQ ID NO: 670185 - DNA, 13 bp, D. melanogaster
ttgctttttgcta

SEQ ID NO: 670186 - DNA, 13 bp, D. melanogaster
ttgctttttggca

SEQ ID NO: 670187 - DNA, 13 bp, D. melanogaster
ttgcttttttcga

SEQ ID NO: 670188 - DNA, 13 bp, D. melanogaster
ttggaaaaaatat

SEQ ID NO: 670189 - DNA, 13 bp, D. melanogaster
ttggaaaaacaag

SEQ ID NO: 670190 - DNA, 13 bp, D. melanogaster
ttggaaaaactaa

SEQ ID NO: 670191 - DNA, 13 bp, D. melanogaster
ttggaaaaagttt

SEQ ID NO: 670192 - DNA, 13 bp, D. melanogaster
ttggaaaaataat

SEQ ID NO: 670193 - DNA, 13 bp, D. melanogaster
ttggaaaaatcca

SEQ ID NO: 670194 - DNA, 13 bp, D. melanogaster
ttggaaaaatgtc

SEQ ID NO: 670195 - DNA, 13 bp, D. melanogaster
ttggaaaaattaa

SEQ ID NO: 670196 - DNA, 13 bp, D. melanogaster
ttggaaaaattct

SEQ ID NO: 670197 - DNA, 13 bp, D. melanogaster
ttggaaaacattt

SEQ ID NO: 670198 - DNA, 14 bp, D. melanogaster
ttggaaaacatttt

SEQ ID NO: 670199 - DNA, 13 bp, D. melanogaster
ttggaaaaccaaa

SEQ ID NO: 670200 - DNA, 13 bp, D. melanogaster
ttggaaaagaaat

SEQ ID NO: 670201 - DNA, 13 bp, D. melanogaster
ttggaaaagtaaa

SEQ ID NO: 670202 - DNA, 13 bp, D. melanogaster
ttggaaaataaat

SEQ ID NO: 670203 - DNA, 13 bp, D. melanogaster
ttggaaaataatt

SEQ ID NO: 670204 - DNA, 13 bp, D. melanogaster
ttggaaaatatac

SEQ ID NO: 670205 - DNA, 13 bp, D. melanogaster
ttggaaaatattt

SEQ ID NO: 670206 - DNA, 13 bp, D. melanogaster
ttggaaaatcaat

SEQ ID NO: 670207 - DNA, 13 bp, D. melanogaster
ttggaaaatctaa

SEQ ID NO: 670208 - DNA, 13 bp, D. melanogaster
ttggaaaatgata

SEQ ID NO: 670209 - DNA, 14 bp, D. melanogaster
ttggaaaatggaaa

SEQ ID NO: 670210 - DNA, 13 bp, D. melanogaster
ttggaaaatggca

SEQ ID NO: 670211 - DNA, 13 bp, D. melanogaster
ttggaaaatgtgt

SEQ ID NO: 670212 - DNA, 13 bp, D. melanogaster
ttggaaaatgttt

SEQ ID NO: 670213 - DNA, 14 bp, D. melanogaster
ttggaaaatgtttt

SEQ ID NO: 670214 - DNA, 13 bp, D. melanogaster
ttggaaaattaaa

SEQ ID NO: 670215 - DNA, 13 bp, D. melanogaster
ttggaaaattcaa

SEQ ID NO: 670216 - DNA, 13 bp, D. melanogaster
ttggaaaattcat

SEQ ID NO: 670217 - DNA, 13 bp, D. melanogaster
ttggaaaattgtt

SEQ ID NO: 670218 - DNA, 13 bp, D. melanogaster
ttggaaaatttac

SEQ ID NO: 670219 - DNA, 13 bp, D. melanogaster
ttggaaaatttat

SEQ ID NO: 670220 - DNA, 13 bp, D. melanogaster
ttggaaacgcttc

SEQ ID NO: 670221 - DNA, 13 bp, D. melanogaster
ttggaaagatgca

SEQ ID NO: 670222 - DNA, 13 bp, D. melanogaster
ttggaaagggaaa

SEQ ID NO: 670223 - DNA, 13 bp, D. melanogaster
ttggaaagtattt

SEQ ID NO: 670224 - DNA, 13 bp, D. melanogaster
ttggaaagttttt

SEQ ID NO: 670225 - DNA, 13 bp, D. melanogaster
ttggaaataatgg

SEQ ID NO: 670226 - DNA, 13 bp, D. melanogaster
ttggaaatacata

SEQ ID NO: 670227 - DNA, 13 bp, D. melanogaster
ttggaaatataaa

SEQ ID NO: 670228 - DNA, 13 bp, D. melanogaster
ttggaaatatata

SEQ ID NO: 670229 - DNA, 13 bp, D. melanogaster
ttggaaatattca

SEQ ID NO: 670230 - DNA, 13 bp, D. melanogaster
ttggaaatattta

SEQ ID NO: 670231 - DNA, 13 bp, D. melanogaster
ttggaaatatttc

SEQ ID NO: 670232 - DNA, 14 bp, D. melanogaster
ttggaaatattttg

SEQ ID NO: 670233 - DNA, 13 bp, D. melanogaster
ttggaaatcaaaa

SEQ ID NO: 670234 - DNA, 13 bp, D. melanogaster
ttggaaatcaatt

SEQ ID NO: 670235 - DNA, 13 bp, D. melanogaster
ttggaaatccaat

SEQ ID NO: 670236 - DNA, 13 bp, D. melanogaster
ttggaaatccatt

SEQ ID NO: 670237 - DNA, 13 bp, D. melanogaster
ttggaaatcgaga

SEQ ID NO: 670238 - DNA, 13 bp, D. melanogaster
ttggaaatcttca

SEQ ID NO: 670239 - DNA, 13 bp, D. melanogaster
ttggaaatgattt

SEQ ID NO: 670240 - DNA, 13 bp, D. melanogaster
ttggaaatggcta

SEQ ID NO: 670241 - DNA, 13 bp, D. melanogaster
ttggaaatgtgca

SEQ ID NO: 670242 - DNA, 13 bp, D. melanogaster
ttggaaatgtttt

SEQ ID NO: 670243 - DNA, 13 bp, D. melanogaster
ttggaaattaaaa

SEQ ID NO: 670244 - DNA, 13 bp, D. melanogaster
ttggaaattaagt

SEQ ID NO: 670245 - DNA, 13 bp, D. melanogaster
ttggaaattatca

SEQ ID NO: 670246 - DNA, 13 bp, D. melanogaster
ttggaaattatgt

SEQ ID NO: 670247 - DNA, 13 bp, D. melanogaster
ttggaaattcaat

SEQ ID NO: 670248 - DNA, 13 bp, D. melanogaster
ttggaaattgtgt

SEQ ID NO: 670249 - DNA, 14 bp, D. melanogaster
ttggaaatttaaaa

SEQ ID NO: 670250 - DNA, 13 bp, D. melanogaster
ttggaaatttatg

SEQ ID NO: 670251 - DNA, 13 bp, D. melanogaster
ttggaaatttgtt

SEQ ID NO: 670252 - DNA, 14 bp, D. melanogaster
ttggaaatttgttt

SEQ ID NO: 670253 - DNA, 13 bp, D. melanogaster
ttggaaattttaa

SEQ ID NO: 670254 - DNA, 13 bp, D. melanogaster
ttggaaattttca

SEQ ID NO: 670255 - DNA, 13 bp, D. melanogaster
ttggaaattttga

SEQ ID NO: 670256 - DNA, 14 bp, D. melanogaster
ttggaacatctgtt

SEQ ID NO: 670257 - DNA, 13 bp, D. melanogaster
ttggaacattttc

SEQ ID NO: 670258 - DNA, 14 bp, D. melanogaster
ttggaacattttcc

SEQ ID NO: 670259 - DNA, 13 bp, D. melanogaster
ttggaacgcaaac

SEQ ID NO: 670260 - DNA, 13 bp, D. melanogaster
ttggaactatttt

SEQ ID NO: 670261 - DNA, 13 bp, D. melanogaster
ttggaagaaatcc

SEQ ID NO: 670262 - DNA, 13 bp, D. melanogaster
ttggaagaactga

SEQ ID NO: 670263 - DNA, 13 bp, D. melanogaster
ttggaagactcag

SEQ ID NO: 670264 - DNA, 14 bp, D. melanogaster
ttggaagctggaaa

SEQ ID NO: 670265 - DNA, 14 bp, D. melanogaster
ttggaagtggaaat

SEQ ID NO: 670266 - DNA, 13 bp, D. melanogaster
ttggaagtgtgtt

SEQ ID NO: 670267 - DNA, 13 bp, D. melanogaster
ttggaataaataa

SEQ ID NO: 670268 - DNA, 13 bp, D. melanogaster
ttggaataaattt

SEQ ID NO: 670269 - DNA, 13 bp, D. melanogaster
ttggaataataat

SEQ ID NO: 670270 - DNA, 13 bp, D. melanogaster
ttggaatacaaat

SEQ ID NO: 670271 - DNA, 13 bp, D. melanogaster
ttggaatataaaa

SEQ ID NO: 670272 - DNA, 13 bp, D. melanogaster
ttggaatatacta

SEQ ID NO: 670273 - DNA, 13 bp, D. melanogaster
ttggaatatttct

SEQ ID NO: 670274 - DNA, 13 bp, D. melanogaster
ttggaatcattat

SEQ ID NO: 670275 - DNA, 13 bp, D. melanogaster
ttggaatgcaaat

SEQ ID NO: 670276 - DNA, 13 bp, D. melanogaster
ttggaattaaaat

SEQ ID NO: 670277 - DNA, 13 bp, D. melanogaster
ttggaattaaata

SEQ ID NO: 670278 - DNA, 13 bp, D. melanogaster
ttggaattatttg

SEQ ID NO: 670279 - DNA, 13 bp, D. melanogaster
ttggaattcattt

SEQ ID NO: 670280 - DNA, 13 bp, D. melanogaster
ttggaattgaaat

SEQ ID NO: 670281 - DNA, 13 bp, D. melanogaster
ttggaattgataa

SEQ ID NO: 670282 - DNA, 14 bp, D. melanogaster
ttggaattgataat

SEQ ID NO: 670283 - DNA, 13 bp, D. melanogaster
ttggaattgattt

SEQ ID NO: 670284 - DNA, 13 bp, D. melanogaster
ttggaattgcaat

SEQ ID NO: 670285 - DNA, 13 bp, D. melanogaster
ttggaattggaaa

SEQ ID NO: 670286 - DNA, 13 bp, D. melanogaster
ttggaatttaaat

SEQ ID NO: 670287 - DNA, 13 bp, D. melanogaster
ttggaatttcatt

SEQ ID NO: 670288 - DNA, 13 bp, D. melanogaster
ttggaattttaaa

SEQ ID NO: 670289 - DNA, 13 bp, D. melanogaster
ttggaattttata

SEQ ID NO: 670290 - DNA, 13 bp, D. melanogaster
ttggaattttccc

SEQ ID NO: 670291 - DNA, 13 bp, D. melanogaster
ttggaattttgtg

SEQ ID NO: 670292 - DNA, 13 bp, D. melanogaster
ttggaatttttca

SEQ ID NO: 670293 - DNA, 13 bp, D. melanogaster
ttggacaaacaaa

SEQ ID NO: 670294 - DNA, 13 bp, D. melanogaster
ttggacaaggatg

SEQ ID NO: 670295 - DNA, 13 bp, D. melanogaster
ttggacaagtttt

SEQ ID NO: 670296 - DNA, 13 bp, D. melanogaster
ttggacatttttc

SEQ ID NO: 670297 - DNA, 13 bp, D. melanogaster
ttggacccaaaaa

SEQ ID NO: 670298 - DNA, 13 bp, D. melanogaster
ttggacgccgttt

SEQ ID NO: 670299 - DNA, 13 bp, D. melanogaster
ttggactgtttaa

SEQ ID NO: 670300 - DNA, 14 bp, D. melanogaster
ttggactgtttaac

SEQ ID NO: 670301 - DNA, 13 bp, D. melanogaster
ttggacttctact

SEQ ID NO: 670302 - DNA, 14 bp, D. melanogaster
ttggacttctactt

SEQ ID NO: 670303 - DNA, 13 bp, D. melanogaster
ttggacttggctt

SEQ ID NO: 670304 - DNA, 14 bp, D. melanogaster
ttggagaaccacag

SEQ ID NO: 670305 - DNA, 13 bp, D. melanogaster
ttggagagcagag

SEQ ID NO: 670306 - DNA, 13 bp, D. melanogaster
ttggagattcaac

SEQ ID NO: 670307 - DNA, 13 bp, D. melanogaster
ttggagcagaaaa

SEQ ID NO: 670308 - DNA, 13 bp, D. melanogaster
ttggagcagttcc

SEQ ID NO: 670309 - DNA, 13 bp, D. melanogaster
ttggagcttggag

SEQ ID NO: 670310 - DNA, 13 bp, D. melanogaster
ttggagtcggagt

SEQ ID NO: 670311 - DNA, 13 bp, D. melanogaster
ttggagttattag

SEQ ID NO: 670312 - DNA, 13 bp, D. melanogaster
ttggagttcatca

SEQ ID NO: 670313 - DNA, 13 bp, D. melanogaster
ttggagttggagc

SEQ ID NO: 670314 - DNA, 13 bp, D. melanogaster
ttggagttggagt

SEQ ID NO: 670315 - DNA, 14 bp, D. melanogaster
ttggagttggagtt

SEQ ID NO: 670316 - DNA, 13 bp, D. melanogaster
ttggataacttgg

SEQ ID NO: 670317 - DNA, 14 bp, D. melanogaster
ttggataatttaaa

SEQ ID NO: 670318 - DNA, 13 bp, D. melanogaster
ttggataccattt

SEQ ID NO: 670319 - DNA, 13 bp, D. melanogaster
ttggatagcgaca

SEQ ID NO: 670320 - DNA, 13 bp, D. melanogaster
ttggataggggac

SEQ ID NO: 670321 - DNA, 14 bp, D. melanogaster
ttggatatacaaat

SEQ ID NO: 670322 - DNA, 13 bp, D. melanogaster
ttggatatctatc

SEQ ID NO: 670323 - DNA, 13 bp, D. melanogaster
ttggatattaatt

SEQ ID NO: 670324 - DNA, 13 bp, D. melanogaster
ttggatattgata

SEQ ID NO: 670325 - DNA, 14 bp, D. melanogaster
ttggatattgataa

SEQ ID NO: 670326 - DNA, 14 bp, D. melanogaster
ttggatctcagctt

SEQ ID NO: 670327 - DNA, 13 bp, D. melanogaster
ttggatggatgga

SEQ ID NO: 670328 - DNA, 14 bp, D. melanogaster
ttggatggatggat

SEQ ID NO: 670329 - DNA, 14 bp, D. melanogaster
ttggatgtttgtcg

SEQ ID NO: 670330 - DNA, 13 bp, D. melanogaster
ttggattaattca

SEQ ID NO: 670331 - DNA, 13 bp, D. melanogaster
ttggattataatt

SEQ ID NO: 670332 - DNA, 13 bp, D. melanogaster
ttggattattaat

SEQ ID NO: 670333 - DNA, 14 bp, D. melanogaster
ttggattccatttt

SEQ ID NO: 670334 - DNA, 13 bp, D. melanogaster
ttggattcgaatt

SEQ ID NO: 670335 - DNA, 13 bp, D. melanogaster
ttggattcgattg

SEQ ID NO: 670336 - DNA, 13 bp, D. melanogaster
ttggattcgattt

SEQ ID NO: 670337 - DNA, 13 bp, D. melanogaster
ttggattcggatt

SEQ ID NO: 670338 - DNA, 14 bp, D. melanogaster
ttggattcggattc

SEQ ID NO: 670339 - DNA, 13 bp, D. melanogaster
ttggattctaaat

SEQ ID NO: 670340 - DNA, 13 bp, D. melanogaster
ttggattggattg

SEQ ID NO: 670341 - DNA, 13 bp, D. melanogaster
ttggattgggatt

SEQ ID NO: 670342 - DNA, 13 bp, D. melanogaster
ttggatttcagtt

SEQ ID NO: 670343 - DNA, 13 bp, D. melanogaster
ttggatttcattt

SEQ ID NO: 670344 - DNA, 13 bp, D. melanogaster
ttggatttcgatt

SEQ ID NO: 670345 - DNA, 13 bp, D. melanogaster
ttggatttgcaaa

SEQ ID NO: 670346 - DNA, 14 bp, D. melanogaster
ttggatttgcaaaa

SEQ ID NO: 670347 - DNA, 13 bp, D. melanogaster
ttggatttgcttt

SEQ ID NO: 670348 - DNA, 13 bp, D. melanogaster
ttggatttggatt

SEQ ID NO: 670349 - DNA, 13 bp, D. melanogaster
ttggatttggcca

SEQ ID NO: 670350 - DNA, 14 bp, D. melanogaster
ttggatttggcttt

SEQ ID NO: 670351 - DNA, 13 bp, D. melanogaster
ttggatttgggat

SEQ ID NO: 670352 - DNA, 13 bp, D. melanogaster
ttggatttgggct

SEQ ID NO: 670353 - DNA, 13 bp, D. melanogaster
ttggattttaaaa

SEQ ID NO: 670354 - DNA, 13 bp, D. melanogaster
ttggattttcaat

SEQ ID NO: 670355 - DNA, 13 bp, D. melanogaster
ttggattttggct

SEQ ID NO: 670356 - DNA, 13 bp, D. melanogaster
ttggatttttcat

SEQ ID NO: 670357 - DNA, 13 bp, D. melanogaster
ttggatttttcca

SEQ ID NO: 670358 - DNA, 13 bp, D. melanogaster
ttggatttttcct

SEQ ID NO: 670359 - DNA, 13 bp, D. melanogaster
ttggcaaaaaact

SEQ ID NO: 670360 - DNA, 13 bp, D. melanogaster
ttggcaaaaacta

SEQ ID NO: 670361 - DNA, 13 bp, D. melanogaster
ttggcaaaaactt

SEQ ID NO: 670362 - DNA, 14 bp, D. melanogaster
ttggcaaaaagttt

SEQ ID NO: 670363 - DNA, 13 bp, D. melanogaster
ttggcaaaaatgc

SEQ ID NO: 670364 - DNA, 13 bp, D. melanogaster
ttggcaaaaattt

SEQ ID NO: 670365 - DNA, 13 bp, D. melanogaster
ttggcaaaacatt

SEQ ID NO: 670366 - DNA, 13 bp, D. melanogaster
ttggcaaaacttt

SEQ ID NO: 670367 - DNA, 13 bp, D. melanogaster
ttggcaaaattat

SEQ ID NO: 670368 - DNA, 13 bp, D. melanogaster
ttggcaaacaaaa

SEQ ID NO: 670369 - DNA, 14 bp, D. melanogaster
ttggcaaacaaaca

SEQ ID NO: 670370 - DNA, 13 bp, D. melanogaster
ttggcaaacaaat

SEQ ID NO: 670371 - DNA, 14 bp, D. melanogaster
ttggcaaacaaatg

SEQ ID NO: 670372 - DNA, 14 bp, D. melanogaster
ttggcaaacaaatt

SEQ ID NO: 670373 - DNA, 13 bp, D. melanogaster
ttggcaaacaatt

SEQ ID NO: 670374 - DNA, 13 bp, D. melanogaster
ttggcaaacagaa

SEQ ID NO: 670375 - DNA, 13 bp, D. melanogaster
ttggcaaacattg

SEQ ID NO: 670376 - DNA, 13 bp, D. melanogaster
ttggcaaacattt

SEQ ID NO: 670377 - DNA, 13 bp, D. melanogaster
ttggcaaactttt

SEQ ID NO: 670378 - DNA, 13 bp, D. melanogaster
ttggcaaagcaaa

SEQ ID NO: 670379 - DNA, 13 bp, D. melanogaster
ttggcaaaggaaa

SEQ ID NO: 670380 - DNA, 13 bp, D. melanogaster
ttggcaaagtgtt

SEQ ID NO: 670381 - DNA, 13 bp, D. melanogaster
ttggcaaagtttt

SEQ ID NO: 670382 - DNA, 13 bp, D. melanogaster
ttggcaaataaat

SEQ ID NO: 670383 - DNA, 13 bp, D. melanogaster
ttggcaaatattt

SEQ ID NO: 670384 - DNA, 14 bp, D. melanogaster
ttggcaaatatttg

SEQ ID NO: 670385 - DNA, 13 bp, D. melanogaster
ttggcaaatcaaa

SEQ ID NO: 670386 - DNA, 13 bp, D. melanogaster
ttggcaaatctgg

SEQ ID NO: 670387 - DNA, 13 bp, D. melanogaster
ttggcaaatgaaa

SEQ ID NO: 670388 - DNA, 14 bp, D. melanogaster
ttggcaaatgctca

SEQ ID NO: 670389 - DNA, 13 bp, D. melanogaster
ttggcaaatgtat

SEQ ID NO: 670390 - DNA, 13 bp, D. melanogaster
ttggcaaatgttt

SEQ ID NO: 670391 - DNA, 14 bp, D. melanogaster
ttggcaaatgtttg

SEQ ID NO: 670392 - DNA, 14 bp, D. melanogaster
ttggcaaattaaaa

SEQ ID NO: 670393 - DNA, 13 bp, D. melanogaster
ttggcaaattgtt

SEQ ID NO: 670394 - DNA, 13 bp, D. melanogaster
ttggcaaattttc

SEQ ID NO: 670395 - DNA, 13 bp, D. melanogaster
ttggcaacaaaca

SEQ ID NO: 670396 - DNA, 14 bp, D. melanogaster
ttggcaacaacaaa

SEQ ID NO: 670397 - DNA, 13 bp, D. melanogaster
ttggcaacaactt

SEQ ID NO: 670398 - DNA, 13 bp, D. melanogaster
ttggcaacaattt

SEQ ID NO: 670399 - DNA, 13 bp, D. melanogaster
ttggcaacacaaa

SEQ ID NO: 670400 - DNA, 13 bp, D. melanogaster
ttggcaacacttt

SEQ ID NO: 670401 - DNA, 14 bp, D. melanogaster
ttggcaacactttt

SEQ ID NO: 670402 - DNA, 13 bp, D. melanogaster
ttggcaacatgtt

SEQ ID NO: 670403 - DNA, 13 bp, D. melanogaster
ttggcaacattgt

SEQ ID NO: 670404 - DNA, 13 bp, D. melanogaster
ttggcaacatttt

SEQ ID NO: 670405 - DNA, 13 bp, D. melanogaster
ttggcaacctttt

SEQ ID NO: 670406 - DNA, 13 bp, D. melanogaster
ttggcaacgaaaa

SEQ ID NO: 670407 - DNA, 13 bp, D. melanogaster
ttggcaactaatt

SEQ ID NO: 670408 - DNA, 13 bp, D. melanogaster
ttggcaactgaaa

SEQ ID NO: 670409 - DNA, 13 bp, D. melanogaster
ttggcaacttttt

SEQ ID NO: 670410 - DNA, 13 bp, D. melanogaster
ttggcaagaaaaa

SEQ ID NO: 670411 - DNA, 13 bp, D. melanogaster
ttggcaagacaaa

SEQ ID NO: 670412 - DNA, 13 bp, D. melanogaster
ttggcaagagttt

SEQ ID NO: 670413 - DNA, 13 bp, D. melanogaster
ttggcaagcaaaa

SEQ ID NO: 670414 - DNA, 13 bp, D. melanogaster
ttggcaagcattt

SEQ ID NO: 670415 - DNA, 13 bp, D. melanogaster
ttggcaagcgaaa

SEQ ID NO: 670416 - DNA, 13 bp, D. melanogaster
ttggcaaggagag

SEQ ID NO: 670417 - DNA, 14 bp, D. melanogaster
ttggcaataaaaaa

SEQ ID NO: 670418 - DNA, 13 bp, D. melanogaster
ttggcaataattt

SEQ ID NO: 670419 - DNA, 13 bp, D. melanogaster
ttggcaatataaa

SEQ ID NO: 670420 - DNA, 13 bp, D. melanogaster
ttggcaatcaatt

SEQ ID NO: 670421 - DNA, 13 bp, D. melanogaster
ttggcaatcgaaa

SEQ ID NO: 670422 - DNA, 13 bp, D. melanogaster
ttggcaatcgttt

SEQ ID NO: 670423 - DNA, 14 bp, D. melanogaster
ttggcaatgcaatt

SEQ ID NO: 670424 - DNA, 14 bp, D. melanogaster
ttggcaatgccaaa

SEQ ID NO: 670425 - DNA, 13 bp, D. melanogaster
ttggcaatggcaa

SEQ ID NO: 670426 - DNA, 13 bp, D. melanogaster
ttggcaatggcat

SEQ ID NO: 670427 - DNA, 13 bp, D. melanogaster
ttggcaatgggaa

SEQ ID NO: 670428 - DNA, 13 bp, D. melanogaster
ttggcaattaagc

SEQ ID NO: 670429 - DNA, 13 bp, D. melanogaster
ttggcaattattt

SEQ ID NO: 670430 - DNA, 13 bp, D. melanogaster
ttggcaattgaaa

SEQ ID NO: 670431 - DNA, 13 bp, D. melanogaster
ttggcaattggaa

SEQ ID NO: 670432 - DNA, 13 bp, D. melanogaster
ttggcaatttaat

SEQ ID NO: 670433 - DNA, 13 bp, D. melanogaster
ttggcaatttcca

SEQ ID NO: 670434 - DNA, 13 bp, D. melanogaster
ttggcaatttctt

SEQ ID NO: 670435 - DNA, 14 bp, D. melanogaster
ttggcaatttcttt

SEQ ID NO: 670436 - DNA, 13 bp, D. melanogaster
ttggcaatttgca

SEQ ID NO: 670437 - DNA, 13 bp, D. melanogaster
ttggcaatttggc

SEQ ID NO: 670438 - DNA, 13 bp, D. melanogaster
ttggcaatttgtt

SEQ ID NO: 670439 - DNA, 13 bp, D. melanogaster
ttggcaattttgg

SEQ ID NO: 670440 - DNA, 13 bp, D. melanogaster
ttggcaattttgt

SEQ ID NO: 670441 - DNA, 13 bp, D. melanogaster
ttggcaatttttg

SEQ ID NO: 670442 - DNA, 13 bp, D. melanogaster
ttggcaatttttt

SEQ ID NO: 670443 - DNA, 13 bp, D. melanogaster
ttggcacaatttt

SEQ ID NO: 670444 - DNA, 14 bp, D. melanogaster
ttggcacaattttg

SEQ ID NO: 670445 - DNA, 13 bp, D. melanogaster
ttggcacacaatg

SEQ ID NO: 670446 - DNA, 14 bp, D. melanogaster
ttggcacacacaca

SEQ ID NO: 670447 - DNA, 13 bp, D. melanogaster
ttggcacactttt

SEQ ID NO: 670448 - DNA, 13 bp, D. melanogaster
ttggcacgcccac

SEQ ID NO: 670449 - DNA, 13 bp, D. melanogaster
ttggcactgccat

SEQ ID NO: 670450 - DNA, 13 bp, D. melanogaster
ttggcactgctca

SEQ ID NO: 670451 - DNA, 14 bp, D. melanogaster
ttggcactgctcag

SEQ ID NO: 670452 - DNA, 13 bp, D. melanogaster
ttggcactttgct

SEQ ID NO: 670453 - DNA, 13 bp, D. melanogaster
ttggcactttggc

SEQ ID NO: 670454 - DNA, 13 bp, D. melanogaster
ttggcagaaaatt

SEQ ID NO: 670455 - DNA, 13 bp, D. melanogaster
ttggcagacattt

SEQ ID NO: 670456 - DNA, 13 bp, D. melanogaster
ttggcagcaaaaa

SEQ ID NO: 670457 - DNA, 13 bp, D. melanogaster
ttggcagcaaaca

SEQ ID NO: 670458 - DNA, 13 bp, D. melanogaster
ttggcagcaattt

SEQ ID NO: 670459 - DNA, 13 bp, D. melanogaster
ttggcagccattt

SEQ ID NO: 670460 - DNA, 13 bp, D. melanogaster
ttggcagcgcagc

SEQ ID NO: 670461 - DNA, 13 bp, D. melanogaster
ttggcagctactt

SEQ ID NO: 670462 - DNA, 14 bp, D. melanogaster
ttggcagctacttt

SEQ ID NO: 670463 - DNA, 13 bp, D. melanogaster
ttggcagctgcca

SEQ ID NO: 670464 - DNA, 13 bp, D. melanogaster
ttggcagctgctt

SEQ ID NO: 670465 - DNA, 13 bp, D. melanogaster
ttggcagctgttg

SEQ ID NO: 670466 - DNA, 13 bp, D. melanogaster
ttggcagcttttt

SEQ ID NO: 670467 - DNA, 13 bp, D. melanogaster
ttggcaggaaaaa

SEQ ID NO: 670468 - DNA, 13 bp, D. melanogaster
ttggcagggaaaa

SEQ ID NO: 670469 - DNA, 14 bp, D. melanogaster
ttggcagtacaaaa

SEQ ID NO: 670470 - DNA, 13 bp, D. melanogaster
ttggcagtggcag

SEQ ID NO: 670471 - DNA, 13 bp, D. melanogaster
ttggcagttgcca

SEQ ID NO: 670472 - DNA, 13 bp, D. melanogaster
ttggcagttggca

SEQ ID NO: 670473 - DNA, 13 bp, D. melanogaster
ttggcagtttttt

SEQ ID NO: 670474 - DNA, 13 bp, D. melanogaster
ttggcataaatat

SEQ ID NO: 670475 - DNA, 13 bp, D. melanogaster
ttggcataataat

SEQ ID NO: 670476 - DNA, 13 bp, D. melanogaster
ttggcataattaa

SEQ ID NO: 670477 - DNA, 13 bp, D. melanogaster
ttggcataattga

SEQ ID NO: 670478 - DNA, 13 bp, D. melanogaster
ttggcatactttt

SEQ ID NO: 670479 - DNA, 13 bp, D. melanogaster
ttggcatatttca

SEQ ID NO: 670480 - DNA, 15 bp, D. melanogaster
ttggcatcaatgtta

SEQ ID NO: 670481 - DNA, 14 bp, D. melanogaster
ttggcatccttggc

SEQ ID NO: 670482 - DNA, 13 bp, D. melanogaster
ttggcatcgattt

SEQ ID NO: 670483 - DNA, 13 bp, D. melanogaster
ttggcatcggaat

SEQ ID NO: 670484 - DNA, 13 bp, D. melanogaster
ttggcatgcaaaa

SEQ ID NO: 670485 - DNA, 13 bp, D. melanogaster
ttggcatgccaaa

SEQ ID NO: 670486 - DNA, 13 bp, D. melanogaster
ttggcatgtctgt

SEQ ID NO: 670487 - DNA, 13 bp, D. melanogaster
ttggcattaaatt

SEQ ID NO: 670488 - DNA, 13 bp, D. melanogaster
ttggcattagttt

SEQ ID NO: 670489 - DNA, 14 bp, D. melanogaster
ttggcattcaaatt

SEQ ID NO: 670490 - DNA, 13 bp, D. melanogaster
ttggcattcattt

SEQ ID NO: 670491 - DNA, 13 bp, D. melanogaster
ttggcattgaatt

SEQ ID NO: 670492 - DNA, 13 bp, D. melanogaster
ttggcattgattg

SEQ ID NO: 670493 - DNA, 13 bp, D. melanogaster
ttggcattgcaaa

SEQ ID NO: 670494 - DNA, 13 bp, D. melanogaster
ttggcattgccaa

SEQ ID NO: 670495 - DNA, 13 bp, D. melanogaster
ttggcattgccat

SEQ ID NO: 670496 - DNA, 13 bp, D. melanogaster
ttggcattgcttt

SEQ ID NO: 670497 - DNA, 13 bp, D. melanogaster
ttggcattggcca

SEQ ID NO: 670498 - DNA, 13 bp, D. melanogaster
ttggcattgtaat

SEQ ID NO: 670499 - DNA, 13 bp, D. melanogaster
ttggcattgtttt

SEQ ID NO: 670500 - DNA, 13 bp, D. melanogaster
ttggcatttaaat

SEQ ID NO: 670501 - DNA, 14 bp, D. melanogaster
ttggcatttaaatt

SEQ ID NO: 670502 - DNA, 13 bp, D. melanogaster
ttggcatttaatt

SEQ ID NO: 670503 - DNA, 13 bp, D. melanogaster
ttggcatttatga

SEQ ID NO: 670504 - DNA, 13 bp, D. melanogaster
ttggcatttatgc

SEQ ID NO: 670505 - DNA, 13 bp, D. melanogaster
ttggcatttattt

SEQ ID NO: 670506 - DNA, 13 bp, D. melanogaster
ttggcatttcaat

SEQ ID NO: 670507 - DNA, 13 bp, D. melanogaster
ttggcatttcatt

SEQ ID NO: 670508 - DNA, 13 bp, D. melanogaster
ttggcatttccgt

SEQ ID NO: 670509 - DNA, 13 bp, D. melanogaster
ttggcatttcgca

SEQ ID NO: 670510 - DNA, 13 bp, D. melanogaster
ttggcatttctat

SEQ ID NO: 670511 - DNA, 13 bp, D. melanogaster
ttggcatttgaat

SEQ ID NO: 670512 - DNA, 13 bp, D. melanogaster
ttggcatttgcaa

SEQ ID NO: 670513 - DNA, 13 bp, D. melanogaster
ttggcatttgcat

SEQ ID NO: 670514 - DNA, 13 bp, D. melanogaster
ttggcatttgttg

SEQ ID NO: 670515 - DNA, 14 bp, D. melanogaster
ttggcatttgtttg

SEQ ID NO: 670516 - DNA, 14 bp, D. melanogaster
ttggcatttgtttt

SEQ ID NO: 670517 - DNA, 13 bp, D. melanogaster
ttggcattttaaa

SEQ ID NO: 670518 - DNA, 14 bp, D. melanogaster
ttggcattttaaat

SEQ ID NO: 670519 - DNA, 14 bp, D. melanogaster
ttggcattttaatt

SEQ ID NO: 670520 - DNA, 13 bp, D. melanogaster
ttggcattttcat

SEQ ID NO: 670521 - DNA, 14 bp, D. melanogaster
ttggcattttcatt

SEQ ID NO: 670522 - DNA, 13 bp, D. melanogaster
ttggcattttgtt

SEQ ID NO: 670523 - DNA, 13 bp, D. melanogaster
ttggcatttttat

SEQ ID NO: 670524 - DNA, 13 bp, D. melanogaster
ttggcatttttcg

SEQ ID NO: 670525 - DNA, 13 bp, D. melanogaster
ttggcatttttga

SEQ ID NO: 670526 - DNA, 13 bp, D. melanogaster
ttggcatttttgc

SEQ ID NO: 670527 - DNA, 13 bp, D. melanogaster
ttggcattttttg

SEQ ID NO: 670528 - DNA, 14 bp, D. melanogaster
ttggccaaaaaaaa

SEQ ID NO: 670529 - DNA, 13 bp, D. melanogaster
ttggccaaaaaag

SEQ ID NO: 670530 - DNA, 14 bp, D. melanogaster
ttggccaaaaaaga

SEQ ID NO: 670531 - DNA, 14 bp, D. melanogaster
ttggccaaaaaagg

SEQ ID NO: 670532 - DNA, 13 bp, D. melanogaster
ttggccaaaaaat

SEQ ID NO: 670533 - DNA, 13 bp, D. melanogaster
ttggccaaaaaca

SEQ ID NO: 670534 - DNA, 14 bp, D. melanogaster
ttggccaaaaacaa

SEQ ID NO: 670535 - DNA, 13 bp, D. melanogaster
ttggccaaaaacg

SEQ ID NO: 670536 - DNA, 13 bp, D. melanogaster
ttggccaaaaact

SEQ ID NO: 670537 - DNA, 14 bp, D. melanogaster
ttggccaaaaagaa

SEQ ID NO: 670538 - DNA, 14 bp, D. melanogaster
ttggccaaaaagca

SEQ ID NO: 670539 - DNA, 13 bp, D. melanogaster
ttggccaaaaagg

SEQ ID NO: 670540 - DNA, 14 bp, D. melanogaster
ttggccaaaaaggg

SEQ ID NO: 670541 - DNA, 14 bp, D. melanogaster
ttggccaaaaagtt

SEQ ID NO: 670542 - DNA, 13 bp, D. melanogaster
ttggccaaaaatg

SEQ ID NO: 670543 - DNA, 13 bp, D. melanogaster
ttggccaaaacaa

SEQ ID NO: 670544 - DNA, 14 bp, D. melanogaster
ttggccaaaacaaa

SEQ ID NO: 670545 - DNA, 14 bp, D. melanogaster
ttggccaaaacaat

SEQ ID NO: 670546 - DNA, 13 bp, D. melanogaster
ttggccaaaacac

SEQ ID NO: 670547 - DNA, 14 bp, D. melanogaster
ttggccaaaacaga

SEQ ID NO: 670548 - DNA, 14 bp, D. melanogaster
ttggccaaaaccaa

SEQ ID NO: 670549 - DNA, 13 bp, D. melanogaster
ttggccaaaaccc

SEQ ID NO: 670550 - DNA, 13 bp, D. melanogaster
ttggccaaaactc

SEQ ID NO: 670551 - DNA, 13 bp, D. melanogaster
ttggccaaaactt

SEQ ID NO: 670552 - DNA, 13 bp, D. melanogaster
ttggccaaaagaa

SEQ ID NO: 670553 - DNA, 13 bp, D. melanogaster
ttggccaaaagag

SEQ ID NO: 670554 - DNA, 13 bp, D. melanogaster
ttggccaaaagca

SEQ ID NO: 670555 - DNA, 14 bp, D. melanogaster
ttggccaaaagcaa

SEQ ID NO: 670556 - DNA, 14 bp, D. melanogaster
ttggccaaaagcag

SEQ ID NO: 670557 - DNA, 14 bp, D. melanogaster
ttggccaaaagcca

SEQ ID NO: 670558 - DNA, 13 bp, D. melanogaster
ttggccaaaagcg

SEQ ID NO: 670559 - DNA, 14 bp, D. melanogaster
ttggccaaaagcga

SEQ ID NO: 670560 - DNA, 13 bp, D. melanogaster
ttggccaaaagtg

SEQ ID NO: 670561 - DNA, 13 bp, D. melanogaster
ttggccaaaagtt

SEQ ID NO: 670562 - DNA, 14 bp, D. melanogaster
ttggccaaaagttt

SEQ ID NO: 670563 - DNA, 13 bp, D. melanogaster
ttggccaaaatgc

SEQ ID NO: 670564 - DNA, 13 bp, D. melanogaster
ttggccaaacaaa

SEQ ID NO: 670565 - DNA, 14 bp, D. melanogaster
ttggccaaacaaaa

SEQ ID NO: 670566 - DNA, 13 bp, D. melanogaster
ttggccaaactaa

SEQ ID NO: 670567 - DNA, 13 bp, D. melanogaster
ttggccaaagcaa

SEQ ID NO: 670568 - DNA, 13 bp, D. melanogaster
ttggccaaaggaa

SEQ ID NO: 670569 - DNA, 13 bp, D. melanogaster
ttggccaaagtaa

SEQ ID NO: 670570 - DNA, 13 bp, D. melanogaster
ttggccaaagtca

SEQ ID NO: 670571 - DNA, 13 bp, D. melanogaster
ttggccaaagtgc

SEQ ID NO: 670572 - DNA, 13 bp, D. melanogaster
ttggccaaagtgg

SEQ ID NO: 670573 - DNA, 13 bp, D. melanogaster
ttggccaaagtta

SEQ ID NO: 670574 - DNA, 13 bp, D. melanogaster
ttggccaaagttg

SEQ ID NO: 670575 - DNA, 14 bp, D. melanogaster
ttggccaaataaat

SEQ ID NO: 670576 - DNA, 13 bp, D. melanogaster
ttggccaaatatt

SEQ ID NO: 670577 - DNA, 13 bp, D. melanogaster
ttggccaaatccc

SEQ ID NO: 670578 - DNA, 13 bp, D. melanogaster
ttggccaaatgaa

SEQ ID NO: 670579 - DNA, 13 bp, D. melanogaster
ttggccaaatgac

SEQ ID NO: 670580 - DNA, 13 bp, D. melanogaster
ttggccaaatgat

SEQ ID NO: 670581 - DNA, 13 bp, D. melanogaster
ttggccaaatgca

SEQ ID NO: 670582 - DNA, 13 bp, D. melanogaster
ttggccaaatgtc

SEQ ID NO: 670583 - DNA, 13 bp, D. melanogaster
ttggccaaattaa

SEQ ID NO: 670584 - DNA, 13 bp, D. melanogaster
ttggccaaattat

SEQ ID NO: 670585 - DNA, 13 bp, D. melanogaster
ttggccaaattgc

SEQ ID NO: 670586 - DNA, 14 bp, D. melanogaster
ttggccaaattgca

SEQ ID NO: 670587 - DNA, 13 bp, D. melanogaster
ttggccaaatttg

SEQ ID NO: 670588 - DNA, 13 bp, D. melanogaster
ttggccaacaaaa

SEQ ID NO: 670589 - DNA, 14 bp, D. melanogaster
ttggccaacaaaaa

SEQ ID NO: 670590 - DNA, 14 bp, D. melanogaster
ttggccaacaaaca

SEQ ID NO: 670591 - DNA, 13 bp, D. melanogaster
ttggccaacaaat

SEQ ID NO: 670592 - DNA, 14 bp, D. melanogaster
ttggccaacaacaa

SEQ ID NO: 670593 - DNA, 13 bp, D. melanogaster
ttggccaacaact

SEQ ID NO: 670594 - DNA, 13 bp, D. melanogaster
ttggccaacaagt

SEQ ID NO: 670595 - DNA, 14 bp, D. melanogaster
ttggccaacacaca

SEQ ID NO: 670596 - DNA, 13 bp, D. melanogaster
ttggccaacactt

SEQ ID NO: 670597 - DNA, 14 bp, D. melanogaster
ttggccaacacttt

SEQ ID NO: 670598 - DNA, 14 bp, D. melanogaster
ttggccaacagcaa

SEQ ID NO: 670599 - DNA, 13 bp, D. melanogaster
ttggccaacagtt

SEQ ID NO: 670600 - DNA, 13 bp, D. melanogaster
ttggccaacattt

SEQ ID NO: 670601 - DNA, 13 bp, D. melanogaster
ttggccaaccaaa

SEQ ID NO: 670602 - DNA, 13 bp, D. melanogaster
ttggccaaccaca

SEQ ID NO: 670603 - DNA, 13 bp, D. melanogaster
ttggccaaccgaa

SEQ ID NO: 670604 - DNA, 13 bp, D. melanogaster
ttggccaactcaa

SEQ ID NO: 670605 - DNA, 13 bp, D. melanogaster
ttggccaactcag

SEQ ID NO: 670606 - DNA, 13 bp, D. melanogaster
ttggccaactcga

SEQ ID NO: 670607 - DNA, 13 bp, D. melanogaster
ttggccaactgcc

SEQ ID NO: 670608 - DNA, 13 bp, D. melanogaster
ttggccaactggc

SEQ ID NO: 670609 - DNA, 13 bp, D. melanogaster
ttggccaacttcc

SEQ ID NO: 670610 - DNA, 13 bp, D. melanogaster
ttggccaactttg

SEQ ID NO: 670611 - DNA, 13 bp, D. melanogaster
ttggccaactttt

SEQ ID NO: 670612 - DNA, 13 bp, D. melanogaster
ttggccaagaaaa

SEQ ID NO: 670613 - DNA, 13 bp, D. melanogaster
ttggccaagaaac

SEQ ID NO: 670614 - DNA, 13 bp, D. melanogaster
ttggccaagaaag

SEQ ID NO: 670615 - DNA, 13 bp, D. melanogaster
ttggccaagaaga

SEQ ID NO: 670616 - DNA, 14 bp, D. melanogaster
ttggccaagacaaa

SEQ ID NO: 670617 - DNA, 13 bp, D. melanogaster
ttggccaagagca

SEQ ID NO: 670618 - DNA, 13 bp, D. melanogaster
ttggccaagagct

SEQ ID NO: 670619 - DNA, 13 bp, D. melanogaster
ttggccaagatgg

SEQ ID NO: 670620 - DNA, 13 bp, D. melanogaster
ttggccaagattt

SEQ ID NO: 670621 - DNA, 13 bp, D. melanogaster
ttggccaagcgaa

SEQ ID NO: 670622 - DNA, 13 bp, D. melanogaster
ttggccaaggttt

SEQ ID NO: 670623 - DNA, 13 bp, D. melanogaster
ttggccaagtcag

SEQ ID NO: 670624 - DNA, 13 bp, D. melanogaster
ttggccaagtcga

SEQ ID NO: 670625 - DNA, 13 bp, D. melanogaster
ttggccaagtgca

SEQ ID NO: 670626 - DNA, 13 bp, D. melanogaster
ttggccaagtggc

SEQ ID NO: 670627 - DNA, 13 bp, D. melanogaster
ttggccaagttaa

SEQ ID NO: 670628 - DNA, 14 bp, D. melanogaster
ttggccaagttaat

SEQ ID NO: 670629 - DNA, 13 bp, D. melanogaster
ttggccaagttag

SEQ ID NO: 670630 - DNA, 13 bp, D. melanogaster
ttggccaagttat

SEQ ID NO: 670631 - DNA, 13 bp, D. melanogaster
ttggccaagttgt

SEQ ID NO: 670632 - DNA, 13 bp, D. melanogaster
ttggccaagttta

SEQ ID NO: 670633 - DNA, 13 bp, D. melanogaster
ttggccaatgaaa

SEQ ID NO: 670634 - DNA, 13 bp, D. melanogaster
ttggccaatgcaa

SEQ ID NO: 670635 - DNA, 13 bp, D. melanogaster
ttggccaattgtt

SEQ ID NO: 670636 - DNA, 13 bp, D. melanogaster
ttggccaatttac

SEQ ID NO: 670637 - DNA, 13 bp, D. melanogaster
ttggccaatttcc

SEQ ID NO: 670638 - DNA, 13 bp, D. melanogaster
ttggccaatttgt

SEQ ID NO: 670639 - DNA, 13 bp, D. melanogaster
ttggccaattttc

SEQ ID NO: 670640 - DNA, 13 bp, D. melanogaster
ttggccacaaaaa

SEQ ID NO: 670641 - DNA, 13 bp, D. melanogaster
ttggccacaaaag

SEQ ID NO: 670642 - DNA, 13 bp, D. melanogaster
ttggccacaaaat

SEQ ID NO: 670643 - DNA, 13 bp, D. melanogaster
ttggccacaacaa

SEQ ID NO: 670644 - DNA, 13 bp, D. melanogaster
ttggccacaactt

SEQ ID NO: 670645 - DNA, 14 bp, D. melanogaster
ttggccacaacttt

SEQ ID NO: 670646 - DNA, 13 bp, D. melanogaster
ttggccacaatca

SEQ ID NO: 670647 - DNA, 13 bp, D. melanogaster
ttggccacacaaa

SEQ ID NO: 670648 - DNA, 13 bp, D. melanogaster
ttggccacatcgt

SEQ ID NO: 670649 - DNA, 13 bp, D. melanogaster
ttggccacatttt

SEQ ID NO: 670650 - DNA, 13 bp, D. melanogaster
ttggccacgtttg

SEQ ID NO: 670651 - DNA, 13 bp, D. melanogaster
ttggccactgcaa

SEQ ID NO: 670652 - DNA, 13 bp, D. melanogaster
ttggccactttaa

SEQ ID NO: 670653 - DNA, 13 bp, D. melanogaster
ttggccacttttg

SEQ ID NO: 670654 - DNA, 13 bp, D. melanogaster
ttggccagaaaac

SEQ ID NO: 670655 - DNA, 13 bp, D. melanogaster
ttggccagaactt

SEQ ID NO: 670656 - DNA, 13 bp, D. melanogaster
ttggccagaagag

SEQ ID NO: 670657 - DNA, 13 bp, D. melanogaster
ttggccagaagtt

SEQ ID NO: 670658 - DNA, 13 bp, D. melanogaster
ttggccagaattt

SEQ ID NO: 670659 - DNA, 13 bp, D. melanogaster
ttggccagacaaa

SEQ ID NO: 670660 - DNA, 13 bp, D. melanogaster
ttggccagcaaaa

SEQ ID NO: 670661 - DNA, 13 bp, D. melanogaster
ttggccagcaaac

SEQ ID NO: 670662 - DNA, 13 bp, D. melanogaster
ttggccagcaatt

SEQ ID NO: 670663 - DNA, 13 bp, D. melanogaster
ttggccagcacaa

SEQ ID NO: 670664 - DNA, 13 bp, D. melanogaster
ttggccagcacat

SEQ ID NO: 670665 - DNA, 13 bp, D. melanogaster
ttggccagcactt

SEQ ID NO: 670666 - DNA, 13 bp, D. melanogaster
ttggccagcattt

SEQ ID NO: 670667 - DNA, 13 bp, D. melanogaster
ttggccagccagc

SEQ ID NO: 670668 - DNA, 13 bp, D. melanogaster
ttggccagcggca

SEQ ID NO: 670669 - DNA, 13 bp, D. melanogaster
ttggccagcggct

SEQ ID NO: 670670 - DNA, 13 bp, D. melanogaster
ttggccagctcct

SEQ ID NO: 670671 - DNA, 13 bp, D. melanogaster
ttggccagctgaa

SEQ ID NO: 670672 - DNA, 13 bp, D. melanogaster
ttggccagctgca

SEQ ID NO: 670673 - DNA, 13 bp, D. melanogaster
ttggccagctgct

SEQ ID NO: 670674 - DNA, 13 bp, D. melanogaster
ttggccagcttgg

SEQ ID NO: 670675 - DNA, 13 bp, D. melanogaster
ttggccagctttt

SEQ ID NO: 670676 - DNA, 13 bp, D. melanogaster
ttggccaggacaa

SEQ ID NO: 670677 - DNA, 13 bp, D. melanogaster
ttggccaggacat

SEQ ID NO: 670678 - DNA, 13 bp, D. melanogaster
ttggccaggacga

SEQ ID NO: 670679 - DNA, 13 bp, D. melanogaster
ttggccaggactc

SEQ ID NO: 670680 - DNA, 13 bp, D. melanogaster
ttggccaggcaaa

SEQ ID NO: 670681 - DNA, 13 bp, D. melanogaster
ttggccaggccaa

SEQ ID NO: 670682 - DNA, 14 bp, D. melanogaster
ttggccaggccaaa

SEQ ID NO: 670683 - DNA, 13 bp, D. melanogaster
ttggccaggccga

SEQ ID NO: 670684 - DNA, 13 bp, D. melanogaster
ttggccaggcttt

SEQ ID NO: 670685 - DNA, 13 bp, D. melanogaster
ttggccagttgac

SEQ ID NO: 670686 - DNA, 13 bp, D. melanogaster
ttggccagttggc

SEQ ID NO: 670687 - DNA, 13 bp, D. melanogaster
ttggccagtttcc

SEQ ID NO: 670688 - DNA, 14 bp, D. melanogaster
ttggccagtttgtt

SEQ ID NO: 670689 - DNA, 13 bp, D. melanogaster
ttggccataaaaa

SEQ ID NO: 670690 - DNA, 14 bp, D. melanogaster
ttggccataaaaat

SEQ ID NO: 670691 - DNA, 14 bp, D. melanogaster
ttggccataaaaca

SEQ ID NO: 670692 - DNA, 13 bp, D. melanogaster
ttggccataaaat

SEQ ID NO: 670693 - DNA, 14 bp, D. melanogaster
ttggccataaacaa

SEQ ID NO: 670694 - DNA, 13 bp, D. melanogaster
ttggccataaagc

SEQ ID NO: 670695 - DNA, 13 bp, D. melanogaster
ttggccataaata

SEQ ID NO: 670696 - DNA, 14 bp, D. melanogaster
ttggccataaataa

SEQ ID NO: 670697 - DNA, 13 bp, D. melanogaster
ttggccataaatt

SEQ ID NO: 670698 - DNA, 14 bp, D. melanogaster
ttggccataaattt

SEQ ID NO: 670699 - DNA, 13 bp, D. melanogaster
ttggccataacaa

SEQ ID NO: 670700 - DNA, 13 bp, D. melanogaster
ttggccataatat

SEQ ID NO: 670701 - DNA, 13 bp, D. melanogaster
ttggccataatga

SEQ ID NO: 670702 - DNA, 13 bp, D. melanogaster
ttggccataattg

SEQ ID NO: 670703 - DNA, 13 bp, D. melanogaster
ttggccatattta

SEQ ID NO: 670704 - DNA, 13 bp, D. melanogaster
ttggccatatttg

SEQ ID NO: 670705 - DNA, 13 bp, D. melanogaster
ttggccatcaaat

SEQ ID NO: 670706 - DNA, 13 bp, D. melanogaster
ttggccatcaatt

SEQ ID NO: 670707 - DNA, 13 bp, D. melanogaster
ttggccatcgaca

SEQ ID NO: 670708 - DNA, 13 bp, D. melanogaster
ttggccatcgatt

SEQ ID NO: 670709 - DNA, 13 bp, D. melanogaster
ttggccatcggca

SEQ ID NO: 670710 - DNA, 13 bp, D. melanogaster
ttggccatcgttt

SEQ ID NO: 670711 - DNA, 13 bp, D. melanogaster
ttggccatctcgt

SEQ ID NO: 670712 - DNA, 13 bp, D. melanogaster
ttggccatgcaaa

SEQ ID NO: 670713 - DNA, 13 bp, D. melanogaster
ttggccatggcaa

SEQ ID NO: 670714 - DNA, 13 bp, D. melanogaster
ttggccatggcca

SEQ ID NO: 670715 - DNA, 14 bp, D. melanogaster
ttggccatggccaa

SEQ ID NO: 670716 - DNA, 13 bp, D. melanogaster
ttggccatgtttc

SEQ ID NO: 670717 - DNA, 14 bp, D. melanogaster
ttggccatgtttct

SEQ ID NO: 670718 - DNA, 13 bp, D. melanogaster
ttggccattaaat

SEQ ID NO: 670719 - DNA, 13 bp, D. melanogaster
ttggccattagtt

SEQ ID NO: 670720 - DNA, 13 bp, D. melanogaster
ttggccattatgc

SEQ ID NO: 670721 - DNA, 13 bp, D. melanogaster
ttggccattcaat

SEQ ID NO: 670722 - DNA, 13 bp, D. melanogaster
ttggccattgcca

SEQ ID NO: 670723 - DNA, 13 bp, D. melanogaster
ttggccattgtct

SEQ ID NO: 670724 - DNA, 13 bp, D. melanogaster
ttggccattgttc

SEQ ID NO: 670725 - DNA, 13 bp, D. melanogaster
ttggccattgttt

SEQ ID NO: 670726 - DNA, 14 bp, D. melanogaster
ttggccatttaatt

SEQ ID NO: 670727 - DNA, 13 bp, D. melanogaster
ttggccatttatt

SEQ ID NO: 670728 - DNA, 13 bp, D. melanogaster
ttggccatttcca

SEQ ID NO: 670729 - DNA, 13 bp, D. melanogaster
ttggccatttctc

SEQ ID NO: 670730 - DNA, 13 bp, D. melanogaster
ttggccattttca

SEQ ID NO: 670731 - DNA, 13 bp, D. melanogaster
ttggcccaaaaaa

SEQ ID NO: 670732 - DNA, 14 bp, D. melanogaster
ttggcccaaaacaa

SEQ ID NO: 670733 - DNA, 13 bp, D. melanogaster
ttggcccaaaact

SEQ ID NO: 670734 - DNA, 13 bp, D. melanogaster
ttggcccaaaagc

SEQ ID NO: 670735 - DNA, 13 bp, D. melanogaster
ttggcccaaacaa

SEQ ID NO: 670736 - DNA, 13 bp, D. melanogaster
ttggcccaaacac

SEQ ID NO: 670737 - DNA, 13 bp, D. melanogaster
ttggcccaaatga

SEQ ID NO: 670738 - DNA, 13 bp, D. melanogaster
ttggcccaactga

SEQ ID NO: 670739 - DNA, 13 bp, D. melanogaster
ttggcccataaat

SEQ ID NO: 670740 - DNA, 13 bp, D. melanogaster
ttggccccagatg

SEQ ID NO: 670741 - DNA, 13 bp, D. melanogaster
ttggcccgacttt

SEQ ID NO: 670742 - DNA, 13 bp, D. melanogaster
ttggcccggccaa

SEQ ID NO: 670743 - DNA, 13 bp, D. melanogaster
ttggcccggctta

SEQ ID NO: 670744 - DNA, 13 bp, D. melanogaster
ttggccgaaaaat

SEQ ID NO: 670745 - DNA, 13 bp, D. melanogaster
ttggccgggccaa

SEQ ID NO: 670746 - DNA, 13 bp, D. melanogaster
ttggcctaattga

SEQ ID NO: 670747 - DNA, 13 bp, D. melanogaster
ttggcctatgcct

SEQ ID NO: 670748 - DNA, 13 bp, D. melanogaster
ttggcctcaaaaa

SEQ ID NO: 670749 - DNA, 14 bp, D. melanogaster
ttggcctcgctttt

SEQ ID NO: 670750 - DNA, 13 bp, D. melanogaster
ttggcctgctttt

SEQ ID NO: 670751 - DNA, 13 bp, D. melanogaster
ttggcctggccaa

SEQ ID NO: 670752 - DNA, 14 bp, D. melanogaster
ttggcctggccaaa

SEQ ID NO: 670753 - DNA, 13 bp, D. melanogaster
ttggcctggccta

SEQ ID NO: 670754 - DNA, 13 bp, D. melanogaster
ttggcctggcctg

SEQ ID NO: 670755 - DNA, 13 bp, D. melanogaster
ttggcctggcttt

SEQ ID NO: 670756 - DNA, 13 bp, D. melanogaster
ttggccttggcca

SEQ ID NO: 670757 - DNA, 13 bp, D. melanogaster
ttggcctttataa

SEQ ID NO: 670758 - DNA, 13 bp, D. melanogaster
ttggcctttgtgc

SEQ ID NO: 670759 - DNA, 13 bp, D. melanogaster
ttggccttttgcc

SEQ ID NO: 670760 - DNA, 13 bp, D. melanogaster
ttggcgaaaagtt

SEQ ID NO: 670761 - DNA, 14 bp, D. melanogaster
ttggcgaaaataaa

SEQ ID NO: 670762 - DNA, 13 bp, D. melanogaster
ttggcgcaaacat

SEQ ID NO: 670763 - DNA, 13 bp, D. melanogaster
ttggcgcataaat

SEQ ID NO: 670764 - DNA, 13 bp, D. melanogaster
ttggcgccaaaaa

SEQ ID NO: 670765 - DNA, 13 bp, D. melanogaster
ttggcgcccaaac

SEQ ID NO: 670766 - DNA, 13 bp, D. melanogaster
ttggcgcgcattt

SEQ ID NO: 670767 - DNA, 13 bp, D. melanogaster
ttggcgctattgg

SEQ ID NO: 670768 - DNA, 13 bp, D. melanogaster
ttggcggccattt

SEQ ID NO: 670769 - DNA, 13 bp, D. melanogaster
ttggcggttttag

SEQ ID NO: 670770 - DNA, 13 bp, D. melanogaster
ttggcgtgctcca

SEQ ID NO: 670771 - DNA, 14 bp, D. melanogaster
ttggcgttgtcctt

SEQ ID NO: 670772 - DNA, 13 bp, D. melanogaster
ttggctaaaaatg

SEQ ID NO: 670773 - DNA, 14 bp, D. melanogaster
ttggctaaaaatgc

SEQ ID NO: 670774 - DNA, 13 bp, D. melanogaster
ttggctaaaaatt

SEQ ID NO: 670775 - DNA, 13 bp, D. melanogaster
ttggctaaaagtt

SEQ ID NO: 670776 - DNA, 13 bp, D. melanogaster
ttggctaaataaa

SEQ ID NO: 670777 - DNA, 13 bp, D. melanogaster
ttggctaataaaa

SEQ ID NO: 670778 - DNA, 13 bp, D. melanogaster
ttggctaataaat

SEQ ID NO: 670779 - DNA, 13 bp, D. melanogaster
ttggctaatattt

SEQ ID NO: 670780 - DNA, 13 bp, D. melanogaster
ttggctaatgaaa

SEQ ID NO: 670781 - DNA, 13 bp, D. melanogaster
ttggctaatgaat

SEQ ID NO: 670782 - DNA, 13 bp, D. melanogaster
ttggctaatttaa

SEQ ID NO: 670783 - DNA, 13 bp, D. melanogaster
ttggctacaaatt

SEQ ID NO: 670784 - DNA, 13 bp, D. melanogaster
ttggctagttggc

SEQ ID NO: 670785 - DNA, 13 bp, D. melanogaster
ttggctataactt

SEQ ID NO: 670786 - DNA, 13 bp, D. melanogaster
ttggctatctgcc

SEQ ID NO: 670787 - DNA, 13 bp, D. melanogaster
ttggctattaaat

SEQ ID NO: 670788 - DNA, 14 bp, D. melanogaster
ttggctattaaatt

SEQ ID NO: 670789 - DNA, 13 bp, D. melanogaster
ttggctatttgaa

SEQ ID NO: 670790 - DNA, 13 bp, D. melanogaster
ttggctatttgca

SEQ ID NO: 670791 - DNA, 13 bp, D. melanogaster
ttggctattttag

SEQ ID NO: 670792 - DNA, 13 bp, D. melanogaster
ttggctatttttg

SEQ ID NO: 670793 - DNA, 13 bp, D. melanogaster
ttggctcctcaaa

SEQ ID NO: 670794 - DNA, 13 bp, D. melanogaster
ttggctccttggc

SEQ ID NO: 670795 - DNA, 13 bp, D. melanogaster
ttggctcgctttt

SEQ ID NO: 670796 - DNA, 13 bp, D. melanogaster
ttggctcttggct

SEQ ID NO: 670797 - DNA, 13 bp, D. melanogaster
ttggctgacattt

SEQ ID NO: 670798 - DNA, 13 bp, D. melanogaster
ttggctgactggc

SEQ ID NO: 670799 - DNA, 13 bp, D. melanogaster
ttggctgactttg

SEQ ID NO: 670800 - DNA, 13 bp, D. melanogaster
ttggctgataaat

SEQ ID NO: 670801 - DNA, 13 bp, D. melanogaster
ttggctgattttt

SEQ ID NO: 670802 - DNA, 13 bp, D. melanogaster
ttggctgcaactt

SEQ ID NO: 670803 - DNA, 13 bp, D. melanogaster
ttggctgcacttt

SEQ ID NO: 670804 - DNA, 13 bp, D. melanogaster
ttggctgcatttt

SEQ ID NO: 670805 - DNA, 13 bp, D. melanogaster
ttggctgccaatt

SEQ ID NO: 670806 - DNA, 13 bp, D. melanogaster
ttggctgccactg

SEQ ID NO: 670807 - DNA, 13 bp, D. melanogaster
ttggctgccagca

SEQ ID NO: 670808 - DNA, 13 bp, D. melanogaster
ttggctgccattg

SEQ ID NO: 670809 - DNA, 13 bp, D. melanogaster
ttggctgccattt

SEQ ID NO: 670810 - DNA, 13 bp, D. melanogaster
ttggctgcctttc

SEQ ID NO: 670811 - DNA, 14 bp, D. melanogaster
ttggctgcctttcc

SEQ ID NO: 670812 - DNA, 13 bp, D. melanogaster
ttggctgcctttg

SEQ ID NO: 670813 - DNA, 13 bp, D. melanogaster
ttggctgcgtttt

SEQ ID NO: 670814 - DNA, 13 bp, D. melanogaster
ttggctgctcctt

SEQ ID NO: 670815 - DNA, 13 bp, D. melanogaster
ttggctgctctgc

SEQ ID NO: 670816 - DNA, 13 bp, D. melanogaster
ttggctgctgctg

SEQ ID NO: 670817 - DNA, 14 bp, D. melanogaster
ttggctgctgctgc

SEQ ID NO: 670818 - DNA, 13 bp, D. melanogaster
ttggctgctgttt

SEQ ID NO: 670819 - DNA, 13 bp, D. melanogaster
ttggctggatttt

SEQ ID NO: 670820 - DNA, 13 bp, D. melanogaster
ttggctggcaact

SEQ ID NO: 670821 - DNA, 13 bp, D. melanogaster
ttggctggcaatg

SEQ ID NO: 670822 - DNA, 13 bp, D. melanogaster
ttggctggcaatt

SEQ ID NO: 670823 - DNA, 13 bp, D. melanogaster
ttggctggccaaa

SEQ ID NO: 670824 - DNA, 13 bp, D. melanogaster
ttggctggctgac

SEQ ID NO: 670825 - DNA, 13 bp, D. melanogaster
ttggctggctgca

SEQ ID NO: 670826 - DNA, 13 bp, D. melanogaster
ttggctggctggc

SEQ ID NO: 670827 - DNA, 14 bp, D. melanogaster
ttggctggctggct

SEQ ID NO: 670828 - DNA, 13 bp, D. melanogaster
ttggctggctgtt

SEQ ID NO: 670829 - DNA, 13 bp, D. melanogaster
ttggctggctttt

SEQ ID NO: 670830 - DNA, 13 bp, D. melanogaster
ttggctggggaaa

SEQ ID NO: 670831 - DNA, 13 bp, D. melanogaster
ttggctggttgcc

SEQ ID NO: 670832 - DNA, 13 bp, D. melanogaster
ttggctgtcattt

SEQ ID NO: 670833 - DNA, 13 bp, D. melanogaster
ttggctgtgtggc

SEQ ID NO: 670834 - DNA, 13 bp, D. melanogaster
ttggctgttggct

SEQ ID NO: 670835 - DNA, 13 bp, D. melanogaster
ttggctgtttaca

SEQ ID NO: 670836 - DNA, 13 bp, D. melanogaster
ttggcttaaactt

SEQ ID NO: 670837 - DNA, 13 bp, D. melanogaster
ttggcttaacttt

SEQ ID NO: 670838 - DNA, 13 bp, D. melanogaster
ttggcttaattgc

SEQ ID NO: 670839 - DNA, 13 bp, D. melanogaster
ttggcttaattta

SEQ ID NO: 670840 - DNA, 13 bp, D. melanogaster
ttggcttacattt

SEQ ID NO: 670841 - DNA, 13 bp, D. melanogaster
ttggcttactttt

SEQ ID NO: 670842 - DNA, 13 bp, D. melanogaster
ttggcttagtttt

SEQ ID NO: 670843 - DNA, 14 bp, D. melanogaster
ttggcttcaatgtg

SEQ ID NO: 670844 - DNA, 13 bp, D. melanogaster
ttggcttcagttt

SEQ ID NO: 670845 - DNA, 13 bp, D. melanogaster
ttggcttcatttc

SEQ ID NO: 670846 - DNA, 13 bp, D. melanogaster
ttggcttcatttt

SEQ ID NO: 670847 - DNA, 13 bp, D. melanogaster
ttggcttccattt

SEQ ID NO: 670848 - DNA, 13 bp, D. melanogaster
ttggcttcgattt

SEQ ID NO: 670849 - DNA, 13 bp, D. melanogaster
ttggcttcggttt

SEQ ID NO: 670850 - DNA, 13 bp, D. melanogaster
ttggcttcttggc

SEQ ID NO: 670851 - DNA, 13 bp, D. melanogaster
ttggcttgacttg

SEQ ID NO: 670852 - DNA, 13 bp, D. melanogaster
ttggcttgattga

SEQ ID NO: 670853 - DNA, 13 bp, D. melanogaster
ttggcttgatttt

SEQ ID NO: 670854 - DNA, 13 bp, D. melanogaster
ttggcttgcattt

SEQ ID NO: 670855 - DNA, 13 bp, D. melanogaster
ttggcttgccatt

SEQ ID NO: 670856 - DNA, 13 bp, D. melanogaster
ttggcttgctgaa

SEQ ID NO: 670857 - DNA, 13 bp, D. melanogaster
ttggcttggaaaa

SEQ ID NO: 670858 - DNA, 13 bp, D. melanogaster
ttggcttggaaat

SEQ ID NO: 670859 - DNA, 13 bp, D. melanogaster
ttggcttggattt

SEQ ID NO: 670860 - DNA, 14 bp, D. melanogaster
ttggcttggatttc

SEQ ID NO: 670861 - DNA, 13 bp, D. melanogaster
ttggcttggccaa

SEQ ID NO: 670862 - DNA, 13 bp, D. melanogaster
ttggcttgggctt

SEQ ID NO: 670863 - DNA, 13 bp, D. melanogaster
ttggcttgttgac

SEQ ID NO: 670864 - DNA, 13 bp, D. melanogaster
ttggctttaaaaa

SEQ ID NO: 670865 - DNA, 13 bp, D. melanogaster
ttggctttaaaat

SEQ ID NO: 670866 - DNA, 13 bp, D. melanogaster
ttggctttaaagt

SEQ ID NO: 670867 - DNA, 13 bp, D. melanogaster
ttggctttaatgc

SEQ ID NO: 670868 - DNA, 13 bp, D. melanogaster
ttggctttaatgt

SEQ ID NO: 670869 - DNA, 13 bp, D. melanogaster
ttggctttaattt

SEQ ID NO: 670870 - DNA, 13 bp, D. melanogaster
ttggctttacttt

SEQ ID NO: 670871 - DNA, 13 bp, D. melanogaster
ttggctttagctt

SEQ ID NO: 670872 - DNA, 13 bp, D. melanogaster
ttggctttattaa

SEQ ID NO: 670873 - DNA, 13 bp, D. melanogaster
ttggctttcaaat

SEQ ID NO: 670874 - DNA, 13 bp, D. melanogaster
ttggctttcactt

SEQ ID NO: 670875 - DNA, 13 bp, D. melanogaster
ttggctttcagtt

SEQ ID NO: 670876 - DNA, 13 bp, D. melanogaster
ttggctttcatta

SEQ ID NO: 670877 - DNA, 13 bp, D. melanogaster
ttggctttcattt

SEQ ID NO: 670878 - DNA, 13 bp, D. melanogaster
ttggctttcggtt

SEQ ID NO: 670879 - DNA, 13 bp, D. melanogaster
ttggctttgagtt

SEQ ID NO: 670880 - DNA, 13 bp, D. melanogaster
ttggctttgattt

SEQ ID NO: 670881 - DNA, 13 bp, D. melanogaster
ttggctttggatt

SEQ ID NO: 670882 - DNA, 14 bp, D. melanogaster
ttggctttggccaa

SEQ ID NO: 670883 - DNA, 13 bp, D. melanogaster
ttggctttggctc

SEQ ID NO: 670884 - DNA, 13 bp, D. melanogaster
ttggctttggctt

SEQ ID NO: 670885 - DNA, 14 bp, D. melanogaster
ttggctttggcttc

SEQ ID NO: 670886 - DNA, 13 bp, D. melanogaster
ttggctttgttgc

SEQ ID NO: 670887 - DNA, 13 bp, D. melanogaster
ttggcttttaaaa

SEQ ID NO: 670888 - DNA, 13 bp, D. melanogaster
ttggcttttagcc

SEQ ID NO: 670889 - DNA, 14 bp, D. melanogaster
ttggcttttatggc

SEQ ID NO: 670890 - DNA, 13 bp, D. melanogaster
ttggcttttattg

SEQ ID NO: 670891 - DNA, 13 bp, D. melanogaster
ttggcttttccct

SEQ ID NO: 670892 - DNA, 13 bp, D. melanogaster
ttggcttttgcct

SEQ ID NO: 670893 - DNA, 13 bp, D. melanogaster
ttggcttttggat

SEQ ID NO: 670894 - DNA, 13 bp, D. melanogaster
ttggcttttggca

SEQ ID NO: 670895 - DNA, 14 bp, D. melanogaster
ttggcttttggcca

SEQ ID NO: 670896 - DNA, 13 bp, D. melanogaster
ttggctttttatg

SEQ ID NO: 670897 - DNA, 13 bp, D. melanogaster
ttggctttttgca

SEQ ID NO: 670898 - DNA, 13 bp, D. melanogaster
ttggctttttggc

SEQ ID NO: 670899 - DNA, 13 bp, D. melanogaster
ttgggaaaaaaat

SEQ ID NO: 670900 - DNA, 13 bp, D. melanogaster
ttgggaaaaactt

SEQ ID NO: 670901 - DNA, 13 bp, D. melanogaster
ttgggaaaaataa

SEQ ID NO: 670902 - DNA, 13 bp, D. melanogaster
ttgggaaaaatta

SEQ ID NO: 670903 - DNA, 13 bp, D. melanogaster
ttgggaaaacaaa

SEQ ID NO: 670904 - DNA, 13 bp, D. melanogaster
ttgggaaaacatt

SEQ ID NO: 670905 - DNA, 14 bp, D. melanogaster
ttgggaaaactttt

SEQ ID NO: 670906 - DNA, 13 bp, D. melanogaster
ttgggaaaatgtt

SEQ ID NO: 670907 - DNA, 13 bp, D. melanogaster
ttgggaaaatttc

SEQ ID NO: 670908 - DNA, 13 bp, D. melanogaster
ttgggaaacaaaa

SEQ ID NO: 670909 - DNA, 13 bp, D. melanogaster
ttgggaaataaac

SEQ ID NO: 670910 - DNA, 13 bp, D. melanogaster
ttgggaaatattt

SEQ ID NO: 670911 - DNA, 13 bp, D. melanogaster
ttgggaaatgaaa

SEQ ID NO: 670912 - DNA, 14 bp, D. melanogaster
ttgggaaatgaaat

SEQ ID NO: 670913 - DNA, 13 bp, D. melanogaster
ttgggaaatgttt

SEQ ID NO: 670914 - DNA, 13 bp, D. melanogaster
ttgggaaatttgt

SEQ ID NO: 670915 - DNA, 13 bp, D. melanogaster
ttgggaagatatt

SEQ ID NO: 670916 - DNA, 13 bp, D. melanogaster
ttgggaataaaaa

SEQ ID NO: 670917 - DNA, 13 bp, D. melanogaster
ttgggaatataaa

SEQ ID NO: 670918 - DNA, 13 bp, D. melanogaster
ttgggaatattgt

SEQ ID NO: 670919 - DNA, 13 bp, D. melanogaster
ttgggaattctag

SEQ ID NO: 670920 - DNA, 13 bp, D. melanogaster
ttgggaatttaaa

SEQ ID NO: 670921 - DNA, 14 bp, D. melanogaster
ttgggaatttaaat

SEQ ID NO: 670922 - DNA, 13 bp, D. melanogaster
ttgggaatttatt

SEQ ID NO: 670923 - DNA, 13 bp, D. melanogaster
ttgggactgggac

SEQ ID NO: 670924 - DNA, 13 bp, D. melanogaster
ttgggactttgat

SEQ ID NO: 670925 - DNA, 13 bp, D. melanogaster
ttgggagatgttt

SEQ ID NO: 670926 - DNA, 13 bp, D. melanogaster
ttgggatatatgg

SEQ ID NO: 670927 - DNA, 13 bp, D. melanogaster
ttgggattaaata

SEQ ID NO: 670928 - DNA, 14 bp, D. melanogaster
ttgggattcggatt

SEQ ID NO: 670929 - DNA, 13 bp, D. melanogaster
ttgggattggaat

SEQ ID NO: 670930 - DNA, 13 bp, D. melanogaster
ttgggattgggaa

SEQ ID NO: 670931 - DNA, 13 bp, D. melanogaster
ttgggattgggac

SEQ ID NO: 670932 - DNA, 13 bp, D. melanogaster
ttgggattgggat

SEQ ID NO: 670933 - DNA, 13 bp, D. melanogaster
ttgggattgggct

SEQ ID NO: 670934 - DNA, 13 bp, D. melanogaster
ttgggatttggcc

SEQ ID NO: 670935 - DNA, 13 bp, D. melanogaster
ttgggatttggga

SEQ ID NO: 670936 - DNA, 13 bp, D. melanogaster
ttgggcaaaaaac

SEQ ID NO: 670937 - DNA, 13 bp, D. melanogaster
ttgggcaaacaaa

SEQ ID NO: 670938 - DNA, 13 bp, D. melanogaster
ttgggcaaacatt

SEQ ID NO: 670939 - DNA, 14 bp, D. melanogaster
ttgggcaaacattt

SEQ ID NO: 670940 - DNA, 14 bp, D. melanogaster
ttgggcaaagccaa

SEQ ID NO: 670941 - DNA, 13 bp, D. melanogaster
ttgggcaaataat

SEQ ID NO: 670942 - DNA, 13 bp, D. melanogaster
ttgggcaaatatt

SEQ ID NO: 670943 - DNA, 13 bp, D. melanogaster
ttgggcaacaaaa

SEQ ID NO: 670944 - DNA, 13 bp, D. melanogaster
ttgggcaacaaca

SEQ ID NO: 670945 - DNA, 13 bp, D. melanogaster
ttgggcaacagaa

SEQ ID NO: 670946 - DNA, 13 bp, D. melanogaster
ttgggcaaggaac

SEQ ID NO: 670947 - DNA, 13 bp, D. melanogaster
ttgggcaattttt

SEQ ID NO: 670948 - DNA, 13 bp, D. melanogaster
ttgggcacaaaaa

SEQ ID NO: 670949 - DNA, 13 bp, D. melanogaster
ttgggcagtgatg

SEQ ID NO: 670950 - DNA, 13 bp, D. melanogaster
ttgggcatcaaca

SEQ ID NO: 670951 - DNA, 14 bp, D. melanogaster
ttgggcattatggt

SEQ ID NO: 670952 - DNA, 13 bp, D. melanogaster
ttgggcattgttt

SEQ ID NO: 670953 - DNA, 13 bp, D. melanogaster
ttgggcattttgt

SEQ ID NO: 670954 - DNA, 13 bp, D. melanogaster
ttgggccaaaaac

SEQ ID NO: 670955 - DNA, 13 bp, D. melanogaster
ttgggccaaaagg

SEQ ID NO: 670956 - DNA, 13 bp, D. melanogaster
ttgggccaaaagt

SEQ ID NO: 670957 - DNA, 13 bp, D. melanogaster
ttgggccaacctt

SEQ ID NO: 670958 - DNA, 13 bp, D. melanogaster
ttgggccaagaac

SEQ ID NO: 670959 - DNA, 14 bp, D. melanogaster
ttgggccaagaacg

SEQ ID NO: 670960 - DNA, 13 bp, D. melanogaster
ttgggccacgagt

SEQ ID NO: 670961 - DNA, 13 bp, D. melanogaster
ttgggccaggcca

SEQ ID NO: 670962 - DNA, 13 bp, D. melanogaster
ttgggccgctgac

SEQ ID NO: 670963 - DNA, 13 bp, D. melanogaster
ttgggcctcaaag

SEQ ID NO: 670964 - DNA, 13 bp, D. melanogaster
ttgggcctgcttt

SEQ ID NO: 670965 - DNA, 13 bp, D. melanogaster
ttgggcgccagtt

SEQ ID NO: 670966 - DNA, 13 bp, D. melanogaster
ttgggcgcttttt

SEQ ID NO: 670967 - DNA, 13 bp, D. melanogaster
ttgggcgtggcag

SEQ ID NO: 670968 - DNA, 13 bp, D. melanogaster
ttgggctggaaaa

SEQ ID NO: 670969 - DNA, 13 bp, D. melanogaster
ttgggctgggaaa

SEQ ID NO: 670970 - DNA, 13 bp, D. melanogaster
ttgggcttagctc

SEQ ID NO: 670971 - DNA, 13 bp, D. melanogaster
ttgggcttggatt

SEQ ID NO: 670972 - DNA, 13 bp, D. melanogaster
ttgggcttgggct

SEQ ID NO: 670973 - DNA, 14 bp, D. melanogaster
ttgggcttgggctt

SEQ ID NO: 670974 - DNA, 13 bp, D. melanogaster
ttgggctttaatt

SEQ ID NO: 670975 - DNA, 13 bp, D. melanogaster
ttgggctttattt

SEQ ID NO: 670976 - DNA, 13 bp, D. melanogaster
ttgggctttgggc

SEQ ID NO: 670977 - DNA, 13 bp, D. melanogaster
ttggggaaaaaaa

SEQ ID NO: 670978 - DNA, 13 bp, D. melanogaster
ttggggaacacct

SEQ ID NO: 670979 - DNA, 13 bp, D. melanogaster
ttggggaatttaa

SEQ ID NO: 670980 - DNA, 13 bp, D. melanogaster
ttggggaatttta

SEQ ID NO: 670981 - DNA, 13 bp, D. melanogaster
ttggggatgagga

SEQ ID NO: 670982 - DNA, 14 bp, D. melanogaster
ttggggatgaggac

SEQ ID NO: 670983 - DNA, 13 bp, D. melanogaster
ttggggcaaacaa

SEQ ID NO: 670984 - DNA, 13 bp, D. melanogaster
ttgggggaaaaat

SEQ ID NO: 670985 - DNA, 13 bp, D. melanogaster
ttggggtgaggat

SEQ ID NO: 670986 - DNA, 13 bp, D. melanogaster
ttggggtgtgcga

SEQ ID NO: 670987 - DNA, 13 bp, D. melanogaster
ttgggtaaaagct

SEQ ID NO: 670988 - DNA, 13 bp, D. melanogaster
ttgggtaaacaaa

SEQ ID NO: 670989 - DNA, 13 bp, D. melanogaster
ttgggtaattgaa

SEQ ID NO: 670990 - DNA, 14 bp, D. melanogaster
ttgggtattccctt

SEQ ID NO: 670991 - DNA, 13 bp, D. melanogaster
ttgggtccttcga

SEQ ID NO: 670992 - DNA, 14 bp, D. melanogaster
ttgggtgcacttcg

SEQ ID NO: 670993 - DNA, 13 bp, D. melanogaster
ttgggtgccttct

SEQ ID NO: 670994 - DNA, 13 bp, D. melanogaster
ttgggtggaaaag

SEQ ID NO: 670995 - DNA, 13 bp, D. melanogaster
ttgggttcagcta

SEQ ID NO: 670996 - DNA, 13 bp, D. melanogaster
ttgggttcagttg

SEQ ID NO: 670997 - DNA, 13 bp, D. melanogaster
ttgggtttcattt

SEQ ID NO: 670998 - DNA, 13 bp, D. melanogaster
ttgggtttgctgc

SEQ ID NO: 670999 - DNA, 13 bp, D. melanogaster
ttgggttttcatt

SEQ ID NO: 671000 - DNA, 13 bp, D. melanogaster
ttggtaaaaaatg

SEQ ID NO: 671001 - DNA, 13 bp, D. melanogaster
ttggtaaaacaaa

SEQ ID NO: 671002 - DNA, 13 bp, D. melanogaster
ttggtaaacaaaa

SEQ ID NO: 671003 - DNA, 13 bp, D. melanogaster
ttggtaaacaaat

SEQ ID NO: 671004 - DNA, 13 bp, D. melanogaster
ttggtaaagtttt

SEQ ID NO: 671005 - DNA, 13 bp, D. melanogaster
ttggtaaatagtt

SEQ ID NO: 671006 - DNA, 14 bp, D. melanogaster
ttggtaaatagtta

SEQ ID NO: 671007 - DNA, 13 bp, D. melanogaster
ttggtaaatattt

SEQ ID NO: 671008 - DNA, 13 bp, D. melanogaster
ttggtaacaaaaa

SEQ ID NO: 671009 - DNA, 13 bp, D. melanogaster
ttggtaataaaat

SEQ ID NO: 671010 - DNA, 13 bp, D. melanogaster
ttggtatatatat

SEQ ID NO: 671011 - DNA, 14 bp, D. melanogaster
ttggtatatatata

SEQ ID NO: 671012 - DNA, 13 bp, D. melanogaster
ttggtatatatgt

SEQ ID NO: 671013 - DNA, 13 bp, D. melanogaster
ttggtatatcaaa

SEQ ID NO: 671014 - DNA, 13 bp, D. melanogaster
ttggtatcttcga

SEQ ID NO: 671015 - DNA, 13 bp, D. melanogaster
ttggtatgcaaat

SEQ ID NO: 671016 - DNA, 13 bp, D. melanogaster
ttggtatgtgtag

SEQ ID NO: 671017 - DNA, 13 bp, D. melanogaster
ttggtattcgctt

SEQ ID NO: 671018 - DNA, 13 bp, D. melanogaster
ttggtattggaat

SEQ ID NO: 671019 - DNA, 13 bp, D. melanogaster
ttggtatttgcag

SEQ ID NO: 671020 - DNA, 13 bp, D. melanogaster
ttggtattttcat

SEQ ID NO: 671021 - DNA, 13 bp, D. melanogaster
ttggtcaaaaact

SEQ ID NO: 671022 - DNA, 13 bp, D. melanogaster
ttggtcaacgaaa

SEQ ID NO: 671023 - DNA, 13 bp, D. melanogaster
ttggtcaataaaa

SEQ ID NO: 671024 - DNA, 15 bp, D. melanogaster
ttggtccactgccaa

SEQ ID NO: 671025 - DNA, 13 bp, D. melanogaster
ttggtcctggcca

SEQ ID NO: 671026 - DNA, 14 bp, D. melanogaster
ttggtccttcgagc

SEQ ID NO: 671027 - DNA, 13 bp, D. melanogaster
ttggtccttcgtc

SEQ ID NO: 671028 - DNA, 13 bp, D. melanogaster
ttggtcctttggc

SEQ ID NO: 671029 - DNA, 13 bp, D. melanogaster
ttggtcctttggt

SEQ ID NO: 671030 - DNA, 13 bp, D. melanogaster
ttggtcgaaatta

SEQ ID NO: 671031 - DNA, 13 bp, D. melanogaster
ttggtcgattttg

SEQ ID NO: 671032 - DNA, 14 bp, D. melanogaster
ttggtcggaatcgg

SEQ ID NO: 671033 - DNA, 13 bp, D. melanogaster
ttggtcggcgtgt

SEQ ID NO: 671034 - DNA, 14 bp, D. melanogaster
ttggtcggttggtc

SEQ ID NO: 671035 - DNA, 13 bp, D. melanogaster
ttggtctaaaaat

SEQ ID NO: 671036 - DNA, 13 bp, D. melanogaster
ttggtgaaaaaaa

SEQ ID NO: 671037 - DNA, 13 bp, D. melanogaster
ttggtgaaaaatg

SEQ ID NO: 671038 - DNA, 13 bp, D. melanogaster
ttggtgaaataaa

SEQ ID NO: 671039 - DNA, 13 bp, D. melanogaster
ttggtgaataaaa

SEQ ID NO: 671040 - DNA, 14 bp, D. melanogaster
ttggtgaataaaat

SEQ ID NO: 671041 - DNA, 13 bp, D. melanogaster
ttggtgatctatt

SEQ ID NO: 671042 - DNA, 14 bp, D. melanogaster
ttggtgatctatta

SEQ ID NO: 671043 - DNA, 13 bp, D. melanogaster
ttggtgatggcat

SEQ ID NO: 671044 - DNA, 13 bp, D. melanogaster
ttggtgattccaa

SEQ ID NO: 671045 - DNA, 14 bp, D. melanogaster
ttggtgcaactgtt

SEQ ID NO: 671046 - DNA, 13 bp, D. melanogaster
ttggtgctacttt

SEQ ID NO: 671047 - DNA, 13 bp, D. melanogaster
ttggtgctatttt

SEQ ID NO: 671048 - DNA, 13 bp, D. melanogaster
ttggtgctgctgc

SEQ ID NO: 671049 - DNA, 13 bp, D. melanogaster
ttggtggaggcct

SEQ ID NO: 671050 - DNA, 13 bp, D. melanogaster
ttggtggatgagc

SEQ ID NO: 671051 - DNA, 13 bp, D. melanogaster
ttggtggccatgc

SEQ ID NO: 671052 - DNA, 13 bp, D. melanogaster
ttggtggccatta

SEQ ID NO: 671053 - DNA, 13 bp, D. melanogaster
ttggtgggaaaat

SEQ ID NO: 671054 - DNA, 13 bp, D. melanogaster
ttggtgggcgaga

SEQ ID NO: 671055 - DNA, 13 bp, D. melanogaster
ttggtggtcaaaa

SEQ ID NO: 671056 - DNA, 13 bp, D. melanogaster
ttggtggttgaaa

SEQ ID NO: 671057 - DNA, 13 bp, D. melanogaster
ttggtgtatgcgg

SEQ ID NO: 671058 - DNA, 13 bp, D. melanogaster
ttggtgtgggaaa

SEQ ID NO: 671059 - DNA, 13 bp, D. melanogaster
ttggttaaagctg

SEQ ID NO: 671060 - DNA, 13 bp, D. melanogaster
ttggttaaatcgg

SEQ ID NO: 671061 - DNA, 13 bp, D. melanogaster
ttggttaataaat

SEQ ID NO: 671062 - DNA, 13 bp, D. melanogaster
ttggttaatgaat

SEQ ID NO: 671063 - DNA, 13 bp, D. melanogaster
ttggttaattaaa

SEQ ID NO: 671064 - DNA, 13 bp, D. melanogaster
ttggttacatttt

SEQ ID NO: 671065 - DNA, 13 bp, D. melanogaster
ttggttacccctt

SEQ ID NO: 671066 - DNA, 13 bp, D. melanogaster
ttggttatgtgga

SEQ ID NO: 671067 - DNA, 13 bp, D. melanogaster
ttggttatttaaa

SEQ ID NO: 671068 - DNA, 13 bp, D. melanogaster
ttggttcggttcg

SEQ ID NO: 671069 - DNA, 13 bp, D. melanogaster
ttggttcttaatg

SEQ ID NO: 671070 - DNA, 13 bp, D. melanogaster
ttggttgaatatt

SEQ ID NO: 671071 - DNA, 13 bp, D. melanogaster
ttggttgcacgag

SEQ ID NO: 671072 - DNA, 13 bp, D. melanogaster
ttggttggaaaaa

SEQ ID NO: 671073 - DNA, 13 bp, D. melanogaster
ttggttggaaaat

SEQ ID NO: 671074 - DNA, 13 bp, D. melanogaster
ttggttggctggc

SEQ ID NO: 671075 - DNA, 13 bp, D. melanogaster
ttggttgtttaag

SEQ ID NO: 671076 - DNA, 13 bp, D. melanogaster
ttggttgtttgaa

SEQ ID NO: 671077 - DNA, 14 bp, D. melanogaster
ttggttgtttgaaa

SEQ ID NO: 671078 - DNA, 13 bp, D. melanogaster
ttggtttaataaa

SEQ ID NO: 671079 - DNA, 13 bp, D. melanogaster
ttggtttacttta

SEQ ID NO: 671080 - DNA, 13 bp, D. melanogaster
ttggtttattaca

SEQ ID NO: 671081 - DNA, 14 bp, D. melanogaster
ttggtttattacat

SEQ ID NO: 671082 - DNA, 13 bp, D. melanogaster
ttggtttcaattt

SEQ ID NO: 671083 - DNA, 13 bp, D. melanogaster
ttggtttcatcga

SEQ ID NO: 671084 - DNA, 13 bp, D. melanogaster
ttggtttcattaa

SEQ ID NO: 671085 - DNA, 13 bp, D. melanogaster
ttggtttcatttg

SEQ ID NO: 671086 - DNA, 13 bp, D. melanogaster
ttggtttccattt

SEQ ID NO: 671087 - DNA, 13 bp, D. melanogaster
ttggtttcccgag

SEQ ID NO: 671088 - DNA, 13 bp, D. melanogaster
ttggtttcgattt

SEQ ID NO: 671089 - DNA, 13 bp, D. melanogaster
ttggtttggcatt

SEQ ID NO: 671090 - DNA, 13 bp, D. melanogaster
ttggttttaaagt

SEQ ID NO: 671091 - DNA, 13 bp, D. melanogaster
ttggttttaagaa

SEQ ID NO: 671092 - DNA, 13 bp, D. melanogaster
ttggttttcaaaa

SEQ ID NO: 671093 - DNA, 13 bp, D. melanogaster
ttggttttcaaat

SEQ ID NO: 671094 - DNA, 13 bp, D. melanogaster
ttggttttcaatt

SEQ ID NO: 671095 - DNA, 13 bp, D. melanogaster
ttggttttcagtt

SEQ ID NO: 671096 - DNA, 13 bp, D. melanogaster
ttggttttccatt

SEQ ID NO: 671097 - DNA, 13 bp, D. melanogaster
ttggttttcccaa

SEQ ID NO: 671098 - DNA, 13 bp, D. melanogaster
ttggttttcggct

SEQ ID NO: 671099 - DNA, 13 bp, D. melanogaster
ttggttttctact

SEQ ID NO: 671100 - DNA, 13 bp, D. melanogaster
ttggttttggaaa

SEQ ID NO: 671101 - DNA, 13 bp, D. melanogaster
ttggttttggcat

SEQ ID NO: 671102 - DNA, 13 bp, D. melanogaster
ttggttttggcca

SEQ ID NO: 671103 - DNA, 14 bp, D. melanogaster
ttggttttggccaa

SEQ ID NO: 671104 - DNA, 15 bp, D. melanogaster
ttggtttttacattt

SEQ ID NO: 671105 - DNA, 13 bp, D. melanogaster
ttggtttttgaaa

SEQ ID NO: 671106 - DNA, 13 bp, D. melanogaster
ttggtttttggcc

SEQ ID NO: 671107 - DNA, 13 bp, D. melanogaster
ttgtaaaaactaa

SEQ ID NO: 671108 - DNA, 13 bp, D. melanogaster
ttgtaaaaagcaa

SEQ ID NO: 671109 - DNA, 13 bp, D. melanogaster
ttgtaaaaagttt

SEQ ID NO: 671110 - DNA, 13 bp, D. melanogaster
ttgtaaaaatttg

SEQ ID NO: 671111 - DNA, 13 bp, D. melanogaster
ttgtaaaacaaaa

SEQ ID NO: 671112 - DNA, 13 bp, D. melanogaster
ttgtaaaacaatt

SEQ ID NO: 671113 - DNA, 13 bp, D. melanogaster
ttgtaaaacattt

SEQ ID NO: 671114 - DNA, 13 bp, D. melanogaster
ttgtaaaactttt

SEQ ID NO: 671115 - DNA, 13 bp, D. melanogaster
ttgtaaaatcaaa

SEQ ID NO: 671116 - DNA, 14 bp, D. melanogaster
ttgtaaaatcccaa

SEQ ID NO: 671117 - DNA, 13 bp, D. melanogaster
ttgtaaaatgcaa

SEQ ID NO: 671118 - DNA, 13 bp, D. melanogaster
ttgtaaaatgcat

SEQ ID NO: 671119 - DNA, 13 bp, D. melanogaster
ttgtaaaatggaa

SEQ ID NO: 671120 - DNA, 13 bp, D. melanogaster
ttgtaaaattcaa

SEQ ID NO: 671121 - DNA, 13 bp, D. melanogaster
ttgtaaaattgat

SEQ ID NO: 671122 - DNA, 14 bp, D. melanogaster
ttgtaaaattgtaa

SEQ ID NO: 671123 - DNA, 13 bp, D. melanogaster
ttgtaaaatttgt

SEQ ID NO: 671124 - DNA, 13 bp, D. melanogaster
ttgtaaacaaaaa

SEQ ID NO: 671125 - DNA, 13 bp, D. melanogaster
ttgtaaacaaaac

SEQ ID NO: 671126 - DNA, 13 bp, D. melanogaster
ttgtaaacaaaca

SEQ ID NO: 671127 - DNA, 14 bp, D. melanogaster
ttgtaaacaaatat

SEQ ID NO: 671128 - DNA, 13 bp, D. melanogaster
ttgtaaacaagtt

SEQ ID NO: 671129 - DNA, 13 bp, D. melanogaster
ttgtaaacaataa

SEQ ID NO: 671130 - DNA, 13 bp, D. melanogaster
ttgtaaacaattt

SEQ ID NO: 671131 - DNA, 13 bp, D. melanogaster
ttgtaaacagttg

SEQ ID NO: 671132 - DNA, 13 bp, D. melanogaster
ttgtaaacataaa

SEQ ID NO: 671133 - DNA, 13 bp, D. melanogaster
ttgtaaacattta

SEQ ID NO: 671134 - DNA, 13 bp, D. melanogaster
ttgtaaacatttt

SEQ ID NO: 671135 - DNA, 13 bp, D. melanogaster
ttgtaaaccattt

SEQ ID NO: 671136 - DNA, 14 bp, D. melanogaster
ttgtaaaccatttg

SEQ ID NO: 671137 - DNA, 13 bp, D. melanogaster
ttgtaaactaatt

SEQ ID NO: 671138 - DNA, 13 bp, D. melanogaster
ttgtaaactattt

SEQ ID NO: 671139 - DNA, 13 bp, D. melanogaster
ttgtaaacttgta

SEQ ID NO: 671140 - DNA, 13 bp, D. melanogaster
ttgtaaactttaa

SEQ ID NO: 671141 - DNA, 13 bp, D. melanogaster
ttgtaaagcattt

SEQ ID NO: 671142 - DNA, 13 bp, D. melanogaster
ttgtaaagtaaaa

SEQ ID NO: 671143 - DNA, 13 bp, D. melanogaster
ttgtaaagttaat

SEQ ID NO: 671144 - DNA, 13 bp, D. melanogaster
ttgtaaataacaa

SEQ ID NO: 671145 - DNA, 13 bp, D. melanogaster
ttgtaaataactt

SEQ ID NO: 671146 - DNA, 13 bp, D. melanogaster
ttgtaaataattg

SEQ ID NO: 671147 - DNA, 13 bp, D. melanogaster
ttgtaaatacaaa

SEQ ID NO: 671148 - DNA, 13 bp, D. melanogaster
ttgtaaatacata

SEQ ID NO: 671149 - DNA, 13 bp, D. melanogaster
ttgtaaatacttt

SEQ ID NO: 671150 - DNA, 13 bp, D. melanogaster
ttgtaaataggat

SEQ ID NO: 671151 - DNA, 13 bp, D. melanogaster
ttgtaaatatcta

SEQ ID NO: 671152 - DNA, 13 bp, D. melanogaster
ttgtaaatattga

SEQ ID NO: 671153 - DNA, 13 bp, D. melanogaster
ttgtaaatatttg

SEQ ID NO: 671154 - DNA, 13 bp, D. melanogaster
ttgtaaatcattt

SEQ ID NO: 671155 - DNA, 13 bp, D. melanogaster
ttgtaaatgatat

SEQ ID NO: 671156 - DNA, 13 bp, D. melanogaster
ttgtaaatgcttt

SEQ ID NO: 671157 - DNA, 13 bp, D. melanogaster
ttgtaaatggtca

SEQ ID NO: 671158 - DNA, 13 bp, D. melanogaster
ttgtaaatgtaaa

SEQ ID NO: 671159 - DNA, 13 bp, D. melanogaster
ttgtaaattactt

SEQ ID NO: 671160 - DNA, 13 bp, D. melanogaster
ttgtaaattatac

SEQ ID NO: 671161 - DNA, 13 bp, D. melanogaster
ttgtaaattatgc

SEQ ID NO: 671162 - DNA, 13 bp, D. melanogaster
ttgtaaattcttt

SEQ ID NO: 671163 - DNA, 13 bp, D. melanogaster
ttgtaaatttcta

SEQ ID NO: 671164 - DNA, 14 bp, D. melanogaster
ttgtaaatttctat

SEQ ID NO: 671165 - DNA, 13 bp, D. melanogaster
ttgtaacaaattg

SEQ ID NO: 671166 - DNA, 13 bp, D. melanogaster
ttgtaacaatttt

SEQ ID NO: 671167 - DNA, 13 bp, D. melanogaster
ttgtaacatttat

SEQ ID NO: 671168 - DNA, 13 bp, D. melanogaster
ttgtaactatttt

SEQ ID NO: 671169 - DNA, 13 bp, D. melanogaster
ttgtaagcaaatt

SEQ ID NO: 671170 - DNA, 13 bp, D. melanogaster
ttgtaagcataat

SEQ ID NO: 671171 - DNA, 13 bp, D. melanogaster
ttgtaagccattt

SEQ ID NO: 671172 - DNA, 13 bp, D. melanogaster
ttgtaagccgcaa

SEQ ID NO: 671173 - DNA, 13 bp, D. melanogaster
ttgtaagcgcgat

SEQ ID NO: 671174 - DNA, 14 bp, D. melanogaster
ttgtaagtagtttt

SEQ ID NO: 671175 - DNA, 14 bp, D. melanogaster
ttgtaataaaatgt

SEQ ID NO: 671176 - DNA, 13 bp, D. melanogaster
ttgtaataacaat

SEQ ID NO: 671177 - DNA, 13 bp, D. melanogaster
ttgtaatacatat

SEQ ID NO: 671178 - DNA, 13 bp, D. melanogaster
ttgtaatatatgt

SEQ ID NO: 671179 - DNA, 13 bp, D. melanogaster
ttgtaatcaaaat

SEQ ID NO: 671180 - DNA, 13 bp, D. melanogaster
ttgtaatcaccac

SEQ ID NO: 671181 - DNA, 13 bp, D. melanogaster
ttgtaatccaatt

SEQ ID NO: 671182 - DNA, 13 bp, D. melanogaster
ttgtaatccattt

SEQ ID NO: 671183 - DNA, 13 bp, D. melanogaster
ttgtaatgatgaa

SEQ ID NO: 671184 - DNA, 13 bp, D. melanogaster
ttgtaatgcctgt

SEQ ID NO: 671185 - DNA, 13 bp, D. melanogaster
ttgtaatggaaaa

SEQ ID NO: 671186 - DNA, 13 bp, D. melanogaster
ttgtaatggattt

SEQ ID NO: 671187 - DNA, 13 bp, D. melanogaster
ttgtaattaaatc

SEQ ID NO: 671188 - DNA, 13 bp, D. melanogaster
ttgtaattaagtt

SEQ ID NO: 671189 - DNA, 13 bp, D. melanogaster
ttgtaattaattg

SEQ ID NO: 671190 - DNA, 13 bp, D. melanogaster
ttgtaattacttt

SEQ ID NO: 671191 - DNA, 13 bp, D. melanogaster
ttgtaattatgtg

SEQ ID NO: 671192 - DNA, 13 bp, D. melanogaster
ttgtaattcaaaa

SEQ ID NO: 671193 - DNA, 13 bp, D. melanogaster
ttgtaattcaatt

SEQ ID NO: 671194 - DNA, 14 bp, D. melanogaster
ttgtaattcaattt

SEQ ID NO: 671195 - DNA, 14 bp, D. melanogaster
ttgtaattgcaatt

SEQ ID NO: 671196 - DNA, 13 bp, D. melanogaster
ttgtaattgcatt

SEQ ID NO: 671197 - DNA, 14 bp, D. melanogaster
ttgtaattgcatta

SEQ ID NO: 671198 - DNA, 14 bp, D. melanogaster
ttgtaattgcattt

SEQ ID NO: 671199 - DNA, 13 bp, D. melanogaster
ttgtaattgcttt

SEQ ID NO: 671200 - DNA, 13 bp, D. melanogaster
ttgtaattgttgc

SEQ ID NO: 671201 - DNA, 13 bp, D. melanogaster
ttgtaatttaaga

SEQ ID NO: 671202 - DNA, 13 bp, D. melanogaster
ttgtaatttaatg

SEQ ID NO: 671203 - DNA, 13 bp, D. melanogaster
ttgtaatttatgc

SEQ ID NO: 671204 - DNA, 13 bp, D. melanogaster
ttgtaatttcaat

SEQ ID NO: 671205 - DNA, 13 bp, D. melanogaster
ttgtaatttctat

SEQ ID NO: 671206 - DNA, 15 bp, D. melanogaster
ttgtaatttcttaat

SEQ ID NO: 671207 - DNA, 13 bp, D. melanogaster
ttgtaatttgcat

SEQ ID NO: 671208 - DNA, 13 bp, D. melanogaster
ttgtaatttgtaa

SEQ ID NO: 671209 - DNA, 13 bp, D. melanogaster
ttgtaattttaag

SEQ ID NO: 671210 - DNA, 13 bp, D. melanogaster
ttgtacaaaaaaa

SEQ ID NO: 671211 - DNA, 13 bp, D. melanogaster
ttgtacaaatata

SEQ ID NO: 671212 - DNA, 13 bp, D. melanogaster
ttgtacaaatatt

SEQ ID NO: 671213 - DNA, 13 bp, D. melanogaster
ttgtacaaattat

SEQ ID NO: 671214 - DNA, 13 bp, D. melanogaster
ttgtacaacaatt

SEQ ID NO: 671215 - DNA, 13 bp, D. melanogaster
ttgtacaactttt

SEQ ID NO: 671216 - DNA, 13 bp, D. melanogaster
ttgtacaatattt

SEQ ID NO: 671217 - DNA, 13 bp, D. melanogaster
ttgtacaatgcgc

SEQ ID NO: 671218 - DNA, 13 bp, D. melanogaster
ttgtacacatata

SEQ ID NO: 671219 - DNA, 13 bp, D. melanogaster
ttgtacacttttt

SEQ ID NO: 671220 - DNA, 13 bp, D. melanogaster
ttgtacagatttt

SEQ ID NO: 671221 - DNA, 13 bp, D. melanogaster
ttgtacaggagcc

SEQ ID NO: 671222 - DNA, 13 bp, D. melanogaster
ttgtacatacata

SEQ ID NO: 671223 - DNA, 15 bp, D. melanogaster
ttgtacatacataca

SEQ ID NO: 671224 - DNA, 13 bp, D. melanogaster
ttgtacatatatt

SEQ ID NO: 671225 - DNA, 13 bp, D. melanogaster
ttgtacatatgta

SEQ ID NO: 671226 - DNA, 14 bp, D. melanogaster
ttgtacatatgtat

SEQ ID NO: 671227 - DNA, 13 bp, D. melanogaster
ttgtacatattag

SEQ ID NO: 671228 - DNA, 13 bp, D. melanogaster
ttgtacatatttt

SEQ ID NO: 671229 - DNA, 13 bp, D. melanogaster
ttgtacatttaat

SEQ ID NO: 671230 - DNA, 13 bp, D. melanogaster
ttgtacattttca

SEQ ID NO: 671231 - DNA, 13 bp, D. melanogaster
ttgtacattttga

SEQ ID NO: 671232 - DNA, 13 bp, D. melanogaster
ttgtacattttgt

SEQ ID NO: 671233 - DNA, 14 bp, D. melanogaster
ttgtacatttttat

SEQ ID NO: 671234 - DNA, 13 bp, D. melanogaster
ttgtacatttttg

SEQ ID NO: 671235 - DNA, 13 bp, D. melanogaster
ttgtactatactt

SEQ ID NO: 671236 - DNA, 13 bp, D. melanogaster
ttgtactcatatt

SEQ ID NO: 671237 - DNA, 14 bp, D. melanogaster
ttgtactgtgaaac

SEQ ID NO: 671238 - DNA, 13 bp, D. melanogaster
ttgtacttccttt

SEQ ID NO: 671239 - DNA, 13 bp, D. melanogaster
ttgtactttgttc

SEQ ID NO: 671240 - DNA, 14 bp, D. melanogaster
ttgtactttgttct

SEQ ID NO: 671241 - DNA, 15 bp, D. melanogaster
ttgtactttttctat

SEQ ID NO: 671242 - DNA, 13 bp, D. melanogaster
ttgtagaaaaata

SEQ ID NO: 671243 - DNA, 13 bp, D. melanogaster
ttgtagaatttat

SEQ ID NO: 671244 - DNA, 13 bp, D. melanogaster
ttgtagataatgc

SEQ ID NO: 671245 - DNA, 14 bp, D. melanogaster
ttgtagatgcaaaa

SEQ ID NO: 671246 - DNA, 13 bp, D. melanogaster
ttgtagccaattt

SEQ ID NO: 671247 - DNA, 13 bp, D. melanogaster
ttgtagctaaagc

SEQ ID NO: 671248 - DNA, 13 bp, D. melanogaster
ttgtagttgtcgt

SEQ ID NO: 671249 - DNA, 14 bp, D. melanogaster
ttgtagtttttaga

SEQ ID NO: 671250 - DNA, 13 bp, D. melanogaster
ttgtataaaatgc

SEQ ID NO: 671251 - DNA, 13 bp, D. melanogaster
ttgtataaacaaa

SEQ ID NO: 671252 - DNA, 13 bp, D. melanogaster
ttgtataaattgt

SEQ ID NO: 671253 - DNA, 13 bp, D. melanogaster
ttgtataactttt

SEQ ID NO: 671254 - DNA, 15 bp, D. melanogaster
ttgtataagaactaa

SEQ ID NO: 671255 - DNA, 13 bp, D. melanogaster
ttgtataattgta

SEQ ID NO: 671256 - DNA, 14 bp, D. melanogaster
ttgtatacatatat

SEQ ID NO: 671257 - DNA, 13 bp, D. melanogaster
ttgtatacatttt

SEQ ID NO: 671258 - DNA, 13 bp, D. melanogaster
ttgtatataaaca

SEQ ID NO: 671259 - DNA, 13 bp, D. melanogaster
ttgtatatacata

SEQ ID NO: 671260 - DNA, 14 bp, D. melanogaster
ttgtatatacatat

SEQ ID NO: 671261 - DNA, 13 bp, D. melanogaster
ttgtatatacatt

SEQ ID NO: 671262 - DNA, 13 bp, D. melanogaster
ttgtatatataca

SEQ ID NO: 671263 - DNA, 13 bp, D. melanogaster
ttgtatatatgta

SEQ ID NO: 671264 - DNA, 13 bp, D. melanogaster
ttgtatatatttc

SEQ ID NO: 671265 - DNA, 13 bp, D. melanogaster
ttgtatatgttaa

SEQ ID NO: 671266 - DNA, 13 bp, D. melanogaster
ttgtatatttaca

SEQ ID NO: 671267 - DNA, 13 bp, D. melanogaster
ttgtatattttca

SEQ ID NO: 671268 - DNA, 13 bp, D. melanogaster
ttgtatcaaaagg

SEQ ID NO: 671269 - DNA, 13 bp, D. melanogaster
ttgtatcatattt

SEQ ID NO: 671270 - DNA, 13 bp, D. melanogaster
ttgtatctgcatc

SEQ ID NO: 671271 - DNA, 14 bp, D. melanogaster
ttgtatctgtatct

SEQ ID NO: 671272 - DNA, 13 bp, D. melanogaster
ttgtatcttcaaa

SEQ ID NO: 671273 - DNA, 13 bp, D. melanogaster
ttgtatcttttgg

SEQ ID NO: 671274 - DNA, 13 bp, D. melanogaster
ttgtatgatttaa

SEQ ID NO: 671275 - DNA, 13 bp, D. melanogaster
ttgtatgcaaaca

SEQ ID NO: 671276 - DNA, 13 bp, D. melanogaster
ttgtatgcaaatt

SEQ ID NO: 671277 - DNA, 13 bp, D. melanogaster
ttgtatgcaataa

SEQ ID NO: 671278 - DNA, 13 bp, D. melanogaster
ttgtatgcataat

SEQ ID NO: 671279 - DNA, 13 bp, D. melanogaster
ttgtatgcatatg

SEQ ID NO: 671280 - DNA, 13 bp, D. melanogaster
ttgtatgcattta

SEQ ID NO: 671281 - DNA, 13 bp, D. melanogaster
ttgtatgccaaat

SEQ ID NO: 671282 - DNA, 13 bp, D. melanogaster
ttgtatggaaatt

SEQ ID NO: 671283 - DNA, 13 bp, D. melanogaster
ttgtatgtaaagt

SEQ ID NO: 671284 - DNA, 13 bp, D. melanogaster
ttgtatgtacata

SEQ ID NO: 671285 - DNA, 14 bp, D. melanogaster
ttgtatgtacatat

SEQ ID NO: 671286 - DNA, 14 bp, D. melanogaster
ttgtatgtatgtat

SEQ ID NO: 671287 - DNA, 13 bp, D. melanogaster
ttgtatgtatgtg

SEQ ID NO: 671288 - DNA, 13 bp, D. melanogaster
ttgtattacattt

SEQ ID NO: 671289 - DNA, 13 bp, D. melanogaster
ttgtattataatg

SEQ ID NO: 671290 - DNA, 13 bp, D. melanogaster
ttgtattatcctt

SEQ ID NO: 671291 - DNA, 13 bp, D. melanogaster
ttgtattcaaatg

SEQ ID NO: 671292 - DNA, 13 bp, D. melanogaster
ttgtattcaaatt

SEQ ID NO: 671293 - DNA, 14 bp, D. melanogaster
ttgtattcaatttt

SEQ ID NO: 671294 - DNA, 13 bp, D. melanogaster
ttgtattcacttt

SEQ ID NO: 671295 - DNA, 13 bp, D. melanogaster
ttgtattcatttc

SEQ ID NO: 671296 - DNA, 13 bp, D. melanogaster
ttgtattcatttg

SEQ ID NO: 671297 - DNA, 13 bp, D. melanogaster
ttgtattccaaat

SEQ ID NO: 671298 - DNA, 13 bp, D. melanogaster
ttgtattccattt

SEQ ID NO: 671299 - DNA, 13 bp, D. melanogaster
ttgtattcctcta

SEQ ID NO: 671300 - DNA, 14 bp, D. melanogaster
ttgtattgcattaa

SEQ ID NO: 671301 - DNA, 13 bp, D. melanogaster
ttgtattggatca

SEQ ID NO: 671302 - DNA, 13 bp, D. melanogaster
ttgtattgtgata

SEQ ID NO: 671303 - DNA, 13 bp, D. melanogaster
ttgtatttaaagt

SEQ ID NO: 671304 - DNA, 13 bp, D. melanogaster
ttgtatttacata

SEQ ID NO: 671305 - DNA, 13 bp, D. melanogaster
ttgtatttattgc

SEQ ID NO: 671306 - DNA, 13 bp, D. melanogaster
ttgtatttcaaat

SEQ ID NO: 671307 - DNA, 13 bp, D. melanogaster
ttgtatttcaagt

SEQ ID NO: 671308 - DNA, 13 bp, D. melanogaster
ttgtatttcaatt

SEQ ID NO: 671309 - DNA, 14 bp, D. melanogaster
ttgtatttcaattt

SEQ ID NO: 671310 - DNA, 13 bp, D. melanogaster
ttgtatttccatt

SEQ ID NO: 671311 - DNA, 14 bp, D. melanogaster
ttgtatttccattt

SEQ ID NO: 671312 - DNA, 13 bp, D. melanogaster
ttgtatttcgatt

SEQ ID NO: 671313 - DNA, 14 bp, D. melanogaster
ttgtatttcttcca

SEQ ID NO: 671314 - DNA, 13 bp, D. melanogaster
ttgtatttgcata

SEQ ID NO: 671315 - DNA, 13 bp, D. melanogaster
ttgtatttgccca

SEQ ID NO: 671316 - DNA, 13 bp, D. melanogaster
ttgtatttgctgt

SEQ ID NO: 671317 - DNA, 14 bp, D. melanogaster
ttgtatttgcttta

SEQ ID NO: 671318 - DNA, 13 bp, D. melanogaster
ttgtatttggctt

SEQ ID NO: 671319 - DNA, 13 bp, D. melanogaster
ttgtatttgtaaa

SEQ ID NO: 671320 - DNA, 13 bp, D. melanogaster
ttgtatttgtatc

SEQ ID NO: 671321 - DNA, 14 bp, D. melanogaster
ttgtatttgtatct

SEQ ID NO: 671322 - DNA, 13 bp, D. melanogaster
ttgtatttgtgcg

SEQ ID NO: 671323 - DNA, 13 bp, D. melanogaster
ttgtattttgcta

SEQ ID NO: 671324 - DNA, 13 bp, D. melanogaster
ttgtatttttcca

SEQ ID NO: 671325 - DNA, 13 bp, D. melanogaster
ttgtatttttgca

SEQ ID NO: 671326 - DNA, 13 bp, D. melanogaster
ttgtcaaaaaaat

SEQ ID NO: 671327 - DNA, 13 bp, D. melanogaster
ttgtcaaaaattc

SEQ ID NO: 671328 - DNA, 13 bp, D. melanogaster
ttgtcaaaataaa

SEQ ID NO: 671329 - DNA, 14 bp, D. melanogaster
ttgtcaaaataaat

SEQ ID NO: 671330 - DNA, 14 bp, D. melanogaster
ttgtcaaaatattt

SEQ ID NO: 671331 - DNA, 13 bp, D. melanogaster
ttgtcaaaatttc

SEQ ID NO: 671332 - DNA, 13 bp, D. melanogaster
ttgtcaaagtttt

SEQ ID NO: 671333 - DNA, 13 bp, D. melanogaster
ttgtcaaatatat

SEQ ID NO: 671334 - DNA, 13 bp, D. melanogaster
ttgtcaaatattt

SEQ ID NO: 671335 - DNA, 13 bp, D. melanogaster
ttgtcaaatgttt

SEQ ID NO: 671336 - DNA, 13 bp, D. melanogaster
ttgtcaaattaaa

SEQ ID NO: 671337 - DNA, 13 bp, D. melanogaster
ttgtcaaatttac

SEQ ID NO: 671338 - DNA, 13 bp, D. melanogaster
ttgtcaaattttt

SEQ ID NO: 671339 - DNA, 13 bp, D. melanogaster
ttgtcaacaaaat

SEQ ID NO: 671340 - DNA, 13 bp, D. melanogaster
ttgtcaacaattt

SEQ ID NO: 671341 - DNA, 13 bp, D. melanogaster
ttgtcaagttctt

SEQ ID NO: 671342 - DNA, 13 bp, D. melanogaster
ttgtcaagtttct

SEQ ID NO: 671343 - DNA, 13 bp, D. melanogaster
ttgtcaataataa

SEQ ID NO: 671344 - DNA, 13 bp, D. melanogaster
ttgtcaatcaaaa

SEQ ID NO: 671345 - DNA, 13 bp, D. melanogaster
ttgtcaattgtca

SEQ ID NO: 671346 - DNA, 13 bp, D. melanogaster
ttgtcaatttaaa

SEQ ID NO: 671347 - DNA, 13 bp, D. melanogaster
ttgtcaatttaat

SEQ ID NO: 671348 - DNA, 13 bp, D. melanogaster
ttgtcaatttcta

SEQ ID NO: 671349 - DNA, 13 bp, D. melanogaster
ttgtcaatttgtt

SEQ ID NO: 671350 - DNA, 13 bp, D. melanogaster
ttgtcacaaattg

SEQ ID NO: 671351 - DNA, 13 bp, D. melanogaster
ttgtcacaatttt

SEQ ID NO: 671352 - DNA, 13 bp, D. melanogaster
ttgtcacattttg

SEQ ID NO: 671353 - DNA, 13 bp, D. melanogaster
ttgtcaccattaa

SEQ ID NO: 671354 - DNA, 13 bp, D. melanogaster
ttgtcagccattt

SEQ ID NO: 671355 - DNA, 13 bp, D. melanogaster
ttgtcagcgaaaa

SEQ ID NO: 671356 - DNA, 13 bp, D. melanogaster
ttgtcagctgcaa

SEQ ID NO: 671357 - DNA, 13 bp, D. melanogaster
ttgtcagcttgtt

SEQ ID NO: 671358 - DNA, 13 bp, D. melanogaster
ttgtcagttggca

SEQ ID NO: 671359 - DNA, 13 bp, D. melanogaster
ttgtcagtttctc

SEQ ID NO: 671360 - DNA, 13 bp, D. melanogaster
ttgtcataataaa

SEQ ID NO: 671361 - DNA, 13 bp, D. melanogaster
ttgtcataattaa

SEQ ID NO: 671362 - DNA, 14 bp, D. melanogaster
ttgtcatacctatt

SEQ ID NO: 671363 - DNA, 13 bp, D. melanogaster
ttgtcatcatttt

SEQ ID NO: 671364 - DNA, 13 bp, D. melanogaster
ttgtcatccagct

SEQ ID NO: 671365 - DNA, 13 bp, D. melanogaster
ttgtcatcctgca

SEQ ID NO: 671366 - DNA, 13 bp, D. melanogaster
ttgtcatcgtcat

SEQ ID NO: 671367 - DNA, 13 bp, D. melanogaster
ttgtcatctggca

SEQ ID NO: 671368 - DNA, 14 bp, D. melanogaster
ttgtcatctggcaa

SEQ ID NO: 671369 - DNA, 13 bp, D. melanogaster
ttgtcatgtaaat

SEQ ID NO: 671370 - DNA, 13 bp, D. melanogaster
ttgtcattaattt

SEQ ID NO: 671371 - DNA, 13 bp, D. melanogaster
ttgtcattcaaat

SEQ ID NO: 671372 - DNA, 13 bp, D. melanogaster
ttgtcattgattt

SEQ ID NO: 671373 - DNA, 13 bp, D. melanogaster
ttgtcattgcaaa

SEQ ID NO: 671374 - DNA, 13 bp, D. melanogaster
ttgtcattgccaa

SEQ ID NO: 671375 - DNA, 13 bp, D. melanogaster
ttgtcattgtcat

SEQ ID NO: 671376 - DNA, 13 bp, D. melanogaster
ttgtcattgttat

SEQ ID NO: 671377 - DNA, 13 bp, D. melanogaster
ttgtcatttaatc

SEQ ID NO: 671378 - DNA, 13 bp, D. melanogaster
ttgtcatttgcca

SEQ ID NO: 671379 - DNA, 14 bp, D. melanogaster
ttgtcatttgtggc

SEQ ID NO: 671380 - DNA, 13 bp, D. melanogaster
ttgtcattttctg

SEQ ID NO: 671381 - DNA, 13 bp, D. melanogaster
ttgtcattttggc

SEQ ID NO: 671382 - DNA, 13 bp, D. melanogaster
ttgtcatttttaa

SEQ ID NO: 671383 - DNA, 13 bp, D. melanogaster
ttgtccaaaaatg

SEQ ID NO: 671384 - DNA, 13 bp, D. melanogaster
ttgtccaaaaatt

SEQ ID NO: 671385 - DNA, 13 bp, D. melanogaster
ttgtccaatgacc

SEQ ID NO: 671386 - DNA, 13 bp, D. melanogaster
ttgtcccctgtgt

SEQ ID NO: 671387 - DNA, 13 bp, D. melanogaster
ttgtccgaaaatg

SEQ ID NO: 671388 - DNA, 13 bp, D. melanogaster
ttgtccgacattg

SEQ ID NO: 671389 - DNA, 13 bp, D. melanogaster
ttgtcgaatgctt

SEQ ID NO: 671390 - DNA, 13 bp, D. melanogaster
ttgtcgataactt

SEQ ID NO: 671391 - DNA, 13 bp, D. melanogaster
ttgtcgccgcttt

SEQ ID NO: 671392 - DNA, 14 bp, D. melanogaster
ttgtcgctgctgct

SEQ ID NO: 671393 - DNA, 13 bp, D. melanogaster
ttgtcgctggctt

SEQ ID NO: 671394 - DNA, 13 bp, D. melanogaster
ttgtcgctgttgc

SEQ ID NO: 671395 - DNA, 13 bp, D. melanogaster
ttgtcggaattgg

SEQ ID NO: 671396 - DNA, 13 bp, D. melanogaster
ttgtcggacatca

SEQ ID NO: 671397 - DNA, 13 bp, D. melanogaster
ttgtcggctatcc

SEQ ID NO: 671398 - DNA, 13 bp, D. melanogaster
ttgtcgtcgtcgc

SEQ ID NO: 671399 - DNA, 13 bp, D. melanogaster
ttgtcgttggcat

SEQ ID NO: 671400 - DNA, 14 bp, D. melanogaster
ttgtcgttgtcgtc

SEQ ID NO: 671401 - DNA, 13 bp, D. melanogaster
ttgtcgttgttgc

SEQ ID NO: 671402 - DNA, 13 bp, D. melanogaster
ttgtctaaaaatg

SEQ ID NO: 671403 - DNA, 14 bp, D. melanogaster
ttgtctacaacgag

SEQ ID NO: 671404 - DNA, 13 bp, D. melanogaster
ttgtctcgcataa

SEQ ID NO: 671405 - DNA, 13 bp, D. melanogaster
ttgtctgaatatg

SEQ ID NO: 671406 - DNA, 13 bp, D. melanogaster
ttgtctgactatc

SEQ ID NO: 671407 - DNA, 13 bp, D. melanogaster
ttgtctgatccat

SEQ ID NO: 671408 - DNA, 13 bp, D. melanogaster
ttgtctgcagctt

SEQ ID NO: 671409 - DNA, 13 bp, D. melanogaster
ttgtctgcattgt

SEQ ID NO: 671410 - DNA, 13 bp, D. melanogaster
ttgtctgcatttt

SEQ ID NO: 671411 - DNA, 13 bp, D. melanogaster
ttgtctgccgcgc

SEQ ID NO: 671412 - DNA, 13 bp, D. melanogaster
ttgtctgctgaag

SEQ ID NO: 671413 - DNA, 13 bp, D. melanogaster
ttgtctggcattt

SEQ ID NO: 671414 - DNA, 13 bp, D. melanogaster
ttgtctggccgaa

SEQ ID NO: 671415 - DNA, 13 bp, D. melanogaster
ttgtctgtgtgtc

SEQ ID NO: 671416 - DNA, 13 bp, D. melanogaster
ttgtcttaaaaaa

SEQ ID NO: 671417 - DNA, 13 bp, D. melanogaster
ttgtcttaatatt

SEQ ID NO: 671418 - DNA, 13 bp, D. melanogaster
ttgtcttcccatt

SEQ ID NO: 671419 - DNA, 13 bp, D. melanogaster
ttgtcttgagtat

SEQ ID NO: 671420 - DNA, 14 bp, D. melanogaster
ttgtcttgccaatt

SEQ ID NO: 671421 - DNA, 13 bp, D. melanogaster
ttgtcttggccaa

SEQ ID NO: 671422 - DNA, 13 bp, D. melanogaster
ttgtcttggccat

SEQ ID NO: 671423 - DNA, 13 bp, D. melanogaster
ttgtctttcactc

SEQ ID NO: 671424 - DNA, 13 bp, D. melanogaster
ttgtctttggcaa

SEQ ID NO: 671425 - DNA, 13 bp, D. melanogaster
ttgtgaaaaagtg

SEQ ID NO: 671426 - DNA, 13 bp, D. melanogaster
ttgtgaaaacaat

SEQ ID NO: 671427 - DNA, 13 bp, D. melanogaster
ttgtgaaaataaa

SEQ ID NO: 671428 - DNA, 13 bp, D. melanogaster
ttgtgaaaatatt

SEQ ID NO: 671429 - DNA, 14 bp, D. melanogaster
ttgtgaaaatcaaa

SEQ ID NO: 671430 - DNA, 13 bp, D. melanogaster
ttgtgaaaattat

SEQ ID NO: 671431 - DNA, 13 bp, D. melanogaster
ttgtgaaaattgt

SEQ ID NO: 671432 - DNA, 13 bp, D. melanogaster
ttgtgaaacgatg

SEQ ID NO: 671433 - DNA, 13 bp, D. melanogaster
ttgtgaaactaaa

SEQ ID NO: 671434 - DNA, 14 bp, D. melanogaster
ttgtgaaactaaaa

SEQ ID NO: 671435 - DNA, 13 bp, D. melanogaster
ttgtgaaactgat

SEQ ID NO: 671436 - DNA, 13 bp, D. melanogaster
ttgtgaaagtttt

SEQ ID NO: 671437 - DNA, 13 bp, D. melanogaster
ttgtgaaatatat

SEQ ID NO: 671438 - DNA, 13 bp, D. melanogaster
ttgtgaaatattc

SEQ ID NO: 671439 - DNA, 14 bp, D. melanogaster
ttgtgaaattaaaa

SEQ ID NO: 671440 - DNA, 13 bp, D. melanogaster
ttgtgaaattcaa

SEQ ID NO: 671441 - DNA, 13 bp, D. melanogaster
ttgtgaacttttt

SEQ ID NO: 671442 - DNA, 13 bp, D. melanogaster
ttgtgaataaaaa

SEQ ID NO: 671443 - DNA, 13 bp, D. melanogaster
ttgtgaataattt

SEQ ID NO: 671444 - DNA, 13 bp, D. melanogaster
ttgtgaatcgaaa

SEQ ID NO: 671445 - DNA, 13 bp, D. melanogaster
ttgtgaatgaaaa

SEQ ID NO: 671446 - DNA, 13 bp, D. melanogaster
ttgtgaatgaatg

SEQ ID NO: 671447 - DNA, 13 bp, D. melanogaster
ttgtgaatgcaaa

SEQ ID NO: 671448 - DNA, 13 bp, D. melanogaster
ttgtgaatggaaa

SEQ ID NO: 671449 - DNA, 14 bp, D. melanogaster
ttgtgaattaaaga

SEQ ID NO: 671450 - DNA, 13 bp, D. melanogaster
ttgtgaatttttc

SEQ ID NO: 671451 - DNA, 13 bp, D. melanogaster
ttgtgacactttg

SEQ ID NO: 671452 - DNA, 13 bp, D. melanogaster
ttgtgacatttta

SEQ ID NO: 671453 - DNA, 13 bp, D. melanogaster
ttgtgacattttt

SEQ ID NO: 671454 - DNA, 14 bp, D. melanogaster
ttgtgacccaaata

SEQ ID NO: 671455 - DNA, 13 bp, D. melanogaster
ttgtgagcgtgtg

SEQ ID NO: 671456 - DNA, 13 bp, D. melanogaster
ttgtgataaaaaa

SEQ ID NO: 671457 - DNA, 13 bp, D. melanogaster
ttgtgataaatga

SEQ ID NO: 671458 - DNA, 13 bp, D. melanogaster
ttgtgatacattt

SEQ ID NO: 671459 - DNA, 13 bp, D. melanogaster
ttgtgatattttc

SEQ ID NO: 671460 - DNA, 13 bp, D. melanogaster
ttgtgatccatca

SEQ ID NO: 671461 - DNA, 13 bp, D. melanogaster
ttgtgatctggct

SEQ ID NO: 671462 - DNA, 14 bp, D. melanogaster
ttgtgatctggctg

SEQ ID NO: 671463 - DNA, 15 bp, D. melanogaster
ttgtgatctggctgg

SEQ ID NO: 671464 - DNA, 13 bp, D. melanogaster
ttgtgatgcctca

SEQ ID NO: 671465 - DNA, 13 bp, D. melanogaster
ttgtgattaaaat

SEQ ID NO: 671466 - DNA, 13 bp, D. melanogaster
ttgtgattgaatt

SEQ ID NO: 671467 - DNA, 13 bp, D. melanogaster
ttgtgattgtgat

SEQ ID NO: 671468 - DNA, 13 bp, D. melanogaster
ttgtgatttcatt

SEQ ID NO: 671469 - DNA, 13 bp, D. melanogaster
ttgtgatttgtgc

SEQ ID NO: 671470 - DNA, 13 bp, D. melanogaster
ttgtgcaaaaaaa

SEQ ID NO: 671471 - DNA, 14 bp, D. melanogaster
ttgtgcaaaaaaaa

SEQ ID NO: 671472 - DNA, 13 bp, D. melanogaster
ttgtgcaaaaagt

SEQ ID NO: 671473 - DNA, 14 bp, D. melanogaster
ttgtgcaaacattt

SEQ ID NO: 671474 - DNA, 13 bp, D. melanogaster
ttgtgcaaataaa

SEQ ID NO: 671475 - DNA, 14 bp, D. melanogaster
ttgtgcaaataaat

SEQ ID NO: 671476 - DNA, 14 bp, D. melanogaster
ttgtgcaaataatt

SEQ ID NO: 671477 - DNA, 13 bp, D. melanogaster
ttgtgcaaattaa

SEQ ID NO: 671478 - DNA, 13 bp, D. melanogaster
ttgtgcaaatttc

SEQ ID NO: 671479 - DNA, 13 bp, D. melanogaster
ttgtgcaaatttg

SEQ ID NO: 671480 - DNA, 13 bp, D. melanogaster
ttgtgcaacatca

SEQ ID NO: 671481 - DNA, 13 bp, D. melanogaster
ttgtgcaacattt

SEQ ID NO: 671482 - DNA, 13 bp, D. melanogaster
ttgtgcaactgca

SEQ ID NO: 671483 - DNA, 13 bp, D. melanogaster
ttgtgcaataaat

SEQ ID NO: 671484 - DNA, 13 bp, D. melanogaster
ttgtgcaatattt

SEQ ID NO: 671485 - DNA, 13 bp, D. melanogaster
ttgtgcaatgcaa

SEQ ID NO: 671486 - DNA, 13 bp, D. melanogaster
ttgtgcaattaaa

SEQ ID NO: 671487 - DNA, 13 bp, D. melanogaster
ttgtgcaattgca

SEQ ID NO: 671488 - DNA, 13 bp, D. melanogaster
ttgtgcaattgtg

SEQ ID NO: 671489 - DNA, 13 bp, D. melanogaster
ttgtgcaattttt

SEQ ID NO: 671490 - DNA, 14 bp, D. melanogaster
ttgtgcaatttttt

SEQ ID NO: 671491 - DNA, 13 bp, D. melanogaster
ttgtgcacacatt

SEQ ID NO: 671492 - DNA, 14 bp, D. melanogaster
ttgtgcactatttt

SEQ ID NO: 671493 - DNA, 13 bp, D. melanogaster
ttgtgcagaaaaa

SEQ ID NO: 671494 - DNA, 13 bp, D. melanogaster
ttgtgcagaaatt

SEQ ID NO: 671495 - DNA, 13 bp, D. melanogaster
ttgtgcagcaagt

SEQ ID NO: 671496 - DNA, 13 bp, D. melanogaster
ttgtgcagttttt

SEQ ID NO: 671497 - DNA, 13 bp, D. melanogaster
ttgtgcataatta

SEQ ID NO: 671498 - DNA, 13 bp, D. melanogaster
ttgtgcatatatt

SEQ ID NO: 671499 - DNA, 13 bp, D. melanogaster
ttgtgcatatttc

SEQ ID NO: 671500 - DNA, 13 bp, D. melanogaster
ttgtgcatatttt

SEQ ID NO: 671501 - DNA, 13 bp, D. melanogaster
ttgtgcatgtgtg

SEQ ID NO: 671502 - DNA, 13 bp, D. melanogaster
ttgtgcattgtgc

SEQ ID NO: 671503 - DNA, 13 bp, D. melanogaster
ttgtgcatttata

SEQ ID NO: 671504 - DNA, 13 bp, D. melanogaster
ttgtgcatttgct

SEQ ID NO: 671505 - DNA, 14 bp, D. melanogaster
ttgtgcatttttaa

SEQ ID NO: 671506 - DNA, 13 bp, D. melanogaster
ttgtgccaaaaaa

SEQ ID NO: 671507 - DNA, 13 bp, D. melanogaster
ttgtgccaaaaat

SEQ ID NO: 671508 - DNA, 13 bp, D. melanogaster
ttgtgccaaaata

SEQ ID NO: 671509 - DNA, 13 bp, D. melanogaster
ttgtgccaactat

SEQ ID NO: 671510 - DNA, 13 bp, D. melanogaster
ttgtgccacaaaa

SEQ ID NO: 671511 - DNA, 13 bp, D. melanogaster
ttgtgccacattt

SEQ ID NO: 671512 - DNA, 13 bp, D. melanogaster
ttgtgccacgccc

SEQ ID NO: 671513 - DNA, 13 bp, D. melanogaster
ttgtgccattcgg

SEQ ID NO: 671514 - DNA, 13 bp, D. melanogaster
ttgtgcccattgt

SEQ ID NO: 671515 - DNA, 13 bp, D. melanogaster
ttgtgccccaaaa

SEQ ID NO: 671516 - DNA, 13 bp, D. melanogaster
ttgtgccgtttgt

SEQ ID NO: 671517 - DNA, 13 bp, D. melanogaster
ttgtgcctgtgtg

SEQ ID NO: 671518 - DNA, 13 bp, D. melanogaster
ttgtgcgaatgtt

SEQ ID NO: 671519 - DNA, 13 bp, D. melanogaster
ttgtgcgacgaga

SEQ ID NO: 671520 - DNA, 13 bp, D. melanogaster
ttgtgcgatttgt

SEQ ID NO: 671521 - DNA, 13 bp, D. melanogaster
ttgtgcggctcct

SEQ ID NO: 671522 - DNA, 13 bp, D. melanogaster
ttgtgcggcttgt

SEQ ID NO: 671523 - DNA, 14 bp, D. melanogaster
ttgtgcgttgaaaa

SEQ ID NO: 671524 - DNA, 13 bp, D. melanogaster
ttgtgctcttctc

SEQ ID NO: 671525 - DNA, 14 bp, D. melanogaster
ttgtgctgctgctg

SEQ ID NO: 671526 - DNA, 13 bp, D. melanogaster
ttgtgctgtaatt

SEQ ID NO: 671527 - DNA, 13 bp, D. melanogaster
ttgtgctgtattt

SEQ ID NO: 671528 - DNA, 13 bp, D. melanogaster
ttgtgcttttcgc

SEQ ID NO: 671529 - DNA, 13 bp, D. melanogaster
ttgtggaaaaaaa

SEQ ID NO: 671530 - DNA, 13 bp, D. melanogaster
ttgtggaaaagaa

SEQ ID NO: 671531 - DNA, 13 bp, D. melanogaster
ttgtggaaaatat

SEQ ID NO: 671532 - DNA, 13 bp, D. melanogaster
ttgtggaaattaa

SEQ ID NO: 671533 - DNA, 14 bp, D. melanogaster
ttgtggaaatttgt

SEQ ID NO: 671534 - DNA, 13 bp, D. melanogaster
ttgtggaatattt

SEQ ID NO: 671535 - DNA, 13 bp, D. melanogaster
ttgtggacgaaat

SEQ ID NO: 671536 - DNA, 14 bp, D. melanogaster
ttgtggactccaaa

SEQ ID NO: 671537 - DNA, 14 bp, D. melanogaster
ttgtggagaatgca

SEQ ID NO: 671538 - DNA, 13 bp, D. melanogaster
ttgtggatgtgga

SEQ ID NO: 671539 - DNA, 13 bp, D. melanogaster
ttgtggcaaacaa

SEQ ID NO: 671540 - DNA, 13 bp, D. melanogaster
ttgtggcaaagtt

SEQ ID NO: 671541 - DNA, 13 bp, D. melanogaster
ttgtggcaaatta

SEQ ID NO: 671542 - DNA, 13 bp, D. melanogaster
ttgtggcaacttt

SEQ ID NO: 671543 - DNA, 13 bp, D. melanogaster
ttgtggcactttt

SEQ ID NO: 671544 - DNA, 13 bp, D. melanogaster
ttgtggcagttgc

SEQ ID NO: 671545 - DNA, 13 bp, D. melanogaster
ttgtggcatattt

SEQ ID NO: 671546 - DNA, 13 bp, D. melanogaster
ttgtggcatgtgt

SEQ ID NO: 671547 - DNA, 13 bp, D. melanogaster
ttgtggcatttaa

SEQ ID NO: 671548 - DNA, 13 bp, D. melanogaster
ttgtggcatttta

SEQ ID NO: 671549 - DNA, 13 bp, D. melanogaster
ttgtggcattttt

SEQ ID NO: 671550 - DNA, 13 bp, D. melanogaster
ttgtggccaaaaa

SEQ ID NO: 671551 - DNA, 13 bp, D. melanogaster
ttgtggccaaaac

SEQ ID NO: 671552 - DNA, 13 bp, D. melanogaster
ttgtggccaaaat

SEQ ID NO: 671553 - DNA, 13 bp, D. melanogaster
ttgtggccaaagt

SEQ ID NO: 671554 - DNA, 13 bp, D. melanogaster
ttgtggccaacaa

SEQ ID NO: 671555 - DNA, 13 bp, D. melanogaster
ttgtggccaactt

SEQ ID NO: 671556 - DNA, 13 bp, D. melanogaster
ttgtggccaagaa

SEQ ID NO: 671557 - DNA, 13 bp, D. melanogaster
ttgtggccaagag

SEQ ID NO: 671558 - DNA, 13 bp, D. melanogaster
ttgtggccaagtt

SEQ ID NO: 671559 - DNA, 13 bp, D. melanogaster
ttgtggccaataa

SEQ ID NO: 671560 - DNA, 13 bp, D. melanogaster
ttgtggccataaa

SEQ ID NO: 671561 - DNA, 13 bp, D. melanogaster
ttgtggccattgt

SEQ ID NO: 671562 - DNA, 13 bp, D. melanogaster
ttgtggccttcga

SEQ ID NO: 671563 - DNA, 13 bp, D. melanogaster
ttgtggcctttgt

SEQ ID NO: 671564 - DNA, 13 bp, D. melanogaster
ttgtggccttttg

SEQ ID NO: 671565 - DNA, 13 bp, D. melanogaster
ttgtggctaaaaa

SEQ ID NO: 671566 - DNA, 14 bp, D. melanogaster
ttgtggctacaatg

SEQ ID NO: 671567 - DNA, 13 bp, D. melanogaster
ttgtggctgcaac

SEQ ID NO: 671568 - DNA, 13 bp, D. melanogaster
ttgtggctgcatt

SEQ ID NO: 671569 - DNA, 14 bp, D. melanogaster
ttgtggctgctgct

SEQ ID NO: 671570 - DNA, 13 bp, D. melanogaster
ttgtggctgcttt

SEQ ID NO: 671571 - DNA, 13 bp, D. melanogaster
ttgtggctttaat

SEQ ID NO: 671572 - DNA, 13 bp, D. melanogaster
ttgtgggaaaatt

SEQ ID NO: 671573 - DNA, 14 bp, D. melanogaster
ttgtgggaaaattt

SEQ ID NO: 671574 - DNA, 13 bp, D. melanogaster
ttgtgggcagaaa

SEQ ID NO: 671575 - DNA, 13 bp, D. melanogaster
ttgtgggcatgac

SEQ ID NO: 671576 - DNA, 13 bp, D. melanogaster
ttgtgggcgtggc

SEQ ID NO: 671577 - DNA, 13 bp, D. melanogaster
ttgtgggcgtgtc

SEQ ID NO: 671578 - DNA, 13 bp, D. melanogaster
ttgtgggcgttgc

SEQ ID NO: 671579 - DNA, 14 bp, D. melanogaster
ttgtgggctatgaa

SEQ ID NO: 671580 - DNA, 13 bp, D. melanogaster
ttgtgggggaaaa

SEQ ID NO: 671581 - DNA, 13 bp, D. melanogaster
ttgtgggtaatat

SEQ ID NO: 671582 - DNA, 13 bp, D. melanogaster
ttgtggtcataaa

SEQ ID NO: 671583 - DNA, 13 bp, D. melanogaster
ttgtggttgatat

SEQ ID NO: 671584 - DNA, 14 bp, D. melanogaster
ttgtggtttcttta

SEQ ID NO: 671585 - DNA, 13 bp, D. melanogaster
ttgtgtaaaaaaa

SEQ ID NO: 671586 - DNA, 13 bp, D. melanogaster
ttgtgtaaaacta

SEQ ID NO: 671587 - DNA, 14 bp, D. melanogaster
ttgtgtaaacaaat

SEQ ID NO: 671588 - DNA, 13 bp, D. melanogaster
ttgtgtaaataaa

SEQ ID NO: 671589 - DNA, 13 bp, D. melanogaster
ttgtgtaaatatt

SEQ ID NO: 671590 - DNA, 14 bp, D. melanogaster
ttgtgtaatattaa

SEQ ID NO: 671591 - DNA, 13 bp, D. melanogaster
ttgtgtaatcttt

SEQ ID NO: 671592 - DNA, 13 bp, D. melanogaster
ttgtgtaattaat

SEQ ID NO: 671593 - DNA, 13 bp, D. melanogaster
ttgtgtaccatct

SEQ ID NO: 671594 - DNA, 13 bp, D. melanogaster
ttgtgtacttata

SEQ ID NO: 671595 - DNA, 13 bp, D. melanogaster
ttgtgtatatata

SEQ ID NO: 671596 - DNA, 13 bp, D. melanogaster
ttgtgtatgcatt

SEQ ID NO: 671597 - DNA, 13 bp, D. melanogaster
ttgtgtcactttt

SEQ ID NO: 671598 - DNA, 13 bp, D. melanogaster
ttgtgtcccaaaa

SEQ ID NO: 671599 - DNA, 13 bp, D. melanogaster
ttgtgtgaaaaat

SEQ ID NO: 671600 - DNA, 13 bp, D. melanogaster
ttgtgtgaaatat

SEQ ID NO: 671601 - DNA, 14 bp, D. melanogaster
ttgtgtgagtgtgc

SEQ ID NO: 671602 - DNA, 13 bp, D. melanogaster
ttgtgtgataatg

SEQ ID NO: 671603 - DNA, 13 bp, D. melanogaster
ttgtgtgattttc

SEQ ID NO: 671604 - DNA, 13 bp, D. melanogaster
ttgtgtgcacttc

SEQ ID NO: 671605 - DNA, 14 bp, D. melanogaster
ttgtgtgcacttca

SEQ ID NO: 671606 - DNA, 14 bp, D. melanogaster
ttgtgtgcatgtgt

SEQ ID NO: 671607 - DNA, 13 bp, D. melanogaster
ttgtgtgcattgt

SEQ ID NO: 671608 - DNA, 13 bp, D. melanogaster
ttgtgtgcatttg

SEQ ID NO: 671609 - DNA, 13 bp, D. melanogaster
ttgtgtgccaaaa

SEQ ID NO: 671610 - DNA, 13 bp, D. melanogaster
ttgtgtgccattt

SEQ ID NO: 671611 - DNA, 14 bp, D. melanogaster
ttgtgtgcgtgcgt

SEQ ID NO: 671612 - DNA, 13 bp, D. melanogaster
ttgtgtggaaaat

SEQ ID NO: 671613 - DNA, 13 bp, D. melanogaster
ttgtgtggccaaa

SEQ ID NO: 671614 - DNA, 13 bp, D. melanogaster
ttgtgtgtgaaaa

SEQ ID NO: 671615 - DNA, 13 bp, D. melanogaster
ttgtgtgtgcaaa

SEQ ID NO: 671616 - DNA, 13 bp, D. melanogaster
ttgtgtgtgcaat

SEQ ID NO: 671617 - DNA, 13 bp, D. melanogaster
ttgtgtgtgccac

SEQ ID NO: 671618 - DNA, 13 bp, D. melanogaster
ttgtgtgtgcctt

SEQ ID NO: 671619 - DNA, 14 bp, D. melanogaster
ttgtgttaatacca

SEQ ID NO: 671620 - DNA, 13 bp, D. melanogaster
ttgtgttcaaaat

SEQ ID NO: 671621 - DNA, 13 bp, D. melanogaster
ttgtgttcaattt

SEQ ID NO: 671622 - DNA, 13 bp, D. melanogaster
ttgtgttcatatt

SEQ ID NO: 671623 - DNA, 13 bp, D. melanogaster
ttgtgttcgattt

SEQ ID NO: 671624 - DNA, 13 bp, D. melanogaster
ttgtgttgacttt

SEQ ID NO: 671625 - DNA, 14 bp, D. melanogaster
ttgtgttgctgctg

SEQ ID NO: 671626 - DNA, 13 bp, D. melanogaster
ttgtgttggcact

SEQ ID NO: 671627 - DNA, 14 bp, D. melanogaster
ttgtgttggccaaa

SEQ ID NO: 671628 - DNA, 13 bp, D. melanogaster
ttgtgtttaaata

SEQ ID NO: 671629 - DNA, 13 bp, D. melanogaster
ttgtgtttacatt

SEQ ID NO: 671630 - DNA, 13 bp, D. melanogaster
ttgtgtttattac

SEQ ID NO: 671631 - DNA, 13 bp, D. melanogaster
ttgtgtttgaaaa

SEQ ID NO: 671632 - DNA, 13 bp, D. melanogaster
ttgtgtttgccaa

SEQ ID NO: 671633 - DNA, 13 bp, D. melanogaster
ttgtgtttgtgca

SEQ ID NO: 671634 - DNA, 13 bp, D. melanogaster
ttgtgttttacaa

SEQ ID NO: 671635 - DNA, 13 bp, D. melanogaster
ttgtgttttcaaa

SEQ ID NO: 671636 - DNA, 13 bp, D. melanogaster
ttgtgttttcgaa

SEQ ID NO: 671637 - DNA, 13 bp, D. melanogaster
ttgttaaaaaaca

SEQ ID NO: 671638 - DNA, 13 bp, D. melanogaster
ttgttaaaaactg

SEQ ID NO: 671639 - DNA, 13 bp, D. melanogaster
ttgttaaaaatgt

SEQ ID NO: 671640 - DNA, 13 bp, D. melanogaster
ttgttaaaagttt

SEQ ID NO: 671641 - DNA, 14 bp, D. melanogaster
ttgttaaaagtttc

SEQ ID NO: 671642 - DNA, 13 bp, D. melanogaster
ttgttaaaatgtt

SEQ ID NO: 671643 - DNA, 13 bp, D. melanogaster
ttgttaaacaatt

SEQ ID NO: 671644 - DNA, 13 bp, D. melanogaster
ttgttaaacatat

SEQ ID NO: 671645 - DNA, 14 bp, D. melanogaster
ttgttaaacatatt

SEQ ID NO: 671646 - DNA, 13 bp, D. melanogaster
ttgttaaacatta

SEQ ID NO: 671647 - DNA, 14 bp, D. melanogaster
ttgttaaacattac

SEQ ID NO: 671648 - DNA, 13 bp, D. melanogaster
ttgttaaatagtt

SEQ ID NO: 671649 - DNA, 13 bp, D. melanogaster
ttgttaaatgatt

SEQ ID NO: 671650 - DNA, 13 bp, D. melanogaster
ttgttaaattaac

SEQ ID NO: 671651 - DNA, 13 bp, D. melanogaster
ttgttaacaaaaa

SEQ ID NO: 671652 - DNA, 13 bp, D. melanogaster
ttgttaacaaaat

SEQ ID NO: 671653 - DNA, 13 bp, D. melanogaster
ttgttaacaaatc

SEQ ID NO: 671654 - DNA, 13 bp, D. melanogaster
ttgttaacaactt

SEQ ID NO: 671655 - DNA, 13 bp, D. melanogaster
ttgttaacaattt

SEQ ID NO: 671656 - DNA, 13 bp, D. melanogaster
ttgttaacatatt

SEQ ID NO: 671657 - DNA, 13 bp, D. melanogaster
ttgttaacatttt

SEQ ID NO: 671658 - DNA, 14 bp, D. melanogaster
ttgttaacatttta

SEQ ID NO: 671659 - DNA, 13 bp, D. melanogaster
ttgttaaccaaaa

SEQ ID NO: 671660 - DNA, 13 bp, D. melanogaster
ttgttaacctttt

SEQ ID NO: 671661 - DNA, 13 bp, D. melanogaster
ttgttaactaatt

SEQ ID NO: 671662 - DNA, 13 bp, D. melanogaster
ttgttaagcattt

SEQ ID NO: 671663 - DNA, 13 bp, D. melanogaster
ttgttaagcgaaa

SEQ ID NO: 671664 - DNA, 13 bp, D. melanogaster
ttgttaagcttaa

SEQ ID NO: 671665 - DNA, 13 bp, D. melanogaster
ttgttaagcttta

SEQ ID NO: 671666 - DNA, 13 bp, D. melanogaster
ttgttaagttttc

SEQ ID NO: 671667 - DNA, 13 bp, D. melanogaster
ttgttaataactt

SEQ ID NO: 671668 - DNA, 13 bp, D. melanogaster
ttgttaatagtat

SEQ ID NO: 671669 - DNA, 13 bp, D. melanogaster
ttgttaatcattt

SEQ ID NO: 671670 - DNA, 13 bp, D. melanogaster
ttgttaatggaaa

SEQ ID NO: 671671 - DNA, 14 bp, D. melanogaster
ttgttaattaaatg

SEQ ID NO: 671672 - DNA, 13 bp, D. melanogaster
ttgttaattaact

SEQ ID NO: 671673 - DNA, 13 bp, D. melanogaster
ttgttaattaagt

SEQ ID NO: 671674 - DNA, 13 bp, D. melanogaster
ttgttaattgcat

SEQ ID NO: 671675 - DNA, 13 bp, D. melanogaster
ttgttaatttcta

SEQ ID NO: 671676 - DNA, 14 bp, D. melanogaster
ttgttaatttgaaa

SEQ ID NO: 671677 - DNA, 13 bp, D. melanogaster
ttgttaatttgac

SEQ ID NO: 671678 - DNA, 13 bp, D. melanogaster
ttgttaattttca

SEQ ID NO: 671679 - DNA, 13 bp, D. melanogaster
ttgttacaaattt

SEQ ID NO: 671680 - DNA, 13 bp, D. melanogaster
ttgttacaatgat

SEQ ID NO: 671681 - DNA, 13 bp, D. melanogaster
ttgttacatatat

SEQ ID NO: 671682 - DNA, 13 bp, D. melanogaster
ttgttagccagca

SEQ ID NO: 671683 - DNA, 13 bp, D. melanogaster
ttgttagtaaaaa

SEQ ID NO: 671684 - DNA, 13 bp, D. melanogaster
ttgttagttatct

SEQ ID NO: 671685 - DNA, 13 bp, D. melanogaster
ttgttagttctta

SEQ ID NO: 671686 - DNA, 13 bp, D. melanogaster
ttgttataaaatc

SEQ ID NO: 671687 - DNA, 13 bp, D. melanogaster
ttgttataaattg

SEQ ID NO: 671688 - DNA, 13 bp, D. melanogaster
ttgttatacattt

SEQ ID NO: 671689 - DNA, 13 bp, D. melanogaster
ttgttatacttaa

SEQ ID NO: 671690 - DNA, 13 bp, D. melanogaster
ttgttatagttaa

SEQ ID NO: 671691 - DNA, 13 bp, D. melanogaster
ttgttatcgataa

SEQ ID NO: 671692 - DNA, 13 bp, D. melanogaster
ttgttatcgattt

SEQ ID NO: 671693 - DNA, 14 bp, D. melanogaster
ttgttatcttaaat

SEQ ID NO: 671694 - DNA, 13 bp, D. melanogaster
ttgttatgcagtt

SEQ ID NO: 671695 - DNA, 13 bp, D. melanogaster
ttgttatgctaat

SEQ ID NO: 671696 - DNA, 13 bp, D. melanogaster
ttgttatggccac

SEQ ID NO: 671697 - DNA, 13 bp, D. melanogaster
ttgttatgtaaat

SEQ ID NO: 671698 - DNA, 13 bp, D. melanogaster
ttgttattaaaca

SEQ ID NO: 671699 - DNA, 13 bp, D. melanogaster
ttgttattaagaa

SEQ ID NO: 671700 - DNA, 14 bp, D. melanogaster
ttgttattaagaaa

SEQ ID NO: 671701 - DNA, 13 bp, D. melanogaster
ttgttattattgc

SEQ ID NO: 671702 - DNA, 14 bp, D. melanogaster
ttgttattattgct

SEQ ID NO: 671703 - DNA, 13 bp, D. melanogaster
ttgttattcaatt

SEQ ID NO: 671704 - DNA, 13 bp, D. melanogaster
ttgttattgctat

SEQ ID NO: 671705 - DNA, 14 bp, D. melanogaster
ttgttattgctgtt

SEQ ID NO: 671706 - DNA, 13 bp, D. melanogaster
ttgttattgctta

SEQ ID NO: 671707 - DNA, 13 bp, D. melanogaster
ttgttattgtcat

SEQ ID NO: 671708 - DNA, 14 bp, D. melanogaster
ttgttattgttgct

SEQ ID NO: 671709 - DNA, 13 bp, D. melanogaster
ttgttcaaaaatg

SEQ ID NO: 671710 - DNA, 14 bp, D. melanogaster
ttgttcaaatattt

SEQ ID NO: 671711 - DNA, 13 bp, D. melanogaster
ttgttcaaattta

SEQ ID NO: 671712 - DNA, 14 bp, D. melanogaster
ttgttcaaatttgt

SEQ ID NO: 671713 - DNA, 13 bp, D. melanogaster
ttgttcaaatttt

SEQ ID NO: 671714 - DNA, 13 bp, D. melanogaster
ttgttcaatattt

SEQ ID NO: 671715 - DNA, 13 bp, D. melanogaster
ttgttcaattatt

SEQ ID NO: 671716 - DNA, 13 bp, D. melanogaster
ttgttcaatttgt

SEQ ID NO: 671717 - DNA, 13 bp, D. melanogaster
ttgttcacaattt

SEQ ID NO: 671718 - DNA, 13 bp, D. melanogaster
ttgttcacattgt

SEQ ID NO: 671719 - DNA, 14 bp, D. melanogaster
ttgttcacattgtc

SEQ ID NO: 671720 - DNA, 13 bp, D. melanogaster
ttgttcagctttt

SEQ ID NO: 671721 - DNA, 13 bp, D. melanogaster
ttgttcagttgtt

SEQ ID NO: 671722 - DNA, 13 bp, D. melanogaster
ttgttcagttttc

SEQ ID NO: 671723 - DNA, 13 bp, D. melanogaster
ttgttcataaaat

SEQ ID NO: 671724 - DNA, 13 bp, D. melanogaster
ttgttcataattt

SEQ ID NO: 671725 - DNA, 13 bp, D. melanogaster
ttgttcattttaa

SEQ ID NO: 671726 - DNA, 13 bp, D. melanogaster
ttgttccaccatt

SEQ ID NO: 671727 - DNA, 13 bp, D. melanogaster
ttgttcgacttgt

SEQ ID NO: 671728 - DNA, 13 bp, D. melanogaster
ttgttcgatttta

SEQ ID NO: 671729 - DNA, 13 bp, D. melanogaster
ttgttcgccattt

SEQ ID NO: 671730 - DNA, 13 bp, D. melanogaster
ttgttcggtcgca

SEQ ID NO: 671731 - DNA, 14 bp, D. melanogaster
ttgttctaaatgct

SEQ ID NO: 671732 - DNA, 13 bp, D. melanogaster
ttgttctatctgc

SEQ ID NO: 671733 - DNA, 13 bp, D. melanogaster
ttgttctatggta

SEQ ID NO: 671734 - DNA, 13 bp, D. melanogaster
ttgttctctgtgc

SEQ ID NO: 671735 - DNA, 13 bp, D. melanogaster
ttgttctgcattt

SEQ ID NO: 671736 - DNA, 13 bp, D. melanogaster
ttgttcttgctgc

SEQ ID NO: 671737 - DNA, 13 bp, D. melanogaster
ttgttgaaaaaaa

SEQ ID NO: 671738 - DNA, 14 bp, D. melanogaster
ttgttgaaaagtat

SEQ ID NO: 671739 - DNA, 13 bp, D. melanogaster
ttgttgaaaatat

SEQ ID NO: 671740 - DNA, 13 bp, D. melanogaster
ttgttgaaattat

SEQ ID NO: 671741 - DNA, 13 bp, D. melanogaster
ttgttgaaattgt

SEQ ID NO: 671742 - DNA, 13 bp, D. melanogaster
ttgttgaacagca

SEQ ID NO: 671743 - DNA, 13 bp, D. melanogaster
ttgttgaacattt

SEQ ID NO: 671744 - DNA, 14 bp, D. melanogaster
ttgttgaacatttt

SEQ ID NO: 671745 - DNA, 13 bp, D. melanogaster
ttgttgaactttt

SEQ ID NO: 671746 - DNA, 13 bp, D. melanogaster
ttgttgaatatat

SEQ ID NO: 671747 - DNA, 13 bp, D. melanogaster
ttgttgaattcgt

SEQ ID NO: 671748 - DNA, 13 bp, D. melanogaster
ttgttgacaatga

SEQ ID NO: 671749 - DNA, 13 bp, D. melanogaster
ttgttgacatttt

SEQ ID NO: 671750 - DNA, 13 bp, D. melanogaster
ttgttgacttctc

SEQ ID NO: 671751 - DNA, 13 bp, D. melanogaster
ttgttgagcaatt

SEQ ID NO: 671752 - DNA, 13 bp, D. melanogaster
ttgttgagttgta

SEQ ID NO: 671753 - DNA, 13 bp, D. melanogaster
ttgttgatagttc

SEQ ID NO: 671754 - DNA, 13 bp, D. melanogaster
ttgttgatcctgt

SEQ ID NO: 671755 - DNA, 13 bp, D. melanogaster
ttgttgatgatga

SEQ ID NO: 671756 - DNA, 13 bp, D. melanogaster
ttgttgattcaat

SEQ ID NO: 671757 - DNA, 13 bp, D. melanogaster
ttgttgatttaac

SEQ ID NO: 671758 - DNA, 13 bp, D. melanogaster
ttgttgattttcg

SEQ ID NO: 671759 - DNA, 13 bp, D. melanogaster
ttgttgcaaaaaa

SEQ ID NO: 671760 - DNA, 13 bp, D. melanogaster
ttgttgcaaattt

SEQ ID NO: 671761 - DNA, 13 bp, D. melanogaster
ttgttgcaacatt

SEQ ID NO: 671762 - DNA, 13 bp, D. melanogaster
ttgttgcaactgc

SEQ ID NO: 671763 - DNA, 13 bp, D. melanogaster
ttgttgcaatatc

SEQ ID NO: 671764 - DNA, 13 bp, D. melanogaster
ttgttgcaattaa

SEQ ID NO: 671765 - DNA, 13 bp, D. melanogaster
ttgttgcacaaaa

SEQ ID NO: 671766 - DNA, 13 bp, D. melanogaster
ttgttgcacatgt

SEQ ID NO: 671767 - DNA, 13 bp, D. melanogaster
ttgttgcacttct

SEQ ID NO: 671768 - DNA, 14 bp, D. melanogaster
ttgttgcacttctc

SEQ ID NO: 671769 - DNA, 13 bp, D. melanogaster
ttgttgcatactt

SEQ ID NO: 671770 - DNA, 13 bp, D. melanogaster
ttgttgcatattt

SEQ ID NO: 671771 - DNA, 13 bp, D. melanogaster
ttgttgcatgtgt

SEQ ID NO: 671772 - DNA, 13 bp, D. melanogaster
ttgttgcatgttg

SEQ ID NO: 671773 - DNA, 13 bp, D. melanogaster
ttgttgcattaaa

SEQ ID NO: 671774 - DNA, 13 bp, D. melanogaster
ttgttgcattgct

SEQ ID NO: 671775 - DNA, 14 bp, D. melanogaster
ttgttgcatttgtt

SEQ ID NO: 671776 - DNA, 13 bp, D. melanogaster
ttgttgccaaaaa

SEQ ID NO: 671777 - DNA, 13 bp, D. melanogaster
ttgttgccaaaag

SEQ ID NO: 671778 - DNA, 13 bp, D. melanogaster
ttgttgccaaatt

SEQ ID NO: 671779 - DNA, 13 bp, D. melanogaster
ttgttgccaagtt

SEQ ID NO: 671780 - DNA, 13 bp, D. melanogaster
ttgttgccaattt

SEQ ID NO: 671781 - DNA, 13 bp, D. melanogaster
ttgttgccacact

SEQ ID NO: 671782 - DNA, 13 bp, D. melanogaster
ttgttgccactgc

SEQ ID NO: 671783 - DNA, 13 bp, D. melanogaster
ttgttgccactgt

SEQ ID NO: 671784 - DNA, 13 bp, D. melanogaster
ttgttgccacttc

SEQ ID NO: 671785 - DNA, 13 bp, D. melanogaster
ttgttgccacttt

SEQ ID NO: 671786 - DNA, 14 bp, D. melanogaster
ttgttgccattgct

SEQ ID NO: 671787 - DNA, 13 bp, D. melanogaster
ttgttgccatttc

SEQ ID NO: 671788 - DNA, 13 bp, D. melanogaster
ttgttgccgccgc

SEQ ID NO: 671789 - DNA, 14 bp, D. melanogaster
ttgttgccgccgct

SEQ ID NO: 671790 - DNA, 13 bp, D. melanogaster
ttgttgccgcctt

SEQ ID NO: 671791 - DNA, 14 bp, D. melanogaster
ttgttgccgctgcc

SEQ ID NO: 671792 - DNA, 14 bp, D. melanogaster
ttgttgccgctgtt

SEQ ID NO: 671793 - DNA, 13 bp, D. melanogaster
ttgttgccgcttt

SEQ ID NO: 671794 - DNA, 13 bp, D. melanogaster
ttgttgccgtctg

SEQ ID NO: 671795 - DNA, 13 bp, D. melanogaster
ttgttgccgttgt

SEQ ID NO: 671796 - DNA, 14 bp, D. melanogaster
ttgttgccgttgtc

SEQ ID NO: 671797 - DNA, 13 bp, D. melanogaster
ttgttgccgtttg

SEQ ID NO: 671798 - DNA, 13 bp, D. melanogaster
ttgttgcctgcca

SEQ ID NO: 671799 - DNA, 13 bp, D. melanogaster
ttgttgcctgcct

SEQ ID NO: 671800 - DNA, 13 bp, D. melanogaster
ttgttgcctttgc

SEQ ID NO: 671801 - DNA, 13 bp, D. melanogaster
ttgttgcgatttt

SEQ ID NO: 671802 - DNA, 13 bp, D. melanogaster
ttgttgcggtggc

SEQ ID NO: 671803 - DNA, 14 bp, D. melanogaster
ttgttgctactgct

SEQ ID NO: 671804 - DNA, 13 bp, D. melanogaster
ttgttgctattgt

SEQ ID NO: 671805 - DNA, 14 bp, D. melanogaster
ttgttgctattgtt

SEQ ID NO: 671806 - DNA, 13 bp, D. melanogaster
ttgttgctcattt

SEQ ID NO: 671807 - DNA, 13 bp, D. melanogaster
ttgttgctcctgc

SEQ ID NO: 671808 - DNA, 13 bp, D. melanogaster
ttgttgctcctgt

SEQ ID NO: 671809 - DNA, 13 bp, D. melanogaster
ttgttgctccttg

SEQ ID NO: 671810 - DNA, 13 bp, D. melanogaster
ttgttgctctgcc

SEQ ID NO: 671811 - DNA, 13 bp, D. melanogaster
ttgttgctctggc

SEQ ID NO: 671812 - DNA, 13 bp, D. melanogaster
ttgttgctcttgc

SEQ ID NO: 671813 - DNA, 13 bp, D. melanogaster
ttgttgctgatgc

SEQ ID NO: 671814 - DNA, 13 bp, D. melanogaster
ttgttgctgatgt

SEQ ID NO: 671815 - DNA, 13 bp, D. melanogaster
ttgttgctgcaaa

SEQ ID NO: 671816 - DNA, 13 bp, D. melanogaster
ttgttgctgcaac

SEQ ID NO: 671817 - DNA, 13 bp, D. melanogaster
ttgttgctgcagc

SEQ ID NO: 671818 - DNA, 14 bp, D. melanogaster
ttgttgctgcagtt

SEQ ID NO: 671819 - DNA, 13 bp, D. melanogaster
ttgttgctgcatg

SEQ ID NO: 671820 - DNA, 14 bp, D. melanogaster
ttgttgctgcattt

SEQ ID NO: 671821 - DNA, 13 bp, D. melanogaster
ttgttgctgccac

SEQ ID NO: 671822 - DNA, 13 bp, D. melanogaster
ttgttgctgccat

SEQ ID NO: 671823 - DNA, 13 bp, D. melanogaster
ttgttgctgcccc

SEQ ID NO: 671824 - DNA, 13 bp, D. melanogaster
ttgttgctgccgc

SEQ ID NO: 671825 - DNA, 13 bp, D. melanogaster
ttgttgctgccgg

SEQ ID NO: 671826 - DNA, 13 bp, D. melanogaster
ttgttgctgccgt

SEQ ID NO: 671827 - DNA, 14 bp, D. melanogaster
ttgttgctgccgtg

SEQ ID NO: 671828 - DNA, 13 bp, D. melanogaster
ttgttgctgcgaa

SEQ ID NO: 671829 - DNA, 13 bp, D. melanogaster
ttgttgctgcgcc

SEQ ID NO: 671830 - DNA, 13 bp, D. melanogaster
ttgttgctgcgct

SEQ ID NO: 671831 - DNA, 13 bp, D. melanogaster
ttgttgctgcggc

SEQ ID NO: 671832 - DNA, 13 bp, D. melanogaster
ttgttgctgctct

SEQ ID NO: 671833 - DNA, 13 bp, D. melanogaster
ttgttgctgctga

SEQ ID NO: 671834 - DNA, 14 bp, D. melanogaster
ttgttgctgctgcc

SEQ ID NO: 671835 - DNA, 14 bp, D. melanogaster
ttgttgctgctgtg

SEQ ID NO: 671836 - DNA, 16 bp, D. melanogaster
ttgttgctgctgttgc

SEQ ID NO: 671837 - DNA, 13 bp, D. melanogaster
ttgttgctggctg

SEQ ID NO: 671838 - DNA, 13 bp, D. melanogaster
ttgttgctgtgct

SEQ ID NO: 671839 - DNA, 14 bp, D. melanogaster
ttgttgctgtggct

SEQ ID NO: 671840 - DNA, 13 bp, D. melanogaster
ttgttgctgttcg

SEQ ID NO: 671841 - DNA, 13 bp, D. melanogaster
ttgttgcttaagt

SEQ ID NO: 671842 - DNA, 13 bp, D. melanogaster
ttgttggaatatt

SEQ ID NO: 671843 - DNA, 13 bp, D. melanogaster
ttgttggcaactt

SEQ ID NO: 671844 - DNA, 13 bp, D. melanogaster
ttgttggcagctg

SEQ ID NO: 671845 - DNA, 13 bp, D. melanogaster
ttgttggcattgt

SEQ ID NO: 671846 - DNA, 13 bp, D. melanogaster
ttgttggcatttt

SEQ ID NO: 671847 - DNA, 14 bp, D. melanogaster
ttgttggccaaaac

SEQ ID NO: 671848 - DNA, 13 bp, D. melanogaster
ttgttggccaaac

SEQ ID NO: 671849 - DNA, 13 bp, D. melanogaster
ttgttggccaact

SEQ ID NO: 671850 - DNA, 13 bp, D. melanogaster
ttgttggccaagt

SEQ ID NO: 671851 - DNA, 14 bp, D. melanogaster
ttgttggccaagtt

SEQ ID NO: 671852 - DNA, 13 bp, D. melanogaster
ttgttggccaatt

SEQ ID NO: 671853 - DNA, 13 bp, D. melanogaster
ttgttggccagaa

SEQ ID NO: 671854 - DNA, 13 bp, D. melanogaster
ttgttggccagct

SEQ ID NO: 671855 - DNA, 13 bp, D. melanogaster
ttgttggccaggc

SEQ ID NO: 671856 - DNA, 13 bp, D. melanogaster
ttgttggccagtt

SEQ ID NO: 671857 - DNA, 14 bp, D. melanogaster
ttgttggccataaa

SEQ ID NO: 671858 - DNA, 13 bp, D. melanogaster
ttgttggccattg

SEQ ID NO: 671859 - DNA, 13 bp, D. melanogaster
ttgttggccattt

SEQ ID NO: 671860 - DNA, 14 bp, D. melanogaster
ttgttggccatttt

SEQ ID NO: 671861 - DNA, 13 bp, D. melanogaster
ttgttggcccaaa

SEQ ID NO: 671862 - DNA, 13 bp, D. melanogaster
ttgttggctctgt

SEQ ID NO: 671863 - DNA, 13 bp, D. melanogaster
ttgttggctgtca

SEQ ID NO: 671864 - DNA, 13 bp, D. melanogaster
ttgttggctttat

SEQ ID NO: 671865 - DNA, 13 bp, D. melanogaster
ttgttggtgctgc

SEQ ID NO: 671866 - DNA, 13 bp, D. melanogaster
ttgttggttaaat

SEQ ID NO: 671867 - DNA, 13 bp, D. melanogaster
ttgttgtaaaaat

SEQ ID NO: 671868 - DNA, 13 bp, D. melanogaster
ttgttgtaaaata

SEQ ID NO: 671869 - DNA, 13 bp, D. melanogaster
ttgttgtaaacaa

SEQ ID NO: 671870 - DNA, 13 bp, D. melanogaster
ttgttgtaaatta

SEQ ID NO: 671871 - DNA, 13 bp, D. melanogaster
ttgttgtaatgca

SEQ ID NO: 671872 - DNA, 13 bp, D. melanogaster
ttgttgtaattgc

SEQ ID NO: 671873 - DNA, 13 bp, D. melanogaster
ttgttgtagctct

SEQ ID NO: 671874 - DNA, 13 bp, D. melanogaster
ttgttgtcaaaaa

SEQ ID NO: 671875 - DNA, 13 bp, D. melanogaster
ttgttgtccattt

SEQ ID NO: 671876 - DNA, 13 bp, D. melanogaster
ttgttgtcctgcc

SEQ ID NO: 671877 - DNA, 13 bp, D. melanogaster
ttgttgtcgccgc

SEQ ID NO: 671878 - DNA, 13 bp, D. melanogaster
ttgttgtcgctgc

SEQ ID NO: 671879 - DNA, 13 bp, D. melanogaster
ttgttgtcgtcgc

SEQ ID NO: 671880 - DNA, 13 bp, D. melanogaster
ttgttgtcgttgc

SEQ ID NO: 671881 - DNA, 13 bp, D. melanogaster
ttgttgtgatttc

SEQ ID NO: 671882 - DNA, 13 bp, D. melanogaster
ttgttgtgcaaat

SEQ ID NO: 671883 - DNA, 13 bp, D. melanogaster
ttgttgtgcatat

SEQ ID NO: 671884 - DNA, 13 bp, D. melanogaster
ttgttgtgcattt

SEQ ID NO: 671885 - DNA, 13 bp, D. melanogaster
ttgttgtggaaaa

SEQ ID NO: 671886 - DNA, 13 bp, D. melanogaster
ttgttgtggctgc

SEQ ID NO: 671887 - DNA, 13 bp, D. melanogaster
ttgttgttaaata

SEQ ID NO: 671888 - DNA, 14 bp, D. melanogaster
ttgttgttactgtt

SEQ ID NO: 671889 - DNA, 13 bp, D. melanogaster
ttgttgttagctg

SEQ ID NO: 671890 - DNA, 13 bp, D. melanogaster
ttgttgttatggc

SEQ ID NO: 671891 - DNA, 13 bp, D. melanogaster
ttgttgttattca

SEQ ID NO: 671892 - DNA, 13 bp, D. melanogaster
ttgttgttattgc

SEQ ID NO: 671893 - DNA, 14 bp, D. melanogaster
ttgttgttcaaaca

SEQ ID NO: 671894 - DNA, 13 bp, D. melanogaster
ttgttgttcagtt

SEQ ID NO: 671895 - DNA, 13 bp, D. melanogaster
ttgttgttcctgc

SEQ ID NO: 671896 - DNA, 14 bp, D. melanogaster
ttgttgttcctgct

SEQ ID NO: 671897 - DNA, 14 bp, D. melanogaster
ttgttgttcttgcc

SEQ ID NO: 671898 - DNA, 14 bp, D. melanogaster
ttgttgttgatctt

SEQ ID NO: 671899 - DNA, 14 bp, D. melanogaster
ttgttgttgcaaac

SEQ ID NO: 671900 - DNA, 14 bp, D. melanogaster
ttgttgttgcagtt

SEQ ID NO: 671901 - DNA, 14 bp, D. melanogaster
ttgttgttgcattt

SEQ ID NO: 671902 - DNA, 13 bp, D. melanogaster
ttgttgttgccat

SEQ ID NO: 671903 - DNA, 14 bp, D. melanogaster
ttgttgttgccatt

SEQ ID NO: 671904 - DNA, 13 bp, D. melanogaster
ttgttgttgcccc

SEQ ID NO: 671905 - DNA, 13 bp, D. melanogaster
ttgttgttgccgc

SEQ ID NO: 671906 - DNA, 13 bp, D. melanogaster
ttgttgttgccgt

SEQ ID NO: 671907 - DNA, 13 bp, D. melanogaster
ttgttgttgcctg

SEQ ID NO: 671908 - DNA, 13 bp, D. melanogaster
ttgttgttgcgcc

SEQ ID NO: 671909 - DNA, 13 bp, D. melanogaster
ttgttgttgcgct

SEQ ID NO: 671910 - DNA, 13 bp, D. melanogaster
ttgttgttgctaa

SEQ ID NO: 671911 - DNA, 13 bp, D. melanogaster
ttgttgttgctac

SEQ ID NO: 671912 - DNA, 14 bp, D. melanogaster
ttgttgttgctact

SEQ ID NO: 671913 - DNA, 13 bp, D. melanogaster
ttgttgttgctga

SEQ ID NO: 671914 - DNA, 14 bp, D. melanogaster
ttgttgttgctgcc

SEQ ID NO: 671915 - DNA, 14 bp, D. melanogaster
ttgttgttgctgcg

SEQ ID NO: 671916 - DNA, 14 bp, D. melanogaster
ttgttgttgctggc

SEQ ID NO: 671917 - DNA, 13 bp, D. melanogaster
ttgttgttggcca

SEQ ID NO: 671918 - DNA, 14 bp, D. melanogaster
ttgttgttggccaa

SEQ ID NO: 671919 - DNA, 14 bp, D. melanogaster
ttgttgttgtagct

SEQ ID NO: 671920 - DNA, 13 bp, D. melanogaster
ttgttgttgtcat

SEQ ID NO: 671921 - DNA, 13 bp, D. melanogaster
ttgttgttgtcgc

SEQ ID NO: 671922 - DNA, 13 bp, D. melanogaster
ttgttgtttaaca

SEQ ID NO: 671923 - DNA, 13 bp, D. melanogaster
ttgttgttttcaa

SEQ ID NO: 671924 - DNA, 13 bp, D. melanogaster
ttgttgttttcca

SEQ ID NO: 671925 - DNA, 13 bp, D. melanogaster
ttgttgttttcga

SEQ ID NO: 671926 - DNA, 13 bp, D. melanogaster
ttgtttaaaaaag

SEQ ID NO: 671927 - DNA, 13 bp, D. melanogaster
ttgtttaaaaaga

SEQ ID NO: 671928 - DNA, 13 bp, D. melanogaster
ttgtttaaaaatc

SEQ ID NO: 671929 - DNA, 14 bp, D. melanogaster
ttgtttaaaaatcg

SEQ ID NO: 671930 - DNA, 14 bp, D. melanogaster
ttgtttaaaaattg

SEQ ID NO: 671931 - DNA, 14 bp, D. melanogaster
ttgtttaaaaggaa

SEQ ID NO: 671932 - DNA, 13 bp, D. melanogaster
ttgtttaaaagtg

SEQ ID NO: 671933 - DNA, 13 bp, D. melanogaster
ttgtttaaaagtt

SEQ ID NO: 671934 - DNA, 13 bp, D. melanogaster
ttgtttaaacaaa

SEQ ID NO: 671935 - DNA, 14 bp, D. melanogaster
ttgtttaaacaaat

SEQ ID NO: 671936 - DNA, 13 bp, D. melanogaster
ttgtttaaacaat

SEQ ID NO: 671937 - DNA, 14 bp, D. melanogaster
ttgtttaaacattt

SEQ ID NO: 671938 - DNA, 13 bp, D. melanogaster
ttgtttaaacttt

SEQ ID NO: 671939 - DNA, 13 bp, D. melanogaster
ttgtttaaagaag

SEQ ID NO: 671940 - DNA, 13 bp, D. melanogaster
ttgtttaaagcca

SEQ ID NO: 671941 - DNA, 13 bp, D. melanogaster
ttgtttaaattac

SEQ ID NO: 671942 - DNA, 13 bp, D. melanogaster
ttgtttaacaaat

SEQ ID NO: 671943 - DNA, 13 bp, D. melanogaster
ttgtttaacatac

SEQ ID NO: 671944 - DNA, 13 bp, D. melanogaster
ttgtttaacattt

SEQ ID NO: 671945 - DNA, 13 bp, D. melanogaster
ttgtttaactatt

SEQ ID NO: 671946 - DNA, 13 bp, D. melanogaster
ttgtttaagccaa

SEQ ID NO: 671947 - DNA, 13 bp, D. melanogaster
ttgtttaatggaa

SEQ ID NO: 671948 - DNA, 13 bp, D. melanogaster
ttgtttaattgaa

SEQ ID NO: 671949 - DNA, 13 bp, D. melanogaster
ttgtttacaaaaa

SEQ ID NO: 671950 - DNA, 13 bp, D. melanogaster
ttgtttacaagaa

SEQ ID NO: 671951 - DNA, 14 bp, D. melanogaster
ttgtttacaagaat

SEQ ID NO: 671952 - DNA, 13 bp, D. melanogaster
ttgtttacaagct

SEQ ID NO: 671953 - DNA, 13 bp, D. melanogaster
ttgtttacaattc

SEQ ID NO: 671954 - DNA, 13 bp, D. melanogaster
ttgtttacaattt

SEQ ID NO: 671955 - DNA, 14 bp, D. melanogaster
ttgtttacaatttg

SEQ ID NO: 671956 - DNA, 13 bp, D. melanogaster
ttgtttacacaca

SEQ ID NO: 671957 - DNA, 13 bp, D. melanogaster
ttgtttacagttt

SEQ ID NO: 671958 - DNA, 13 bp, D. melanogaster
ttgtttacattat

SEQ ID NO: 671959 - DNA, 13 bp, D. melanogaster
ttgtttacatttg

SEQ ID NO: 671960 - DNA, 14 bp, D. melanogaster
ttgtttacatttta

SEQ ID NO: 671961 - DNA, 14 bp, D. melanogaster
ttgtttacattttg

SEQ ID NO: 671962 - DNA, 13 bp, D. melanogaster
ttgtttaccaaca

SEQ ID NO: 671963 - DNA, 13 bp, D. melanogaster
ttgtttaccaact

SEQ ID NO: 671964 - DNA, 13 bp, D. melanogaster
ttgtttaccattt

SEQ ID NO: 671965 - DNA, 13 bp, D. melanogaster
ttgtttacccaac

SEQ ID NO: 671966 - DNA, 13 bp, D. melanogaster
ttgtttacccttt

SEQ ID NO: 671967 - DNA, 13 bp, D. melanogaster
ttgtttacctttg

SEQ ID NO: 671968 - DNA, 13 bp, D. melanogaster
ttgtttacgttta

SEQ ID NO: 671969 - DNA, 13 bp, D. melanogaster
ttgtttactctgc

SEQ ID NO: 671970 - DNA, 13 bp, D. melanogaster
ttgtttactttac

SEQ ID NO: 671971 - DNA, 13 bp, D. melanogaster
ttgtttactttgc

SEQ ID NO: 671972 - DNA, 13 bp, D. melanogaster
ttgtttagcattt

SEQ ID NO: 671973 - DNA, 13 bp, D. melanogaster
ttgtttagccagc

SEQ ID NO: 671974 - DNA, 13 bp, D. melanogaster
ttgtttataaaac

SEQ ID NO: 671975 - DNA, 13 bp, D. melanogaster
ttgtttataaagt

SEQ ID NO: 671976 - DNA, 13 bp, D. melanogaster
ttgtttataagaa

SEQ ID NO: 671977 - DNA, 14 bp, D. melanogaster
ttgtttataattgc

SEQ ID NO: 671978 - DNA, 13 bp, D. melanogaster
ttgtttatacaat

SEQ ID NO: 671979 - DNA, 13 bp, D. melanogaster
ttgtttatacctt

SEQ ID NO: 671980 - DNA, 13 bp, D. melanogaster
ttgtttatatcaa

SEQ ID NO: 671981 - DNA, 13 bp, D. melanogaster
ttgtttatgaaaa

SEQ ID NO: 671982 - DNA, 13 bp, D. melanogaster
ttgtttatgcaaa

SEQ ID NO: 671983 - DNA, 14 bp, D. melanogaster
ttgtttatgcattt

SEQ ID NO: 671984 - DNA, 13 bp, D. melanogaster
ttgtttatgccaa

SEQ ID NO: 671985 - DNA, 13 bp, D. melanogaster
ttgtttatggaaa

SEQ ID NO: 671986 - DNA, 13 bp, D. melanogaster
ttgtttatggcca

SEQ ID NO: 671987 - DNA, 13 bp, D. melanogaster
ttgtttatgtcaa

SEQ ID NO: 671988 - DNA, 13 bp, D. melanogaster
ttgtttattatac

SEQ ID NO: 671989 - DNA, 13 bp, D. melanogaster
ttgtttattcaaa

SEQ ID NO: 671990 - DNA, 13 bp, D. melanogaster
ttgtttattctaa

SEQ ID NO: 671991 - DNA, 13 bp, D. melanogaster
ttgtttatttaca

SEQ ID NO: 671992 - DNA, 13 bp, D. melanogaster
ttgtttatttacc

SEQ ID NO: 671993 - DNA, 14 bp, D. melanogaster
ttgtttatttgcat

SEQ ID NO: 671994 - DNA, 13 bp, D. melanogaster
ttgtttatttgcc

SEQ ID NO: 671995 - DNA, 13 bp, D. melanogaster
ttgtttatttgcg

SEQ ID NO: 671996 - DNA, 13 bp, D. melanogaster
ttgtttcaatgaa

SEQ ID NO: 671997 - DNA, 13 bp, D. melanogaster
ttgtttcaatttc

SEQ ID NO: 671998 - DNA, 13 bp, D. melanogaster
ttgtttcacattt

SEQ ID NO: 671999 - DNA, 13 bp, D. melanogaster
ttgtttcagagcg

SEQ ID NO: 672000 - DNA, 13 bp, D. melanogaster
ttgtttcatttca

SEQ ID NO: 672001 - DNA, 13 bp, D. melanogaster
ttgtttccacttt

SEQ ID NO: 672002 - DNA, 14 bp, D. melanogaster
ttgtttccagtgca

SEQ ID NO: 672003 - DNA, 13 bp, D. melanogaster
ttgtttcccaaaa

SEQ ID NO: 672004 - DNA, 13 bp, D. melanogaster
ttgtttcctaaag

SEQ ID NO: 672005 - DNA, 14 bp, D. melanogaster
ttgtttcctaaagg

SEQ ID NO: 672006 - DNA, 13 bp, D. melanogaster
ttgtttcctgctg

SEQ ID NO: 672007 - DNA, 14 bp, D. melanogaster
ttgtttcctgctgc

SEQ ID NO: 672008 - DNA, 13 bp, D. melanogaster
ttgtttccttcgg

SEQ ID NO: 672009 - DNA, 13 bp, D. melanogaster
ttgtttcgaattt

SEQ ID NO: 672010 - DNA, 13 bp, D. melanogaster
ttgtttcgagtgc

SEQ ID NO: 672011 - DNA, 13 bp, D. melanogaster
ttgtttcgagtgt

SEQ ID NO: 672012 - DNA, 13 bp, D. melanogaster
ttgtttcgagttt

SEQ ID NO: 672013 - DNA, 13 bp, D. melanogaster
ttgtttcggaaaa

SEQ ID NO: 672014 - DNA, 13 bp, D. melanogaster
ttgtttcgtaatt

SEQ ID NO: 672015 - DNA, 13 bp, D. melanogaster
ttgtttctgcatt

SEQ ID NO: 672016 - DNA, 14 bp, D. melanogaster
ttgtttctttgaat

SEQ ID NO: 672017 - DNA, 13 bp, D. melanogaster
ttgtttgaaaaaa

SEQ ID NO: 672018 - DNA, 13 bp, D. melanogaster
ttgtttgaaaaga

SEQ ID NO: 672019 - DNA, 13 bp, D. melanogaster
ttgtttgaacttt

SEQ ID NO: 672020 - DNA, 13 bp, D. melanogaster
ttgtttgaattaa

SEQ ID NO: 672021 - DNA, 13 bp, D. melanogaster
ttgtttgagagca

SEQ ID NO: 672022 - DNA, 13 bp, D. melanogaster
ttgtttgataaaa

SEQ ID NO: 672023 - DNA, 13 bp, D. melanogaster
ttgtttgatatac

SEQ ID NO: 672024 - DNA, 13 bp, D. melanogaster
ttgtttgcaaaaa

SEQ ID NO: 672025 - DNA, 13 bp, D. melanogaster
ttgtttgcacata

SEQ ID NO: 672026 - DNA, 13 bp, D. melanogaster
ttgtttgcagtgc

SEQ ID NO: 672027 - DNA, 13 bp, D. melanogaster
ttgtttgcagttt

SEQ ID NO: 672028 - DNA, 13 bp, D. melanogaster
ttgtttgcattga

SEQ ID NO: 672029 - DNA, 13 bp, D. melanogaster
ttgtttgcattgc

SEQ ID NO: 672030 - DNA, 13 bp, D. melanogaster
ttgtttgcatttc

SEQ ID NO: 672031 - DNA, 13 bp, D. melanogaster
ttgtttgcatttg

SEQ ID NO: 672032 - DNA, 13 bp, D. melanogaster
ttgtttgccaagc

SEQ ID NO: 672033 - DNA, 13 bp, D. melanogaster
ttgtttgccaatg

SEQ ID NO: 672034 - DNA, 13 bp, D. melanogaster
ttgtttgccaatt

SEQ ID NO: 672035 - DNA, 14 bp, D. melanogaster
ttgtttgccaattt

SEQ ID NO: 672036 - DNA, 13 bp, D. melanogaster
ttgtttgccatct

SEQ ID NO: 672037 - DNA, 13 bp, D. melanogaster
ttgtttgccattg

SEQ ID NO: 672038 - DNA, 14 bp, D. melanogaster
ttgtttgccattgt

SEQ ID NO: 672039 - DNA, 13 bp, D. melanogaster
ttgtttgccattt

SEQ ID NO: 672040 - DNA, 14 bp, D. melanogaster
ttgtttgccatttc

SEQ ID NO: 672041 - DNA, 14 bp, D. melanogaster
ttgtttgccatttg

SEQ ID NO: 672042 - DNA, 14 bp, D. melanogaster
ttgtttgcccagca

SEQ ID NO: 672043 - DNA, 13 bp, D. melanogaster
ttgtttgcccgcc

SEQ ID NO: 672044 - DNA, 13 bp, D. melanogaster
ttgtttgccgctg

SEQ ID NO: 672045 - DNA, 13 bp, D. melanogaster
ttgtttgccggca

SEQ ID NO: 672046 - DNA, 13 bp, D. melanogaster
ttgtttgcctaaa

SEQ ID NO: 672047 - DNA, 13 bp, D. melanogaster
ttgtttgcctggc

SEQ ID NO: 672048 - DNA, 13 bp, D. melanogaster
ttgtttgccttta

SEQ ID NO: 672049 - DNA, 13 bp, D. melanogaster
ttgtttgcgaaat

SEQ ID NO: 672050 - DNA, 13 bp, D. melanogaster
ttgtttgcgattt

SEQ ID NO: 672051 - DNA, 13 bp, D. melanogaster
ttgtttgcgtggc

SEQ ID NO: 672052 - DNA, 13 bp, D. melanogaster
ttgtttgctaaaa

SEQ ID NO: 672053 - DNA, 13 bp, D. melanogaster
ttgtttgctaatt

SEQ ID NO: 672054 - DNA, 13 bp, D. melanogaster
ttgtttgctatgc

SEQ ID NO: 672055 - DNA, 13 bp, D. melanogaster
ttgtttgctctcc

SEQ ID NO: 672056 - DNA, 13 bp, D. melanogaster
ttgtttgctgaaa

SEQ ID NO: 672057 - DNA, 13 bp, D. melanogaster
ttgtttgctggcc

SEQ ID NO: 672058 - DNA, 13 bp, D. melanogaster
ttgtttgctggct

SEQ ID NO: 672059 - DNA, 13 bp, D. melanogaster
ttgtttgcttaaa

SEQ ID NO: 672060 - DNA, 13 bp, D. melanogaster
ttgtttgcttagc

SEQ ID NO: 672061 - DNA, 13 bp, D. melanogaster
ttgtttgctttaa

SEQ ID NO: 672062 - DNA, 13 bp, D. melanogaster
ttgtttggcaaaa

SEQ ID NO: 672063 - DNA, 13 bp, D. melanogaster
ttgtttggcaaat

SEQ ID NO: 672064 - DNA, 13 bp, D. melanogaster
ttgtttggcattt

SEQ ID NO: 672065 - DNA, 14 bp, D. melanogaster
ttgtttggcatttg

SEQ ID NO: 672066 - DNA, 14 bp, D. melanogaster
ttgtttggccaaaa

SEQ ID NO: 672067 - DNA, 13 bp, D. melanogaster
ttgtttggccaac

SEQ ID NO: 672068 - DNA, 13 bp, D. melanogaster
ttgtttggccaag

SEQ ID NO: 672069 - DNA, 13 bp, D. melanogaster
ttgtttggccagc

SEQ ID NO: 672070 - DNA, 13 bp, D. melanogaster
ttgtttggcctgt

SEQ ID NO: 672071 - DNA, 13 bp, D. melanogaster
ttgtttggctaat

SEQ ID NO: 672072 - DNA, 13 bp, D. melanogaster
ttgtttggctgcc

SEQ ID NO: 672073 - DNA, 13 bp, D. melanogaster
ttgtttggctggc

SEQ ID NO: 672074 - DNA, 13 bp, D. melanogaster
ttgtttggcttcg

SEQ ID NO: 672075 - DNA, 13 bp, D. melanogaster
ttgtttggtaaat

SEQ ID NO: 672076 - DNA, 13 bp, D. melanogaster
ttgtttgtaaaat

SEQ ID NO: 672077 - DNA, 13 bp, D. melanogaster
ttgtttgtaaact

SEQ ID NO: 672078 - DNA, 14 bp, D. melanogaster
ttgtttgtaaataa

SEQ ID NO: 672079 - DNA, 13 bp, D. melanogaster
ttgtttgtacaaa

SEQ ID NO: 672080 - DNA, 13 bp, D. melanogaster
ttgtttgtcctgc

SEQ ID NO: 672081 - DNA, 13 bp, D. melanogaster
ttgtttgtgaaat

SEQ ID NO: 672082 - DNA, 13 bp, D. melanogaster
ttgtttgtgcccc

SEQ ID NO: 672083 - DNA, 13 bp, D. melanogaster
ttgtttgtggcca

SEQ ID NO: 672084 - DNA, 13 bp, D. melanogaster
ttgtttgtgtgca

SEQ ID NO: 672085 - DNA, 13 bp, D. melanogaster
ttgtttgttaaaa

SEQ ID NO: 672086 - DNA, 13 bp, D. melanogaster
ttgtttgttgcaa

SEQ ID NO: 672087 - DNA, 13 bp, D. melanogaster
ttgtttgttgcca

SEQ ID NO: 672088 - DNA, 13 bp, D. melanogaster
ttgtttgttggcc

SEQ ID NO: 672089 - DNA, 13 bp, D. melanogaster
ttgtttgttgtca

SEQ ID NO: 672090 - DNA, 13 bp, D. melanogaster
ttgtttgtttaac

SEQ ID NO: 672091 - DNA, 13 bp, D. melanogaster
ttgtttgtttacc

SEQ ID NO: 672092 - DNA, 14 bp, D. melanogaster
ttgtttgtttacca

SEQ ID NO: 672093 - DNA, 14 bp, D. melanogaster
ttgtttgtttgcca

SEQ ID NO: 672094 - DNA, 13 bp, D. melanogaster
ttgttttaaaaca

SEQ ID NO: 672095 - DNA, 14 bp, D. melanogaster
ttgttttaaaacat

SEQ ID NO: 672096 - DNA, 13 bp, D. melanogaster
ttgttttaaacaa

SEQ ID NO: 672097 - DNA, 13 bp, D. melanogaster
ttgttttaacaaa

SEQ ID NO: 672098 - DNA, 13 bp, D. melanogaster
ttgttttaatcaa

SEQ ID NO: 672099 - DNA, 13 bp, D. melanogaster
ttgttttaatgaa

SEQ ID NO: 672100 - DNA, 14 bp, D. melanogaster
ttgttttaattgca

SEQ ID NO: 672101 - DNA, 14 bp, D. melanogaster
ttgttttaatttgc

SEQ ID NO: 672102 - DNA, 13 bp, D. melanogaster
ttgttttagccaa

SEQ ID NO: 672103 - DNA, 13 bp, D. melanogaster
ttgttttatatac

SEQ ID NO: 672104 - DNA, 13 bp, D. melanogaster
ttgttttattcaa

SEQ ID NO: 672105 - DNA, 13 bp, D. melanogaster
ttgttttcaaatt

SEQ ID NO: 672106 - DNA, 13 bp, D. melanogaster
ttgttttcaatga

SEQ ID NO: 672107 - DNA, 13 bp, D. melanogaster
ttgttttcacaaa

SEQ ID NO: 672108 - DNA, 13 bp, D. melanogaster
ttgttttcagtgc

SEQ ID NO: 672109 - DNA, 14 bp, D. melanogaster
ttgttttcagtgca

SEQ ID NO: 672110 - DNA, 13 bp, D. melanogaster
ttgttttcattaa

SEQ ID NO: 672111 - DNA, 14 bp, D. melanogaster
ttgttttcatttca

SEQ ID NO: 672112 - DNA, 13 bp, D. melanogaster
ttgttttccaaat

SEQ ID NO: 672113 - DNA, 13 bp, D. melanogaster
ttgttttccattc

SEQ ID NO: 672114 - DNA, 13 bp, D. melanogaster
ttgttttcccagc

SEQ ID NO: 672115 - DNA, 13 bp, D. melanogaster
ttgttttcgattc

SEQ ID NO: 672116 - DNA, 13 bp, D. melanogaster
ttgttttcgcaaa

SEQ ID NO: 672117 - DNA, 13 bp, D. melanogaster
ttgttttcggcca

SEQ ID NO: 672118 - DNA, 13 bp, D. melanogaster
ttgttttctaaac

SEQ ID NO: 672119 - DNA, 13 bp, D. melanogaster
ttgttttctgaat

SEQ ID NO: 672120 - DNA, 14 bp, D. melanogaster
ttgttttctgtgca

SEQ ID NO: 672121 - DNA, 14 bp, D. melanogaster
ttgttttctgtgta

SEQ ID NO: 672122 - DNA, 13 bp, D. melanogaster
ttgttttgaattc

SEQ ID NO: 672123 - DNA, 13 bp, D. melanogaster
ttgttttgacatt

SEQ ID NO: 672124 - DNA, 13 bp, D. melanogaster
ttgttttgactta

SEQ ID NO: 672125 - DNA, 13 bp, D. melanogaster
ttgttttgcaaaa

SEQ ID NO: 672126 - DNA, 13 bp, D. melanogaster
ttgttttgcaaat

SEQ ID NO: 672127 - DNA, 13 bp, D. melanogaster
ttgttttgcaact

SEQ ID NO: 672128 - DNA, 13 bp, D. melanogaster
ttgttttgcacaa

SEQ ID NO: 672129 - DNA, 13 bp, D. melanogaster
ttgttttgcagct

SEQ ID NO: 672130 - DNA, 14 bp, D. melanogaster
ttgttttgcatttc

SEQ ID NO: 672131 - DNA, 14 bp, D. melanogaster
ttgttttgccaatt

SEQ ID NO: 672132 - DNA, 13 bp, D. melanogaster
ttgttttgccagc

SEQ ID NO: 672133 - DNA, 13 bp, D. melanogaster
ttgttttgccatt

SEQ ID NO: 672134 - DNA, 13 bp, D. melanogaster
ttgttttgctaaa

SEQ ID NO: 672135 - DNA, 13 bp, D. melanogaster
ttgttttgctcca

SEQ ID NO: 672136 - DNA, 13 bp, D. melanogaster
ttgttttgctgat

SEQ ID NO: 672137 - DNA, 13 bp, D. melanogaster
ttgttttggcaaa

SEQ ID NO: 672138 - DNA, 13 bp, D. melanogaster
ttgttttggcagc

SEQ ID NO: 672139 - DNA, 13 bp, D. melanogaster
ttgttttggccgc

SEQ ID NO: 672140 - DNA, 13 bp, D. melanogaster
ttgttttggctaa

SEQ ID NO: 672141 - DNA, 13 bp, D. melanogaster
ttgttttggctga

SEQ ID NO: 672142 - DNA, 13 bp, D. melanogaster
ttgttttgggaaa

SEQ ID NO: 672143 - DNA, 14 bp, D. melanogaster
ttgttttgggcatt

SEQ ID NO: 672144 - DNA, 13 bp, D. melanogaster
ttgttttgggcca

SEQ ID NO: 672145 - DNA, 13 bp, D. melanogaster
ttgttttggtcat

SEQ ID NO: 672146 - DNA, 13 bp, D. melanogaster
ttgttttggttca

SEQ ID NO: 672147 - DNA, 14 bp, D. melanogaster
ttgttttgtttgca

SEQ ID NO: 672148 - DNA, 14 bp, D. melanogaster
ttgtttttaattgc

SEQ ID NO: 672149 - DNA, 13 bp, D. melanogaster
ttgtttttactgc

SEQ ID NO: 672150 - DNA, 13 bp, D. melanogaster
ttgtttttagcca

SEQ ID NO: 672151 - DNA, 13 bp, D. melanogaster
ttgtttttagccc

SEQ ID NO: 672152 - DNA, 13 bp, D. melanogaster
ttgtttttcaact

SEQ ID NO: 672153 - DNA, 13 bp, D. melanogaster
ttgtttttcagct

SEQ ID NO: 672154 - DNA, 13 bp, D. melanogaster
ttgtttttccaca

SEQ ID NO: 672155 - DNA, 13 bp, D. melanogaster
ttgtttttccacc

SEQ ID NO: 672156 - DNA, 13 bp, D. melanogaster
ttgtttttcccag

SEQ ID NO: 672157 - DNA, 13 bp, D. melanogaster
ttgtttttcgcaa

SEQ ID NO: 672158 - DNA, 13 bp, D. melanogaster
ttgtttttgcaat

SEQ ID NO: 672159 - DNA, 13 bp, D. melanogaster
ttgtttttgccaa

SEQ ID NO: 672160 - DNA, 13 bp, D. melanogaster
ttgtttttgcccg

SEQ ID NO: 672161 - DNA, 13 bp, D. melanogaster
ttgtttttggaaa

SEQ ID NO: 672162 - DNA, 13 bp, D. melanogaster
ttgtttttgtaca

SEQ ID NO: 672163 - DNA, 13 bp, D. melanogaster
ttgttttttacaa

SEQ ID NO: 672164 - DNA, 13 bp, D. melanogaster
tttaaaaaacctt

SEQ ID NO: 672165 - DNA, 14 bp, D. melanogaster
tttaaaaaaccttt

SEQ ID NO: 672166 - DNA, 13 bp, D. melanogaster
tttaaaaaactgt

SEQ ID NO: 672167 - DNA, 13 bp, D. melanogaster
tttaaaaaatctg

SEQ ID NO: 672168 - DNA, 13 bp, D. melanogaster
tttaaaaaatgtg

SEQ ID NO: 672169 - DNA, 13 bp, D. melanogaster
tttaaaaacaatc

SEQ ID NO: 672170 - DNA, 13 bp, D. melanogaster
tttaaaaacactt

SEQ ID NO: 672171 - DNA, 13 bp, D. melanogaster
tttaaaaacagct

SEQ ID NO: 672172 - DNA, 13 bp, D. melanogaster
tttaaaaacatct

SEQ ID NO: 672173 - DNA, 13 bp, D. melanogaster
tttaaaaacattc

SEQ ID NO: 672174 - DNA, 13 bp, D. melanogaster
tttaaaaaccctt

SEQ ID NO: 672175 - DNA, 13 bp, D. melanogaster
tttaaaaaccttt

SEQ ID NO: 672176 - DNA, 13 bp, D. melanogaster
tttaaaaacgaaa

SEQ ID NO: 672177 - DNA, 13 bp, D. melanogaster
tttaaaaacgaat

SEQ ID NO: 672178 - DNA, 13 bp, D. melanogaster
tttaaaaacgagt

SEQ ID NO: 672179 - DNA, 13 bp, D. melanogaster
tttaaaaacgctt

SEQ ID NO: 672180 - DNA, 13 bp, D. melanogaster
tttaaaaacgtat

SEQ ID NO: 672181 - DNA, 13 bp, D. melanogaster
tttaaaaactatg

SEQ ID NO: 672182 - DNA, 13 bp, D. melanogaster
tttaaaaactcaa

SEQ ID NO: 672183 - DNA, 13 bp, D. melanogaster
tttaaaaactctt

SEQ ID NO: 672184 - DNA, 13 bp, D. melanogaster
tttaaaaactgaa

SEQ ID NO: 672185 - DNA, 13 bp, D. melanogaster
tttaaaaactttc

SEQ ID NO: 672186 - DNA, 14 bp, D. melanogaster
tttaaaaagaaagc

SEQ ID NO: 672187 - DNA, 13 bp, D. melanogaster
tttaaaaagcatt

SEQ ID NO: 672188 - DNA, 13 bp, D. melanogaster
tttaaaaagcttt

SEQ ID NO: 672189 - DNA, 13 bp, D. melanogaster
tttaaaaaggatt

SEQ ID NO: 672190 - DNA, 14 bp, D. melanogaster
tttaaaaagtgttt

SEQ ID NO: 672191 - DNA, 13 bp, D. melanogaster
tttaaaaagttct

SEQ ID NO: 672192 - DNA, 13 bp, D. melanogaster
tttaaaaagtttg

SEQ ID NO: 672193 - DNA, 14 bp, D. melanogaster
tttaaaaagtttgt

SEQ ID NO: 672194 - DNA, 13 bp, D. melanogaster
tttaaaaatagcc

SEQ ID NO: 672195 - DNA, 13 bp, D. melanogaster
tttaaaaatcaca

SEQ ID NO: 672196 - DNA, 13 bp, D. melanogaster
tttaaaaatcact

SEQ ID NO: 672197 - DNA, 14 bp, D. melanogaster
tttaaaaatccatt

SEQ ID NO: 672198 - DNA, 13 bp, D. melanogaster
tttaaaaatcgat

SEQ ID NO: 672199 - DNA, 13 bp, D. melanogaster
tttaaaaatgcaa

SEQ ID NO: 672200 - DNA, 14 bp, D. melanogaster
tttaaaaatgcaaa

SEQ ID NO: 672201 - DNA, 13 bp, D. melanogaster
tttaaaaatgcta

SEQ ID NO: 672202 - DNA, 13 bp, D. melanogaster
tttaaaaatgctt

SEQ ID NO: 672203 - DNA, 14 bp, D. melanogaster
tttaaaaatgtttc

SEQ ID NO: 672204 - DNA, 13 bp, D. melanogaster
tttaaaaattgtc

SEQ ID NO: 672205 - DNA, 14 bp, D. melanogaster
tttaaaaattgttc

SEQ ID NO: 672206 - DNA, 13 bp, D. melanogaster
tttaaaacaaaga

SEQ ID NO: 672207 - DNA, 13 bp, D. melanogaster
tttaaaacaaagt

SEQ ID NO: 672208 - DNA, 13 bp, D. melanogaster
tttaaaacaactt

SEQ ID NO: 672209 - DNA, 13 bp, D. melanogaster
tttaaaacaatac

SEQ ID NO: 672210 - DNA, 13 bp, D. melanogaster
tttaaaacaatct

SEQ ID NO: 672211 - DNA, 13 bp, D. melanogaster
tttaaaacacatt

SEQ ID NO: 672212 - DNA, 13 bp, D. melanogaster
tttaaaacacttt

SEQ ID NO: 672213 - DNA, 13 bp, D. melanogaster
tttaaaacagaaa

SEQ ID NO: 672214 - DNA, 14 bp, D. melanogaster
tttaaaacagaaaa

SEQ ID NO: 672215 - DNA, 13 bp, D. melanogaster
tttaaaacattca

SEQ ID NO: 672216 - DNA, 14 bp, D. melanogaster
tttaaaacattgta

SEQ ID NO: 672217 - DNA, 13 bp, D. melanogaster
tttaaaaccaaac

SEQ ID NO: 672218 - DNA, 13 bp, D. melanogaster
tttaaaaccaaca

SEQ ID NO: 672219 - DNA, 13 bp, D. melanogaster
tttaaaaccaact

SEQ ID NO: 672220 - DNA, 13 bp, D. melanogaster
tttaaaaccaatt

SEQ ID NO: 672221 - DNA, 14 bp, D. melanogaster
tttaaaaccaattt

SEQ ID NO: 672222 - DNA, 13 bp, D. melanogaster
tttaaaaccagtt

SEQ ID NO: 672223 - DNA, 13 bp, D. melanogaster
tttaaaaccattt

SEQ ID NO: 672224 - DNA, 13 bp, D. melanogaster
tttaaaacctgaa

SEQ ID NO: 672225 - DNA, 13 bp, D. melanogaster
tttaaaacgaaaa

SEQ ID NO: 672226 - DNA, 13 bp, D. melanogaster
tttaaaacgaaat

SEQ ID NO: 672227 - DNA, 13 bp, D. melanogaster
tttaaaacgcatt

SEQ ID NO: 672228 - DNA, 13 bp, D. melanogaster
tttaaaacgtttt

SEQ ID NO: 672229 - DNA, 13 bp, D. melanogaster
tttaaaactagtt

SEQ ID NO: 672230 - DNA, 13 bp, D. melanogaster
tttaaaactcaaa

SEQ ID NO: 672231 - DNA, 13 bp, D. melanogaster
tttaaaactcaat

SEQ ID NO: 672232 - DNA, 13 bp, D. melanogaster
tttaaaactcttt

SEQ ID NO: 672233 - DNA, 13 bp, D. melanogaster
tttaaaactgaaa

SEQ ID NO: 672234 - DNA, 13 bp, D. melanogaster
tttaaaactgatt

SEQ ID NO: 672235 - DNA, 13 bp, D. melanogaster
tttaaaactgttc

SEQ ID NO: 672236 - DNA, 14 bp, D. melanogaster
tttaaaactgttca

SEQ ID NO: 672237 - DNA, 13 bp, D. melanogaster
tttaaaactgttt

SEQ ID NO: 672238 - DNA, 13 bp, D. melanogaster
tttaaaacttagt

SEQ ID NO: 672239 - DNA, 13 bp, D. melanogaster
tttaaaacttgta

SEQ ID NO: 672240 - DNA, 13 bp, D. melanogaster
tttaaaactttga

SEQ ID NO: 672241 - DNA, 14 bp, D. melanogaster
tttaaaagaaaact

SEQ ID NO: 672242 - DNA, 13 bp, D. melanogaster
tttaaaagcaaat

SEQ ID NO: 672243 - DNA, 13 bp, D. melanogaster
tttaaaagcaatc

SEQ ID NO: 672244 - DNA, 14 bp, D. melanogaster
tttaaaagcaattt

SEQ ID NO: 672245 - DNA, 13 bp, D. melanogaster
tttaaaagcagaa

SEQ ID NO: 672246 - DNA, 13 bp, D. melanogaster
tttaaaagcatat

SEQ ID NO: 672247 - DNA, 13 bp, D. melanogaster
tttaaaagcatta

SEQ ID NO: 672248 - DNA, 14 bp, D. melanogaster
tttaaaagcatttt

SEQ ID NO: 672249 - DNA, 13 bp, D. melanogaster
tttaaaagccaaa

SEQ ID NO: 672250 - DNA, 13 bp, D. melanogaster
tttaaaagccaat

SEQ ID NO: 672251 - DNA, 13 bp, D. melanogaster
tttaaaagccttt

SEQ ID NO: 672252 - DNA, 14 bp, D. melanogaster
tttaaaagcgaaat

SEQ ID NO: 672253 - DNA, 13 bp, D. melanogaster
tttaaaagcgaca

SEQ ID NO: 672254 - DNA, 13 bp, D. melanogaster
tttaaaagcgttt

SEQ ID NO: 672255 - DNA, 14 bp, D. melanogaster
tttaaaagcttttt

SEQ ID NO: 672256 - DNA, 13 bp, D. melanogaster
tttaaaaggatat

SEQ ID NO: 672257 - DNA, 13 bp, D. melanogaster
tttaaaaggatgt

SEQ ID NO: 672258 - DNA, 13 bp, D. melanogaster
tttaaaagggcaa

SEQ ID NO: 672259 - DNA, 13 bp, D. melanogaster
tttaaaaggtttt

SEQ ID NO: 672260 - DNA, 13 bp, D. melanogaster
tttaaaagtatct

SEQ ID NO: 672261 - DNA, 13 bp, D. melanogaster
tttaaaagtgaaa

SEQ ID NO: 672262 - DNA, 14 bp, D. melanogaster
tttaaaagtgaaag

SEQ ID NO: 672263 - DNA, 13 bp, D. melanogaster
tttaaaagtgaga

SEQ ID NO: 672264 - DNA, 13 bp, D. melanogaster
tttaaaagtgata

SEQ ID NO: 672265 - DNA, 13 bp, D. melanogaster
tttaaaagtgcat

SEQ ID NO: 672266 - DNA, 13 bp, D. melanogaster
tttaaaagtgtaa

SEQ ID NO: 672267 - DNA, 13 bp, D. melanogaster
tttaaaagttcat

SEQ ID NO: 672268 - DNA, 13 bp, D. melanogaster
tttaaaagttttc

SEQ ID NO: 672269 - DNA, 14 bp, D. melanogaster
tttaaaataattgc

SEQ ID NO: 672270 - DNA, 13 bp, D. melanogaster
tttaaaatacaac

SEQ ID NO: 672271 - DNA, 13 bp, D. melanogaster
tttaaaatacaca

SEQ ID NO: 672272 - DNA, 13 bp, D. melanogaster
tttaaaataccaa

SEQ ID NO: 672273 - DNA, 13 bp, D. melanogaster
tttaaaatatacc

SEQ ID NO: 672274 - DNA, 13 bp, D. melanogaster
tttaaaatatcca

SEQ ID NO: 672275 - DNA, 13 bp, D. melanogaster
tttaaaatatgcc

SEQ ID NO: 672276 - DNA, 13 bp, D. melanogaster
tttaaaatatgga

SEQ ID NO: 672277 - DNA, 13 bp, D. melanogaster
tttaaaatcactt

SEQ ID NO: 672278 - DNA, 14 bp, D. melanogaster
tttaaaatcagttt

SEQ ID NO: 672279 - DNA, 14 bp, D. melanogaster
tttaaaatccattt

SEQ ID NO: 672280 - DNA, 13 bp, D. melanogaster
tttaaaatcgttt

SEQ ID NO: 672281 - DNA, 13 bp, D. melanogaster
tttaaaatctcag

SEQ ID NO: 672282 - DNA, 14 bp, D. melanogaster
tttaaaatgaaatg

SEQ ID NO: 672283 - DNA, 13 bp, D. melanogaster
tttaaaatgcaaa

SEQ ID NO: 672284 - DNA, 14 bp, D. melanogaster
tttaaaatgcattt

SEQ ID NO: 672285 - DNA, 14 bp, D. melanogaster
tttaaaatggaaat

SEQ ID NO: 672286 - DNA, 13 bp, D. melanogaster
tttaaaatggcaa

SEQ ID NO: 672287 - DNA, 13 bp, D. melanogaster
tttaaaatggctt

SEQ ID NO: 672288 - DNA, 13 bp, D. melanogaster
tttaaaatgttct

SEQ ID NO: 672289 - DNA, 13 bp, D. melanogaster
tttaaaatgttga

SEQ ID NO: 672290 - DNA, 13 bp, D. melanogaster
tttaaaattccca

SEQ ID NO: 672291 - DNA, 13 bp, D. melanogaster
tttaaaattgctt

SEQ ID NO: 672292 - DNA, 13 bp, D. melanogaster
tttaaaattgttc

SEQ ID NO: 672293 - DNA, 13 bp, D. melanogaster
tttaaaatttgag

SEQ ID NO: 672294 - DNA, 13 bp, D. melanogaster
tttaaacaaaagt

SEQ ID NO: 672295 - DNA, 13 bp, D. melanogaster
tttaaacaaactg

SEQ ID NO: 672296 - DNA, 13 bp, D. melanogaster
tttaaacaaattg

SEQ ID NO: 672297 - DNA, 13 bp, D. melanogaster
tttaaacaacata

SEQ ID NO: 672298 - DNA, 14 bp, D. melanogaster
tttaaacaactgca

SEQ ID NO: 672299 - DNA, 13 bp, D. melanogaster
tttaaacaatgaa

SEQ ID NO: 672300 - DNA, 13 bp, D. melanogaster
tttaaacaattgt

SEQ ID NO: 672301 - DNA, 13 bp, D. melanogaster
tttaaacacaaat

SEQ ID NO: 672302 - DNA, 13 bp, D. melanogaster
tttaaacacaatt

SEQ ID NO: 672303 - DNA, 13 bp, D. melanogaster
tttaaacacatta

SEQ ID NO: 672304 - DNA, 13 bp, D. melanogaster
tttaaacacattc

SEQ ID NO: 672305 - DNA, 13 bp, D. melanogaster
tttaaacactttg

SEQ ID NO: 672306 - DNA, 13 bp, D. melanogaster
tttaaacactttt

SEQ ID NO: 672307 - DNA, 14 bp, D. melanogaster
tttaaacactttta

SEQ ID NO: 672308 - DNA, 13 bp, D. melanogaster
tttaaacagctga

SEQ ID NO: 672309 - DNA, 13 bp, D. melanogaster
tttaaacatgaaa

SEQ ID NO: 672310 - DNA, 13 bp, D. melanogaster
tttaaacatgttt

SEQ ID NO: 672311 - DNA, 13 bp, D. melanogaster
tttaaacatttcg

SEQ ID NO: 672312 - DNA, 13 bp, D. melanogaster
tttaaacattttc

SEQ ID NO: 672313 - DNA, 13 bp, D. melanogaster
tttaaacattttg

SEQ ID NO: 672314 - DNA, 13 bp, D. melanogaster
tttaaaccaaatg

SEQ ID NO: 672315 - DNA, 14 bp, D. melanogaster
tttaaaccaaatgg

SEQ ID NO: 672316 - DNA, 13 bp, D. melanogaster
tttaaaccaaatt

SEQ ID NO: 672317 - DNA, 13 bp, D. melanogaster
tttaaaccaagaa

SEQ ID NO: 672318 - DNA, 14 bp, D. melanogaster
tttaaaccaagaag

SEQ ID NO: 672319 - DNA, 13 bp, D. melanogaster
tttaaaccgattt

SEQ ID NO: 672320 - DNA, 13 bp, D. melanogaster
tttaaacgaaaac

SEQ ID NO: 672321 - DNA, 13 bp, D. melanogaster
tttaaacgaatct

SEQ ID NO: 672322 - DNA, 13 bp, D. melanogaster
tttaaacgatttt

SEQ ID NO: 672323 - DNA, 13 bp, D. melanogaster
tttaaacgctttt

SEQ ID NO: 672324 - DNA, 13 bp, D. melanogaster
tttaaacggattt

SEQ ID NO: 672325 - DNA, 13 bp, D. melanogaster
tttaaacgtaaat

SEQ ID NO: 672326 - DNA, 13 bp, D. melanogaster
tttaaacgtttta

SEQ ID NO: 672327 - DNA, 13 bp, D. melanogaster
tttaaactaaatc

SEQ ID NO: 672328 - DNA, 13 bp, D. melanogaster
tttaaactacaaa

SEQ ID NO: 672329 - DNA, 13 bp, D. melanogaster
tttaaactatttc

SEQ ID NO: 672330 - DNA, 13 bp, D. melanogaster
tttaaactgaaat

SEQ ID NO: 672331 - DNA, 13 bp, D. melanogaster
tttaaactgatta

SEQ ID NO: 672332 - DNA, 13 bp, D. melanogaster
tttaaactgattt

SEQ ID NO: 672333 - DNA, 13 bp, D. melanogaster
tttaaactgtttt

SEQ ID NO: 672334 - DNA, 13 bp, D. melanogaster
tttaaacttcatt

SEQ ID NO: 672335 - DNA, 13 bp, D. melanogaster
tttaaactttgtt

SEQ ID NO: 672336 - DNA, 14 bp, D. melanogaster
tttaaactttgttt

SEQ ID NO: 672337 - DNA, 13 bp, D. melanogaster
tttaaacttttca

SEQ ID NO: 672338 - DNA, 13 bp, D. melanogaster
tttaaacttttga

SEQ ID NO: 672339 - DNA, 14 bp, D. melanogaster
tttaaagaaaaggg

SEQ ID NO: 672340 - DNA, 13 bp, D. melanogaster
tttaaagaaactt

SEQ ID NO: 672341 - DNA, 13 bp, D. melanogaster
tttaaagaaatga

SEQ ID NO: 672342 - DNA, 13 bp, D. melanogaster
tttaaagaacata

SEQ ID NO: 672343 - DNA, 13 bp, D. melanogaster
tttaaagaacatt

SEQ ID NO: 672344 - DNA, 13 bp, D. melanogaster
tttaaagaactaa

SEQ ID NO: 672345 - DNA, 13 bp, D. melanogaster
tttaaagaagaat

SEQ ID NO: 672346 - DNA, 14 bp, D. melanogaster
tttaaagaagcaaa

SEQ ID NO: 672347 - DNA, 13 bp, D. melanogaster
tttaaagaagttt

SEQ ID NO: 672348 - DNA, 13 bp, D. melanogaster
tttaaagaatgta

SEQ ID NO: 672349 - DNA, 13 bp, D. melanogaster
tttaaagaattca

SEQ ID NO: 672350 - DNA, 13 bp, D. melanogaster
tttaaagaatttc

SEQ ID NO: 672351 - DNA, 13 bp, D. melanogaster
tttaaagactaaa

SEQ ID NO: 672352 - DNA, 13 bp, D. melanogaster
tttaaagactata

SEQ ID NO: 672353 - DNA, 13 bp, D. melanogaster
tttaaagactttt

SEQ ID NO: 672354 - DNA, 13 bp, D. melanogaster
tttaaagagaaat

SEQ ID NO: 672355 - DNA, 14 bp, D. melanogaster
tttaaagagatttt

SEQ ID NO: 672356 - DNA, 13 bp, D. melanogaster
tttaaagagcaat

SEQ ID NO: 672357 - DNA, 13 bp, D. melanogaster
tttaaagagttta

SEQ ID NO: 672358 - DNA, 13 bp, D. melanogaster
tttaaagagtttt

SEQ ID NO: 672359 - DNA, 13 bp, D. melanogaster
tttaaagatactt

SEQ ID NO: 672360 - DNA, 13 bp, D. melanogaster
tttaaagatatgt

SEQ ID NO: 672361 - DNA, 13 bp, D. melanogaster
tttaaagatcttt

SEQ ID NO: 672362 - DNA, 13 bp, D. melanogaster
tttaaagcaaaaa

SEQ ID NO: 672363 - DNA, 14 bp, D. melanogaster
tttaaagcaaataa

SEQ ID NO: 672364 - DNA, 13 bp, D. melanogaster
tttaaagcaaatt

SEQ ID NO: 672365 - DNA, 14 bp, D. melanogaster
tttaaagcaaattt

SEQ ID NO: 672366 - DNA, 13 bp, D. melanogaster
tttaaagcaattg

SEQ ID NO: 672367 - DNA, 13 bp, D. melanogaster
tttaaagcaattt

SEQ ID NO: 672368 - DNA, 13 bp, D. melanogaster
tttaaagcattaa

SEQ ID NO: 672369 - DNA, 13 bp, D. melanogaster
tttaaagcattta

SEQ ID NO: 672370 - DNA, 13 bp, D. melanogaster
tttaaagcatttg

SEQ ID NO: 672371 - DNA, 13 bp, D. melanogaster
tttaaagccaaag

SEQ ID NO: 672372 - DNA, 14 bp, D. melanogaster
tttaaagccaaaga

SEQ ID NO: 672373 - DNA, 13 bp, D. melanogaster
tttaaagccaaat

SEQ ID NO: 672374 - DNA, 13 bp, D. melanogaster
tttaaagccaatt

SEQ ID NO: 672375 - DNA, 13 bp, D. melanogaster
tttaaagccattt

SEQ ID NO: 672376 - DNA, 13 bp, D. melanogaster
tttaaagcccaaa

SEQ ID NO: 672377 - DNA, 13 bp, D. melanogaster
tttaaagcccatt

SEQ ID NO: 672378 - DNA, 13 bp, D. melanogaster
tttaaagcgaaac

SEQ ID NO: 672379 - DNA, 13 bp, D. melanogaster
tttaaagcgaaat

SEQ ID NO: 672380 - DNA, 13 bp, D. melanogaster
tttaaagcgattt

SEQ ID NO: 672381 - DNA, 13 bp, D. melanogaster
tttaaagcggctt

SEQ ID NO: 672382 - DNA, 13 bp, D. melanogaster
tttaaagctaaac

SEQ ID NO: 672383 - DNA, 13 bp, D. melanogaster
tttaaagctatat

SEQ ID NO: 672384 - DNA, 13 bp, D. melanogaster
tttaaagctgctg

SEQ ID NO: 672385 - DNA, 13 bp, D. melanogaster
tttaaagctgttt

SEQ ID NO: 672386 - DNA, 13 bp, D. melanogaster
tttaaagcttaca

SEQ ID NO: 672387 - DNA, 13 bp, D. melanogaster
tttaaagcttttt

SEQ ID NO: 672388 - DNA, 13 bp, D. melanogaster
tttaaaggaaaat

SEQ ID NO: 672389 - DNA, 13 bp, D. melanogaster
tttaaaggaattt

SEQ ID NO: 672390 - DNA, 13 bp, D. melanogaster
tttaaaggatgtt

SEQ ID NO: 672391 - DNA, 13 bp, D. melanogaster
tttaaaggcaaat

SEQ ID NO: 672392 - DNA, 14 bp, D. melanogaster
tttaaaggcatttt

SEQ ID NO: 672393 - DNA, 13 bp, D. melanogaster
tttaaagggaaaa

SEQ ID NO: 672394 - DNA, 13 bp, D. melanogaster
tttaaagggaatt

SEQ ID NO: 672395 - DNA, 13 bp, D. melanogaster
tttaaaggtcaaa

SEQ ID NO: 672396 - DNA, 13 bp, D. melanogaster
tttaaagtaaaca

SEQ ID NO: 672397 - DNA, 13 bp, D. melanogaster
tttaaagtaaacc

SEQ ID NO: 672398 - DNA, 13 bp, D. melanogaster
tttaaagtcaaaa

SEQ ID NO: 672399 - DNA, 14 bp, D. melanogaster
tttaaagtcaaaaa

SEQ ID NO: 672400 - DNA, 14 bp, D. melanogaster
tttaaagtcaaaga

SEQ ID NO: 672401 - DNA, 13 bp, D. melanogaster
tttaaagtcaatt

SEQ ID NO: 672402 - DNA, 17 bp, D. melanogaster
tttaaagtctaagaact

SEQ ID NO: 672403 - DNA, 13 bp, D. melanogaster
tttaaagtctttt

SEQ ID NO: 672404 - DNA, 13 bp, D. melanogaster
tttaaagtgaaat

SEQ ID NO: 672405 - DNA, 13 bp, D. melanogaster
tttaaagtgcaat

SEQ ID NO: 672406 - DNA, 13 bp, D. melanogaster
tttaaagtgcctt

SEQ ID NO: 672407 - DNA, 13 bp, D. melanogaster
tttaaagtgctta

SEQ ID NO: 672408 - DNA, 13 bp, D. melanogaster
tttaaagtggaaa

SEQ ID NO: 672409 - DNA, 13 bp, D. melanogaster
tttaaagtggatt

SEQ ID NO: 672410 - DNA, 13 bp, D. melanogaster
tttaaagtgtaca

SEQ ID NO: 672411 - DNA, 13 bp, D. melanogaster
tttaaagtgtatt

SEQ ID NO: 672412 - DNA, 13 bp, D. melanogaster
tttaaagttaaca

SEQ ID NO: 672413 - DNA, 13 bp, D. melanogaster
tttaaagttaact

SEQ ID NO: 672414 - DNA, 13 bp, D. melanogaster
tttaaagttcatt

SEQ ID NO: 672415 - DNA, 13 bp, D. melanogaster
tttaaagttgctt

SEQ ID NO: 672416 - DNA, 14 bp, D. melanogaster
tttaaagttgtaaa

SEQ ID NO: 672417 - DNA, 13 bp, D. melanogaster
tttaaagttgtgg

SEQ ID NO: 672418 - DNA, 13 bp, D. melanogaster
tttaaagtttcaa

SEQ ID NO: 672419 - DNA, 13 bp, D. melanogaster
tttaaagtttctt

SEQ ID NO: 672420 - DNA, 13 bp, D. melanogaster
tttaaagttttcc

SEQ ID NO: 672421 - DNA, 13 bp, D. melanogaster
tttaaagttttct

SEQ ID NO: 672422 - DNA, 13 bp, D. melanogaster
tttaaagttttga

SEQ ID NO: 672423 - DNA, 13 bp, D. melanogaster
tttaaagttttgc

SEQ ID NO: 672424 - DNA, 13 bp, D. melanogaster
tttaaataaacag

SEQ ID NO: 672425 - DNA, 13 bp, D. melanogaster
tttaaataaccat

SEQ ID NO: 672426 - DNA, 13 bp, D. melanogaster
tttaaataactga

SEQ ID NO: 672427 - DNA, 13 bp, D. melanogaster
tttaaatacatgt

SEQ ID NO: 672428 - DNA, 14 bp, D. melanogaster
tttaaatacatttc

SEQ ID NO: 672429 - DNA, 13 bp, D. melanogaster
tttaaataccaaa

SEQ ID NO: 672430 - DNA, 13 bp, D. melanogaster
tttaaatacccaa

SEQ ID NO: 672431 - DNA, 13 bp, D. melanogaster
tttaaataccttt

SEQ ID NO: 672432 - DNA, 13 bp, D. melanogaster
tttaaatacgttt

SEQ ID NO: 672433 - DNA, 13 bp, D. melanogaster
tttaaatactcta

SEQ ID NO: 672434 - DNA, 13 bp, D. melanogaster
tttaaatactttg

SEQ ID NO: 672435 - DNA, 13 bp, D. melanogaster
tttaaatagcatt

SEQ ID NO: 672436 - DNA, 13 bp, D. melanogaster
tttaaatagctta

SEQ ID NO: 672437 - DNA, 13 bp, D. melanogaster
tttaaataggaaa

SEQ ID NO: 672438 - DNA, 13 bp, D. melanogaster
tttaaatagttga

SEQ ID NO: 672439 - DNA, 14 bp, D. melanogaster
tttaaatatattcg

SEQ ID NO: 672440 - DNA, 13 bp, D. melanogaster
tttaaatatgcaa

SEQ ID NO: 672441 - DNA, 14 bp, D. melanogaster
tttaaatatgcatt

SEQ ID NO: 672442 - DNA, 13 bp, D. melanogaster
tttaaatatgttg

SEQ ID NO: 672443 - DNA, 13 bp, D. melanogaster
tttaaatattgtg

SEQ ID NO: 672444 - DNA, 14 bp, D. melanogaster
tttaaatatttgct

SEQ ID NO: 672445 - DNA, 13 bp, D. melanogaster
tttaaatcaaaga

SEQ ID NO: 672446 - DNA, 13 bp, D. melanogaster
tttaaatcaaatg

SEQ ID NO: 672447 - DNA, 13 bp, D. melanogaster
tttaaatcacaat

SEQ ID NO: 672448 - DNA, 13 bp, D. melanogaster
tttaaatcagaaa

SEQ ID NO: 672449 - DNA, 13 bp, D. melanogaster
tttaaatccactt

SEQ ID NO: 672450 - DNA, 13 bp, D. melanogaster
tttaaatcgaaat

SEQ ID NO: 672451 - DNA, 14 bp, D. melanogaster
tttaaatcgaattt

SEQ ID NO: 672452 - DNA, 13 bp, D. melanogaster
tttaaatcgtatt

SEQ ID NO: 672453 - DNA, 13 bp, D. melanogaster
tttaaatcgtttt

SEQ ID NO: 672454 - DNA, 13 bp, D. melanogaster
tttaaatctactt

SEQ ID NO: 672455 - DNA, 13 bp, D. melanogaster
tttaaatctgttt

SEQ ID NO: 672456 - DNA, 13 bp, D. melanogaster
tttaaatgaaaac

SEQ ID NO: 672457 - DNA, 14 bp, D. melanogaster
tttaaatgaaacga

SEQ ID NO: 672458 - DNA, 13 bp, D. melanogaster
tttaaatgaaatc

SEQ ID NO: 672459 - DNA, 13 bp, D. melanogaster
tttaaatgaactt

SEQ ID NO: 672460 - DNA, 13 bp, D. melanogaster
tttaaatgaagaa

SEQ ID NO: 672461 - DNA, 13 bp, D. melanogaster
tttaaatgaagtt

SEQ ID NO: 672462 - DNA, 13 bp, D. melanogaster
tttaaatgaatga

SEQ ID NO: 672463 - DNA, 13 bp, D. melanogaster
tttaaatgaattg

SEQ ID NO: 672464 - DNA, 13 bp, D. melanogaster
tttaaatgagatt

SEQ ID NO: 672465 - DNA, 13 bp, D. melanogaster
tttaaatgagcaa

SEQ ID NO: 672466 - DNA, 13 bp, D. melanogaster
tttaaatgattga

SEQ ID NO: 672467 - DNA, 14 bp, D. melanogaster
tttaaatgcaaaat

SEQ ID NO: 672468 - DNA, 13 bp, D. melanogaster
tttaaatgcaaac

SEQ ID NO: 672469 - DNA, 13 bp, D. melanogaster
tttaaatgcaact

SEQ ID NO: 672470 - DNA, 13 bp, D. melanogaster
tttaaatgcaatt

SEQ ID NO: 672471 - DNA, 13 bp, D. melanogaster
tttaaatgcagag

SEQ ID NO: 672472 - DNA, 14 bp, D. melanogaster
tttaaatgcagttt

SEQ ID NO: 672473 - DNA, 13 bp, D. melanogaster
tttaaatgcataa

SEQ ID NO: 672474 - DNA, 13 bp, D. melanogaster
tttaaatgcatat

SEQ ID NO: 672475 - DNA, 13 bp, D. melanogaster
tttaaatgcattt

SEQ ID NO: 672476 - DNA, 13 bp, D. melanogaster
tttaaatgcctaa

SEQ ID NO: 672477 - DNA, 13 bp, D. melanogaster
tttaaatgccttt

SEQ ID NO: 672478 - DNA, 13 bp, D. melanogaster
tttaaatgcgaca

SEQ ID NO: 672479 - DNA, 13 bp, D. melanogaster
tttaaatgcgatt

SEQ ID NO: 672480 - DNA, 13 bp, D. melanogaster
tttaaatgctata

SEQ ID NO: 672481 - DNA, 13 bp, D. melanogaster
tttaaatgctatt

SEQ ID NO: 672482 - DNA, 13 bp, D. melanogaster
tttaaatgctgct

SEQ ID NO: 672483 - DNA, 14 bp, D. melanogaster
tttaaatggaaaat

SEQ ID NO: 672484 - DNA, 13 bp, D. melanogaster
tttaaatggaaac

SEQ ID NO: 672485 - DNA, 13 bp, D. melanogaster
tttaaatggaact

SEQ ID NO: 672486 - DNA, 13 bp, D. melanogaster
tttaaatggaatt

SEQ ID NO: 672487 - DNA, 13 bp, D. melanogaster
tttaaatggattt

SEQ ID NO: 672488 - DNA, 13 bp, D. melanogaster
tttaaatggcaaa

SEQ ID NO: 672489 - DNA, 13 bp, D. melanogaster
tttaaatggcaac

SEQ ID NO: 672490 - DNA, 13 bp, D. melanogaster
tttaaatggctta

SEQ ID NO: 672491 - DNA, 13 bp, D. melanogaster
tttaaatggtaat

SEQ ID NO: 672492 - DNA, 13 bp, D. melanogaster
tttaaatggttta

SEQ ID NO: 672493 - DNA, 14 bp, D. melanogaster
tttaaatggtttaa

SEQ ID NO: 672494 - DNA, 13 bp, D. melanogaster
tttaaatgtcagc

SEQ ID NO: 672495 - DNA, 13 bp, D. melanogaster
tttaaatgtcatt

SEQ ID NO: 672496 - DNA, 13 bp, D. melanogaster
tttaaatgtgcat

SEQ ID NO: 672497 - DNA, 13 bp, D. melanogaster
tttaaatgttaca

SEQ ID NO: 672498 - DNA, 13 bp, D. melanogaster
tttaaatgttcga

SEQ ID NO: 672499 - DNA, 13 bp, D. melanogaster
tttaaatgtttga

SEQ ID NO: 672500 - DNA, 13 bp, D. melanogaster
tttaaattaaacc

SEQ ID NO: 672501 - DNA, 13 bp, D. melanogaster
tttaaattaaacg

SEQ ID NO: 672502 - DNA, 13 bp, D. melanogaster
tttaaattaatcc

SEQ ID NO: 672503 - DNA, 13 bp, D. melanogaster
tttaaattacgaa

SEQ ID NO: 672504 - DNA, 13 bp, D. melanogaster
tttaaattatgca

SEQ ID NO: 672505 - DNA, 14 bp, D. melanogaster
tttaaattatgcaa

SEQ ID NO: 672506 - DNA, 13 bp, D. melanogaster
tttaaattattcc

SEQ ID NO: 672507 - DNA, 14 bp, D. melanogaster
tttaaattcaaatc

SEQ ID NO: 672508 - DNA, 13 bp, D. melanogaster
tttaaattcacat

SEQ ID NO: 672509 - DNA, 13 bp, D. melanogaster
tttaaattcactt

SEQ ID NO: 672510 - DNA, 13 bp, D. melanogaster
tttaaattcagat

SEQ ID NO: 672511 - DNA, 13 bp, D. melanogaster
tttaaattccaat

SEQ ID NO: 672512 - DNA, 13 bp, D. melanogaster
tttaaattcccaa

SEQ ID NO: 672513 - DNA, 13 bp, D. melanogaster
tttaaattcctgt

SEQ ID NO: 672514 - DNA, 15 bp, D. melanogaster
tttaaattcctgtaa

SEQ ID NO: 672515 - DNA, 13 bp, D. melanogaster
tttaaattcgaaa

SEQ ID NO: 672516 - DNA, 13 bp, D. melanogaster
tttaaattcgaat

SEQ ID NO: 672517 - DNA, 14 bp, D. melanogaster
tttaaattgaattc

SEQ ID NO: 672518 - DNA, 13 bp, D. melanogaster
tttaaattgacaa

SEQ ID NO: 672519 - DNA, 13 bp, D. melanogaster
tttaaattgagct

SEQ ID NO: 672520 - DNA, 13 bp, D. melanogaster
tttaaattgattg

SEQ ID NO: 672521 - DNA, 13 bp, D. melanogaster
tttaaattgcaaa

SEQ ID NO: 672522 - DNA, 14 bp, D. melanogaster
tttaaattgcaaat

SEQ ID NO: 672523 - DNA, 14 bp, D. melanogaster
tttaaattgcaatt

SEQ ID NO: 672524 - DNA, 13 bp, D. melanogaster
tttaaattgcact

SEQ ID NO: 672525 - DNA, 13 bp, D. melanogaster
tttaaattgcagt

SEQ ID NO: 672526 - DNA, 14 bp, D. melanogaster
tttaaattgcatta

SEQ ID NO: 672527 - DNA, 14 bp, D. melanogaster
tttaaattgcattt

SEQ ID NO: 672528 - DNA, 13 bp, D. melanogaster
tttaaattgcgtt

SEQ ID NO: 672529 - DNA, 13 bp, D. melanogaster
tttaaattgttct

SEQ ID NO: 672530 - DNA, 13 bp, D. melanogaster
tttaaatttaagc

SEQ ID NO: 672531 - DNA, 13 bp, D. melanogaster
tttaaatttagac

SEQ ID NO: 672532 - DNA, 14 bp, D. melanogaster
tttaaatttatggc

SEQ ID NO: 672533 - DNA, 14 bp, D. melanogaster
tttaaatttattgc

SEQ ID NO: 672534 - DNA, 13 bp, D. melanogaster
tttaaatttccaa

SEQ ID NO: 672535 - DNA, 13 bp, D. melanogaster
tttaaatttccca

SEQ ID NO: 672536 - DNA, 13 bp, D. melanogaster
tttaaatttgcat

SEQ ID NO: 672537 - DNA, 13 bp, D. melanogaster
tttaaatttggaa

SEQ ID NO: 672538 - DNA, 13 bp, D. melanogaster
tttaaatttggcg

SEQ ID NO: 672539 - DNA, 13 bp, D. melanogaster
tttaaattttcca

SEQ ID NO: 672540 - DNA, 13 bp, D. melanogaster
tttaacaaacatt

SEQ ID NO: 672541 - DNA, 13 bp, D. melanogaster
tttaacaaagaat

SEQ ID NO: 672542 - DNA, 14 bp, D. melanogaster
tttaacaaattgaa

SEQ ID NO: 672543 - DNA, 14 bp, D. melanogaster
tttaacaaattttc

SEQ ID NO: 672544 - DNA, 14 bp, D. melanogaster
tttaacaacaaatt

SEQ ID NO: 672545 - DNA, 13 bp, D. melanogaster
tttaacaacaata

SEQ ID NO: 672546 - DNA, 13 bp, D. melanogaster
tttaacaacgaaa

SEQ ID NO: 672547 - DNA, 13 bp, D. melanogaster
tttaacaactttt

SEQ ID NO: 672548 - DNA, 13 bp, D. melanogaster
tttaacaagcaaa

SEQ ID NO: 672549 - DNA, 13 bp, D. melanogaster
tttaacaatattg

SEQ ID NO: 672550 - DNA, 13 bp, D. melanogaster
tttaacaatgttt

SEQ ID NO: 672551 - DNA, 13 bp, D. melanogaster
tttaacaatttcc

SEQ ID NO: 672552 - DNA, 13 bp, D. melanogaster
tttaacaatttgt

SEQ ID NO: 672553 - DNA, 13 bp, D. melanogaster
tttaacacaaatt

SEQ ID NO: 672554 - DNA, 13 bp, D. melanogaster
tttaacacacaaa

SEQ ID NO: 672555 - DNA, 13 bp, D. melanogaster
tttaacacattca

SEQ ID NO: 672556 - DNA, 13 bp, D. melanogaster
tttaacacatttt

SEQ ID NO: 672557 - DNA, 13 bp, D. melanogaster
tttaacagaaaaa

SEQ ID NO: 672558 - DNA, 14 bp, D. melanogaster
tttaacagaaaaac

SEQ ID NO: 672559 - DNA, 13 bp, D. melanogaster
tttaacagctgtt

SEQ ID NO: 672560 - DNA, 13 bp, D. melanogaster
tttaacataaaca

SEQ ID NO: 672561 - DNA, 13 bp, D. melanogaster
tttaacatagttt

SEQ ID NO: 672562 - DNA, 13 bp, D. melanogaster
tttaacatgaaat

SEQ ID NO: 672563 - DNA, 13 bp, D. melanogaster
tttaacatgattt

SEQ ID NO: 672564 - DNA, 13 bp, D. melanogaster
tttaacattaaca

SEQ ID NO: 672565 - DNA, 13 bp, D. melanogaster
tttaacattgacc

SEQ ID NO: 672566 - DNA, 13 bp, D. melanogaster
tttaacattgtta

SEQ ID NO: 672567 - DNA, 13 bp, D. melanogaster
tttaacatttact

SEQ ID NO: 672568 - DNA, 13 bp, D. melanogaster
tttaacatttcca

SEQ ID NO: 672569 - DNA, 13 bp, D. melanogaster
tttaacattttag

SEQ ID NO: 672570 - DNA, 13 bp, D. melanogaster
tttaaccaaaaat

SEQ ID NO: 672571 - DNA, 13 bp, D. melanogaster
tttaaccaaaatc

SEQ ID NO: 672572 - DNA, 13 bp, D. melanogaster
tttaaccaaaatg

SEQ ID NO: 672573 - DNA, 13 bp, D. melanogaster
tttaaccaaactg

SEQ ID NO: 672574 - DNA, 13 bp, D. melanogaster
tttaaccaaattg

SEQ ID NO: 672575 - DNA, 13 bp, D. melanogaster
tttaaccaaattt

SEQ ID NO: 672576 - DNA, 13 bp, D. melanogaster
tttaaccaagtac

SEQ ID NO: 672577 - DNA, 13 bp, D. melanogaster
tttaaccaatttt

SEQ ID NO: 672578 - DNA, 13 bp, D. melanogaster
tttaaccatatat

SEQ ID NO: 672579 - DNA, 13 bp, D. melanogaster
tttaaccatttaa

SEQ ID NO: 672580 - DNA, 14 bp, D. melanogaster
tttaaccgccaaat

SEQ ID NO: 672581 - DNA, 13 bp, D. melanogaster
tttaacctggcct

SEQ ID NO: 672582 - DNA, 13 bp, D. melanogaster
tttaaccttttca

SEQ ID NO: 672583 - DNA, 13 bp, D. melanogaster
tttaacgaaatca

SEQ ID NO: 672584 - DNA, 13 bp, D. melanogaster
tttaacgaaatta

SEQ ID NO: 672585 - DNA, 13 bp, D. melanogaster
tttaacgaattta

SEQ ID NO: 672586 - DNA, 13 bp, D. melanogaster
tttaacgactgcc

SEQ ID NO: 672587 - DNA, 14 bp, D. melanogaster
tttaacgactgcct

SEQ ID NO: 672588 - DNA, 13 bp, D. melanogaster
tttaacgatttta

SEQ ID NO: 672589 - DNA, 13 bp, D. melanogaster
tttaacgattttt

SEQ ID NO: 672590 - DNA, 13 bp, D. melanogaster
tttaacgtatgct

SEQ ID NO: 672591 - DNA, 14 bp, D. melanogaster
tttaacgttatttt

SEQ ID NO: 672592 - DNA, 13 bp, D. melanogaster
tttaactacattt

SEQ ID NO: 672593 - DNA, 13 bp, D. melanogaster
tttaactagtttt

SEQ ID NO: 672594 - DNA, 13 bp, D. melanogaster
tttaactcaaatt

SEQ ID NO: 672595 - DNA, 13 bp, D. melanogaster
tttaactcaattt

SEQ ID NO: 672596 - DNA, 13 bp, D. melanogaster
tttaactcattta

SEQ ID NO: 672597 - DNA, 13 bp, D. melanogaster
tttaactgaattt

SEQ ID NO: 672598 - DNA, 13 bp, D. melanogaster
tttaactgatttt

SEQ ID NO: 672599 - DNA, 13 bp, D. melanogaster
tttaactgcaaca

SEQ ID NO: 672600 - DNA, 13 bp, D. melanogaster
tttaactgcactt

SEQ ID NO: 672601 - DNA, 13 bp, D. melanogaster
tttaactgcattt

SEQ ID NO: 672602 - DNA, 13 bp, D. melanogaster
tttaacttaagtg

SEQ ID NO: 672603 - DNA, 14 bp, D. melanogaster
tttaacttatttag

SEQ ID NO: 672604 - DNA, 13 bp, D. melanogaster
tttaacttgattt

SEQ ID NO: 672605 - DNA, 13 bp, D. melanogaster
tttaactttaaag

SEQ ID NO: 672606 - DNA, 13 bp, D. melanogaster
tttaactttaaga

SEQ ID NO: 672607 - DNA, 13 bp, D. melanogaster
tttaactttacat

SEQ ID NO: 672608 - DNA, 13 bp, D. melanogaster
tttaactttgaga

SEQ ID NO: 672609 - DNA, 14 bp, D. melanogaster
tttaactttgagaa

SEQ ID NO: 672610 - DNA, 13 bp, D. melanogaster
tttaactttgatt

SEQ ID NO: 672611 - DNA, 13 bp, D. melanogaster
tttaacttttgct

SEQ ID NO: 672612 - DNA, 13 bp, D. melanogaster
tttaacttttggc

SEQ ID NO: 672613 - DNA, 13 bp, D. melanogaster
tttaagaaaaaca

SEQ ID NO: 672614 - DNA, 13 bp, D. melanogaster
tttaagaaaacaa

SEQ ID NO: 672615 - DNA, 13 bp, D. melanogaster
tttaagaaaatca

SEQ ID NO: 672616 - DNA, 13 bp, D. melanogaster
tttaagaaaatgt

SEQ ID NO: 672617 - DNA, 13 bp, D. melanogaster
tttaagaaactaa

SEQ ID NO: 672618 - DNA, 13 bp, D. melanogaster
tttaagaaagctg

SEQ ID NO: 672619 - DNA, 14 bp, D. melanogaster
tttaagaaagctgt

SEQ ID NO: 672620 - DNA, 13 bp, D. melanogaster
tttaagaaatgtt

SEQ ID NO: 672621 - DNA, 13 bp, D. melanogaster
tttaagaaattca

SEQ ID NO: 672622 - DNA, 13 bp, D. melanogaster
tttaagaacaaaa

SEQ ID NO: 672623 - DNA, 13 bp, D. melanogaster
tttaagaacattt

SEQ ID NO: 672624 - DNA, 13 bp, D. melanogaster
tttaagaacttaa

SEQ ID NO: 672625 - DNA, 13 bp, D. melanogaster
tttaagaacttct

SEQ ID NO: 672626 - DNA, 13 bp, D. melanogaster
tttaagaactttg

SEQ ID NO: 672627 - DNA, 13 bp, D. melanogaster
tttaagaactttt

SEQ ID NO: 672628 - DNA, 13 bp, D. melanogaster
tttaagaagcaat

SEQ ID NO: 672629 - DNA, 13 bp, D. melanogaster
tttaagaagctaa

SEQ ID NO: 672630 - DNA, 13 bp, D. melanogaster
tttaagaatttca

SEQ ID NO: 672631 - DNA, 13 bp, D. melanogaster
tttaagaccattt

SEQ ID NO: 672632 - DNA, 14 bp, D. melanogaster
tttaagacggactt

SEQ ID NO: 672633 - DNA, 13 bp, D. melanogaster
tttaagagtattt

SEQ ID NO: 672634 - DNA, 13 bp, D. melanogaster
tttaagatacatt

SEQ ID NO: 672635 - DNA, 13 bp, D. melanogaster
tttaagatatgta

SEQ ID NO: 672636 - DNA, 14 bp, D. melanogaster
tttaagatatgtat

SEQ ID NO: 672637 - DNA, 13 bp, D. melanogaster
tttaagatcaacg

SEQ ID NO: 672638 - DNA, 13 bp, D. melanogaster
tttaagatgtttc

SEQ ID NO: 672639 - DNA, 13 bp, D. melanogaster
tttaagatttctt

SEQ ID NO: 672640 - DNA, 13 bp, D. melanogaster
tttaagattttca

SEQ ID NO: 672641 - DNA, 13 bp, D. melanogaster
tttaagcaaaaaa

SEQ ID NO: 672642 - DNA, 13 bp, D. melanogaster
tttaagcaaaact

SEQ ID NO: 672643 - DNA, 13 bp, D. melanogaster
tttaagcaaaatt

SEQ ID NO: 672644 - DNA, 13 bp, D. melanogaster
tttaagcaaacaa

SEQ ID NO: 672645 - DNA, 14 bp, D. melanogaster
tttaagcaaatatt

SEQ ID NO: 672646 - DNA, 13 bp, D. melanogaster
tttaagcaaatga

SEQ ID NO: 672647 - DNA, 13 bp, D. melanogaster
tttaagcaaatta

SEQ ID NO: 672648 - DNA, 13 bp, D. melanogaster
tttaagcaacaaa

SEQ ID NO: 672649 - DNA, 13 bp, D. melanogaster
tttaagcaacatt

SEQ ID NO: 672650 - DNA, 13 bp, D. melanogaster
tttaagcaataaa

SEQ ID NO: 672651 - DNA, 13 bp, D. melanogaster
tttaagcaatcaa

SEQ ID NO: 672652 - DNA, 13 bp, D. melanogaster
tttaagcaatttt

SEQ ID NO: 672653 - DNA, 13 bp, D. melanogaster
tttaagcacgttt

SEQ ID NO: 672654 - DNA, 13 bp, D. melanogaster
tttaagcacttga

SEQ ID NO: 672655 - DNA, 13 bp, D. melanogaster
tttaagcagctgg

SEQ ID NO: 672656 - DNA, 13 bp, D. melanogaster
tttaagcagtttt

SEQ ID NO: 672657 - DNA, 14 bp, D. melanogaster
tttaagcagttttt

SEQ ID NO: 672658 - DNA, 13 bp, D. melanogaster
tttaagcataaat

SEQ ID NO: 672659 - DNA, 13 bp, D. melanogaster
tttaagcatataa

SEQ ID NO: 672660 - DNA, 13 bp, D. melanogaster
tttaagcatatgt

SEQ ID NO: 672661 - DNA, 14 bp, D. melanogaster
tttaagcatatgtt

SEQ ID NO: 672662 - DNA, 13 bp, D. melanogaster
tttaagcattatt

SEQ ID NO: 672663 - DNA, 13 bp, D. melanogaster
tttaagcatttaa

SEQ ID NO: 672664 - DNA, 13 bp, D. melanogaster
tttaagcatttcg

SEQ ID NO: 672665 - DNA, 13 bp, D. melanogaster
tttaagcattttt

SEQ ID NO: 672666 - DNA, 14 bp, D. melanogaster
tttaagcattttta

SEQ ID NO: 672667 - DNA, 13 bp, D. melanogaster
tttaagccaaaag

SEQ ID NO: 672668 - DNA, 13 bp, D. melanogaster
tttaagccaaagt

SEQ ID NO: 672669 - DNA, 13 bp, D. melanogaster
tttaagccaaatg

SEQ ID NO: 672670 - DNA, 14 bp, D. melanogaster
tttaagccaaatgg

SEQ ID NO: 672671 - DNA, 13 bp, D. melanogaster
tttaagccaactt

SEQ ID NO: 672672 - DNA, 13 bp, D. melanogaster
tttaagccaagtt

SEQ ID NO: 672673 - DNA, 13 bp, D. melanogaster
tttaagccaattt

SEQ ID NO: 672674 - DNA, 13 bp, D. melanogaster
tttaagccacaaa

SEQ ID NO: 672675 - DNA, 13 bp, D. melanogaster
tttaagccactta

SEQ ID NO: 672676 - DNA, 13 bp, D. melanogaster
tttaagccacttt

SEQ ID NO: 672677 - DNA, 13 bp, D. melanogaster
tttaagccatata

SEQ ID NO: 672678 - DNA, 13 bp, D. melanogaster
tttaagccatttg

SEQ ID NO: 672679 - DNA, 13 bp, D. melanogaster
tttaagcccaatt

SEQ ID NO: 672680 - DNA, 14 bp, D. melanogaster
tttaagcccactat

SEQ ID NO: 672681 - DNA, 13 bp, D. melanogaster
tttaagccctttt

SEQ ID NO: 672682 - DNA, 13 bp, D. melanogaster
tttaagccgaaaa

SEQ ID NO: 672683 - DNA, 13 bp, D. melanogaster
tttaagccgaaat

SEQ ID NO: 672684 - DNA, 13 bp, D. melanogaster
tttaagcctaaaa

SEQ ID NO: 672685 - DNA, 13 bp, D. melanogaster
tttaagcctttaa

SEQ ID NO: 672686 - DNA, 13 bp, D. melanogaster
tttaagccttttt

SEQ ID NO: 672687 - DNA, 13 bp, D. melanogaster
tttaagcgaaatt

SEQ ID NO: 672688 - DNA, 13 bp, D. melanogaster
tttaagcgaattt

SEQ ID NO: 672689 - DNA, 13 bp, D. melanogaster
tttaagcgatctt

SEQ ID NO: 672690 - DNA, 13 bp, D. melanogaster
tttaagcgatttt

SEQ ID NO: 672691 - DNA, 13 bp, D. melanogaster
tttaagcggattt

SEQ ID NO: 672692 - DNA, 13 bp, D. melanogaster
tttaagctaaata

SEQ ID NO: 672693 - DNA, 13 bp, D. melanogaster
tttaagctattta

SEQ ID NO: 672694 - DNA, 13 bp, D. melanogaster
tttaagctcttaa

SEQ ID NO: 672695 - DNA, 13 bp, D. melanogaster
tttaagctcttta

SEQ ID NO: 672696 - DNA, 14 bp, D. melanogaster
tttaagctctttag

SEQ ID NO: 672697 - DNA, 13 bp, D. melanogaster
tttaagctctttt

SEQ ID NO: 672698 - DNA, 13 bp, D. melanogaster
tttaagctgattt

SEQ ID NO: 672699 - DNA, 13 bp, D. melanogaster
tttaagctgcaat

SEQ ID NO: 672700 - DNA, 13 bp, D. melanogaster
tttaagctgctgc

SEQ ID NO: 672701 - DNA, 13 bp, D. melanogaster
tttaagcttaaaa

SEQ ID NO: 672702 - DNA, 13 bp, D. melanogaster
tttaagcttataa

SEQ ID NO: 672703 - DNA, 13 bp, D. melanogaster
tttaagctttaaa

SEQ ID NO: 672704 - DNA, 14 bp, D. melanogaster
tttaagctttaaat

SEQ ID NO: 672705 - DNA, 13 bp, D. melanogaster
tttaagctttctt

SEQ ID NO: 672706 - DNA, 13 bp, D. melanogaster
tttaaggaaataa

SEQ ID NO: 672707 - DNA, 13 bp, D. melanogaster
tttaaggaaattt

SEQ ID NO: 672708 - DNA, 14 bp, D. melanogaster
tttaaggaagatct

SEQ ID NO: 672709 - DNA, 13 bp, D. melanogaster
tttaaggaatttt

SEQ ID NO: 672710 - DNA, 13 bp, D. melanogaster
tttaaggacttaa

SEQ ID NO: 672711 - DNA, 13 bp, D. melanogaster
tttaaggatataa

SEQ ID NO: 672712 - DNA, 13 bp, D. melanogaster
tttaaggatatta

SEQ ID NO: 672713 - DNA, 13 bp, D. melanogaster
tttaaggcatatt

SEQ ID NO: 672714 - DNA, 13 bp, D. melanogaster
tttaaggcttaaa

SEQ ID NO: 672715 - DNA, 13 bp, D. melanogaster
tttaaggctttaa

SEQ ID NO: 672716 - DNA, 13 bp, D. melanogaster
tttaaggtaaagg

SEQ ID NO: 672717 - DNA, 13 bp, D. melanogaster
tttaagtaaatga

SEQ ID NO: 672718 - DNA, 13 bp, D. melanogaster
tttaagtacaata

SEQ ID NO: 672719 - DNA, 13 bp, D. melanogaster
tttaagtacatat

SEQ ID NO: 672720 - DNA, 13 bp, D. melanogaster
tttaagtacattt

SEQ ID NO: 672721 - DNA, 14 bp, D. melanogaster
tttaagtacttctt

SEQ ID NO: 672722 - DNA, 13 bp, D. melanogaster
tttaagtactttt

SEQ ID NO: 672723 - DNA, 13 bp, D. melanogaster
tttaagtatcttt

SEQ ID NO: 672724 - DNA, 13 bp, D. melanogaster
tttaagtatggct

SEQ ID NO: 672725 - DNA, 13 bp, D. melanogaster
tttaagtattttc

SEQ ID NO: 672726 - DNA, 15 bp, D. melanogaster
tttaagtcataattt

SEQ ID NO: 672727 - DNA, 13 bp, D. melanogaster
tttaagtgaaaat

SEQ ID NO: 672728 - DNA, 14 bp, D. melanogaster
tttaagtgaaaatc

SEQ ID NO: 672729 - DNA, 13 bp, D. melanogaster
tttaagtgaaata

SEQ ID NO: 672730 - DNA, 13 bp, D. melanogaster
tttaagtgaatta

SEQ ID NO: 672731 - DNA, 13 bp, D. melanogaster
tttaagtgatatt

SEQ ID NO: 672732 - DNA, 13 bp, D. melanogaster
tttaagtgatttg

SEQ ID NO: 672733 - DNA, 13 bp, D. melanogaster
tttaagtgcaaaa

SEQ ID NO: 672734 - DNA, 13 bp, D. melanogaster
tttaagtgcaatt

SEQ ID NO: 672735 - DNA, 13 bp, D. melanogaster
tttaagtgcattt

SEQ ID NO: 672736 - DNA, 13 bp, D. melanogaster
tttaagtgcttta

SEQ ID NO: 672737 - DNA, 13 bp, D. melanogaster
tttaagtgctttc

SEQ ID NO: 672738 - DNA, 13 bp, D. melanogaster
tttaagtggaaat

SEQ ID NO: 672739 - DNA, 13 bp, D. melanogaster
tttaagtggattt

SEQ ID NO: 672740 - DNA, 13 bp, D. melanogaster
tttaagtggcaaa

SEQ ID NO: 672741 - DNA, 13 bp, D. melanogaster
tttaagtgtatat

SEQ ID NO: 672742 - DNA, 13 bp, D. melanogaster
tttaagtgtgtgt

SEQ ID NO: 672743 - DNA, 14 bp, D. melanogaster
tttaagtgtgtgtg

SEQ ID NO: 672744 - DNA, 13 bp, D. melanogaster
tttaagtgtttaa

SEQ ID NO: 672745 - DNA, 13 bp, D. melanogaster
tttaagttaaaag

SEQ ID NO: 672746 - DNA, 13 bp, D. melanogaster
tttaagttaagtt

SEQ ID NO: 672747 - DNA, 13 bp, D. melanogaster
tttaagttcattt

SEQ ID NO: 672748 - DNA, 13 bp, D. melanogaster
tttaagttctatt

SEQ ID NO: 672749 - DNA, 13 bp, D. melanogaster
tttaagttctgaa

SEQ ID NO: 672750 - DNA, 13 bp, D. melanogaster
tttaagttgattg

SEQ ID NO: 672751 - DNA, 13 bp, D. melanogaster
tttaagttgcaaa

SEQ ID NO: 672752 - DNA, 13 bp, D. melanogaster
tttaagttgggtt

SEQ ID NO: 672753 - DNA, 13 bp, D. melanogaster
tttaagttgtggg

SEQ ID NO: 672754 - DNA, 13 bp, D. melanogaster
tttaagtttaaga

SEQ ID NO: 672755 - DNA, 14 bp, D. melanogaster
tttaagtttaagat

SEQ ID NO: 672756 - DNA, 13 bp, D. melanogaster
tttaagtttaagt

SEQ ID NO: 672757 - DNA, 13 bp, D. melanogaster
tttaagttttcat

SEQ ID NO: 672758 - DNA, 13 bp, D. melanogaster
tttaagtttttcc

SEQ ID NO: 672759 - DNA, 13 bp, D. melanogaster
tttaataaaaacg

SEQ ID NO: 672760 - DNA, 13 bp, D. melanogaster
tttaataaaaagc

SEQ ID NO: 672761 - DNA, 14 bp, D. melanogaster
tttaataaaaatgc

SEQ ID NO: 672762 - DNA, 13 bp, D. melanogaster
tttaataaaacag

SEQ ID NO: 672763 - DNA, 13 bp, D. melanogaster
tttaataaacact

SEQ ID NO: 672764 - DNA, 14 bp, D. melanogaster
tttaataaactaca

SEQ ID NO: 672765 - DNA, 13 bp, D. melanogaster
tttaataaactga

SEQ ID NO: 672766 - DNA, 13 bp, D. melanogaster
tttaataaatgcc

SEQ ID NO: 672767 - DNA, 13 bp, D. melanogaster
tttaataaatgct

SEQ ID NO: 672768 - DNA, 14 bp, D. melanogaster
tttaataacaatag

SEQ ID NO: 672769 - DNA, 13 bp, D. melanogaster
tttaataacattg

SEQ ID NO: 672770 - DNA, 13 bp, D. melanogaster
tttaataaccttt

SEQ ID NO: 672771 - DNA, 13 bp, D. melanogaster
tttaataagcaaa

SEQ ID NO: 672772 - DNA, 13 bp, D. melanogaster
tttaataatgcca

SEQ ID NO: 672773 - DNA, 13 bp, D. melanogaster
tttaatacaattg

SEQ ID NO: 672774 - DNA, 13 bp, D. melanogaster
tttaatacacata

SEQ ID NO: 672775 - DNA, 13 bp, D. melanogaster
tttaatacatttc

SEQ ID NO: 672776 - DNA, 13 bp, D. melanogaster
tttaataccaaaa

SEQ ID NO: 672777 - DNA, 13 bp, D. melanogaster
tttaatacgaatt

SEQ ID NO: 672778 - DNA, 13 bp, D. melanogaster
tttaatacttgaa

SEQ ID NO: 672779 - DNA, 13 bp, D. melanogaster
tttaatagaattg

SEQ ID NO: 672780 - DNA, 13 bp, D. melanogaster
tttaatagactca

SEQ ID NO: 672781 - DNA, 13 bp, D. melanogaster
tttaatagatact

SEQ ID NO: 672782 - DNA, 14 bp, D. melanogaster
tttaatagatactt

SEQ ID NO: 672783 - DNA, 14 bp, D. melanogaster
tttaatagattaga

SEQ ID NO: 672784 - DNA, 13 bp, D. melanogaster
tttaatagcattt

SEQ ID NO: 672785 - DNA, 13 bp, D. melanogaster
tttaataggaaat

SEQ ID NO: 672786 - DNA, 13 bp, D. melanogaster
tttaatagtttac

SEQ ID NO: 672787 - DNA, 13 bp, D. melanogaster
tttaatagtttct

SEQ ID NO: 672788 - DNA, 13 bp, D. melanogaster
tttaatatatgca

SEQ ID NO: 672789 - DNA, 13 bp, D. melanogaster
tttaatatattcc

SEQ ID NO: 672790 - DNA, 13 bp, D. melanogaster
tttaatatccaaa

SEQ ID NO: 672791 - DNA, 13 bp, D. melanogaster
tttaatatgcaaa

SEQ ID NO: 672792 - DNA, 14 bp, D. melanogaster
tttaatatgcaaaa

SEQ ID NO: 672793 - DNA, 14 bp, D. melanogaster
tttaatatgcaaat

SEQ ID NO: 672794 - DNA, 13 bp, D. melanogaster
tttaatattcagc

SEQ ID NO: 672795 - DNA, 14 bp, D. melanogaster
tttaatattcagct

SEQ ID NO: 672796 - DNA, 13 bp, D. melanogaster
tttaatattccaa

SEQ ID NO: 672797 - DNA, 13 bp, D. melanogaster
tttaatattgctt

SEQ ID NO: 672798 - DNA, 13 bp, D. melanogaster
tttaatatttgct

SEQ ID NO: 672799 - DNA, 13 bp, D. melanogaster
tttaatcaaaagt

SEQ ID NO: 672800 - DNA, 13 bp, D. melanogaster
tttaatcaaacta

SEQ ID NO: 672801 - DNA, 13 bp, D. melanogaster
tttaatcaaagct

SEQ ID NO: 672802 - DNA, 13 bp, D. melanogaster
tttaatcaacaaa

SEQ ID NO: 672803 - DNA, 13 bp, D. melanogaster
tttaatcaagtca

SEQ ID NO: 672804 - DNA, 13 bp, D. melanogaster
tttaatcaagttt

SEQ ID NO: 672805 - DNA, 13 bp, D. melanogaster
tttaatcagattt

SEQ ID NO: 672806 - DNA, 13 bp, D. melanogaster
tttaatcagcaat

SEQ ID NO: 672807 - DNA, 13 bp, D. melanogaster
tttaatcatcatt

SEQ ID NO: 672808 - DNA, 13 bp, D. melanogaster
tttaatccaaaaa

SEQ ID NO: 672809 - DNA, 13 bp, D. melanogaster
tttaatccaatta

SEQ ID NO: 672810 - DNA, 13 bp, D. melanogaster
tttaatcctttaa

SEQ ID NO: 672811 - DNA, 13 bp, D. melanogaster
tttaatcgaaata

SEQ ID NO: 672812 - DNA, 13 bp, D. melanogaster
tttaatcgaaatg

SEQ ID NO: 672813 - DNA, 13 bp, D. melanogaster
tttaatcgaatat

SEQ ID NO: 672814 - DNA, 13 bp, D. melanogaster
tttaatcgatttg

SEQ ID NO: 672815 - DNA, 13 bp, D. melanogaster
tttaatcgctttt

SEQ ID NO: 672816 - DNA, 13 bp, D. melanogaster
tttaatcgtttaa

SEQ ID NO: 672817 - DNA, 13 bp, D. melanogaster
tttaatctcaact

SEQ ID NO: 672818 - DNA, 13 bp, D. melanogaster
tttaatctcaatt

SEQ ID NO: 672819 - DNA, 13 bp, D. melanogaster
tttaatctcatcc

SEQ ID NO: 672820 - DNA, 13 bp, D. melanogaster
tttaatctctcac

SEQ ID NO: 672821 - DNA, 13 bp, D. melanogaster
tttaatctgagct

SEQ ID NO: 672822 - DNA, 13 bp, D. melanogaster
tttaatctgattt

SEQ ID NO: 672823 - DNA, 13 bp, D. melanogaster
tttaatctgcaaa

SEQ ID NO: 672824 - DNA, 13 bp, D. melanogaster
tttaatcttaaag

SEQ ID NO: 672825 - DNA, 13 bp, D. melanogaster
tttaatctttaag

SEQ ID NO: 672826 - DNA, 13 bp, D. melanogaster
tttaatgaaacca

SEQ ID NO: 672827 - DNA, 13 bp, D. melanogaster
tttaatgaaatcg

SEQ ID NO: 672828 - DNA, 13 bp, D. melanogaster
tttaatgaaccaa

SEQ ID NO: 672829 - DNA, 13 bp, D. melanogaster
tttaatgaacttt

SEQ ID NO: 672830 - DNA, 13 bp, D. melanogaster
tttaatgaagttt

SEQ ID NO: 672831 - DNA, 13 bp, D. melanogaster
tttaatgacaaat

SEQ ID NO: 672832 - DNA, 13 bp, D. melanogaster
tttaatgacaatt

SEQ ID NO: 672833 - DNA, 13 bp, D. melanogaster
tttaatgactttc

SEQ ID NO: 672834 - DNA, 13 bp, D. melanogaster
tttaatgactttg

SEQ ID NO: 672835 - DNA, 13 bp, D. melanogaster
tttaatgagaaat

SEQ ID NO: 672836 - DNA, 13 bp, D. melanogaster
tttaatgagcagc

SEQ ID NO: 672837 - DNA, 13 bp, D. melanogaster
tttaatgagctgc

SEQ ID NO: 672838 - DNA, 13 bp, D. melanogaster
tttaatgagttgc

SEQ ID NO: 672839 - DNA, 13 bp, D. melanogaster
tttaatgagtttg

SEQ ID NO: 672840 - DNA, 13 bp, D. melanogaster
tttaatgatcaaa

SEQ ID NO: 672841 - DNA, 13 bp, D. melanogaster
tttaatgatgatt

SEQ ID NO: 672842 - DNA, 13 bp, D. melanogaster
tttaatgcaaaat

SEQ ID NO: 672843 - DNA, 13 bp, D. melanogaster
tttaatgcaaaca

SEQ ID NO: 672844 - DNA, 13 bp, D. melanogaster
tttaatgcaaatt

SEQ ID NO: 672845 - DNA, 13 bp, D. melanogaster
tttaatgcaatta

SEQ ID NO: 672846 - DNA, 14 bp, D. melanogaster
tttaatgcaattaa

SEQ ID NO: 672847 - DNA, 13 bp, D. melanogaster
tttaatgcaattt

SEQ ID NO: 672848 - DNA, 13 bp, D. melanogaster
tttaatgcagcca

SEQ ID NO: 672849 - DNA, 13 bp, D. melanogaster
tttaatgcagttt

SEQ ID NO: 672850 - DNA, 13 bp, D. melanogaster
tttaatgcattta

SEQ ID NO: 672851 - DNA, 13 bp, D. melanogaster
tttaatgcatttt

SEQ ID NO: 672852 - DNA, 13 bp, D. melanogaster
tttaatgccaaaa

SEQ ID NO: 672853 - DNA, 13 bp, D. melanogaster
tttaatgccaaca

SEQ ID NO: 672854 - DNA, 13 bp, D. melanogaster
tttaatgccatca

SEQ ID NO: 672855 - DNA, 13 bp, D. melanogaster
tttaatgccattt

SEQ ID NO: 672856 - DNA, 13 bp, D. melanogaster
tttaatgccttta

SEQ ID NO: 672857 - DNA, 13 bp, D. melanogaster
tttaatgcgattt

SEQ ID NO: 672858 - DNA, 14 bp, D. melanogaster
tttaatgcgatttt

SEQ ID NO: 672859 - DNA, 13 bp, D. melanogaster
tttaatgctaatt

SEQ ID NO: 672860 - DNA, 13 bp, D. melanogaster
tttaatgctatta

SEQ ID NO: 672861 - DNA, 13 bp, D. melanogaster
tttaatgctattg

SEQ ID NO: 672862 - DNA, 14 bp, D. melanogaster
tttaatgctgctgc

SEQ ID NO: 672863 - DNA, 13 bp, D. melanogaster
tttaatgctttct

SEQ ID NO: 672864 - DNA, 13 bp, D. melanogaster
tttaatgcttttc

SEQ ID NO: 672865 - DNA, 13 bp, D. melanogaster
tttaatggaaaaa

SEQ ID NO: 672866 - DNA, 13 bp, D. melanogaster
tttaatggaaatt

SEQ ID NO: 672867 - DNA, 13 bp, D. melanogaster
tttaatggcaaaa

SEQ ID NO: 672868 - DNA, 13 bp, D. melanogaster
tttaatggcaata

SEQ ID NO: 672869 - DNA, 13 bp, D. melanogaster
tttaatggcaatt

SEQ ID NO: 672870 - DNA, 13 bp, D. melanogaster
tttaatggcataa

SEQ ID NO: 672871 - DNA, 13 bp, D. melanogaster
tttaatggcattt

SEQ ID NO: 672872 - DNA, 13 bp, D. melanogaster
tttaatggccaaa

SEQ ID NO: 672873 - DNA, 13 bp, D. melanogaster
tttaatggccaca

SEQ ID NO: 672874 - DNA, 13 bp, D. melanogaster
tttaatggctttt

SEQ ID NO: 672875 - DNA, 13 bp, D. melanogaster
tttaatgggaatt

SEQ ID NO: 672876 - DNA, 14 bp, D. melanogaster
tttaatggtgaaat

SEQ ID NO: 672877 - DNA, 13 bp, D. melanogaster
tttaatggttttc

SEQ ID NO: 672878 - DNA, 13 bp, D. melanogaster
tttaatgtacata

SEQ ID NO: 672879 - DNA, 13 bp, D. melanogaster
tttaatgtgaaaa

SEQ ID NO: 672880 - DNA, 13 bp, D. melanogaster
tttaatgtgcaaa

SEQ ID NO: 672881 - DNA, 13 bp, D. melanogaster
tttaatgtgcaat

SEQ ID NO: 672882 - DNA, 13 bp, D. melanogaster
tttaatgtgccaa

SEQ ID NO: 672883 - DNA, 13 bp, D. melanogaster
tttaatgtggctt

SEQ ID NO: 672884 - DNA, 13 bp, D. melanogaster
tttaatgtgtgtg

SEQ ID NO: 672885 - DNA, 14 bp, D. melanogaster
tttaatgttaaaca

SEQ ID NO: 672886 - DNA, 13 bp, D. melanogaster
tttaatgttccat

SEQ ID NO: 672887 - DNA, 13 bp, D. melanogaster
tttaatgttctct

SEQ ID NO: 672888 - DNA, 13 bp, D. melanogaster
tttaatgttcttg

SEQ ID NO: 672889 - DNA, 14 bp, D. melanogaster
tttaattaaaactc

SEQ ID NO: 672890 - DNA, 13 bp, D. melanogaster
tttaattaaactg

SEQ ID NO: 672891 - DNA, 13 bp, D. melanogaster
tttaattaaagac

SEQ ID NO: 672892 - DNA, 13 bp, D. melanogaster
tttaattaaagcc

SEQ ID NO: 672893 - DNA, 13 bp, D. melanogaster
tttaattaaagct

SEQ ID NO: 672894 - DNA, 13 bp, D. melanogaster
tttaattaaaggt

SEQ ID NO: 672895 - DNA, 13 bp, D. melanogaster
tttaattaacagc

SEQ ID NO: 672896 - DNA, 13 bp, D. melanogaster
tttaattaacttc

SEQ ID NO: 672897 - DNA, 13 bp, D. melanogaster
tttaattaagagc

SEQ ID NO: 672898 - DNA, 14 bp, D. melanogaster
tttaattaagcaaa

SEQ ID NO: 672899 - DNA, 13 bp, D. melanogaster
tttaattaaggca

SEQ ID NO: 672900 - DNA, 13 bp, D. melanogaster
tttaattaagttc

SEQ ID NO: 672901 - DNA, 13 bp, D. melanogaster
tttaattaattgg

SEQ ID NO: 672902 - DNA, 14 bp, D. melanogaster
tttaattaatttgc

SEQ ID NO: 672903 - DNA, 13 bp, D. melanogaster
tttaattacaaca

SEQ ID NO: 672904 - DNA, 13 bp, D. melanogaster
tttaattacaatg

SEQ ID NO: 672905 - DNA, 13 bp, D. melanogaster
tttaattaccgaa

SEQ ID NO: 672906 - DNA, 13 bp, D. melanogaster
tttaattaccgca

SEQ ID NO: 672907 - DNA, 13 bp, D. melanogaster
tttaattacgctt

SEQ ID NO: 672908 - DNA, 13 bp, D. melanogaster
tttaattacgttt

SEQ ID NO: 672909 - DNA, 13 bp, D. melanogaster
tttaattagcaac

SEQ ID NO: 672910 - DNA, 13 bp, D. melanogaster
tttaattagcaga

SEQ ID NO: 672911 - DNA, 13 bp, D. melanogaster
tttaattagcata

SEQ ID NO: 672912 - DNA, 13 bp, D. melanogaster
tttaattagcatt

SEQ ID NO: 672913 - DNA, 14 bp, D. melanogaster
tttaattagcattt

SEQ ID NO: 672914 - DNA, 14 bp, D. melanogaster
tttaattagccaaa

SEQ ID NO: 672915 - DNA, 13 bp, D. melanogaster
tttaattagcgca

SEQ ID NO: 672916 - DNA, 13 bp, D. melanogaster
tttaattaggaaa

SEQ ID NO: 672917 - DNA, 13 bp, D. melanogaster
tttaattatcaac

SEQ ID NO: 672918 - DNA, 13 bp, D. melanogaster
tttaattatgagc

SEQ ID NO: 672919 - DNA, 14 bp, D. melanogaster
tttaattatgcaaa

SEQ ID NO: 672920 - DNA, 13 bp, D. melanogaster
tttaattatgccc

SEQ ID NO: 672921 - DNA, 13 bp, D. melanogaster
tttaattatgctg

SEQ ID NO: 672922 - DNA, 13 bp, D. melanogaster
tttaattatgctt

SEQ ID NO: 672923 - DNA, 13 bp, D. melanogaster
tttaattattgtc

SEQ ID NO: 672924 - DNA, 14 bp, D. melanogaster
tttaattattgtcc

SEQ ID NO: 672925 - DNA, 13 bp, D. melanogaster
tttaattcaaaac

SEQ ID NO: 672926 - DNA, 13 bp, D. melanogaster
tttaattcaattc

SEQ ID NO: 672927 - DNA, 14 bp, D. melanogaster
tttaattcaattca

SEQ ID NO: 672928 - DNA, 14 bp, D. melanogaster
tttaattcaatttg

SEQ ID NO: 672929 - DNA, 13 bp, D. melanogaster
tttaattcactta

SEQ ID NO: 672930 - DNA, 13 bp, D. melanogaster
tttaattccaaac

SEQ ID NO: 672931 - DNA, 13 bp, D. melanogaster
tttaattcccaat

SEQ ID NO: 672932 - DNA, 13 bp, D. melanogaster
tttaattcgaaat

SEQ ID NO: 672933 - DNA, 13 bp, D. melanogaster
tttaattcgaatt

SEQ ID NO: 672934 - DNA, 13 bp, D. melanogaster
tttaattcgattc

SEQ ID NO: 672935 - DNA, 13 bp, D. melanogaster
tttaattcgattt

SEQ ID NO: 672936 - DNA, 13 bp, D. melanogaster
tttaattcgcttt

SEQ ID NO: 672937 - DNA, 13 bp, D. melanogaster
tttaattcggttt

SEQ ID NO: 672938 - DNA, 13 bp, D. melanogaster
tttaattctgcaa

SEQ ID NO: 672939 - DNA, 14 bp, D. melanogaster
tttaattgaatgaa

SEQ ID NO: 672940 - DNA, 13 bp, D. melanogaster
tttaattgaattg

SEQ ID NO: 672941 - DNA, 14 bp, D. melanogaster
tttaattgaattga

SEQ ID NO: 672942 - DNA, 14 bp, D. melanogaster
tttaattgacaatt

SEQ ID NO: 672943 - DNA, 13 bp, D. melanogaster
tttaattgacatt

SEQ ID NO: 672944 - DNA, 13 bp, D. melanogaster
tttaattgagcca

SEQ ID NO: 672945 - DNA, 13 bp, D. melanogaster
tttaattgattac

SEQ ID NO: 672946 - DNA, 13 bp, D. melanogaster
tttaattgcaatt

SEQ ID NO: 672947 - DNA, 14 bp, D. melanogaster
tttaattgcaattt

SEQ ID NO: 672948 - DNA, 13 bp, D. melanogaster
tttaattgcagca

SEQ ID NO: 672949 - DNA, 13 bp, D. melanogaster
tttaattgcattt

SEQ ID NO: 672950 - DNA, 13 bp, D. melanogaster
tttaattgccatg

SEQ ID NO: 672951 - DNA, 13 bp, D. melanogaster
tttaattgcctgt

SEQ ID NO: 672952 - DNA, 13 bp, D. melanogaster
tttaattgctgct

SEQ ID NO: 672953 - DNA, 13 bp, D. melanogaster
tttaattgcttat

SEQ ID NO: 672954 - DNA, 14 bp, D. melanogaster
tttaattgcttatt

SEQ ID NO: 672955 - DNA, 13 bp, D. melanogaster
tttaattgcttgt

SEQ ID NO: 672956 - DNA, 13 bp, D. melanogaster
tttaattgctttg

SEQ ID NO: 672957 - DNA, 13 bp, D. melanogaster
tttaattggaatt

SEQ ID NO: 672958 - DNA, 13 bp, D. melanogaster
tttaattggactt

SEQ ID NO: 672959 - DNA, 13 bp, D. melanogaster
tttaattggcaaa

SEQ ID NO: 672960 - DNA, 14 bp, D. melanogaster
tttaattggcattt

SEQ ID NO: 672961 - DNA, 13 bp, D. melanogaster
tttaattgtcatt

SEQ ID NO: 672962 - DNA, 13 bp, D. melanogaster
tttaattgtgaat

SEQ ID NO: 672963 - DNA, 13 bp, D. melanogaster
tttaattgtgctg

SEQ ID NO: 672964 - DNA, 13 bp, D. melanogaster
tttaattgtgctt

SEQ ID NO: 672965 - DNA, 13 bp, D. melanogaster
tttaattgttcaa

SEQ ID NO: 672966 - DNA, 13 bp, D. melanogaster
tttaattgttggc

SEQ ID NO: 672967 - DNA, 13 bp, D. melanogaster
tttaattgtttcc

SEQ ID NO: 672968 - DNA, 14 bp, D. melanogaster
tttaatttaagcaa

SEQ ID NO: 672969 - DNA, 13 bp, D. melanogaster
tttaatttaagcc

SEQ ID NO: 672970 - DNA, 13 bp, D. melanogaster
tttaatttaatcg

SEQ ID NO: 672971 - DNA, 13 bp, D. melanogaster
tttaatttacaca

SEQ ID NO: 672972 - DNA, 13 bp, D. melanogaster
tttaatttagcaa

SEQ ID NO: 672973 - DNA, 13 bp, D. melanogaster
tttaatttcaaag

SEQ ID NO: 672974 - DNA, 13 bp, D. melanogaster
tttaatttcaagc

SEQ ID NO: 672975 - DNA, 13 bp, D. melanogaster
tttaatttcaatg

SEQ ID NO: 672976 - DNA, 13 bp, D. melanogaster
tttaatttcacaa

SEQ ID NO: 672977 - DNA, 13 bp, D. melanogaster
tttaatttcatca

SEQ ID NO: 672978 - DNA, 14 bp, D. melanogaster
tttaatttcattag

SEQ ID NO: 672979 - DNA, 14 bp, D. melanogaster
tttaatttcatttg

SEQ ID NO: 672980 - DNA, 13 bp, D. melanogaster
tttaatttccaat

SEQ ID NO: 672981 - DNA, 13 bp, D. melanogaster
tttaatttcgaaa

SEQ ID NO: 672982 - DNA, 13 bp, D. melanogaster
tttaatttcgatt

SEQ ID NO: 672983 - DNA, 13 bp, D. melanogaster
tttaatttcgcct

SEQ ID NO: 672984 - DNA, 13 bp, D. melanogaster
tttaatttcggaa

SEQ ID NO: 672985 - DNA, 13 bp, D. melanogaster
tttaatttcgtta

SEQ ID NO: 672986 - DNA, 13 bp, D. melanogaster
tttaatttgaaga

SEQ ID NO: 672987 - DNA, 14 bp, D. melanogaster
tttaatttgatttc

SEQ ID NO: 672988 - DNA, 13 bp, D. melanogaster
tttaatttgcaag

SEQ ID NO: 672989 - DNA, 13 bp, D. melanogaster
tttaatttgcaat

SEQ ID NO: 672990 - DNA, 13 bp, D. melanogaster
tttaatttgcatt

SEQ ID NO: 672991 - DNA, 14 bp, D. melanogaster
tttaatttgcattt

SEQ ID NO: 672992 - DNA, 13 bp, D. melanogaster
tttaatttgccat

SEQ ID NO: 672993 - DNA, 14 bp, D. melanogaster
tttaatttgccatt

SEQ ID NO: 672994 - DNA, 13 bp, D. melanogaster
tttaatttgcccg

SEQ ID NO: 672995 - DNA, 14 bp, D. melanogaster
tttaatttgccttt

SEQ ID NO: 672996 - DNA, 13 bp, D. melanogaster
tttaatttgctca

SEQ ID NO: 672997 - DNA, 13 bp, D. melanogaster
tttaatttggaaa

SEQ ID NO: 672998 - DNA, 13 bp, D. melanogaster
tttaatttggcat

SEQ ID NO: 672999 - DNA, 14 bp, D. melanogaster
tttaatttggcatt

SEQ ID NO: 673000 - DNA, 13 bp, D. melanogaster
tttaatttggctt

SEQ ID NO: 673001 - DNA, 14 bp, D. melanogaster
tttaatttggcttt

SEQ ID NO: 673002 - DNA, 13 bp, D. melanogaster
tttaatttgtatc

SEQ ID NO: 673003 - DNA, 13 bp, D. melanogaster
tttaatttgtgca

SEQ ID NO: 673004 - DNA, 14 bp, D. melanogaster
tttaatttgtgcaa

SEQ ID NO: 673005 - DNA, 14 bp, D. melanogaster
tttaatttgtttac

SEQ ID NO: 673006 - DNA, 13 bp, D. melanogaster
tttaattttactg

SEQ ID NO: 673007 - DNA, 14 bp, D. melanogaster
tttaattttagcca

SEQ ID NO: 673008 - DNA, 13 bp, D. melanogaster
tttaattttatgc

SEQ ID NO: 673009 - DNA, 13 bp, D. melanogaster
tttaattttccaa

SEQ ID NO: 673010 - DNA, 13 bp, D. melanogaster
tttaattttcctg

SEQ ID NO: 673011 - DNA, 13 bp, D. melanogaster
tttaattttctgc

SEQ ID NO: 673012 - DNA, 13 bp, D. melanogaster
tttaattttgcaa

SEQ ID NO: 673013 - DNA, 13 bp, D. melanogaster
tttaattttgcgt

SEQ ID NO: 673014 - DNA, 13 bp, D. melanogaster
tttaattttggaa

SEQ ID NO: 673015 - DNA, 13 bp, D. melanogaster
tttacaaaaagtt

SEQ ID NO: 673016 - DNA, 13 bp, D. melanogaster
tttacaaaaatca

SEQ ID NO: 673017 - DNA, 13 bp, D. melanogaster
tttacaaaaccgt

SEQ ID NO: 673018 - DNA, 14 bp, D. melanogaster
tttacaaaaccgtt

SEQ ID NO: 673019 - DNA, 13 bp, D. melanogaster
tttacaaaactag

SEQ ID NO: 673020 - DNA, 14 bp, D. melanogaster
tttacaaaactaga

SEQ ID NO: 673021 - DNA, 13 bp, D. melanogaster
tttacaaaatgtg

SEQ ID NO: 673022 - DNA, 13 bp, D. melanogaster
tttacaaaatttc

SEQ ID NO: 673023 - DNA, 13 bp, D. melanogaster
tttacaaacaaat

SEQ ID NO: 673024 - DNA, 13 bp, D. melanogaster
tttacaaacaatt

SEQ ID NO: 673025 - DNA, 13 bp, D. melanogaster
tttacaaacagat

SEQ ID NO: 673026 - DNA, 13 bp, D. melanogaster
tttacaaactaaa

SEQ ID NO: 673027 - DNA, 13 bp, D. melanogaster
tttacaaactttt

SEQ ID NO: 673028 - DNA, 13 bp, D. melanogaster
tttacaaagaaaa

SEQ ID NO: 673029 - DNA, 14 bp, D. melanogaster
tttacaaagaaatt

SEQ ID NO: 673030 - DNA, 14 bp, D. melanogaster
tttacaaatacaat

SEQ ID NO: 673031 - DNA, 13 bp, D. melanogaster
tttacaaatcaat

SEQ ID NO: 673032 - DNA, 13 bp, D. melanogaster
tttacaaatcgat

SEQ ID NO: 673033 - DNA, 13 bp, D. melanogaster
tttacaaatgaat

SEQ ID NO: 673034 - DNA, 13 bp, D. melanogaster
tttacaaatgttt

SEQ ID NO: 673035 - DNA, 13 bp, D. melanogaster
tttacaaattctt

SEQ ID NO: 673036 - DNA, 13 bp, D. melanogaster
tttacaaattgca

SEQ ID NO: 673037 - DNA, 13 bp, D. melanogaster
tttacaaatttgt

SEQ ID NO: 673038 - DNA, 13 bp, D. melanogaster
tttacaacaacaa

SEQ ID NO: 673039 - DNA, 13 bp, D. melanogaster
tttacaacaattt

SEQ ID NO: 673040 - DNA, 13 bp, D. melanogaster
tttacaacattta

SEQ ID NO: 673041 - DNA, 13 bp, D. melanogaster
tttacaacatttt

SEQ ID NO: 673042 - DNA, 13 bp, D. melanogaster
tttacaacgcaac

SEQ ID NO: 673043 - DNA, 13 bp, D. melanogaster
tttacaactattt

SEQ ID NO: 673044 - DNA, 13 bp, D. melanogaster
tttacaagaaaat

SEQ ID NO: 673045 - DNA, 13 bp, D. melanogaster
tttacaagaatgg

SEQ ID NO: 673046 - DNA, 13 bp, D. melanogaster
tttacaagatttt

SEQ ID NO: 673047 - DNA, 13 bp, D. melanogaster
tttacaagcaaaa

SEQ ID NO: 673048 - DNA, 13 bp, D. melanogaster
tttacaagcaatt

SEQ ID NO: 673049 - DNA, 13 bp, D. melanogaster
tttacaagttttt

SEQ ID NO: 673050 - DNA, 13 bp, D. melanogaster
tttacaataacaa

SEQ ID NO: 673051 - DNA, 13 bp, D. melanogaster
tttacaataatgt

SEQ ID NO: 673052 - DNA, 13 bp, D. melanogaster
tttacaatgcaaa

SEQ ID NO: 673053 - DNA, 14 bp, D. melanogaster
tttacaatgtgtct

SEQ ID NO: 673054 - DNA, 13 bp, D. melanogaster
tttacaattacaa

SEQ ID NO: 673055 - DNA, 13 bp, D. melanogaster
tttacaattcaat

SEQ ID NO: 673056 - DNA, 13 bp, D. melanogaster
tttacaattgctt

SEQ ID NO: 673057 - DNA, 13 bp, D. melanogaster
tttacaattggca

SEQ ID NO: 673058 - DNA, 13 bp, D. melanogaster
tttacaattgttt

SEQ ID NO: 673059 - DNA, 13 bp, D. melanogaster
tttacaatttatg

SEQ ID NO: 673060 - DNA, 13 bp, D. melanogaster
tttacacaaaaat

SEQ ID NO: 673061 - DNA, 13 bp, D. melanogaster
tttacacaaaata

SEQ ID NO: 673062 - DNA, 13 bp, D. melanogaster
tttacacaaataa

SEQ ID NO: 673063 - DNA, 13 bp, D. melanogaster
tttacacaaatta

SEQ ID NO: 673064 - DNA, 13 bp, D. melanogaster
tttacacaagact

SEQ ID NO: 673065 - DNA, 13 bp, D. melanogaster
tttacacacaatt

SEQ ID NO: 673066 - DNA, 13 bp, D. melanogaster
tttacacatacat

SEQ ID NO: 673067 - DNA, 13 bp, D. melanogaster
tttacacatatct

SEQ ID NO: 673068 - DNA, 14 bp, D. melanogaster
tttacacatatctt

SEQ ID NO: 673069 - DNA, 13 bp, D. melanogaster
tttacacatttat

SEQ ID NO: 673070 - DNA, 14 bp, D. melanogaster
tttacacatttata

SEQ ID NO: 673071 - DNA, 13 bp, D. melanogaster
tttacacattttg

SEQ ID NO: 673072 - DNA, 13 bp, D. melanogaster
tttacacgactaa

SEQ ID NO: 673073 - DNA, 13 bp, D. melanogaster
tttacacttaaaa

SEQ ID NO: 673074 - DNA, 13 bp, D. melanogaster
tttacacttaatt

SEQ ID NO: 673075 - DNA, 13 bp, D. melanogaster
tttacactttaaa

SEQ ID NO: 673076 - DNA, 13 bp, D. melanogaster
tttacagagaaaa

SEQ ID NO: 673077 - DNA, 13 bp, D. melanogaster
tttacagatattt

SEQ ID NO: 673078 - DNA, 13 bp, D. melanogaster
tttacagcttttg

SEQ ID NO: 673079 - DNA, 13 bp, D. melanogaster
tttacaggtttta

SEQ ID NO: 673080 - DNA, 13 bp, D. melanogaster
tttacagtttaca

SEQ ID NO: 673081 - DNA, 13 bp, D. melanogaster
tttacagttttat

SEQ ID NO: 673082 - DNA, 13 bp, D. melanogaster
tttacataaatgt

SEQ ID NO: 673083 - DNA, 13 bp, D. melanogaster
tttacataacaat

SEQ ID NO: 673084 - DNA, 13 bp, D. melanogaster
tttacataacatt

SEQ ID NO: 673085 - DNA, 13 bp, D. melanogaster
tttacataacttt

SEQ ID NO: 673086 - DNA, 13 bp, D. melanogaster
tttacataatctt

SEQ ID NO: 673087 - DNA, 14 bp, D. melanogaster
tttacatacataca

SEQ ID NO: 673088 - DNA, 13 bp, D. melanogaster
tttacatacattt

SEQ ID NO: 673089 - DNA, 13 bp, D. melanogaster
tttacatatacat

SEQ ID NO: 673090 - DNA, 13 bp, D. melanogaster
tttacatatatgt

SEQ ID NO: 673091 - DNA, 13 bp, D. melanogaster
tttacatatgatt

SEQ ID NO: 673092 - DNA, 13 bp, D. melanogaster
tttacatatgtac

SEQ ID NO: 673093 - DNA, 13 bp, D. melanogaster
tttacatatgttt

SEQ ID NO: 673094 - DNA, 13 bp, D. melanogaster
tttacatattgat

SEQ ID NO: 673095 - DNA, 13 bp, D. melanogaster
tttacatattgtt

SEQ ID NO: 673096 - DNA, 13 bp, D. melanogaster
tttacatatttac

SEQ ID NO: 673097 - DNA, 14 bp, D. melanogaster
tttacatatttaca

SEQ ID NO: 673098 - DNA, 14 bp, D. melanogaster
tttacatatttatg

SEQ ID NO: 673099 - DNA, 13 bp, D. melanogaster
tttacatatttga

SEQ ID NO: 673100 - DNA, 13 bp, D. melanogaster
tttacatcaattt

SEQ ID NO: 673101 - DNA, 13 bp, D. melanogaster
tttacatccagaa

SEQ ID NO: 673102 - DNA, 13 bp, D. melanogaster
tttacatgcaaaa

SEQ ID NO: 673103 - DNA, 13 bp, D. melanogaster
tttacatgcatat

SEQ ID NO: 673104 - DNA, 13 bp, D. melanogaster
tttacatgcattt

SEQ ID NO: 673105 - DNA, 13 bp, D. melanogaster
tttacatggatga

SEQ ID NO: 673106 - DNA, 13 bp, D. melanogaster
tttacattacatt

SEQ ID NO: 673107 - DNA, 13 bp, D. melanogaster
tttacattcaatt

SEQ ID NO: 673108 - DNA, 13 bp, D. melanogaster
tttacattcgatt

SEQ ID NO: 673109 - DNA, 13 bp, D. melanogaster
tttacattgattt

SEQ ID NO: 673110 - DNA, 13 bp, D. melanogaster
tttacatttacat

SEQ ID NO: 673111 - DNA, 13 bp, D. melanogaster
tttacatttcaca

SEQ ID NO: 673112 - DNA, 13 bp, D. melanogaster
tttacatttccat

SEQ ID NO: 673113 - DNA, 13 bp, D. melanogaster
tttacatttgatt

SEQ ID NO: 673114 - DNA, 14 bp, D. melanogaster
tttacatttgattt

SEQ ID NO: 673115 - DNA, 14 bp, D. melanogaster
tttacatttgcatt

SEQ ID NO: 673116 - DNA, 13 bp, D. melanogaster
tttacatttgctt

SEQ ID NO: 673117 - DNA, 13 bp, D. melanogaster
tttacattttaca

SEQ ID NO: 673118 - DNA, 13 bp, D. melanogaster
tttaccaaaaact

SEQ ID NO: 673119 - DNA, 14 bp, D. melanogaster
tttaccaaaaactt

SEQ ID NO: 673120 - DNA, 13 bp, D. melanogaster
tttaccaaaaatt

SEQ ID NO: 673121 - DNA, 13 bp, D. melanogaster
tttaccaaatcat

SEQ ID NO: 673122 - DNA, 13 bp, D. melanogaster
tttaccaaatgaa

SEQ ID NO: 673123 - DNA, 13 bp, D. melanogaster
tttaccaacactg

SEQ ID NO: 673124 - DNA, 13 bp, D. melanogaster
tttaccaattatt

SEQ ID NO: 673125 - DNA, 13 bp, D. melanogaster
tttaccaatttat

SEQ ID NO: 673126 - DNA, 13 bp, D. melanogaster
tttaccaattttc

SEQ ID NO: 673127 - DNA, 13 bp, D. melanogaster
tttaccacaaaaa

SEQ ID NO: 673128 - DNA, 13 bp, D. melanogaster
tttaccacaaata

SEQ ID NO: 673129 - DNA, 13 bp, D. melanogaster
tttaccaggacat

SEQ ID NO: 673130 - DNA, 13 bp, D. melanogaster
tttaccatttatc

SEQ ID NO: 673131 - DNA, 13 bp, D. melanogaster
tttaccatttccc

SEQ ID NO: 673132 - DNA, 13 bp, D. melanogaster
tttaccattttgc

SEQ ID NO: 673133 - DNA, 13 bp, D. melanogaster
tttacccaaaaat

SEQ ID NO: 673134 - DNA, 13 bp, D. melanogaster
tttacccactttt

SEQ ID NO: 673135 - DNA, 13 bp, D. melanogaster
tttacccattttc

SEQ ID NO: 673136 - DNA, 13 bp, D. melanogaster
tttacccgcaata

SEQ ID NO: 673137 - DNA, 13 bp, D. melanogaster
tttaccgacttgt

SEQ ID NO: 673138 - DNA, 13 bp, D. melanogaster
tttaccgcacaaa

SEQ ID NO: 673139 - DNA, 13 bp, D. melanogaster
tttaccgcaccag

SEQ ID NO: 673140 - DNA, 13 bp, D. melanogaster
tttaccgtgctta

SEQ ID NO: 673141 - DNA, 13 bp, D. melanogaster
tttacctacattt

SEQ ID NO: 673142 - DNA, 13 bp, D. melanogaster
tttacctagatga

SEQ ID NO: 673143 - DNA, 13 bp, D. melanogaster
tttacctagttga

SEQ ID NO: 673144 - DNA, 15 bp, D. melanogaster
tttaccttaaacaaa

SEQ ID NO: 673145 - DNA, 13 bp, D. melanogaster
tttaccttatcaa

SEQ ID NO: 673146 - DNA, 13 bp, D. melanogaster
tttacctttaaaa

SEQ ID NO: 673147 - DNA, 13 bp, D. melanogaster
tttacctttaaag

SEQ ID NO: 673148 - DNA, 13 bp, D. melanogaster
tttaccttttaaa

SEQ ID NO: 673149 - DNA, 13 bp, D. melanogaster
tttaccttttcaa

SEQ ID NO: 673150 - DNA, 13 bp, D. melanogaster
tttaccttttgcc

SEQ ID NO: 673151 - DNA, 13 bp, D. melanogaster
tttaccttttggc

SEQ ID NO: 673152 - DNA, 13 bp, D. melanogaster
tttacgaatattt

SEQ ID NO: 673153 - DNA, 13 bp, D. melanogaster
tttacgaattaat

SEQ ID NO: 673154 - DNA, 13 bp, D. melanogaster
tttacgaatttca

SEQ ID NO: 673155 - DNA, 13 bp, D. melanogaster
tttacgacatttt

SEQ ID NO: 673156 - DNA, 13 bp, D. melanogaster
tttacgacttttc

SEQ ID NO: 673157 - DNA, 13 bp, D. melanogaster
tttacgagtatgt

SEQ ID NO: 673158 - DNA, 13 bp, D. melanogaster
tttacgattattt

SEQ ID NO: 673159 - DNA, 13 bp, D. melanogaster
tttacgcaaattt

SEQ ID NO: 673160 - DNA, 14 bp, D. melanogaster
tttacgcacaaatt

SEQ ID NO: 673161 - DNA, 13 bp, D. melanogaster
tttacgccaaaaa

SEQ ID NO: 673162 - DNA, 13 bp, D. melanogaster
tttacgcctgttt

SEQ ID NO: 673163 - DNA, 13 bp, D. melanogaster
tttacgctaaaca

SEQ ID NO: 673164 - DNA, 13 bp, D. melanogaster
tttacgcttaatt

SEQ ID NO: 673165 - DNA, 13 bp, D. melanogaster
tttacggaaaaca

SEQ ID NO: 673166 - DNA, 13 bp, D. melanogaster
tttacggaataca

SEQ ID NO: 673167 - DNA, 13 bp, D. melanogaster
tttacggcttgga

SEQ ID NO: 673168 - DNA, 13 bp, D. melanogaster
tttacgtatttat

SEQ ID NO: 673169 - DNA, 13 bp, D. melanogaster
tttacgtgcatta

SEQ ID NO: 673170 - DNA, 13 bp, D. melanogaster
tttacgtttaaaa

SEQ ID NO: 673171 - DNA, 13 bp, D. melanogaster
tttacgtttaatt

SEQ ID NO: 673172 - DNA, 13 bp, D. melanogaster
tttactaaattac

SEQ ID NO: 673173 - DNA, 13 bp, D. melanogaster
tttactaatcaaa

SEQ ID NO: 673174 - DNA, 13 bp, D. melanogaster
tttactcaaaact

SEQ ID NO: 673175 - DNA, 13 bp, D. melanogaster
tttactcaattta

SEQ ID NO: 673176 - DNA, 13 bp, D. melanogaster
tttactcataaat

SEQ ID NO: 673177 - DNA, 13 bp, D. melanogaster
tttactcgtagag

SEQ ID NO: 673178 - DNA, 13 bp, D. melanogaster
tttactgattttc

SEQ ID NO: 673179 - DNA, 13 bp, D. melanogaster
tttactggaaaat

SEQ ID NO: 673180 - DNA, 13 bp, D. melanogaster
tttactgttgttg

SEQ ID NO: 673181 - DNA, 13 bp, D. melanogaster
tttacttaaaaac

SEQ ID NO: 673182 - DNA, 13 bp, D. melanogaster
tttacttacaaaa

SEQ ID NO: 673183 - DNA, 13 bp, D. melanogaster
tttacttacatat

SEQ ID NO: 673184 - DNA, 13 bp, D. melanogaster
tttacttatcaaa

SEQ ID NO: 673185 - DNA, 13 bp, D. melanogaster
tttacttcaaaaa

SEQ ID NO: 673186 - DNA, 13 bp, D. melanogaster
tttacttcaaaat

SEQ ID NO: 673187 - DNA, 14 bp, D. melanogaster
tttacttgaatcaa

SEQ ID NO: 673188 - DNA, 13 bp, D. melanogaster
tttacttgattta

SEQ ID NO: 673189 - DNA, 13 bp, D. melanogaster
tttacttgcaatt

SEQ ID NO: 673190 - DNA, 13 bp, D. melanogaster
tttacttggaatt

SEQ ID NO: 673191 - DNA, 13 bp, D. melanogaster
tttacttggccaa

SEQ ID NO: 673192 - DNA, 13 bp, D. melanogaster
tttacttggcttt

SEQ ID NO: 673193 - DNA, 13 bp, D. melanogaster
tttacttgggctt

SEQ ID NO: 673194 - DNA, 13 bp, D. melanogaster
tttacttgtttaa

SEQ ID NO: 673195 - DNA, 14 bp, D. melanogaster
tttactttaagttt

SEQ ID NO: 673196 - DNA, 13 bp, D. melanogaster
tttactttatatg

SEQ ID NO: 673197 - DNA, 13 bp, D. melanogaster
tttactttatgaa

SEQ ID NO: 673198 - DNA, 13 bp, D. melanogaster
tttactttcaaaa

SEQ ID NO: 673199 - DNA, 13 bp, D. melanogaster
tttactttcagtg

SEQ ID NO: 673200 - DNA, 13 bp, D. melanogaster
tttactttcagtt

SEQ ID NO: 673201 - DNA, 13 bp, D. melanogaster
tttactttccaaa

SEQ ID NO: 673202 - DNA, 13 bp, D. melanogaster
tttactttcgatt

SEQ ID NO: 673203 - DNA, 13 bp, D. melanogaster
tttactttcgctt

SEQ ID NO: 673204 - DNA, 13 bp, D. melanogaster
tttactttcggtt

SEQ ID NO: 673205 - DNA, 13 bp, D. melanogaster
tttactttgaaat

SEQ ID NO: 673206 - DNA, 13 bp, D. melanogaster
tttactttgacca

SEQ ID NO: 673207 - DNA, 13 bp, D. melanogaster
tttactttgatta

SEQ ID NO: 673208 - DNA, 14 bp, D. melanogaster
tttactttgcattt

SEQ ID NO: 673209 - DNA, 13 bp, D. melanogaster
tttactttggcaa

SEQ ID NO: 673210 - DNA, 13 bp, D. melanogaster
tttactttggctt

SEQ ID NO: 673211 - DNA, 13 bp, D. melanogaster
tttactttgtaat

SEQ ID NO: 673212 - DNA, 13 bp, D. melanogaster
tttacttttcgtg

SEQ ID NO: 673213 - DNA, 13 bp, D. melanogaster
tttactttttgca

SEQ ID NO: 673214 - DNA, 14 bp, D. melanogaster
tttactttttggca

SEQ ID NO: 673215 - DNA, 13 bp, D. melanogaster
tttagaaaaatac

SEQ ID NO: 673216 - DNA, 13 bp, D. melanogaster
tttagaaagcaaa

SEQ ID NO: 673217 - DNA, 13 bp, D. melanogaster
tttagaaagtatt

SEQ ID NO: 673218 - DNA, 13 bp, D. melanogaster
tttagaaagtttt

SEQ ID NO: 673219 - DNA, 13 bp, D. melanogaster
tttagaaatagtc

SEQ ID NO: 673220 - DNA, 13 bp, D. melanogaster
tttagaaatatgt

SEQ ID NO: 673221 - DNA, 15 bp, D. melanogaster
tttagaaatcttgaa

SEQ ID NO: 673222 - DNA, 13 bp, D. melanogaster
tttagaaatgcaa

SEQ ID NO: 673223 - DNA, 13 bp, D. melanogaster
tttagaaattgaa

SEQ ID NO: 673224 - DNA, 14 bp, D. melanogaster
tttagaaattgaag

SEQ ID NO: 673225 - DNA, 14 bp, D. melanogaster
tttagaacaacttt

SEQ ID NO: 673226 - DNA, 13 bp, D. melanogaster
tttagaacaattt

SEQ ID NO: 673227 - DNA, 13 bp, D. melanogaster
tttagaagagtat

SEQ ID NO: 673228 - DNA, 14 bp, D. melanogaster
tttagaagatcaac

SEQ ID NO: 673229 - DNA, 13 bp, D. melanogaster
tttagaagtatgc

SEQ ID NO: 673230 - DNA, 13 bp, D. melanogaster
tttagaagtattt

SEQ ID NO: 673231 - DNA, 13 bp, D. melanogaster
tttagaatccaat

SEQ ID NO: 673232 - DNA, 13 bp, D. melanogaster
tttagaatttaga

SEQ ID NO: 673233 - DNA, 13 bp, D. melanogaster
tttagaatttatg

SEQ ID NO: 673234 - DNA, 13 bp, D. melanogaster
tttagaatttctt

SEQ ID NO: 673235 - DNA, 13 bp, D. melanogaster
tttagacagtatt

SEQ ID NO: 673236 - DNA, 13 bp, D. melanogaster
tttagagataaga

SEQ ID NO: 673237 - DNA, 13 bp, D. melanogaster
tttagagattgac

SEQ ID NO: 673238 - DNA, 13 bp, D. melanogaster
tttagataagaaa

SEQ ID NO: 673239 - DNA, 13 bp, D. melanogaster
tttagatacaaat

SEQ ID NO: 673240 - DNA, 13 bp, D. melanogaster
tttagatacattt

SEQ ID NO: 673241 - DNA, 13 bp, D. melanogaster
tttagatcaaatg

SEQ ID NO: 673242 - DNA, 14 bp, D. melanogaster
tttagatcaaatgt

SEQ ID NO: 673243 - DNA, 13 bp, D. melanogaster
tttagatcaattt

SEQ ID NO: 673244 - DNA, 13 bp, D. melanogaster
tttagatgatttg

SEQ ID NO: 673245 - DNA, 13 bp, D. melanogaster
tttagattgaaaa

SEQ ID NO: 673246 - DNA, 13 bp, D. melanogaster
tttagatttaggt

SEQ ID NO: 673247 - DNA, 14 bp, D. melanogaster
tttagatttaggtt

SEQ ID NO: 673248 - DNA, 13 bp, D. melanogaster
tttagatttctta

SEQ ID NO: 673249 - DNA, 17 bp, D. melanogaster
tttagatttcttacgct

SEQ ID NO: 673250 - DNA, 13 bp, D. melanogaster
tttagcaaaaaca

SEQ ID NO: 673251 - DNA, 13 bp, D. melanogaster
tttagcaaatcga

SEQ ID NO: 673252 - DNA, 13 bp, D. melanogaster
tttagcaaattaa

SEQ ID NO: 673253 - DNA, 13 bp, D. melanogaster
tttagcaaattat

SEQ ID NO: 673254 - DNA, 13 bp, D. melanogaster
tttagcaaatttt

SEQ ID NO: 673255 - DNA, 13 bp, D. melanogaster
tttagcaacaaca

SEQ ID NO: 673256 - DNA, 13 bp, D. melanogaster
tttagcaagtttg

SEQ ID NO: 673257 - DNA, 13 bp, D. melanogaster
tttagcaataaaa

SEQ ID NO: 673258 - DNA, 13 bp, D. melanogaster
tttagcaatttgt

SEQ ID NO: 673259 - DNA, 13 bp, D. melanogaster
tttagcaattttt

SEQ ID NO: 673260 - DNA, 14 bp, D. melanogaster
tttagcacttttat

SEQ ID NO: 673261 - DNA, 13 bp, D. melanogaster
tttagcataattt

SEQ ID NO: 673262 - DNA, 13 bp, D. melanogaster
tttagcatacaaa

SEQ ID NO: 673263 - DNA, 13 bp, D. melanogaster
tttagcatagaaa

SEQ ID NO: 673264 - DNA, 13 bp, D. melanogaster
tttagcatatatt

SEQ ID NO: 673265 - DNA, 13 bp, D. melanogaster
tttagcatatttt

SEQ ID NO: 673266 - DNA, 13 bp, D. melanogaster
tttagcatccagg

SEQ ID NO: 673267 - DNA, 13 bp, D. melanogaster
tttagcattaatt

SEQ ID NO: 673268 - DNA, 13 bp, D. melanogaster
tttagcatttaac

SEQ ID NO: 673269 - DNA, 14 bp, D. melanogaster
tttagcatttaatt

SEQ ID NO: 673270 - DNA, 13 bp, D. melanogaster
tttagcattttct

SEQ ID NO: 673271 - DNA, 13 bp, D. melanogaster
tttagcattttta

SEQ ID NO: 673272 - DNA, 13 bp, D. melanogaster
tttagccaaaaag

SEQ ID NO: 673273 - DNA, 13 bp, D. melanogaster
tttagccaaatta

SEQ ID NO: 673274 - DNA, 13 bp, D. melanogaster
tttagccaaattg

SEQ ID NO: 673275 - DNA, 13 bp, D. melanogaster
tttagccaagtta

SEQ ID NO: 673276 - DNA, 13 bp, D. melanogaster
tttagccaagttt

SEQ ID NO: 673277 - DNA, 13 bp, D. melanogaster
tttagccaataaa

SEQ ID NO: 673278 - DNA, 13 bp, D. melanogaster
tttagccaattta

SEQ ID NO: 673279 - DNA, 13 bp, D. melanogaster
tttagccacattt

SEQ ID NO: 673280 - DNA, 13 bp, D. melanogaster
tttagccagattt

SEQ ID NO: 673281 - DNA, 13 bp, D. melanogaster
tttagccataaat

SEQ ID NO: 673282 - DNA, 13 bp, D. melanogaster
tttagccattgtt

SEQ ID NO: 673283 - DNA, 13 bp, D. melanogaster
tttagcccacttt

SEQ ID NO: 673284 - DNA, 30 bp, D. melanogaster
tttagccgccgtttacagaagttaatattc

SEQ ID NO: 673285 - DNA, 13 bp, D. melanogaster
tttagcctgagca

SEQ ID NO: 673286 - DNA, 13 bp, D. melanogaster
tttagccttgtcc

SEQ ID NO: 673287 - DNA, 13 bp, D. melanogaster
tttagctaaatta

SEQ ID NO: 673288 - DNA, 13 bp, D. melanogaster
tttagctattttc

SEQ ID NO: 673289 - DNA, 13 bp, D. melanogaster
tttagctcgacct

SEQ ID NO: 673290 - DNA, 13 bp, D. melanogaster
tttagctcgttta

SEQ ID NO: 673291 - DNA, 13 bp, D. melanogaster
tttagctgattta

SEQ ID NO: 673292 - DNA, 13 bp, D. melanogaster
tttagctgcagtt

SEQ ID NO: 673293 - DNA, 13 bp, D. melanogaster
tttagctgcattt

SEQ ID NO: 673294 - DNA, 13 bp, D. melanogaster
tttagctgctttt

SEQ ID NO: 673295 - DNA, 13 bp, D. melanogaster
tttagctggaaaa

SEQ ID NO: 673296 - DNA, 13 bp, D. melanogaster
tttagctggaaat

SEQ ID NO: 673297 - DNA, 13 bp, D. melanogaster
tttagctggccaa

SEQ ID NO: 673298 - DNA, 13 bp, D. melanogaster
tttagctgttgtt

SEQ ID NO: 673299 - DNA, 13 bp, D. melanogaster
tttagcttaaaaa

SEQ ID NO: 673300 - DNA, 13 bp, D. melanogaster
tttagcttcagct

SEQ ID NO: 673301 - DNA, 13 bp, D. melanogaster
tttagcttgattt

SEQ ID NO: 673302 - DNA, 13 bp, D. melanogaster
tttagctttaact

SEQ ID NO: 673303 - DNA, 13 bp, D. melanogaster
tttagctttagct

SEQ ID NO: 673304 - DNA, 14 bp, D. melanogaster
tttagctttagctt

SEQ ID NO: 673305 - DNA, 13 bp, D. melanogaster
tttagctttatat

SEQ ID NO: 673306 - DNA, 13 bp, D. melanogaster
tttagctttgatt

SEQ ID NO: 673307 - DNA, 13 bp, D. melanogaster
tttagctttgctt

SEQ ID NO: 673308 - DNA, 14 bp, D. melanogaster
tttagctttggctt

SEQ ID NO: 673309 - DNA, 13 bp, D. melanogaster
tttagcttttcaa

SEQ ID NO: 673310 - DNA, 13 bp, D. melanogaster
tttaggaaatata

SEQ ID NO: 673311 - DNA, 13 bp, D. melanogaster
tttaggaatttaa

SEQ ID NO: 673312 - DNA, 13 bp, D. melanogaster
tttaggcaaattg

SEQ ID NO: 673313 - DNA, 13 bp, D. melanogaster
tttagggacagtg

SEQ ID NO: 673314 - DNA, 14 bp, D. melanogaster
tttagtaaatatca

SEQ ID NO: 673315 - DNA, 13 bp, D. melanogaster
tttagtaactatt

SEQ ID NO: 673316 - DNA, 13 bp, D. melanogaster
tttagtaagaaaa

SEQ ID NO: 673317 - DNA, 13 bp, D. melanogaster
tttagtaagttct

SEQ ID NO: 673318 - DNA, 13 bp, D. melanogaster
tttagtacttaaa

SEQ ID NO: 673319 - DNA, 13 bp, D. melanogaster
tttagtagataaa

SEQ ID NO: 673320 - DNA, 13 bp, D. melanogaster
tttagtagttttc

SEQ ID NO: 673321 - DNA, 13 bp, D. melanogaster
tttagtatagctt

SEQ ID NO: 673322 - DNA, 13 bp, D. melanogaster
tttagtattttca

SEQ ID NO: 673323 - DNA, 13 bp, D. melanogaster
tttagtcacattt

SEQ ID NO: 673324 - DNA, 13 bp, D. melanogaster
tttagtcactgca

SEQ ID NO: 673325 - DNA, 13 bp, D. melanogaster
tttagtctttaaa

SEQ ID NO: 673326 - DNA, 13 bp, D. melanogaster
tttagtgactttc

SEQ ID NO: 673327 - DNA, 14 bp, D. melanogaster
tttagtgatacaaa

SEQ ID NO: 673328 - DNA, 13 bp, D. melanogaster
tttagtgcaaatt

SEQ ID NO: 673329 - DNA, 13 bp, D. melanogaster
tttagtgcaattt

SEQ ID NO: 673330 - DNA, 13 bp, D. melanogaster
tttagtggcaatt

SEQ ID NO: 673331 - DNA, 13 bp, D. melanogaster
tttagtggcattt

SEQ ID NO: 673332 - DNA, 13 bp, D. melanogaster
tttagtgtattca

SEQ ID NO: 673333 - DNA, 13 bp, D. melanogaster
tttagttaaatca

SEQ ID NO: 673334 - DNA, 13 bp, D. melanogaster
tttagttaacttt

SEQ ID NO: 673335 - DNA, 13 bp, D. melanogaster
tttagttaagcaa

SEQ ID NO: 673336 - DNA, 13 bp, D. melanogaster
tttagttaagtta

SEQ ID NO: 673337 - DNA, 13 bp, D. melanogaster
tttagttaattca

SEQ ID NO: 673338 - DNA, 13 bp, D. melanogaster
tttagttacttat

SEQ ID NO: 673339 - DNA, 13 bp, D. melanogaster
tttagttcaaata

SEQ ID NO: 673340 - DNA, 13 bp, D. melanogaster
tttagttcagttt

SEQ ID NO: 673341 - DNA, 13 bp, D. melanogaster
tttagttcattta

SEQ ID NO: 673342 - DNA, 13 bp, D. melanogaster
tttagttgaaatt

SEQ ID NO: 673343 - DNA, 14 bp, D. melanogaster
tttagttgccattt

SEQ ID NO: 673344 - DNA, 13 bp, D. melanogaster
tttagttgctatt

SEQ ID NO: 673345 - DNA, 13 bp, D. melanogaster
tttagttggccaa

SEQ ID NO: 673346 - DNA, 13 bp, D. melanogaster
tttagttggcttt

SEQ ID NO: 673347 - DNA, 13 bp, D. melanogaster
tttagttgtaact

SEQ ID NO: 673348 - DNA, 14 bp, D. melanogaster
tttagttgtaactt

SEQ ID NO: 673349 - DNA, 13 bp, D. melanogaster
tttagtttaaaac

SEQ ID NO: 673350 - DNA, 13 bp, D. melanogaster
tttagtttaaaca

SEQ ID NO: 673351 - DNA, 13 bp, D. melanogaster
tttagtttacaat

SEQ ID NO: 673352 - DNA, 13 bp, D. melanogaster
tttagtttagttc

SEQ ID NO: 673353 - DNA, 14 bp, D. melanogaster
tttagtttagtttc

SEQ ID NO: 673354 - DNA, 13 bp, D. melanogaster
tttagtttattgc

SEQ ID NO: 673355 - DNA, 13 bp, D. melanogaster
tttagtttcagtt

SEQ ID NO: 673356 - DNA, 13 bp, D. melanogaster
tttagtttcgaaa

SEQ ID NO: 673357 - DNA, 13 bp, D. melanogaster
tttagtttgcgtt

SEQ ID NO: 673358 - DNA, 13 bp, D. melanogaster
tttagtttggcaa

SEQ ID NO: 673359 - DNA, 13 bp, D. melanogaster
tttagtttgtaaa

SEQ ID NO: 673360 - DNA, 13 bp, D. melanogaster
tttagtttgtgca

SEQ ID NO: 673361 - DNA, 14 bp, D. melanogaster
tttagttttaaaag

SEQ ID NO: 673362 - DNA, 13 bp, D. melanogaster
tttagttttaaac

SEQ ID NO: 673363 - DNA, 13 bp, D. melanogaster
tttagttttcaat

SEQ ID NO: 673364 - DNA, 13 bp, D. melanogaster
tttagttttcagc

SEQ ID NO: 673365 - DNA, 13 bp, D. melanogaster
tttagttttcagt

SEQ ID NO: 673366 - DNA, 14 bp, D. melanogaster
tttagttttcagtt

SEQ ID NO: 673367 - DNA, 13 bp, D. melanogaster
tttagttttcata

SEQ ID NO: 673368 - DNA, 13 bp, D. melanogaster
tttagttttccca

SEQ ID NO: 673369 - DNA, 13 bp, D. melanogaster
tttagttttcggt

SEQ ID NO: 673370 - DNA, 13 bp, D. melanogaster
tttagttttctaa

SEQ ID NO: 673371 - DNA, 13 bp, D. melanogaster
tttagttttgaaa

SEQ ID NO: 673372 - DNA, 13 bp, D. melanogaster
tttagtttttggc

SEQ ID NO: 673373 - DNA, 13 bp, D. melanogaster
tttataaaacaca

SEQ ID NO: 673374 - DNA, 13 bp, D. melanogaster
tttataaaagcag

SEQ ID NO: 673375 - DNA, 13 bp, D. melanogaster
tttataaacaaac

SEQ ID NO: 673376 - DNA, 13 bp, D. melanogaster
tttataaacaaag

SEQ ID NO: 673377 - DNA, 13 bp, D. melanogaster
tttataaacaatc

SEQ ID NO: 673378 - DNA, 13 bp, D. melanogaster
tttataaacacaa

SEQ ID NO: 673379 - DNA, 13 bp, D. melanogaster
tttataaactctt

SEQ ID NO: 673380 - DNA, 13 bp, D. melanogaster
tttataaaggaaa

SEQ ID NO: 673381 - DNA, 13 bp, D. melanogaster
tttataaagtcaa

SEQ ID NO: 673382 - DNA, 13 bp, D. melanogaster
tttataaatgcat

SEQ ID NO: 673383 - DNA, 13 bp, D. melanogaster
tttataaatggat

SEQ ID NO: 673384 - DNA, 13 bp, D. melanogaster
tttataaccattt

SEQ ID NO: 673385 - DNA, 13 bp, D. melanogaster
tttataacgaaaa

SEQ ID NO: 673386 - DNA, 13 bp, D. melanogaster
tttataactgatc

SEQ ID NO: 673387 - DNA, 13 bp, D. melanogaster
tttataacttcaa

SEQ ID NO: 673388 - DNA, 13 bp, D. melanogaster
tttataacttcat

SEQ ID NO: 673389 - DNA, 13 bp, D. melanogaster
tttataagcaaac

SEQ ID NO: 673390 - DNA, 13 bp, D. melanogaster
tttataagcactt

SEQ ID NO: 673391 - DNA, 13 bp, D. melanogaster
tttataagccaca

SEQ ID NO: 673392 - DNA, 13 bp, D. melanogaster
tttataagctttt

SEQ ID NO: 673393 - DNA, 13 bp, D. melanogaster
tttataaggaatc

SEQ ID NO: 673394 - DNA, 13 bp, D. melanogaster
tttataagtgaaa

SEQ ID NO: 673395 - DNA, 13 bp, D. melanogaster
tttataagtttac

SEQ ID NO: 673396 - DNA, 13 bp, D. melanogaster
tttataatgcaaa

SEQ ID NO: 673397 - DNA, 13 bp, D. melanogaster
tttataatgccca

SEQ ID NO: 673398 - DNA, 14 bp, D. melanogaster
tttataatgcccaa

SEQ ID NO: 673399 - DNA, 13 bp, D. melanogaster
tttataatgcttt

SEQ ID NO: 673400 - DNA, 13 bp, D. melanogaster
tttataatggaaa

SEQ ID NO: 673401 - DNA, 13 bp, D. melanogaster
tttataatggtac

SEQ ID NO: 673402 - DNA, 13 bp, D. melanogaster
tttataatgtttc

SEQ ID NO: 673403 - DNA, 13 bp, D. melanogaster
tttataattccat

SEQ ID NO: 673404 - DNA, 13 bp, D. melanogaster
tttataattggaa

SEQ ID NO: 673405 - DNA, 13 bp, D. melanogaster
tttataatttccc

SEQ ID NO: 673406 - DNA, 13 bp, D. melanogaster
tttataattttcg

SEQ ID NO: 673407 - DNA, 13 bp, D. melanogaster
tttatacaaaatg

SEQ ID NO: 673408 - DNA, 13 bp, D. melanogaster
tttatacaatttg

SEQ ID NO: 673409 - DNA, 13 bp, D. melanogaster
tttatacacataa

SEQ ID NO: 673410 - DNA, 13 bp, D. melanogaster
tttatacacatat

SEQ ID NO: 673411 - DNA, 13 bp, D. melanogaster
tttatacactttg

SEQ ID NO: 673412 - DNA, 13 bp, D. melanogaster
tttatacatacat

SEQ ID NO: 673413 - DNA, 14 bp, D. melanogaster
tttatacatatttg

SEQ ID NO: 673414 - DNA, 13 bp, D. melanogaster
tttatacatgttt

SEQ ID NO: 673415 - DNA, 13 bp, D. melanogaster
tttatacatttac

SEQ ID NO: 673416 - DNA, 13 bp, D. melanogaster
tttatacattttg

SEQ ID NO: 673417 - DNA, 13 bp, D. melanogaster
tttataccaatta

SEQ ID NO: 673418 - DNA, 13 bp, D. melanogaster
tttatacccatta

SEQ ID NO: 673419 - DNA, 13 bp, D. melanogaster
tttatacccattt

SEQ ID NO: 673420 - DNA, 13 bp, D. melanogaster
tttatacccctta

SEQ ID NO: 673421 - DNA, 13 bp, D. melanogaster
tttatacctatat

SEQ ID NO: 673422 - DNA, 13 bp, D. melanogaster
tttatacgttttg

SEQ ID NO: 673423 - DNA, 13 bp, D. melanogaster
tttatactaatgg

SEQ ID NO: 673424 - DNA, 13 bp, D. melanogaster
tttatagaaactt

SEQ ID NO: 673425 - DNA, 13 bp, D. melanogaster
tttatagaacttt

SEQ ID NO: 673426 - DNA, 13 bp, D. melanogaster
tttatagacaaat

SEQ ID NO: 673427 - DNA, 13 bp, D. melanogaster
tttatagactttt

SEQ ID NO: 673428 - DNA, 13 bp, D. melanogaster
tttatagcaattt

SEQ ID NO: 673429 - DNA, 13 bp, D. melanogaster
tttatagcattta

SEQ ID NO: 673430 - DNA, 13 bp, D. melanogaster
tttatagcatttt

SEQ ID NO: 673431 - DNA, 13 bp, D. melanogaster
tttatagccaatt

SEQ ID NO: 673432 - DNA, 13 bp, D. melanogaster
tttatagccacaa

SEQ ID NO: 673433 - DNA, 13 bp, D. melanogaster
tttatagcgacaa

SEQ ID NO: 673434 - DNA, 13 bp, D. melanogaster
tttatagctttaa

SEQ ID NO: 673435 - DNA, 13 bp, D. melanogaster
tttataggattta

SEQ ID NO: 673436 - DNA, 13 bp, D. melanogaster
tttataggcaaat

SEQ ID NO: 673437 - DNA, 14 bp, D. melanogaster
tttatagtgacaaa

SEQ ID NO: 673438 - DNA, 13 bp, D. melanogaster
tttatagttacat

SEQ ID NO: 673439 - DNA, 13 bp, D. melanogaster
tttatagttcaaa

SEQ ID NO: 673440 - DNA, 13 bp, D. melanogaster
tttatagtttcta

SEQ ID NO: 673441 - DNA, 13 bp, D. melanogaster
tttatagtttgcc

SEQ ID NO: 673442 - DNA, 13 bp, D. melanogaster
tttatagttttac

SEQ ID NO: 673443 - DNA, 14 bp, D. melanogaster
tttatagttttaca

SEQ ID NO: 673444 - DNA, 13 bp, D. melanogaster
tttatagttttgc

SEQ ID NO: 673445 - DNA, 13 bp, D. melanogaster
tttatatacaaac

SEQ ID NO: 673446 - DNA, 13 bp, D. melanogaster
tttatatacatac

SEQ ID NO: 673447 - DNA, 14 bp, D. melanogaster
tttatatacataca

SEQ ID NO: 673448 - DNA, 13 bp, D. melanogaster
tttatatacattc

SEQ ID NO: 673449 - DNA, 13 bp, D. melanogaster
tttatataccaat

SEQ ID NO: 673450 - DNA, 13 bp, D. melanogaster
tttatatacgtat

SEQ ID NO: 673451 - DNA, 14 bp, D. melanogaster
tttatatacgtata

SEQ ID NO: 673452 - DNA, 13 bp, D. melanogaster
tttatatactatg

SEQ ID NO: 673453 - DNA, 13 bp, D. melanogaster
tttatatagaccg

SEQ ID NO: 673454 - DNA, 13 bp, D. melanogaster
tttatatagcaaa

SEQ ID NO: 673455 - DNA, 14 bp, D. melanogaster
tttatatagtcgga

SEQ ID NO: 673456 - DNA, 13 bp, D. melanogaster
tttatatatcgat

SEQ ID NO: 673457 - DNA, 13 bp, D. melanogaster
tttatatatgcaa

SEQ ID NO: 673458 - DNA, 13 bp, D. melanogaster
tttatatatttcg

SEQ ID NO: 673459 - DNA, 13 bp, D. melanogaster
tttatatatttgc

SEQ ID NO: 673460 - DNA, 13 bp, D. melanogaster
tttatatctgtgg

SEQ ID NO: 673461 - DNA, 13 bp, D. melanogaster
tttatatctgtgt

SEQ ID NO: 673462 - DNA, 13 bp, D. melanogaster
tttatatgaaaca

SEQ ID NO: 673463 - DNA, 13 bp, D. melanogaster
tttatatgcaaat

SEQ ID NO: 673464 - DNA, 13 bp, D. melanogaster
tttatatgcattg

SEQ ID NO: 673465 - DNA, 13 bp, D. melanogaster
tttatatgcattt

SEQ ID NO: 673466 - DNA, 14 bp, D. melanogaster
tttatatgctattt

SEQ ID NO: 673467 - DNA, 13 bp, D. melanogaster
tttatatggaaat

SEQ ID NO: 673468 - DNA, 13 bp, D. melanogaster
tttatatggaatt

SEQ ID NO: 673469 - DNA, 13 bp, D. melanogaster
tttatatggcata

SEQ ID NO: 673470 - DNA, 13 bp, D. melanogaster
tttatatggccaa

SEQ ID NO: 673471 - DNA, 13 bp, D. melanogaster
tttatatggccat

SEQ ID NO: 673472 - DNA, 13 bp, D. melanogaster
tttatatggttgg

SEQ ID NO: 673473 - DNA, 13 bp, D. melanogaster
tttatattccaaa

SEQ ID NO: 673474 - DNA, 13 bp, D. melanogaster
tttatattcgaaa

SEQ ID NO: 673475 - DNA, 13 bp, D. melanogaster
tttatattctgta

SEQ ID NO: 673476 - DNA, 13 bp, D. melanogaster
tttatattgcatt

SEQ ID NO: 673477 - DNA, 13 bp, D. melanogaster
tttatattgccca

SEQ ID NO: 673478 - DNA, 13 bp, D. melanogaster
tttatattgtaga

SEQ ID NO: 673479 - DNA, 13 bp, D. melanogaster
tttatattgtggc

SEQ ID NO: 673480 - DNA, 13 bp, D. melanogaster
tttatatttactg

SEQ ID NO: 673481 - DNA, 13 bp, D. melanogaster
tttatatttatgc

SEQ ID NO: 673482 - DNA, 13 bp, D. melanogaster
tttatatttcgaa

SEQ ID NO: 673483 - DNA, 13 bp, D. melanogaster
tttatattttccg

SEQ ID NO: 673484 - DNA, 13 bp, D. melanogaster
tttatcaaaaaga

SEQ ID NO: 673485 - DNA, 13 bp, D. melanogaster
tttatcaaaagtt

SEQ ID NO: 673486 - DNA, 13 bp, D. melanogaster
tttatcaaaatca

SEQ ID NO: 673487 - DNA, 13 bp, D. melanogaster
tttatcaaacaaa

SEQ ID NO: 673488 - DNA, 13 bp, D. melanogaster
tttatcaaacttt

SEQ ID NO: 673489 - DNA, 13 bp, D. melanogaster
tttatcaaatgaa

SEQ ID NO: 673490 - DNA, 13 bp, D. melanogaster
tttatcaaatgtt

SEQ ID NO: 673491 - DNA, 13 bp, D. melanogaster
tttatcaacaatt

SEQ ID NO: 673492 - DNA, 13 bp, D. melanogaster
tttatcaagaaat

SEQ ID NO: 673493 - DNA, 13 bp, D. melanogaster
tttatcaagattt

SEQ ID NO: 673494 - DNA, 13 bp, D. melanogaster
tttatcaagtatc

SEQ ID NO: 673495 - DNA, 13 bp, D. melanogaster
tttatcaagtttt

SEQ ID NO: 673496 - DNA, 13 bp, D. melanogaster
tttatcaatcaaa

SEQ ID NO: 673497 - DNA, 13 bp, D. melanogaster
tttatcaatcgta

SEQ ID NO: 673498 - DNA, 13 bp, D. melanogaster
tttatcaatgaaa

SEQ ID NO: 673499 - DNA, 13 bp, D. melanogaster
tttatcaatggca

SEQ ID NO: 673500 - DNA, 13 bp, D. melanogaster
tttatcagcattt

SEQ ID NO: 673501 - DNA, 13 bp, D. melanogaster
tttatcagtttat

SEQ ID NO: 673502 - DNA, 13 bp, D. melanogaster
tttatcataactt

SEQ ID NO: 673503 - DNA, 13 bp, D. melanogaster
tttatcatcaatt

SEQ ID NO: 673504 - DNA, 13 bp, D. melanogaster
tttatcatcagat

SEQ ID NO: 673505 - DNA, 13 bp, D. melanogaster
tttatcatttaca

SEQ ID NO: 673506 - DNA, 13 bp, D. melanogaster
tttatcatttgcc

SEQ ID NO: 673507 - DNA, 13 bp, D. melanogaster
tttatcatttgct

SEQ ID NO: 673508 - DNA, 13 bp, D. melanogaster
tttatccaaacta

SEQ ID NO: 673509 - DNA, 14 bp, D. melanogaster
tttatccaaagttt

SEQ ID NO: 673510 - DNA, 13 bp, D. melanogaster
tttatccatctct

SEQ ID NO: 673511 - DNA, 13 bp, D. melanogaster
tttatccattgtt

SEQ ID NO: 673512 - DNA, 13 bp, D. melanogaster
tttatccattttg

SEQ ID NO: 673513 - DNA, 13 bp, D. melanogaster
tttatcccaaaaa

SEQ ID NO: 673514 - DNA, 13 bp, D. melanogaster
tttatccgcgact

SEQ ID NO: 673515 - DNA, 13 bp, D. melanogaster
tttatcgaattta

SEQ ID NO: 673516 - DNA, 13 bp, D. melanogaster
tttatcgatttct

SEQ ID NO: 673517 - DNA, 13 bp, D. melanogaster
tttatcgatttgc

SEQ ID NO: 673518 - DNA, 13 bp, D. melanogaster
tttatcgatttta

SEQ ID NO: 673519 - DNA, 13 bp, D. melanogaster
tttatcgctctcg

SEQ ID NO: 673520 - DNA, 13 bp, D. melanogaster
tttatcgcttttc

SEQ ID NO: 673521 - DNA, 13 bp, D. melanogaster
tttatcgtattta

SEQ ID NO: 673522 - DNA, 14 bp, D. melanogaster
tttatcgttgcctt

SEQ ID NO: 673523 - DNA, 13 bp, D. melanogaster
tttatcgtttatc

SEQ ID NO: 673524 - DNA, 13 bp, D. melanogaster
tttatcgtttgcc

SEQ ID NO: 673525 - DNA, 14 bp, D. melanogaster
tttatctattgaaa

SEQ ID NO: 673526 - DNA, 13 bp, D. melanogaster
tttatctgcaagt

SEQ ID NO: 673527 - DNA, 13 bp, D. melanogaster
tttatctgcattt

SEQ ID NO: 673528 - DNA, 13 bp, D. melanogaster
tttatcttaaact

SEQ ID NO: 673529 - DNA, 13 bp, D. melanogaster
tttatcttaaaga

SEQ ID NO: 673530 - DNA, 13 bp, D. melanogaster
tttatcttcctgc

SEQ ID NO: 673531 - DNA, 13 bp, D. melanogaster
tttatcttgaatt

SEQ ID NO: 673532 - DNA, 13 bp, D. melanogaster
tttatctttggca

SEQ ID NO: 673533 - DNA, 13 bp, D. melanogaster
tttatcttttggc

SEQ ID NO: 673534 - DNA, 13 bp, D. melanogaster
tttatgaaaacaa

SEQ ID NO: 673535 - DNA, 13 bp, D. melanogaster
tttatgaaaacta

SEQ ID NO: 673536 - DNA, 13 bp, D. melanogaster
tttatgaaaactg

SEQ ID NO: 673537 - DNA, 13 bp, D. melanogaster
tttatgaaaatga

SEQ ID NO: 673538 - DNA, 13 bp, D. melanogaster
tttatgaaagaag

SEQ ID NO: 673539 - DNA, 13 bp, D. melanogaster
tttatgaaagagg

SEQ ID NO: 673540 - DNA, 13 bp, D. melanogaster
tttatgaaagtat

SEQ ID NO: 673541 - DNA, 13 bp, D. melanogaster
tttatgaaatact

SEQ ID NO: 673542 - DNA, 13 bp, D. melanogaster
tttatgaaatcat

SEQ ID NO: 673543 - DNA, 13 bp, D. melanogaster
tttatgaaatgaa

SEQ ID NO: 673544 - DNA, 13 bp, D. melanogaster
tttatgaaattcc

SEQ ID NO: 673545 - DNA, 13 bp, D. melanogaster
tttatgaacaatt

SEQ ID NO: 673546 - DNA, 13 bp, D. melanogaster
tttatgaacgaaa

SEQ ID NO: 673547 - DNA, 13 bp, D. melanogaster
tttatgaacttta

SEQ ID NO: 673548 - DNA, 13 bp, D. melanogaster
tttatgaactttt

SEQ ID NO: 673549 - DNA, 13 bp, D. melanogaster
tttatgaagacca

SEQ ID NO: 673550 - DNA, 14 bp, D. melanogaster
tttatgaagaggaa

SEQ ID NO: 673551 - DNA, 13 bp, D. melanogaster
tttatgaatactt

SEQ ID NO: 673552 - DNA, 13 bp, D. melanogaster
tttatgaatatga

SEQ ID NO: 673553 - DNA, 13 bp, D. melanogaster
tttatgaatgaaa

SEQ ID NO: 673554 - DNA, 14 bp, D. melanogaster
tttatgaatgaaat

SEQ ID NO: 673555 - DNA, 13 bp, D. melanogaster
tttatgaattcaa

SEQ ID NO: 673556 - DNA, 13 bp, D. melanogaster
tttatgacaattt

SEQ ID NO: 673557 - DNA, 13 bp, D. melanogaster
tttatgacattat

SEQ ID NO: 673558 - DNA, 13 bp, D. melanogaster
tttatgaccattt

SEQ ID NO: 673559 - DNA, 13 bp, D. melanogaster
tttatgactggtt

SEQ ID NO: 673560 - DNA, 13 bp, D. melanogaster
tttatgacttcat

SEQ ID NO: 673561 - DNA, 13 bp, D. melanogaster
tttatgagcagcc

SEQ ID NO: 673562 - DNA, 14 bp, D. melanogaster
tttatgagcagcca

SEQ ID NO: 673563 - DNA, 13 bp, D. melanogaster
tttatgagcattt

SEQ ID NO: 673564 - DNA, 13 bp, D. melanogaster
tttatgataaatg

SEQ ID NO: 673565 - DNA, 13 bp, D. melanogaster
tttatgatatgat

SEQ ID NO: 673566 - DNA, 13 bp, D. melanogaster
tttatgatgatga

SEQ ID NO: 673567 - DNA, 13 bp, D. melanogaster
tttatgatgctgt

SEQ ID NO: 673568 - DNA, 13 bp, D. melanogaster
tttatgattatga

SEQ ID NO: 673569 - DNA, 13 bp, D. melanogaster
tttatgattgaaa

SEQ ID NO: 673570 - DNA, 13 bp, D. melanogaster
tttatgatttcaa

SEQ ID NO: 673571 - DNA, 13 bp, D. melanogaster
tttatgattttcc

SEQ ID NO: 673572 - DNA, 13 bp, D. melanogaster
tttatgcaaaaaa

SEQ ID NO: 673573 - DNA, 13 bp, D. melanogaster
tttatgcaaaaat

SEQ ID NO: 673574 - DNA, 13 bp, D. melanogaster
tttatgcaaaagc

SEQ ID NO: 673575 - DNA, 13 bp, D. melanogaster
tttatgcaaaagt

SEQ ID NO: 673576 - DNA, 13 bp, D. melanogaster
tttatgcaaaatc

SEQ ID NO: 673577 - DNA, 14 bp, D. melanogaster
tttatgcaaatatt

SEQ ID NO: 673578 - DNA, 13 bp, D. melanogaster
tttatgcaaatca

SEQ ID NO: 673579 - DNA, 14 bp, D. melanogaster
tttatgcaaatcaa

SEQ ID NO: 673580 - DNA, 13 bp, D. melanogaster
tttatgcaaatcg

SEQ ID NO: 673581 - DNA, 13 bp, D. melanogaster
tttatgcaaattc

SEQ ID NO: 673582 - DNA, 13 bp, D. melanogaster
tttatgcaaattg

SEQ ID NO: 673583 - DNA, 14 bp, D. melanogaster
tttatgcaaattgt

SEQ ID NO: 673584 - DNA, 13 bp, D. melanogaster
tttatgcaacaat

SEQ ID NO: 673585 - DNA, 13 bp, D. melanogaster
tttatgcaacttt

SEQ ID NO: 673586 - DNA, 14 bp, D. melanogaster
tttatgcaatgcaa

SEQ ID NO: 673587 - DNA, 13 bp, D. melanogaster
tttatgcaattat

SEQ ID NO: 673588 - DNA, 13 bp, D. melanogaster
tttatgcaattca

SEQ ID NO: 673589 - DNA, 13 bp, D. melanogaster
tttatgcacaaaa

SEQ ID NO: 673590 - DNA, 13 bp, D. melanogaster
tttatgcacaaca

SEQ ID NO: 673591 - DNA, 13 bp, D. melanogaster
tttatgcacacaa

SEQ ID NO: 673592 - DNA, 13 bp, D. melanogaster
tttatgcacacac

SEQ ID NO: 673593 - DNA, 13 bp, D. melanogaster
tttatgcacattt

SEQ ID NO: 673594 - DNA, 14 bp, D. melanogaster
tttatgcacatttt

SEQ ID NO: 673595 - DNA, 13 bp, D. melanogaster
tttatgcacgcag

SEQ ID NO: 673596 - DNA, 13 bp, D. melanogaster
tttatgcacttaa

SEQ ID NO: 673597 - DNA, 13 bp, D. melanogaster
tttatgcacttca

SEQ ID NO: 673598 - DNA, 13 bp, D. melanogaster
tttatgcactttc

SEQ ID NO: 673599 - DNA, 13 bp, D. melanogaster
tttatgcactttg

SEQ ID NO: 673600 - DNA, 13 bp, D. melanogaster
tttatgcagcagc

SEQ ID NO: 673601 - DNA, 13 bp, D. melanogaster
tttatgcagctgc

SEQ ID NO: 673602 - DNA, 14 bp, D. melanogaster
tttatgcatatatt

SEQ ID NO: 673603 - DNA, 13 bp, D. melanogaster
tttatgcatattt

SEQ ID NO: 673604 - DNA, 14 bp, D. melanogaster
tttatgcatattta

SEQ ID NO: 673605 - DNA, 14 bp, D. melanogaster
tttatgcatatttt

SEQ ID NO: 673606 - DNA, 13 bp, D. melanogaster
tttatgcattaaa

SEQ ID NO: 673607 - DNA, 13 bp, D. melanogaster
tttatgcatttat

SEQ ID NO: 673608 - DNA, 14 bp, D. melanogaster
tttatgcatttatt

SEQ ID NO: 673609 - DNA, 14 bp, D. melanogaster
tttatgcatttgct

SEQ ID NO: 673610 - DNA, 13 bp, D. melanogaster
tttatgcatttgg

SEQ ID NO: 673611 - DNA, 14 bp, D. melanogaster
tttatgcattttat

SEQ ID NO: 673612 - DNA, 13 bp, D. melanogaster
tttatgccaaaaa

SEQ ID NO: 673613 - DNA, 13 bp, D. melanogaster
tttatgccaaaca

SEQ ID NO: 673614 - DNA, 13 bp, D. melanogaster
tttatgccaaatt

SEQ ID NO: 673615 - DNA, 13 bp, D. melanogaster
tttatgccaattt

SEQ ID NO: 673616 - DNA, 13 bp, D. melanogaster
tttatgccactaa

SEQ ID NO: 673617 - DNA, 13 bp, D. melanogaster
tttatgccataaa

SEQ ID NO: 673618 - DNA, 13 bp, D. melanogaster
tttatgccgcttt

SEQ ID NO: 673619 - DNA, 13 bp, D. melanogaster
tttatgcctttta

SEQ ID NO: 673620 - DNA, 13 bp, D. melanogaster
tttatgcgatttg

SEQ ID NO: 673621 - DNA, 13 bp, D. melanogaster
tttatgcgcaaat

SEQ ID NO: 673622 - DNA, 13 bp, D. melanogaster
tttatgcgcatat

SEQ ID NO: 673623 - DNA, 13 bp, D. melanogaster
tttatgcgcattt

SEQ ID NO: 673624 - DNA, 13 bp, D. melanogaster
tttatgcgccaaa

SEQ ID NO: 673625 - DNA, 13 bp, D. melanogaster
tttatgcggcaaa

SEQ ID NO: 673626 - DNA, 13 bp, D. melanogaster
tttatgctaaaaa

SEQ ID NO: 673627 - DNA, 13 bp, D. melanogaster
tttatgctaaaat

SEQ ID NO: 673628 - DNA, 13 bp, D. melanogaster
tttatgctaattt

SEQ ID NO: 673629 - DNA, 14 bp, D. melanogaster
tttatgctaatttc

SEQ ID NO: 673630 - DNA, 13 bp, D. melanogaster
tttatgctatata

SEQ ID NO: 673631 - DNA, 13 bp, D. melanogaster
tttatgctcattt

SEQ ID NO: 673632 - DNA, 13 bp, D. melanogaster
tttatgctgaaat

SEQ ID NO: 673633 - DNA, 13 bp, D. melanogaster
tttatgctgatga

SEQ ID NO: 673634 - DNA, 13 bp, D. melanogaster
tttatgctgatta

SEQ ID NO: 673635 - DNA, 13 bp, D. melanogaster
tttatgctgctgc

SEQ ID NO: 673636 - DNA, 13 bp, D. melanogaster
tttatgctggcca

SEQ ID NO: 673637 - DNA, 13 bp, D. melanogaster
tttatgcttaatt

SEQ ID NO: 673638 - DNA, 13 bp, D. melanogaster
tttatggaaattg

SEQ ID NO: 673639 - DNA, 13 bp, D. melanogaster
tttatggaaattt

SEQ ID NO: 673640 - DNA, 13 bp, D. melanogaster
tttatggaataaa

SEQ ID NO: 673641 - DNA, 13 bp, D. melanogaster
tttatggactatc

SEQ ID NO: 673642 - DNA, 13 bp, D. melanogaster
tttatggagaaat

SEQ ID NO: 673643 - DNA, 14 bp, D. melanogaster
tttatggagaaatt

SEQ ID NO: 673644 - DNA, 13 bp, D. melanogaster
tttatggcacaaa

SEQ ID NO: 673645 - DNA, 13 bp, D. melanogaster
tttatggcagcca

SEQ ID NO: 673646 - DNA, 13 bp, D. melanogaster
tttatggcagctt

SEQ ID NO: 673647 - DNA, 13 bp, D. melanogaster
tttatggcataaa

SEQ ID NO: 673648 - DNA, 14 bp, D. melanogaster
tttatggcataaaa

SEQ ID NO: 673649 - DNA, 13 bp, D. melanogaster
tttatggcatact

SEQ ID NO: 673650 - DNA, 13 bp, D. melanogaster
tttatggcatcaa

SEQ ID NO: 673651 - DNA, 13 bp, D. melanogaster
tttatggcattgc

SEQ ID NO: 673652 - DNA, 14 bp, D. melanogaster
tttatggcatttaa

SEQ ID NO: 673653 - DNA, 13 bp, D. melanogaster
tttatggccaaaa

SEQ ID NO: 673654 - DNA, 13 bp, D. melanogaster
tttatggccaaat

SEQ ID NO: 673655 - DNA, 14 bp, D. melanogaster
tttatggccaaatt

SEQ ID NO: 673656 - DNA, 13 bp, D. melanogaster
tttatggccaaca

SEQ ID NO: 673657 - DNA, 14 bp, D. melanogaster
tttatggccaacaa

SEQ ID NO: 673658 - DNA, 14 bp, D. melanogaster
tttatggccaacag

SEQ ID NO: 673659 - DNA, 13 bp, D. melanogaster
tttatggccaaga

SEQ ID NO: 673660 - DNA, 13 bp, D. melanogaster
tttatggccaagc

SEQ ID NO: 673661 - DNA, 13 bp, D. melanogaster
tttatggccaagt

SEQ ID NO: 673662 - DNA, 14 bp, D. melanogaster
tttatggccaagtg

SEQ ID NO: 673663 - DNA, 14 bp, D. melanogaster
tttatggccaagtt

SEQ ID NO: 673664 - DNA, 13 bp, D. melanogaster
tttatggccacca

SEQ ID NO: 673665 - DNA, 13 bp, D. melanogaster
tttatggccactt

SEQ ID NO: 673666 - DNA, 13 bp, D. melanogaster
tttatggccagaa

SEQ ID NO: 673667 - DNA, 13 bp, D. melanogaster
tttatggccagca

SEQ ID NO: 673668 - DNA, 14 bp, D. melanogaster
tttatggccagcaa

SEQ ID NO: 673669 - DNA, 13 bp, D. melanogaster
tttatggccagtt

SEQ ID NO: 673670 - DNA, 14 bp, D. melanogaster
tttatggccataaa

SEQ ID NO: 673671 - DNA, 13 bp, D. melanogaster
tttatggccatgg

SEQ ID NO: 673672 - DNA, 13 bp, D. melanogaster
tttatggccatta

SEQ ID NO: 673673 - DNA, 13 bp, D. melanogaster
tttatggccattc

SEQ ID NO: 673674 - DNA, 13 bp, D. melanogaster
tttatggccattt

SEQ ID NO: 673675 - DNA, 13 bp, D. melanogaster
tttatggcccaaa

SEQ ID NO: 673676 - DNA, 13 bp, D. melanogaster
tttatggcccaca

SEQ ID NO: 673677 - DNA, 13 bp, D. melanogaster
tttatggcccact

SEQ ID NO: 673678 - DNA, 13 bp, D. melanogaster
tttatggcccaga

SEQ ID NO: 673679 - DNA, 13 bp, D. melanogaster
tttatggcccagt

SEQ ID NO: 673680 - DNA, 13 bp, D. melanogaster
tttatggcccgct

SEQ ID NO: 673681 - DNA, 13 bp, D. melanogaster
tttatggccctgc

SEQ ID NO: 673682 - DNA, 13 bp, D. melanogaster
tttatggccgcat

SEQ ID NO: 673683 - DNA, 13 bp, D. melanogaster
tttatggcctggc

SEQ ID NO: 673684 - DNA, 13 bp, D. melanogaster
tttatggccttta

SEQ ID NO: 673685 - DNA, 13 bp, D. melanogaster
tttatggcctttg

SEQ ID NO: 673686 - DNA, 13 bp, D. melanogaster
tttatggcgaaat

SEQ ID NO: 673687 - DNA, 13 bp, D. melanogaster
tttatggcgcaaa

SEQ ID NO: 673688 - DNA, 13 bp, D. melanogaster
tttatggcgcttt

SEQ ID NO: 673689 - DNA, 13 bp, D. melanogaster
tttatggcgtttt

SEQ ID NO: 673690 - DNA, 13 bp, D. melanogaster
tttatggctgaaa

SEQ ID NO: 673691 - DNA, 13 bp, D. melanogaster
tttatggctgcca

SEQ ID NO: 673692 - DNA, 13 bp, D. melanogaster
tttatggcttaaa

SEQ ID NO: 673693 - DNA, 13 bp, D. melanogaster
tttatggcttgta

SEQ ID NO: 673694 - DNA, 13 bp, D. melanogaster
tttatggctttaa

SEQ ID NO: 673695 - DNA, 13 bp, D. melanogaster
tttatggctttca

SEQ ID NO: 673696 - DNA, 13 bp, D. melanogaster
tttatggctttcg

SEQ ID NO: 673697 - DNA, 13 bp, D. melanogaster
tttatgggaattt

SEQ ID NO: 673698 - DNA, 13 bp, D. melanogaster
tttatgggcttaa

SEQ ID NO: 673699 - DNA, 13 bp, D. melanogaster
tttatgggcttta

SEQ ID NO: 673700 - DNA, 15 bp, D. melanogaster
tttatgggttccttg

SEQ ID NO: 673701 - DNA, 13 bp, D. melanogaster
tttatggtaaatt

SEQ ID NO: 673702 - DNA, 13 bp, D. melanogaster
tttatggtgggaa

SEQ ID NO: 673703 - DNA, 13 bp, D. melanogaster
tttatgtaaatga

SEQ ID NO: 673704 - DNA, 13 bp, D. melanogaster
tttatgtaaattg

SEQ ID NO: 673705 - DNA, 13 bp, D. melanogaster
tttatgtaatcac

SEQ ID NO: 673706 - DNA, 13 bp, D. melanogaster
tttatgtacacat

SEQ ID NO: 673707 - DNA, 14 bp, D. melanogaster
tttatgtacataca

SEQ ID NO: 673708 - DNA, 13 bp, D. melanogaster
tttatgtacatat

SEQ ID NO: 673709 - DNA, 14 bp, D. melanogaster
tttatgtacatgta

SEQ ID NO: 673710 - DNA, 13 bp, D. melanogaster
tttatgtacattt

SEQ ID NO: 673711 - DNA, 14 bp, D. melanogaster
tttatgtactattt

SEQ ID NO: 673712 - DNA, 13 bp, D. melanogaster
tttatgtatacat

SEQ ID NO: 673713 - DNA, 13 bp, D. melanogaster
tttatgtattcat

SEQ ID NO: 673714 - DNA, 13 bp, D. melanogaster
tttatgtatttac

SEQ ID NO: 673715 - DNA, 13 bp, D. melanogaster
tttatgtatttca

SEQ ID NO: 673716 - DNA, 13 bp, D. melanogaster
tttatgtcgctca

SEQ ID NO: 673717 - DNA, 13 bp, D. melanogaster
tttatgtgaaaaa

SEQ ID NO: 673718 - DNA, 14 bp, D. melanogaster
tttatgtgaaaaat

SEQ ID NO: 673719 - DNA, 13 bp, D. melanogaster
tttatgtgacatt

SEQ ID NO: 673720 - DNA, 13 bp, D. melanogaster
tttatgtgatttc

SEQ ID NO: 673721 - DNA, 13 bp, D. melanogaster
tttatgtgcaaaa

SEQ ID NO: 673722 - DNA, 13 bp, D. melanogaster
tttatgtgcaaat

SEQ ID NO: 673723 - DNA, 13 bp, D. melanogaster
tttatgtgcaaca

SEQ ID NO: 673724 - DNA, 14 bp, D. melanogaster
tttatgtgcaattt

SEQ ID NO: 673725 - DNA, 13 bp, D. melanogaster
tttatgtgcacag

SEQ ID NO: 673726 - DNA, 13 bp, D. melanogaster
tttatgtgcactt

SEQ ID NO: 673727 - DNA, 13 bp, D. melanogaster
tttatgtgcagca

SEQ ID NO: 673728 - DNA, 13 bp, D. melanogaster
tttatgtgcatat

SEQ ID NO: 673729 - DNA, 14 bp, D. melanogaster
tttatgtgcatatt

SEQ ID NO: 673730 - DNA, 13 bp, D. melanogaster
tttatgtgcattt

SEQ ID NO: 673731 - DNA, 14 bp, D. melanogaster
tttatgtgcattta

SEQ ID NO: 673732 - DNA, 14 bp, D. melanogaster
tttatgtgcatttt

SEQ ID NO: 673733 - DNA, 13 bp, D. melanogaster
tttatgtgccgca

SEQ ID NO: 673734 - DNA, 13 bp, D. melanogaster
tttatgtgccttt

SEQ ID NO: 673735 - DNA, 13 bp, D. melanogaster
tttatgtgcgaaa

SEQ ID NO: 673736 - DNA, 13 bp, D. melanogaster
tttatgtgcgttt

SEQ ID NO: 673737 - DNA, 13 bp, D. melanogaster
tttatgtgcttaa

SEQ ID NO: 673738 - DNA, 13 bp, D. melanogaster
tttatgtggcaat

SEQ ID NO: 673739 - DNA, 13 bp, D. melanogaster
tttatgtggcagc

SEQ ID NO: 673740 - DNA, 13 bp, D. melanogaster
tttatgtggccag

SEQ ID NO: 673741 - DNA, 13 bp, D. melanogaster
tttatgtggccat

SEQ ID NO: 673742 - DNA, 13 bp, D. melanogaster
tttatgtgtcatt

SEQ ID NO: 673743 - DNA, 13 bp, D. melanogaster
tttatgtgtgtgc

SEQ ID NO: 673744 - DNA, 14 bp, D. melanogaster
tttatgtgtttgaa

SEQ ID NO: 673745 - DNA, 13 bp, D. melanogaster
tttatgttaattc

SEQ ID NO: 673746 - DNA, 13 bp, D. melanogaster
tttatgttcaatt

SEQ ID NO: 673747 - DNA, 13 bp, D. melanogaster
tttatgttcactt

SEQ ID NO: 673748 - DNA, 14 bp, D. melanogaster
tttatgttcataaa

SEQ ID NO: 673749 - DNA, 13 bp, D. melanogaster
tttatgttcatat

SEQ ID NO: 673750 - DNA, 13 bp, D. melanogaster
tttatgttgaaat

SEQ ID NO: 673751 - DNA, 13 bp, D. melanogaster
tttatgttgccaa

SEQ ID NO: 673752 - DNA, 13 bp, D. melanogaster
tttatgtttaaca

SEQ ID NO: 673753 - DNA, 14 bp, D. melanogaster
tttatgtttaacat

SEQ ID NO: 673754 - DNA, 13 bp, D. melanogaster
tttatgtttacgt

SEQ ID NO: 673755 - DNA, 13 bp, D. melanogaster
tttatgtttcata

SEQ ID NO: 673756 - DNA, 13 bp, D. melanogaster
tttatgtttgcaa

SEQ ID NO: 673757 - DNA, 13 bp, D. melanogaster
tttatgtttgcca

SEQ ID NO: 673758 - DNA, 13 bp, D. melanogaster
tttatgtttggcc

SEQ ID NO: 673759 - DNA, 13 bp, D. melanogaster
tttatgtttgtgc

SEQ ID NO: 673760 - DNA, 13 bp, D. melanogaster
tttatgttttcag

SEQ ID NO: 673761 - DNA, 13 bp, D. melanogaster
tttattaaaacca

SEQ ID NO: 673762 - DNA, 13 bp, D. melanogaster
tttattaaaacga

SEQ ID NO: 673763 - DNA, 14 bp, D. melanogaster
tttattaaaacgag

SEQ ID NO: 673764 - DNA, 13 bp, D. melanogaster
tttattaaaagtg

SEQ ID NO: 673765 - DNA, 14 bp, D. melanogaster
tttattaaaatcgg

SEQ ID NO: 673766 - DNA, 13 bp, D. melanogaster
tttattaaaccaa

SEQ ID NO: 673767 - DNA, 13 bp, D. melanogaster
tttattaaacgaa

SEQ ID NO: 673768 - DNA, 14 bp, D. melanogaster
tttattaaagatct

SEQ ID NO: 673769 - DNA, 13 bp, D. melanogaster
tttattaaatgtc

SEQ ID NO: 673770 - DNA, 13 bp, D. melanogaster
tttattaaccaaa

SEQ ID NO: 673771 - DNA, 14 bp, D. melanogaster
tttattaactacat

SEQ ID NO: 673772 - DNA, 13 bp, D. melanogaster
tttattaactgaa

SEQ ID NO: 673773 - DNA, 13 bp, D. melanogaster
tttattaagccaa

SEQ ID NO: 673774 - DNA, 13 bp, D. melanogaster
tttattaagctat

SEQ ID NO: 673775 - DNA, 14 bp, D. melanogaster
tttattaagttttc

SEQ ID NO: 673776 - DNA, 13 bp, D. melanogaster
tttattaatggcc

SEQ ID NO: 673777 - DNA, 13 bp, D. melanogaster
tttattaatttcg

SEQ ID NO: 673778 - DNA, 14 bp, D. melanogaster
tttattaatttggc

SEQ ID NO: 673779 - DNA, 13 bp, D. melanogaster
tttattacagaaa

SEQ ID NO: 673780 - DNA, 13 bp, D. melanogaster
tttattacagttt

SEQ ID NO: 673781 - DNA, 13 bp, D. melanogaster
tttattacattgg

SEQ ID NO: 673782 - DNA, 14 bp, D. melanogaster
tttattacattggc

SEQ ID NO: 673783 - DNA, 13 bp, D. melanogaster
tttattaccactt

SEQ ID NO: 673784 - DNA, 13 bp, D. melanogaster
tttattaccataa

SEQ ID NO: 673785 - DNA, 13 bp, D. melanogaster
tttattacccaat

SEQ ID NO: 673786 - DNA, 13 bp, D. melanogaster
tttattacgaatt

SEQ ID NO: 673787 - DNA, 13 bp, D. melanogaster
tttattacgattt

SEQ ID NO: 673788 - DNA, 13 bp, D. melanogaster
tttattacgtata

SEQ ID NO: 673789 - DNA, 13 bp, D. melanogaster
tttattagcaatt

SEQ ID NO: 673790 - DNA, 13 bp, D. melanogaster
tttattagcattt

SEQ ID NO: 673791 - DNA, 14 bp, D. melanogaster
tttattagcatttt

SEQ ID NO: 673792 - DNA, 13 bp, D. melanogaster
tttattagcctct

SEQ ID NO: 673793 - DNA, 13 bp, D. melanogaster
tttattagctatt

SEQ ID NO: 673794 - DNA, 13 bp, D. melanogaster
tttattagcttaa

SEQ ID NO: 673795 - DNA, 13 bp, D. melanogaster
tttattagtttca

SEQ ID NO: 673796 - DNA, 14 bp, D. melanogaster
tttattagttttcg

SEQ ID NO: 673797 - DNA, 14 bp, D. melanogaster
tttattatacacaa

SEQ ID NO: 673798 - DNA, 13 bp, D. melanogaster
tttattatcatca

SEQ ID NO: 673799 - DNA, 13 bp, D. melanogaster
tttattatgaaag

SEQ ID NO: 673800 - DNA, 14 bp, D. melanogaster
tttattatgacaaa

SEQ ID NO: 673801 - DNA, 13 bp, D. melanogaster
tttattatgcaaa

SEQ ID NO: 673802 - DNA, 13 bp, D. melanogaster
tttattatgcact

SEQ ID NO: 673803 - DNA, 13 bp, D. melanogaster
tttattatgcatt

SEQ ID NO: 673804 - DNA, 13 bp, D. melanogaster
tttattatgccaa

SEQ ID NO: 673805 - DNA, 13 bp, D. melanogaster
tttattatgcgaa

SEQ ID NO: 673806 - DNA, 13 bp, D. melanogaster
tttattatggcca

SEQ ID NO: 673807 - DNA, 13 bp, D. melanogaster
tttattattatgc

SEQ ID NO: 673808 - DNA, 13 bp, D. melanogaster
tttattattccaa

SEQ ID NO: 673809 - DNA, 13 bp, D. melanogaster
tttattattgcaa

SEQ ID NO: 673810 - DNA, 13 bp, D. melanogaster
tttattattgcag

SEQ ID NO: 673811 - DNA, 14 bp, D. melanogaster
tttattattggccc

SEQ ID NO: 673812 - DNA, 14 bp, D. melanogaster
tttattatttatgc

SEQ ID NO: 673813 - DNA, 13 bp, D. melanogaster
tttattatttgca

SEQ ID NO: 673814 - DNA, 14 bp, D. melanogaster
tttattatttgcat

SEQ ID NO: 673815 - DNA, 13 bp, D. melanogaster
tttattatttggc

SEQ ID NO: 673816 - DNA, 13 bp, D. melanogaster
tttattcaaaaga

SEQ ID NO: 673817 - DNA, 13 bp, D. melanogaster
tttattcaaagca

SEQ ID NO: 673818 - DNA, 14 bp, D. melanogaster
tttattcaaatcaa

SEQ ID NO: 673819 - DNA, 13 bp, D. melanogaster
tttattcaaatga

SEQ ID NO: 673820 - DNA, 13 bp, D. melanogaster
tttattcaacatt

SEQ ID NO: 673821 - DNA, 13 bp, D. melanogaster
tttattcaagtgt

SEQ ID NO: 673822 - DNA, 14 bp, D. melanogaster
tttattcaattcaa

SEQ ID NO: 673823 - DNA, 13 bp, D. melanogaster
tttattcaattgt

SEQ ID NO: 673824 - DNA, 13 bp, D. melanogaster
tttattcaatttg

SEQ ID NO: 673825 - DNA, 14 bp, D. melanogaster
tttattcaatttgt

SEQ ID NO: 673826 - DNA, 14 bp, D. melanogaster
tttattcatcgacg

SEQ ID NO: 673827 - DNA, 13 bp, D. melanogaster
tttattcatctga

SEQ ID NO: 673828 - DNA, 13 bp, D. melanogaster
tttattcattgaa

SEQ ID NO: 673829 - DNA, 13 bp, D. melanogaster
tttattcatttgc

SEQ ID NO: 673830 - DNA, 13 bp, D. melanogaster
tttattccacatt

SEQ ID NO: 673831 - DNA, 13 bp, D. melanogaster
tttattccatctg

SEQ ID NO: 673832 - DNA, 13 bp, D. melanogaster
tttattccatttg

SEQ ID NO: 673833 - DNA, 13 bp, D. melanogaster
tttattcccccgg

SEQ ID NO: 673834 - DNA, 13 bp, D. melanogaster
tttattcctaact

SEQ ID NO: 673835 - DNA, 13 bp, D. melanogaster
tttattcctttgc

SEQ ID NO: 673836 - DNA, 13 bp, D. melanogaster
tttattcgaaaat

SEQ ID NO: 673837 - DNA, 13 bp, D. melanogaster
tttattcgaataa

SEQ ID NO: 673838 - DNA, 13 bp, D. melanogaster
tttattcgattta

SEQ ID NO: 673839 - DNA, 13 bp, D. melanogaster
tttattcgcttat

SEQ ID NO: 673840 - DNA, 13 bp, D. melanogaster
tttattctaattg

SEQ ID NO: 673841 - DNA, 13 bp, D. melanogaster
tttattcttagtg

SEQ ID NO: 673842 - DNA, 13 bp, D. melanogaster
tttattctttgga

SEQ ID NO: 673843 - DNA, 13 bp, D. melanogaster
tttattgaaaaac

SEQ ID NO: 673844 - DNA, 13 bp, D. melanogaster
tttattgaaaaga

SEQ ID NO: 673845 - DNA, 13 bp, D. melanogaster
tttattgaaaagt

SEQ ID NO: 673846 - DNA, 13 bp, D. melanogaster
tttattgaaagtg

SEQ ID NO: 673847 - DNA, 13 bp, D. melanogaster
tttattgaaatgc

SEQ ID NO: 673848 - DNA, 14 bp, D. melanogaster
tttattgaaattca

SEQ ID NO: 673849 - DNA, 14 bp, D. melanogaster
tttattgaaattct

SEQ ID NO: 673850 - DNA, 13 bp, D. melanogaster
tttattgaatgcc

SEQ ID NO: 673851 - DNA, 13 bp, D. melanogaster
tttattgacacaa

SEQ ID NO: 673852 - DNA, 13 bp, D. melanogaster
tttattgaccaaa

SEQ ID NO: 673853 - DNA, 13 bp, D. melanogaster
tttattgatgtca

SEQ ID NO: 673854 - DNA, 13 bp, D. melanogaster
tttattgattaac

SEQ ID NO: 673855 - DNA, 13 bp, D. melanogaster
tttattgattcct

SEQ ID NO: 673856 - DNA, 13 bp, D. melanogaster
tttattgattgca

SEQ ID NO: 673857 - DNA, 13 bp, D. melanogaster
tttattgattggc

SEQ ID NO: 673858 - DNA, 13 bp, D. melanogaster
tttattgcaaaaa

SEQ ID NO: 673859 - DNA, 14 bp, D. melanogaster
tttattgcaaaaat

SEQ ID NO: 673860 - DNA, 13 bp, D. melanogaster
tttattgcaaaac

SEQ ID NO: 673861 - DNA, 14 bp, D. melanogaster
tttattgcaaaagt

SEQ ID NO: 673862 - DNA, 13 bp, D. melanogaster
tttattgcaattt

SEQ ID NO: 673863 - DNA, 14 bp, D. melanogaster
tttattgcaattta

SEQ ID NO: 673864 - DNA, 13 bp, D. melanogaster
tttattgcacaat

SEQ ID NO: 673865 - DNA, 13 bp, D. melanogaster
tttattgcactgc

SEQ ID NO: 673866 - DNA, 13 bp, D. melanogaster
tttattgcacttg

SEQ ID NO: 673867 - DNA, 13 bp, D. melanogaster
tttattgcacttt

SEQ ID NO: 673868 - DNA, 13 bp, D. melanogaster
tttattgcagttt

SEQ ID NO: 673869 - DNA, 14 bp, D. melanogaster
tttattgcatattt

SEQ ID NO: 673870 - DNA, 13 bp, D. melanogaster
tttattgcattac

SEQ ID NO: 673871 - DNA, 13 bp, D. melanogaster
tttattgcattcc

SEQ ID NO: 673872 - DNA, 13 bp, D. melanogaster
tttattgcattta

SEQ ID NO: 673873 - DNA, 14 bp, D. melanogaster
tttattgcatttaa

SEQ ID NO: 673874 - DNA, 13 bp, D. melanogaster
tttattgcatttg

SEQ ID NO: 673875 - DNA, 13 bp, D. melanogaster
tttattgccaaca

SEQ ID NO: 673876 - DNA, 13 bp, D. melanogaster
tttattgccaact

SEQ ID NO: 673877 - DNA, 13 bp, D. melanogaster
tttattgccaatt

SEQ ID NO: 673878 - DNA, 13 bp, D. melanogaster
tttattgccacaa

SEQ ID NO: 673879 - DNA, 13 bp, D. melanogaster
tttattgccatcg

SEQ ID NO: 673880 - DNA, 13 bp, D. melanogaster
tttattgccattg

SEQ ID NO: 673881 - DNA, 13 bp, D. melanogaster
tttattgccattt

SEQ ID NO: 673882 - DNA, 14 bp, D. melanogaster
tttattgccatttt

SEQ ID NO: 673883 - DNA, 13 bp, D. melanogaster
tttattgcccaac

SEQ ID NO: 673884 - DNA, 13 bp, D. melanogaster
tttattgcccagc

SEQ ID NO: 673885 - DNA, 13 bp, D. melanogaster
tttattgccgcct

SEQ ID NO: 673886 - DNA, 13 bp, D. melanogaster
tttattgccgctg

SEQ ID NO: 673887 - DNA, 13 bp, D. melanogaster
tttattgcctcga

SEQ ID NO: 673888 - DNA, 13 bp, D. melanogaster
tttattgcctgct

SEQ ID NO: 673889 - DNA, 13 bp, D. melanogaster
tttattgcgaaaa

SEQ ID NO: 673890 - DNA, 14 bp, D. melanogaster
tttattgcgtttta

SEQ ID NO: 673891 - DNA, 13 bp, D. melanogaster
tttattgctaaac

SEQ ID NO: 673892 - DNA, 13 bp, D. melanogaster
tttattgctagac

SEQ ID NO: 673893 - DNA, 13 bp, D. melanogaster
tttattgctcaca

SEQ ID NO: 673894 - DNA, 13 bp, D. melanogaster
tttattgctttga

SEQ ID NO: 673895 - DNA, 13 bp, D. melanogaster
tttattggaaata

SEQ ID NO: 673896 - DNA, 14 bp, D. melanogaster
tttattggaaatct

SEQ ID NO: 673897 - DNA, 13 bp, D. melanogaster
tttattggattaa

SEQ ID NO: 673898 - DNA, 13 bp, D. melanogaster
tttattggattac

SEQ ID NO: 673899 - DNA, 13 bp, D. melanogaster
tttattggcaaaa

SEQ ID NO: 673900 - DNA, 13 bp, D. melanogaster
tttattggcaata

SEQ ID NO: 673901 - DNA, 13 bp, D. melanogaster
tttattggcaatt

SEQ ID NO: 673902 - DNA, 13 bp, D. melanogaster
tttattggcattg

SEQ ID NO: 673903 - DNA, 13 bp, D. melanogaster
tttattggcattt

SEQ ID NO: 673904 - DNA, 13 bp, D. melanogaster
tttattggccatt

SEQ ID NO: 673905 - DNA, 13 bp, D. melanogaster
tttattggcccaa

SEQ ID NO: 673906 - DNA, 13 bp, D. melanogaster
tttattggcctgc

SEQ ID NO: 673907 - DNA, 13 bp, D. melanogaster
tttattggcgttt

SEQ ID NO: 673908 - DNA, 13 bp, D. melanogaster
tttattggcttat

SEQ ID NO: 673909 - DNA, 13 bp, D. melanogaster
tttattgggaaaa

SEQ ID NO: 673910 - DNA, 13 bp, D. melanogaster
tttattgggcatt

SEQ ID NO: 673911 - DNA, 14 bp, D. melanogaster
tttattgggcattt

SEQ ID NO: 673912 - DNA, 13 bp, D. melanogaster
tttattggtaaat

SEQ ID NO: 673913 - DNA, 13 bp, D. melanogaster
tttattgtaaaca

SEQ ID NO: 673914 - DNA, 13 bp, D. melanogaster
tttattgtaaatg

SEQ ID NO: 673915 - DNA, 13 bp, D. melanogaster
tttattgtgccac

SEQ ID NO: 673916 - DNA, 13 bp, D. melanogaster
tttattgttaaca

SEQ ID NO: 673917 - DNA, 13 bp, D. melanogaster
tttattgttcaaa

SEQ ID NO: 673918 - DNA, 13 bp, D. melanogaster
tttattgttcgat

SEQ ID NO: 673919 - DNA, 13 bp, D. melanogaster
tttattgttgcta

SEQ ID NO: 673920 - DNA, 13 bp, D. melanogaster
tttattgtttaca

SEQ ID NO: 673921 - DNA, 13 bp, D. melanogaster
tttattgtttcac

SEQ ID NO: 673922 - DNA, 13 bp, D. melanogaster
tttattgtttggc

SEQ ID NO: 673923 - DNA, 13 bp, D. melanogaster
tttatttaaaagc

SEQ ID NO: 673924 - DNA, 13 bp, D. melanogaster
tttatttaaagca

SEQ ID NO: 673925 - DNA, 13 bp, D. melanogaster
tttatttaaatgc

SEQ ID NO: 673926 - DNA, 13 bp, D. melanogaster
tttatttaacaag

SEQ ID NO: 673927 - DNA, 13 bp, D. melanogaster
tttatttaaccaa

SEQ ID NO: 673928 - DNA, 13 bp, D. melanogaster
tttatttaattgc

SEQ ID NO: 673929 - DNA, 13 bp, D. melanogaster
tttatttacaagt

SEQ ID NO: 673930 - DNA, 13 bp, D. melanogaster
tttatttacacgc

SEQ ID NO: 673931 - DNA, 13 bp, D. melanogaster
tttatttacagtt

SEQ ID NO: 673932 - DNA, 14 bp, D. melanogaster
tttatttacatttg

SEQ ID NO: 673933 - DNA, 13 bp, D. melanogaster
tttatttacgcac

SEQ ID NO: 673934 - DNA, 15 bp, D. melanogaster
tttatttactattga

SEQ ID NO: 673935 - DNA, 13 bp, D. melanogaster
tttatttactcgc

SEQ ID NO: 673936 - DNA, 13 bp, D. melanogaster
tttatttactgcc

SEQ ID NO: 673937 - DNA, 14 bp, D. melanogaster
tttatttagcattt

SEQ ID NO: 673938 - DNA, 13 bp, D. melanogaster
tttatttagttac

SEQ ID NO: 673939 - DNA, 13 bp, D. melanogaster
tttatttataacc

SEQ ID NO: 673940 - DNA, 13 bp, D. melanogaster
tttatttatacac

SEQ ID NO: 673941 - DNA, 13 bp, D. melanogaster
tttatttatacca

SEQ ID NO: 673942 - DNA, 13 bp, D. melanogaster
tttatttatagcc

SEQ ID NO: 673943 - DNA, 13 bp, D. melanogaster
tttatttatgaca

SEQ ID NO: 673944 - DNA, 14 bp, D. melanogaster
tttatttatgactt

SEQ ID NO: 673945 - DNA, 13 bp, D. melanogaster
tttatttatgcag

SEQ ID NO: 673946 - DNA, 13 bp, D. melanogaster
tttatttatgcca

SEQ ID NO: 673947 - DNA, 14 bp, D. melanogaster
tttatttatgccac

SEQ ID NO: 673948 - DNA, 13 bp, D. melanogaster
tttatttatggca

SEQ ID NO: 673949 - DNA, 13 bp, D. melanogaster
tttatttatgtgc

SEQ ID NO: 673950 - DNA, 13 bp, D. melanogaster
tttatttattcgg

SEQ ID NO: 673951 - DNA, 13 bp, D. melanogaster
tttatttattgcc

SEQ ID NO: 673952 - DNA, 14 bp, D. melanogaster
tttatttatttgca

SEQ ID NO: 673953 - DNA, 14 bp, D. melanogaster
tttatttatttggc

SEQ ID NO: 673954 - DNA, 13 bp, D. melanogaster
tttatttcaagaa

SEQ ID NO: 673955 - DNA, 13 bp, D. melanogaster
tttatttcaagtg

SEQ ID NO: 673956 - DNA, 13 bp, D. melanogaster
tttatttcacaat

SEQ ID NO: 673957 - DNA, 13 bp, D. melanogaster
tttatttcagaaa

SEQ ID NO: 673958 - DNA, 13 bp, D. melanogaster
tttatttcagtgc

SEQ ID NO: 673959 - DNA, 13 bp, D. melanogaster
tttatttcatgaa

SEQ ID NO: 673960 - DNA, 14 bp, D. melanogaster
tttatttcatttcg

SEQ ID NO: 673961 - DNA, 13 bp, D. melanogaster
tttatttccaaat

SEQ ID NO: 673962 - DNA, 13 bp, D. melanogaster
tttatttccaaca

SEQ ID NO: 673963 - DNA, 13 bp, D. melanogaster
tttatttccagct

SEQ ID NO: 673964 - DNA, 13 bp, D. melanogaster
tttatttccatgt

SEQ ID NO: 673965 - DNA, 13 bp, D. melanogaster
tttatttcccaaa

SEQ ID NO: 673966 - DNA, 13 bp, D. melanogaster
tttatttcctatg

SEQ ID NO: 673967 - DNA, 13 bp, D. melanogaster
tttatttcgaaac

SEQ ID NO: 673968 - DNA, 13 bp, D. melanogaster
tttatttcgaaat

SEQ ID NO: 673969 - DNA, 13 bp, D. melanogaster
tttatttcgatat

SEQ ID NO: 673970 - DNA, 13 bp, D. melanogaster
tttatttcgcaca

SEQ ID NO: 673971 - DNA, 13 bp, D. melanogaster
tttatttcgcatt

SEQ ID NO: 673972 - DNA, 13 bp, D. melanogaster
tttatttcgcctt

SEQ ID NO: 673973 - DNA, 13 bp, D. melanogaster
tttatttcgctgc

SEQ ID NO: 673974 - DNA, 13 bp, D. melanogaster
tttatttcggctt

SEQ ID NO: 673975 - DNA, 13 bp, D. melanogaster
tttatttctcaac

SEQ ID NO: 673976 - DNA, 13 bp, D. melanogaster
tttatttctgcca

SEQ ID NO: 673977 - DNA, 13 bp, D. melanogaster
tttatttgaactt

SEQ ID NO: 673978 - DNA, 13 bp, D. melanogaster
tttatttgaatgg

SEQ ID NO: 673979 - DNA, 13 bp, D. melanogaster
tttatttgagaaa

SEQ ID NO: 673980 - DNA, 14 bp, D. melanogaster
tttatttgatttca

SEQ ID NO: 673981 - DNA, 14 bp, D. melanogaster
tttatttgatttgc

SEQ ID NO: 673982 - DNA, 13 bp, D. melanogaster
tttatttgcaact

SEQ ID NO: 673983 - DNA, 13 bp, D. melanogaster
tttatttgcaatt

SEQ ID NO: 673984 - DNA, 14 bp, D. melanogaster
tttatttgcaattg

SEQ ID NO: 673985 - DNA, 13 bp, D. melanogaster
tttatttgcacaa

SEQ ID NO: 673986 - DNA, 14 bp, D. melanogaster
tttatttgcacaaa

SEQ ID NO: 673987 - DNA, 13 bp, D. melanogaster
tttatttgcactg

SEQ ID NO: 673988 - DNA, 13 bp, D. melanogaster
tttatttgcagca

SEQ ID NO: 673989 - DNA, 13 bp, D. melanogaster
tttatttgcatat

SEQ ID NO: 673990 - DNA, 13 bp, D. melanogaster
tttatttgcattg

SEQ ID NO: 673991 - DNA, 14 bp, D. melanogaster
tttatttgcattgc

SEQ ID NO: 673992 - DNA, 13 bp, D. melanogaster
tttatttgccacc

SEQ ID NO: 673993 - DNA, 13 bp, D. melanogaster
tttatttgccact

SEQ ID NO: 673994 - DNA, 13 bp, D. melanogaster
tttatttgccaga

SEQ ID NO: 673995 - DNA, 13 bp, D. melanogaster
tttatttgccagc

SEQ ID NO: 673996 - DNA, 13 bp, D. melanogaster
tttatttgccatg

SEQ ID NO: 673997 - DNA, 13 bp, D. melanogaster
tttatttgccatt

SEQ ID NO: 673998 - DNA, 14 bp, D. melanogaster
tttatttgccattt

SEQ ID NO: 673999 - DNA, 14 bp, D. melanogaster
tttatttgcccagc

SEQ ID NO: 674000 - DNA, 13 bp, D. melanogaster
tttatttgcccat

SEQ ID NO: 674001 - DNA, 13 bp, D. melanogaster
tttatttgccgca

SEQ ID NO: 674002 - DNA, 13 bp, D. melanogaster
tttatttgcctat

SEQ ID NO: 674003 - DNA, 13 bp, D. melanogaster
tttatttgcgaat

SEQ ID NO: 674004 - DNA, 13 bp, D. melanogaster
tttatttgcggtt

SEQ ID NO: 674005 - DNA, 13 bp, D. melanogaster
tttatttgcgtat

SEQ ID NO: 674006 - DNA, 13 bp, D. melanogaster
tttatttgcgtgc

SEQ ID NO: 674007 - DNA, 13 bp, D. melanogaster
tttatttgctaaa

SEQ ID NO: 674008 - DNA, 13 bp, D. melanogaster
tttatttgctctc

SEQ ID NO: 674009 - DNA, 13 bp, D. melanogaster
tttatttgctgca

SEQ ID NO: 674010 - DNA, 13 bp, D. melanogaster
tttatttgctgct

SEQ ID NO: 674011 - DNA, 13 bp, D. melanogaster
tttatttgctgtg

SEQ ID NO: 674012 - DNA, 14 bp, D. melanogaster
tttatttgctttgg

SEQ ID NO: 674013 - DNA, 13 bp, D. melanogaster
tttatttggaaat

SEQ ID NO: 674014 - DNA, 14 bp, D. melanogaster
tttatttggaaata

SEQ ID NO: 674015 - DNA, 13 bp, D. melanogaster
tttatttggcaaa

SEQ ID NO: 674016 - DNA, 14 bp, D. melanogaster
tttatttggcaaaa

SEQ ID NO: 674017 - DNA, 14 bp, D. melanogaster
tttatttggcaatt

SEQ ID NO: 674018 - DNA, 13 bp, D. melanogaster
tttatttggcatt

SEQ ID NO: 674019 - DNA, 13 bp, D. melanogaster
tttatttggcctg

SEQ ID NO: 674020 - DNA, 13 bp, D. melanogaster
tttatttggcgat

SEQ ID NO: 674021 - DNA, 13 bp, D. melanogaster
tttatttgggcaa

SEQ ID NO: 674022 - DNA, 13 bp, D. melanogaster
tttatttgggtca

SEQ ID NO: 674023 - DNA, 13 bp, D. melanogaster
tttatttggtaaa

SEQ ID NO: 674024 - DNA, 13 bp, D. melanogaster
tttatttgtatac

SEQ ID NO: 674025 - DNA, 13 bp, D. melanogaster
tttatttgtccaa

SEQ ID NO: 674026 - DNA, 13 bp, D. melanogaster
tttatttgtctgc

SEQ ID NO: 674027 - DNA, 13 bp, D. melanogaster
tttatttgtgcat

SEQ ID NO: 674028 - DNA, 14 bp, D. melanogaster
tttatttgtgcatt

SEQ ID NO: 674029 - DNA, 13 bp, D. melanogaster
tttatttgtgcgc

SEQ ID NO: 674030 - DNA, 13 bp, D. melanogaster
tttatttgtgtgc

SEQ ID NO: 674031 - DNA, 13 bp, D. melanogaster
tttatttgttcga

SEQ ID NO: 674032 - DNA, 13 bp, D. melanogaster
tttattttaactg

SEQ ID NO: 674033 - DNA, 14 bp, D. melanogaster
tttattttacaatg

SEQ ID NO: 674034 - DNA, 14 bp, D. melanogaster
tttattttagcatt

SEQ ID NO: 674035 - DNA, 13 bp, D. melanogaster
tttattttagcta

SEQ ID NO: 674036 - DNA, 13 bp, D. melanogaster
tttattttatacg

SEQ ID NO: 674037 - DNA, 13 bp, D. melanogaster
tttattttatgcc

SEQ ID NO: 674038 - DNA, 14 bp, D. melanogaster
tttattttcaatgt

SEQ ID NO: 674039 - DNA, 13 bp, D. melanogaster
tttattttcacaa

SEQ ID NO: 674040 - DNA, 13 bp, D. melanogaster
tttattttcacag

SEQ ID NO: 674041 - DNA, 13 bp, D. melanogaster
tttattttcactg

SEQ ID NO: 674042 - DNA, 13 bp, D. melanogaster
tttattttcatgc

SEQ ID NO: 674043 - DNA, 13 bp, D. melanogaster
tttattttccaaa

SEQ ID NO: 674044 - DNA, 13 bp, D. melanogaster
tttattttccaga

SEQ ID NO: 674045 - DNA, 13 bp, D. melanogaster
tttattttccgca

SEQ ID NO: 674046 - DNA, 13 bp, D. melanogaster
tttattttcctgc

SEQ ID NO: 674047 - DNA, 13 bp, D. melanogaster
tttattttcgatg

SEQ ID NO: 674048 - DNA, 13 bp, D. melanogaster
tttattttcgcat

SEQ ID NO: 674049 - DNA, 13 bp, D. melanogaster
tttattttcgcca

SEQ ID NO: 674050 - DNA, 14 bp, D. melanogaster
tttattttcgccaa

SEQ ID NO: 674051 - DNA, 13 bp, D. melanogaster
tttattttcggca

SEQ ID NO: 674052 - DNA, 13 bp, D. melanogaster
tttattttcggta

SEQ ID NO: 674053 - DNA, 13 bp, D. melanogaster
tttattttcgtca

SEQ ID NO: 674054 - DNA, 14 bp, D. melanogaster
tttattttctatgg

SEQ ID NO: 674055 - DNA, 13 bp, D. melanogaster
tttattttctgcc

SEQ ID NO: 674056 - DNA, 13 bp, D. melanogaster
tttattttgacag

SEQ ID NO: 674057 - DNA, 13 bp, D. melanogaster
tttattttgcagt

SEQ ID NO: 674058 - DNA, 14 bp, D. melanogaster
tttattttgccatt

SEQ ID NO: 674059 - DNA, 13 bp, D. melanogaster
tttattttgctaa

SEQ ID NO: 674060 - DNA, 13 bp, D. melanogaster
tttattttgctga

SEQ ID NO: 674061 - DNA, 13 bp, D. melanogaster
tttattttggccc

SEQ ID NO: 674062 - DNA, 13 bp, D. melanogaster
tttattttgggca

SEQ ID NO: 674063 - DNA, 13 bp, D. melanogaster
tttattttgtgcc

SEQ ID NO: 674064 - DNA, 13 bp, D. melanogaster
tttatttttaagc

SEQ ID NO: 674065 - DNA, 13 bp, D. melanogaster
tttatttttagac

SEQ ID NO: 674066 - DNA, 13 bp, D. melanogaster
tttatttttagcc

SEQ ID NO: 674067 - DNA, 14 bp, D. melanogaster
tttatttttagccc

SEQ ID NO: 674068 - DNA, 14 bp, D. melanogaster
tttatttttatggc

SEQ ID NO: 674069 - DNA, 13 bp, D. melanogaster
tttatttttcgaa

SEQ ID NO: 674070 - DNA, 13 bp, D. melanogaster
tttatttttcgca

SEQ ID NO: 674071 - DNA, 14 bp, D. melanogaster
tttatttttgcaaa

SEQ ID NO: 674072 - DNA, 13 bp, D. melanogaster
tttatttttgcac

SEQ ID NO: 674073 - DNA, 14 bp, D. melanogaster
tttatttttgcata

SEQ ID NO: 674074 - DNA, 13 bp, D. melanogaster
tttatttttgcga

SEQ ID NO: 674075 - DNA, 13 bp, D. melanogaster
tttatttttggac

SEQ ID NO: 674076 - DNA, 13 bp, D. melanogaster
tttatttttggca

SEQ ID NO: 674077 - DNA, 14 bp, D. melanogaster
tttatttttggcac

SEQ ID NO: 674078 - DNA, 13 bp, D. melanogaster
tttatttttggcc

SEQ ID NO: 674079 - DNA, 14 bp, D. melanogaster
tttatttttggcca

SEQ ID NO: 674080 - DNA, 13 bp, D. melanogaster
tttatttttgggc

SEQ ID NO: 674081 - DNA, 14 bp, D. melanogaster
tttattttttacag

SEQ ID NO: 674082 - DNA, 14 bp, D. melanogaster
tttattttttgccc

SEQ ID NO: 674083 - DNA, 13 bp, D. melanogaster
tttcaaaaaaacc

SEQ ID NO: 674084 - DNA, 14 bp, D. melanogaster
tttcaaaaaaaccg

SEQ ID NO: 674085 - DNA, 13 bp, D. melanogaster
tttcaaaaaatac

SEQ ID NO: 674086 - DNA, 13 bp, D. melanogaster
tttcaaaaaatgt

SEQ ID NO: 674087 - DNA, 14 bp, D. melanogaster
tttcaaaaaatgtt

SEQ ID NO: 674088 - DNA, 13 bp, D. melanogaster
tttcaaaaaccca

SEQ ID NO: 674089 - DNA, 13 bp, D. melanogaster
tttcaaaaacttt

SEQ ID NO: 674090 - DNA, 14 bp, D. melanogaster
tttcaaaaagaaaa

SEQ ID NO: 674091 - DNA, 14 bp, D. melanogaster
tttcaaaaagtttt

SEQ ID NO: 674092 - DNA, 13 bp, D. melanogaster
tttcaaaaataag

SEQ ID NO: 674093 - DNA, 14 bp, D. melanogaster
tttcaaaaataatc

SEQ ID NO: 674094 - DNA, 13 bp, D. melanogaster
tttcaaaaatcaa

SEQ ID NO: 674095 - DNA, 13 bp, D. melanogaster
tttcaaaaatcga

SEQ ID NO: 674096 - DNA, 13 bp, D. melanogaster
tttcaaaaatgtt

SEQ ID NO: 674097 - DNA, 13 bp, D. melanogaster
tttcaaaacaaag

SEQ ID NO: 674098 - DNA, 13 bp, D. melanogaster
tttcaaaacattt

SEQ ID NO: 674099 - DNA, 13 bp, D. melanogaster
tttcaaaacgaaa

SEQ ID NO: 674100 - DNA, 13 bp, D. melanogaster
tttcaaaactaat

SEQ ID NO: 674101 - DNA, 13 bp, D. melanogaster
tttcaaaactatt

SEQ ID NO: 674102 - DNA, 14 bp, D. melanogaster
tttcaaaactattt

SEQ ID NO: 674103 - DNA, 13 bp, D. melanogaster
tttcaaaactgtt

SEQ ID NO: 674104 - DNA, 13 bp, D. melanogaster
tttcaaaacttta

SEQ ID NO: 674105 - DNA, 13 bp, D. melanogaster
tttcaaaagaaat

SEQ ID NO: 674106 - DNA, 13 bp, D. melanogaster
tttcaaaagaact

SEQ ID NO: 674107 - DNA, 14 bp, D. melanogaster
tttcaaaagaattt

SEQ ID NO: 674108 - DNA, 13 bp, D. melanogaster
tttcaaaagcaaa

SEQ ID NO: 674109 - DNA, 13 bp, D. melanogaster
tttcaaaagctaa

SEQ ID NO: 674110 - DNA, 13 bp, D. melanogaster
tttcaaaagtaaa

SEQ ID NO: 674111 - DNA, 13 bp, D. melanogaster
tttcaaaagtgca

SEQ ID NO: 674112 - DNA, 13 bp, D. melanogaster
tttcaaaagtgtt

SEQ ID NO: 674113 - DNA, 13 bp, D. melanogaster
tttcaaaagttat

SEQ ID NO: 674114 - DNA, 13 bp, D. melanogaster
tttcaaaagttgt

SEQ ID NO: 674115 - DNA, 13 bp, D. melanogaster
tttcaaaagtttg

SEQ ID NO: 674116 - DNA, 13 bp, D. melanogaster
tttcaaaagtttt

SEQ ID NO: 674117 - DNA, 14 bp, D. melanogaster
tttcaaaagttttt

SEQ ID NO: 674118 - DNA, 13 bp, D. melanogaster
tttcaaaataact

SEQ ID NO: 674119 - DNA, 13 bp, D. melanogaster
tttcaaaataatg

SEQ ID NO: 674120 - DNA, 13 bp, D. melanogaster
tttcaaaatactt

SEQ ID NO: 674121 - DNA, 13 bp, D. melanogaster
tttcaaaatatga

SEQ ID NO: 674122 - DNA, 14 bp, D. melanogaster
tttcaaaatatttg

SEQ ID NO: 674123 - DNA, 13 bp, D. melanogaster
tttcaaaatcaac

SEQ ID NO: 674124 - DNA, 13 bp, D. melanogaster
tttcaaaatcagg

SEQ ID NO: 674125 - DNA, 14 bp, D. melanogaster
tttcaaaatcattt

SEQ ID NO: 674126 - DNA, 13 bp, D. melanogaster
tttcaaaatcctt

SEQ ID NO: 674127 - DNA, 13 bp, D. melanogaster
tttcaaaatctat

SEQ ID NO: 674128 - DNA, 13 bp, D. melanogaster
tttcaaaatcttt

SEQ ID NO: 674129 - DNA, 14 bp, D. melanogaster
tttcaaaatgattt

SEQ ID NO: 674130 - DNA, 13 bp, D. melanogaster
tttcaaaatgcaa

SEQ ID NO: 674131 - DNA, 13 bp, D. melanogaster
tttcaaaatgtaa

SEQ ID NO: 674132 - DNA, 13 bp, D. melanogaster
tttcaaaatgtga

SEQ ID NO: 674133 - DNA, 13 bp, D. melanogaster
tttcaaaattcta

SEQ ID NO: 674134 - DNA, 13 bp, D. melanogaster
tttcaaaattttc

SEQ ID NO: 674135 - DNA, 13 bp, D. melanogaster
tttcaaacaaaac

SEQ ID NO: 674136 - DNA, 13 bp, D. melanogaster
tttcaaacaaaca

SEQ ID NO: 674137 - DNA, 13 bp, D. melanogaster
tttcaaacaaact

SEQ ID NO: 674138 - DNA, 13 bp, D. melanogaster
tttcaaacaactt

SEQ ID NO: 674139 - DNA, 13 bp, D. melanogaster
tttcaaacaagtt

SEQ ID NO: 674140 - DNA, 13 bp, D. melanogaster
tttcaaacaattt

SEQ ID NO: 674141 - DNA, 14 bp, D. melanogaster
tttcaaacaatttt

SEQ ID NO: 674142 - DNA, 13 bp, D. melanogaster
tttcaaacacaat

SEQ ID NO: 674143 - DNA, 13 bp, D. melanogaster
tttcaaacagttt

SEQ ID NO: 674144 - DNA, 13 bp, D. melanogaster
tttcaaacatttt

SEQ ID NO: 674145 - DNA, 13 bp, D. melanogaster
tttcaaaccattt

SEQ ID NO: 674146 - DNA, 13 bp, D. melanogaster
tttcaaacgaaat

SEQ ID NO: 674147 - DNA, 13 bp, D. melanogaster
tttcaaactaaaa

SEQ ID NO: 674148 - DNA, 13 bp, D. melanogaster
tttcaaactaaat

SEQ ID NO: 674149 - DNA, 13 bp, D. melanogaster
tttcaaactaata

SEQ ID NO: 674150 - DNA, 13 bp, D. melanogaster
tttcaaactgaaa

SEQ ID NO: 674151 - DNA, 13 bp, D. melanogaster
tttcaaactgttt

SEQ ID NO: 674152 - DNA, 13 bp, D. melanogaster
tttcaaactttta

SEQ ID NO: 674153 - DNA, 13 bp, D. melanogaster
tttcaaagaaaac

SEQ ID NO: 674154 - DNA, 13 bp, D. melanogaster
tttcaaagaaata

SEQ ID NO: 674155 - DNA, 13 bp, D. melanogaster
tttcaaagaactt

SEQ ID NO: 674156 - DNA, 13 bp, D. melanogaster
tttcaaagaattt

SEQ ID NO: 674157 - DNA, 13 bp, D. melanogaster
tttcaaagagaaa

SEQ ID NO: 674158 - DNA, 13 bp, D. melanogaster
tttcaaagatttt

SEQ ID NO: 674159 - DNA, 13 bp, D. melanogaster
tttcaaaggctaa

SEQ ID NO: 674160 - DNA, 13 bp, D. melanogaster
tttcaaagtcaat

SEQ ID NO: 674161 - DNA, 13 bp, D. melanogaster
tttcaaagtgcag

SEQ ID NO: 674162 - DNA, 13 bp, D. melanogaster
tttcaaagttatt

SEQ ID NO: 674163 - DNA, 13 bp, D. melanogaster
tttcaaagttgta

SEQ ID NO: 674164 - DNA, 13 bp, D. melanogaster
tttcaaagttgtt

SEQ ID NO: 674165 - DNA, 13 bp, D. melanogaster
tttcaaagttttc

SEQ ID NO: 674166 - DNA, 13 bp, D. melanogaster
tttcaaagttttg

SEQ ID NO: 674167 - DNA, 13 bp, D. melanogaster
tttcaaataaact

SEQ ID NO: 674168 - DNA, 13 bp, D. melanogaster
tttcaaataacat

SEQ ID NO: 674169 - DNA, 13 bp, D. melanogaster
tttcaaataacta

SEQ ID NO: 674170 - DNA, 13 bp, D. melanogaster
tttcaaataatca

SEQ ID NO: 674171 - DNA, 13 bp, D. melanogaster
tttcaaatacaaa

SEQ ID NO: 674172 - DNA, 14 bp, D. melanogaster
tttcaaatacattt

SEQ ID NO: 674173 - DNA, 13 bp, D. melanogaster
tttcaaatagttt

SEQ ID NO: 674174 - DNA, 13 bp, D. melanogaster
tttcaaatataca

SEQ ID NO: 674175 - DNA, 13 bp, D. melanogaster
tttcaaatattct

SEQ ID NO: 674176 - DNA, 13 bp, D. melanogaster
tttcaaatcaaat

SEQ ID NO: 674177 - DNA, 13 bp, D. melanogaster
tttcaaatcaatt

SEQ ID NO: 674178 - DNA, 13 bp, D. melanogaster
tttcaaatcactt

SEQ ID NO: 674179 - DNA, 13 bp, D. melanogaster
tttcaaatccttt

SEQ ID NO: 674180 - DNA, 13 bp, D. melanogaster
tttcaaatcgaaa

SEQ ID NO: 674181 - DNA, 14 bp, D. melanogaster
tttcaaatcgaaat

SEQ ID NO: 674182 - DNA, 13 bp, D. melanogaster
tttcaaatcgaat

SEQ ID NO: 674183 - DNA, 13 bp, D. melanogaster
tttcaaatcgatt

SEQ ID NO: 674184 - DNA, 13 bp, D. melanogaster
tttcaaatcgcaa

SEQ ID NO: 674185 - DNA, 13 bp, D. melanogaster
tttcaaatctaaa

SEQ ID NO: 674186 - DNA, 13 bp, D. melanogaster
tttcaaatctaat

SEQ ID NO: 674187 - DNA, 13 bp, D. melanogaster
tttcaaatcttta

SEQ ID NO: 674188 - DNA, 13 bp, D. melanogaster
tttcaaatgaaat

SEQ ID NO: 674189 - DNA, 13 bp, D. melanogaster
tttcaaatgaact

SEQ ID NO: 674190 - DNA, 13 bp, D. melanogaster
tttcaaatgataa

SEQ ID NO: 674191 - DNA, 14 bp, D. melanogaster
tttcaaatgataaa

SEQ ID NO: 674192 - DNA, 13 bp, D. melanogaster
tttcaaatgattt

SEQ ID NO: 674193 - DNA, 13 bp, D. melanogaster
tttcaaatgcaaa

SEQ ID NO: 674194 - DNA, 13 bp, D. melanogaster
tttcaaatgcaca

SEQ ID NO: 674195 - DNA, 13 bp, D. melanogaster
tttcaaatgcatt

SEQ ID NO: 674196 - DNA, 13 bp, D. melanogaster
tttcaaatgccaa

SEQ ID NO: 674197 - DNA, 13 bp, D. melanogaster
tttcaaatgccat

SEQ ID NO: 674198 - DNA, 13 bp, D. melanogaster
tttcaaatgcttt

SEQ ID NO: 674199 - DNA, 13 bp, D. melanogaster
tttcaaatggaaa

SEQ ID NO: 674200 - DNA, 14 bp, D. melanogaster
tttcaaatggaaat

SEQ ID NO: 674201 - DNA, 13 bp, D. melanogaster
tttcaaatggaac

SEQ ID NO: 674202 - DNA, 13 bp, D. melanogaster
tttcaaatgttca

SEQ ID NO: 674203 - DNA, 14 bp, D. melanogaster
tttcaaatgttgat

SEQ ID NO: 674204 - DNA, 13 bp, D. melanogaster
tttcaaatgttta

SEQ ID NO: 674205 - DNA, 13 bp, D. melanogaster
tttcaaatgtttc

SEQ ID NO: 674206 - DNA, 13 bp, D. melanogaster
tttcaaatgtttt

SEQ ID NO: 674207 - DNA, 14 bp, D. melanogaster
tttcaaatgttttc

SEQ ID NO: 674208 - DNA, 14 bp, D. melanogaster
tttcaaatgttttt

SEQ ID NO: 674209 - DNA, 13 bp, D. melanogaster
tttcaaattaaca

SEQ ID NO: 674210 - DNA, 13 bp, D. melanogaster
tttcaaattatgc

SEQ ID NO: 674211 - DNA, 13 bp, D. melanogaster
tttcaaattatgt

SEQ ID NO: 674212 - DNA, 13 bp, D. melanogaster
tttcaaattcaaa

SEQ ID NO: 674213 - DNA, 13 bp, D. melanogaster
tttcaaattcaat

SEQ ID NO: 674214 - DNA, 13 bp, D. melanogaster
tttcaaattcgtt

SEQ ID NO: 674215 - DNA, 13 bp, D. melanogaster
tttcaaattgaaa

SEQ ID NO: 674216 - DNA, 14 bp, D. melanogaster
tttcaaattgaaaa

SEQ ID NO: 674217 - DNA, 13 bp, D. melanogaster
tttcaaattgatt

SEQ ID NO: 674218 - DNA, 13 bp, D. melanogaster
tttcaaattgctt

SEQ ID NO: 674219 - DNA, 13 bp, D. melanogaster
tttcaaattggaa

SEQ ID NO: 674220 - DNA, 13 bp, D. melanogaster
tttcaaattggct

SEQ ID NO: 674221 - DNA, 13 bp, D. melanogaster
tttcaaattgtat

SEQ ID NO: 674222 - DNA, 13 bp, D. melanogaster
tttcaaattgtgt

SEQ ID NO: 674223 - DNA, 13 bp, D. melanogaster
tttcaaattgttt

SEQ ID NO: 674224 - DNA, 14 bp, D. melanogaster
tttcaaattgttta

SEQ ID NO: 674225 - DNA, 14 bp, D. melanogaster
tttcaaattgtttg

SEQ ID NO: 674226 - DNA, 14 bp, D. melanogaster
tttcaaatttaaca

SEQ ID NO: 674227 - DNA, 13 bp, D. melanogaster
tttcaaatttcaa

SEQ ID NO: 674228 - DNA, 14 bp, D. melanogaster
tttcaaatttcaaa

SEQ ID NO: 674229 - DNA, 13 bp, D. melanogaster
tttcaaatttcca

SEQ ID NO: 674230 - DNA, 14 bp, D. melanogaster
tttcaaatttgaaa

SEQ ID NO: 674231 - DNA, 13 bp, D. melanogaster
tttcaaattttca

SEQ ID NO: 674232 - DNA, 13 bp, D. melanogaster
tttcaaattttga

SEQ ID NO: 674233 - DNA, 13 bp, D. melanogaster
tttcaacaaaaac

SEQ ID NO: 674234 - DNA, 14 bp, D. melanogaster
tttcaacaaaaaca

SEQ ID NO: 674235 - DNA, 13 bp, D. melanogaster
tttcaacaaaata

SEQ ID NO: 674236 - DNA, 13 bp, D. melanogaster
tttcaacaaaatg

SEQ ID NO: 674237 - DNA, 13 bp, D. melanogaster
tttcaacaaaatt

SEQ ID NO: 674238 - DNA, 13 bp, D. melanogaster
tttcaacaaacaa

SEQ ID NO: 674239 - DNA, 13 bp, D. melanogaster
tttcaacaaatat

SEQ ID NO: 674240 - DNA, 13 bp, D. melanogaster
tttcaacaaatta

SEQ ID NO: 674241 - DNA, 13 bp, D. melanogaster
tttcaacaaattg

SEQ ID NO: 674242 - DNA, 13 bp, D. melanogaster
tttcaacaaattt

SEQ ID NO: 674243 - DNA, 13 bp, D. melanogaster
tttcaacaacaac

SEQ ID NO: 674244 - DNA, 13 bp, D. melanogaster
tttcaacaacaat

SEQ ID NO: 674245 - DNA, 13 bp, D. melanogaster
tttcaacaagttt

SEQ ID NO: 674246 - DNA, 13 bp, D. melanogaster
tttcaacaatttc

SEQ ID NO: 674247 - DNA, 13 bp, D. melanogaster
tttcaacaatttt

SEQ ID NO: 674248 - DNA, 13 bp, D. melanogaster
tttcaacacattt

SEQ ID NO: 674249 - DNA, 13 bp, D. melanogaster
tttcaacagcagc

SEQ ID NO: 674250 - DNA, 13 bp, D. melanogaster
tttcaacagccaa

SEQ ID NO: 674251 - DNA, 13 bp, D. melanogaster
tttcaacagtttt

SEQ ID NO: 674252 - DNA, 13 bp, D. melanogaster
tttcaacattttg

SEQ ID NO: 674253 - DNA, 13 bp, D. melanogaster
tttcaaccaaaaa

SEQ ID NO: 674254 - DNA, 13 bp, D. melanogaster
tttcaaccaaatc

SEQ ID NO: 674255 - DNA, 13 bp, D. melanogaster
tttcaaccacccc

SEQ ID NO: 674256 - DNA, 13 bp, D. melanogaster
tttcaacgaatat

SEQ ID NO: 674257 - DNA, 14 bp, D. melanogaster
tttcaacgaatata

SEQ ID NO: 674258 - DNA, 13 bp, D. melanogaster
tttcaacgaattt

SEQ ID NO: 674259 - DNA, 14 bp, D. melanogaster
tttcaacgaattta

SEQ ID NO: 674260 - DNA, 14 bp, D. melanogaster
tttcaacgcacaaa

SEQ ID NO: 674261 - DNA, 13 bp, D. melanogaster
tttcaacgctttt

SEQ ID NO: 674262 - DNA, 13 bp, D. melanogaster
tttcaactaattt

SEQ ID NO: 674263 - DNA, 13 bp, D. melanogaster
tttcaactcaaat

SEQ ID NO: 674264 - DNA, 13 bp, D. melanogaster
tttcaactgaaaa

SEQ ID NO: 674265 - DNA, 13 bp, D. melanogaster
tttcaactgaaat

SEQ ID NO: 674266 - DNA, 13 bp, D. melanogaster
tttcaactgctgc

SEQ ID NO: 674267 - DNA, 13 bp, D. melanogaster
tttcaactgtttt

SEQ ID NO: 674268 - DNA, 13 bp, D. melanogaster
tttcaacttaatt

SEQ ID NO: 674269 - DNA, 14 bp, D. melanogaster
tttcaacttcaact

SEQ ID NO: 674270 - DNA, 13 bp, D. melanogaster
tttcaacttcgat

SEQ ID NO: 674271 - DNA, 13 bp, D. melanogaster
tttcaactttggc

SEQ ID NO: 674272 - DNA, 13 bp, D. melanogaster
tttcaactttgtt

SEQ ID NO: 674273 - DNA, 13 bp, D. melanogaster
tttcaacttttaa

SEQ ID NO: 674274 - DNA, 13 bp, D. melanogaster
tttcaacttttcc

SEQ ID NO: 674275 - DNA, 13 bp, D. melanogaster
tttcaagattttg

SEQ ID NO: 674276 - DNA, 13 bp, D. melanogaster
tttcaagcaaaaa

SEQ ID NO: 674277 - DNA, 13 bp, D. melanogaster
tttcaagcaatta

SEQ ID NO: 674278 - DNA, 13 bp, D. melanogaster
tttcaagcatttc

SEQ ID NO: 674279 - DNA, 13 bp, D. melanogaster
tttcaagcatttt

SEQ ID NO: 674280 - DNA, 13 bp, D. melanogaster
tttcaagccaaaa

SEQ ID NO: 674281 - DNA, 13 bp, D. melanogaster
tttcaagctgaaa

SEQ ID NO: 674282 - DNA, 13 bp, D. melanogaster
tttcaaggaattt

SEQ ID NO: 674283 - DNA, 13 bp, D. melanogaster
tttcaaggatata

SEQ ID NO: 674284 - DNA, 13 bp, D. melanogaster
tttcaaggatatt

SEQ ID NO: 674285 - DNA, 13 bp, D. melanogaster
tttcaaggatttt

SEQ ID NO: 674286 - DNA, 13 bp, D. melanogaster
tttcaaggcattt

SEQ ID NO: 674287 - DNA, 13 bp, D. melanogaster
tttcaagtattta

SEQ ID NO: 674288 - DNA, 14 bp, D. melanogaster
tttcaagtatttat

SEQ ID NO: 674289 - DNA, 13 bp, D. melanogaster
tttcaagtatttt

SEQ ID NO: 674290 - DNA, 13 bp, D. melanogaster
tttcaagtgcaaa

SEQ ID NO: 674291 - DNA, 13 bp, D. melanogaster
tttcaagtgcatc

SEQ ID NO: 674292 - DNA, 13 bp, D. melanogaster
tttcaagtgccaa

SEQ ID NO: 674293 - DNA, 13 bp, D. melanogaster
tttcaagtggcca

SEQ ID NO: 674294 - DNA, 13 bp, D. melanogaster
tttcaagtgtttt

SEQ ID NO: 674295 - DNA, 14 bp, D. melanogaster
tttcaagtgttttt

SEQ ID NO: 674296 - DNA, 13 bp, D. melanogaster
tttcaagttaaaa

SEQ ID NO: 674297 - DNA, 13 bp, D. melanogaster
tttcaagttaaat

SEQ ID NO: 674298 - DNA, 13 bp, D. melanogaster
tttcaagttaatt

SEQ ID NO: 674299 - DNA, 13 bp, D. melanogaster
tttcaagttatac

SEQ ID NO: 674300 - DNA, 13 bp, D. melanogaster
tttcaagttcaag

SEQ ID NO: 674301 - DNA, 13 bp, D. melanogaster
tttcaagttcaat

SEQ ID NO: 674302 - DNA, 13 bp, D. melanogaster
tttcaagttcatt

SEQ ID NO: 674303 - DNA, 13 bp, D. melanogaster
tttcaagttcttt

SEQ ID NO: 674304 - DNA, 13 bp, D. melanogaster
tttcaagttggct

SEQ ID NO: 674305 - DNA, 13 bp, D. melanogaster
tttcaagttgttt

SEQ ID NO: 674306 - DNA, 13 bp, D. melanogaster
tttcaagtttcaa

SEQ ID NO: 674307 - DNA, 13 bp, D. melanogaster
tttcaagtttcct

SEQ ID NO: 674308 - DNA, 13 bp, D. melanogaster
tttcaagttttaa

SEQ ID NO: 674309 - DNA, 13 bp, D. melanogaster
tttcaagtttttg

SEQ ID NO: 674310 - DNA, 13 bp, D. melanogaster
tttcaataaaaga

SEQ ID NO: 674311 - DNA, 13 bp, D. melanogaster
tttcaataaaagt

SEQ ID NO: 674312 - DNA, 13 bp, D. melanogaster
tttcaataaaatc

SEQ ID NO: 674313 - DNA, 13 bp, D. melanogaster
tttcaataaaatg

SEQ ID NO: 674314 - DNA, 15 bp, D. melanogaster
tttcaataaatgttc

SEQ ID NO: 674315 - DNA, 13 bp, D. melanogaster
tttcaataacatt

SEQ ID NO: 674316 - DNA, 13 bp, D. melanogaster
tttcaataacttt

SEQ ID NO: 674317 - DNA, 13 bp, D. melanogaster
tttcaataagcca

SEQ ID NO: 674318 - DNA, 13 bp, D. melanogaster
tttcaataatcaa

SEQ ID NO: 674319 - DNA, 13 bp, D. melanogaster
tttcaataccaaa

SEQ ID NO: 674320 - DNA, 13 bp, D. melanogaster
tttcaatagaagc

SEQ ID NO: 674321 - DNA, 13 bp, D. melanogaster
tttcaatagataa

SEQ ID NO: 674322 - DNA, 14 bp, D. melanogaster
tttcaatagataaa

SEQ ID NO: 674323 - DNA, 13 bp, D. melanogaster
tttcaataggttt

SEQ ID NO: 674324 - DNA, 13 bp, D. melanogaster
tttcaatagtttt

SEQ ID NO: 674325 - DNA, 13 bp, D. melanogaster
tttcaatatagaa

SEQ ID NO: 674326 - DNA, 14 bp, D. melanogaster
tttcaatatagaat

SEQ ID NO: 674327 - DNA, 13 bp, D. melanogaster
tttcaatatagtt

SEQ ID NO: 674328 - DNA, 13 bp, D. melanogaster
tttcaatatatgt

SEQ ID NO: 674329 - DNA, 14 bp, D. melanogaster
tttcaatatatgta

SEQ ID NO: 674330 - DNA, 13 bp, D. melanogaster
tttcaatatgaaa

SEQ ID NO: 674331 - DNA, 13 bp, D. melanogaster
tttcaatattcaa

SEQ ID NO: 674332 - DNA, 13 bp, D. melanogaster
tttcaatatttac

SEQ ID NO: 674333 - DNA, 13 bp, D. melanogaster
tttcaatatttgc

SEQ ID NO: 674334 - DNA, 14 bp, D. melanogaster
tttcaatatttgtg

SEQ ID NO: 674335 - DNA, 13 bp, D. melanogaster
tttcaatcaaaaa

SEQ ID NO: 674336 - DNA, 13 bp, D. melanogaster
tttcaatcaatca

SEQ ID NO: 674337 - DNA, 13 bp, D. melanogaster
tttcaatcacttt

SEQ ID NO: 674338 - DNA, 13 bp, D. melanogaster
tttcaatcagttt

SEQ ID NO: 674339 - DNA, 13 bp, D. melanogaster
tttcaatcataaa

SEQ ID NO: 674340 - DNA, 13 bp, D. melanogaster
tttcaatcataca

SEQ ID NO: 674341 - DNA, 14 bp, D. melanogaster
tttcaatcatacat

SEQ ID NO: 674342 - DNA, 13 bp, D. melanogaster
tttcaatctcaat

SEQ ID NO: 674343 - DNA, 13 bp, D. melanogaster
tttcaatgaaaat

SEQ ID NO: 674344 - DNA, 13 bp, D. melanogaster
tttcaatgaaact

SEQ ID NO: 674345 - DNA, 13 bp, D. melanogaster
tttcaatgaaata

SEQ ID NO: 674346 - DNA, 13 bp, D. melanogaster
tttcaatgagaaa

SEQ ID NO: 674347 - DNA, 13 bp, D. melanogaster
tttcaatgagttt

SEQ ID NO: 674348 - DNA, 13 bp, D. melanogaster
tttcaatgataat

SEQ ID NO: 674349 - DNA, 13 bp, D. melanogaster
tttcaatgatttt

SEQ ID NO: 674350 - DNA, 13 bp, D. melanogaster
tttcaatgcaata

SEQ ID NO: 674351 - DNA, 13 bp, D. melanogaster
tttcaatgcagct

SEQ ID NO: 674352 - DNA, 13 bp, D. melanogaster
tttcaatgccaaa

SEQ ID NO: 674353 - DNA, 14 bp, D. melanogaster
tttcaatgccaaaa

SEQ ID NO: 674354 - DNA, 13 bp, D. melanogaster
tttcaatgccaat

SEQ ID NO: 674355 - DNA, 13 bp, D. melanogaster
tttcaatgccatt

SEQ ID NO: 674356 - DNA, 13 bp, D. melanogaster
tttcaatgctaat

SEQ ID NO: 674357 - DNA, 13 bp, D. melanogaster
tttcaatgctatt

SEQ ID NO: 674358 - DNA, 13 bp, D. melanogaster
tttcaatggaaaa

SEQ ID NO: 674359 - DNA, 13 bp, D. melanogaster
tttcaatggcaat

SEQ ID NO: 674360 - DNA, 13 bp, D. melanogaster
tttcaatggcatt

SEQ ID NO: 674361 - DNA, 13 bp, D. melanogaster
tttcaatggccaa

SEQ ID NO: 674362 - DNA, 13 bp, D. melanogaster
tttcaatggcttt

SEQ ID NO: 674363 - DNA, 13 bp, D. melanogaster
tttcaatggtttt

SEQ ID NO: 674364 - DNA, 13 bp, D. melanogaster
tttcaatgtaatt

SEQ ID NO: 674365 - DNA, 13 bp, D. melanogaster
tttcaatgtcaat

SEQ ID NO: 674366 - DNA, 13 bp, D. melanogaster
tttcaatgtgtat

SEQ ID NO: 674367 - DNA, 13 bp, D. melanogaster
tttcaatgttcgc

SEQ ID NO: 674368 - DNA, 14 bp, D. melanogaster
tttcaatgttcgca

SEQ ID NO: 674369 - DNA, 13 bp, D. melanogaster
tttcaatgttttc

SEQ ID NO: 674370 - DNA, 13 bp, D. melanogaster
tttcaattaaaag

SEQ ID NO: 674371 - DNA, 14 bp, D. melanogaster
tttcaattaaaagt

SEQ ID NO: 674372 - DNA, 13 bp, D. melanogaster
tttcaattaaact

SEQ ID NO: 674373 - DNA, 13 bp, D. melanogaster
tttcaattaaatg

SEQ ID NO: 674374 - DNA, 14 bp, D. melanogaster
tttcaattaaatgc

SEQ ID NO: 674375 - DNA, 13 bp, D. melanogaster
tttcaattaagcc

SEQ ID NO: 674376 - DNA, 13 bp, D. melanogaster
tttcaattaagcg

SEQ ID NO: 674377 - DNA, 13 bp, D. melanogaster
tttcaattaagtg

SEQ ID NO: 674378 - DNA, 13 bp, D. melanogaster
tttcaattaagtt

SEQ ID NO: 674379 - DNA, 13 bp, D. melanogaster
tttcaattacaaa

SEQ ID NO: 674380 - DNA, 13 bp, D. melanogaster
tttcaattacaat

SEQ ID NO: 674381 - DNA, 13 bp, D. melanogaster
tttcaattaccaa

SEQ ID NO: 674382 - DNA, 13 bp, D. melanogaster
tttcaattagaaa

SEQ ID NO: 674383 - DNA, 14 bp, D. melanogaster
tttcaattagaaaa

SEQ ID NO: 674384 - DNA, 13 bp, D. melanogaster
tttcaattagatt

SEQ ID NO: 674385 - DNA, 13 bp, D. melanogaster
tttcaattaggca

SEQ ID NO: 674386 - DNA, 13 bp, D. melanogaster
tttcaattagttt

SEQ ID NO: 674387 - DNA, 14 bp, D. melanogaster
tttcaattatgaaa

SEQ ID NO: 674388 - DNA, 13 bp, D. melanogaster
tttcaattattgc

SEQ ID NO: 674389 - DNA, 13 bp, D. melanogaster
tttcaattcaaat

SEQ ID NO: 674390 - DNA, 13 bp, D. melanogaster
tttcaattcaatg

SEQ ID NO: 674391 - DNA, 13 bp, D. melanogaster
tttcaattcaatt

SEQ ID NO: 674392 - DNA, 13 bp, D. melanogaster
tttcaattcgaat

SEQ ID NO: 674393 - DNA, 13 bp, D. melanogaster
tttcaattcgatt

SEQ ID NO: 674394 - DNA, 14 bp, D. melanogaster
tttcaattcgattt

SEQ ID NO: 674395 - DNA, 13 bp, D. melanogaster
tttcaattctcaa

SEQ ID NO: 674396 - DNA, 13 bp, D. melanogaster
tttcaattctttg

SEQ ID NO: 674397 - DNA, 14 bp, D. melanogaster
tttcaattctttgg

SEQ ID NO: 674398 - DNA, 13 bp, D. melanogaster
tttcaattgaaaa

SEQ ID NO: 674399 - DNA, 14 bp, D. melanogaster
tttcaattgaaatt

SEQ ID NO: 674400 - DNA, 13 bp, D. melanogaster
tttcaattgaaca

SEQ ID NO: 674401 - DNA, 13 bp, D. melanogaster
tttcaattgaatg

SEQ ID NO: 674402 - DNA, 14 bp, D. melanogaster
tttcaattgaattt

SEQ ID NO: 674403 - DNA, 13 bp, D. melanogaster
tttcaattgacaa

SEQ ID NO: 674404 - DNA, 13 bp, D. melanogaster
tttcaattgacat

SEQ ID NO: 674405 - DNA, 13 bp, D. melanogaster
tttcaattgagca

SEQ ID NO: 674406 - DNA, 13 bp, D. melanogaster
tttcaattgagtt

SEQ ID NO: 674407 - DNA, 13 bp, D. melanogaster
tttcaattgattc

SEQ ID NO: 674408 - DNA, 13 bp, D. melanogaster
tttcaattgattt

SEQ ID NO: 674409 - DNA, 14 bp, D. melanogaster
tttcaattgatttt

SEQ ID NO: 674410 - DNA, 13 bp, D. melanogaster
tttcaattgcaaa

SEQ ID NO: 674411 - DNA, 13 bp, D. melanogaster
tttcaattgcaat

SEQ ID NO: 674412 - DNA, 14 bp, D. melanogaster
tttcaattgcaatt

SEQ ID NO: 674413 - DNA, 13 bp, D. melanogaster
tttcaattgcaca

SEQ ID NO: 674414 - DNA, 13 bp, D. melanogaster
tttcaattgcact

SEQ ID NO: 674415 - DNA, 13 bp, D. melanogaster
tttcaattgcagc

SEQ ID NO: 674416 - DNA, 13 bp, D. melanogaster
tttcaattgcatt

SEQ ID NO: 674417 - DNA, 13 bp, D. melanogaster
tttcaattgccaa

SEQ ID NO: 674418 - DNA, 13 bp, D. melanogaster
tttcaattgccca

SEQ ID NO: 674419 - DNA, 13 bp, D. melanogaster
tttcaattgcctc

SEQ ID NO: 674420 - DNA, 13 bp, D. melanogaster
tttcaattgctgt

SEQ ID NO: 674421 - DNA, 13 bp, D. melanogaster
tttcaattgcttt

SEQ ID NO: 674422 - DNA, 13 bp, D. melanogaster
tttcaattggaaa

SEQ ID NO: 674423 - DNA, 13 bp, D. melanogaster
tttcaattggatt

SEQ ID NO: 674424 - DNA, 13 bp, D. melanogaster
tttcaattggttt

SEQ ID NO: 674425 - DNA, 13 bp, D. melanogaster
tttcaattgttta

SEQ ID NO: 674426 - DNA, 13 bp, D. melanogaster
tttcaattgtttg

SEQ ID NO: 674427 - DNA, 13 bp, D. melanogaster
tttcaatttaaac

SEQ ID NO: 674428 - DNA, 14 bp, D. melanogaster
tttcaatttaaatg

SEQ ID NO: 674429 - DNA, 13 bp, D. melanogaster
tttcaatttaact

SEQ ID NO: 674430 - DNA, 13 bp, D. melanogaster
tttcaatttaatc

SEQ ID NO: 674431 - DNA, 13 bp, D. melanogaster
tttcaatttcaaa

SEQ ID NO: 674432 - DNA, 14 bp, D. melanogaster
tttcaatttcaaaa

SEQ ID NO: 674433 - DNA, 13 bp, D. melanogaster
tttcaatttcaat

SEQ ID NO: 674434 - DNA, 13 bp, D. melanogaster
tttcaatttcact

SEQ ID NO: 674435 - DNA, 13 bp, D. melanogaster
tttcaatttcagc

SEQ ID NO: 674436 - DNA, 13 bp, D. melanogaster
tttcaatttcagt

SEQ ID NO: 674437 - DNA, 14 bp, D. melanogaster
tttcaatttcattc

SEQ ID NO: 674438 - DNA, 13 bp, D. melanogaster
tttcaatttccac

SEQ ID NO: 674439 - DNA, 14 bp, D. melanogaster
tttcaatttccatt

SEQ ID NO: 674440 - DNA, 13 bp, D. melanogaster
tttcaatttccta

SEQ ID NO: 674441 - DNA, 14 bp, D. melanogaster
tttcaatttcgatt

SEQ ID NO: 674442 - DNA, 13 bp, D. melanogaster
tttcaatttcgcc

SEQ ID NO: 674443 - DNA, 13 bp, D. melanogaster
tttcaatttcgtt

SEQ ID NO: 674444 - DNA, 14 bp, D. melanogaster
tttcaatttcgttt

SEQ ID NO: 674445 - DNA, 13 bp, D. melanogaster
tttcaatttctgt

SEQ ID NO: 674446 - DNA, 14 bp, D. melanogaster
tttcaatttgaatt

SEQ ID NO: 674447 - DNA, 13 bp, D. melanogaster
tttcaatttgata

SEQ ID NO: 674448 - DNA, 14 bp, D. melanogaster
tttcaatttgatat

SEQ ID NO: 674449 - DNA, 14 bp, D. melanogaster
tttcaatttgattt

SEQ ID NO: 674450 - DNA, 13 bp, D. melanogaster
tttcaatttgcat

SEQ ID NO: 674451 - DNA, 14 bp, D. melanogaster
tttcaatttgcatt

SEQ ID NO: 674452 - DNA, 13 bp, D. melanogaster
tttcaatttgcca

SEQ ID NO: 674453 - DNA, 13 bp, D. melanogaster
tttcaatttgctc

SEQ ID NO: 674454 - DNA, 13 bp, D. melanogaster
tttcaatttgtca

SEQ ID NO: 674455 - DNA, 13 bp, D. melanogaster
tttcaatttgtct

SEQ ID NO: 674456 - DNA, 13 bp, D. melanogaster
tttcaatttgtgc

SEQ ID NO: 674457 - DNA, 13 bp, D. melanogaster
tttcaatttgttg

SEQ ID NO: 674458 - DNA, 14 bp, D. melanogaster
tttcaatttgttgc

SEQ ID NO: 674459 - DNA, 13 bp, D. melanogaster
tttcaattttacg

SEQ ID NO: 674460 - DNA, 14 bp, D. melanogaster
tttcaattttcgca

SEQ ID NO: 674461 - DNA, 13 bp, D. melanogaster
tttcaattttgca

SEQ ID NO: 674462 - DNA, 13 bp, D. melanogaster
tttcaattttgct

SEQ ID NO: 674463 - DNA, 13 bp, D. melanogaster
tttcaatttttga

SEQ ID NO: 674464 - DNA, 13 bp, D. melanogaster
tttcacaaacaaa

SEQ ID NO: 674465 - DNA, 13 bp, D. melanogaster
tttcacaaacaat

SEQ ID NO: 674466 - DNA, 13 bp, D. melanogaster
tttcacaaataat

SEQ ID NO: 674467 - DNA, 13 bp, D. melanogaster
tttcacaactttt

SEQ ID NO: 674468 - DNA, 14 bp, D. melanogaster
tttcacaagaatgt

SEQ ID NO: 674469 - DNA, 13 bp, D. melanogaster
tttcacaatcttt

SEQ ID NO: 674470 - DNA, 13 bp, D. melanogaster
tttcacaatttca

SEQ ID NO: 674471 - DNA, 13 bp, D. melanogaster
tttcacaatttcc

SEQ ID NO: 674472 - DNA, 13 bp, D. melanogaster
tttcacacaaaaa

SEQ ID NO: 674473 - DNA, 13 bp, D. melanogaster
tttcacacaattt

SEQ ID NO: 674474 - DNA, 13 bp, D. melanogaster
tttcacacacaca

SEQ ID NO: 674475 - DNA, 13 bp, D. melanogaster
tttcacacatttc

SEQ ID NO: 674476 - DNA, 13 bp, D. melanogaster
tttcacacatttg

SEQ ID NO: 674477 - DNA, 13 bp, D. melanogaster
tttcacaccattt

SEQ ID NO: 674478 - DNA, 13 bp, D. melanogaster
tttcacacgccgc

SEQ ID NO: 674479 - DNA, 13 bp, D. melanogaster
tttcacacttttc

SEQ ID NO: 674480 - DNA, 13 bp, D. melanogaster
tttcacagccatt

SEQ ID NO: 674481 - DNA, 13 bp, D. melanogaster
tttcacatacata

SEQ ID NO: 674482 - DNA, 13 bp, D. melanogaster
tttcacatacttt

SEQ ID NO: 674483 - DNA, 13 bp, D. melanogaster
tttcacatatatt

SEQ ID NO: 674484 - DNA, 13 bp, D. melanogaster
tttcacattaaaa

SEQ ID NO: 674485 - DNA, 13 bp, D. melanogaster
tttcacattcaaa

SEQ ID NO: 674486 - DNA, 13 bp, D. melanogaster
tttcacattcatt

SEQ ID NO: 674487 - DNA, 13 bp, D. melanogaster
tttcacattgaaa

SEQ ID NO: 674488 - DNA, 13 bp, D. melanogaster
tttcacatttaaa

SEQ ID NO: 674489 - DNA, 13 bp, D. melanogaster
tttcacatttcgc

SEQ ID NO: 674490 - DNA, 13 bp, D. melanogaster
tttcacatttcgt

SEQ ID NO: 674491 - DNA, 13 bp, D. melanogaster
tttcacatttgtt

SEQ ID NO: 674492 - DNA, 13 bp, D. melanogaster
tttcacattttaa

SEQ ID NO: 674493 - DNA, 13 bp, D. melanogaster
tttcacattttcg

SEQ ID NO: 674494 - DNA, 14 bp, D. melanogaster
tttcacattttcga

SEQ ID NO: 674495 - DNA, 13 bp, D. melanogaster
tttcaccaaaaaa

SEQ ID NO: 674496 - DNA, 13 bp, D. melanogaster
tttcaccaacaat

SEQ ID NO: 674497 - DNA, 13 bp, D. melanogaster
tttcaccaatttt

SEQ ID NO: 674498 - DNA, 13 bp, D. melanogaster
tttcaccaccttt

SEQ ID NO: 674499 - DNA, 14 bp, D. melanogaster
tttcaccagctttg

SEQ ID NO: 674500 - DNA, 13 bp, D. melanogaster
tttcaccatttcc

SEQ ID NO: 674501 - DNA, 13 bp, D. melanogaster
tttcacccaattt

SEQ ID NO: 674502 - DNA, 13 bp, D. melanogaster
tttcacccacttt

SEQ ID NO: 674503 - DNA, 13 bp, D. melanogaster
tttcacccatttc

SEQ ID NO: 674504 - DNA, 13 bp, D. melanogaster
tttcacccatttt

SEQ ID NO: 674505 - DNA, 13 bp, D. melanogaster
tttcacctgcgca

SEQ ID NO: 674506 - DNA, 13 bp, D. melanogaster
tttcacctttcac

SEQ ID NO: 674507 - DNA, 13 bp, D. melanogaster
tttcaccttttgt

SEQ ID NO: 674508 - DNA, 13 bp, D. melanogaster
tttcacgaattta

SEQ ID NO: 674509 - DNA, 13 bp, D. melanogaster
tttcacgctttga

SEQ ID NO: 674510 - DNA, 13 bp, D. melanogaster
tttcactaaagtt

SEQ ID NO: 674511 - DNA, 13 bp, D. melanogaster
tttcactaattta

SEQ ID NO: 674512 - DNA, 13 bp, D. melanogaster
tttcactgaaaat

SEQ ID NO: 674513 - DNA, 13 bp, D. melanogaster
tttcactgaattt

SEQ ID NO: 674514 - DNA, 13 bp, D. melanogaster
tttcactgcattt

SEQ ID NO: 674515 - DNA, 13 bp, D. melanogaster
tttcactgctttt

SEQ ID NO: 674516 - DNA, 13 bp, D. melanogaster
tttcactggaaaa

SEQ ID NO: 674517 - DNA, 13 bp, D. melanogaster
tttcactggcttt

SEQ ID NO: 674518 - DNA, 13 bp, D. melanogaster
tttcactgtttgc

SEQ ID NO: 674519 - DNA, 13 bp, D. melanogaster
tttcactgttttc

SEQ ID NO: 674520 - DNA, 13 bp, D. melanogaster
tttcacttaaatt

SEQ ID NO: 674521 - DNA, 13 bp, D. melanogaster
tttcacttcaatt

SEQ ID NO: 674522 - DNA, 13 bp, D. melanogaster
tttcacttcactt

SEQ ID NO: 674523 - DNA, 13 bp, D. melanogaster
tttcacttcgttt

SEQ ID NO: 674524 - DNA, 13 bp, D. melanogaster
tttcacttgattt

SEQ ID NO: 674525 - DNA, 13 bp, D. melanogaster
tttcacttgcatt

SEQ ID NO: 674526 - DNA, 13 bp, D. melanogaster
tttcacttgccaa

SEQ ID NO: 674527 - DNA, 13 bp, D. melanogaster
tttcacttgctgc

SEQ ID NO: 674528 - DNA, 13 bp, D. melanogaster
tttcacttgcttt

SEQ ID NO: 674529 - DNA, 13 bp, D. melanogaster
tttcactttaaag

SEQ ID NO: 674530 - DNA, 13 bp, D. melanogaster
tttcactttattg

SEQ ID NO: 674531 - DNA, 13 bp, D. melanogaster
tttcactttcaat

SEQ ID NO: 674532 - DNA, 13 bp, D. melanogaster
tttcactttcaca

SEQ ID NO: 674533 - DNA, 13 bp, D. melanogaster
tttcactttcact

SEQ ID NO: 674534 - DNA, 13 bp, D. melanogaster
tttcactttcgtt

SEQ ID NO: 674535 - DNA, 13 bp, D. melanogaster
tttcactttgaat

SEQ ID NO: 674536 - DNA, 13 bp, D. melanogaster
tttcactttgagc

SEQ ID NO: 674537 - DNA, 13 bp, D. melanogaster
tttcactttgatt

SEQ ID NO: 674538 - DNA, 13 bp, D. melanogaster
tttcactttgcaa

SEQ ID NO: 674539 - DNA, 13 bp, D. melanogaster
tttcactttgcgc

SEQ ID NO: 674540 - DNA, 13 bp, D. melanogaster
tttcactttgtgc

SEQ ID NO: 674541 - DNA, 13 bp, D. melanogaster
tttcacttttaaa

SEQ ID NO: 674542 - DNA, 13 bp, D. melanogaster
tttcacttttacc

SEQ ID NO: 674543 - DNA, 13 bp, D. melanogaster
tttcacttttcaa

SEQ ID NO: 674544 - DNA, 13 bp, D. melanogaster
tttcacttttcag

SEQ ID NO: 674545 - DNA, 13 bp, D. melanogaster
tttcacttttgcc

SEQ ID NO: 674546 - DNA, 13 bp, D. melanogaster
tttcagaaaatat

SEQ ID NO: 674547 - DNA, 13 bp, D. melanogaster
tttcagaaaatcc

SEQ ID NO: 674548 - DNA, 13 bp, D. melanogaster
tttcagaaaattt

SEQ ID NO: 674549 - DNA, 13 bp, D. melanogaster
tttcagaaatttt

SEQ ID NO: 674550 - DNA, 13 bp, D. melanogaster
tttcagaacattt

SEQ ID NO: 674551 - DNA, 13 bp, D. melanogaster
tttcagaagaaca

SEQ ID NO: 674552 - DNA, 13 bp, D. melanogaster
tttcagaatattt

SEQ ID NO: 674553 - DNA, 13 bp, D. melanogaster
tttcagagaacaa

SEQ ID NO: 674554 - DNA, 13 bp, D. melanogaster
tttcagatatttt

SEQ ID NO: 674555 - DNA, 14 bp, D. melanogaster
tttcagatctataa

SEQ ID NO: 674556 - DNA, 13 bp, D. melanogaster
tttcagattcaaa

SEQ ID NO: 674557 - DNA, 13 bp, D. melanogaster
tttcagatttttc

SEQ ID NO: 674558 - DNA, 14 bp, D. melanogaster
tttcagattttttg

SEQ ID NO: 674559 - DNA, 13 bp, D. melanogaster
tttcagcaaattg

SEQ ID NO: 674560 - DNA, 13 bp, D. melanogaster
tttcagcaaattt

SEQ ID NO: 674561 - DNA, 13 bp, D. melanogaster
tttcagcaacttt

SEQ ID NO: 674562 - DNA, 13 bp, D. melanogaster
tttcagcaatttc

SEQ ID NO: 674563 - DNA, 13 bp, D. melanogaster
tttcagcagatag

SEQ ID NO: 674564 - DNA, 13 bp, D. melanogaster
tttcagcagcagc

SEQ ID NO: 674565 - DNA, 13 bp, D. melanogaster
tttcagcagctgc

SEQ ID NO: 674566 - DNA, 13 bp, D. melanogaster
tttcagcatcctt

SEQ ID NO: 674567 - DNA, 13 bp, D. melanogaster
tttcagcattttg

SEQ ID NO: 674568 - DNA, 14 bp, D. melanogaster
tttcagcattttta

SEQ ID NO: 674569 - DNA, 13 bp, D. melanogaster
tttcagccaaaaa

SEQ ID NO: 674570 - DNA, 13 bp, D. melanogaster
tttcagccaaatg

SEQ ID NO: 674571 - DNA, 13 bp, D. melanogaster
tttcagccacttt

SEQ ID NO: 674572 - DNA, 13 bp, D. melanogaster
tttcagccataaa

SEQ ID NO: 674573 - DNA, 13 bp, D. melanogaster
tttcagccattta

SEQ ID NO: 674574 - DNA, 13 bp, D. melanogaster
tttcagccatttt

SEQ ID NO: 674575 - DNA, 13 bp, D. melanogaster
tttcagcgctttt

SEQ ID NO: 674576 - DNA, 13 bp, D. melanogaster
tttcagctatttt

SEQ ID NO: 674577 - DNA, 13 bp, D. melanogaster
tttcagctcagtt

SEQ ID NO: 674578 - DNA, 13 bp, D. melanogaster
tttcagctcattt

SEQ ID NO: 674579 - DNA, 13 bp, D. melanogaster
tttcagctccttt

SEQ ID NO: 674580 - DNA, 13 bp, D. melanogaster
tttcagctctttt

SEQ ID NO: 674581 - DNA, 13 bp, D. melanogaster
tttcagctgcatt

SEQ ID NO: 674582 - DNA, 13 bp, D. melanogaster
tttcagctgctcc

SEQ ID NO: 674583 - DNA, 13 bp, D. melanogaster
tttcagctgctct

SEQ ID NO: 674584 - DNA, 13 bp, D. melanogaster
tttcagctgctgc

SEQ ID NO: 674585 - DNA, 13 bp, D. melanogaster
tttcagctgcttt

SEQ ID NO: 674586 - DNA, 13 bp, D. melanogaster
tttcagctggaaa

SEQ ID NO: 674587 - DNA, 13 bp, D. melanogaster
tttcagctggcag

SEQ ID NO: 674588 - DNA, 13 bp, D. melanogaster
tttcagctggcca

SEQ ID NO: 674589 - DNA, 13 bp, D. melanogaster
tttcagctggctt

SEQ ID NO: 674590 - DNA, 13 bp, D. melanogaster
tttcagcttaatt

SEQ ID NO: 674591 - DNA, 13 bp, D. melanogaster
tttcagcttgaaa

SEQ ID NO: 674592 - DNA, 13 bp, D. melanogaster
tttcagcttgttt

SEQ ID NO: 674593 - DNA, 13 bp, D. melanogaster
tttcagctttatt

SEQ ID NO: 674594 - DNA, 14 bp, D. melanogaster
tttcagctttattt

SEQ ID NO: 674595 - DNA, 13 bp, D. melanogaster
tttcagcttttcc

SEQ ID NO: 674596 - DNA, 13 bp, D. melanogaster
tttcaggaacact

SEQ ID NO: 674597 - DNA, 13 bp, D. melanogaster
tttcaggaattgt

SEQ ID NO: 674598 - DNA, 13 bp, D. melanogaster
tttcaggacttta

SEQ ID NO: 674599 - DNA, 13 bp, D. melanogaster
tttcagtactttt

SEQ ID NO: 674600 - DNA, 13 bp, D. melanogaster
tttcagtccgtat

SEQ ID NO: 674601 - DNA, 13 bp, D. melanogaster
tttcagtcggtgg

SEQ ID NO: 674602 - DNA, 13 bp, D. melanogaster
tttcagtgcagca

SEQ ID NO: 674603 - DNA, 13 bp, D. melanogaster
tttcagtggtttt

SEQ ID NO: 674604 - DNA, 13 bp, D. melanogaster
tttcagttaaatt

SEQ ID NO: 674605 - DNA, 13 bp, D. melanogaster
tttcagttacttt

SEQ ID NO: 674606 - DNA, 13 bp, D. melanogaster
tttcagttagttt

SEQ ID NO: 674607 - DNA, 13 bp, D. melanogaster
tttcagttcaaat

SEQ ID NO: 674608 - DNA, 13 bp, D. melanogaster
tttcagttcactt

SEQ ID NO: 674609 - DNA, 13 bp, D. melanogaster
tttcagttcagtt

SEQ ID NO: 674610 - DNA, 14 bp, D. melanogaster
tttcagttcagttc

SEQ ID NO: 674611 - DNA, 13 bp, D. melanogaster
tttcagttcattg

SEQ ID NO: 674612 - DNA, 13 bp, D. melanogaster
tttcagttccagc

SEQ ID NO: 674613 - DNA, 13 bp, D. melanogaster
tttcagttcccag

SEQ ID NO: 674614 - DNA, 13 bp, D. melanogaster
tttcagttccttt

SEQ ID NO: 674615 - DNA, 13 bp, D. melanogaster
tttcagttcgatt

SEQ ID NO: 674616 - DNA, 13 bp, D. melanogaster
tttcagttcggtt

SEQ ID NO: 674617 - DNA, 13 bp, D. melanogaster
tttcagttcgttt

SEQ ID NO: 674618 - DNA, 13 bp, D. melanogaster
tttcagttctcag

SEQ ID NO: 674619 - DNA, 13 bp, D. melanogaster
tttcagttgaaat

SEQ ID NO: 674620 - DNA, 13 bp, D. melanogaster
tttcagttgagtt

SEQ ID NO: 674621 - DNA, 13 bp, D. melanogaster
tttcagttgcaaa

SEQ ID NO: 674622 - DNA, 14 bp, D. melanogaster
tttcagttgcattt

SEQ ID NO: 674623 - DNA, 13 bp, D. melanogaster
tttcagttgccac

SEQ ID NO: 674624 - DNA, 13 bp, D. melanogaster
tttcagttgctgc

SEQ ID NO: 674625 - DNA, 13 bp, D. melanogaster
tttcagttgcttt

SEQ ID NO: 674626 - DNA, 13 bp, D. melanogaster
tttcagttggcca

SEQ ID NO: 674627 - DNA, 13 bp, D. melanogaster
tttcagttggctt

SEQ ID NO: 674628 - DNA, 13 bp, D. melanogaster
tttcagttggttt

SEQ ID NO: 674629 - DNA, 13 bp, D. melanogaster
tttcagttgtaaa

SEQ ID NO: 674630 - DNA, 13 bp, D. melanogaster
tttcagttgttgt

SEQ ID NO: 674631 - DNA, 13 bp, D. melanogaster
tttcagtttaatt

SEQ ID NO: 674632 - DNA, 14 bp, D. melanogaster
tttcagtttaattt

SEQ ID NO: 674633 - DNA, 13 bp, D. melanogaster
tttcagtttatta

SEQ ID NO: 674634 - DNA, 13 bp, D. melanogaster
tttcagtttattg

SEQ ID NO: 674635 - DNA, 14 bp, D. melanogaster
tttcagtttcactt

SEQ ID NO: 674636 - DNA, 13 bp, D. melanogaster
tttcagtttcaga

SEQ ID NO: 674637 - DNA, 13 bp, D. melanogaster
tttcagtttcagc

SEQ ID NO: 674638 - DNA, 13 bp, D. melanogaster
tttcagtttcagg

SEQ ID NO: 674639 - DNA, 14 bp, D. melanogaster
tttcagtttcagtt

SEQ ID NO: 674640 - DNA, 13 bp, D. melanogaster
tttcagtttcatt

SEQ ID NO: 674641 - DNA, 14 bp, D. melanogaster
tttcagtttcattt

SEQ ID NO: 674642 - DNA, 13 bp, D. melanogaster
tttcagtttccag

SEQ ID NO: 674643 - DNA, 13 bp, D. melanogaster
tttcagtttccat

SEQ ID NO: 674644 - DNA, 14 bp, D. melanogaster
tttcagtttcgttt

SEQ ID NO: 674645 - DNA, 13 bp, D. melanogaster
tttcagtttctgt

SEQ ID NO: 674646 - DNA, 13 bp, D. melanogaster
tttcagtttgcca

SEQ ID NO: 674647 - DNA, 13 bp, D. melanogaster
tttcagtttggca

SEQ ID NO: 674648 - DNA, 13 bp, D. melanogaster
tttcagtttggtt

SEQ ID NO: 674649 - DNA, 13 bp, D. melanogaster
tttcagttttcaa

SEQ ID NO: 674650 - DNA, 13 bp, D. melanogaster
tttcagttttccc

SEQ ID NO: 674651 - DNA, 13 bp, D. melanogaster
tttcagttttgaa

SEQ ID NO: 674652 - DNA, 13 bp, D. melanogaster
tttcagttttgag

SEQ ID NO: 674653 - DNA, 13 bp, D. melanogaster
tttcagttttgca

SEQ ID NO: 674654 - DNA, 13 bp, D. melanogaster
tttcagttttggc

SEQ ID NO: 674655 - DNA, 13 bp, D. melanogaster
tttcagtttttca

SEQ ID NO: 674656 - DNA, 14 bp, D. melanogaster
tttcagtttttcag

SEQ ID NO: 674657 - DNA, 13 bp, D. melanogaster
tttcagtttttcc

SEQ ID NO: 674658 - DNA, 13 bp, D. melanogaster
tttcagtttttgg

SEQ ID NO: 674659 - DNA, 13 bp, D. melanogaster
tttcataaaaact

SEQ ID NO: 674660 - DNA, 13 bp, D. melanogaster
tttcataaaatag

SEQ ID NO: 674661 - DNA, 13 bp, D. melanogaster
tttcataaaattc

SEQ ID NO: 674662 - DNA, 13 bp, D. melanogaster
tttcataaagaaa

SEQ ID NO: 674663 - DNA, 13 bp, D. melanogaster
tttcataacaatt

SEQ ID NO: 674664 - DNA, 13 bp, D. melanogaster
tttcataacattt

SEQ ID NO: 674665 - DNA, 13 bp, D. melanogaster
tttcataacttaa

SEQ ID NO: 674666 - DNA, 13 bp, D. melanogaster
tttcataacttta

SEQ ID NO: 674667 - DNA, 13 bp, D. melanogaster
tttcataagtttt

SEQ ID NO: 674668 - DNA, 13 bp, D. melanogaster
tttcataattgtg

SEQ ID NO: 674669 - DNA, 13 bp, D. melanogaster
tttcataatttcc

SEQ ID NO: 674670 - DNA, 13 bp, D. melanogaster
tttcataattttg

SEQ ID NO: 674671 - DNA, 13 bp, D. melanogaster
tttcatacaaatt

SEQ ID NO: 674672 - DNA, 13 bp, D. melanogaster
tttcatacatatg

SEQ ID NO: 674673 - DNA, 13 bp, D. melanogaster
tttcatacgattt

SEQ ID NO: 674674 - DNA, 13 bp, D. melanogaster
tttcatagccaaa

SEQ ID NO: 674675 - DNA, 13 bp, D. melanogaster
tttcatagtttct

SEQ ID NO: 674676 - DNA, 13 bp, D. melanogaster
tttcatagtttta

SEQ ID NO: 674677 - DNA, 13 bp, D. melanogaster
tttcatataattc

SEQ ID NO: 674678 - DNA, 13 bp, D. melanogaster
tttcatatacata

SEQ ID NO: 674679 - DNA, 13 bp, D. melanogaster
tttcatatatgta

SEQ ID NO: 674680 - DNA, 13 bp, D. melanogaster
tttcatatcgttt

SEQ ID NO: 674681 - DNA, 13 bp, D. melanogaster
tttcatatgaaat

SEQ ID NO: 674682 - DNA, 13 bp, D. melanogaster
tttcatatgaatt

SEQ ID NO: 674683 - DNA, 13 bp, D. melanogaster
tttcatatgaccc

SEQ ID NO: 674684 - DNA, 14 bp, D. melanogaster
tttcatatgcatat

SEQ ID NO: 674685 - DNA, 13 bp, D. melanogaster
tttcatatgcatt

SEQ ID NO: 674686 - DNA, 13 bp, D. melanogaster
tttcatattcaaa

SEQ ID NO: 674687 - DNA, 13 bp, D. melanogaster
tttcatattgtta

SEQ ID NO: 674688 - DNA, 13 bp, D. melanogaster
tttcatatttaca

SEQ ID NO: 674689 - DNA, 13 bp, D. melanogaster
tttcatatttatg

SEQ ID NO: 674690 - DNA, 13 bp, D. melanogaster
tttcatatttcag

SEQ ID NO: 674691 - DNA, 13 bp, D. melanogaster
tttcatatttcgc

SEQ ID NO: 674692 - DNA, 13 bp, D. melanogaster
tttcatatttcgt

SEQ ID NO: 674693 - DNA, 14 bp, D. melanogaster
tttcatatttttga

SEQ ID NO: 674694 - DNA, 13 bp, D. melanogaster
tttcatcaaaatt

SEQ ID NO: 674695 - DNA, 13 bp, D. melanogaster
tttcatcaaatcg

SEQ ID NO: 674696 - DNA, 13 bp, D. melanogaster
tttcatcagcttt

SEQ ID NO: 674697 - DNA, 13 bp, D. melanogaster
tttcatcagtgtc

SEQ ID NO: 674698 - DNA, 13 bp, D. melanogaster
tttcatcataact

SEQ ID NO: 674699 - DNA, 14 bp, D. melanogaster
tttcatcatcatca

SEQ ID NO: 674700 - DNA, 13 bp, D. melanogaster
tttcatcattaaa

SEQ ID NO: 674701 - DNA, 13 bp, D. melanogaster
tttcatcgacaac

SEQ ID NO: 674702 - DNA, 13 bp, D. melanogaster
tttcatcgatccc

SEQ ID NO: 674703 - DNA, 13 bp, D. melanogaster
tttcatcgcattt

SEQ ID NO: 674704 - DNA, 13 bp, D. melanogaster
tttcatctgcttt

SEQ ID NO: 674705 - DNA, 13 bp, D. melanogaster
tttcatgaaaatt

SEQ ID NO: 674706 - DNA, 13 bp, D. melanogaster
tttcatgatattt

SEQ ID NO: 674707 - DNA, 13 bp, D. melanogaster
tttcatgatttat

SEQ ID NO: 674708 - DNA, 13 bp, D. melanogaster
tttcatgcaaatt

SEQ ID NO: 674709 - DNA, 13 bp, D. melanogaster
tttcatgcacttt

SEQ ID NO: 674710 - DNA, 13 bp, D. melanogaster
tttcatgcataaa

SEQ ID NO: 674711 - DNA, 13 bp, D. melanogaster
tttcatgcatttt

SEQ ID NO: 674712 - DNA, 13 bp, D. melanogaster
tttcatgccattt

SEQ ID NO: 674713 - DNA, 13 bp, D. melanogaster
tttcatggatttt

SEQ ID NO: 674714 - DNA, 13 bp, D. melanogaster
tttcatggcaatt

SEQ ID NO: 674715 - DNA, 13 bp, D. melanogaster
tttcatggcattt

SEQ ID NO: 674716 - DNA, 13 bp, D. melanogaster
tttcatgggtttt

SEQ ID NO: 674717 - DNA, 13 bp, D. melanogaster
tttcatgtaattt

SEQ ID NO: 674718 - DNA, 13 bp, D. melanogaster
tttcatgtagtac

SEQ ID NO: 674719 - DNA, 13 bp, D. melanogaster
tttcatgtttgct

SEQ ID NO: 674720 - DNA, 13 bp, D. melanogaster
tttcatgttttcc

SEQ ID NO: 674721 - DNA, 13 bp, D. melanogaster
tttcattaaaaca

SEQ ID NO: 674722 - DNA, 13 bp, D. melanogaster
tttcattaaaact

SEQ ID NO: 674723 - DNA, 13 bp, D. melanogaster
tttcattaaacaa

SEQ ID NO: 674724 - DNA, 13 bp, D. melanogaster
tttcattaagaaa

SEQ ID NO: 674725 - DNA, 13 bp, D. melanogaster
tttcattaagaca

SEQ ID NO: 674726 - DNA, 13 bp, D. melanogaster
tttcattaagttt

SEQ ID NO: 674727 - DNA, 14 bp, D. melanogaster
tttcattaagtttt

SEQ ID NO: 674728 - DNA, 13 bp, D. melanogaster
tttcattacaaaa

SEQ ID NO: 674729 - DNA, 13 bp, D. melanogaster
tttcattagaaaa

SEQ ID NO: 674730 - DNA, 13 bp, D. melanogaster
tttcattagattt

SEQ ID NO: 674731 - DNA, 13 bp, D. melanogaster
tttcattagcata

SEQ ID NO: 674732 - DNA, 13 bp, D. melanogaster
tttcattaggcaa

SEQ ID NO: 674733 - DNA, 13 bp, D. melanogaster
tttcattagttta

SEQ ID NO: 674734 - DNA, 13 bp, D. melanogaster
tttcattatcaaa

SEQ ID NO: 674735 - DNA, 13 bp, D. melanogaster
tttcattatctag

SEQ ID NO: 674736 - DNA, 13 bp, D. melanogaster
tttcattatgcca

SEQ ID NO: 674737 - DNA, 14 bp, D. melanogaster
tttcattcaaaaat

SEQ ID NO: 674738 - DNA, 13 bp, D. melanogaster
tttcattcaaata

SEQ ID NO: 674739 - DNA, 14 bp, D. melanogaster
tttcattcaatttc

SEQ ID NO: 674740 - DNA, 13 bp, D. melanogaster
tttcattcagaaa

SEQ ID NO: 674741 - DNA, 13 bp, D. melanogaster
tttcattcaggtg

SEQ ID NO: 674742 - DNA, 14 bp, D. melanogaster
tttcattcataaaa

SEQ ID NO: 674743 - DNA, 13 bp, D. melanogaster
tttcattcataat

SEQ ID NO: 674744 - DNA, 14 bp, D. melanogaster
tttcattcatgaaa

SEQ ID NO: 674745 - DNA, 14 bp, D. melanogaster
tttcattcatgatt

SEQ ID NO: 674746 - DNA, 13 bp, D. melanogaster
tttcattcattca

SEQ ID NO: 674747 - DNA, 13 bp, D. melanogaster
tttcattccattc

SEQ ID NO: 674748 - DNA, 13 bp, D. melanogaster
tttcattccgttt

SEQ ID NO: 674749 - DNA, 13 bp, D. melanogaster
tttcattcgatta

SEQ ID NO: 674750 - DNA, 13 bp, D. melanogaster
tttcattcgattt

SEQ ID NO: 674751 - DNA, 14 bp, D. melanogaster
tttcattcgcattt

SEQ ID NO: 674752 - DNA, 13 bp, D. melanogaster
tttcattcgcttt

SEQ ID NO: 674753 - DNA, 13 bp, D. melanogaster
tttcattcggttt

SEQ ID NO: 674754 - DNA, 13 bp, D. melanogaster
tttcattcgtttc

SEQ ID NO: 674755 - DNA, 13 bp, D. melanogaster
tttcattctagtt

SEQ ID NO: 674756 - DNA, 14 bp, D. melanogaster
tttcattctgattt

SEQ ID NO: 674757 - DNA, 13 bp, D. melanogaster
tttcattgaaaat

SEQ ID NO: 674758 - DNA, 13 bp, D. melanogaster
tttcattgaatat

SEQ ID NO: 674759 - DNA, 14 bp, D. melanogaster
tttcattgaatata

SEQ ID NO: 674760 - DNA, 13 bp, D. melanogaster
tttcattgaattt

SEQ ID NO: 674761 - DNA, 14 bp, D. melanogaster
tttcattgaatttt

SEQ ID NO: 674762 - DNA, 13 bp, D. melanogaster
tttcattgagttc

SEQ ID NO: 674763 - DNA, 13 bp, D. melanogaster
tttcattgagttt

SEQ ID NO: 674764 - DNA, 13 bp, D. melanogaster
tttcattgataat

SEQ ID NO: 674765 - DNA, 13 bp, D. melanogaster
tttcattgatgtt

SEQ ID NO: 674766 - DNA, 13 bp, D. melanogaster
tttcattgcattt

SEQ ID NO: 674767 - DNA, 13 bp, D. melanogaster
tttcattgcgatt

SEQ ID NO: 674768 - DNA, 13 bp, D. melanogaster
tttcattgcgttt

SEQ ID NO: 674769 - DNA, 13 bp, D. melanogaster
tttcattgctaat

SEQ ID NO: 674770 - DNA, 13 bp, D. melanogaster
tttcattggattt

SEQ ID NO: 674771 - DNA, 13 bp, D. melanogaster
tttcattgggttt

SEQ ID NO: 674772 - DNA, 13 bp, D. melanogaster
tttcattgtaatt

SEQ ID NO: 674773 - DNA, 13 bp, D. melanogaster
tttcattgtcatt

SEQ ID NO: 674774 - DNA, 14 bp, D. melanogaster
tttcattgtcattt

SEQ ID NO: 674775 - DNA, 13 bp, D. melanogaster
tttcatttaaagt

SEQ ID NO: 674776 - DNA, 14 bp, D. melanogaster
tttcatttaaagtt

SEQ ID NO: 674777 - DNA, 13 bp, D. melanogaster
tttcatttaaatg

SEQ ID NO: 674778 - DNA, 14 bp, D. melanogaster
tttcatttaaatgc

SEQ ID NO: 674779 - DNA, 13 bp, D. melanogaster
tttcatttaacta

SEQ ID NO: 674780 - DNA, 13 bp, D. melanogaster
tttcatttaagcc

SEQ ID NO: 674781 - DNA, 13 bp, D. melanogaster
tttcatttaatca

SEQ ID NO: 674782 - DNA, 13 bp, D. melanogaster
tttcatttacagc

SEQ ID NO: 674783 - DNA, 14 bp, D. melanogaster
tttcatttacagca

SEQ ID NO: 674784 - DNA, 13 bp, D. melanogaster
tttcatttacgtt

SEQ ID NO: 674785 - DNA, 14 bp, D. melanogaster
tttcatttactttg

SEQ ID NO: 674786 - DNA, 13 bp, D. melanogaster
tttcatttagaat

SEQ ID NO: 674787 - DNA, 13 bp, D. melanogaster
tttcatttagatt

SEQ ID NO: 674788 - DNA, 13 bp, D. melanogaster
tttcatttagttg

SEQ ID NO: 674789 - DNA, 13 bp, D. melanogaster
tttcatttattga

SEQ ID NO: 674790 - DNA, 14 bp, D. melanogaster
tttcatttatttgc

SEQ ID NO: 674791 - DNA, 13 bp, D. melanogaster
tttcatttcaaaa

SEQ ID NO: 674792 - DNA, 14 bp, D. melanogaster
tttcatttcaaaaa

SEQ ID NO: 674793 - DNA, 13 bp, D. melanogaster
tttcatttcaaac

SEQ ID NO: 674794 - DNA, 13 bp, D. melanogaster
tttcatttcaaat

SEQ ID NO: 674795 - DNA, 13 bp, D. melanogaster
tttcatttcaact

SEQ ID NO: 674796 - DNA, 14 bp, D. melanogaster
tttcatttcagttt

SEQ ID NO: 674797 - DNA, 13 bp, D. melanogaster
tttcatttcatca

SEQ ID NO: 674798 - DNA, 13 bp, D. melanogaster
tttcatttccaat

SEQ ID NO: 674799 - DNA, 13 bp, D. melanogaster
tttcatttccact

SEQ ID NO: 674800 - DNA, 13 bp, D. melanogaster
tttcatttccatg

SEQ ID NO: 674801 - DNA, 14 bp, D. melanogaster
tttcatttccgttt

SEQ ID NO: 674802 - DNA, 13 bp, D. melanogaster
tttcatttcctgc

SEQ ID NO: 674803 - DNA, 13 bp, D. melanogaster
tttcatttcgaaa

SEQ ID NO: 674804 - DNA, 13 bp, D. melanogaster
tttcatttcgaat

SEQ ID NO: 674805 - DNA, 13 bp, D. melanogaster
tttcatttcgatt

SEQ ID NO: 674806 - DNA, 14 bp, D. melanogaster
tttcatttcgattt

SEQ ID NO: 674807 - DNA, 13 bp, D. melanogaster
tttcatttcgcac

SEQ ID NO: 674808 - DNA, 13 bp, D. melanogaster
tttcatttcgcca

SEQ ID NO: 674809 - DNA, 13 bp, D. melanogaster
tttcatttcgctt

SEQ ID NO: 674810 - DNA, 14 bp, D. melanogaster
tttcatttcgcttt

SEQ ID NO: 674811 - DNA, 13 bp, D. melanogaster
tttcatttcgggc

SEQ ID NO: 674812 - DNA, 14 bp, D. melanogaster
tttcatttcgtttg

SEQ ID NO: 674813 - DNA, 13 bp, D. melanogaster
tttcatttgaaat

SEQ ID NO: 674814 - DNA, 14 bp, D. melanogaster
tttcatttgaaatt

SEQ ID NO: 674815 - DNA, 13 bp, D. melanogaster
tttcatttgaata

SEQ ID NO: 674816 - DNA, 13 bp, D. melanogaster
tttcatttgaatt

SEQ ID NO: 674817 - DNA, 14 bp, D. melanogaster
tttcatttgaattt

SEQ ID NO: 674818 - DNA, 13 bp, D. melanogaster
tttcatttgagtt

SEQ ID NO: 674819 - DNA, 13 bp, D. melanogaster
tttcatttgcaaa

SEQ ID NO: 674820 - DNA, 13 bp, D. melanogaster
tttcatttgcaat

SEQ ID NO: 674821 - DNA, 14 bp, D. melanogaster
tttcatttgcaatt

SEQ ID NO: 674822 - DNA, 13 bp, D. melanogaster
tttcatttgcagt

SEQ ID NO: 674823 - DNA, 14 bp, D. melanogaster
tttcatttgcagtt

SEQ ID NO: 674824 - DNA, 13 bp, D. melanogaster
tttcatttgcata

SEQ ID NO: 674825 - DNA, 14 bp, D. melanogaster
tttcatttgcataa

SEQ ID NO: 674826 - DNA, 14 bp, D. melanogaster
tttcatttgcatat

SEQ ID NO: 674827 - DNA, 13 bp, D. melanogaster
tttcatttgcatt

SEQ ID NO: 674828 - DNA, 14 bp, D. melanogaster
tttcatttgcattc

SEQ ID NO: 674829 - DNA, 14 bp, D. melanogaster
tttcatttgcattt

SEQ ID NO: 674830 - DNA, 14 bp, D. melanogaster
tttcatttgccaaa

SEQ ID NO: 674831 - DNA, 13 bp, D. melanogaster
tttcatttgccca

SEQ ID NO: 674832 - DNA, 13 bp, D. melanogaster
tttcatttgcgtt

SEQ ID NO: 674833 - DNA, 13 bp, D. melanogaster
tttcatttgctat

SEQ ID NO: 674834 - DNA, 13 bp, D. melanogaster
tttcatttgctgc

SEQ ID NO: 674835 - DNA, 13 bp, D. melanogaster
tttcatttgctgt

SEQ ID NO: 674836 - DNA, 13 bp, D. melanogaster
tttcatttggaaa

SEQ ID NO: 674837 - DNA, 14 bp, D. melanogaster
tttcatttggattt

SEQ ID NO: 674838 - DNA, 13 bp, D. melanogaster
tttcatttggcac

SEQ ID NO: 674839 - DNA, 14 bp, D. melanogaster
tttcatttggcatt

SEQ ID NO: 674840 - DNA, 13 bp, D. melanogaster
tttcatttggcta

SEQ ID NO: 674841 - DNA, 13 bp, D. melanogaster
tttcatttggctg

SEQ ID NO: 674842 - DNA, 14 bp, D. melanogaster
tttcatttggcttt

SEQ ID NO: 674843 - DNA, 14 bp, D. melanogaster
tttcatttgtaatt

SEQ ID NO: 674844 - DNA, 13 bp, D. melanogaster
tttcatttgtctc

SEQ ID NO: 674845 - DNA, 13 bp, D. melanogaster
tttcatttgtgga

SEQ ID NO: 674846 - DNA, 13 bp, D. melanogaster
tttcattttaaga

SEQ ID NO: 674847 - DNA, 13 bp, D. melanogaster
tttcattttatgc

SEQ ID NO: 674848 - DNA, 13 bp, D. melanogaster
tttcattttcaaa

SEQ ID NO: 674849 - DNA, 13 bp, D. melanogaster
tttcattttcaca

SEQ ID NO: 674850 - DNA, 13 bp, D. melanogaster
tttcattttcagt

SEQ ID NO: 674851 - DNA, 14 bp, D. melanogaster
tttcattttcagtt

SEQ ID NO: 674852 - DNA, 13 bp, D. melanogaster
tttcattttcatg

SEQ ID NO: 674853 - DNA, 13 bp, D. melanogaster
tttcattttcgat

SEQ ID NO: 674854 - DNA, 13 bp, D. melanogaster
tttcattttgaat

SEQ ID NO: 674855 - DNA, 13 bp, D. melanogaster
tttcattttgagt

SEQ ID NO: 674856 - DNA, 13 bp, D. melanogaster
tttcattttgata

SEQ ID NO: 674857 - DNA, 13 bp, D. melanogaster
tttcattttgatc

SEQ ID NO: 674858 - DNA, 13 bp, D. melanogaster
tttcattttgcaa

SEQ ID NO: 674859 - DNA, 14 bp, D. melanogaster
tttcattttgcatt

SEQ ID NO: 674860 - DNA, 13 bp, D. melanogaster
tttcattttgcca

SEQ ID NO: 674861 - DNA, 13 bp, D. melanogaster
tttcattttgcgt

SEQ ID NO: 674862 - DNA, 13 bp, D. melanogaster
tttcattttggaa

SEQ ID NO: 674863 - DNA, 13 bp, D. melanogaster
tttcattttggcc

SEQ ID NO: 674864 - DNA, 13 bp, D. melanogaster
tttcattttggct

SEQ ID NO: 674865 - DNA, 13 bp, D. melanogaster
tttcatttttgcc

SEQ ID NO: 674866 - DNA, 13 bp, D. melanogaster
tttcatttttggc

SEQ ID NO: 674867 - DNA, 14 bp, D. melanogaster
tttcatttttggca

SEQ ID NO: 674868 - DNA, 13 bp, D. melanogaster
tttcatttttggg

SEQ ID NO: 674869 - DNA, 14 bp, D. melanogaster
tttccaaaaacaaa

SEQ ID NO: 674870 - DNA, 13 bp, D. melanogaster
tttccaaaaacca

SEQ ID NO: 674871 - DNA, 13 bp, D. melanogaster
tttccaaaaactt

SEQ ID NO: 674872 - DNA, 13 bp, D. melanogaster
tttccaaaaagtt

SEQ ID NO: 674873 - DNA, 13 bp, D. melanogaster
tttccaaaacaaa

SEQ ID NO: 674874 - DNA, 13 bp, D. melanogaster
tttccaaaacatt

SEQ ID NO: 674875 - DNA, 13 bp, D. melanogaster
tttccaaaactat

SEQ ID NO: 674876 - DNA, 13 bp, D. melanogaster
tttccaaaataaa

SEQ ID NO: 674877 - DNA, 13 bp, D. melanogaster
tttccaaaataat

SEQ ID NO: 674878 - DNA, 13 bp, D. melanogaster
tttccaaaatata

SEQ ID NO: 674879 - DNA, 14 bp, D. melanogaster
tttccaaaatatat

SEQ ID NO: 674880 - DNA, 13 bp, D. melanogaster
tttccaaaatatt

SEQ ID NO: 674881 - DNA, 14 bp, D. melanogaster
tttccaaaatattt

SEQ ID NO: 674882 - DNA, 13 bp, D. melanogaster
tttccaaaattta

SEQ ID NO: 674883 - DNA, 13 bp, D. melanogaster
tttccaaaatttt

SEQ ID NO: 674884 - DNA, 14 bp, D. melanogaster
tttccaaacaaaaa

SEQ ID NO: 674885 - DNA, 13 bp, D. melanogaster
tttccaaacaaat

SEQ ID NO: 674886 - DNA, 13 bp, D. melanogaster
tttccaaacattt

SEQ ID NO: 674887 - DNA, 13 bp, D. melanogaster
tttccaaacgaaa

SEQ ID NO: 674888 - DNA, 13 bp, D. melanogaster
tttccaaacgatt

SEQ ID NO: 674889 - DNA, 13 bp, D. melanogaster
tttccaaactatt

SEQ ID NO: 674890 - DNA, 13 bp, D. melanogaster
tttccaaactcaa

SEQ ID NO: 674891 - DNA, 13 bp, D. melanogaster
tttccaaagccaa

SEQ ID NO: 674892 - DNA, 13 bp, D. melanogaster
tttccaaaggaaa

SEQ ID NO: 674893 - DNA, 13 bp, D. melanogaster
tttccaaatagtt

SEQ ID NO: 674894 - DNA, 13 bp, D. melanogaster
tttccaaatattt

SEQ ID NO: 674895 - DNA, 13 bp, D. melanogaster
tttccaaatcaaa

SEQ ID NO: 674896 - DNA, 13 bp, D. melanogaster
tttccaaatcgat

SEQ ID NO: 674897 - DNA, 13 bp, D. melanogaster
tttccaaatcttc

SEQ ID NO: 674898 - DNA, 13 bp, D. melanogaster
tttccaaatgaaa

SEQ ID NO: 674899 - DNA, 13 bp, D. melanogaster
tttccaaatggtt

SEQ ID NO: 674900 - DNA, 13 bp, D. melanogaster
tttccaaattatt

SEQ ID NO: 674901 - DNA, 13 bp, D. melanogaster
tttccaaattcaa

SEQ ID NO: 674902 - DNA, 13 bp, D. melanogaster
tttccaaattgaa

SEQ ID NO: 674903 - DNA, 13 bp, D. melanogaster
tttccaaattgca

SEQ ID NO: 674904 - DNA, 13 bp, D. melanogaster
tttccaaatttcc

SEQ ID NO: 674905 - DNA, 13 bp, D. melanogaster
tttccaaatttga

SEQ ID NO: 674906 - DNA, 13 bp, D. melanogaster
tttccaacaaatt

SEQ ID NO: 674907 - DNA, 13 bp, D. melanogaster
tttccaacataaa

SEQ ID NO: 674908 - DNA, 13 bp, D. melanogaster
tttccaaccatat

SEQ ID NO: 674909 - DNA, 13 bp, D. melanogaster
tttccaacgcttt

SEQ ID NO: 674910 - DNA, 13 bp, D. melanogaster
tttccaactattt

SEQ ID NO: 674911 - DNA, 13 bp, D. melanogaster
tttccaactcatt

SEQ ID NO: 674912 - DNA, 13 bp, D. melanogaster
tttccaactgcca

SEQ ID NO: 674913 - DNA, 13 bp, D. melanogaster
tttccaacttgtt

SEQ ID NO: 674914 - DNA, 13 bp, D. melanogaster
tttccaagaaaaa

SEQ ID NO: 674915 - DNA, 13 bp, D. melanogaster
tttccaagaaaat

SEQ ID NO: 674916 - DNA, 13 bp, D. melanogaster
tttccaagcaaat

SEQ ID NO: 674917 - DNA, 13 bp, D. melanogaster
tttccaagcaatt

SEQ ID NO: 674918 - DNA, 13 bp, D. melanogaster
tttccaagccgac

SEQ ID NO: 674919 - DNA, 13 bp, D. melanogaster
tttccaagctttc

SEQ ID NO: 674920 - DNA, 14 bp, D. melanogaster
tttccaagctttcg

SEQ ID NO: 674921 - DNA, 13 bp, D. melanogaster
tttccaaggaaat

SEQ ID NO: 674922 - DNA, 13 bp, D. melanogaster
tttccaagtattt

SEQ ID NO: 674923 - DNA, 13 bp, D. melanogaster
tttccaagtgcac

SEQ ID NO: 674924 - DNA, 13 bp, D. melanogaster
tttccaagtgcat

SEQ ID NO: 674925 - DNA, 13 bp, D. melanogaster
tttccaagtgcca

SEQ ID NO: 674926 - DNA, 13 bp, D. melanogaster
tttccaataaaat

SEQ ID NO: 674927 - DNA, 14 bp, D. melanogaster
tttccaataaagaa

SEQ ID NO: 674928 - DNA, 13 bp, D. melanogaster
tttccaataaata

SEQ ID NO: 674929 - DNA, 13 bp, D. melanogaster
tttccaatatata

SEQ ID NO: 674930 - DNA, 13 bp, D. melanogaster
tttccaatcaaat

SEQ ID NO: 674931 - DNA, 13 bp, D. melanogaster
tttccaatcaatt

SEQ ID NO: 674932 - DNA, 14 bp, D. melanogaster
tttccaatcaattt

SEQ ID NO: 674933 - DNA, 13 bp, D. melanogaster
tttccaatcgaaa

SEQ ID NO: 674934 - DNA, 13 bp, D. melanogaster
tttccaatcgaac

SEQ ID NO: 674935 - DNA, 13 bp, D. melanogaster
tttccaatgcaaa

SEQ ID NO: 674936 - DNA, 13 bp, D. melanogaster
tttccaatgtttt

SEQ ID NO: 674937 - DNA, 13 bp, D. melanogaster
tttccaattcaaa

SEQ ID NO: 674938 - DNA, 13 bp, D. melanogaster
tttccaattccaa

SEQ ID NO: 674939 - DNA, 13 bp, D. melanogaster
tttccaattcgat

SEQ ID NO: 674940 - DNA, 13 bp, D. melanogaster
tttccaattcgtt

SEQ ID NO: 674941 - DNA, 14 bp, D. melanogaster
tttccaattgaaaa

SEQ ID NO: 674942 - DNA, 13 bp, D. melanogaster
tttccaattgaat

SEQ ID NO: 674943 - DNA, 13 bp, D. melanogaster
tttccaattgcat

SEQ ID NO: 674944 - DNA, 14 bp, D. melanogaster
tttccaattggaaa

SEQ ID NO: 674945 - DNA, 13 bp, D. melanogaster
tttccaattggca

SEQ ID NO: 674946 - DNA, 14 bp, D. melanogaster
tttccaattgtttt

SEQ ID NO: 674947 - DNA, 13 bp, D. melanogaster
tttccaatttcaa

SEQ ID NO: 674948 - DNA, 13 bp, D. melanogaster
tttccaatttgca

SEQ ID NO: 674949 - DNA, 13 bp, D. melanogaster
tttccaatttggc

SEQ ID NO: 674950 - DNA, 14 bp, D. melanogaster
tttccaatttgttt

SEQ ID NO: 674951 - DNA, 13 bp, D. melanogaster
tttccaattttcc

SEQ ID NO: 674952 - DNA, 13 bp, D. melanogaster
tttccaattttgc

SEQ ID NO: 674953 - DNA, 13 bp, D. melanogaster
tttccacaattaa

SEQ ID NO: 674954 - DNA, 13 bp, D. melanogaster
tttccacacaaat

SEQ ID NO: 674955 - DNA, 13 bp, D. melanogaster
tttccacacaatt

SEQ ID NO: 674956 - DNA, 14 bp, D. melanogaster
tttccacacacaca

SEQ ID NO: 674957 - DNA, 13 bp, D. melanogaster
tttccacactttt

SEQ ID NO: 674958 - DNA, 14 bp, D. melanogaster
tttccacacttttc

SEQ ID NO: 674959 - DNA, 13 bp, D. melanogaster
tttccacagcatt

SEQ ID NO: 674960 - DNA, 13 bp, D. melanogaster
tttccacagtttt

SEQ ID NO: 674961 - DNA, 13 bp, D. melanogaster
tttccacatttaa

SEQ ID NO: 674962 - DNA, 13 bp, D. melanogaster
tttccacatttcc

SEQ ID NO: 674963 - DNA, 14 bp, D. melanogaster
tttccacatttcca

SEQ ID NO: 674964 - DNA, 14 bp, D. melanogaster
tttccacatttccc

SEQ ID NO: 674965 - DNA, 14 bp, D. melanogaster
tttccacattttcc

SEQ ID NO: 674966 - DNA, 14 bp, D. melanogaster
tttccacattttta

SEQ ID NO: 674967 - DNA, 14 bp, D. melanogaster
tttccaccaaaaat

SEQ ID NO: 674968 - DNA, 14 bp, D. melanogaster
tttccaccagtcga

SEQ ID NO: 674969 - DNA, 13 bp, D. melanogaster
tttccaccatttt

SEQ ID NO: 674970 - DNA, 13 bp, D. melanogaster
tttccacccaaaa

SEQ ID NO: 674971 - DNA, 13 bp, D. melanogaster
tttccacccaatt

SEQ ID NO: 674972 - DNA, 13 bp, D. melanogaster
tttccacccactg

SEQ ID NO: 674973 - DNA, 13 bp, D. melanogaster
tttccacctctgg

SEQ ID NO: 674974 - DNA, 13 bp, D. melanogaster
tttccacctgcaa

SEQ ID NO: 674975 - DNA, 13 bp, D. melanogaster
tttccacgctttc

SEQ ID NO: 674976 - DNA, 14 bp, D. melanogaster
tttccacgcttttc

SEQ ID NO: 674977 - DNA, 13 bp, D. melanogaster
tttccacggtgcc

SEQ ID NO: 674978 - DNA, 13 bp, D. melanogaster
tttccactaaaaa

SEQ ID NO: 674979 - DNA, 13 bp, D. melanogaster
tttccactaccga

SEQ ID NO: 674980 - DNA, 13 bp, D. melanogaster
tttccactcacac

SEQ ID NO: 674981 - DNA, 13 bp, D. melanogaster
tttccactcactc

SEQ ID NO: 674982 - DNA, 13 bp, D. melanogaster
tttccactcgaag

SEQ ID NO: 674983 - DNA, 13 bp, D. melanogaster
tttccactgaaaa

SEQ ID NO: 674984 - DNA, 13 bp, D. melanogaster
tttccactgcaat

SEQ ID NO: 674985 - DNA, 13 bp, D. melanogaster
tttccactgcact

SEQ ID NO: 674986 - DNA, 13 bp, D. melanogaster
tttccactgctgc

SEQ ID NO: 674987 - DNA, 13 bp, D. melanogaster
tttccactgtttt

SEQ ID NO: 674988 - DNA, 13 bp, D. melanogaster
tttccacttaacc

SEQ ID NO: 674989 - DNA, 13 bp, D. melanogaster
tttccacttccat

SEQ ID NO: 674990 - DNA, 13 bp, D. melanogaster
tttccacttgcct

SEQ ID NO: 674991 - DNA, 13 bp, D. melanogaster
tttccacttggca

SEQ ID NO: 674992 - DNA, 14 bp, D. melanogaster
tttccacttggcca

SEQ ID NO: 674993 - DNA, 13 bp, D. melanogaster
tttccacttggcg

SEQ ID NO: 674994 - DNA, 13 bp, D. melanogaster
tttccactttcca

SEQ ID NO: 674995 - DNA, 14 bp, D. melanogaster
tttccactttccac

SEQ ID NO: 674996 - DNA, 13 bp, D. melanogaster
tttccactttgct

SEQ ID NO: 674997 - DNA, 14 bp, D. melanogaster
tttccacttttata

SEQ ID NO: 674998 - DNA, 14 bp, D. melanogaster
tttccacttttccg

SEQ ID NO: 674999 - DNA, 13 bp, D. melanogaster
tttccagcaaatt

SEQ ID NO: 675000 - DNA, 13 bp, D. melanogaster
tttccagcacttt

SEQ ID NO: 675001 - DNA, 13 bp, D. melanogaster
tttccagcatttc

SEQ ID NO: 675002 - DNA, 13 bp, D. melanogaster
tttccagcatttg

SEQ ID NO: 675003 - DNA, 13 bp, D. melanogaster
tttccagcatttt

SEQ ID NO: 675004 - DNA, 14 bp, D. melanogaster
tttccagcattttc

SEQ ID NO: 675005 - DNA, 13 bp, D. melanogaster
tttccagccaaaa

SEQ ID NO: 675006 - DNA, 13 bp, D. melanogaster
tttccagcccaaa

SEQ ID NO: 675007 - DNA, 13 bp, D. melanogaster
tttccagcgattt

SEQ ID NO: 675008 - DNA, 13 bp, D. melanogaster
tttccagcgcctg

SEQ ID NO: 675009 - DNA, 13 bp, D. melanogaster
tttccagcgtctg

SEQ ID NO: 675010 - DNA, 13 bp, D. melanogaster
tttccagctgaaa

SEQ ID NO: 675011 - DNA, 13 bp, D. melanogaster
tttccagctgcat

SEQ ID NO: 675012 - DNA, 13 bp, D. melanogaster
tttccagctgccc

SEQ ID NO: 675013 - DNA, 13 bp, D. melanogaster
tttccagctgtct

SEQ ID NO: 675014 - DNA, 13 bp, D. melanogaster
tttccagcttctt

SEQ ID NO: 675015 - DNA, 13 bp, D. melanogaster
tttccagcttgtt

SEQ ID NO: 675016 - DNA, 13 bp, D. melanogaster
tttccaggctttt

SEQ ID NO: 675017 - DNA, 13 bp, D. melanogaster
tttccagtccgaa

SEQ ID NO: 675018 - DNA, 13 bp, D. melanogaster
tttccagtgcaca

SEQ ID NO: 675019 - DNA, 13 bp, D. melanogaster
tttccagtgcacc

SEQ ID NO: 675020 - DNA, 13 bp, D. melanogaster
tttccagtgcatc

SEQ ID NO: 675021 - DNA, 13 bp, D. melanogaster
tttccagttaaat

SEQ ID NO: 675022 - DNA, 13 bp, D. melanogaster
tttccagtttagc

SEQ ID NO: 675023 - DNA, 13 bp, D. melanogaster
tttccagtttcag

SEQ ID NO: 675024 - DNA, 13 bp, D. melanogaster
tttccagttttct

SEQ ID NO: 675025 - DNA, 13 bp, D. melanogaster
tttccagtttttc

SEQ ID NO: 675026 - DNA, 13 bp, D. melanogaster
tttccataaataa

SEQ ID NO: 675027 - DNA, 13 bp, D. melanogaster
tttccataaatat

SEQ ID NO: 675028 - DNA, 13 bp, D. melanogaster
tttccataaattt

SEQ ID NO: 675029 - DNA, 13 bp, D. melanogaster
tttccataacaaa

SEQ ID NO: 675030 - DNA, 13 bp, D. melanogaster
tttccatacaaat

SEQ ID NO: 675031 - DNA, 13 bp, D. melanogaster
tttccatacacta

SEQ ID NO: 675032 - DNA, 14 bp, D. melanogaster
tttccatacactac

SEQ ID NO: 675033 - DNA, 13 bp, D. melanogaster
tttccatacattt

SEQ ID NO: 675034 - DNA, 13 bp, D. melanogaster
tttccatagaaaa

SEQ ID NO: 675035 - DNA, 13 bp, D. melanogaster
tttccatataaat

SEQ ID NO: 675036 - DNA, 14 bp, D. melanogaster
tttccatatatgta

SEQ ID NO: 675037 - DNA, 13 bp, D. melanogaster
tttccatatccat

SEQ ID NO: 675038 - DNA, 13 bp, D. melanogaster
tttccatattcca

SEQ ID NO: 675039 - DNA, 13 bp, D. melanogaster
tttccatatttca

SEQ ID NO: 675040 - DNA, 13 bp, D. melanogaster
tttccatcaaata

SEQ ID NO: 675041 - DNA, 13 bp, D. melanogaster
tttccatcacatt

SEQ ID NO: 675042 - DNA, 13 bp, D. melanogaster
tttccatcgattt

SEQ ID NO: 675043 - DNA, 13 bp, D. melanogaster
tttccatcgcttt

SEQ ID NO: 675044 - DNA, 14 bp, D. melanogaster
tttccatcgctttt

SEQ ID NO: 675045 - DNA, 13 bp, D. melanogaster
tttccatctcatt

SEQ ID NO: 675046 - DNA, 13 bp, D. melanogaster
tttccatgaattt

SEQ ID NO: 675047 - DNA, 13 bp, D. melanogaster
tttccatgatttt

SEQ ID NO: 675048 - DNA, 13 bp, D. melanogaster
tttccatgcaaat

SEQ ID NO: 675049 - DNA, 13 bp, D. melanogaster
tttccatgcattc

SEQ ID NO: 675050 - DNA, 13 bp, D. melanogaster
tttccatgccatt

SEQ ID NO: 675051 - DNA, 13 bp, D. melanogaster
tttccatgcccat

SEQ ID NO: 675052 - DNA, 13 bp, D. melanogaster
tttccatgcgaaa

SEQ ID NO: 675053 - DNA, 13 bp, D. melanogaster
tttccatgctgca

SEQ ID NO: 675054 - DNA, 13 bp, D. melanogaster
tttccatggcaaa

SEQ ID NO: 675055 - DNA, 13 bp, D. melanogaster
tttccatggcagc

SEQ ID NO: 675056 - DNA, 13 bp, D. melanogaster
tttccatggcatt

SEQ ID NO: 675057 - DNA, 13 bp, D. melanogaster
tttccatgtaatt

SEQ ID NO: 675058 - DNA, 13 bp, D. melanogaster
tttccatgtgtgt

SEQ ID NO: 675059 - DNA, 13 bp, D. melanogaster
tttccatgttgtt

SEQ ID NO: 675060 - DNA, 13 bp, D. melanogaster
tttccatgttttc

SEQ ID NO: 675061 - DNA, 13 bp, D. melanogaster
tttccattaaaaa

SEQ ID NO: 675062 - DNA, 13 bp, D. melanogaster
tttccattaactt

SEQ ID NO: 675063 - DNA, 13 bp, D. melanogaster
tttccattaagaa

SEQ ID NO: 675064 - DNA, 13 bp, D. melanogaster
tttccattaagtt

SEQ ID NO: 675065 - DNA, 13 bp, D. melanogaster
tttccattacatt

SEQ ID NO: 675066 - DNA, 13 bp, D. melanogaster
tttccattataaa

SEQ ID NO: 675067 - DNA, 13 bp, D. melanogaster
tttccattataac

SEQ ID NO: 675068 - DNA, 13 bp, D. melanogaster
tttccattcaaaa

SEQ ID NO: 675069 - DNA, 13 bp, D. melanogaster
tttccattcaaac

SEQ ID NO: 675070 - DNA, 13 bp, D. melanogaster
tttccattcaact

SEQ ID NO: 675071 - DNA, 13 bp, D. melanogaster
tttccattcaatt

SEQ ID NO: 675072 - DNA, 13 bp, D. melanogaster
tttccattcacat

SEQ ID NO: 675073 - DNA, 13 bp, D. melanogaster
tttccattccact

SEQ ID NO: 675074 - DNA, 13 bp, D. melanogaster
tttccattccatt

SEQ ID NO: 675075 - DNA, 13 bp, D. melanogaster
tttccattcccac

SEQ ID NO: 675076 - DNA, 13 bp, D. melanogaster
tttccattcccat

SEQ ID NO: 675077 - DNA, 13 bp, D. melanogaster
tttccattcctgc

SEQ ID NO: 675078 - DNA, 13 bp, D. melanogaster
tttccattcgcca

SEQ ID NO: 675079 - DNA, 13 bp, D. melanogaster
tttccattcgttt

SEQ ID NO: 675080 - DNA, 13 bp, D. melanogaster
tttccattgaaaa

SEQ ID NO: 675081 - DNA, 13 bp, D. melanogaster
tttccattgattg

SEQ ID NO: 675082 - DNA, 13 bp, D. melanogaster
tttccattgcatt

SEQ ID NO: 675083 - DNA, 13 bp, D. melanogaster
tttccattgccag

SEQ ID NO: 675084 - DNA, 13 bp, D. melanogaster
tttccattgcgtc

SEQ ID NO: 675085 - DNA, 13 bp, D. melanogaster
tttccattgctgc

SEQ ID NO: 675086 - DNA, 13 bp, D. melanogaster
tttccattggaaa

SEQ ID NO: 675087 - DNA, 13 bp, D. melanogaster
tttccattggcat

SEQ ID NO: 675088 - DNA, 13 bp, D. melanogaster
tttccattggctt

SEQ ID NO: 675089 - DNA, 13 bp, D. melanogaster
tttccatttaaaa

SEQ ID NO: 675090 - DNA, 13 bp, D. melanogaster
tttccatttaaat

SEQ ID NO: 675091 - DNA, 14 bp, D. melanogaster
tttccatttaaatg

SEQ ID NO: 675092 - DNA, 13 bp, D. melanogaster
tttccatttaagc

SEQ ID NO: 675093 - DNA, 13 bp, D. melanogaster
tttccatttaagt

SEQ ID NO: 675094 - DNA, 13 bp, D. melanogaster
tttccatttacca

SEQ ID NO: 675095 - DNA, 13 bp, D. melanogaster
tttccatttagct

SEQ ID NO: 675096 - DNA, 13 bp, D. melanogaster
tttccatttatga

SEQ ID NO: 675097 - DNA, 13 bp, D. melanogaster
tttccatttattg

SEQ ID NO: 675098 - DNA, 14 bp, D. melanogaster
tttccatttcaaaa

SEQ ID NO: 675099 - DNA, 13 bp, D. melanogaster
tttccatttcaat

SEQ ID NO: 675100 - DNA, 13 bp, D. melanogaster
tttccatttccac

SEQ ID NO: 675101 - DNA, 13 bp, D. melanogaster
tttccatttccat

SEQ ID NO: 675102 - DNA, 13 bp, D. melanogaster
tttccatttccca

SEQ ID NO: 675103 - DNA, 14 bp, D. melanogaster
tttccatttcccag

SEQ ID NO: 675104 - DNA, 13 bp, D. melanogaster
tttccatttcccg

SEQ ID NO: 675105 - DNA, 13 bp, D. melanogaster
tttccatttccga

SEQ ID NO: 675106 - DNA, 14 bp, D. melanogaster
tttccatttccttg

SEQ ID NO: 675107 - DNA, 13 bp, D. melanogaster
tttccatttcgat

SEQ ID NO: 675108 - DNA, 13 bp, D. melanogaster
tttccatttcgcg

SEQ ID NO: 675109 - DNA, 13 bp, D. melanogaster
tttccatttcgct

SEQ ID NO: 675110 - DNA, 13 bp, D. melanogaster
tttccatttcggc

SEQ ID NO: 675111 - DNA, 14 bp, D. melanogaster
tttccatttcgttt

SEQ ID NO: 675112 - DNA, 13 bp, D. melanogaster
tttccatttctgg

SEQ ID NO: 675113 - DNA, 13 bp, D. melanogaster
tttccatttgctc

SEQ ID NO: 675114 - DNA, 13 bp, D. melanogaster
tttccatttgctg

SEQ ID NO: 675115 - DNA, 13 bp, D. melanogaster
tttccatttggca

SEQ ID NO: 675116 - DNA, 13 bp, D. melanogaster
tttccatttggcc

SEQ ID NO: 675117 - DNA, 14 bp, D. melanogaster
tttccatttggcca

SEQ ID NO: 675118 - DNA, 13 bp, D. melanogaster
tttccatttgtat

SEQ ID NO: 675119 - DNA, 13 bp, D. melanogaster
tttccattttcaa

SEQ ID NO: 675120 - DNA, 14 bp, D. melanogaster
tttccattttcaat

SEQ ID NO: 675121 - DNA, 14 bp, D. melanogaster
tttccattttccca

SEQ ID NO: 675122 - DNA, 13 bp, D. melanogaster
tttccattttccg

SEQ ID NO: 675123 - DNA, 14 bp, D. melanogaster
tttccattttccgc

SEQ ID NO: 675124 - DNA, 13 bp, D. melanogaster
tttccattttctg

SEQ ID NO: 675125 - DNA, 13 bp, D. melanogaster
tttccattttgct

SEQ ID NO: 675126 - DNA, 13 bp, D. melanogaster
tttccatttttga

SEQ ID NO: 675127 - DNA, 14 bp, D. melanogaster
tttccatttttgaa

SEQ ID NO: 675128 - DNA, 13 bp, D. melanogaster
tttccatttttgg

SEQ ID NO: 675129 - DNA, 13 bp, D. melanogaster
tttcccaaaaaaa

SEQ ID NO: 675130 - DNA, 14 bp, D. melanogaster
tttcccaaaaaaaa

SEQ ID NO: 675131 - DNA, 13 bp, D. melanogaster
tttcccaaaaact

SEQ ID NO: 675132 - DNA, 13 bp, D. melanogaster
tttcccaaaaatg

SEQ ID NO: 675133 - DNA, 13 bp, D. melanogaster
tttcccaaaatat

SEQ ID NO: 675134 - DNA, 13 bp, D. melanogaster
tttcccaaacaaa

SEQ ID NO: 675135 - DNA, 13 bp, D. melanogaster
tttcccaaatcaa

SEQ ID NO: 675136 - DNA, 13 bp, D. melanogaster
tttcccaacaaaa

SEQ ID NO: 675137 - DNA, 13 bp, D. melanogaster
tttcccaactgca

SEQ ID NO: 675138 - DNA, 13 bp, D. melanogaster
tttcccaactttt

SEQ ID NO: 675139 - DNA, 13 bp, D. melanogaster
tttcccaatttat

SEQ ID NO: 675140 - DNA, 13 bp, D. melanogaster
tttcccaatttgg

SEQ ID NO: 675141 - DNA, 13 bp, D. melanogaster
tttcccaatttta

SEQ ID NO: 675142 - DNA, 13 bp, D. melanogaster
tttcccacaaaag

SEQ ID NO: 675143 - DNA, 13 bp, D. melanogaster
tttcccacaattt

SEQ ID NO: 675144 - DNA, 13 bp, D. melanogaster
tttcccacatttt

SEQ ID NO: 675145 - DNA, 14 bp, D. melanogaster
tttcccacattttc

SEQ ID NO: 675146 - DNA, 13 bp, D. melanogaster
tttcccaccattt

SEQ ID NO: 675147 - DNA, 13 bp, D. melanogaster
tttcccacgattt

SEQ ID NO: 675148 - DNA, 13 bp, D. melanogaster
tttcccactgcca

SEQ ID NO: 675149 - DNA, 13 bp, D. melanogaster
tttcccactttgt

SEQ ID NO: 675150 - DNA, 13 bp, D. melanogaster
tttcccagaattt

SEQ ID NO: 675151 - DNA, 13 bp, D. melanogaster
tttcccagcaaat

SEQ ID NO: 675152 - DNA, 13 bp, D. melanogaster
tttcccagcaatt

SEQ ID NO: 675153 - DNA, 13 bp, D. melanogaster
tttcccagcagct

SEQ ID NO: 675154 - DNA, 13 bp, D. melanogaster
tttcccagcattt

SEQ ID NO: 675155 - DNA, 13 bp, D. melanogaster
tttcccagccaaa

SEQ ID NO: 675156 - DNA, 13 bp, D. melanogaster
tttcccagccagc

SEQ ID NO: 675157 - DNA, 13 bp, D. melanogaster
tttcccagcccca

SEQ ID NO: 675158 - DNA, 13 bp, D. melanogaster
tttcccagccttt

SEQ ID NO: 675159 - DNA, 13 bp, D. melanogaster
tttcccagctatt

SEQ ID NO: 675160 - DNA, 13 bp, D. melanogaster
tttcccagcttcc

SEQ ID NO: 675161 - DNA, 13 bp, D. melanogaster
tttcccagctttt

SEQ ID NO: 675162 - DNA, 14 bp, D. melanogaster
tttcccagcttttc

SEQ ID NO: 675163 - DNA, 13 bp, D. melanogaster
tttcccagggaaa

SEQ ID NO: 675164 - DNA, 13 bp, D. melanogaster
tttcccagtgcac

SEQ ID NO: 675165 - DNA, 13 bp, D. melanogaster
tttcccagtgcag

SEQ ID NO: 675166 - DNA, 13 bp, D. melanogaster
tttcccagtgcat

SEQ ID NO: 675167 - DNA, 13 bp, D. melanogaster
tttcccagtgtat

SEQ ID NO: 675168 - DNA, 13 bp, D. melanogaster
tttcccagtgttt

SEQ ID NO: 675169 - DNA, 13 bp, D. melanogaster
tttcccagttgcc

SEQ ID NO: 675170 - DNA, 14 bp, D. melanogaster
tttcccagttttcc

SEQ ID NO: 675171 - DNA, 13 bp, D. melanogaster
tttcccagttttt

SEQ ID NO: 675172 - DNA, 13 bp, D. melanogaster
tttcccataaaaa

SEQ ID NO: 675173 - DNA, 13 bp, D. melanogaster
tttcccataaatt

SEQ ID NO: 675174 - DNA, 13 bp, D. melanogaster
tttcccataattt

SEQ ID NO: 675175 - DNA, 13 bp, D. melanogaster
tttcccatattcc

SEQ ID NO: 675176 - DNA, 13 bp, D. melanogaster
tttcccatcttac

SEQ ID NO: 675177 - DNA, 13 bp, D. melanogaster
tttcccatgcatt

SEQ ID NO: 675178 - DNA, 13 bp, D. melanogaster
tttcccattaaaa

SEQ ID NO: 675179 - DNA, 13 bp, D. melanogaster
tttcccattcaaa

SEQ ID NO: 675180 - DNA, 13 bp, D. melanogaster
tttcccattcgaa

SEQ ID NO: 675181 - DNA, 13 bp, D. melanogaster
tttcccattgccc

SEQ ID NO: 675182 - DNA, 13 bp, D. melanogaster
tttcccatttaaa

SEQ ID NO: 675183 - DNA, 14 bp, D. melanogaster
tttcccatttaaat

SEQ ID NO: 675184 - DNA, 13 bp, D. melanogaster
tttcccatttcgc

SEQ ID NO: 675185 - DNA, 13 bp, D. melanogaster
tttcccatttgca

SEQ ID NO: 675186 - DNA, 13 bp, D. melanogaster
tttccccaaaaac

SEQ ID NO: 675187 - DNA, 13 bp, D. melanogaster
tttccccaacttt

SEQ ID NO: 675188 - DNA, 14 bp, D. melanogaster
tttccccaatttcc

SEQ ID NO: 675189 - DNA, 13 bp, D. melanogaster
tttccccactgca

SEQ ID NO: 675190 - DNA, 13 bp, D. melanogaster
tttccccactttg

SEQ ID NO: 675191 - DNA, 13 bp, D. melanogaster
tttccccagcttt

SEQ ID NO: 675192 - DNA, 13 bp, D. melanogaster
tttccccagtgca

SEQ ID NO: 675193 - DNA, 13 bp, D. melanogaster
tttccccagtgta

SEQ ID NO: 675194 - DNA, 13 bp, D. melanogaster
tttccccagtttt

SEQ ID NO: 675195 - DNA, 13 bp, D. melanogaster
tttccccattcaa

SEQ ID NO: 675196 - DNA, 13 bp, D. melanogaster
tttccccatttgc

SEQ ID NO: 675197 - DNA, 13 bp, D. melanogaster
tttcccccaaaaa

SEQ ID NO: 675198 - DNA, 13 bp, D. melanogaster
tttcccccaccag

SEQ ID NO: 675199 - DNA, 13 bp, D. melanogaster
tttcccccagttt

SEQ ID NO: 675200 - DNA, 13 bp, D. melanogaster
tttccccccaaaa

SEQ ID NO: 675201 - DNA, 13 bp, D. melanogaster
tttcccccgaaaa

SEQ ID NO: 675202 - DNA, 13 bp, D. melanogaster
tttcccccgattt

SEQ ID NO: 675203 - DNA, 13 bp, D. melanogaster
tttccccgcagtt

SEQ ID NO: 675204 - DNA, 13 bp, D. melanogaster
tttccccgcattt

SEQ ID NO: 675205 - DNA, 13 bp, D. melanogaster
tttccccgcccac

SEQ ID NO: 675206 - DNA, 13 bp, D. melanogaster
tttcccctgtgca

SEQ ID NO: 675207 - DNA, 13 bp, D. melanogaster
tttccccttcgaa

SEQ ID NO: 675208 - DNA, 13 bp, D. melanogaster
tttcccgactatc

SEQ ID NO: 675209 - DNA, 13 bp, D. melanogaster
tttcccgcagtgt

SEQ ID NO: 675210 - DNA, 13 bp, D. melanogaster
tttcccgctccca

SEQ ID NO: 675211 - DNA, 13 bp, D. melanogaster
tttcccgctttca

SEQ ID NO: 675212 - DNA, 13 bp, D. melanogaster
tttcccggaaaat

SEQ ID NO: 675213 - DNA, 13 bp, D. melanogaster
tttcccggctttc

SEQ ID NO: 675214 - DNA, 13 bp, D. melanogaster
tttccctatccaa

SEQ ID NO: 675215 - DNA, 13 bp, D. melanogaster
tttccctgctgct

SEQ ID NO: 675216 - DNA, 13 bp, D. melanogaster
tttccctgcttaa

SEQ ID NO: 675217 - DNA, 13 bp, D. melanogaster
tttccctggaaaa

SEQ ID NO: 675218 - DNA, 13 bp, D. melanogaster
tttccctggcttt

SEQ ID NO: 675219 - DNA, 13 bp, D. melanogaster
tttccctgtgcac

SEQ ID NO: 675220 - DNA, 13 bp, D. melanogaster
tttccctgtgcat

SEQ ID NO: 675221 - DNA, 13 bp, D. melanogaster
tttccctgtgtgt

SEQ ID NO: 675222 - DNA, 13 bp, D. melanogaster
tttccctttaaaa

SEQ ID NO: 675223 - DNA, 13 bp, D. melanogaster
tttccctttcaat

SEQ ID NO: 675224 - DNA, 13 bp, D. melanogaster
tttccctttgatt

SEQ ID NO: 675225 - DNA, 13 bp, D. melanogaster
tttccctttggct

SEQ ID NO: 675226 - DNA, 13 bp, D. melanogaster
tttcccttttcgg

SEQ ID NO: 675227 - DNA, 14 bp, D. melanogaster
tttcccttttggcc

SEQ ID NO: 675228 - DNA, 13 bp, D. melanogaster
tttccgaaagctt

SEQ ID NO: 675229 - DNA, 13 bp, D. melanogaster
tttccgaattttt

SEQ ID NO: 675230 - DNA, 13 bp, D. melanogaster
tttccgaccattt

SEQ ID NO: 675231 - DNA, 13 bp, D. melanogaster
tttccgaccctat

SEQ ID NO: 675232 - DNA, 13 bp, D. melanogaster
tttccgactatat

SEQ ID NO: 675233 - DNA, 14 bp, D. melanogaster
tttccgagctcaga

SEQ ID NO: 675234 - DNA, 13 bp, D. melanogaster
tttccgattccga

SEQ ID NO: 675235 - DNA, 13 bp, D. melanogaster
tttccgattttca

SEQ ID NO: 675236 - DNA, 13 bp, D. melanogaster
tttccgattttcc

SEQ ID NO: 675237 - DNA, 13 bp, D. melanogaster
tttccgatttttc

SEQ ID NO: 675238 - DNA, 13 bp, D. melanogaster
tttccgcactttc

SEQ ID NO: 675239 - DNA, 13 bp, D. melanogaster
tttccgcactttt

SEQ ID NO: 675240 - DNA, 13 bp, D. melanogaster
tttccgcattttc

SEQ ID NO: 675241 - DNA, 13 bp, D. melanogaster
tttccgccgcttt

SEQ ID NO: 675242 - DNA, 13 bp, D. melanogaster
tttccgctcgctt

SEQ ID NO: 675243 - DNA, 13 bp, D. melanogaster
tttccgctgcaac

SEQ ID NO: 675244 - DNA, 13 bp, D. melanogaster
tttccgctgcagc

SEQ ID NO: 675245 - DNA, 13 bp, D. melanogaster
tttccgctgcatt

SEQ ID NO: 675246 - DNA, 13 bp, D. melanogaster
tttccgctgccag

SEQ ID NO: 675247 - DNA, 13 bp, D. melanogaster
tttccgctgcctt

SEQ ID NO: 675248 - DNA, 13 bp, D. melanogaster
tttccgcttccgc

SEQ ID NO: 675249 - DNA, 14 bp, D. melanogaster
tttccgcttccgtt

SEQ ID NO: 675250 - DNA, 13 bp, D. melanogaster
tttccgcttgcca

SEQ ID NO: 675251 - DNA, 13 bp, D. melanogaster
tttccgcttttca

SEQ ID NO: 675252 - DNA, 13 bp, D. melanogaster
tttccgcttttcg

SEQ ID NO: 675253 - DNA, 13 bp, D. melanogaster
tttccggaagcca

SEQ ID NO: 675254 - DNA, 13 bp, D. melanogaster
tttccggcatttc

SEQ ID NO: 675255 - DNA, 13 bp, D. melanogaster
tttccgtatgaaa

SEQ ID NO: 675256 - DNA, 13 bp, D. melanogaster
tttccgttcattt

SEQ ID NO: 675257 - DNA, 13 bp, D. melanogaster
tttccgttccatt

SEQ ID NO: 675258 - DNA, 13 bp, D. melanogaster
tttccgttcgatt

SEQ ID NO: 675259 - DNA, 13 bp, D. melanogaster
tttccgttgcatt

SEQ ID NO: 675260 - DNA, 13 bp, D. melanogaster
tttccgttggcca

SEQ ID NO: 675261 - DNA, 13 bp, D. melanogaster
tttccgtttaaaa

SEQ ID NO: 675262 - DNA, 13 bp, D. melanogaster
tttccgtttaatt

SEQ ID NO: 675263 - DNA, 13 bp, D. melanogaster
tttccgtttccat

SEQ ID NO: 675264 - DNA, 13 bp, D. melanogaster
tttccgtttccca

SEQ ID NO: 675265 - DNA, 13 bp, D. melanogaster
tttccgtttccgc

SEQ ID NO: 675266 - DNA, 14 bp, D. melanogaster
tttccgtttccgct

SEQ ID NO: 675267 - DNA, 13 bp, D. melanogaster
tttccgtttccgg

SEQ ID NO: 675268 - DNA, 13 bp, D. melanogaster
tttccgtttcgct

SEQ ID NO: 675269 - DNA, 13 bp, D. melanogaster
tttccgtttgccg

SEQ ID NO: 675270 - DNA, 13 bp, D. melanogaster
tttccgtttggca

SEQ ID NO: 675271 - DNA, 14 bp, D. melanogaster
tttccgttttaatt

SEQ ID NO: 675272 - DNA, 13 bp, D. melanogaster
tttccgttttcaa

SEQ ID NO: 675273 - DNA, 13 bp, D. melanogaster
tttccgttttcca

SEQ ID NO: 675274 - DNA, 13 bp, D. melanogaster
tttccgttttcga

SEQ ID NO: 675275 - DNA, 13 bp, D. melanogaster
tttccgttttgca

SEQ ID NO: 675276 - DNA, 13 bp, D. melanogaster
tttccgtttttaa

SEQ ID NO: 675277 - DNA, 13 bp, D. melanogaster
tttcctaaatatt

SEQ ID NO: 675278 - DNA, 13 bp, D. melanogaster
tttcctaatcaaa

SEQ ID NO: 675279 - DNA, 13 bp, D. melanogaster
tttcctattaaaa

SEQ ID NO: 675280 - DNA, 13 bp, D. melanogaster
tttcctatttagt

SEQ ID NO: 675281 - DNA, 14 bp, D. melanogaster
tttcctatttagtt

SEQ ID NO: 675282 - DNA, 13 bp, D. melanogaster
tttcctatttgca

SEQ ID NO: 675283 - DNA, 13 bp, D. melanogaster
tttcctcaaaaaa

SEQ ID NO: 675284 - DNA, 13 bp, D. melanogaster
tttcctcacattt

SEQ ID NO: 675285 - DNA, 13 bp, D. melanogaster
tttcctcagtgca

SEQ ID NO: 675286 - DNA, 13 bp, D. melanogaster
tttcctcagtttt

SEQ ID NO: 675287 - DNA, 13 bp, D. melanogaster
tttcctcatactt

SEQ ID NO: 675288 - DNA, 13 bp, D. melanogaster
tttcctcgatttt

SEQ ID NO: 675289 - DNA, 14 bp, D. melanogaster
tttcctcgattttc

SEQ ID NO: 675290 - DNA, 13 bp, D. melanogaster
tttcctcgcattt

SEQ ID NO: 675291 - DNA, 14 bp, D. melanogaster
tttcctcggccatt

SEQ ID NO: 675292 - DNA, 13 bp, D. melanogaster
tttcctctgtgca

SEQ ID NO: 675293 - DNA, 13 bp, D. melanogaster
tttcctcttgtat

SEQ ID NO: 675294 - DNA, 13 bp, D. melanogaster
tttcctgcacttt

SEQ ID NO: 675295 - DNA, 13 bp, D. melanogaster
tttcctgcatttt

SEQ ID NO: 675296 - DNA, 13 bp, D. melanogaster
tttcctgccattt

SEQ ID NO: 675297 - DNA, 13 bp, D. melanogaster
tttcctgcgcttt

SEQ ID NO: 675298 - DNA, 13 bp, D. melanogaster
tttcctgctgcaa

SEQ ID NO: 675299 - DNA, 13 bp, D. melanogaster
tttcctgctgcgc

SEQ ID NO: 675300 - DNA, 13 bp, D. melanogaster
tttcctgctgctc

SEQ ID NO: 675301 - DNA, 13 bp, D. melanogaster
tttcctgctgctg

SEQ ID NO: 675302 - DNA, 13 bp, D. melanogaster
tttcctggccaac

SEQ ID NO: 675303 - DNA, 13 bp, D. melanogaster
tttcctgggctat

SEQ ID NO: 675304 - DNA, 13 bp, D. melanogaster
tttcctgtacttg

SEQ ID NO: 675305 - DNA, 13 bp, D. melanogaster
tttcctgtatccc

SEQ ID NO: 675306 - DNA, 13 bp, D. melanogaster
tttcctgtttgcc

SEQ ID NO: 675307 - DNA, 13 bp, D. melanogaster
tttccttaattaa

SEQ ID NO: 675308 - DNA, 13 bp, D. melanogaster
tttccttatcagc

SEQ ID NO: 675309 - DNA, 13 bp, D. melanogaster
tttccttattgaa

SEQ ID NO: 675310 - DNA, 13 bp, D. melanogaster
tttccttgaaatt

SEQ ID NO: 675311 - DNA, 13 bp, D. melanogaster
tttccttgcattt

SEQ ID NO: 675312 - DNA, 13 bp, D. melanogaster
tttccttgccatt

SEQ ID NO: 675313 - DNA, 13 bp, D. melanogaster
tttccttggaaaa

SEQ ID NO: 675314 - DNA, 13 bp, D. melanogaster
tttccttggatta

SEQ ID NO: 675315 - DNA, 14 bp, D. melanogaster
tttccttggattaa

SEQ ID NO: 675316 - DNA, 13 bp, D. melanogaster
tttccttggcaaa

SEQ ID NO: 675317 - DNA, 13 bp, D. melanogaster
tttccttggccat

SEQ ID NO: 675318 - DNA, 13 bp, D. melanogaster
tttccttggctaa

SEQ ID NO: 675319 - DNA, 13 bp, D. melanogaster
tttcctttaaagt

SEQ ID NO: 675320 - DNA, 13 bp, D. melanogaster
tttcctttaattg

SEQ ID NO: 675321 - DNA, 14 bp, D. melanogaster
tttcctttcgattt

SEQ ID NO: 675322 - DNA, 13 bp, D. melanogaster
tttcctttgaaat

SEQ ID NO: 675323 - DNA, 13 bp, D. melanogaster
tttcctttgcatt

SEQ ID NO: 675324 - DNA, 13 bp, D. melanogaster
tttcctttgccac

SEQ ID NO: 675325 - DNA, 14 bp, D. melanogaster
tttcctttggattt

SEQ ID NO: 675326 - DNA, 13 bp, D. melanogaster
tttcctttggcag

SEQ ID NO: 675327 - DNA, 13 bp, D. melanogaster
tttcctttggcca

SEQ ID NO: 675328 - DNA, 13 bp, D. melanogaster
tttcctttgtggc

SEQ ID NO: 675329 - DNA, 13 bp, D. melanogaster
tttccttttcaaa

SEQ ID NO: 675330 - DNA, 13 bp, D. melanogaster
tttccttttcggc

SEQ ID NO: 675331 - DNA, 14 bp, D. melanogaster
tttccttttgcatt

SEQ ID NO: 675332 - DNA, 13 bp, D. melanogaster
tttccttttggcc

SEQ ID NO: 675333 - DNA, 14 bp, D. melanogaster
tttccttttggcca

SEQ ID NO: 675334 - DNA, 13 bp, D. melanogaster
tttcgaaaaaaaa

SEQ ID NO: 675335 - DNA, 14 bp, D. melanogaster
tttcgaaaaaaaat

SEQ ID NO: 675336 - DNA, 13 bp, D. melanogaster
tttcgaaaaacaa

SEQ ID NO: 675337 - DNA, 13 bp, D. melanogaster
tttcgaaaaagtt

SEQ ID NO: 675338 - DNA, 13 bp, D. melanogaster
tttcgaaaaataa

SEQ ID NO: 675339 - DNA, 14 bp, D. melanogaster
tttcgaaaaatttt

SEQ ID NO: 675340 - DNA, 13 bp, D. melanogaster
tttcgaaaacaat

SEQ ID NO: 675341 - DNA, 13 bp, D. melanogaster
tttcgaaaacttt

SEQ ID NO: 675342 - DNA, 13 bp, D. melanogaster
tttcgaaaagaaa

SEQ ID NO: 675343 - DNA, 13 bp, D. melanogaster
tttcgaaaagatt

SEQ ID NO: 675344 - DNA, 13 bp, D. melanogaster
tttcgaaaagtgt

SEQ ID NO: 675345 - DNA, 13 bp, D. melanogaster
tttcgaaaataaa

SEQ ID NO: 675346 - DNA, 14 bp, D. melanogaster
tttcgaaaataaaa

SEQ ID NO: 675347 - DNA, 13 bp, D. melanogaster
tttcgaaaatata

SEQ ID NO: 675348 - DNA, 13 bp, D. melanogaster
tttcgaaaatatt

SEQ ID NO: 675349 - DNA, 14 bp, D. melanogaster
tttcgaaaatattt

SEQ ID NO: 675350 - DNA, 14 bp, D. melanogaster
tttcgaaaatcaaa

SEQ ID NO: 675351 - DNA, 13 bp, D. melanogaster
tttcgaaaatgta

SEQ ID NO: 675352 - DNA, 14 bp, D. melanogaster
tttcgaaaatgttt

SEQ ID NO: 675353 - DNA, 13 bp, D. melanogaster
tttcgaaaattca

SEQ ID NO: 675354 - DNA, 13 bp, D. melanogaster
tttcgaaaattgt

SEQ ID NO: 675355 - DNA, 13 bp, D. melanogaster
tttcgaaaatttt

SEQ ID NO: 675356 - DNA, 14 bp, D. melanogaster
tttcgaaaattttc

SEQ ID NO: 675357 - DNA, 13 bp, D. melanogaster
tttcgaaacgaaa

SEQ ID NO: 675358 - DNA, 13 bp, D. melanogaster
tttcgaaagaaaa

SEQ ID NO: 675359 - DNA, 13 bp, D. melanogaster
tttcgaaagaaat

SEQ ID NO: 675360 - DNA, 13 bp, D. melanogaster
tttcgaaagcaat

SEQ ID NO: 675361 - DNA, 13 bp, D. melanogaster
tttcgaaagtatt

SEQ ID NO: 675362 - DNA, 13 bp, D. melanogaster
tttcgaaatagaa

SEQ ID NO: 675363 - DNA, 13 bp, D. melanogaster
tttcgaaatatct

SEQ ID NO: 675364 - DNA, 13 bp, D. melanogaster
tttcgaaatattc

SEQ ID NO: 675365 - DNA, 13 bp, D. melanogaster
tttcgaaatattt

SEQ ID NO: 675366 - DNA, 13 bp, D. melanogaster
tttcgaaatcaaa

SEQ ID NO: 675367 - DNA, 13 bp, D. melanogaster
tttcgaaatcatt

SEQ ID NO: 675368 - DNA, 13 bp, D. melanogaster
tttcgaaatcgaa

SEQ ID NO: 675369 - DNA, 13 bp, D. melanogaster
tttcgaaatgaaa

SEQ ID NO: 675370 - DNA, 13 bp, D. melanogaster
tttcgaaatgcat

SEQ ID NO: 675371 - DNA, 13 bp, D. melanogaster
tttcgaaatggtt

SEQ ID NO: 675372 - DNA, 14 bp, D. melanogaster
tttcgaaatggtta

SEQ ID NO: 675373 - DNA, 13 bp, D. melanogaster
tttcgaaatgtat

SEQ ID NO: 675374 - DNA, 13 bp, D. melanogaster
tttcgaaatgtgt

SEQ ID NO: 675375 - DNA, 13 bp, D. melanogaster
tttcgaaatgttt

SEQ ID NO: 675376 - DNA, 13 bp, D. melanogaster
tttcgaaattaat

SEQ ID NO: 675377 - DNA, 14 bp, D. melanogaster
tttcgaaattattt

SEQ ID NO: 675378 - DNA, 13 bp, D. melanogaster
tttcgaaattcat

SEQ ID NO: 675379 - DNA, 13 bp, D. melanogaster
tttcgaaattcca

SEQ ID NO: 675380 - DNA, 13 bp, D. melanogaster
tttcgaaattcga

SEQ ID NO: 675381 - DNA, 13 bp, D. melanogaster
tttcgaaatttat

SEQ ID NO: 675382 - DNA, 14 bp, D. melanogaster
tttcgaaatttttt

SEQ ID NO: 675383 - DNA, 13 bp, D. melanogaster
tttcgaagccaaa

SEQ ID NO: 675384 - DNA, 13 bp, D. melanogaster
tttcgaataaatt

SEQ ID NO: 675385 - DNA, 13 bp, D. melanogaster
tttcgaatataaa

SEQ ID NO: 675386 - DNA, 13 bp, D. melanogaster
tttcgaatatatt

SEQ ID NO: 675387 - DNA, 13 bp, D. melanogaster
tttcgaatatttt

SEQ ID NO: 675388 - DNA, 13 bp, D. melanogaster
tttcgaatcactt

SEQ ID NO: 675389 - DNA, 13 bp, D. melanogaster
tttcgaatcgaaa

SEQ ID NO: 675390 - DNA, 13 bp, D. melanogaster
tttcgaatgaaaa

SEQ ID NO: 675391 - DNA, 13 bp, D. melanogaster
tttcgaatgcaaa

SEQ ID NO: 675392 - DNA, 13 bp, D. melanogaster
tttcgaatgcttt

SEQ ID NO: 675393 - DNA, 13 bp, D. melanogaster
tttcgaatgtttt

SEQ ID NO: 675394 - DNA, 13 bp, D. melanogaster
tttcgaattattt

SEQ ID NO: 675395 - DNA, 14 bp, D. melanogaster
tttcgaattcgatt

SEQ ID NO: 675396 - DNA, 13 bp, D. melanogaster
tttcgaattgaaa

SEQ ID NO: 675397 - DNA, 13 bp, D. melanogaster
tttcgaattggca

SEQ ID NO: 675398 - DNA, 13 bp, D. melanogaster
tttcgaattgttt

SEQ ID NO: 675399 - DNA, 13 bp, D. melanogaster
tttcgaatttaaa

SEQ ID NO: 675400 - DNA, 13 bp, D. melanogaster
tttcgaatttcat

SEQ ID NO: 675401 - DNA, 13 bp, D. melanogaster
tttcgaatttcga

SEQ ID NO: 675402 - DNA, 13 bp, D. melanogaster
tttcgaatttgtt

SEQ ID NO: 675403 - DNA, 14 bp, D. melanogaster
tttcgaatttgttt

SEQ ID NO: 675404 - DNA, 13 bp, D. melanogaster
tttcgaattttcc

SEQ ID NO: 675405 - DNA, 13 bp, D. melanogaster
tttcgaatttttg

SEQ ID NO: 675406 - DNA, 13 bp, D. melanogaster
tttcgacaacttt

SEQ ID NO: 675407 - DNA, 13 bp, D. melanogaster
tttcgacatattt

SEQ ID NO: 675408 - DNA, 13 bp, D. melanogaster
tttcgacattatt

SEQ ID NO: 675409 - DNA, 13 bp, D. melanogaster
tttcgacattgtt

SEQ ID NO: 675410 - DNA, 13 bp, D. melanogaster
tttcgacattttc

SEQ ID NO: 675411 - DNA, 13 bp, D. melanogaster
tttcgaccatttt

SEQ ID NO: 675412 - DNA, 13 bp, D. melanogaster
tttcgactgattt

SEQ ID NO: 675413 - DNA, 14 bp, D. melanogaster
tttcgactgtgcag

SEQ ID NO: 675414 - DNA, 13 bp, D. melanogaster
tttcgacttggcc

SEQ ID NO: 675415 - DNA, 13 bp, D. melanogaster
tttcgagacagct

SEQ ID NO: 675416 - DNA, 14 bp, D. melanogaster
tttcgagcaccttc

SEQ ID NO: 675417 - DNA, 13 bp, D. melanogaster
tttcgagcgactg

SEQ ID NO: 675418 - DNA, 13 bp, D. melanogaster
tttcgagcttatc

SEQ ID NO: 675419 - DNA, 13 bp, D. melanogaster
tttcgagtgcaaa

SEQ ID NO: 675420 - DNA, 13 bp, D. melanogaster
tttcgagtgcagc

SEQ ID NO: 675421 - DNA, 13 bp, D. melanogaster
tttcgagtgcatt

SEQ ID NO: 675422 - DNA, 13 bp, D. melanogaster
tttcgagtgcttt

SEQ ID NO: 675423 - DNA, 13 bp, D. melanogaster
tttcgagtttttc

SEQ ID NO: 675424 - DNA, 13 bp, D. melanogaster
tttcgataaaaaa

SEQ ID NO: 675425 - DNA, 13 bp, D. melanogaster
tttcgataaattt

SEQ ID NO: 675426 - DNA, 13 bp, D. melanogaster
tttcgataagaaa

SEQ ID NO: 675427 - DNA, 15 bp, D. melanogaster
tttcgataagaaatt

SEQ ID NO: 675428 - DNA, 13 bp, D. melanogaster
tttcgatataatt

SEQ ID NO: 675429 - DNA, 13 bp, D. melanogaster
tttcgatatattt

SEQ ID NO: 675430 - DNA, 13 bp, D. melanogaster
tttcgatatttgt

SEQ ID NO: 675431 - DNA, 13 bp, D. melanogaster
tttcgatggcatt

SEQ ID NO: 675432 - DNA, 13 bp, D. melanogaster
tttcgatggctcc

SEQ ID NO: 675433 - DNA, 13 bp, D. melanogaster
tttcgatggcttt

SEQ ID NO: 675434 - DNA, 13 bp, D. melanogaster
tttcgatgttatt

SEQ ID NO: 675435 - DNA, 13 bp, D. melanogaster
tttcgattaaaaa

SEQ ID NO: 675436 - DNA, 13 bp, D. melanogaster
tttcgattaaatt

SEQ ID NO: 675437 - DNA, 13 bp, D. melanogaster
tttcgattacttt

SEQ ID NO: 675438 - DNA, 13 bp, D. melanogaster
tttcgattcaatt

SEQ ID NO: 675439 - DNA, 13 bp, D. melanogaster
tttcgattcacaa

SEQ ID NO: 675440 - DNA, 13 bp, D. melanogaster
tttcgattcagtt

SEQ ID NO: 675441 - DNA, 13 bp, D. melanogaster
tttcgattcattt

SEQ ID NO: 675442 - DNA, 13 bp, D. melanogaster
tttcgattccatt

SEQ ID NO: 675443 - DNA, 13 bp, D. melanogaster
tttcgattccgat

SEQ ID NO: 675444 - DNA, 13 bp, D. melanogaster
tttcgattcgtta

SEQ ID NO: 675445 - DNA, 13 bp, D. melanogaster
tttcgattcgttt

SEQ ID NO: 675446 - DNA, 13 bp, D. melanogaster
tttcgattctctt

SEQ ID NO: 675447 - DNA, 13 bp, D. melanogaster
tttcgattgaaaa

SEQ ID NO: 675448 - DNA, 14 bp, D. melanogaster
tttcgattgaaaat

SEQ ID NO: 675449 - DNA, 13 bp, D. melanogaster
tttcgattgcaaa

SEQ ID NO: 675450 - DNA, 13 bp, D. melanogaster
tttcgattgcaat

SEQ ID NO: 675451 - DNA, 14 bp, D. melanogaster
tttcgattgcattt

SEQ ID NO: 675452 - DNA, 13 bp, D. melanogaster
tttcgattgccaa

SEQ ID NO: 675453 - DNA, 13 bp, D. melanogaster
tttcgattgccca

SEQ ID NO: 675454 - DNA, 13 bp, D. melanogaster
tttcgattggaaa

SEQ ID NO: 675455 - DNA, 13 bp, D. melanogaster
tttcgattggatt

SEQ ID NO: 675456 - DNA, 13 bp, D. melanogaster
tttcgattggttt

SEQ ID NO: 675457 - DNA, 13 bp, D. melanogaster
tttcgattgtaat

SEQ ID NO: 675458 - DNA, 13 bp, D. melanogaster
tttcgattgtttg

SEQ ID NO: 675459 - DNA, 13 bp, D. melanogaster
tttcgatttcaag

SEQ ID NO: 675460 - DNA, 13 bp, D. melanogaster
tttcgatttcact

SEQ ID NO: 675461 - DNA, 13 bp, D. melanogaster
tttcgatttcatt

SEQ ID NO: 675462 - DNA, 14 bp, D. melanogaster
tttcgatttcattt

SEQ ID NO: 675463 - DNA, 13 bp, D. melanogaster
tttcgatttcgaa

SEQ ID NO: 675464 - DNA, 14 bp, D. melanogaster
tttcgatttcgaaa

SEQ ID NO: 675465 - DNA, 13 bp, D. melanogaster
tttcgatttcgag

SEQ ID NO: 675466 - DNA, 14 bp, D. melanogaster
tttcgatttcgatt

SEQ ID NO: 675467 - DNA, 13 bp, D. melanogaster
tttcgatttctgt

SEQ ID NO: 675468 - DNA, 14 bp, D. melanogaster
tttcgatttctttc

SEQ ID NO: 675469 - DNA, 13 bp, D. melanogaster
tttcgatttgaaa

SEQ ID NO: 675470 - DNA, 13 bp, D. melanogaster
tttcgatttgatt

SEQ ID NO: 675471 - DNA, 14 bp, D. melanogaster
tttcgatttgattt

SEQ ID NO: 675472 - DNA, 13 bp, D. melanogaster
tttcgatttgcaa

SEQ ID NO: 675473 - DNA, 13 bp, D. melanogaster
tttcgatttgcca

SEQ ID NO: 675474 - DNA, 13 bp, D. melanogaster
tttcgatttggaa

SEQ ID NO: 675475 - DNA, 13 bp, D. melanogaster
tttcgatttgtat

SEQ ID NO: 675476 - DNA, 13 bp, D. melanogaster
tttcgattttaaa

SEQ ID NO: 675477 - DNA, 13 bp, D. melanogaster
tttcgattttcaa

SEQ ID NO: 675478 - DNA, 13 bp, D. melanogaster
tttcgattttcga

SEQ ID NO: 675479 - DNA, 14 bp, D. melanogaster
tttcgattttttcg

SEQ ID NO: 675480 - DNA, 13 bp, D. melanogaster
tttcgcaaaaaat

SEQ ID NO: 675481 - DNA, 13 bp, D. melanogaster
tttcgcaaaacaa

SEQ ID NO: 675482 - DNA, 13 bp, D. melanogaster
tttcgcaaaactc

SEQ ID NO: 675483 - DNA, 13 bp, D. melanogaster
tttcgcaaatcaa

SEQ ID NO: 675484 - DNA, 13 bp, D. melanogaster
tttcgcaaatgtt

SEQ ID NO: 675485 - DNA, 13 bp, D. melanogaster
tttcgcaaattta

SEQ ID NO: 675486 - DNA, 13 bp, D. melanogaster
tttcgcaacattt

SEQ ID NO: 675487 - DNA, 13 bp, D. melanogaster
tttcgcaaggcaa

SEQ ID NO: 675488 - DNA, 13 bp, D. melanogaster
tttcgcaatgaaa

SEQ ID NO: 675489 - DNA, 13 bp, D. melanogaster
tttcgcaatttat

SEQ ID NO: 675490 - DNA, 13 bp, D. melanogaster
tttcgcaatttca

SEQ ID NO: 675491 - DNA, 13 bp, D. melanogaster
tttcgcaattttt

SEQ ID NO: 675492 - DNA, 13 bp, D. melanogaster
tttcgcacaattt

SEQ ID NO: 675493 - DNA, 13 bp, D. melanogaster
tttcgcacacaaa

SEQ ID NO: 675494 - DNA, 13 bp, D. melanogaster
tttcgcacagtgc

SEQ ID NO: 675495 - DNA, 13 bp, D. melanogaster
tttcgcacataaa

SEQ ID NO: 675496 - DNA, 13 bp, D. melanogaster
tttcgcacatttt

SEQ ID NO: 675497 - DNA, 13 bp, D. melanogaster
tttcgcactcgca

SEQ ID NO: 675498 - DNA, 13 bp, D. melanogaster
tttcgcagcattt

SEQ ID NO: 675499 - DNA, 13 bp, D. melanogaster
tttcgcagccatt

SEQ ID NO: 675500 - DNA, 14 bp, D. melanogaster
tttcgcagcgccag

SEQ ID NO: 675501 - DNA, 13 bp, D. melanogaster
tttcgcagtgcat

SEQ ID NO: 675502 - DNA, 13 bp, D. melanogaster
tttcgcagttttt

SEQ ID NO: 675503 - DNA, 13 bp, D. melanogaster
tttcgcataaaaa

SEQ ID NO: 675504 - DNA, 13 bp, D. melanogaster
tttcgcataaatt

SEQ ID NO: 675505 - DNA, 14 bp, D. melanogaster
tttcgcataaattt

SEQ ID NO: 675506 - DNA, 13 bp, D. melanogaster
tttcgcataacat

SEQ ID NO: 675507 - DNA, 13 bp, D. melanogaster
tttcgcatctgaa

SEQ ID NO: 675508 - DNA, 13 bp, D. melanogaster
tttcgcatgaaaa

SEQ ID NO: 675509 - DNA, 13 bp, D. melanogaster
tttcgcatgcaaa

SEQ ID NO: 675510 - DNA, 13 bp, D. melanogaster
tttcgcattaaaa

SEQ ID NO: 675511 - DNA, 13 bp, D. melanogaster
tttcgcattcatt

SEQ ID NO: 675512 - DNA, 13 bp, D. melanogaster
tttcgcattcgca

SEQ ID NO: 675513 - DNA, 13 bp, D. melanogaster
tttcgcattcgtt

SEQ ID NO: 675514 - DNA, 13 bp, D. melanogaster
tttcgcattctgc

SEQ ID NO: 675515 - DNA, 13 bp, D. melanogaster
tttcgcattggca

SEQ ID NO: 675516 - DNA, 14 bp, D. melanogaster
tttcgcatttaatt

SEQ ID NO: 675517 - DNA, 13 bp, D. melanogaster
tttcgcatttgca

SEQ ID NO: 675518 - DNA, 14 bp, D. melanogaster
tttcgcatttgcat

SEQ ID NO: 675519 - DNA, 13 bp, D. melanogaster
tttcgcatttgcc

SEQ ID NO: 675520 - DNA, 13 bp, D. melanogaster
tttcgcatttgct

SEQ ID NO: 675521 - DNA, 14 bp, D. melanogaster
tttcgcatttgttt

SEQ ID NO: 675522 - DNA, 13 bp, D. melanogaster
tttcgcattttat

SEQ ID NO: 675523 - DNA, 13 bp, D. melanogaster
tttcgcattttca

SEQ ID NO: 675524 - DNA, 13 bp, D. melanogaster
tttcgcattttcc

SEQ ID NO: 675525 - DNA, 13 bp, D. melanogaster
tttcgcattttgg

SEQ ID NO: 675526 - DNA, 13 bp, D. melanogaster
tttcgccaaaaat

SEQ ID NO: 675527 - DNA, 13 bp, D. melanogaster
tttcgccaacttt

SEQ ID NO: 675528 - DNA, 13 bp, D. melanogaster
tttcgccactttt

SEQ ID NO: 675529 - DNA, 13 bp, D. melanogaster
tttcgccagcaaa

SEQ ID NO: 675530 - DNA, 13 bp, D. melanogaster
tttcgccagcgaa

SEQ ID NO: 675531 - DNA, 13 bp, D. melanogaster
tttcgccagctgc

SEQ ID NO: 675532 - DNA, 13 bp, D. melanogaster
tttcgccagtttt

SEQ ID NO: 675533 - DNA, 13 bp, D. melanogaster
tttcgccatgttt

SEQ ID NO: 675534 - DNA, 13 bp, D. melanogaster
tttcgccattgtt

SEQ ID NO: 675535 - DNA, 13 bp, D. melanogaster
tttcgcccagtgt

SEQ ID NO: 675536 - DNA, 14 bp, D. melanogaster
tttcgcccagtgta

SEQ ID NO: 675537 - DNA, 13 bp, D. melanogaster
tttcgccgctgct

SEQ ID NO: 675538 - DNA, 13 bp, D. melanogaster
tttcgccggctgc

SEQ ID NO: 675539 - DNA, 13 bp, D. melanogaster
tttcgcctgattt

SEQ ID NO: 675540 - DNA, 13 bp, D. melanogaster
tttcgcctttgcc

SEQ ID NO: 675541 - DNA, 13 bp, D. melanogaster
tttcgcctttgtc

SEQ ID NO: 675542 - DNA, 14 bp, D. melanogaster
tttcgcgaaagcca

SEQ ID NO: 675543 - DNA, 14 bp, D. melanogaster
tttcgcgaaatcca

SEQ ID NO: 675544 - DNA, 13 bp, D. melanogaster
tttcgcgcacttt

SEQ ID NO: 675545 - DNA, 13 bp, D. melanogaster
tttcgctattttc

SEQ ID NO: 675546 - DNA, 14 bp, D. melanogaster
tttcgctcagtgca

SEQ ID NO: 675547 - DNA, 14 bp, D. melanogaster
tttcgctcagtgta

SEQ ID NO: 675548 - DNA, 13 bp, D. melanogaster
tttcgctcgctct

SEQ ID NO: 675549 - DNA, 13 bp, D. melanogaster
tttcgctgacttt

SEQ ID NO: 675550 - DNA, 13 bp, D. melanogaster
tttcgctgagtgc

SEQ ID NO: 675551 - DNA, 13 bp, D. melanogaster
tttcgctgcaatt

SEQ ID NO: 675552 - DNA, 13 bp, D. melanogaster
tttcgctgccaaa

SEQ ID NO: 675553 - DNA, 13 bp, D. melanogaster
tttcgctgccatt

SEQ ID NO: 675554 - DNA, 13 bp, D. melanogaster
tttcgctgccgct

SEQ ID NO: 675555 - DNA, 13 bp, D. melanogaster
tttcgctgccttt

SEQ ID NO: 675556 - DNA, 13 bp, D. melanogaster
tttcgctgcgtgt

SEQ ID NO: 675557 - DNA, 13 bp, D. melanogaster
tttcgctgctctt

SEQ ID NO: 675558 - DNA, 13 bp, D. melanogaster
tttcgctgctgct

SEQ ID NO: 675559 - DNA, 13 bp, D. melanogaster
tttcgctggcaaa

SEQ ID NO: 675560 - DNA, 14 bp, D. melanogaster
tttcgctggcattt

SEQ ID NO: 675561 - DNA, 13 bp, D. melanogaster
tttcgctggctga

SEQ ID NO: 675562 - DNA, 13 bp, D. melanogaster
tttcgctgtgcaa

SEQ ID NO: 675563 - DNA, 13 bp, D. melanogaster
tttcgctgtgcac

SEQ ID NO: 675564 - DNA, 13 bp, D. melanogaster
tttcgcttaattt

SEQ ID NO: 675565 - DNA, 13 bp, D. melanogaster
tttcgcttcattt

SEQ ID NO: 675566 - DNA, 13 bp, D. melanogaster
tttcgcttccatt

SEQ ID NO: 675567 - DNA, 13 bp, D. melanogaster
tttcgcttcgatt

SEQ ID NO: 675568 - DNA, 13 bp, D. melanogaster
tttcgcttgattg

SEQ ID NO: 675569 - DNA, 13 bp, D. melanogaster
tttcgcttgccaa

SEQ ID NO: 675570 - DNA, 13 bp, D. melanogaster
tttcgcttggcca

SEQ ID NO: 675571 - DNA, 13 bp, D. melanogaster
tttcgctttccca

SEQ ID NO: 675572 - DNA, 13 bp, D. melanogaster
tttcgctttcgat

SEQ ID NO: 675573 - DNA, 14 bp, D. melanogaster
tttcgctttcgatt

SEQ ID NO: 675574 - DNA, 13 bp, D. melanogaster
tttcgctttcgca

SEQ ID NO: 675575 - DNA, 13 bp, D. melanogaster
tttcgctttcgcc

SEQ ID NO: 675576 - DNA, 13 bp, D. melanogaster
tttcgctttcgct

SEQ ID NO: 675577 - DNA, 13 bp, D. melanogaster
tttcgctttgaat

SEQ ID NO: 675578 - DNA, 14 bp, D. melanogaster
tttcgctttgattt

SEQ ID NO: 675579 - DNA, 13 bp, D. melanogaster
tttcgctttgcat

SEQ ID NO: 675580 - DNA, 13 bp, D. melanogaster
tttcgctttggca

SEQ ID NO: 675581 - DNA, 13 bp, D. melanogaster
tttcgctttggct

SEQ ID NO: 675582 - DNA, 13 bp, D. melanogaster
tttcgctttgtgc

SEQ ID NO: 675583 - DNA, 13 bp, D. melanogaster
tttcgcttttcac

SEQ ID NO: 675584 - DNA, 14 bp, D. melanogaster
tttcgcttttcact

SEQ ID NO: 675585 - DNA, 13 bp, D. melanogaster
tttcgcttttcat

SEQ ID NO: 675586 - DNA, 14 bp, D. melanogaster
tttcgcttttcatt

SEQ ID NO: 675587 - DNA, 13 bp, D. melanogaster
tttcgcttttcca

SEQ ID NO: 675588 - DNA, 13 bp, D. melanogaster
tttcgcttttcgc

SEQ ID NO: 675589 - DNA, 13 bp, D. melanogaster
tttcgcttttcgg

SEQ ID NO: 675590 - DNA, 13 bp, D. melanogaster
tttcggaaaatgt

SEQ ID NO: 675591 - DNA, 13 bp, D. melanogaster
tttcggaacatcc

SEQ ID NO: 675592 - DNA, 14 bp, D. melanogaster
tttcggacattatc

SEQ ID NO: 675593 - DNA, 13 bp, D. melanogaster
tttcggacattgt

SEQ ID NO: 675594 - DNA, 13 bp, D. melanogaster
tttcggagaaaca

SEQ ID NO: 675595 - DNA, 14 bp, D. melanogaster
tttcggagaaccta

SEQ ID NO: 675596 - DNA, 13 bp, D. melanogaster
tttcggagaattt

SEQ ID NO: 675597 - DNA, 13 bp, D. melanogaster
tttcggaggcatt

SEQ ID NO: 675598 - DNA, 13 bp, D. melanogaster
tttcggattcaat

SEQ ID NO: 675599 - DNA, 13 bp, D. melanogaster
tttcggatttcgg

SEQ ID NO: 675600 - DNA, 13 bp, D. melanogaster
tttcggattttca

SEQ ID NO: 675601 - DNA, 13 bp, D. melanogaster
tttcggcaacttt

SEQ ID NO: 675602 - DNA, 13 bp, D. melanogaster
tttcggcaatttt

SEQ ID NO: 675603 - DNA, 13 bp, D. melanogaster
tttcggcatttat

SEQ ID NO: 675604 - DNA, 13 bp, D. melanogaster
tttcggcatttcg

SEQ ID NO: 675605 - DNA, 13 bp, D. melanogaster
tttcggccaaaaa

SEQ ID NO: 675606 - DNA, 13 bp, D. melanogaster
tttcggccaaaat

SEQ ID NO: 675607 - DNA, 13 bp, D. melanogaster
tttcggccaactt

SEQ ID NO: 675608 - DNA, 13 bp, D. melanogaster
tttcggccaagtt

SEQ ID NO: 675609 - DNA, 13 bp, D. melanogaster
tttcggccacatt

SEQ ID NO: 675610 - DNA, 13 bp, D. melanogaster
tttcggccataaa

SEQ ID NO: 675611 - DNA, 13 bp, D. melanogaster
tttcggcctggcc

SEQ ID NO: 675612 - DNA, 13 bp, D. melanogaster
tttcggctgcaaa

SEQ ID NO: 675613 - DNA, 13 bp, D. melanogaster
tttcggctgcatt

SEQ ID NO: 675614 - DNA, 13 bp, D. melanogaster
tttcggcttcatt

SEQ ID NO: 675615 - DNA, 13 bp, D. melanogaster
tttcggctttgat

SEQ ID NO: 675616 - DNA, 13 bp, D. melanogaster
tttcgggaaattg

SEQ ID NO: 675617 - DNA, 13 bp, D. melanogaster
tttcgggccaatt

SEQ ID NO: 675618 - DNA, 13 bp, D. melanogaster
tttcggggaggaa

SEQ ID NO: 675619 - DNA, 13 bp, D. melanogaster
tttcgggtggcat

SEQ ID NO: 675620 - DNA, 13 bp, D. melanogaster
tttcgggttttcc

SEQ ID NO: 675621 - DNA, 13 bp, D. melanogaster
tttcgggttttcg

SEQ ID NO: 675622 - DNA, 13 bp, D. melanogaster
tttcggtagtgga

SEQ ID NO: 675623 - DNA, 13 bp, D. melanogaster
tttcggtattata

SEQ ID NO: 675624 - DNA, 13 bp, D. melanogaster
tttcggtattttc

SEQ ID NO: 675625 - DNA, 13 bp, D. melanogaster
tttcggtggcttt

SEQ ID NO: 675626 - DNA, 13 bp, D. melanogaster
tttcggtgtattt

SEQ ID NO: 675627 - DNA, 13 bp, D. melanogaster
tttcggttaattg

SEQ ID NO: 675628 - DNA, 13 bp, D. melanogaster
tttcggttagttt

SEQ ID NO: 675629 - DNA, 13 bp, D. melanogaster
tttcggttcgctt

SEQ ID NO: 675630 - DNA, 13 bp, D. melanogaster
tttcggtttcact

SEQ ID NO: 675631 - DNA, 13 bp, D. melanogaster
tttcggtttcagt

SEQ ID NO: 675632 - DNA, 13 bp, D. melanogaster
tttcggtttcatt

SEQ ID NO: 675633 - DNA, 13 bp, D. melanogaster
tttcggtttccat

SEQ ID NO: 675634 - DNA, 14 bp, D. melanogaster
tttcggtttcgatt

SEQ ID NO: 675635 - DNA, 13 bp, D. melanogaster
tttcggtttcgct

SEQ ID NO: 675636 - DNA, 14 bp, D. melanogaster
tttcggtttcgctt

SEQ ID NO: 675637 - DNA, 13 bp, D. melanogaster
tttcggtttcgga

SEQ ID NO: 675638 - DNA, 14 bp, D. melanogaster
tttcggtttcggtt

SEQ ID NO: 675639 - DNA, 13 bp, D. melanogaster
tttcggtttgcca

SEQ ID NO: 675640 - DNA, 13 bp, D. melanogaster
tttcggtttggca

SEQ ID NO: 675641 - DNA, 13 bp, D. melanogaster
tttcgtaaaagct

SEQ ID NO: 675642 - DNA, 13 bp, D. melanogaster
tttcgtaaaatat

SEQ ID NO: 675643 - DNA, 14 bp, D. melanogaster
tttcgtaaacaaaa

SEQ ID NO: 675644 - DNA, 13 bp, D. melanogaster
tttcgtaataaaa

SEQ ID NO: 675645 - DNA, 13 bp, D. melanogaster
tttcgtaatacag

SEQ ID NO: 675646 - DNA, 13 bp, D. melanogaster
tttcgtaattgaa

SEQ ID NO: 675647 - DNA, 13 bp, D. melanogaster
tttcgtataattt

SEQ ID NO: 675648 - DNA, 13 bp, D. melanogaster
tttcgtatatatg

SEQ ID NO: 675649 - DNA, 13 bp, D. melanogaster
tttcgtatctgtg

SEQ ID NO: 675650 - DNA, 13 bp, D. melanogaster
tttcgtcacaaaa

SEQ ID NO: 675651 - DNA, 16 bp, D. melanogaster
tttcgtcacaaaatat

SEQ ID NO: 675652 - DNA, 13 bp, D. melanogaster
tttcgtccacaat

SEQ ID NO: 675653 - DNA, 13 bp, D. melanogaster
tttcgtcctggca

SEQ ID NO: 675654 - DNA, 13 bp, D. melanogaster
tttcgtgcatttt

SEQ ID NO: 675655 - DNA, 13 bp, D. melanogaster
tttcgtggaaatt

SEQ ID NO: 675656 - DNA, 13 bp, D. melanogaster
tttcgttaagttt

SEQ ID NO: 675657 - DNA, 13 bp, D. melanogaster
tttcgttaatatt

SEQ ID NO: 675658 - DNA, 13 bp, D. melanogaster
tttcgttacgttt

SEQ ID NO: 675659 - DNA, 13 bp, D. melanogaster
tttcgttcataaa

SEQ ID NO: 675660 - DNA, 13 bp, D. melanogaster
tttcgttccattt

SEQ ID NO: 675661 - DNA, 13 bp, D. melanogaster
tttcgttgacttt

SEQ ID NO: 675662 - DNA, 13 bp, D. melanogaster
tttcgttgcattt

SEQ ID NO: 675663 - DNA, 13 bp, D. melanogaster
tttcgttgccatt

SEQ ID NO: 675664 - DNA, 13 bp, D. melanogaster
tttcgttggcgtt

SEQ ID NO: 675665 - DNA, 13 bp, D. melanogaster
tttcgttgtcatt

SEQ ID NO: 675666 - DNA, 14 bp, D. melanogaster
tttcgtttagttca

SEQ ID NO: 675667 - DNA, 13 bp, D. melanogaster
tttcgtttattga

SEQ ID NO: 675668 - DNA, 13 bp, D. melanogaster
tttcgtttcaatt

SEQ ID NO: 675669 - DNA, 14 bp, D. melanogaster
tttcgtttcaattt

SEQ ID NO: 675670 - DNA, 13 bp, D. melanogaster
tttcgtttccaat

SEQ ID NO: 675671 - DNA, 13 bp, D. melanogaster
tttcgtttccact

SEQ ID NO: 675672 - DNA, 13 bp, D. melanogaster
tttcgtttccatt

SEQ ID NO: 675673 - DNA, 14 bp, D. melanogaster
tttcgtttccattt

SEQ ID NO: 675674 - DNA, 13 bp, D. melanogaster
tttcgtttcgcat

SEQ ID NO: 675675 - DNA, 13 bp, D. melanogaster
tttcgtttcggcc

SEQ ID NO: 675676 - DNA, 14 bp, D. melanogaster
tttcgtttgaattt

SEQ ID NO: 675677 - DNA, 13 bp, D. melanogaster
tttcgtttgcatt

SEQ ID NO: 675678 - DNA, 13 bp, D. melanogaster
tttcgtttgccat

SEQ ID NO: 675679 - DNA, 13 bp, D. melanogaster
tttcgtttgccca

SEQ ID NO: 675680 - DNA, 13 bp, D. melanogaster
tttcgtttgctgc

SEQ ID NO: 675681 - DNA, 13 bp, D. melanogaster
tttcgtttggcca

SEQ ID NO: 675682 - DNA, 14 bp, D. melanogaster
tttcgttttcaaaa

SEQ ID NO: 675683 - DNA, 13 bp, D. melanogaster
tttcgttttcaat

SEQ ID NO: 675684 - DNA, 14 bp, D. melanogaster
tttcgttttcaatt

SEQ ID NO: 675685 - DNA, 13 bp, D. melanogaster
tttcgttttcagt

SEQ ID NO: 675686 - DNA, 14 bp, D. melanogaster
tttcgttttcagtt

SEQ ID NO: 675687 - DNA, 13 bp, D. melanogaster
tttcgttttcgat

SEQ ID NO: 675688 - DNA, 14 bp, D. melanogaster
tttcgttttggcca

SEQ ID NO: 675689 - DNA, 13 bp, D. melanogaster
tttcgtttttcga

SEQ ID NO: 675690 - DNA, 13 bp, D. melanogaster
tttcgtttttgga

SEQ ID NO: 675691 - DNA, 13 bp, D. melanogaster
tttctaaaaacaa

SEQ ID NO: 675692 - DNA, 13 bp, D. melanogaster
tttctaaaaagtg

SEQ ID NO: 675693 - DNA, 13 bp, D. melanogaster
tttctaaaactaa

SEQ ID NO: 675694 - DNA, 13 bp, D. melanogaster
tttctaaaactat

SEQ ID NO: 675695 - DNA, 13 bp, D. melanogaster
tttctaaaagtta

SEQ ID NO: 675696 - DNA, 13 bp, D. melanogaster
tttctaaaatttc

SEQ ID NO: 675697 - DNA, 13 bp, D. melanogaster
tttctaaacaaag

SEQ ID NO: 675698 - DNA, 13 bp, D. melanogaster
tttctaaagaaaa

SEQ ID NO: 675699 - DNA, 13 bp, D. melanogaster
tttctaaagattt

SEQ ID NO: 675700 - DNA, 13 bp, D. melanogaster
tttctaaatgttt

SEQ ID NO: 675701 - DNA, 13 bp, D. melanogaster
tttctaaatttgc

SEQ ID NO: 675702 - DNA, 13 bp, D. melanogaster
tttctaaatttgt

SEQ ID NO: 675703 - DNA, 13 bp, D. melanogaster
tttctaacaaaat

SEQ ID NO: 675704 - DNA, 13 bp, D. melanogaster
tttctaacaattt

SEQ ID NO: 675705 - DNA, 14 bp, D. melanogaster
tttctaagaaaaat

SEQ ID NO: 675706 - DNA, 13 bp, D. melanogaster
tttctaagaatat

SEQ ID NO: 675707 - DNA, 13 bp, D. melanogaster
tttctaagcattt

SEQ ID NO: 675708 - DNA, 13 bp, D. melanogaster
tttctaagtaata

SEQ ID NO: 675709 - DNA, 13 bp, D. melanogaster
tttctaatcgtag

SEQ ID NO: 675710 - DNA, 13 bp, D. melanogaster
tttctaatgataa

SEQ ID NO: 675711 - DNA, 13 bp, D. melanogaster
tttctaatgattt

SEQ ID NO: 675712 - DNA, 13 bp, D. melanogaster
tttctaattaagt

SEQ ID NO: 675713 - DNA, 13 bp, D. melanogaster
tttctaattgaat

SEQ ID NO: 675714 - DNA, 13 bp, D. melanogaster
tttctaattgatt

SEQ ID NO: 675715 - DNA, 13 bp, D. melanogaster
tttctaattgctt

SEQ ID NO: 675716 - DNA, 13 bp, D. melanogaster
tttctaattggaa

SEQ ID NO: 675717 - DNA, 13 bp, D. melanogaster
tttctaatttcca

SEQ ID NO: 675718 - DNA, 15 bp, D. melanogaster
tttctaatttccaaa

SEQ ID NO: 675719 - DNA, 13 bp, D. melanogaster
tttctacaaaaat

SEQ ID NO: 675720 - DNA, 13 bp, D. melanogaster
tttctacaaacaa

SEQ ID NO: 675721 - DNA, 13 bp, D. melanogaster
tttctacacattt

SEQ ID NO: 675722 - DNA, 13 bp, D. melanogaster
tttctacatctgt

SEQ ID NO: 675723 - DNA, 13 bp, D. melanogaster
tttctaccatttc

SEQ ID NO: 675724 - DNA, 13 bp, D. melanogaster
tttctacgatttt

SEQ ID NO: 675725 - DNA, 13 bp, D. melanogaster
tttctactactcc

SEQ ID NO: 675726 - DNA, 13 bp, D. melanogaster
tttctagctttta

SEQ ID NO: 675727 - DNA, 13 bp, D. melanogaster
tttctaggaattt

SEQ ID NO: 675728 - DNA, 13 bp, D. melanogaster
tttctaggtcaaa

SEQ ID NO: 675729 - DNA, 13 bp, D. melanogaster
tttctataaacaa

SEQ ID NO: 675730 - DNA, 14 bp, D. melanogaster
tttctataaacaaa

SEQ ID NO: 675731 - DNA, 13 bp, D. melanogaster
tttctataaattc

SEQ ID NO: 675732 - DNA, 13 bp, D. melanogaster
tttctataacaat

SEQ ID NO: 675733 - DNA, 13 bp, D. melanogaster
tttctatacaatt

SEQ ID NO: 675734 - DNA, 13 bp, D. melanogaster
tttctatacatat

SEQ ID NO: 675735 - DNA, 13 bp, D. melanogaster
tttctatataaac

SEQ ID NO: 675736 - DNA, 13 bp, D. melanogaster
tttctatcaaagc

SEQ ID NO: 675737 - DNA, 13 bp, D. melanogaster
tttctatcaacta

SEQ ID NO: 675738 - DNA, 13 bp, D. melanogaster
tttctatcgatat

SEQ ID NO: 675739 - DNA, 13 bp, D. melanogaster
tttctatctccgt

SEQ ID NO: 675740 - DNA, 13 bp, D. melanogaster
tttctatctgatg

SEQ ID NO: 675741 - DNA, 13 bp, D. melanogaster
tttctatgaattt

SEQ ID NO: 675742 - DNA, 13 bp, D. melanogaster
tttctatgcaaat

SEQ ID NO: 675743 - DNA, 13 bp, D. melanogaster
tttctatgcattt

SEQ ID NO: 675744 - DNA, 13 bp, D. melanogaster
tttctatgccaaa

SEQ ID NO: 675745 - DNA, 13 bp, D. melanogaster
tttctatgccatc

SEQ ID NO: 675746 - DNA, 14 bp, D. melanogaster
tttctatgccatca

SEQ ID NO: 675747 - DNA, 13 bp, D. melanogaster
tttctatggataa

SEQ ID NO: 675748 - DNA, 13 bp, D. melanogaster
tttctatggattt

SEQ ID NO: 675749 - DNA, 13 bp, D. melanogaster
tttctatgtgtgt

SEQ ID NO: 675750 - DNA, 13 bp, D. melanogaster
tttctattaaaca

SEQ ID NO: 675751 - DNA, 13 bp, D. melanogaster
tttctattcaaat

SEQ ID NO: 675752 - DNA, 13 bp, D. melanogaster
tttctattgaatt

SEQ ID NO: 675753 - DNA, 14 bp, D. melanogaster
tttctattgatttg

SEQ ID NO: 675754 - DNA, 13 bp, D. melanogaster
tttctattgtact

SEQ ID NO: 675755 - DNA, 13 bp, D. melanogaster
tttctatttcggt

SEQ ID NO: 675756 - DNA, 13 bp, D. melanogaster
tttctatttgaat

SEQ ID NO: 675757 - DNA, 13 bp, D. melanogaster
tttctatttgcct

SEQ ID NO: 675758 - DNA, 13 bp, D. melanogaster
tttctcaaaaaac

SEQ ID NO: 675759 - DNA, 13 bp, D. melanogaster
tttctcaacattt

SEQ ID NO: 675760 - DNA, 13 bp, D. melanogaster
tttctcaaccagc

SEQ ID NO: 675761 - DNA, 13 bp, D. melanogaster
tttctcaatcaat

SEQ ID NO: 675762 - DNA, 13 bp, D. melanogaster
tttctcaatgtaa

SEQ ID NO: 675763 - DNA, 14 bp, D. melanogaster
tttctcacagtgca

SEQ ID NO: 675764 - DNA, 13 bp, D. melanogaster
tttctcactcatc

SEQ ID NO: 675765 - DNA, 13 bp, D. melanogaster
tttctcactgtgc

SEQ ID NO: 675766 - DNA, 13 bp, D. melanogaster
tttctcagatttt

SEQ ID NO: 675767 - DNA, 13 bp, D. melanogaster
tttctcagctatt

SEQ ID NO: 675768 - DNA, 13 bp, D. melanogaster
tttctcagtgcct

SEQ ID NO: 675769 - DNA, 13 bp, D. melanogaster
tttctcagtgtaa

SEQ ID NO: 675770 - DNA, 13 bp, D. melanogaster
tttctcagtgtac

SEQ ID NO: 675771 - DNA, 13 bp, D. melanogaster
tttctcagtgtgt

SEQ ID NO: 675772 - DNA, 13 bp, D. melanogaster
tttctcattaaaa

SEQ ID NO: 675773 - DNA, 13 bp, D. melanogaster
tttctcattgaaa

SEQ ID NO: 675774 - DNA, 14 bp, D. melanogaster
tttctcattgaaaa

SEQ ID NO: 675775 - DNA, 13 bp, D. melanogaster
tttctcatttgat

SEQ ID NO: 675776 - DNA, 13 bp, D. melanogaster
tttctcatttgca

SEQ ID NO: 675777 - DNA, 13 bp, D. melanogaster
tttctcatttgct

SEQ ID NO: 675778 - DNA, 14 bp, D. melanogaster
tttctcatttggtt

SEQ ID NO: 675779 - DNA, 13 bp, D. melanogaster
tttctccaaaaat

SEQ ID NO: 675780 - DNA, 13 bp, D. melanogaster
tttctccacattt

SEQ ID NO: 675781 - DNA, 13 bp, D. melanogaster
tttctccatttgc

SEQ ID NO: 675782 - DNA, 13 bp, D. melanogaster
tttctccctgtgt

SEQ ID NO: 675783 - DNA, 13 bp, D. melanogaster
tttctccgagtgt

SEQ ID NO: 675784 - DNA, 13 bp, D. melanogaster
tttctcctaaaaa

SEQ ID NO: 675785 - DNA, 13 bp, D. melanogaster
tttctcgactatc

SEQ ID NO: 675786 - DNA, 13 bp, D. melanogaster
tttctcgagccag

SEQ ID NO: 675787 - DNA, 13 bp, D. melanogaster
tttctcgcagtgc

SEQ ID NO: 675788 - DNA, 14 bp, D. melanogaster
tttctcgcagtgca

SEQ ID NO: 675789 - DNA, 14 bp, D. melanogaster
tttctcgcagtgta

SEQ ID NO: 675790 - DNA, 13 bp, D. melanogaster
tttctcgccgtgc

SEQ ID NO: 675791 - DNA, 14 bp, D. melanogaster
tttctcgccgtgta

SEQ ID NO: 675792 - DNA, 13 bp, D. melanogaster
tttctcgctgtgt

SEQ ID NO: 675793 - DNA, 14 bp, D. melanogaster
tttctcgctgtgta

SEQ ID NO: 675794 - DNA, 13 bp, D. melanogaster
tttctcggctttc

SEQ ID NO: 675795 - DNA, 13 bp, D. melanogaster
tttctcgtagttt

SEQ ID NO: 675796 - DNA, 13 bp, D. melanogaster
tttctcgttcgca

SEQ ID NO: 675797 - DNA, 13 bp, D. melanogaster
tttctcgttttca

SEQ ID NO: 675798 - DNA, 13 bp, D. melanogaster
tttctctcagtgc

SEQ ID NO: 675799 - DNA, 14 bp, D. melanogaster
tttctctcagtgca

SEQ ID NO: 675800 - DNA, 14 bp, D. melanogaster
tttctctcagtgcc

SEQ ID NO: 675801 - DNA, 13 bp, D. melanogaster
tttctctcagtgt

SEQ ID NO: 675802 - DNA, 14 bp, D. melanogaster
tttctctcagtgtg

SEQ ID NO: 675803 - DNA, 13 bp, D. melanogaster
tttctctcggtgc

SEQ ID NO: 675804 - DNA, 14 bp, D. melanogaster
tttctctctctgta

SEQ ID NO: 675805 - DNA, 14 bp, D. melanogaster
tttctctctgtgta

SEQ ID NO: 675806 - DNA, 14 bp, D. melanogaster
tttctctctgtgtg

SEQ ID NO: 675807 - DNA, 13 bp, D. melanogaster
tttctctgcattt

SEQ ID NO: 675808 - DNA, 13 bp, D. melanogaster
tttctctgtgtgc

SEQ ID NO: 675809 - DNA, 13 bp, D. melanogaster
tttctcttcgact

SEQ ID NO: 675810 - DNA, 13 bp, D. melanogaster
tttctcttggcca

SEQ ID NO: 675811 - DNA, 13 bp, D. melanogaster
tttctctttgcca

SEQ ID NO: 675812 - DNA, 13 bp, D. melanogaster
tttctgaaaatat

SEQ ID NO: 675813 - DNA, 13 bp, D. melanogaster
tttctgaaattaa

SEQ ID NO: 675814 - DNA, 13 bp, D. melanogaster
tttctgaaatttt

SEQ ID NO: 675815 - DNA, 13 bp, D. melanogaster
tttctgaatatat

SEQ ID NO: 675816 - DNA, 13 bp, D. melanogaster
tttctgaatgaaa

SEQ ID NO: 675817 - DNA, 13 bp, D. melanogaster
tttctgaatgaga

SEQ ID NO: 675818 - DNA, 13 bp, D. melanogaster
tttctgatgcgcg

SEQ ID NO: 675819 - DNA, 13 bp, D. melanogaster
tttctgattgaaa

SEQ ID NO: 675820 - DNA, 13 bp, D. melanogaster
tttctgcaagtgt

SEQ ID NO: 675821 - DNA, 13 bp, D. melanogaster
tttctgcaatttg

SEQ ID NO: 675822 - DNA, 13 bp, D. melanogaster
tttctgcacattt

SEQ ID NO: 675823 - DNA, 13 bp, D. melanogaster
tttctgcactggc

SEQ ID NO: 675824 - DNA, 13 bp, D. melanogaster
tttctgcatttaa

SEQ ID NO: 675825 - DNA, 13 bp, D. melanogaster
tttctgcatttca

SEQ ID NO: 675826 - DNA, 13 bp, D. melanogaster
tttctgcatttcc

SEQ ID NO: 675827 - DNA, 13 bp, D. melanogaster
tttctgccagtgc

SEQ ID NO: 675828 - DNA, 14 bp, D. melanogaster
tttctgccagtgca

SEQ ID NO: 675829 - DNA, 13 bp, D. melanogaster
tttctgccagtgt

SEQ ID NO: 675830 - DNA, 13 bp, D. melanogaster
tttctgccatttc

SEQ ID NO: 675831 - DNA, 13 bp, D. melanogaster
tttctgccatttg

SEQ ID NO: 675832 - DNA, 13 bp, D. melanogaster
tttctgccatttt

SEQ ID NO: 675833 - DNA, 13 bp, D. melanogaster
tttctgcccgatg

SEQ ID NO: 675834 - DNA, 13 bp, D. melanogaster
tttctgccgctgc

SEQ ID NO: 675835 - DNA, 13 bp, D. melanogaster
tttctgcgcctgg

SEQ ID NO: 675836 - DNA, 13 bp, D. melanogaster
tttctgcggagga

SEQ ID NO: 675837 - DNA, 13 bp, D. melanogaster
tttctgctgattt

SEQ ID NO: 675838 - DNA, 13 bp, D. melanogaster
tttctgctgccaa

SEQ ID NO: 675839 - DNA, 13 bp, D. melanogaster
tttctgctgcctg

SEQ ID NO: 675840 - DNA, 13 bp, D. melanogaster
tttctgctgctgt

SEQ ID NO: 675841 - DNA, 13 bp, D. melanogaster
tttctgcttctgc

SEQ ID NO: 675842 - DNA, 13 bp, D. melanogaster
tttctgctttaat

SEQ ID NO: 675843 - DNA, 13 bp, D. melanogaster
tttctggaatatc

SEQ ID NO: 675844 - DNA, 13 bp, D. melanogaster
tttctggaatttt

SEQ ID NO: 675845 - DNA, 13 bp, D. melanogaster
tttctggattatg

SEQ ID NO: 675846 - DNA, 13 bp, D. melanogaster
tttctggcagtgt

SEQ ID NO: 675847 - DNA, 13 bp, D. melanogaster
tttctggcatttt

SEQ ID NO: 675848 - DNA, 13 bp, D. melanogaster
tttctggccaaaa

SEQ ID NO: 675849 - DNA, 13 bp, D. melanogaster
tttctggccaaat

SEQ ID NO: 675850 - DNA, 13 bp, D. melanogaster
tttctggccaaga

SEQ ID NO: 675851 - DNA, 13 bp, D. melanogaster
tttctggccagca

SEQ ID NO: 675852 - DNA, 13 bp, D. melanogaster
tttctggccagga

SEQ ID NO: 675853 - DNA, 14 bp, D. melanogaster
tttctggccaggat

SEQ ID NO: 675854 - DNA, 13 bp, D. melanogaster
tttctggccattt

SEQ ID NO: 675855 - DNA, 13 bp, D. melanogaster
tttctggccttca

SEQ ID NO: 675856 - DNA, 13 bp, D. melanogaster
tttctggcctttg

SEQ ID NO: 675857 - DNA, 13 bp, D. melanogaster
tttctggctgcca

SEQ ID NO: 675858 - DNA, 13 bp, D. melanogaster
tttctggctgctg

SEQ ID NO: 675859 - DNA, 13 bp, D. melanogaster
tttctggctggct

SEQ ID NO: 675860 - DNA, 13 bp, D. melanogaster
tttctgggcattt

SEQ ID NO: 675861 - DNA, 13 bp, D. melanogaster
tttctggttctgg

SEQ ID NO: 675862 - DNA, 13 bp, D. melanogaster
tttctggttgctg

SEQ ID NO: 675863 - DNA, 13 bp, D. melanogaster
tttctgtaaaatt

SEQ ID NO: 675864 - DNA, 13 bp, D. melanogaster
tttctgtaattag

SEQ ID NO: 675865 - DNA, 13 bp, D. melanogaster
tttctgtacattt

SEQ ID NO: 675866 - DNA, 13 bp, D. melanogaster
tttctgtactgca

SEQ ID NO: 675867 - DNA, 13 bp, D. melanogaster
tttctgtatatgg

SEQ ID NO: 675868 - DNA, 13 bp, D. melanogaster
tttctgtatgctt

SEQ ID NO: 675869 - DNA, 13 bp, D. melanogaster
tttctgtatttca

SEQ ID NO: 675870 - DNA, 13 bp, D. melanogaster
tttctgtcacttt

SEQ ID NO: 675871 - DNA, 14 bp, D. melanogaster
tttctgtctgtctg

SEQ ID NO: 675872 - DNA, 13 bp, D. melanogaster
tttctgtgcaatt

SEQ ID NO: 675873 - DNA, 13 bp, D. melanogaster
tttctgtgcacaa

SEQ ID NO: 675874 - DNA, 13 bp, D. melanogaster
tttctgtgcactt

SEQ ID NO: 675875 - DNA, 13 bp, D. melanogaster
tttctgtgcagca

SEQ ID NO: 675876 - DNA, 13 bp, D. melanogaster
tttctgtggcaaa

SEQ ID NO: 675877 - DNA, 13 bp, D. melanogaster
tttctgtggctgc

SEQ ID NO: 675878 - DNA, 13 bp, D. melanogaster
tttctgtgtgccc

SEQ ID NO: 675879 - DNA, 13 bp, D. melanogaster
tttctgtgtgctc

SEQ ID NO: 675880 - DNA, 14 bp, D. melanogaster
tttctgttattgtc

SEQ ID NO: 675881 - DNA, 13 bp, D. melanogaster
tttctgttcgcct

SEQ ID NO: 675882 - DNA, 14 bp, D. melanogaster
tttctgttgctgct

SEQ ID NO: 675883 - DNA, 14 bp, D. melanogaster
tttctgttgtagtt

SEQ ID NO: 675884 - DNA, 13 bp, D. melanogaster
tttctgtttacac

SEQ ID NO: 675885 - DNA, 13 bp, D. melanogaster
tttctgtttatcc

SEQ ID NO: 675886 - DNA, 14 bp, D. melanogaster
tttctgtttcagtt

SEQ ID NO: 675887 - DNA, 13 bp, D. melanogaster
tttctgtttgccc

SEQ ID NO: 675888 - DNA, 13 bp, D. melanogaster
tttctgttttcga

SEQ ID NO: 675889 - DNA, 13 bp, D. melanogaster
tttctgttttgca

SEQ ID NO: 675890 - DNA, 13 bp, D. melanogaster
tttcttaaaaagt

SEQ ID NO: 675891 - DNA, 13 bp, D. melanogaster
tttcttaaaagtg

SEQ ID NO: 675892 - DNA, 13 bp, D. melanogaster
tttcttaaacaaa

SEQ ID NO: 675893 - DNA, 13 bp, D. melanogaster
tttcttaaacaat

SEQ ID NO: 675894 - DNA, 13 bp, D. melanogaster
tttcttaaactta

SEQ ID NO: 675895 - DNA, 14 bp, D. melanogaster
tttcttaaatggca

SEQ ID NO: 675896 - DNA, 13 bp, D. melanogaster
tttcttaacaaaa

SEQ ID NO: 675897 - DNA, 13 bp, D. melanogaster
tttcttaagtgaa

SEQ ID NO: 675898 - DNA, 13 bp, D. melanogaster
tttcttaagtggc

SEQ ID NO: 675899 - DNA, 13 bp, D. melanogaster
tttcttaatgtta

SEQ ID NO: 675900 - DNA, 13 bp, D. melanogaster
tttcttacaaaaa

SEQ ID NO: 675901 - DNA, 13 bp, D. melanogaster
tttcttacaataa

SEQ ID NO: 675902 - DNA, 14 bp, D. melanogaster
tttcttactaaaaa

SEQ ID NO: 675903 - DNA, 13 bp, D. melanogaster
tttcttactgtgc

SEQ ID NO: 675904 - DNA, 13 bp, D. melanogaster
tttcttagcattt

SEQ ID NO: 675905 - DNA, 13 bp, D. melanogaster
tttcttagcttaa

SEQ ID NO: 675906 - DNA, 15 bp, D. melanogaster
tttcttatcacttaa

SEQ ID NO: 675907 - DNA, 13 bp, D. melanogaster
tttcttatcgaaa

SEQ ID NO: 675908 - DNA, 13 bp, D. melanogaster
tttcttatcgcca

SEQ ID NO: 675909 - DNA, 13 bp, D. melanogaster
tttcttatgattc

SEQ ID NO: 675910 - DNA, 13 bp, D. melanogaster
tttcttattagaa

SEQ ID NO: 675911 - DNA, 13 bp, D. melanogaster
tttcttcaaatat

SEQ ID NO: 675912 - DNA, 13 bp, D. melanogaster
tttcttcaccgtc

SEQ ID NO: 675913 - DNA, 13 bp, D. melanogaster
tttcttcataaat

SEQ ID NO: 675914 - DNA, 13 bp, D. melanogaster
tttcttcatcact

SEQ ID NO: 675915 - DNA, 14 bp, D. melanogaster
tttcttcattgatt

SEQ ID NO: 675916 - DNA, 13 bp, D. melanogaster
tttcttccacttg

SEQ ID NO: 675917 - DNA, 13 bp, D. melanogaster
tttcttccagtgc

SEQ ID NO: 675918 - DNA, 14 bp, D. melanogaster
tttcttccagtgca

SEQ ID NO: 675919 - DNA, 13 bp, D. melanogaster
tttcttcctgtgc

SEQ ID NO: 675920 - DNA, 14 bp, D. melanogaster
tttcttcctgtgca

SEQ ID NO: 675921 - DNA, 13 bp, D. melanogaster
tttcttcgattct

SEQ ID NO: 675922 - DNA, 13 bp, D. melanogaster
tttcttcgccgct

SEQ ID NO: 675923 - DNA, 13 bp, D. melanogaster
tttcttcgggact

SEQ ID NO: 675924 - DNA, 13 bp, D. melanogaster
tttcttcgttatc

SEQ ID NO: 675925 - DNA, 13 bp, D. melanogaster
tttcttcttcgaa

SEQ ID NO: 675926 - DNA, 13 bp, D. melanogaster
tttcttctttgca

SEQ ID NO: 675927 - DNA, 13 bp, D. melanogaster
tttcttgaaattt

SEQ ID NO: 675928 - DNA, 13 bp, D. melanogaster
tttcttgaacttt

SEQ ID NO: 675929 - DNA, 13 bp, D. melanogaster
tttcttgaatttg

SEQ ID NO: 675930 - DNA, 13 bp, D. melanogaster
tttcttgacatta

SEQ ID NO: 675931 - DNA, 13 bp, D. melanogaster
tttcttgataaaa

SEQ ID NO: 675932 - DNA, 13 bp, D. melanogaster
tttcttgatattc

SEQ ID NO: 675933 - DNA, 13 bp, D. melanogaster
tttcttgcaattt

SEQ ID NO: 675934 - DNA, 13 bp, D. melanogaster
tttcttgcagtgc

SEQ ID NO: 675935 - DNA, 14 bp, D. melanogaster
tttcttgcagtgca

SEQ ID NO: 675936 - DNA, 13 bp, D. melanogaster
tttcttgccaatt

SEQ ID NO: 675937 - DNA, 13 bp, D. melanogaster
tttcttgccgtgc

SEQ ID NO: 675938 - DNA, 13 bp, D. melanogaster
tttcttggcaaaa

SEQ ID NO: 675939 - DNA, 13 bp, D. melanogaster
tttcttgtaaatt

SEQ ID NO: 675940 - DNA, 13 bp, D. melanogaster
tttcttgtttgca

SEQ ID NO: 675941 - DNA, 13 bp, D. melanogaster
tttctttaaacaa

SEQ ID NO: 675942 - DNA, 13 bp, D. melanogaster
tttctttaaagaa

SEQ ID NO: 675943 - DNA, 13 bp, D. melanogaster
tttctttaagaac

SEQ ID NO: 675944 - DNA, 14 bp, D. melanogaster
tttctttaagaact

SEQ ID NO: 675945 - DNA, 14 bp, D. melanogaster
tttctttaagtgta

SEQ ID NO: 675946 - DNA, 13 bp, D. melanogaster
tttctttaattag

SEQ ID NO: 675947 - DNA, 13 bp, D. melanogaster
tttctttagaatt

SEQ ID NO: 675948 - DNA, 13 bp, D. melanogaster
tttctttagcatt

SEQ ID NO: 675949 - DNA, 14 bp, D. melanogaster
tttctttcatttcg

SEQ ID NO: 675950 - DNA, 14 bp, D. melanogaster
tttctttccgtgca

SEQ ID NO: 675951 - DNA, 13 bp, D. melanogaster
tttctttcgaaat

SEQ ID NO: 675952 - DNA, 13 bp, D. melanogaster
tttctttcgctgc

SEQ ID NO: 675953 - DNA, 13 bp, D. melanogaster
tttctttcggatt

SEQ ID NO: 675954 - DNA, 13 bp, D. melanogaster
tttctttcggcca

SEQ ID NO: 675955 - DNA, 13 bp, D. melanogaster
tttctttcggtgc

SEQ ID NO: 675956 - DNA, 13 bp, D. melanogaster
tttctttctgcca

SEQ ID NO: 675957 - DNA, 13 bp, D. melanogaster
tttctttgaaaaa

SEQ ID NO: 675958 - DNA, 13 bp, D. melanogaster
tttctttgaaaat

SEQ ID NO: 675959 - DNA, 13 bp, D. melanogaster
tttctttgaagaa

SEQ ID NO: 675960 - DNA, 13 bp, D. melanogaster
tttctttgacatt

SEQ ID NO: 675961 - DNA, 13 bp, D. melanogaster
tttctttgccaaa

SEQ ID NO: 675962 - DNA, 13 bp, D. melanogaster
tttctttgccaca

SEQ ID NO: 675963 - DNA, 13 bp, D. melanogaster
tttctttgccata

SEQ ID NO: 675964 - DNA, 13 bp, D. melanogaster
tttctttgcctgc

SEQ ID NO: 675965 - DNA, 13 bp, D. melanogaster
tttctttgctgga

SEQ ID NO: 675966 - DNA, 13 bp, D. melanogaster
tttctttgctggc

SEQ ID NO: 675967 - DNA, 13 bp, D. melanogaster
tttctttggcatt

SEQ ID NO: 675968 - DNA, 13 bp, D. melanogaster
tttctttggccac

SEQ ID NO: 675969 - DNA, 13 bp, D. melanogaster
tttctttggtgat

SEQ ID NO: 675970 - DNA, 13 bp, D. melanogaster
tttcttttatggc

SEQ ID NO: 675971 - DNA, 13 bp, D. melanogaster
tttcttttcaatg

SEQ ID NO: 675972 - DNA, 13 bp, D. melanogaster
tttcttttcagca

SEQ ID NO: 675973 - DNA, 13 bp, D. melanogaster
tttcttttcagtg

SEQ ID NO: 675974 - DNA, 13 bp, D. melanogaster
tttcttttccaaa

SEQ ID NO: 675975 - DNA, 13 bp, D. melanogaster
tttcttttcgaaa

SEQ ID NO: 675976 - DNA, 13 bp, D. melanogaster
tttcttttcgcaa

SEQ ID NO: 675977 - DNA, 13 bp, D. melanogaster
tttcttttcgcca

SEQ ID NO: 675978 - DNA, 13 bp, D. melanogaster
tttcttttctaag

SEQ ID NO: 675979 - DNA, 13 bp, D. melanogaster
tttcttttgaaaa

SEQ ID NO: 675980 - DNA, 13 bp, D. melanogaster
tttcttttgaaac

SEQ ID NO: 675981 - DNA, 13 bp, D. melanogaster
tttcttttgaaat

SEQ ID NO: 675982 - DNA, 13 bp, D. melanogaster
tttcttttgcact

SEQ ID NO: 675983 - DNA, 13 bp, D. melanogaster
tttcttttgccat

SEQ ID NO: 675984 - DNA, 13 bp, D. melanogaster
tttcttttgccgc

SEQ ID NO: 675985 - DNA, 13 bp, D. melanogaster
tttcttttggaaa

SEQ ID NO: 675986 - DNA, 14 bp, D. melanogaster
tttcttttggccaa

SEQ ID NO: 675987 - DNA, 13 bp, D. melanogaster
tttctttttcgca

SEQ ID NO: 675988 - DNA, 13 bp, D. melanogaster
tttctttttgcaa

SEQ ID NO: 675989 - DNA, 13 bp, D. melanogaster
tttctttttggaa

SEQ ID NO: 675990 - DNA, 14 bp, D. melanogaster
tttctttttggcca

SEQ ID NO: 675991 - DNA, 13 bp, D. melanogaster
tttgaaaaaacaa

SEQ ID NO: 675992 - DNA, 14 bp, D. melanogaster
tttgaaaaaagaca

SEQ ID NO: 675993 - DNA, 13 bp, D. melanogaster
tttgaaaaaagga

SEQ ID NO: 675994 - DNA, 13 bp, D. melanogaster
tttgaaaaaagtg

SEQ ID NO: 675995 - DNA, 13 bp, D. melanogaster
tttgaaaaaatct

SEQ ID NO: 675996 - DNA, 13 bp, D. melanogaster
tttgaaaaacaaa

SEQ ID NO: 675997 - DNA, 13 bp, D. melanogaster
tttgaaaaacaca

SEQ ID NO: 675998 - DNA, 13 bp, D. melanogaster
tttgaaaaaccca

SEQ ID NO: 675999 - DNA, 13 bp, D. melanogaster
tttgaaaaactga

SEQ ID NO: 676000 - DNA, 13 bp, D. melanogaster
tttgaaaaagaat

SEQ ID NO: 676001 - DNA, 13 bp, D. melanogaster
tttgaaaaagatt

SEQ ID NO: 676002 - DNA, 13 bp, D. melanogaster
tttgaaaaagtgt

SEQ ID NO: 676003 - DNA, 13 bp, D. melanogaster
tttgaaaaagttg

SEQ ID NO: 676004 - DNA, 13 bp, D. melanogaster
tttgaaaaataac

SEQ ID NO: 676005 - DNA, 14 bp, D. melanogaster
tttgaaaaatgatt

SEQ ID NO: 676006 - DNA, 13 bp, D. melanogaster
tttgaaaaatgcc

SEQ ID NO: 676007 - DNA, 13 bp, D. melanogaster
tttgaaaaatgtg

SEQ ID NO: 676008 - DNA, 14 bp, D. melanogaster
tttgaaaaatgtgg

SEQ ID NO: 676009 - DNA, 13 bp, D. melanogaster
tttgaaaaatgtt

SEQ ID NO: 676010 - DNA, 14 bp, D. melanogaster
tttgaaaaatgttt

SEQ ID NO: 676011 - DNA, 13 bp, D. melanogaster
tttgaaaaattgt

SEQ ID NO: 676012 - DNA, 14 bp, D. melanogaster
tttgaaaaattgtt

SEQ ID NO: 676013 - DNA, 14 bp, D. melanogaster
tttgaaaacaaaaa

SEQ ID NO: 676014 - DNA, 14 bp, D. melanogaster
tttgaaaacaaaat

SEQ ID NO: 676015 - DNA, 13 bp, D. melanogaster
tttgaaaacaaac

SEQ ID NO: 676016 - DNA, 14 bp, D. melanogaster
tttgaaaacaattt

SEQ ID NO: 676017 - DNA, 13 bp, D. melanogaster
tttgaaaacacaa

SEQ ID NO: 676018 - DNA, 14 bp, D. melanogaster
tttgaaaacacaat

SEQ ID NO: 676019 - DNA, 13 bp, D. melanogaster
tttgaaaacacta

SEQ ID NO: 676020 - DNA, 13 bp, D. melanogaster
tttgaaaacattc

SEQ ID NO: 676021 - DNA, 14 bp, D. melanogaster
tttgaaaacatttt

SEQ ID NO: 676022 - DNA, 13 bp, D. melanogaster
tttgaaaaccaac

SEQ ID NO: 676023 - DNA, 13 bp, D. melanogaster
tttgaaaacgatt

SEQ ID NO: 676024 - DNA, 13 bp, D. melanogaster
tttgaaaactata

SEQ ID NO: 676025 - DNA, 14 bp, D. melanogaster
tttgaaaactattt

SEQ ID NO: 676026 - DNA, 13 bp, D. melanogaster
tttgaaaacttta

SEQ ID NO: 676027 - DNA, 14 bp, D. melanogaster
tttgaaaagaaaac

SEQ ID NO: 676028 - DNA, 13 bp, D. melanogaster
tttgaaaagaaat

SEQ ID NO: 676029 - DNA, 13 bp, D. melanogaster
tttgaaaagattt

SEQ ID NO: 676030 - DNA, 14 bp, D. melanogaster
tttgaaaagatttt

SEQ ID NO: 676031 - DNA, 13 bp, D. melanogaster
tttgaaaagcaaa

SEQ ID NO: 676032 - DNA, 14 bp, D. melanogaster
tttgaaaagcaatt

SEQ ID NO: 676033 - DNA, 13 bp, D. melanogaster
tttgaaaagcatt

SEQ ID NO: 676034 - DNA, 13 bp, D. melanogaster
tttgaaaaggatt

SEQ ID NO: 676035 - DNA, 13 bp, D. melanogaster
tttgaaaagtaat

SEQ ID NO: 676036 - DNA, 14 bp, D. melanogaster
tttgaaaagtatgt

SEQ ID NO: 676037 - DNA, 14 bp, D. melanogaster
tttgaaaagtattt

SEQ ID NO: 676038 - DNA, 13 bp, D. melanogaster
tttgaaaagttat

SEQ ID NO: 676039 - DNA, 13 bp, D. melanogaster
tttgaaaagtttt

SEQ ID NO: 676040 - DNA, 14 bp, D. melanogaster
tttgaaaagtttta

SEQ ID NO: 676041 - DNA, 13 bp, D. melanogaster
tttgaaaatacaa

SEQ ID NO: 676042 - DNA, 13 bp, D. melanogaster
tttgaaaatactt

SEQ ID NO: 676043 - DNA, 14 bp, D. melanogaster
tttgaaaatacttt

SEQ ID NO: 676044 - DNA, 13 bp, D. melanogaster
tttgaaaatagtt

SEQ ID NO: 676045 - DNA, 14 bp, D. melanogaster
tttgaaaatagttt

SEQ ID NO: 676046 - DNA, 13 bp, D. melanogaster
tttgaaaatatga

SEQ ID NO: 676047 - DNA, 13 bp, D. melanogaster
tttgaaaatattg

SEQ ID NO: 676048 - DNA, 13 bp, D. melanogaster
tttgaaaatcgat

SEQ ID NO: 676049 - DNA, 14 bp, D. melanogaster
tttgaaaatgattt

SEQ ID NO: 676050 - DNA, 13 bp, D. melanogaster
tttgaaaatgcaa

SEQ ID NO: 676051 - DNA, 13 bp, D. melanogaster
tttgaaaatggat

SEQ ID NO: 676052 - DNA, 13 bp, D. melanogaster
tttgaaaatgttt

SEQ ID NO: 676053 - DNA, 13 bp, D. melanogaster
tttgaaaattgat

SEQ ID NO: 676054 - DNA, 13 bp, D. melanogaster
tttgaaaattgtg

SEQ ID NO: 676055 - DNA, 14 bp, D. melanogaster
tttgaaaattttga

SEQ ID NO: 676056 - DNA, 13 bp, D. melanogaster
tttgaaacaaatt

SEQ ID NO: 676057 - DNA, 13 bp, D. melanogaster
tttgaaacaataa

SEQ ID NO: 676058 - DNA, 13 bp, D. melanogaster
tttgaaacaattt

SEQ ID NO: 676059 - DNA, 13 bp, D. melanogaster
tttgaaacacttt

SEQ ID NO: 676060 - DNA, 14 bp, D. melanogaster
tttgaaacactttt

SEQ ID NO: 676061 - DNA, 14 bp, D. melanogaster
tttgaaacatattt

SEQ ID NO: 676062 - DNA, 13 bp, D. melanogaster
tttgaaacccaaa

SEQ ID NO: 676063 - DNA, 13 bp, D. melanogaster
tttgaaactaata

SEQ ID NO: 676064 - DNA, 13 bp, D. melanogaster
tttgaaactaatt

SEQ ID NO: 676065 - DNA, 13 bp, D. melanogaster
tttgaaactattt

SEQ ID NO: 676066 - DNA, 13 bp, D. melanogaster
tttgaaagaaatg

SEQ ID NO: 676067 - DNA, 13 bp, D. melanogaster
tttgaaagaattg

SEQ ID NO: 676068 - DNA, 13 bp, D. melanogaster
tttgaaagagaaa

SEQ ID NO: 676069 - DNA, 13 bp, D. melanogaster
tttgaaagatttt

SEQ ID NO: 676070 - DNA, 13 bp, D. melanogaster
tttgaaagcaatt

SEQ ID NO: 676071 - DNA, 13 bp, D. melanogaster
tttgaaagccaaa

SEQ ID NO: 676072 - DNA, 13 bp, D. melanogaster
tttgaaaggaaaa

SEQ ID NO: 676073 - DNA, 13 bp, D. melanogaster
tttgaaaggatat

SEQ ID NO: 676074 - DNA, 13 bp, D. melanogaster
tttgaaaggattt

SEQ ID NO: 676075 - DNA, 13 bp, D. melanogaster
tttgaaagtattt

SEQ ID NO: 676076 - DNA, 13 bp, D. melanogaster
tttgaaagtgaaa

SEQ ID NO: 676077 - DNA, 13 bp, D. melanogaster
tttgaaagtgaat

SEQ ID NO: 676078 - DNA, 13 bp, D. melanogaster
tttgaaagttttg

SEQ ID NO: 676079 - DNA, 13 bp, D. melanogaster
tttgaaatacata

SEQ ID NO: 676080 - DNA, 13 bp, D. melanogaster
tttgaaatacatt

SEQ ID NO: 676081 - DNA, 13 bp, D. melanogaster
tttgaaatactct

SEQ ID NO: 676082 - DNA, 13 bp, D. melanogaster
tttgaaatacttt

SEQ ID NO: 676083 - DNA, 13 bp, D. melanogaster
tttgaaatataca

SEQ ID NO: 676084 - DNA, 13 bp, D. melanogaster
tttgaaatatgct

SEQ ID NO: 676085 - DNA, 13 bp, D. melanogaster
tttgaaatatttc

SEQ ID NO: 676086 - DNA, 14 bp, D. melanogaster
tttgaaatcaattt

SEQ ID NO: 676087 - DNA, 13 bp, D. melanogaster
tttgaaatcattt

SEQ ID NO: 676088 - DNA, 13 bp, D. melanogaster
tttgaaatccatt

SEQ ID NO: 676089 - DNA, 13 bp, D. melanogaster
tttgaaatcgaaa

SEQ ID NO: 676090 - DNA, 13 bp, D. melanogaster
tttgaaatgaaaa

SEQ ID NO: 676091 - DNA, 13 bp, D. melanogaster
tttgaaatgatat

SEQ ID NO: 676092 - DNA, 13 bp, D. melanogaster
tttgaaatgatta

SEQ ID NO: 676093 - DNA, 13 bp, D. melanogaster
tttgaaatgattt

SEQ ID NO: 676094 - DNA, 13 bp, D. melanogaster
tttgaaatgcaaa

SEQ ID NO: 676095 - DNA, 14 bp, D. melanogaster
tttgaaatgcaaat

SEQ ID NO: 676096 - DNA, 13 bp, D. melanogaster
tttgaaatgcgat

SEQ ID NO: 676097 - DNA, 13 bp, D. melanogaster
tttgaaatgcgtt

SEQ ID NO: 676098 - DNA, 13 bp, D. melanogaster
tttgaaatggaaa

SEQ ID NO: 676099 - DNA, 13 bp, D. melanogaster
tttgaaatggaat

SEQ ID NO: 676100 - DNA, 13 bp, D. melanogaster
tttgaaatgtaat

SEQ ID NO: 676101 - DNA, 13 bp, D. melanogaster
tttgaaatgtata

SEQ ID NO: 676102 - DNA, 13 bp, D. melanogaster
tttgaaatgtgtt

SEQ ID NO: 676103 - DNA, 13 bp, D. melanogaster
tttgaaattaaag

SEQ ID NO: 676104 - DNA, 13 bp, D. melanogaster
tttgaaattaatg

SEQ ID NO: 676105 - DNA, 13 bp, D. melanogaster
tttgaaattagtt

SEQ ID NO: 676106 - DNA, 13 bp, D. melanogaster
tttgaaattcact

SEQ ID NO: 676107 - DNA, 13 bp, D. melanogaster
tttgaaattcatt

SEQ ID NO: 676108 - DNA, 13 bp, D. melanogaster
tttgaaattctaa

SEQ ID NO: 676109 - DNA, 13 bp, D. melanogaster
tttgaaattctat

SEQ ID NO: 676110 - DNA, 13 bp, D. melanogaster
tttgaaattgaat

SEQ ID NO: 676111 - DNA, 13 bp, D. melanogaster
tttgaaattgatt

SEQ ID NO: 676112 - DNA, 13 bp, D. melanogaster
tttgaaattgtaa

SEQ ID NO: 676113 - DNA, 13 bp, D. melanogaster
tttgaaattgtat

SEQ ID NO: 676114 - DNA, 13 bp, D. melanogaster
tttgaaatttatg

SEQ ID NO: 676115 - DNA, 14 bp, D. melanogaster
tttgaaatttccaa

SEQ ID NO: 676116 - DNA, 13 bp, D. melanogaster
tttgaaatttctt

SEQ ID NO: 676117 - DNA, 13 bp, D. melanogaster
tttgaaatttgaa

SEQ ID NO: 676118 - DNA, 14 bp, D. melanogaster
tttgaaatttgaaa

SEQ ID NO: 676119 - DNA, 13 bp, D. melanogaster
tttgaacaaaaaa

SEQ ID NO: 676120 - DNA, 13 bp, D. melanogaster
tttgaacaacaaa

SEQ ID NO: 676121 - DNA, 14 bp, D. melanogaster
tttgaacaacaata

SEQ ID NO: 676122 - DNA, 13 bp, D. melanogaster
tttgaacaagttt

SEQ ID NO: 676123 - DNA, 13 bp, D. melanogaster
tttgaacaataaa

SEQ ID NO: 676124 - DNA, 13 bp, D. melanogaster
tttgaacaattaa

SEQ ID NO: 676125 - DNA, 13 bp, D. melanogaster
tttgaacaatttt

SEQ ID NO: 676126 - DNA, 14 bp, D. melanogaster
tttgaacaattttt

SEQ ID NO: 676127 - DNA, 13 bp, D. melanogaster
tttgaacacattt

SEQ ID NO: 676128 - DNA, 13 bp, D. melanogaster
tttgaacactttt

SEQ ID NO: 676129 - DNA, 13 bp, D. melanogaster
tttgaacagttgt

SEQ ID NO: 676130 - DNA, 13 bp, D. melanogaster
tttgaacataaaa

SEQ ID NO: 676131 - DNA, 13 bp, D. melanogaster
tttgaacatattt

SEQ ID NO: 676132 - DNA, 13 bp, D. melanogaster
tttgaacatcatt

SEQ ID NO: 676133 - DNA, 14 bp, D. melanogaster
tttgaacattaaaa

SEQ ID NO: 676134 - DNA, 13 bp, D. melanogaster
tttgaacatttaa

SEQ ID NO: 676135 - DNA, 14 bp, D. melanogaster
tttgaacatttaac

SEQ ID NO: 676136 - DNA, 13 bp, D. melanogaster
tttgaacatttgt

SEQ ID NO: 676137 - DNA, 13 bp, D. melanogaster
tttgaaccatttt

SEQ ID NO: 676138 - DNA, 13 bp, D. melanogaster
tttgaaccgtttc

SEQ ID NO: 676139 - DNA, 14 bp, D. melanogaster
tttgaacggagaaa

SEQ ID NO: 676140 - DNA, 13 bp, D. melanogaster
tttgaactcagtt

SEQ ID NO: 676141 - DNA, 14 bp, D. melanogaster
tttgaactcagttg

SEQ ID NO: 676142 - DNA, 13 bp, D. melanogaster
tttgaactccaga

SEQ ID NO: 676143 - DNA, 13 bp, D. melanogaster
tttgaactgattt

SEQ ID NO: 676144 - DNA, 13 bp, D. melanogaster
tttgaacttaaat

SEQ ID NO: 676145 - DNA, 13 bp, D. melanogaster
tttgaacttgaaa

SEQ ID NO: 676146 - DNA, 13 bp, D. melanogaster
tttgaacttgaac

SEQ ID NO: 676147 - DNA, 13 bp, D. melanogaster
tttgaacttggca

SEQ ID NO: 676148 - DNA, 13 bp, D. melanogaster
tttgaacttgttt

SEQ ID NO: 676149 - DNA, 13 bp, D. melanogaster
tttgaactttatt

SEQ ID NO: 676150 - DNA, 13 bp, D. melanogaster
tttgaactttcaa

SEQ ID NO: 676151 - DNA, 13 bp, D. melanogaster
tttgaactttggc

SEQ ID NO: 676152 - DNA, 13 bp, D. melanogaster
tttgaactttttc

SEQ ID NO: 676153 - DNA, 14 bp, D. melanogaster
tttgaacttttttc

SEQ ID NO: 676154 - DNA, 13 bp, D. melanogaster
tttgaagaaaata

SEQ ID NO: 676155 - DNA, 13 bp, D. melanogaster
tttgaagaaaatt

SEQ ID NO: 676156 - DNA, 13 bp, D. melanogaster
tttgaagaaatat

SEQ ID NO: 676157 - DNA, 13 bp, D. melanogaster
tttgaagaattta

SEQ ID NO: 676158 - DNA, 13 bp, D. melanogaster
tttgaagatttta

SEQ ID NO: 676159 - DNA, 13 bp, D. melanogaster
tttgaagattttg

SEQ ID NO: 676160 - DNA, 13 bp, D. melanogaster
tttgaagcgcttg

SEQ ID NO: 676161 - DNA, 13 bp, D. melanogaster
tttgaagctcatt

SEQ ID NO: 676162 - DNA, 13 bp, D. melanogaster
tttgaagcttttc

SEQ ID NO: 676163 - DNA, 13 bp, D. melanogaster
tttgaaggatttt

SEQ ID NO: 676164 - DNA, 13 bp, D. melanogaster
tttgaagggacag

SEQ ID NO: 676165 - DNA, 13 bp, D. melanogaster
tttgaagtaaaat

SEQ ID NO: 676166 - DNA, 13 bp, D. melanogaster
tttgaagtattat

SEQ ID NO: 676167 - DNA, 13 bp, D. melanogaster
tttgaagtatttg

SEQ ID NO: 676168 - DNA, 13 bp, D. melanogaster
tttgaagtgaaat

SEQ ID NO: 676169 - DNA, 13 bp, D. melanogaster
tttgaagtggttt

SEQ ID NO: 676170 - DNA, 13 bp, D. melanogaster
tttgaagttgagt

SEQ ID NO: 676171 - DNA, 13 bp, D. melanogaster
tttgaagtttaaa

SEQ ID NO: 676172 - DNA, 13 bp, D. melanogaster
tttgaagtttgaa

SEQ ID NO: 676173 - DNA, 13 bp, D. melanogaster
tttgaagttttca

SEQ ID NO: 676174 - DNA, 13 bp, D. melanogaster
tttgaagttttct

SEQ ID NO: 676175 - DNA, 13 bp, D. melanogaster
tttgaagtttttc

SEQ ID NO: 676176 - DNA, 13 bp, D. melanogaster
tttgaataaaaac

SEQ ID NO: 676177 - DNA, 13 bp, D. melanogaster
tttgaataaaaag

SEQ ID NO: 676178 - DNA, 13 bp, D. melanogaster
tttgaataaaatg

SEQ ID NO: 676179 - DNA, 13 bp, D. melanogaster
tttgaataatgaa

SEQ ID NO: 676180 - DNA, 13 bp, D. melanogaster
tttgaataattga

SEQ ID NO: 676181 - DNA, 14 bp, D. melanogaster
tttgaataattgaa

SEQ ID NO: 676182 - DNA, 13 bp, D. melanogaster
tttgaatacaatt

SEQ ID NO: 676183 - DNA, 13 bp, D. melanogaster
tttgaatacattt

SEQ ID NO: 676184 - DNA, 13 bp, D. melanogaster
tttgaataccatt

SEQ ID NO: 676185 - DNA, 13 bp, D. melanogaster
tttgaataccctt

SEQ ID NO: 676186 - DNA, 13 bp, D. melanogaster
tttgaatacgaaa

SEQ ID NO: 676187 - DNA, 13 bp, D. melanogaster
tttgaatactctt

SEQ ID NO: 676188 - DNA, 13 bp, D. melanogaster
tttgaatacttaa

SEQ ID NO: 676189 - DNA, 13 bp, D. melanogaster
tttgaatactttg

SEQ ID NO: 676190 - DNA, 13 bp, D. melanogaster
tttgaatactttt

SEQ ID NO: 676191 - DNA, 13 bp, D. melanogaster
tttgaatatacat

SEQ ID NO: 676192 - DNA, 13 bp, D. melanogaster
tttgaatatcgcg

SEQ ID NO: 676193 - DNA, 13 bp, D. melanogaster
tttgaatatgaaa

SEQ ID NO: 676194 - DNA, 14 bp, D. melanogaster
tttgaatatgaaat

SEQ ID NO: 676195 - DNA, 13 bp, D. melanogaster
tttgaatattaag

SEQ ID NO: 676196 - DNA, 14 bp, D. melanogaster
tttgaatattcaaa

SEQ ID NO: 676197 - DNA, 13 bp, D. melanogaster
tttgaatattcat

SEQ ID NO: 676198 - DNA, 13 bp, D. melanogaster
tttgaatatttca

SEQ ID NO: 676199 - DNA, 13 bp, D. melanogaster
tttgaatcaaatt

SEQ ID NO: 676200 - DNA, 13 bp, D. melanogaster
tttgaatcctttt

SEQ ID NO: 676201 - DNA, 13 bp, D. melanogaster
tttgaatcgaatt

SEQ ID NO: 676202 - DNA, 13 bp, D. melanogaster
tttgaatctgttt

SEQ ID NO: 676203 - DNA, 13 bp, D. melanogaster
tttgaatgaagac

SEQ ID NO: 676204 - DNA, 13 bp, D. melanogaster
tttgaatgaattc

SEQ ID NO: 676205 - DNA, 13 bp, D. melanogaster
tttgaatgagttt

SEQ ID NO: 676206 - DNA, 13 bp, D. melanogaster
tttgaatgcaaat

SEQ ID NO: 676207 - DNA, 13 bp, D. melanogaster
tttgaatgcaatg

SEQ ID NO: 676208 - DNA, 13 bp, D. melanogaster
tttgaatgccaat

SEQ ID NO: 676209 - DNA, 13 bp, D. melanogaster
tttgaatgccatt

SEQ ID NO: 676210 - DNA, 13 bp, D. melanogaster
tttgaatgcgaat

SEQ ID NO: 676211 - DNA, 13 bp, D. melanogaster
tttgaatgctttt

SEQ ID NO: 676212 - DNA, 13 bp, D. melanogaster
tttgaatggaatt

SEQ ID NO: 676213 - DNA, 13 bp, D. melanogaster
tttgaatggcatt

SEQ ID NO: 676214 - DNA, 13 bp, D. melanogaster
tttgaatgtgaat

SEQ ID NO: 676215 - DNA, 13 bp, D. melanogaster
tttgaatgtgcaa

SEQ ID NO: 676216 - DNA, 13 bp, D. melanogaster
tttgaatgtttga

SEQ ID NO: 676217 - DNA, 14 bp, D. melanogaster
tttgaattaaagat

SEQ ID NO: 676218 - DNA, 13 bp, D. melanogaster
tttgaattaagat

SEQ ID NO: 676219 - DNA, 13 bp, D. melanogaster
tttgaattcaaaa

SEQ ID NO: 676220 - DNA, 13 bp, D. melanogaster
tttgaattcaatt

SEQ ID NO: 676221 - DNA, 13 bp, D. melanogaster
tttgaattcattt

SEQ ID NO: 676222 - DNA, 14 bp, D. melanogaster
tttgaattcatttt

SEQ ID NO: 676223 - DNA, 13 bp, D. melanogaster
tttgaattccaat

SEQ ID NO: 676224 - DNA, 13 bp, D. melanogaster
tttgaattccatt

SEQ ID NO: 676225 - DNA, 13 bp, D. melanogaster
tttgaattcgaaa

SEQ ID NO: 676226 - DNA, 14 bp, D. melanogaster
tttgaattcgattt

SEQ ID NO: 676227 - DNA, 13 bp, D. melanogaster
tttgaattcgcag

SEQ ID NO: 676228 - DNA, 13 bp, D. melanogaster
tttgaattcggtt

SEQ ID NO: 676229 - DNA, 13 bp, D. melanogaster
tttgaattcgttt

SEQ ID NO: 676230 - DNA, 13 bp, D. melanogaster
tttgaattgaaag

SEQ ID NO: 676231 - DNA, 13 bp, D. melanogaster
tttgaattgaata

SEQ ID NO: 676232 - DNA, 13 bp, D. melanogaster
tttgaattgagtt

SEQ ID NO: 676233 - DNA, 13 bp, D. melanogaster
tttgaattgatta

SEQ ID NO: 676234 - DNA, 13 bp, D. melanogaster
tttgaattgattg

SEQ ID NO: 676235 - DNA, 14 bp, D. melanogaster
tttgaattgcaaat

SEQ ID NO: 676236 - DNA, 13 bp, D. melanogaster
tttgaattgggtt

SEQ ID NO: 676237 - DNA, 13 bp, D. melanogaster
tttgaatttaaac

SEQ ID NO: 676238 - DNA, 13 bp, D. melanogaster
tttgaatttcaaa

SEQ ID NO: 676239 - DNA, 14 bp, D. melanogaster
tttgaatttcaaaa

SEQ ID NO: 676240 - DNA, 14 bp, D. melanogaster
tttgaatttcacaa

SEQ ID NO: 676241 - DNA, 13 bp, D. melanogaster
tttgaatttccct

SEQ ID NO: 676242 - DNA, 13 bp, D. melanogaster
tttgaatttcgaa

SEQ ID NO: 676243 - DNA, 13 bp, D. melanogaster
tttgaatttcttc

SEQ ID NO: 676244 - DNA, 14 bp, D. melanogaster
tttgaatttgaaaa

SEQ ID NO: 676245 - DNA, 14 bp, D. melanogaster
tttgaatttgaaat

SEQ ID NO: 676246 - DNA, 13 bp, D. melanogaster
tttgaatttgaac

SEQ ID NO: 676247 - DNA, 14 bp, D. melanogaster
tttgaatttgaata

SEQ ID NO: 676248 - DNA, 13 bp, D. melanogaster
tttgaatttgact

SEQ ID NO: 676249 - DNA, 13 bp, D. melanogaster
tttgaatttgcat

SEQ ID NO: 676250 - DNA, 13 bp, D. melanogaster
tttgaatttggcg

SEQ ID NO: 676251 - DNA, 13 bp, D. melanogaster
tttgaatttggct

SEQ ID NO: 676252 - DNA, 13 bp, D. melanogaster
tttgaattttaca

SEQ ID NO: 676253 - DNA, 14 bp, D. melanogaster
tttgaattttcaat

SEQ ID NO: 676254 - DNA, 13 bp, D. melanogaster
tttgaattttgaa

SEQ ID NO: 676255 - DNA, 13 bp, D. melanogaster
tttgaattttgct

SEQ ID NO: 676256 - DNA, 13 bp, D. melanogaster
tttgaatttttac

SEQ ID NO: 676257 - DNA, 13 bp, D. melanogaster
tttgaatttttgc

SEQ ID NO: 676258 - DNA, 13 bp, D. melanogaster
tttgacaaaaact

SEQ ID NO: 676259 - DNA, 13 bp, D. melanogaster
tttgacaaaaatt

SEQ ID NO: 676260 - DNA, 13 bp, D. melanogaster
tttgacaaacaaa

SEQ ID NO: 676261 - DNA, 13 bp, D. melanogaster
tttgacaaacaca

SEQ ID NO: 676262 - DNA, 13 bp, D. melanogaster
tttgacaaacttt

SEQ ID NO: 676263 - DNA, 13 bp, D. melanogaster
tttgacaaataaa

SEQ ID NO: 676264 - DNA, 13 bp, D. melanogaster
tttgacaagaaaa

SEQ ID NO: 676265 - DNA, 13 bp, D. melanogaster
tttgacaagtatt

SEQ ID NO: 676266 - DNA, 13 bp, D. melanogaster
tttgacaataaaa

SEQ ID NO: 676267 - DNA, 13 bp, D. melanogaster
tttgacaattatt

SEQ ID NO: 676268 - DNA, 13 bp, D. melanogaster
tttgacaattttg

SEQ ID NO: 676269 - DNA, 13 bp, D. melanogaster
tttgacacacaaa

SEQ ID NO: 676270 - DNA, 13 bp, D. melanogaster
tttgacacatttc

SEQ ID NO: 676271 - DNA, 13 bp, D. melanogaster
tttgacagccaaa

SEQ ID NO: 676272 - DNA, 13 bp, D. melanogaster
tttgacagctgct

SEQ ID NO: 676273 - DNA, 13 bp, D. melanogaster
tttgacagttttt

SEQ ID NO: 676274 - DNA, 13 bp, D. melanogaster
tttgacataaatt

SEQ ID NO: 676275 - DNA, 13 bp, D. melanogaster
tttgacatatttt

SEQ ID NO: 676276 - DNA, 13 bp, D. melanogaster
tttgacattatta

SEQ ID NO: 676277 - DNA, 14 bp, D. melanogaster
tttgacattcatct

SEQ ID NO: 676278 - DNA, 13 bp, D. melanogaster
tttgacattggcg

SEQ ID NO: 676279 - DNA, 13 bp, D. melanogaster
tttgacatttatc

SEQ ID NO: 676280 - DNA, 13 bp, D. melanogaster
tttgacatttatg

SEQ ID NO: 676281 - DNA, 13 bp, D. melanogaster
tttgacatttgtg

SEQ ID NO: 676282 - DNA, 13 bp, D. melanogaster
tttgacattttca

SEQ ID NO: 676283 - DNA, 13 bp, D. melanogaster
tttgacattttcc

SEQ ID NO: 676284 - DNA, 13 bp, D. melanogaster
tttgacattttgc

SEQ ID NO: 676285 - DNA, 13 bp, D. melanogaster
tttgacattttta

SEQ ID NO: 676286 - DNA, 14 bp, D. melanogaster
tttgacatttttat

SEQ ID NO: 676287 - DNA, 13 bp, D. melanogaster
tttgaccaaatat

SEQ ID NO: 676288 - DNA, 13 bp, D. melanogaster
tttgaccaagtta

SEQ ID NO: 676289 - DNA, 13 bp, D. melanogaster
tttgaccaagttt

SEQ ID NO: 676290 - DNA, 13 bp, D. melanogaster
tttgaccaatttg

SEQ ID NO: 676291 - DNA, 13 bp, D. melanogaster
tttgaccaatttt

SEQ ID NO: 676292 - DNA, 13 bp, D. melanogaster
tttgacctagaaa

SEQ ID NO: 676293 - DNA, 13 bp, D. melanogaster
tttgacctggttg

SEQ ID NO: 676294 - DNA, 13 bp, D. melanogaster
tttgactaattga

SEQ ID NO: 676295 - DNA, 13 bp, D. melanogaster
tttgactaattta

SEQ ID NO: 676296 - DNA, 13 bp, D. melanogaster
tttgactactttt

SEQ ID NO: 676297 - DNA, 14 bp, D. melanogaster
tttgactgcatact

SEQ ID NO: 676298 - DNA, 13 bp, D. melanogaster
tttgactgcattt

SEQ ID NO: 676299 - DNA, 13 bp, D. melanogaster
tttgactgggttc

SEQ ID NO: 676300 - DNA, 13 bp, D. melanogaster
tttgacttcatta

SEQ ID NO: 676301 - DNA, 13 bp, D. melanogaster
tttgacttctgga

SEQ ID NO: 676302 - DNA, 13 bp, D. melanogaster
tttgacttgaatt

SEQ ID NO: 676303 - DNA, 13 bp, D. melanogaster
tttgactttaaat

SEQ ID NO: 676304 - DNA, 13 bp, D. melanogaster
tttgactttcaat

SEQ ID NO: 676305 - DNA, 13 bp, D. melanogaster
tttgactttgaaa

SEQ ID NO: 676306 - DNA, 13 bp, D. melanogaster
tttgactttgaca

SEQ ID NO: 676307 - DNA, 13 bp, D. melanogaster
tttgactttgact

SEQ ID NO: 676308 - DNA, 13 bp, D. melanogaster
tttgactttgagt

SEQ ID NO: 676309 - DNA, 13 bp, D. melanogaster
tttgactttggct

SEQ ID NO: 676310 - DNA, 13 bp, D. melanogaster
tttgacttttact

SEQ ID NO: 676311 - DNA, 13 bp, D. melanogaster
tttgacttttata

SEQ ID NO: 676312 - DNA, 13 bp, D. melanogaster
tttgacttttcaa

SEQ ID NO: 676313 - DNA, 13 bp, D. melanogaster
tttgacttttgca

SEQ ID NO: 676314 - DNA, 13 bp, D. melanogaster
tttgagaaaaaat

SEQ ID NO: 676315 - DNA, 13 bp, D. melanogaster
tttgagaaaaatg

SEQ ID NO: 676316 - DNA, 13 bp, D. melanogaster
tttgagaaatttc

SEQ ID NO: 676317 - DNA, 13 bp, D. melanogaster
tttgagaactttg

SEQ ID NO: 676318 - DNA, 13 bp, D. melanogaster
tttgagaatattt

SEQ ID NO: 676319 - DNA, 13 bp, D. melanogaster
tttgagagccact

SEQ ID NO: 676320 - DNA, 14 bp, D. melanogaster
tttgagatactttt

SEQ ID NO: 676321 - DNA, 13 bp, D. melanogaster
tttgagcaaagac

SEQ ID NO: 676322 - DNA, 13 bp, D. melanogaster
tttgagcaatcaa

SEQ ID NO: 676323 - DNA, 13 bp, D. melanogaster
tttgagcaatgca

SEQ ID NO: 676324 - DNA, 13 bp, D. melanogaster
tttgagcacattt

SEQ ID NO: 676325 - DNA, 13 bp, D. melanogaster
tttgagcactttc

SEQ ID NO: 676326 - DNA, 13 bp, D. melanogaster
tttgagcagaaaa

SEQ ID NO: 676327 - DNA, 13 bp, D. melanogaster
tttgagcagcaaa

SEQ ID NO: 676328 - DNA, 13 bp, D. melanogaster
tttgagcagtttt

SEQ ID NO: 676329 - DNA, 13 bp, D. melanogaster
tttgagcattttt

SEQ ID NO: 676330 - DNA, 13 bp, D. melanogaster
tttgagccaagtt

SEQ ID NO: 676331 - DNA, 13 bp, D. melanogaster
tttgagctacgtg

SEQ ID NO: 676332 - DNA, 13 bp, D. melanogaster
tttgaggaatttt

SEQ ID NO: 676333 - DNA, 13 bp, D. melanogaster
tttgaggagccaa

SEQ ID NO: 676334 - DNA, 13 bp, D. melanogaster
tttgaggcatttt

SEQ ID NO: 676335 - DNA, 13 bp, D. melanogaster
tttgaggcccaaa

SEQ ID NO: 676336 - DNA, 13 bp, D. melanogaster
tttgaggttatgt

SEQ ID NO: 676337 - DNA, 13 bp, D. melanogaster
tttgaggttccca

SEQ ID NO: 676338 - DNA, 13 bp, D. melanogaster
tttgagtaattaa

SEQ ID NO: 676339 - DNA, 13 bp, D. melanogaster
tttgagtccaact

SEQ ID NO: 676340 - DNA, 13 bp, D. melanogaster
tttgagtgcactt

SEQ ID NO: 676341 - DNA, 13 bp, D. melanogaster
tttgagtgccttt

SEQ ID NO: 676342 - DNA, 13 bp, D. melanogaster
tttgagtggaaaa

SEQ ID NO: 676343 - DNA, 13 bp, D. melanogaster
tttgagtgggcgt

SEQ ID NO: 676344 - DNA, 13 bp, D. melanogaster
tttgagtgtacaa

SEQ ID NO: 676345 - DNA, 13 bp, D. melanogaster
tttgagttccttt

SEQ ID NO: 676346 - DNA, 13 bp, D. melanogaster
tttgagttcgact

SEQ ID NO: 676347 - DNA, 13 bp, D. melanogaster
tttgagttggaaa

SEQ ID NO: 676348 - DNA, 14 bp, D. melanogaster
tttgagtttcattt

SEQ ID NO: 676349 - DNA, 13 bp, D. melanogaster
tttgagtttcctt

SEQ ID NO: 676350 - DNA, 13 bp, D. melanogaster
tttgagtttgaac

SEQ ID NO: 676351 - DNA, 14 bp, D. melanogaster
tttgagtttgaaca

SEQ ID NO: 676352 - DNA, 13 bp, D. melanogaster
tttgagttttgag

SEQ ID NO: 676353 - DNA, 13 bp, D. melanogaster
tttgataaaaagt

SEQ ID NO: 676354 - DNA, 13 bp, D. melanogaster
tttgataaaatgc

SEQ ID NO: 676355 - DNA, 13 bp, D. melanogaster
tttgataaactcg

SEQ ID NO: 676356 - DNA, 13 bp, D. melanogaster
tttgataaatgcc

SEQ ID NO: 676357 - DNA, 13 bp, D. melanogaster
tttgataaatttg

SEQ ID NO: 676358 - DNA, 13 bp, D. melanogaster
tttgataacattt

SEQ ID NO: 676359 - DNA, 13 bp, D. melanogaster
tttgataactttt

SEQ ID NO: 676360 - DNA, 13 bp, D. melanogaster
tttgataagcaaa

SEQ ID NO: 676361 - DNA, 13 bp, D. melanogaster
tttgataagtaaa

SEQ ID NO: 676362 - DNA, 14 bp, D. melanogaster
tttgataagtaaat

SEQ ID NO: 676363 - DNA, 13 bp, D. melanogaster
tttgataataacc

SEQ ID NO: 676364 - DNA, 13 bp, D. melanogaster
tttgatacatttt

SEQ ID NO: 676365 - DNA, 13 bp, D. melanogaster
tttgatagaaacc

SEQ ID NO: 676366 - DNA, 13 bp, D. melanogaster
tttgatatacaaa

SEQ ID NO: 676367 - DNA, 13 bp, D. melanogaster
tttgatatacttt

SEQ ID NO: 676368 - DNA, 13 bp, D. melanogaster
tttgatatattac

SEQ ID NO: 676369 - DNA, 13 bp, D. melanogaster
tttgatatatttc

SEQ ID NO: 676370 - DNA, 13 bp, D. melanogaster
tttgatatgaatg

SEQ ID NO: 676371 - DNA, 13 bp, D. melanogaster
tttgatatgcaaa

SEQ ID NO: 676372 - DNA, 14 bp, D. melanogaster
tttgatattattgc

SEQ ID NO: 676373 - DNA, 13 bp, D. melanogaster
tttgatattgaaa

SEQ ID NO: 676374 - DNA, 14 bp, D. melanogaster
tttgatattgaaca

SEQ ID NO: 676375 - DNA, 13 bp, D. melanogaster
tttgatattgtaa

SEQ ID NO: 676376 - DNA, 13 bp, D. melanogaster
tttgatattttcg

SEQ ID NO: 676377 - DNA, 13 bp, D. melanogaster
tttgatcaaaaag

SEQ ID NO: 676378 - DNA, 13 bp, D. melanogaster
tttgatcaacgca

SEQ ID NO: 676379 - DNA, 13 bp, D. melanogaster
tttgatcagcgcg

SEQ ID NO: 676380 - DNA, 13 bp, D. melanogaster
tttgatcataaca

SEQ ID NO: 676381 - DNA, 13 bp, D. melanogaster
tttgatcattaaa

SEQ ID NO: 676382 - DNA, 13 bp, D. melanogaster
tttgatcatttga

SEQ ID NO: 676383 - DNA, 13 bp, D. melanogaster
tttgatcattttg

SEQ ID NO: 676384 - DNA, 13 bp, D. melanogaster
tttgatccacatt

SEQ ID NO: 676385 - DNA, 13 bp, D. melanogaster
tttgatcgatttt

SEQ ID NO: 676386 - DNA, 14 bp, D. melanogaster
tttgatcgtgattt

SEQ ID NO: 676387 - DNA, 14 bp, D. melanogaster
tttgatctgcttaa

SEQ ID NO: 676388 - DNA, 13 bp, D. melanogaster
tttgatgaaatat

SEQ ID NO: 676389 - DNA, 13 bp, D. melanogaster
tttgatgaaatcc

SEQ ID NO: 676390 - DNA, 13 bp, D. melanogaster
tttgatgaccgaa

SEQ ID NO: 676391 - DNA, 13 bp, D. melanogaster
tttgatgactttc

SEQ ID NO: 676392 - DNA, 13 bp, D. melanogaster
tttgatgatatat

SEQ ID NO: 676393 - DNA, 13 bp, D. melanogaster
tttgatgatgatg

SEQ ID NO: 676394 - DNA, 13 bp, D. melanogaster
tttgatgatgatt

SEQ ID NO: 676395 - DNA, 13 bp, D. melanogaster
tttgatgcaatta

SEQ ID NO: 676396 - DNA, 13 bp, D. melanogaster
tttgatgcaattt

SEQ ID NO: 676397 - DNA, 13 bp, D. melanogaster
tttgatgcatttg

SEQ ID NO: 676398 - DNA, 13 bp, D. melanogaster
tttgatgcgattt

SEQ ID NO: 676399 - DNA, 13 bp, D. melanogaster
tttgatggaaaac

SEQ ID NO: 676400 - DNA, 13 bp, D. melanogaster
tttgatggaaacc

SEQ ID NO: 676401 - DNA, 13 bp, D. melanogaster
tttgatggaatcc

SEQ ID NO: 676402 - DNA, 14 bp, D. melanogaster
tttgatggaatcca

SEQ ID NO: 676403 - DNA, 13 bp, D. melanogaster
tttgatggaattt

SEQ ID NO: 676404 - DNA, 13 bp, D. melanogaster
tttgatggactca

SEQ ID NO: 676405 - DNA, 13 bp, D. melanogaster
tttgatggacttt

SEQ ID NO: 676406 - DNA, 14 bp, D. melanogaster
tttgatggactttc

SEQ ID NO: 676407 - DNA, 13 bp, D. melanogaster
tttgatggcaaaa

SEQ ID NO: 676408 - DNA, 13 bp, D. melanogaster
tttgatggcattg

SEQ ID NO: 676409 - DNA, 13 bp, D. melanogaster
tttgatggcccaa

SEQ ID NO: 676410 - DNA, 13 bp, D. melanogaster
tttgatggctttt

SEQ ID NO: 676411 - DNA, 13 bp, D. melanogaster
tttgattaaattg

SEQ ID NO: 676412 - DNA, 13 bp, D. melanogaster
tttgattaacaaa

SEQ ID NO: 676413 - DNA, 13 bp, D. melanogaster
tttgattaatggc

SEQ ID NO: 676414 - DNA, 13 bp, D. melanogaster
tttgattaatgtg

SEQ ID NO: 676415 - DNA, 13 bp, D. melanogaster
tttgattacactt

SEQ ID NO: 676416 - DNA, 14 bp, D. melanogaster
tttgattacatttt

SEQ ID NO: 676417 - DNA, 13 bp, D. melanogaster
tttgattagaaat

SEQ ID NO: 676418 - DNA, 13 bp, D. melanogaster
tttgattaggaaa

SEQ ID NO: 676419 - DNA, 13 bp, D. melanogaster
tttgattatcaat

SEQ ID NO: 676420 - DNA, 13 bp, D. melanogaster
tttgattatgcca

SEQ ID NO: 676421 - DNA, 13 bp, D. melanogaster
tttgattcaaaat

SEQ ID NO: 676422 - DNA, 13 bp, D. melanogaster
tttgattcaattc

SEQ ID NO: 676423 - DNA, 13 bp, D. melanogaster
tttgattcagttt

SEQ ID NO: 676424 - DNA, 13 bp, D. melanogaster
tttgattccattt

SEQ ID NO: 676425 - DNA, 13 bp, D. melanogaster
tttgattccgatt

SEQ ID NO: 676426 - DNA, 13 bp, D. melanogaster
tttgattccgttt

SEQ ID NO: 676427 - DNA, 13 bp, D. melanogaster
tttgattcgaaat

SEQ ID NO: 676428 - DNA, 13 bp, D. melanogaster
tttgattcgattg

SEQ ID NO: 676429 - DNA, 13 bp, D. melanogaster
tttgattcgattt

SEQ ID NO: 676430 - DNA, 14 bp, D. melanogaster
tttgattcgatttg

SEQ ID NO: 676431 - DNA, 13 bp, D. melanogaster
tttgattcggttt

SEQ ID NO: 676432 - DNA, 13 bp, D. melanogaster
tttgattgaaatt

SEQ ID NO: 676433 - DNA, 13 bp, D. melanogaster
tttgattgacagc

SEQ ID NO: 676434 - DNA, 13 bp, D. melanogaster
tttgattgacgat

SEQ ID NO: 676435 - DNA, 13 bp, D. melanogaster
tttgattgacgtt

SEQ ID NO: 676436 - DNA, 13 bp, D. melanogaster
tttgattgatgaa

SEQ ID NO: 676437 - DNA, 13 bp, D. melanogaster
tttgattgattaa

SEQ ID NO: 676438 - DNA, 13 bp, D. melanogaster
tttgattgattga

SEQ ID NO: 676439 - DNA, 13 bp, D. melanogaster
tttgattgattgc

SEQ ID NO: 676440 - DNA, 13 bp, D. melanogaster
tttgattgcaaat

SEQ ID NO: 676441 - DNA, 13 bp, D. melanogaster
tttgattgcaatt

SEQ ID NO: 676442 - DNA, 13 bp, D. melanogaster
tttgattgcattt

SEQ ID NO: 676443 - DNA, 13 bp, D. melanogaster
tttgattgccagc

SEQ ID NO: 676444 - DNA, 13 bp, D. melanogaster
tttgattgcgttt

SEQ ID NO: 676445 - DNA, 13 bp, D. melanogaster
tttgattgctttc

SEQ ID NO: 676446 - DNA, 13 bp, D. melanogaster
tttgattggaaaa

SEQ ID NO: 676447 - DNA, 13 bp, D. melanogaster
tttgattggaaat

SEQ ID NO: 676448 - DNA, 13 bp, D. melanogaster
tttgattggcttt

SEQ ID NO: 676449 - DNA, 13 bp, D. melanogaster
tttgattgggaat

SEQ ID NO: 676450 - DNA, 13 bp, D. melanogaster
tttgattgtgaaa

SEQ ID NO: 676451 - DNA, 13 bp, D. melanogaster
tttgattgttgct

SEQ ID NO: 676452 - DNA, 13 bp, D. melanogaster
tttgatttaatac

SEQ ID NO: 676453 - DNA, 14 bp, D. melanogaster
tttgatttaataca

SEQ ID NO: 676454 - DNA, 13 bp, D. melanogaster
tttgatttacata

SEQ ID NO: 676455 - DNA, 13 bp, D. melanogaster
tttgatttataag

SEQ ID NO: 676456 - DNA, 13 bp, D. melanogaster
tttgatttataca

SEQ ID NO: 676457 - DNA, 14 bp, D. melanogaster
tttgatttatggcc

SEQ ID NO: 676458 - DNA, 13 bp, D. melanogaster
tttgatttattcc

SEQ ID NO: 676459 - DNA, 13 bp, D. melanogaster
tttgatttcaaat

SEQ ID NO: 676460 - DNA, 14 bp, D. melanogaster
tttgatttcaaatt

SEQ ID NO: 676461 - DNA, 13 bp, D. melanogaster
tttgatttcaatt

SEQ ID NO: 676462 - DNA, 13 bp, D. melanogaster
tttgatttcccat

SEQ ID NO: 676463 - DNA, 14 bp, D. melanogaster
tttgatttcgaatt

SEQ ID NO: 676464 - DNA, 13 bp, D. melanogaster
tttgatttcgatt

SEQ ID NO: 676465 - DNA, 14 bp, D. melanogaster
tttgatttcgattc

SEQ ID NO: 676466 - DNA, 14 bp, D. melanogaster
tttgatttcggttt

SEQ ID NO: 676467 - DNA, 13 bp, D. melanogaster
tttgatttctaat

SEQ ID NO: 676468 - DNA, 13 bp, D. melanogaster
tttgatttgaaaa

SEQ ID NO: 676469 - DNA, 13 bp, D. melanogaster
tttgatttgaata

SEQ ID NO: 676470 - DNA, 13 bp, D. melanogaster
tttgatttgactt

SEQ ID NO: 676471 - DNA, 13 bp, D. melanogaster
tttgatttgagct

SEQ ID NO: 676472 - DNA, 13 bp, D. melanogaster
tttgatttgataa

SEQ ID NO: 676473 - DNA, 13 bp, D. melanogaster
tttgatttgattc

SEQ ID NO: 676474 - DNA, 13 bp, D. melanogaster
tttgatttgcact

SEQ ID NO: 676475 - DNA, 13 bp, D. melanogaster
tttgatttgcagc

SEQ ID NO: 676476 - DNA, 13 bp, D. melanogaster
tttgatttgcatt

SEQ ID NO: 676477 - DNA, 14 bp, D. melanogaster
tttgatttgcattt

SEQ ID NO: 676478 - DNA, 13 bp, D. melanogaster
tttgatttgcctc

SEQ ID NO: 676479 - DNA, 13 bp, D. melanogaster
tttgatttggcaa

SEQ ID NO: 676480 - DNA, 13 bp, D. melanogaster
tttgatttggctt

SEQ ID NO: 676481 - DNA, 13 bp, D. melanogaster
tttgatttgggaa

SEQ ID NO: 676482 - DNA, 14 bp, D. melanogaster
tttgatttgggaat

SEQ ID NO: 676483 - DNA, 13 bp, D. melanogaster
tttgatttgtgcg

SEQ ID NO: 676484 - DNA, 14 bp, D. melanogaster
tttgatttgtttac

SEQ ID NO: 676485 - DNA, 13 bp, D. melanogaster
tttgattttaagc

SEQ ID NO: 676486 - DNA, 13 bp, D. melanogaster
tttgattttaatc

SEQ ID NO: 676487 - DNA, 13 bp, D. melanogaster
tttgattttacaa

SEQ ID NO: 676488 - DNA, 13 bp, D. melanogaster
tttgattttcgaa

SEQ ID NO: 676489 - DNA, 14 bp, D. melanogaster
tttgattttctgag

SEQ ID NO: 676490 - DNA, 13 bp, D. melanogaster
tttgattttgaag

SEQ ID NO: 676491 - DNA, 13 bp, D. melanogaster
tttgattttgcca

SEQ ID NO: 676492 - DNA, 14 bp, D. melanogaster
tttgattttggaat

SEQ ID NO: 676493 - DNA, 13 bp, D. melanogaster
tttgatttttgcc

SEQ ID NO: 676494 - DNA, 13 bp, D. melanogaster
tttgcaaaaaaaa

SEQ ID NO: 676495 - DNA, 14 bp, D. melanogaster
tttgcaaaaaaaaa

SEQ ID NO: 676496 - DNA, 13 bp, D. melanogaster
tttgcaaaaaaat

SEQ ID NO: 676497 - DNA, 13 bp, D. melanogaster
tttgcaaaaaaca

SEQ ID NO: 676498 - DNA, 13 bp, D. melanogaster
tttgcaaaaaatt

SEQ ID NO: 676499 - DNA, 13 bp, D. melanogaster
tttgcaaaaagaa

SEQ ID NO: 676500 - DNA, 13 bp, D. melanogaster
tttgcaaaaagct

SEQ ID NO: 676501 - DNA, 13 bp, D. melanogaster
tttgcaaaaagtt

SEQ ID NO: 676502 - DNA, 13 bp, D. melanogaster
tttgcaaaaatgt

SEQ ID NO: 676503 - DNA, 13 bp, D. melanogaster
tttgcaaaacaaa

SEQ ID NO: 676504 - DNA, 14 bp, D. melanogaster
tttgcaaaacaatt

SEQ ID NO: 676505 - DNA, 13 bp, D. melanogaster
tttgcaaaagtgt

SEQ ID NO: 676506 - DNA, 14 bp, D. melanogaster
tttgcaaaagtttt

SEQ ID NO: 676507 - DNA, 13 bp, D. melanogaster
tttgcaaaataaa

SEQ ID NO: 676508 - DNA, 14 bp, D. melanogaster
tttgcaaaataaat

SEQ ID NO: 676509 - DNA, 13 bp, D. melanogaster
tttgcaaaataat

SEQ ID NO: 676510 - DNA, 13 bp, D. melanogaster
tttgcaaaatact

SEQ ID NO: 676511 - DNA, 13 bp, D. melanogaster
tttgcaaaatatt

SEQ ID NO: 676512 - DNA, 13 bp, D. melanogaster
tttgcaaaatgtt

SEQ ID NO: 676513 - DNA, 14 bp, D. melanogaster
tttgcaaacaaaaa

SEQ ID NO: 676514 - DNA, 13 bp, D. melanogaster
tttgcaaacaata

SEQ ID NO: 676515 - DNA, 14 bp, D. melanogaster
tttgcaaacatttt

SEQ ID NO: 676516 - DNA, 13 bp, D. melanogaster
tttgcaaacgaaa

SEQ ID NO: 676517 - DNA, 13 bp, D. melanogaster
tttgcaaactctt

SEQ ID NO: 676518 - DNA, 14 bp, D. melanogaster
tttgcaaactcttt

SEQ ID NO: 676519 - DNA, 13 bp, D. melanogaster
tttgcaaactttt

SEQ ID NO: 676520 - DNA, 13 bp, D. melanogaster
tttgcaaagcaaa

SEQ ID NO: 676521 - DNA, 13 bp, D. melanogaster
tttgcaaataaaa

SEQ ID NO: 676522 - DNA, 13 bp, D. melanogaster
tttgcaaataatt

SEQ ID NO: 676523 - DNA, 13 bp, D. melanogaster
tttgcaaatagtt

SEQ ID NO: 676524 - DNA, 13 bp, D. melanogaster
tttgcaaatatac

SEQ ID NO: 676525 - DNA, 13 bp, D. melanogaster
tttgcaaatatgt

SEQ ID NO: 676526 - DNA, 13 bp, D. melanogaster
tttgcaaatattc

SEQ ID NO: 676527 - DNA, 13 bp, D. melanogaster
tttgcaaatattt

SEQ ID NO: 676528 - DNA, 13 bp, D. melanogaster
tttgcaaatcgaa

SEQ ID NO: 676529 - DNA, 13 bp, D. melanogaster
tttgcaaatgcaa

SEQ ID NO: 676530 - DNA, 13 bp, D. melanogaster
tttgcaaatggca

SEQ ID NO: 676531 - DNA, 13 bp, D. melanogaster
tttgcaaattaat

SEQ ID NO: 676532 - DNA, 13 bp, D. melanogaster
tttgcaaattgcc

SEQ ID NO: 676533 - DNA, 14 bp, D. melanogaster
tttgcaaatttatt

SEQ ID NO: 676534 - DNA, 13 bp, D. melanogaster
tttgcaaatttgc

SEQ ID NO: 676535 - DNA, 13 bp, D. melanogaster
tttgcaaattttc

SEQ ID NO: 676536 - DNA, 13 bp, D. melanogaster
tttgcaaattttg

SEQ ID NO: 676537 - DNA, 14 bp, D. melanogaster
tttgcaaattttga

SEQ ID NO: 676538 - DNA, 13 bp, D. melanogaster
tttgcaaattttt

SEQ ID NO: 676539 - DNA, 14 bp, D. melanogaster
tttgcaaattttta

SEQ ID NO: 676540 - DNA, 13 bp, D. melanogaster
tttgcaacaaatt

SEQ ID NO: 676541 - DNA, 13 bp, D. melanogaster
tttgcaacaacaa

SEQ ID NO: 676542 - DNA, 13 bp, D. melanogaster
tttgcaacaatgt

SEQ ID NO: 676543 - DNA, 13 bp, D. melanogaster
tttgcaacaattt

SEQ ID NO: 676544 - DNA, 14 bp, D. melanogaster
tttgcaacaatttc

SEQ ID NO: 676545 - DNA, 13 bp, D. melanogaster
tttgcaacacaaa

SEQ ID NO: 676546 - DNA, 13 bp, D. melanogaster
tttgcaacacatt

SEQ ID NO: 676547 - DNA, 13 bp, D. melanogaster
tttgcaacacttt

SEQ ID NO: 676548 - DNA, 13 bp, D. melanogaster
tttgcaacatttt

SEQ ID NO: 676549 - DNA, 14 bp, D. melanogaster
tttgcaacattttt

SEQ ID NO: 676550 - DNA, 13 bp, D. melanogaster
tttgcaactaaaa

SEQ ID NO: 676551 - DNA, 13 bp, D. melanogaster
tttgcaactaaga

SEQ ID NO: 676552 - DNA, 13 bp, D. melanogaster
tttgcaactattt

SEQ ID NO: 676553 - DNA, 13 bp, D. melanogaster
tttgcaacttaat

SEQ ID NO: 676554 - DNA, 13 bp, D. melanogaster
tttgcaactttaa

SEQ ID NO: 676555 - DNA, 13 bp, D. melanogaster
tttgcaactttat

SEQ ID NO: 676556 - DNA, 13 bp, D. melanogaster
tttgcaacttttt

SEQ ID NO: 676557 - DNA, 14 bp, D. melanogaster
tttgcaacttttta

SEQ ID NO: 676558 - DNA, 13 bp, D. melanogaster
tttgcaagaacag

SEQ ID NO: 676559 - DNA, 13 bp, D. melanogaster
tttgcaagcaaaa

SEQ ID NO: 676560 - DNA, 13 bp, D. melanogaster
tttgcaagcattt

SEQ ID NO: 676561 - DNA, 13 bp, D. melanogaster
tttgcaagctttt

SEQ ID NO: 676562 - DNA, 13 bp, D. melanogaster
tttgcaaggaaaa

SEQ ID NO: 676563 - DNA, 13 bp, D. melanogaster
tttgcaaggcaaa

SEQ ID NO: 676564 - DNA, 13 bp, D. melanogaster
tttgcaagggtat

SEQ ID NO: 676565 - DNA, 13 bp, D. melanogaster
tttgcaagtgcag

SEQ ID NO: 676566 - DNA, 13 bp, D. melanogaster
tttgcaataaaaa

SEQ ID NO: 676567 - DNA, 13 bp, D. melanogaster
tttgcaataaaag

SEQ ID NO: 676568 - DNA, 13 bp, D. melanogaster
tttgcaataaatt

SEQ ID NO: 676569 - DNA, 13 bp, D. melanogaster
tttgcaataatat

SEQ ID NO: 676570 - DNA, 14 bp, D. melanogaster
tttgcaatatattt

SEQ ID NO: 676571 - DNA, 13 bp, D. melanogaster
tttgcaatatttt

SEQ ID NO: 676572 - DNA, 13 bp, D. melanogaster
tttgcaatcaaaa

SEQ ID NO: 676573 - DNA, 13 bp, D. melanogaster
tttgcaatcattt

SEQ ID NO: 676574 - DNA, 13 bp, D. melanogaster
tttgcaatcgaat

SEQ ID NO: 676575 - DNA, 13 bp, D. melanogaster
tttgcaatgcaaa

SEQ ID NO: 676576 - DNA, 14 bp, D. melanogaster
tttgcaatgcaaat

SEQ ID NO: 676577 - DNA, 13 bp, D. melanogaster
tttgcaatgcttt

SEQ ID NO: 676578 - DNA, 13 bp, D. melanogaster
tttgcaatggaat

SEQ ID NO: 676579 - DNA, 13 bp, D. melanogaster
tttgcaatggcaa

SEQ ID NO: 676580 - DNA, 13 bp, D. melanogaster
tttgcaattaaat

SEQ ID NO: 676581 - DNA, 14 bp, D. melanogaster
tttgcaattaattt

SEQ ID NO: 676582 - DNA, 13 bp, D. melanogaster
tttgcaattagtt

SEQ ID NO: 676583 - DNA, 13 bp, D. melanogaster
tttgcaattatat

SEQ ID NO: 676584 - DNA, 14 bp, D. melanogaster
tttgcaattatata

SEQ ID NO: 676585 - DNA, 13 bp, D. melanogaster
tttgcaattattt

SEQ ID NO: 676586 - DNA, 13 bp, D. melanogaster
tttgcaattcaaa

SEQ ID NO: 676587 - DNA, 14 bp, D. melanogaster
tttgcaattcaatt

SEQ ID NO: 676588 - DNA, 13 bp, D. melanogaster
tttgcaattcatt

SEQ ID NO: 676589 - DNA, 13 bp, D. melanogaster
tttgcaattgcaa

SEQ ID NO: 676590 - DNA, 13 bp, D. melanogaster
tttgcaattggcg

SEQ ID NO: 676591 - DNA, 13 bp, D. melanogaster
tttgcaattggct

SEQ ID NO: 676592 - DNA, 13 bp, D. melanogaster
tttgcaattggtt

SEQ ID NO: 676593 - DNA, 14 bp, D. melanogaster
tttgcaattgtttt

SEQ ID NO: 676594 - DNA, 14 bp, D. melanogaster
tttgcaatttaaaa

SEQ ID NO: 676595 - DNA, 14 bp, D. melanogaster
tttgcaatttattt

SEQ ID NO: 676596 - DNA, 13 bp, D. melanogaster
tttgcaatttcaa

SEQ ID NO: 676597 - DNA, 13 bp, D. melanogaster
tttgcaatttcat

SEQ ID NO: 676598 - DNA, 13 bp, D. melanogaster
tttgcaatttgca

SEQ ID NO: 676599 - DNA, 14 bp, D. melanogaster
tttgcaatttgcaa

SEQ ID NO: 676600 - DNA, 13 bp, D. melanogaster
tttgcaatttggt

SEQ ID NO: 676601 - DNA, 14 bp, D. melanogaster
tttgcaatttgttt

SEQ ID NO: 676602 - DNA, 13 bp, D. melanogaster
tttgcaattttcg

SEQ ID NO: 676603 - DNA, 13 bp, D. melanogaster
tttgcaatttttg

SEQ ID NO: 676604 - DNA, 13 bp, D. melanogaster
tttgcacaaaaac

SEQ ID NO: 676605 - DNA, 13 bp, D. melanogaster
tttgcacaaaact

SEQ ID NO: 676606 - DNA, 13 bp, D. melanogaster
tttgcacaaacaa

SEQ ID NO: 676607 - DNA, 14 bp, D. melanogaster
tttgcacaatattt

SEQ ID NO: 676608 - DNA, 13 bp, D. melanogaster
tttgcacaatgcc

SEQ ID NO: 676609 - DNA, 14 bp, D. melanogaster
tttgcacaatgcct

SEQ ID NO: 676610 - DNA, 13 bp, D. melanogaster
tttgcacaatttg

SEQ ID NO: 676611 - DNA, 13 bp, D. melanogaster
tttgcacaatttt

SEQ ID NO: 676612 - DNA, 14 bp, D. melanogaster
tttgcacaattttc

SEQ ID NO: 676613 - DNA, 13 bp, D. melanogaster
tttgcacacaaaa

SEQ ID NO: 676614 - DNA, 13 bp, D. melanogaster
tttgcacacacac

SEQ ID NO: 676615 - DNA, 13 bp, D. melanogaster
tttgcacacactt

SEQ ID NO: 676616 - DNA, 13 bp, D. melanogaster
tttgcacactttt

SEQ ID NO: 676617 - DNA, 13 bp, D. melanogaster
tttgcacagctgc

SEQ ID NO: 676618 - DNA, 13 bp, D. melanogaster
tttgcacagtttt

SEQ ID NO: 676619 - DNA, 13 bp, D. melanogaster
tttgcacataaat

SEQ ID NO: 676620 - DNA, 13 bp, D. melanogaster
tttgcacatattt

SEQ ID NO: 676621 - DNA, 13 bp, D. melanogaster
tttgcacattaaa

SEQ ID NO: 676622 - DNA, 13 bp, D. melanogaster
tttgcacatttgc

SEQ ID NO: 676623 - DNA, 13 bp, D. melanogaster
tttgcacatttgt

SEQ ID NO: 676624 - DNA, 13 bp, D. melanogaster
tttgcaccaccca

SEQ ID NO: 676625 - DNA, 13 bp, D. melanogaster
tttgcaccagctg

SEQ ID NO: 676626 - DNA, 13 bp, D. melanogaster
tttgcaccttttg

SEQ ID NO: 676627 - DNA, 14 bp, D. melanogaster
tttgcacgttttat

SEQ ID NO: 676628 - DNA, 13 bp, D. melanogaster
tttgcacgttttt

SEQ ID NO: 676629 - DNA, 13 bp, D. melanogaster
tttgcactaattt

SEQ ID NO: 676630 - DNA, 13 bp, D. melanogaster
tttgcactcgaaa

SEQ ID NO: 676631 - DNA, 13 bp, D. melanogaster
tttgcactgattt

SEQ ID NO: 676632 - DNA, 13 bp, D. melanogaster
tttgcactgcact

SEQ ID NO: 676633 - DNA, 14 bp, D. melanogaster
tttgcactgcactt

SEQ ID NO: 676634 - DNA, 13 bp, D. melanogaster
tttgcactgccaa

SEQ ID NO: 676635 - DNA, 13 bp, D. melanogaster
tttgcacttaatt

SEQ ID NO: 676636 - DNA, 13 bp, D. melanogaster
tttgcacttcatt

SEQ ID NO: 676637 - DNA, 14 bp, D. melanogaster
tttgcacttcattt

SEQ ID NO: 676638 - DNA, 14 bp, D. melanogaster
tttgcacttgaaaa

SEQ ID NO: 676639 - DNA, 13 bp, D. melanogaster
tttgcacttgccg

SEQ ID NO: 676640 - DNA, 13 bp, D. melanogaster
tttgcacttggct

SEQ ID NO: 676641 - DNA, 13 bp, D. melanogaster
tttgcactttatt

SEQ ID NO: 676642 - DNA, 13 bp, D. melanogaster
tttgcactttgct

SEQ ID NO: 676643 - DNA, 13 bp, D. melanogaster
tttgcactttgtt

SEQ ID NO: 676644 - DNA, 13 bp, D. melanogaster
tttgcacttttca

SEQ ID NO: 676645 - DNA, 13 bp, D. melanogaster
tttgcacttttcc

SEQ ID NO: 676646 - DNA, 13 bp, D. melanogaster
tttgcagaatatt

SEQ ID NO: 676647 - DNA, 13 bp, D. melanogaster
tttgcagacggcg

SEQ ID NO: 676648 - DNA, 13 bp, D. melanogaster
tttgcagattaaa

SEQ ID NO: 676649 - DNA, 13 bp, D. melanogaster
tttgcagcaattt

SEQ ID NO: 676650 - DNA, 13 bp, D. melanogaster
tttgcagcacttg

SEQ ID NO: 676651 - DNA, 13 bp, D. melanogaster
tttgcagcatatt

SEQ ID NO: 676652 - DNA, 13 bp, D. melanogaster
tttgcagcgaaaa

SEQ ID NO: 676653 - DNA, 13 bp, D. melanogaster
tttgcagcgattt

SEQ ID NO: 676654 - DNA, 13 bp, D. melanogaster
tttgcagcgtttt

SEQ ID NO: 676655 - DNA, 13 bp, D. melanogaster
tttgcagctaatt

SEQ ID NO: 676656 - DNA, 13 bp, D. melanogaster
tttgcagctcaag

SEQ ID NO: 676657 - DNA, 13 bp, D. melanogaster
tttgcagctcttt

SEQ ID NO: 676658 - DNA, 13 bp, D. melanogaster
tttgcagctgaca

SEQ ID NO: 676659 - DNA, 13 bp, D. melanogaster
tttgcagctgcaa

SEQ ID NO: 676660 - DNA, 13 bp, D. melanogaster
tttgcagctgcca

SEQ ID NO: 676661 - DNA, 13 bp, D. melanogaster
tttgcagctgtca

SEQ ID NO: 676662 - DNA, 13 bp, D. melanogaster
tttgcagcttgtt

SEQ ID NO: 676663 - DNA, 13 bp, D. melanogaster
tttgcagcttttg

SEQ ID NO: 676664 - DNA, 13 bp, D. melanogaster
tttgcagcttttt

SEQ ID NO: 676665 - DNA, 13 bp, D. melanogaster
tttgcagtgaaaa

SEQ ID NO: 676666 - DNA, 13 bp, D. melanogaster
tttgcagtgcact

SEQ ID NO: 676667 - DNA, 13 bp, D. melanogaster
tttgcagttaatt

SEQ ID NO: 676668 - DNA, 13 bp, D. melanogaster
tttgcagttgcat

SEQ ID NO: 676669 - DNA, 13 bp, D. melanogaster
tttgcagttgggg

SEQ ID NO: 676670 - DNA, 14 bp, D. melanogaster
tttgcagttgggga

SEQ ID NO: 676671 - DNA, 13 bp, D. melanogaster
tttgcagtttaat

SEQ ID NO: 676672 - DNA, 13 bp, D. melanogaster
tttgcagtttgca

SEQ ID NO: 676673 - DNA, 14 bp, D. melanogaster
tttgcagtttgcag

SEQ ID NO: 676674 - DNA, 13 bp, D. melanogaster
tttgcagtttgcc

SEQ ID NO: 676675 - DNA, 13 bp, D. melanogaster
tttgcataaaaaa

SEQ ID NO: 676676 - DNA, 14 bp, D. melanogaster
tttgcataaaaaat

SEQ ID NO: 676677 - DNA, 13 bp, D. melanogaster
tttgcataaaaac

SEQ ID NO: 676678 - DNA, 13 bp, D. melanogaster
tttgcataaaaat

SEQ ID NO: 676679 - DNA, 14 bp, D. melanogaster
tttgcataaaaatt

SEQ ID NO: 676680 - DNA, 13 bp, D. melanogaster
tttgcataaaata

SEQ ID NO: 676681 - DNA, 13 bp, D. melanogaster
tttgcataaacaa

SEQ ID NO: 676682 - DNA, 14 bp, D. melanogaster
tttgcataaatatt

SEQ ID NO: 676683 - DNA, 13 bp, D. melanogaster
tttgcataaatct

SEQ ID NO: 676684 - DNA, 13 bp, D. melanogaster
tttgcataaatga

SEQ ID NO: 676685 - DNA, 13 bp, D. melanogaster
tttgcataaatgc

SEQ ID NO: 676686 - DNA, 14 bp, D. melanogaster
tttgcataaatgca

SEQ ID NO: 676687 - DNA, 13 bp, D. melanogaster
tttgcataacaaa

SEQ ID NO: 676688 - DNA, 13 bp, D. melanogaster
tttgcataacaat

SEQ ID NO: 676689 - DNA, 13 bp, D. melanogaster
tttgcataacatt

SEQ ID NO: 676690 - DNA, 13 bp, D. melanogaster
tttgcataaccac

SEQ ID NO: 676691 - DNA, 13 bp, D. melanogaster
tttgcataacttt

SEQ ID NO: 676692 - DNA, 13 bp, D. melanogaster
tttgcataattaa

SEQ ID NO: 676693 - DNA, 13 bp, D. melanogaster
tttgcataatttt

SEQ ID NO: 676694 - DNA, 13 bp, D. melanogaster
tttgcatacaaat

SEQ ID NO: 676695 - DNA, 14 bp, D. melanogaster
tttgcatacaattt

SEQ ID NO: 676696 - DNA, 13 bp, D. melanogaster
tttgcatacagca

SEQ ID NO: 676697 - DNA, 13 bp, D. melanogaster
tttgcatacattt

SEQ ID NO: 676698 - DNA, 14 bp, D. melanogaster
tttgcatacatttt

SEQ ID NO: 676699 - DNA, 13 bp, D. melanogaster
tttgcataccaaa

SEQ ID NO: 676700 - DNA, 13 bp, D. melanogaster
tttgcatacgaat

SEQ ID NO: 676701 - DNA, 13 bp, D. melanogaster
tttgcatacgcaa

SEQ ID NO: 676702 - DNA, 13 bp, D. melanogaster
tttgcatacgctc

SEQ ID NO: 676703 - DNA, 13 bp, D. melanogaster
tttgcatagcaaa

SEQ ID NO: 676704 - DNA, 13 bp, D. melanogaster
tttgcatagccag

SEQ ID NO: 676705 - DNA, 13 bp, D. melanogaster
tttgcatagctaa

SEQ ID NO: 676706 - DNA, 13 bp, D. melanogaster
tttgcatagttta

SEQ ID NO: 676707 - DNA, 13 bp, D. melanogaster
tttgcatataaaa

SEQ ID NO: 676708 - DNA, 14 bp, D. melanogaster
tttgcatataaaaa

SEQ ID NO: 676709 - DNA, 14 bp, D. melanogaster
tttgcatatatgca

SEQ ID NO: 676710 - DNA, 14 bp, D. melanogaster
tttgcatatatgta

SEQ ID NO: 676711 - DNA, 13 bp, D. melanogaster
tttgcatatattt

SEQ ID NO: 676712 - DNA, 14 bp, D. melanogaster
tttgcatatatttt

SEQ ID NO: 676713 - DNA, 13 bp, D. melanogaster
tttgcatatcctt

SEQ ID NO: 676714 - DNA, 13 bp, D. melanogaster
tttgcatatctaa

SEQ ID NO: 676715 - DNA, 13 bp, D. melanogaster
tttgcatatgcaa

SEQ ID NO: 676716 - DNA, 13 bp, D. melanogaster
tttgcatatgcat

SEQ ID NO: 676717 - DNA, 14 bp, D. melanogaster
tttgcatatgcatt

SEQ ID NO: 676718 - DNA, 13 bp, D. melanogaster
tttgcatatgcca

SEQ ID NO: 676719 - DNA, 13 bp, D. melanogaster
tttgcatatgtgc

SEQ ID NO: 676720 - DNA, 13 bp, D. melanogaster
tttgcatatgtgt

SEQ ID NO: 676721 - DNA, 13 bp, D. melanogaster
tttgcatattcat

SEQ ID NO: 676722 - DNA, 13 bp, D. melanogaster
tttgcatattctc

SEQ ID NO: 676723 - DNA, 13 bp, D. melanogaster
tttgcatatttat

SEQ ID NO: 676724 - DNA, 14 bp, D. melanogaster
tttgcatatttatg

SEQ ID NO: 676725 - DNA, 13 bp, D. melanogaster
tttgcatatttct

SEQ ID NO: 676726 - DNA, 13 bp, D. melanogaster
tttgcatatttgt

SEQ ID NO: 676727 - DNA, 13 bp, D. melanogaster
tttgcatatttta

SEQ ID NO: 676728 - DNA, 14 bp, D. melanogaster
tttgcatattttat

SEQ ID NO: 676729 - DNA, 13 bp, D. melanogaster
tttgcatattttg

SEQ ID NO: 676730 - DNA, 14 bp, D. melanogaster
tttgcatattttga

SEQ ID NO: 676731 - DNA, 14 bp, D. melanogaster
tttgcatatttttc

SEQ ID NO: 676732 - DNA, 13 bp, D. melanogaster
tttgcatcccaat

SEQ ID NO: 676733 - DNA, 14 bp, D. melanogaster
tttgcatcccaatt

SEQ ID NO: 676734 - DNA, 13 bp, D. melanogaster
tttgcatcgattt

SEQ ID NO: 676735 - DNA, 13 bp, D. melanogaster
tttgcatctgcaa

SEQ ID NO: 676736 - DNA, 13 bp, D. melanogaster
tttgcatctgcat

SEQ ID NO: 676737 - DNA, 13 bp, D. melanogaster
tttgcatcttgaa

SEQ ID NO: 676738 - DNA, 13 bp, D. melanogaster
tttgcatgaaaat

SEQ ID NO: 676739 - DNA, 13 bp, D. melanogaster
tttgcatgaaatt

SEQ ID NO: 676740 - DNA, 13 bp, D. melanogaster
tttgcatgcaatt

SEQ ID NO: 676741 - DNA, 13 bp, D. melanogaster
tttgcatgcattt

SEQ ID NO: 676742 - DNA, 14 bp, D. melanogaster
tttgcatgcatttc

SEQ ID NO: 676743 - DNA, 13 bp, D. melanogaster
tttgcatgccaaa

SEQ ID NO: 676744 - DNA, 14 bp, D. melanogaster
tttgcatgccaaaa

SEQ ID NO: 676745 - DNA, 13 bp, D. melanogaster
tttgcatgccatt

SEQ ID NO: 676746 - DNA, 13 bp, D. melanogaster
tttgcatgcgatt

SEQ ID NO: 676747 - DNA, 13 bp, D. melanogaster
tttgcatgctgca

SEQ ID NO: 676748 - DNA, 13 bp, D. melanogaster
tttgcatggaaat

SEQ ID NO: 676749 - DNA, 13 bp, D. melanogaster
tttgcatggcaaa

SEQ ID NO: 676750 - DNA, 13 bp, D. melanogaster
tttgcatgggaaa

SEQ ID NO: 676751 - DNA, 13 bp, D. melanogaster
tttgcatgtacat

SEQ ID NO: 676752 - DNA, 13 bp, D. melanogaster
tttgcatgtgaaa

SEQ ID NO: 676753 - DNA, 13 bp, D. melanogaster
tttgcatgtgcaa

SEQ ID NO: 676754 - DNA, 13 bp, D. melanogaster
tttgcatgtgtat

SEQ ID NO: 676755 - DNA, 14 bp, D. melanogaster
tttgcatgtgtgtg

SEQ ID NO: 676756 - DNA, 13 bp, D. melanogaster
tttgcatgtttgc

SEQ ID NO: 676757 - DNA, 13 bp, D. melanogaster
tttgcatgttttc

SEQ ID NO: 676758 - DNA, 13 bp, D. melanogaster
tttgcatgttttg

SEQ ID NO: 676759 - DNA, 13 bp, D. melanogaster
tttgcattaaaaa

SEQ ID NO: 676760 - DNA, 13 bp, D. melanogaster
tttgcattaagaa

SEQ ID NO: 676761 - DNA, 13 bp, D. melanogaster
tttgcattaattg

SEQ ID NO: 676762 - DNA, 13 bp, D. melanogaster
tttgcattacatt

SEQ ID NO: 676763 - DNA, 13 bp, D. melanogaster
tttgcattagttt

SEQ ID NO: 676764 - DNA, 13 bp, D. melanogaster
tttgcattataaa

SEQ ID NO: 676765 - DNA, 13 bp, D. melanogaster
tttgcattatgca

SEQ ID NO: 676766 - DNA, 13 bp, D. melanogaster
tttgcattattga

SEQ ID NO: 676767 - DNA, 13 bp, D. melanogaster
tttgcattcaaaa

SEQ ID NO: 676768 - DNA, 14 bp, D. melanogaster
tttgcattcaattt

SEQ ID NO: 676769 - DNA, 13 bp, D. melanogaster
tttgcattcagct

SEQ ID NO: 676770 - DNA, 13 bp, D. melanogaster
tttgcattcattt

SEQ ID NO: 676771 - DNA, 13 bp, D. melanogaster
tttgcattccaat

SEQ ID NO: 676772 - DNA, 13 bp, D. melanogaster
tttgcattccttt

SEQ ID NO: 676773 - DNA, 13 bp, D. melanogaster
tttgcattcgatt

SEQ ID NO: 676774 - DNA, 13 bp, D. melanogaster
tttgcattcgcaa

SEQ ID NO: 676775 - DNA, 13 bp, D. melanogaster
tttgcattcgcat

SEQ ID NO: 676776 - DNA, 13 bp, D. melanogaster
tttgcattcgcct

SEQ ID NO: 676777 - DNA, 13 bp, D. melanogaster
tttgcattcgctt

SEQ ID NO: 676778 - DNA, 13 bp, D. melanogaster
tttgcattgaaat

SEQ ID NO: 676779 - DNA, 13 bp, D. melanogaster
tttgcattgataa

SEQ ID NO: 676780 - DNA, 13 bp, D. melanogaster
tttgcattgattt

SEQ ID NO: 676781 - DNA, 13 bp, D. melanogaster
tttgcattgcatt

SEQ ID NO: 676782 - DNA, 13 bp, D. melanogaster
tttgcattgcctt

SEQ ID NO: 676783 - DNA, 13 bp, D. melanogaster
tttgcattgctgc

SEQ ID NO: 676784 - DNA, 13 bp, D. melanogaster
tttgcattgctta

SEQ ID NO: 676785 - DNA, 13 bp, D. melanogaster
tttgcattggaat

SEQ ID NO: 676786 - DNA, 13 bp, D. melanogaster
tttgcattggcaa

SEQ ID NO: 676787 - DNA, 13 bp, D. melanogaster
tttgcattggctt

SEQ ID NO: 676788 - DNA, 13 bp, D. melanogaster
tttgcattgtatt

SEQ ID NO: 676789 - DNA, 13 bp, D. melanogaster
tttgcattgttat

SEQ ID NO: 676790 - DNA, 13 bp, D. melanogaster
tttgcatttaaat

SEQ ID NO: 676791 - DNA, 14 bp, D. melanogaster
tttgcatttaaata

SEQ ID NO: 676792 - DNA, 14 bp, D. melanogaster
tttgcatttaaatt

SEQ ID NO: 676793 - DNA, 14 bp, D. melanogaster
tttgcatttaattt

SEQ ID NO: 676794 - DNA, 13 bp, D. melanogaster
tttgcatttacac

SEQ ID NO: 676795 - DNA, 13 bp, D. melanogaster
tttgcatttacat

SEQ ID NO: 676796 - DNA, 14 bp, D. melanogaster
tttgcatttacatt

SEQ ID NO: 676797 - DNA, 14 bp, D. melanogaster
tttgcatttacttt

SEQ ID NO: 676798 - DNA, 13 bp, D. melanogaster
tttgcatttagca

SEQ ID NO: 676799 - DNA, 13 bp, D. melanogaster
tttgcatttagtt

SEQ ID NO: 676800 - DNA, 14 bp, D. melanogaster
tttgcatttatatt

SEQ ID NO: 676801 - DNA, 14 bp, D. melanogaster
tttgcatttattta

SEQ ID NO: 676802 - DNA, 14 bp, D. melanogaster
tttgcatttatttg

SEQ ID NO: 676803 - DNA, 13 bp, D. melanogaster
tttgcatttcaaa

SEQ ID NO: 676804 - DNA, 14 bp, D. melanogaster
tttgcatttcaaat

SEQ ID NO: 676805 - DNA, 13 bp, D. melanogaster
tttgcatttcaat

SEQ ID NO: 676806 - DNA, 14 bp, D. melanogaster
tttgcatttcattt

SEQ ID NO: 676807 - DNA, 13 bp, D. melanogaster
tttgcatttcgaa

SEQ ID NO: 676808 - DNA, 14 bp, D. melanogaster
tttgcatttcgttt

SEQ ID NO: 676809 - DNA, 13 bp, D. melanogaster
tttgcatttcttc

SEQ ID NO: 676810 - DNA, 13 bp, D. melanogaster
tttgcatttgaaa

SEQ ID NO: 676811 - DNA, 14 bp, D. melanogaster
tttgcatttgaaat

SEQ ID NO: 676812 - DNA, 14 bp, D. melanogaster
tttgcatttgattt

SEQ ID NO: 676813 - DNA, 13 bp, D. melanogaster
tttgcatttgcac

SEQ ID NO: 676814 - DNA, 13 bp, D. melanogaster
tttgcatttgcat

SEQ ID NO: 676815 - DNA, 14 bp, D. melanogaster
tttgcatttgccaa

SEQ ID NO: 676816 - DNA, 13 bp, D. melanogaster
tttgcatttgccc

SEQ ID NO: 676817 - DNA, 13 bp, D. melanogaster
tttgcatttgctg

SEQ ID NO: 676818 - DNA, 13 bp, D. melanogaster
tttgcatttgctt

SEQ ID NO: 676819 - DNA, 14 bp, D. melanogaster
tttgcatttggatt

SEQ ID NO: 676820 - DNA, 13 bp, D. melanogaster
tttgcatttggca

SEQ ID NO: 676821 - DNA, 14 bp, D. melanogaster
tttgcatttggcat

SEQ ID NO: 676822 - DNA, 13 bp, D. melanogaster
tttgcatttggtt

SEQ ID NO: 676823 - DNA, 13 bp, D. melanogaster
tttgcatttgtaa

SEQ ID NO: 676824 - DNA, 14 bp, D. melanogaster
tttgcatttgtttg

SEQ ID NO: 676825 - DNA, 13 bp, D. melanogaster
tttgcattttaaa

SEQ ID NO: 676826 - DNA, 14 bp, D. melanogaster
tttgcattttaaat

SEQ ID NO: 676827 - DNA, 14 bp, D. melanogaster
tttgcattttaatt

SEQ ID NO: 676828 - DNA, 14 bp, D. melanogaster
tttgcattttatat

SEQ ID NO: 676829 - DNA, 13 bp, D. melanogaster
tttgcattttcaa

SEQ ID NO: 676830 - DNA, 14 bp, D. melanogaster
tttgcattttcatt

SEQ ID NO: 676831 - DNA, 13 bp, D. melanogaster
tttgcattttcct

SEQ ID NO: 676832 - DNA, 13 bp, D. melanogaster
tttgcattttcga

SEQ ID NO: 676833 - DNA, 13 bp, D. melanogaster
tttgcattttgca

SEQ ID NO: 676834 - DNA, 14 bp, D. melanogaster
tttgcattttgttg

SEQ ID NO: 676835 - DNA, 13 bp, D. melanogaster
tttgcatttttaa

SEQ ID NO: 676836 - DNA, 13 bp, D. melanogaster
tttgcatttttca

SEQ ID NO: 676837 - DNA, 13 bp, D. melanogaster
tttgccaaaaaaa

SEQ ID NO: 676838 - DNA, 13 bp, D. melanogaster
tttgccaaaaaac

SEQ ID NO: 676839 - DNA, 14 bp, D. melanogaster
tttgccaaaaaact

SEQ ID NO: 676840 - DNA, 13 bp, D. melanogaster
tttgccaaaaacg

SEQ ID NO: 676841 - DNA, 13 bp, D. melanogaster
tttgccaaaaact

SEQ ID NO: 676842 - DNA, 13 bp, D. melanogaster
tttgccaaaaatc

SEQ ID NO: 676843 - DNA, 13 bp, D. melanogaster
tttgccaaaaatg

SEQ ID NO: 676844 - DNA, 13 bp, D. melanogaster
tttgccaaaaatt

SEQ ID NO: 676845 - DNA, 14 bp, D. melanogaster
tttgccaaaaattt

SEQ ID NO: 676846 - DNA, 13 bp, D. melanogaster
tttgccaaaacaa

SEQ ID NO: 676847 - DNA, 13 bp, D. melanogaster
tttgccaaaataa

SEQ ID NO: 676848 - DNA, 14 bp, D. melanogaster
tttgccaaaatatt

SEQ ID NO: 676849 - DNA, 13 bp, D. melanogaster
tttgccaaaatca

SEQ ID NO: 676850 - DNA, 13 bp, D. melanogaster
tttgccaaacaaa

SEQ ID NO: 676851 - DNA, 14 bp, D. melanogaster
tttgccaaacaaat

SEQ ID NO: 676852 - DNA, 13 bp, D. melanogaster
tttgccaaacttt

SEQ ID NO: 676853 - DNA, 14 bp, D. melanogaster
tttgccaaactttt

SEQ ID NO: 676854 - DNA, 13 bp, D. melanogaster
tttgccaaagttt

SEQ ID NO: 676855 - DNA, 13 bp, D. melanogaster
tttgccaaataaa

SEQ ID NO: 676856 - DNA, 14 bp, D. melanogaster
tttgccaaataaat

SEQ ID NO: 676857 - DNA, 13 bp, D. melanogaster
tttgccaaataat

SEQ ID NO: 676858 - DNA, 13 bp, D. melanogaster
tttgccaaatatt

SEQ ID NO: 676859 - DNA, 13 bp, D. melanogaster
tttgccaaatgtt

SEQ ID NO: 676860 - DNA, 13 bp, D. melanogaster
tttgccaaattaa

SEQ ID NO: 676861 - DNA, 14 bp, D. melanogaster
tttgccaaattgaa

SEQ ID NO: 676862 - DNA, 13 bp, D. melanogaster
tttgccaaatttt

SEQ ID NO: 676863 - DNA, 13 bp, D. melanogaster
tttgccaacaaaa

SEQ ID NO: 676864 - DNA, 13 bp, D. melanogaster
tttgccaacaaat

SEQ ID NO: 676865 - DNA, 13 bp, D. melanogaster
tttgccaacagca

SEQ ID NO: 676866 - DNA, 13 bp, D. melanogaster
tttgccaacatgc

SEQ ID NO: 676867 - DNA, 14 bp, D. melanogaster
tttgccaacatgct

SEQ ID NO: 676868 - DNA, 14 bp, D. melanogaster
tttgccaacatttt

SEQ ID NO: 676869 - DNA, 13 bp, D. melanogaster
tttgccaaccttt

SEQ ID NO: 676870 - DNA, 13 bp, D. melanogaster
tttgccaactgca

SEQ ID NO: 676871 - DNA, 13 bp, D. melanogaster
tttgccaacttcc

SEQ ID NO: 676872 - DNA, 13 bp, D. melanogaster
tttgccaacttta

SEQ ID NO: 676873 - DNA, 13 bp, D. melanogaster
tttgccaactttt

SEQ ID NO: 676874 - DNA, 13 bp, D. melanogaster
tttgccaagcaaa

SEQ ID NO: 676875 - DNA, 13 bp, D. melanogaster
tttgccaagccaa

SEQ ID NO: 676876 - DNA, 13 bp, D. melanogaster
tttgccaaggtga

SEQ ID NO: 676877 - DNA, 13 bp, D. melanogaster
tttgccaagttta

SEQ ID NO: 676878 - DNA, 13 bp, D. melanogaster
tttgccaataatt

SEQ ID NO: 676879 - DNA, 13 bp, D. melanogaster
tttgccaatattt

SEQ ID NO: 676880 - DNA, 13 bp, D. melanogaster
tttgccaatcaaa

SEQ ID NO: 676881 - DNA, 13 bp, D. melanogaster
tttgccaatcatt

SEQ ID NO: 676882 - DNA, 13 bp, D. melanogaster
tttgccaatgcca

SEQ ID NO: 676883 - DNA, 13 bp, D. melanogaster
tttgccaattcaa

SEQ ID NO: 676884 - DNA, 13 bp, D. melanogaster
tttgccaattcct

SEQ ID NO: 676885 - DNA, 13 bp, D. melanogaster
tttgccaattgaa

SEQ ID NO: 676886 - DNA, 13 bp, D. melanogaster
tttgccaatttca

SEQ ID NO: 676887 - DNA, 14 bp, D. melanogaster
tttgccaatttcct

SEQ ID NO: 676888 - DNA, 13 bp, D. melanogaster
tttgccaatttct

SEQ ID NO: 676889 - DNA, 13 bp, D. melanogaster
tttgccaattttc

SEQ ID NO: 676890 - DNA, 13 bp, D. melanogaster
tttgccaattttt

SEQ ID NO: 676891 - DNA, 14 bp, D. melanogaster
tttgccaatttttc

SEQ ID NO: 676892 - DNA, 13 bp, D. melanogaster
tttgccacaaaac

SEQ ID NO: 676893 - DNA, 13 bp, D. melanogaster
tttgccacaaaat

SEQ ID NO: 676894 - DNA, 13 bp, D. melanogaster
tttgccacaaact

SEQ ID NO: 676895 - DNA, 14 bp, D. melanogaster
tttgccacaacttt

SEQ ID NO: 676896 - DNA, 13 bp, D. melanogaster
tttgccacaattt

SEQ ID NO: 676897 - DNA, 13 bp, D. melanogaster
tttgccacacaaa

SEQ ID NO: 676898 - DNA, 13 bp, D. melanogaster
tttgccacagttt

SEQ ID NO: 676899 - DNA, 13 bp, D. melanogaster
tttgccaccattt

SEQ ID NO: 676900 - DNA, 13 bp, D. melanogaster
tttgccacccact

SEQ ID NO: 676901 - DNA, 14 bp, D. melanogaster
tttgccacccactt

SEQ ID NO: 676902 - DNA, 13 bp, D. melanogaster
tttgccaccgcca

SEQ ID NO: 676903 - DNA, 14 bp, D. melanogaster
tttgccaccttctt

SEQ ID NO: 676904 - DNA, 14 bp, D. melanogaster
tttgccacgcccac

SEQ ID NO: 676905 - DNA, 13 bp, D. melanogaster
tttgccacgcccc

SEQ ID NO: 676906 - DNA, 14 bp, D. melanogaster
tttgccacgccccc

SEQ ID NO: 676907 - DNA, 13 bp, D. melanogaster
tttgccactcaat

SEQ ID NO: 676908 - DNA, 13 bp, D. melanogaster
tttgccactcgaa

SEQ ID NO: 676909 - DNA, 13 bp, D. melanogaster
tttgccactgaca

SEQ ID NO: 676910 - DNA, 13 bp, D. melanogaster
tttgccactgcaa

SEQ ID NO: 676911 - DNA, 13 bp, D. melanogaster
tttgccactgcca

SEQ ID NO: 676912 - DNA, 13 bp, D. melanogaster
tttgccactgttt

SEQ ID NO: 676913 - DNA, 13 bp, D. melanogaster
tttgccacttaaa

SEQ ID NO: 676914 - DNA, 13 bp, D. melanogaster
tttgccactttaa

SEQ ID NO: 676915 - DNA, 13 bp, D. melanogaster
tttgccactttgc

SEQ ID NO: 676916 - DNA, 13 bp, D. melanogaster
tttgccagagagc

SEQ ID NO: 676917 - DNA, 14 bp, D. melanogaster
tttgccagagagca

SEQ ID NO: 676918 - DNA, 13 bp, D. melanogaster
tttgccagcacaa

SEQ ID NO: 676919 - DNA, 13 bp, D. melanogaster
tttgccagcactt

SEQ ID NO: 676920 - DNA, 13 bp, D. melanogaster
tttgccagcattt

SEQ ID NO: 676921 - DNA, 13 bp, D. melanogaster
tttgccagccact

SEQ ID NO: 676922 - DNA, 13 bp, D. melanogaster
tttgccagccatt

SEQ ID NO: 676923 - DNA, 13 bp, D. melanogaster
tttgccagccgca

SEQ ID NO: 676924 - DNA, 13 bp, D. melanogaster
tttgccagcgaaa

SEQ ID NO: 676925 - DNA, 13 bp, D. melanogaster
tttgccagcgatt

SEQ ID NO: 676926 - DNA, 13 bp, D. melanogaster
tttgccagctatt

SEQ ID NO: 676927 - DNA, 13 bp, D. melanogaster
tttgccagctctt

SEQ ID NO: 676928 - DNA, 13 bp, D. melanogaster
tttgccagctgca

SEQ ID NO: 676929 - DNA, 13 bp, D. melanogaster
tttgccagctttt

SEQ ID NO: 676930 - DNA, 14 bp, D. melanogaster
tttgccagcttttt

SEQ ID NO: 676931 - DNA, 13 bp, D. melanogaster
tttgccagtgcag

SEQ ID NO: 676932 - DNA, 13 bp, D. melanogaster
tttgccagtgcat

SEQ ID NO: 676933 - DNA, 13 bp, D. melanogaster
tttgccagttggc

SEQ ID NO: 676934 - DNA, 13 bp, D. melanogaster
tttgccagtttgt

SEQ ID NO: 676935 - DNA, 13 bp, D. melanogaster
tttgccagttttt

SEQ ID NO: 676936 - DNA, 13 bp, D. melanogaster
tttgccataaaat

SEQ ID NO: 676937 - DNA, 13 bp, D. melanogaster
tttgccatacttt

SEQ ID NO: 676938 - DNA, 13 bp, D. melanogaster
tttgccatataaa

SEQ ID NO: 676939 - DNA, 13 bp, D. melanogaster
tttgccatattta

SEQ ID NO: 676940 - DNA, 13 bp, D. melanogaster
tttgccatatttc

SEQ ID NO: 676941 - DNA, 13 bp, D. melanogaster
tttgccatcaatt

SEQ ID NO: 676942 - DNA, 13 bp, D. melanogaster
tttgccatcattt

SEQ ID NO: 676943 - DNA, 13 bp, D. melanogaster
tttgccatcgcca

SEQ ID NO: 676944 - DNA, 13 bp, D. melanogaster
tttgccatcgctt

SEQ ID NO: 676945 - DNA, 13 bp, D. melanogaster
tttgccatctttt

SEQ ID NO: 676946 - DNA, 13 bp, D. melanogaster
tttgccatgaaaa

SEQ ID NO: 676947 - DNA, 13 bp, D. melanogaster
tttgccatgccca

SEQ ID NO: 676948 - DNA, 13 bp, D. melanogaster
tttgccattaaaa

SEQ ID NO: 676949 - DNA, 13 bp, D. melanogaster
tttgccattatta

SEQ ID NO: 676950 - DNA, 13 bp, D. melanogaster
tttgccattattg

SEQ ID NO: 676951 - DNA, 13 bp, D. melanogaster
tttgccattattt

SEQ ID NO: 676952 - DNA, 13 bp, D. melanogaster
tttgccattcaaa

SEQ ID NO: 676953 - DNA, 13 bp, D. melanogaster
tttgccattccat

SEQ ID NO: 676954 - DNA, 13 bp, D. melanogaster
tttgccattcgcc

SEQ ID NO: 676955 - DNA, 13 bp, D. melanogaster
tttgccattcgct

SEQ ID NO: 676956 - DNA, 13 bp, D. melanogaster
tttgccattcggc

SEQ ID NO: 676957 - DNA, 13 bp, D. melanogaster
tttgccattgaaa

SEQ ID NO: 676958 - DNA, 13 bp, D. melanogaster
tttgccattgaat

SEQ ID NO: 676959 - DNA, 13 bp, D. melanogaster
tttgccattgcaa

SEQ ID NO: 676960 - DNA, 13 bp, D. melanogaster
tttgccattgcca

SEQ ID NO: 676961 - DNA, 13 bp, D. melanogaster
tttgccattgtca

SEQ ID NO: 676962 - DNA, 13 bp, D. melanogaster
tttgccattgtgt

SEQ ID NO: 676963 - DNA, 13 bp, D. melanogaster
tttgccattgttg

SEQ ID NO: 676964 - DNA, 14 bp, D. melanogaster
tttgccattgttgt

SEQ ID NO: 676965 - DNA, 13 bp, D. melanogaster
tttgccatttaaa

SEQ ID NO: 676966 - DNA, 14 bp, D. melanogaster
tttgccatttaaat

SEQ ID NO: 676967 - DNA, 13 bp, D. melanogaster
tttgccatttaat

SEQ ID NO: 676968 - DNA, 13 bp, D. melanogaster
tttgccatttacc

SEQ ID NO: 676969 - DNA, 14 bp, D. melanogaster
tttgccatttacca

SEQ ID NO: 676970 - DNA, 13 bp, D. melanogaster
tttgccatttagc

SEQ ID NO: 676971 - DNA, 13 bp, D. melanogaster
tttgccatttcaa

SEQ ID NO: 676972 - DNA, 13 bp, D. melanogaster
tttgccatttcgt

SEQ ID NO: 676973 - DNA, 14 bp, D. melanogaster
tttgccatttgcat

SEQ ID NO: 676974 - DNA, 13 bp, D. melanogaster
tttgccatttgcc

SEQ ID NO: 676975 - DNA, 13 bp, D. melanogaster
tttgccatttgcg

SEQ ID NO: 676976 - DNA, 13 bp, D. melanogaster
tttgccatttgct

SEQ ID NO: 676977 - DNA, 13 bp, D. melanogaster
tttgccatttggg

SEQ ID NO: 676978 - DNA, 13 bp, D. melanogaster
tttgccatttgtt

SEQ ID NO: 676979 - DNA, 14 bp, D. melanogaster
tttgccatttgttt

SEQ ID NO: 676980 - DNA, 13 bp, D. melanogaster
tttgccattttat

SEQ ID NO: 676981 - DNA, 14 bp, D. melanogaster
tttgccattttata

SEQ ID NO: 676982 - DNA, 14 bp, D. melanogaster
tttgccattttatt

SEQ ID NO: 676983 - DNA, 13 bp, D. melanogaster
tttgccattttcc

SEQ ID NO: 676984 - DNA, 14 bp, D. melanogaster
tttgccattttcca

SEQ ID NO: 676985 - DNA, 13 bp, D. melanogaster
tttgccattttct

SEQ ID NO: 676986 - DNA, 13 bp, D. melanogaster
tttgccattttgc

SEQ ID NO: 676987 - DNA, 14 bp, D. melanogaster
tttgccattttgcc

SEQ ID NO: 676988 - DNA, 13 bp, D. melanogaster
tttgccattttgg

SEQ ID NO: 676989 - DNA, 13 bp, D. melanogaster
tttgccatttttc

SEQ ID NO: 676990 - DNA, 13 bp, D. melanogaster
tttgccatttttg

SEQ ID NO: 676991 - DNA, 13 bp, D. melanogaster
tttgcccaaaaaa

SEQ ID NO: 676992 - DNA, 13 bp, D. melanogaster
tttgcccaaaaac

SEQ ID NO: 676993 - DNA, 13 bp, D. melanogaster
tttgcccaaattt

SEQ ID NO: 676994 - DNA, 13 bp, D. melanogaster
tttgcccaaccat

SEQ ID NO: 676995 - DNA, 14 bp, D. melanogaster
tttgcccaaccatt

SEQ ID NO: 676996 - DNA, 13 bp, D. melanogaster
tttgcccaactaa

SEQ ID NO: 676997 - DNA, 13 bp, D. melanogaster
tttgcccaactac

SEQ ID NO: 676998 - DNA, 13 bp, D. melanogaster
tttgcccaacttt

SEQ ID NO: 676999 - DNA, 14 bp, D. melanogaster
tttgcccaatctgt

SEQ ID NO: 677000 - DNA, 13 bp, D. melanogaster
tttgcccacaaat

SEQ ID NO: 677001 - DNA, 13 bp, D. melanogaster
tttgcccaccatt

SEQ ID NO: 677002 - DNA, 13 bp, D. melanogaster
tttgcccacgtcc

SEQ ID NO: 677003 - DNA, 13 bp, D. melanogaster
tttgcccacgttt

SEQ ID NO: 677004 - DNA, 14 bp, D. melanogaster
tttgcccacgtttg

SEQ ID NO: 677005 - DNA, 13 bp, D. melanogaster
tttgcccactttt

SEQ ID NO: 677006 - DNA, 13 bp, D. melanogaster
tttgcccagcaaa

SEQ ID NO: 677007 - DNA, 13 bp, D. melanogaster
tttgcccagccaa

SEQ ID NO: 677008 - DNA, 13 bp, D. melanogaster
tttgcccagtgta

SEQ ID NO: 677009 - DNA, 13 bp, D. melanogaster
tttgcccagtttt

SEQ ID NO: 677010 - DNA, 13 bp, D. melanogaster
tttgcccataaaa

SEQ ID NO: 677011 - DNA, 13 bp, D. melanogaster
tttgcccatctct

SEQ ID NO: 677012 - DNA, 13 bp, D. melanogaster
tttgcccatgttt

SEQ ID NO: 677013 - DNA, 14 bp, D. melanogaster
tttgcccatgtttg

SEQ ID NO: 677014 - DNA, 14 bp, D. melanogaster
tttgcccattacca

SEQ ID NO: 677015 - DNA, 13 bp, D. melanogaster
tttgcccattgtt

SEQ ID NO: 677016 - DNA, 13 bp, D. melanogaster
tttgcccatttat

SEQ ID NO: 677017 - DNA, 13 bp, D. melanogaster
tttgcccatttgg

SEQ ID NO: 677018 - DNA, 13 bp, D. melanogaster
tttgcccattttg

SEQ ID NO: 677019 - DNA, 13 bp, D. melanogaster
tttgcccattttt

SEQ ID NO: 677020 - DNA, 13 bp, D. melanogaster
tttgccccaaaac

SEQ ID NO: 677021 - DNA, 13 bp, D. melanogaster
tttgccccactat

SEQ ID NO: 677022 - DNA, 13 bp, D. melanogaster
tttgccccactgt

SEQ ID NO: 677023 - DNA, 13 bp, D. melanogaster
tttgccccatctc

SEQ ID NO: 677024 - DNA, 13 bp, D. melanogaster
tttgccccgccca

SEQ ID NO: 677025 - DNA, 13 bp, D. melanogaster
tttgcccctttgc

SEQ ID NO: 677026 - DNA, 13 bp, D. melanogaster
tttgcccgtgatt

SEQ ID NO: 677027 - DNA, 13 bp, D. melanogaster
tttgccctcagcg

SEQ ID NO: 677028 - DNA, 13 bp, D. melanogaster
tttgccctgcttt

SEQ ID NO: 677029 - DNA, 13 bp, D. melanogaster
tttgccctttggc

SEQ ID NO: 677030 - DNA, 13 bp, D. melanogaster
tttgccgaaaaaa

SEQ ID NO: 677031 - DNA, 13 bp, D. melanogaster
tttgccgaaagtt

SEQ ID NO: 677032 - DNA, 13 bp, D. melanogaster
tttgccgataagg

SEQ ID NO: 677033 - DNA, 13 bp, D. melanogaster
tttgccgcaaatt

SEQ ID NO: 677034 - DNA, 13 bp, D. melanogaster
tttgccgcacaca

SEQ ID NO: 677035 - DNA, 13 bp, D. melanogaster
tttgccgcataaa

SEQ ID NO: 677036 - DNA, 13 bp, D. melanogaster
tttgccgccattt

SEQ ID NO: 677037 - DNA, 13 bp, D. melanogaster
tttgccgcgctgt

SEQ ID NO: 677038 - DNA, 13 bp, D. melanogaster
tttgccgctctgc

SEQ ID NO: 677039 - DNA, 13 bp, D. melanogaster
tttgccgctgcca

SEQ ID NO: 677040 - DNA, 13 bp, D. melanogaster
tttgccgctggca

SEQ ID NO: 677041 - DNA, 13 bp, D. melanogaster
tttgccgcttgcc

SEQ ID NO: 677042 - DNA, 13 bp, D. melanogaster
tttgccgcttttc

SEQ ID NO: 677043 - DNA, 13 bp, D. melanogaster
tttgccggatgac

SEQ ID NO: 677044 - DNA, 13 bp, D. melanogaster
tttgccggcaaac

SEQ ID NO: 677045 - DNA, 13 bp, D. melanogaster
tttgccggcaatt

SEQ ID NO: 677046 - DNA, 13 bp, D. melanogaster
tttgccggcattt

SEQ ID NO: 677047 - DNA, 13 bp, D. melanogaster
tttgccggccaaa

SEQ ID NO: 677048 - DNA, 13 bp, D. melanogaster
tttgccggctgtc

SEQ ID NO: 677049 - DNA, 13 bp, D. melanogaster
tttgccggctgtt

SEQ ID NO: 677050 - DNA, 13 bp, D. melanogaster
tttgccggctttc

SEQ ID NO: 677051 - DNA, 13 bp, D. melanogaster
tttgccgggcaaa

SEQ ID NO: 677052 - DNA, 13 bp, D. melanogaster
tttgccgtaattt

SEQ ID NO: 677053 - DNA, 13 bp, D. melanogaster
tttgccgttgcca

SEQ ID NO: 677054 - DNA, 13 bp, D. melanogaster
tttgccgtttgcc

SEQ ID NO: 677055 - DNA, 13 bp, D. melanogaster
tttgcctaattaa

SEQ ID NO: 677056 - DNA, 13 bp, D. melanogaster
tttgcctataaat

SEQ ID NO: 677057 - DNA, 13 bp, D. melanogaster
tttgcctcagcaa

SEQ ID NO: 677058 - DNA, 13 bp, D. melanogaster
tttgcctcatttt

SEQ ID NO: 677059 - DNA, 13 bp, D. melanogaster
tttgcctccgttt

SEQ ID NO: 677060 - DNA, 13 bp, D. melanogaster
tttgcctcctttg

SEQ ID NO: 677061 - DNA, 13 bp, D. melanogaster
tttgcctcgcttt

SEQ ID NO: 677062 - DNA, 13 bp, D. melanogaster
tttgcctctgctt

SEQ ID NO: 677063 - DNA, 13 bp, D. melanogaster
tttgcctgcaaat

SEQ ID NO: 677064 - DNA, 13 bp, D. melanogaster
tttgcctgcattt

SEQ ID NO: 677065 - DNA, 13 bp, D. melanogaster
tttgcctgccaaa

SEQ ID NO: 677066 - DNA, 13 bp, D. melanogaster
tttgcctgccaca

SEQ ID NO: 677067 - DNA, 13 bp, D. melanogaster
tttgcctggccaa

SEQ ID NO: 677068 - DNA, 13 bp, D. melanogaster
tttgccttaattt

SEQ ID NO: 677069 - DNA, 14 bp, D. melanogaster
tttgccttaatttt

SEQ ID NO: 677070 - DNA, 13 bp, D. melanogaster
tttgccttcatca

SEQ ID NO: 677071 - DNA, 13 bp, D. melanogaster
tttgccttcattt

SEQ ID NO: 677072 - DNA, 13 bp, D. melanogaster
tttgccttcgagt

SEQ ID NO: 677073 - DNA, 13 bp, D. melanogaster
tttgccttcgatt

SEQ ID NO: 677074 - DNA, 13 bp, D. melanogaster
tttgccttcgcct

SEQ ID NO: 677075 - DNA, 13 bp, D. melanogaster
tttgccttgccat

SEQ ID NO: 677076 - DNA, 13 bp, D. melanogaster
tttgccttgcctt

SEQ ID NO: 677077 - DNA, 13 bp, D. melanogaster
tttgccttgcgaa

SEQ ID NO: 677078 - DNA, 13 bp, D. melanogaster
tttgccttggcca

SEQ ID NO: 677079 - DNA, 14 bp, D. melanogaster
tttgccttggcttt

SEQ ID NO: 677080 - DNA, 13 bp, D. melanogaster
tttgccttgtcta

SEQ ID NO: 677081 - DNA, 14 bp, D. melanogaster
tttgccttgtctaa

SEQ ID NO: 677082 - DNA, 13 bp, D. melanogaster
tttgcctttcaat

SEQ ID NO: 677083 - DNA, 13 bp, D. melanogaster
tttgcctttcgcc

SEQ ID NO: 677084 - DNA, 13 bp, D. melanogaster
tttgcctttctgc

SEQ ID NO: 677085 - DNA, 13 bp, D. melanogaster
tttgcctttgatt

SEQ ID NO: 677086 - DNA, 14 bp, D. melanogaster
tttgcctttgccat

SEQ ID NO: 677087 - DNA, 13 bp, D. melanogaster
tttgcctttgcct

SEQ ID NO: 677088 - DNA, 13 bp, D. melanogaster
tttgcctttgcta

SEQ ID NO: 677089 - DNA, 13 bp, D. melanogaster
tttgcctttgctg

SEQ ID NO: 677090 - DNA, 13 bp, D. melanogaster
tttgcctttggct

SEQ ID NO: 677091 - DNA, 13 bp, D. melanogaster
tttgcctttgtgc

SEQ ID NO: 677092 - DNA, 14 bp, D. melanogaster
tttgcctttgtgcc

SEQ ID NO: 677093 - DNA, 14 bp, D. melanogaster
tttgccttttaatt

SEQ ID NO: 677094 - DNA, 13 bp, D. melanogaster
tttgccttttgat

SEQ ID NO: 677095 - DNA, 13 bp, D. melanogaster
tttgccttttgcc

SEQ ID NO: 677096 - DNA, 13 bp, D. melanogaster
tttgccttttggc

SEQ ID NO: 677097 - DNA, 13 bp, D. melanogaster
tttgcctttttaa

SEQ ID NO: 677098 - DNA, 13 bp, D. melanogaster
tttgcgaaaacaa

SEQ ID NO: 677099 - DNA, 13 bp, D. melanogaster
tttgcgaaacttt

SEQ ID NO: 677100 - DNA, 13 bp, D. melanogaster
tttgcgaaattat

SEQ ID NO: 677101 - DNA, 13 bp, D. melanogaster
tttgcgaatattt

SEQ ID NO: 677102 - DNA, 13 bp, D. melanogaster
tttgcgaatttat

SEQ ID NO: 677103 - DNA, 13 bp, D. melanogaster
tttgcgaattttt

SEQ ID NO: 677104 - DNA, 13 bp, D. melanogaster
tttgcgacatttg

SEQ ID NO: 677105 - DNA, 13 bp, D. melanogaster
tttgcgactgttt

SEQ ID NO: 677106 - DNA, 13 bp, D. melanogaster
tttgcgagcagtt

SEQ ID NO: 677107 - DNA, 13 bp, D. melanogaster
tttgcgagtgtgt

SEQ ID NO: 677108 - DNA, 13 bp, D. melanogaster
tttgcgataaaaa

SEQ ID NO: 677109 - DNA, 13 bp, D. melanogaster
tttgcgataataa

SEQ ID NO: 677110 - DNA, 13 bp, D. melanogaster
tttgcgatctgcc

SEQ ID NO: 677111 - DNA, 13 bp, D. melanogaster
tttgcgatttaaa

SEQ ID NO: 677112 - DNA, 13 bp, D. melanogaster
tttgcgatttgtt

SEQ ID NO: 677113 - DNA, 13 bp, D. melanogaster
tttgcgcaaaaat

SEQ ID NO: 677114 - DNA, 13 bp, D. melanogaster
tttgcgcaagtgg

SEQ ID NO: 677115 - DNA, 13 bp, D. melanogaster
tttgcgcaatttt

SEQ ID NO: 677116 - DNA, 13 bp, D. melanogaster
tttgcgcactttt

SEQ ID NO: 677117 - DNA, 13 bp, D. melanogaster
tttgcgcataaat

SEQ ID NO: 677118 - DNA, 13 bp, D. melanogaster
tttgcgcatattt

SEQ ID NO: 677119 - DNA, 14 bp, D. melanogaster
tttgcgcatgcgca

SEQ ID NO: 677120 - DNA, 13 bp, D. melanogaster
tttgcgcattttt

SEQ ID NO: 677121 - DNA, 13 bp, D. melanogaster
tttgcgccacttt

SEQ ID NO: 677122 - DNA, 13 bp, D. melanogaster
tttgcgccataaa

SEQ ID NO: 677123 - DNA, 13 bp, D. melanogaster
tttgcgcccattt

SEQ ID NO: 677124 - DNA, 13 bp, D. melanogaster
tttgcgccgcatg

SEQ ID NO: 677125 - DNA, 13 bp, D. melanogaster
tttgcgctcggca

SEQ ID NO: 677126 - DNA, 13 bp, D. melanogaster
tttgcgctgtgcc

SEQ ID NO: 677127 - DNA, 13 bp, D. melanogaster
tttgcggaaaatc

SEQ ID NO: 677128 - DNA, 14 bp, D. melanogaster
tttgcggaaaatca

SEQ ID NO: 677129 - DNA, 13 bp, D. melanogaster
tttgcggcaaatt

SEQ ID NO: 677130 - DNA, 13 bp, D. melanogaster
tttgcggcaattt

SEQ ID NO: 677131 - DNA, 13 bp, D. melanogaster
tttgcggctgcca

SEQ ID NO: 677132 - DNA, 13 bp, D. melanogaster
tttgcggctgcct

SEQ ID NO: 677133 - DNA, 13 bp, D. melanogaster
tttgcggctgctt

SEQ ID NO: 677134 - DNA, 13 bp, D. melanogaster
tttgcggctttgc

SEQ ID NO: 677135 - DNA, 13 bp, D. melanogaster
tttgcggttggca

SEQ ID NO: 677136 - DNA, 13 bp, D. melanogaster
tttgcggtttgcc

SEQ ID NO: 677137 - DNA, 13 bp, D. melanogaster
tttgcggttttgc

SEQ ID NO: 677138 - DNA, 13 bp, D. melanogaster
tttgcggttttta

SEQ ID NO: 677139 - DNA, 13 bp, D. melanogaster
tttgcgtaaacaa

SEQ ID NO: 677140 - DNA, 13 bp, D. melanogaster
tttgcgtacattt

SEQ ID NO: 677141 - DNA, 13 bp, D. melanogaster
tttgcgtatatat

SEQ ID NO: 677142 - DNA, 13 bp, D. melanogaster
tttgcgttcattt

SEQ ID NO: 677143 - DNA, 13 bp, D. melanogaster
tttgcgttcgcat

SEQ ID NO: 677144 - DNA, 13 bp, D. melanogaster
tttgcgttgattt

SEQ ID NO: 677145 - DNA, 13 bp, D. melanogaster
tttgcgttgtata

SEQ ID NO: 677146 - DNA, 13 bp, D. melanogaster
tttgcgtttgcaa

SEQ ID NO: 677147 - DNA, 13 bp, D. melanogaster
tttgcgtttgcct

SEQ ID NO: 677148 - DNA, 13 bp, D. melanogaster
tttgcgttttaat

SEQ ID NO: 677149 - DNA, 13 bp, D. melanogaster
tttgcgttttgcc

SEQ ID NO: 677150 - DNA, 13 bp, D. melanogaster
tttgcgtttttaa

SEQ ID NO: 677151 - DNA, 13 bp, D. melanogaster
tttgcgtttttca

SEQ ID NO: 677152 - DNA, 13 bp, D. melanogaster
tttgctaaaaaat

SEQ ID NO: 677153 - DNA, 13 bp, D. melanogaster
tttgctaaaatat

SEQ ID NO: 677154 - DNA, 13 bp, D. melanogaster
tttgctaaatgtt

SEQ ID NO: 677155 - DNA, 13 bp, D. melanogaster
tttgctaacaaat

SEQ ID NO: 677156 - DNA, 13 bp, D. melanogaster
tttgctaacattt

SEQ ID NO: 677157 - DNA, 13 bp, D. melanogaster
tttgctaaccaaa

SEQ ID NO: 677158 - DNA, 13 bp, D. melanogaster
tttgctaacgttt

SEQ ID NO: 677159 - DNA, 14 bp, D. melanogaster
tttgctaacgtttt

SEQ ID NO: 677160 - DNA, 13 bp, D. melanogaster
tttgctaagcgtt

SEQ ID NO: 677161 - DNA, 13 bp, D. melanogaster
tttgctaatattt

SEQ ID NO: 677162 - DNA, 13 bp, D. melanogaster
tttgctaattaaa

SEQ ID NO: 677163 - DNA, 13 bp, D. melanogaster
tttgctaattatt

SEQ ID NO: 677164 - DNA, 14 bp, D. melanogaster
tttgctaatttatt

SEQ ID NO: 677165 - DNA, 13 bp, D. melanogaster
tttgctaattttc

SEQ ID NO: 677166 - DNA, 13 bp, D. melanogaster
tttgctaattttg

SEQ ID NO: 677167 - DNA, 13 bp, D. melanogaster
tttgctacacttt

SEQ ID NO: 677168 - DNA, 13 bp, D. melanogaster
tttgctactgaca

SEQ ID NO: 677169 - DNA, 13 bp, D. melanogaster
tttgctagcaaaa

SEQ ID NO: 677170 - DNA, 13 bp, D. melanogaster
tttgctagcattt

SEQ ID NO: 677171 - DNA, 13 bp, D. melanogaster
tttgctagctatt

SEQ ID NO: 677172 - DNA, 13 bp, D. melanogaster
tttgctataacaa

SEQ ID NO: 677173 - DNA, 13 bp, D. melanogaster
tttgctatattta

SEQ ID NO: 677174 - DNA, 14 bp, D. melanogaster
tttgctatgctaat

SEQ ID NO: 677175 - DNA, 13 bp, D. melanogaster
tttgctatgcttt

SEQ ID NO: 677176 - DNA, 13 bp, D. melanogaster
tttgctatttaaa

SEQ ID NO: 677177 - DNA, 13 bp, D. melanogaster
tttgctcaaaaaa

SEQ ID NO: 677178 - DNA, 13 bp, D. melanogaster
tttgctcaaaata

SEQ ID NO: 677179 - DNA, 13 bp, D. melanogaster
tttgctcaaatat

SEQ ID NO: 677180 - DNA, 13 bp, D. melanogaster
tttgctcaacttt

SEQ ID NO: 677181 - DNA, 13 bp, D. melanogaster
tttgctcaagtgc

SEQ ID NO: 677182 - DNA, 13 bp, D. melanogaster
tttgctcaataaa

SEQ ID NO: 677183 - DNA, 13 bp, D. melanogaster
tttgctcaatcgc

SEQ ID NO: 677184 - DNA, 13 bp, D. melanogaster
tttgctcaatttt

SEQ ID NO: 677185 - DNA, 14 bp, D. melanogaster
tttgctcaattttt

SEQ ID NO: 677186 - DNA, 13 bp, D. melanogaster
tttgctcacattt

SEQ ID NO: 677187 - DNA, 13 bp, D. melanogaster
tttgctcactttg

SEQ ID NO: 677188 - DNA, 13 bp, D. melanogaster
tttgctcactttt

SEQ ID NO: 677189 - DNA, 13 bp, D. melanogaster
tttgctcagtgca

SEQ ID NO: 677190 - DNA, 13 bp, D. melanogaster
tttgctcatattt

SEQ ID NO: 677191 - DNA, 14 bp, D. melanogaster
tttgctcatgaaaa

SEQ ID NO: 677192 - DNA, 13 bp, D. melanogaster
tttgctcatttcc

SEQ ID NO: 677193 - DNA, 13 bp, D. melanogaster
tttgctccacttt

SEQ ID NO: 677194 - DNA, 13 bp, D. melanogaster
tttgctccatttt

SEQ ID NO: 677195 - DNA, 13 bp, D. melanogaster
tttgctcctttgc

SEQ ID NO: 677196 - DNA, 13 bp, D. melanogaster
tttgctcgaccaa

SEQ ID NO: 677197 - DNA, 13 bp, D. melanogaster
tttgctcgatttt

SEQ ID NO: 677198 - DNA, 13 bp, D. melanogaster
tttgctcgcattt

SEQ ID NO: 677199 - DNA, 13 bp, D. melanogaster
tttgctctcccgt

SEQ ID NO: 677200 - DNA, 13 bp, D. melanogaster
tttgctctgtgca

SEQ ID NO: 677201 - DNA, 13 bp, D. melanogaster
tttgctcttcatt

SEQ ID NO: 677202 - DNA, 13 bp, D. melanogaster
tttgctcttggcc

SEQ ID NO: 677203 - DNA, 13 bp, D. melanogaster
tttgctctttgcc

SEQ ID NO: 677204 - DNA, 13 bp, D. melanogaster
tttgctcttttca

SEQ ID NO: 677205 - DNA, 13 bp, D. melanogaster
tttgctgaaaaaa

SEQ ID NO: 677206 - DNA, 13 bp, D. melanogaster
tttgctgaacttt

SEQ ID NO: 677207 - DNA, 13 bp, D. melanogaster
tttgctgaagcat

SEQ ID NO: 677208 - DNA, 13 bp, D. melanogaster
tttgctgaagtct

SEQ ID NO: 677209 - DNA, 13 bp, D. melanogaster
tttgctgaatttt

SEQ ID NO: 677210 - DNA, 13 bp, D. melanogaster
tttgctgagcgcc

SEQ ID NO: 677211 - DNA, 13 bp, D. melanogaster
tttgctgcaagac

SEQ ID NO: 677212 - DNA, 13 bp, D. melanogaster
tttgctgcaattt

SEQ ID NO: 677213 - DNA, 13 bp, D. melanogaster
tttgctgcacttc

SEQ ID NO: 677214 - DNA, 13 bp, D. melanogaster
tttgctgcagttg

SEQ ID NO: 677215 - DNA, 13 bp, D. melanogaster
tttgctgcagttt

SEQ ID NO: 677216 - DNA, 14 bp, D. melanogaster
tttgctgcatactt

SEQ ID NO: 677217 - DNA, 14 bp, D. melanogaster
tttgctgcatttgc

SEQ ID NO: 677218 - DNA, 13 bp, D. melanogaster
tttgctgccaatt

SEQ ID NO: 677219 - DNA, 13 bp, D. melanogaster
tttgctgccacac

SEQ ID NO: 677220 - DNA, 13 bp, D. melanogaster
tttgctgcctgcc

SEQ ID NO: 677221 - DNA, 13 bp, D. melanogaster
tttgctgcctggc

SEQ ID NO: 677222 - DNA, 13 bp, D. melanogaster
tttgctgcctttg

SEQ ID NO: 677223 - DNA, 13 bp, D. melanogaster
tttgctgcgattg

SEQ ID NO: 677224 - DNA, 13 bp, D. melanogaster
tttgctgcggttt

SEQ ID NO: 677225 - DNA, 13 bp, D. melanogaster
tttgctgctcaaa

SEQ ID NO: 677226 - DNA, 13 bp, D. melanogaster
tttgctgctcctg

SEQ ID NO: 677227 - DNA, 13 bp, D. melanogaster
tttgctgctcggc

SEQ ID NO: 677228 - DNA, 13 bp, D. melanogaster
tttgctgctctgc

SEQ ID NO: 677229 - DNA, 13 bp, D. melanogaster
tttgctgctcttg

SEQ ID NO: 677230 - DNA, 13 bp, D. melanogaster
tttgctgctgcca

SEQ ID NO: 677231 - DNA, 13 bp, D. melanogaster
tttgctgctgctg

SEQ ID NO: 677232 - DNA, 13 bp, D. melanogaster
tttgctggaaatt

SEQ ID NO: 677233 - DNA, 13 bp, D. melanogaster
tttgctggagcgt

SEQ ID NO: 677234 - DNA, 13 bp, D. melanogaster
tttgctggatttt

SEQ ID NO: 677235 - DNA, 13 bp, D. melanogaster
tttgctggccaaa

SEQ ID NO: 677236 - DNA, 13 bp, D. melanogaster
tttgctggccaac

SEQ ID NO: 677237 - DNA, 14 bp, D. melanogaster
tttgctggccataa

SEQ ID NO: 677238 - DNA, 13 bp, D. melanogaster
tttgctggccatc

SEQ ID NO: 677239 - DNA, 14 bp, D. melanogaster
tttgctggccattt

SEQ ID NO: 677240 - DNA, 13 bp, D. melanogaster
tttgctggcgaaa

SEQ ID NO: 677241 - DNA, 13 bp, D. melanogaster
tttgctggcgttt

SEQ ID NO: 677242 - DNA, 13 bp, D. melanogaster
tttgctggctaaa

SEQ ID NO: 677243 - DNA, 13 bp, D. melanogaster
tttgctggctgcc

SEQ ID NO: 677244 - DNA, 13 bp, D. melanogaster
tttgctggctggc

SEQ ID NO: 677245 - DNA, 13 bp, D. melanogaster
tttgctggctgtt

SEQ ID NO: 677246 - DNA, 13 bp, D. melanogaster
tttgctggctttc

SEQ ID NO: 677247 - DNA, 13 bp, D. melanogaster
tttgctgggcaaa

SEQ ID NO: 677248 - DNA, 13 bp, D. melanogaster
tttgctggtgtta

SEQ ID NO: 677249 - DNA, 13 bp, D. melanogaster
tttgctgtaggga

SEQ ID NO: 677250 - DNA, 14 bp, D. melanogaster
tttgctgtagggat

SEQ ID NO: 677251 - DNA, 13 bp, D. melanogaster
tttgctgtcagtt

SEQ ID NO: 677252 - DNA, 13 bp, D. melanogaster
tttgctgtcattt

SEQ ID NO: 677253 - DNA, 13 bp, D. melanogaster
tttgctgtcgctg

SEQ ID NO: 677254 - DNA, 13 bp, D. melanogaster
tttgctgtgattt

SEQ ID NO: 677255 - DNA, 13 bp, D. melanogaster
tttgctgtgcaaa

SEQ ID NO: 677256 - DNA, 13 bp, D. melanogaster
tttgctgtgcgac

SEQ ID NO: 677257 - DNA, 13 bp, D. melanogaster
tttgctgtgtaaa

SEQ ID NO: 677258 - DNA, 13 bp, D. melanogaster
tttgctgttgcca

SEQ ID NO: 677259 - DNA, 13 bp, D. melanogaster
tttgctgttgctg

SEQ ID NO: 677260 - DNA, 13 bp, D. melanogaster
tttgctgttggcc

SEQ ID NO: 677261 - DNA, 13 bp, D. melanogaster
tttgctgtttaat

SEQ ID NO: 677262 - DNA, 13 bp, D. melanogaster
tttgctgtttgca

SEQ ID NO: 677263 - DNA, 13 bp, D. melanogaster
tttgctgtttgcc

SEQ ID NO: 677264 - DNA, 13 bp, D. melanogaster
tttgctgttttca

SEQ ID NO: 677265 - DNA, 13 bp, D. melanogaster
tttgcttaaaact

SEQ ID NO: 677266 - DNA, 13 bp, D. melanogaster
tttgcttaaagtt

SEQ ID NO: 677267 - DNA, 14 bp, D. melanogaster
tttgcttaactttt

SEQ ID NO: 677268 - DNA, 13 bp, D. melanogaster
tttgcttaattaa

SEQ ID NO: 677269 - DNA, 14 bp, D. melanogaster
tttgcttaattaaa

SEQ ID NO: 677270 - DNA, 13 bp, D. melanogaster
tttgcttacaaaa

SEQ ID NO: 677271 - DNA, 13 bp, D. melanogaster
tttgcttacacat

SEQ ID NO: 677272 - DNA, 13 bp, D. melanogaster
tttgcttacataa

SEQ ID NO: 677273 - DNA, 13 bp, D. melanogaster
tttgcttacattt

SEQ ID NO: 677274 - DNA, 13 bp, D. melanogaster
tttgcttagcaaa

SEQ ID NO: 677275 - DNA, 13 bp, D. melanogaster
tttgcttagcatt

SEQ ID NO: 677276 - DNA, 13 bp, D. melanogaster
tttgcttagccaa

SEQ ID NO: 677277 - DNA, 13 bp, D. melanogaster
tttgcttatcagc

SEQ ID NO: 677278 - DNA, 13 bp, D. melanogaster
tttgcttatctaa

SEQ ID NO: 677279 - DNA, 13 bp, D. melanogaster
tttgcttattgaa

SEQ ID NO: 677280 - DNA, 13 bp, D. melanogaster
tttgcttattgga

SEQ ID NO: 677281 - DNA, 13 bp, D. melanogaster
tttgcttatttgc

SEQ ID NO: 677282 - DNA, 14 bp, D. melanogaster
tttgcttatttgca

SEQ ID NO: 677283 - DNA, 13 bp, D. melanogaster
tttgcttcacttt

SEQ ID NO: 677284 - DNA, 13 bp, D. melanogaster
tttgcttcgattt

SEQ ID NO: 677285 - DNA, 13 bp, D. melanogaster
tttgcttcggaca

SEQ ID NO: 677286 - DNA, 13 bp, D. melanogaster
tttgcttctgcta

SEQ ID NO: 677287 - DNA, 13 bp, D. melanogaster
tttgcttctggct

SEQ ID NO: 677288 - DNA, 13 bp, D. melanogaster
tttgcttgacttt

SEQ ID NO: 677289 - DNA, 13 bp, D. melanogaster
tttgcttgcaaat

SEQ ID NO: 677290 - DNA, 13 bp, D. melanogaster
tttgcttgccaaa

SEQ ID NO: 677291 - DNA, 13 bp, D. melanogaster
tttgcttggattt

SEQ ID NO: 677292 - DNA, 13 bp, D. melanogaster
tttgcttgtcaaa

SEQ ID NO: 677293 - DNA, 13 bp, D. melanogaster
tttgcttgtgaga

SEQ ID NO: 677294 - DNA, 13 bp, D. melanogaster
tttgcttgtgtgc

SEQ ID NO: 677295 - DNA, 13 bp, D. melanogaster
tttgctttaaaat

SEQ ID NO: 677296 - DNA, 14 bp, D. melanogaster
tttgctttaaaatt

SEQ ID NO: 677297 - DNA, 13 bp, D. melanogaster
tttgctttaaact

SEQ ID NO: 677298 - DNA, 13 bp, D. melanogaster
tttgctttaaatt

SEQ ID NO: 677299 - DNA, 13 bp, D. melanogaster
tttgctttaatta

SEQ ID NO: 677300 - DNA, 14 bp, D. melanogaster
tttgctttaattat

SEQ ID NO: 677301 - DNA, 13 bp, D. melanogaster
tttgctttagctt

SEQ ID NO: 677302 - DNA, 13 bp, D. melanogaster
tttgctttattgc

SEQ ID NO: 677303 - DNA, 13 bp, D. melanogaster
tttgctttcaaat

SEQ ID NO: 677304 - DNA, 13 bp, D. melanogaster
tttgctttcaatt

SEQ ID NO: 677305 - DNA, 13 bp, D. melanogaster
tttgctttcactt

SEQ ID NO: 677306 - DNA, 13 bp, D. melanogaster
tttgctttcagct

SEQ ID NO: 677307 - DNA, 13 bp, D. melanogaster
tttgctttcagtt

SEQ ID NO: 677308 - DNA, 13 bp, D. melanogaster
tttgctttcattc

SEQ ID NO: 677309 - DNA, 14 bp, D. melanogaster
tttgctttcatttc

SEQ ID NO: 677310 - DNA, 14 bp, D. melanogaster
tttgctttccattt

SEQ ID NO: 677311 - DNA, 13 bp, D. melanogaster
tttgctttcgaaa

SEQ ID NO: 677312 - DNA, 13 bp, D. melanogaster
tttgctttctgcc

SEQ ID NO: 677313 - DNA, 13 bp, D. melanogaster
tttgctttgaaat

SEQ ID NO: 677314 - DNA, 14 bp, D. melanogaster
tttgctttgacatt

SEQ ID NO: 677315 - DNA, 13 bp, D. melanogaster
tttgctttgagca

SEQ ID NO: 677316 - DNA, 13 bp, D. melanogaster
tttgctttgatta

SEQ ID NO: 677317 - DNA, 13 bp, D. melanogaster
tttgctttgcaaa

SEQ ID NO: 677318 - DNA, 13 bp, D. melanogaster
tttgctttgcata

SEQ ID NO: 677319 - DNA, 13 bp, D. melanogaster
tttgctttgcatt

SEQ ID NO: 677320 - DNA, 14 bp, D. melanogaster
tttgctttgcattt

SEQ ID NO: 677321 - DNA, 13 bp, D. melanogaster
tttgctttgcctc

SEQ ID NO: 677322 - DNA, 13 bp, D. melanogaster
tttgctttgctaa

SEQ ID NO: 677323 - DNA, 13 bp, D. melanogaster
tttgctttggcaa

SEQ ID NO: 677324 - DNA, 14 bp, D. melanogaster
tttgctttggccca

SEQ ID NO: 677325 - DNA, 13 bp, D. melanogaster
tttgctttggctc

SEQ ID NO: 677326 - DNA, 13 bp, D. melanogaster
tttgctttggctg

SEQ ID NO: 677327 - DNA, 13 bp, D. melanogaster
tttgctttgtggc

SEQ ID NO: 677328 - DNA, 13 bp, D. melanogaster
tttgctttgttca

SEQ ID NO: 677329 - DNA, 13 bp, D. melanogaster
tttgcttttaaaa

SEQ ID NO: 677330 - DNA, 13 bp, D. melanogaster
tttgcttttaaag

SEQ ID NO: 677331 - DNA, 13 bp, D. melanogaster
tttgcttttaaat

SEQ ID NO: 677332 - DNA, 13 bp, D. melanogaster
tttgcttttaata

SEQ ID NO: 677333 - DNA, 13 bp, D. melanogaster
tttgcttttaatg

SEQ ID NO: 677334 - DNA, 13 bp, D. melanogaster
tttgcttttatga

SEQ ID NO: 677335 - DNA, 13 bp, D. melanogaster
tttgcttttcaaa

SEQ ID NO: 677336 - DNA, 13 bp, D. melanogaster
tttgcttttccaa

SEQ ID NO: 677337 - DNA, 13 bp, D. melanogaster
tttgcttttccca

SEQ ID NO: 677338 - DNA, 13 bp, D. melanogaster
tttgcttttctca

SEQ ID NO: 677339 - DNA, 13 bp, D. melanogaster
tttgcttttgata

SEQ ID NO: 677340 - DNA, 13 bp, D. melanogaster
tttgcttttgcaa

SEQ ID NO: 677341 - DNA, 14 bp, D. melanogaster
tttgcttttggcct

SEQ ID NO: 677342 - DNA, 14 bp, D. melanogaster
tttgctttttctaa

SEQ ID NO: 677343 - DNA, 13 bp, D. melanogaster
tttggaaaaacaa

SEQ ID NO: 677344 - DNA, 13 bp, D. melanogaster
tttggaaaaagtt

SEQ ID NO: 677345 - DNA, 13 bp, D. melanogaster
tttggaaaacaat

SEQ ID NO: 677346 - DNA, 13 bp, D. melanogaster
tttggaaaaccaa

SEQ ID NO: 677347 - DNA, 14 bp, D. melanogaster
tttggaaaactttt

SEQ ID NO: 677348 - DNA, 13 bp, D. melanogaster
tttggaaaagatg

SEQ ID NO: 677349 - DNA, 14 bp, D. melanogaster
tttggaaaagatgt

SEQ ID NO: 677350 - DNA, 13 bp, D. melanogaster
tttggaaaagtgc

SEQ ID NO: 677351 - DNA, 13 bp, D. melanogaster
tttggaaaagtgg

SEQ ID NO: 677352 - DNA, 13 bp, D. melanogaster
tttggaaaagttg

SEQ ID NO: 677353 - DNA, 13 bp, D. melanogaster
tttggaaaataaa

SEQ ID NO: 677354 - DNA, 13 bp, D. melanogaster
tttggaaaatata

SEQ ID NO: 677355 - DNA, 13 bp, D. melanogaster
tttggaaaatatt

SEQ ID NO: 677356 - DNA, 14 bp, D. melanogaster
tttggaaaatattt

SEQ ID NO: 677357 - DNA, 13 bp, D. melanogaster
tttggaaaatcat

SEQ ID NO: 677358 - DNA, 13 bp, D. melanogaster
tttggaaaatctt

SEQ ID NO: 677359 - DNA, 13 bp, D. melanogaster
tttggaaaatgca

SEQ ID NO: 677360 - DNA, 14 bp, D. melanogaster
tttggaaaatgcat

SEQ ID NO: 677361 - DNA, 13 bp, D. melanogaster
tttggaaaatgcc

SEQ ID NO: 677362 - DNA, 13 bp, D. melanogaster
tttggaaaatggt

SEQ ID NO: 677363 - DNA, 13 bp, D. melanogaster
tttggaaaatgtt

SEQ ID NO: 677364 - DNA, 13 bp, D. melanogaster
tttggaaaattaa

SEQ ID NO: 677365 - DNA, 14 bp, D. melanogaster
tttggaaaattaat

SEQ ID NO: 677366 - DNA, 13 bp, D. melanogaster
tttggaaaattat

SEQ ID NO: 677367 - DNA, 13 bp, D. melanogaster
tttggaaaattgc

SEQ ID NO: 677368 - DNA, 14 bp, D. melanogaster
tttggaaaatttat

SEQ ID NO: 677369 - DNA, 13 bp, D. melanogaster
tttggaaactttt

SEQ ID NO: 677370 - DNA, 13 bp, D. melanogaster
tttggaaagaagt

SEQ ID NO: 677371 - DNA, 13 bp, D. melanogaster
tttggaaagaatt

SEQ ID NO: 677372 - DNA, 13 bp, D. melanogaster
tttggaaagcaaa

SEQ ID NO: 677373 - DNA, 13 bp, D. melanogaster
tttggaaagtttt

SEQ ID NO: 677374 - DNA, 13 bp, D. melanogaster
tttggaaataaat

SEQ ID NO: 677375 - DNA, 13 bp, D. melanogaster
tttggaaatataa

SEQ ID NO: 677376 - DNA, 13 bp, D. melanogaster
tttggaaatatat

SEQ ID NO: 677377 - DNA, 13 bp, D. melanogaster
tttggaaatattc

SEQ ID NO: 677378 - DNA, 14 bp, D. melanogaster
tttggaaatatttt

SEQ ID NO: 677379 - DNA, 13 bp, D. melanogaster
tttggaaatcatt

SEQ ID NO: 677380 - DNA, 13 bp, D. melanogaster
tttggaaatgaaa

SEQ ID NO: 677381 - DNA, 13 bp, D. melanogaster
tttggaaatggaa

SEQ ID NO: 677382 - DNA, 14 bp, D. melanogaster
tttggaaatggaaa

SEQ ID NO: 677383 - DNA, 13 bp, D. melanogaster
tttggaaatggct

SEQ ID NO: 677384 - DNA, 13 bp, D. melanogaster
tttggaaattaga

SEQ ID NO: 677385 - DNA, 13 bp, D. melanogaster
tttggaaattata

SEQ ID NO: 677386 - DNA, 13 bp, D. melanogaster
tttggaaattatt

SEQ ID NO: 677387 - DNA, 13 bp, D. melanogaster
tttggaaattcga

SEQ ID NO: 677388 - DNA, 13 bp, D. melanogaster
tttggaaatttgt

SEQ ID NO: 677389 - DNA, 13 bp, D. melanogaster
tttggaacaattt

SEQ ID NO: 677390 - DNA, 14 bp, D. melanogaster
tttggaacaatttt

SEQ ID NO: 677391 - DNA, 13 bp, D. melanogaster
tttggaacgcaaa

SEQ ID NO: 677392 - DNA, 13 bp, D. melanogaster
tttggaataattt

SEQ ID NO: 677393 - DNA, 13 bp, D. melanogaster
tttggaatatatt

SEQ ID NO: 677394 - DNA, 13 bp, D. melanogaster
tttggaatatttc

SEQ ID NO: 677395 - DNA, 13 bp, D. melanogaster
tttggaatatttg

SEQ ID NO: 677396 - DNA, 13 bp, D. melanogaster
tttggaatcacca

SEQ ID NO: 677397 - DNA, 13 bp, D. melanogaster
tttggaatgaatt

SEQ ID NO: 677398 - DNA, 13 bp, D. melanogaster
tttggaatgcatt

SEQ ID NO: 677399 - DNA, 13 bp, D. melanogaster
tttggaatgtggc

SEQ ID NO: 677400 - DNA, 13 bp, D. melanogaster
tttggaatgttta

SEQ ID NO: 677401 - DNA, 13 bp, D. melanogaster
tttggaattaaaa

SEQ ID NO: 677402 - DNA, 14 bp, D. melanogaster
tttggaattaaaat

SEQ ID NO: 677403 - DNA, 13 bp, D. melanogaster
tttggaattccgg

SEQ ID NO: 677404 - DNA, 15 bp, D. melanogaster
tttggaattggatat

SEQ ID NO: 677405 - DNA, 13 bp, D. melanogaster
tttggaatttgtg

SEQ ID NO: 677406 - DNA, 13 bp, D. melanogaster
tttggacaaaaaa

SEQ ID NO: 677407 - DNA, 13 bp, D. melanogaster
tttggacaaatta

SEQ ID NO: 677408 - DNA, 13 bp, D. melanogaster
tttggacaactat

SEQ ID NO: 677409 - DNA, 13 bp, D. melanogaster
tttggacaaggat

SEQ ID NO: 677410 - DNA, 13 bp, D. melanogaster
tttggacatgtgt

SEQ ID NO: 677411 - DNA, 13 bp, D. melanogaster
tttggacattttt

SEQ ID NO: 677412 - DNA, 13 bp, D. melanogaster
tttggaccattat

SEQ ID NO: 677413 - DNA, 13 bp, D. melanogaster
tttggacttaaaa

SEQ ID NO: 677414 - DNA, 13 bp, D. melanogaster
tttggacttacaa

SEQ ID NO: 677415 - DNA, 13 bp, D. melanogaster
tttggactttggc

SEQ ID NO: 677416 - DNA, 13 bp, D. melanogaster
tttggagaatttc

SEQ ID NO: 677417 - DNA, 13 bp, D. melanogaster
tttggagagctca

SEQ ID NO: 677418 - DNA, 13 bp, D. melanogaster
tttggagcagaaa

SEQ ID NO: 677419 - DNA, 13 bp, D. melanogaster
tttggagcatttt

SEQ ID NO: 677420 - DNA, 14 bp, D. melanogaster
tttggagcatttta

SEQ ID NO: 677421 - DNA, 13 bp, D. melanogaster
tttggagtccaca

SEQ ID NO: 677422 - DNA, 14 bp, D. melanogaster
tttggagtccacaa

SEQ ID NO: 677423 - DNA, 13 bp, D. melanogaster
tttggataaataa

SEQ ID NO: 677424 - DNA, 13 bp, D. melanogaster
tttggatacattt

SEQ ID NO: 677425 - DNA, 13 bp, D. melanogaster
tttggatactttt

SEQ ID NO: 677426 - DNA, 13 bp, D. melanogaster
tttggatatacat

SEQ ID NO: 677427 - DNA, 14 bp, D. melanogaster
tttggatatagttt

SEQ ID NO: 677428 - DNA, 13 bp, D. melanogaster
tttggatatatgt

SEQ ID NO: 677429 - DNA, 13 bp, D. melanogaster
tttggatctcagc

SEQ ID NO: 677430 - DNA, 13 bp, D. melanogaster
tttggatgaattt

SEQ ID NO: 677431 - DNA, 13 bp, D. melanogaster
tttggattaaaaa

SEQ ID NO: 677432 - DNA, 13 bp, D. melanogaster
tttggattacaaa

SEQ ID NO: 677433 - DNA, 13 bp, D. melanogaster
tttggattattaa

SEQ ID NO: 677434 - DNA, 14 bp, D. melanogaster
tttggattattgtc

SEQ ID NO: 677435 - DNA, 13 bp, D. melanogaster
tttggattcagtt

SEQ ID NO: 677436 - DNA, 13 bp, D. melanogaster
tttggattccttt

SEQ ID NO: 677437 - DNA, 13 bp, D. melanogaster
tttggattcggaa

SEQ ID NO: 677438 - DNA, 14 bp, D. melanogaster
tttggattcggatt

SEQ ID NO: 677439 - DNA, 13 bp, D. melanogaster
tttggattgaatt

SEQ ID NO: 677440 - DNA, 13 bp, D. melanogaster
tttggattggatt

SEQ ID NO: 677441 - DNA, 14 bp, D. melanogaster
tttggattggattg

SEQ ID NO: 677442 - DNA, 13 bp, D. melanogaster
tttggatttcgat

SEQ ID NO: 677443 - DNA, 13 bp, D. melanogaster
tttggatttcgtt

SEQ ID NO: 677444 - DNA, 13 bp, D. melanogaster
tttggatttgaat

SEQ ID NO: 677445 - DNA, 13 bp, D. melanogaster
tttggatttgcat

SEQ ID NO: 677446 - DNA, 14 bp, D. melanogaster
tttggatttgcatt

SEQ ID NO: 677447 - DNA, 13 bp, D. melanogaster
tttggatttggaa

SEQ ID NO: 677448 - DNA, 13 bp, D. melanogaster
tttggattttcaa

SEQ ID NO: 677449 - DNA, 15 bp, D. melanogaster
tttggattttttaca

SEQ ID NO: 677450 - DNA, 13 bp, D. melanogaster
tttggcaaaaaaa

SEQ ID NO: 677451 - DNA, 14 bp, D. melanogaster
tttggcaaaaaaaa

SEQ ID NO: 677452 - DNA, 14 bp, D. melanogaster
tttggcaaaaacaa

SEQ ID NO: 677453 - DNA, 13 bp, D. melanogaster
tttggcaaaaata

SEQ ID NO: 677454 - DNA, 13 bp, D. melanogaster
tttggcaaaaatc

SEQ ID NO: 677455 - DNA, 13 bp, D. melanogaster
tttggcaaaacaa

SEQ ID NO: 677456 - DNA, 13 bp, D. melanogaster
tttggcaaaactc

SEQ ID NO: 677457 - DNA, 13 bp, D. melanogaster
tttggcaaaagtt

SEQ ID NO: 677458 - DNA, 14 bp, D. melanogaster
tttggcaaaataaa

SEQ ID NO: 677459 - DNA, 13 bp, D. melanogaster
tttggcaaaatgc

SEQ ID NO: 677460 - DNA, 13 bp, D. melanogaster
tttggcaaaattt

SEQ ID NO: 677461 - DNA, 13 bp, D. melanogaster
tttggcaaacaaa

SEQ ID NO: 677462 - DNA, 13 bp, D. melanogaster
tttggcaaacaat

SEQ ID NO: 677463 - DNA, 13 bp, D. melanogaster
tttggcaaacaca

SEQ ID NO: 677464 - DNA, 13 bp, D. melanogaster
tttggcaaacact

SEQ ID NO: 677465 - DNA, 13 bp, D. melanogaster
tttggcaaacagc

SEQ ID NO: 677466 - DNA, 13 bp, D. melanogaster
tttggcaaacatt

SEQ ID NO: 677467 - DNA, 14 bp, D. melanogaster
tttggcaaacattt

SEQ ID NO: 677468 - DNA, 13 bp, D. melanogaster
tttggcaaacgca

SEQ ID NO: 677469 - DNA, 13 bp, D. melanogaster
tttggcaaacttg

SEQ ID NO: 677470 - DNA, 13 bp, D. melanogaster
tttggcaaacttt

SEQ ID NO: 677471 - DNA, 14 bp, D. melanogaster
tttggcaaactttt

SEQ ID NO: 677472 - DNA, 14 bp, D. melanogaster
tttggcaaatattt

SEQ ID NO: 677473 - DNA, 13 bp, D. melanogaster
tttggcaaatcga

SEQ ID NO: 677474 - DNA, 13 bp, D. melanogaster
tttggcaaatgaa

SEQ ID NO: 677475 - DNA, 13 bp, D. melanogaster
tttggcaaatgca

SEQ ID NO: 677476 - DNA, 13 bp, D. melanogaster
tttggcaaattgt

SEQ ID NO: 677477 - DNA, 14 bp, D. melanogaster
tttggcaaattgtt

SEQ ID NO: 677478 - DNA, 13 bp, D. melanogaster
tttggcaaatttt

SEQ ID NO: 677479 - DNA, 13 bp, D. melanogaster
tttggcaacaaaa

SEQ ID NO: 677480 - DNA, 14 bp, D. melanogaster
tttggcaacaaaaa

SEQ ID NO: 677481 - DNA, 13 bp, D. melanogaster
tttggcaacaaat

SEQ ID NO: 677482 - DNA, 14 bp, D. melanogaster
tttggcaacaattt

SEQ ID NO: 677483 - DNA, 13 bp, D. melanogaster
tttggcaacagca

SEQ ID NO: 677484 - DNA, 13 bp, D. melanogaster
tttggcaacataa

SEQ ID NO: 677485 - DNA, 13 bp, D. melanogaster
tttggcaacccaa

SEQ ID NO: 677486 - DNA, 13 bp, D. melanogaster
tttggcaactgca

SEQ ID NO: 677487 - DNA, 13 bp, D. melanogaster
tttggcaactttt

SEQ ID NO: 677488 - DNA, 13 bp, D. melanogaster
tttggcaagaaaa

SEQ ID NO: 677489 - DNA, 13 bp, D. melanogaster
tttggcaagccaa

SEQ ID NO: 677490 - DNA, 13 bp, D. melanogaster
tttggcaagttgt

SEQ ID NO: 677491 - DNA, 13 bp, D. melanogaster
tttggcaagtttt

SEQ ID NO: 677492 - DNA, 14 bp, D. melanogaster
tttggcaataaaat

SEQ ID NO: 677493 - DNA, 13 bp, D. melanogaster
tttggcaatattt

SEQ ID NO: 677494 - DNA, 13 bp, D. melanogaster
tttggcaatcaaa

SEQ ID NO: 677495 - DNA, 13 bp, D. melanogaster
tttggcaatcaat

SEQ ID NO: 677496 - DNA, 13 bp, D. melanogaster
tttggcaatcttt

SEQ ID NO: 677497 - DNA, 13 bp, D. melanogaster
tttggcaatgcca

SEQ ID NO: 677498 - DNA, 13 bp, D. melanogaster
tttggcaattagc

SEQ ID NO: 677499 - DNA, 13 bp, D. melanogaster
tttggcaattata

SEQ ID NO: 677500 - DNA, 14 bp, D. melanogaster
tttggcaattatat

SEQ ID NO: 677501 - DNA, 13 bp, D. melanogaster
tttggcaattcaa

SEQ ID NO: 677502 - DNA, 13 bp, D. melanogaster
tttggcaattcga

SEQ ID NO: 677503 - DNA, 13 bp, D. melanogaster
tttggcaattggc

SEQ ID NO: 677504 - DNA, 13 bp, D. melanogaster
tttggcaatttct

SEQ ID NO: 677505 - DNA, 14 bp, D. melanogaster
tttggcaatttgtt

SEQ ID NO: 677506 - DNA, 13 bp, D. melanogaster
tttggcaattttt

SEQ ID NO: 677507 - DNA, 13 bp, D. melanogaster
tttggcacaaatt

SEQ ID NO: 677508 - DNA, 13 bp, D. melanogaster
tttggcacatttc

SEQ ID NO: 677509 - DNA, 13 bp, D. melanogaster
tttggcaccactt

SEQ ID NO: 677510 - DNA, 13 bp, D. melanogaster
tttggcacttaaa

SEQ ID NO: 677511 - DNA, 13 bp, D. melanogaster
tttggcactttgc

SEQ ID NO: 677512 - DNA, 14 bp, D. melanogaster
tttggcactttggc

SEQ ID NO: 677513 - DNA, 13 bp, D. melanogaster
tttggcagcaaca

SEQ ID NO: 677514 - DNA, 13 bp, D. melanogaster
tttggcagccaaa

SEQ ID NO: 677515 - DNA, 13 bp, D. melanogaster
tttggcagccact

SEQ ID NO: 677516 - DNA, 13 bp, D. melanogaster
tttggcagccagc

SEQ ID NO: 677517 - DNA, 13 bp, D. melanogaster
tttggcagccatt

SEQ ID NO: 677518 - DNA, 13 bp, D. melanogaster
tttggcagccgca

SEQ ID NO: 677519 - DNA, 13 bp, D. melanogaster
tttggcagcgaaa

SEQ ID NO: 677520 - DNA, 14 bp, D. melanogaster
tttggcagcgcagc

SEQ ID NO: 677521 - DNA, 13 bp, D. melanogaster
tttggcagcggca

SEQ ID NO: 677522 - DNA, 13 bp, D. melanogaster
tttggcagcttaa

SEQ ID NO: 677523 - DNA, 13 bp, D. melanogaster
tttggcagctttg

SEQ ID NO: 677524 - DNA, 13 bp, D. melanogaster
tttggcaggaaaa

SEQ ID NO: 677525 - DNA, 13 bp, D. melanogaster
tttggcaggcaaa

SEQ ID NO: 677526 - DNA, 13 bp, D. melanogaster
tttggcataaatt

SEQ ID NO: 677527 - DNA, 13 bp, D. melanogaster
tttggcataataa

SEQ ID NO: 677528 - DNA, 13 bp, D. melanogaster
tttggcataattt

SEQ ID NO: 677529 - DNA, 13 bp, D. melanogaster
tttggcatacaaa

SEQ ID NO: 677530 - DNA, 13 bp, D. melanogaster
tttggcatataca

SEQ ID NO: 677531 - DNA, 13 bp, D. melanogaster
tttggcatatcca

SEQ ID NO: 677532 - DNA, 13 bp, D. melanogaster
tttggcatatcga

SEQ ID NO: 677533 - DNA, 13 bp, D. melanogaster
tttggcatctttg

SEQ ID NO: 677534 - DNA, 14 bp, D. melanogaster
tttggcatctttga

SEQ ID NO: 677535 - DNA, 13 bp, D. melanogaster
tttggcatgaatg

SEQ ID NO: 677536 - DNA, 13 bp, D. melanogaster
tttggcattattt

SEQ ID NO: 677537 - DNA, 13 bp, D. melanogaster
tttggcattcaaa

SEQ ID NO: 677538 - DNA, 13 bp, D. melanogaster
tttggcattcatt

SEQ ID NO: 677539 - DNA, 13 bp, D. melanogaster
tttggcattcttt

SEQ ID NO: 677540 - DNA, 13 bp, D. melanogaster
tttggcattgaaa

SEQ ID NO: 677541 - DNA, 13 bp, D. melanogaster
tttggcattgatt

SEQ ID NO: 677542 - DNA, 13 bp, D. melanogaster
tttggcattgcca

SEQ ID NO: 677543 - DNA, 13 bp, D. melanogaster
tttggcattgctc

SEQ ID NO: 677544 - DNA, 13 bp, D. melanogaster
tttggcattggcc

SEQ ID NO: 677545 - DNA, 13 bp, D. melanogaster
tttggcattggct

SEQ ID NO: 677546 - DNA, 13 bp, D. melanogaster
tttggcattgtgt

SEQ ID NO: 677547 - DNA, 13 bp, D. melanogaster
tttggcattgttc

SEQ ID NO: 677548 - DNA, 13 bp, D. melanogaster
tttggcattgttg

SEQ ID NO: 677549 - DNA, 13 bp, D. melanogaster
tttggcattgttt

SEQ ID NO: 677550 - DNA, 13 bp, D. melanogaster
tttggcatttaaa

SEQ ID NO: 677551 - DNA, 13 bp, D. melanogaster
tttggcatttaag

SEQ ID NO: 677552 - DNA, 13 bp, D. melanogaster
tttggcatttaat

SEQ ID NO: 677553 - DNA, 14 bp, D. melanogaster
tttggcatttaatt

SEQ ID NO: 677554 - DNA, 13 bp, D. melanogaster
tttggcatttaca

SEQ ID NO: 677555 - DNA, 13 bp, D. melanogaster
tttggcatttata

SEQ ID NO: 677556 - DNA, 13 bp, D. melanogaster
tttggcatttatt

SEQ ID NO: 677557 - DNA, 13 bp, D. melanogaster
tttggcatttcaa

SEQ ID NO: 677558 - DNA, 14 bp, D. melanogaster
tttggcatttcatt

SEQ ID NO: 677559 - DNA, 13 bp, D. melanogaster
tttggcatttcct

SEQ ID NO: 677560 - DNA, 13 bp, D. melanogaster
tttggcatttcga

SEQ ID NO: 677561 - DNA, 13 bp, D. melanogaster
tttggcatttcgg

SEQ ID NO: 677562 - DNA, 13 bp, D. melanogaster
tttggcatttgaa

SEQ ID NO: 677563 - DNA, 14 bp, D. melanogaster
tttggcatttgcat

SEQ ID NO: 677564 - DNA, 13 bp, D. melanogaster
tttggcatttgcc

SEQ ID NO: 677565 - DNA, 14 bp, D. melanogaster
tttggcatttgcca

SEQ ID NO: 677566 - DNA, 13 bp, D. melanogaster
tttggcatttggc

SEQ ID NO: 677567 - DNA, 13 bp, D. melanogaster
tttggcatttgtg

SEQ ID NO: 677568 - DNA, 13 bp, D. melanogaster
tttggcattttat

SEQ ID NO: 677569 - DNA, 13 bp, D. melanogaster
tttggcattttcc

SEQ ID NO: 677570 - DNA, 13 bp, D. melanogaster
tttggcattttgc

SEQ ID NO: 677571 - DNA, 13 bp, D. melanogaster
tttggcattttgg

SEQ ID NO: 677572 - DNA, 14 bp, D. melanogaster
tttggcattttggc

SEQ ID NO: 677573 - DNA, 13 bp, D. melanogaster
tttggcattttgt

SEQ ID NO: 677574 - DNA, 14 bp, D. melanogaster
tttggcatttttat

SEQ ID NO: 677575 - DNA, 13 bp, D. melanogaster
tttggcatttttg

SEQ ID NO: 677576 - DNA, 14 bp, D. melanogaster
tttggcattttttg

SEQ ID NO: 677577 - DNA, 14 bp, D. melanogaster
tttggccaaaaaaa

SEQ ID NO: 677578 - DNA, 14 bp, D. melanogaster
tttggccaaaaact

SEQ ID NO: 677579 - DNA, 13 bp, D. melanogaster
tttggccaaaaag

SEQ ID NO: 677580 - DNA, 14 bp, D. melanogaster
tttggccaaaaagc

SEQ ID NO: 677581 - DNA, 14 bp, D. melanogaster
tttggccaaaaagg

SEQ ID NO: 677582 - DNA, 14 bp, D. melanogaster
tttggccaaaaatt

SEQ ID NO: 677583 - DNA, 13 bp, D. melanogaster
tttggccaaaaca

SEQ ID NO: 677584 - DNA, 14 bp, D. melanogaster
tttggccaaaacaa

SEQ ID NO: 677585 - DNA, 13 bp, D. melanogaster
tttggccaaaact

SEQ ID NO: 677586 - DNA, 14 bp, D. melanogaster
tttggccaaaactt

SEQ ID NO: 677587 - DNA, 13 bp, D. melanogaster
tttggccaaaaga

SEQ ID NO: 677588 - DNA, 13 bp, D. melanogaster
tttggccaaaagc

SEQ ID NO: 677589 - DNA, 13 bp, D. melanogaster
tttggccaaactc

SEQ ID NO: 677590 - DNA, 13 bp, D. melanogaster
tttggccaaagca

SEQ ID NO: 677591 - DNA, 13 bp, D. melanogaster
tttggccaaagtg

SEQ ID NO: 677592 - DNA, 13 bp, D. melanogaster
tttggccaaatat

SEQ ID NO: 677593 - DNA, 13 bp, D. melanogaster
tttggccaaatca

SEQ ID NO: 677594 - DNA, 13 bp, D. melanogaster
tttggccaaatcc

SEQ ID NO: 677595 - DNA, 13 bp, D. melanogaster
tttggccaaatct

SEQ ID NO: 677596 - DNA, 14 bp, D. melanogaster
tttggccaaatgca

SEQ ID NO: 677597 - DNA, 13 bp, D. melanogaster
tttggccaaattg

SEQ ID NO: 677598 - DNA, 14 bp, D. melanogaster
tttggccaaattgc

SEQ ID NO: 677599 - DNA, 13 bp, D. melanogaster
tttggccaaattt

SEQ ID NO: 677600 - DNA, 13 bp, D. melanogaster
tttggccaacaaa

SEQ ID NO: 677601 - DNA, 14 bp, D. melanogaster
tttggccaacaaaa

SEQ ID NO: 677602 - DNA, 13 bp, D. melanogaster
tttggccaacaga

SEQ ID NO: 677603 - DNA, 13 bp, D. melanogaster
tttggccaacatc

SEQ ID NO: 677604 - DNA, 14 bp, D. melanogaster
tttggccaacattt

SEQ ID NO: 677605 - DNA, 13 bp, D. melanogaster
tttggccaacgcc

SEQ ID NO: 677606 - DNA, 13 bp, D. melanogaster
tttggccaactat

SEQ ID NO: 677607 - DNA, 13 bp, D. melanogaster
tttggccaactca

SEQ ID NO: 677608 - DNA, 13 bp, D. melanogaster
tttggccaactcc

SEQ ID NO: 677609 - DNA, 13 bp, D. melanogaster
tttggccaactga

SEQ ID NO: 677610 - DNA, 13 bp, D. melanogaster
tttggccaacttg

SEQ ID NO: 677611 - DNA, 13 bp, D. melanogaster
tttggccaacttt

SEQ ID NO: 677612 - DNA, 13 bp, D. melanogaster
tttggccaagaaa

SEQ ID NO: 677613 - DNA, 13 bp, D. melanogaster
tttggccaagaca

SEQ ID NO: 677614 - DNA, 13 bp, D. melanogaster
tttggccaagaga

SEQ ID NO: 677615 - DNA, 13 bp, D. melanogaster
tttggccaagatt

SEQ ID NO: 677616 - DNA, 13 bp, D. melanogaster
tttggccaagtca

SEQ ID NO: 677617 - DNA, 14 bp, D. melanogaster
tttggccaagtcaa

SEQ ID NO: 677618 - DNA, 13 bp, D. melanogaster
tttggccaagtcc

SEQ ID NO: 677619 - DNA, 13 bp, D. melanogaster
tttggccaagtct

SEQ ID NO: 677620 - DNA, 13 bp, D. melanogaster
tttggccaagtta

SEQ ID NO: 677621 - DNA, 13 bp, D. melanogaster
tttggccaattcg

SEQ ID NO: 677622 - DNA, 13 bp, D. melanogaster
tttggccaattta

SEQ ID NO: 677623 - DNA, 13 bp, D. melanogaster
tttggccaatttc

SEQ ID NO: 677624 - DNA, 14 bp, D. melanogaster
tttggccacaaaaa

SEQ ID NO: 677625 - DNA, 13 bp, D. melanogaster
tttggccacaact

SEQ ID NO: 677626 - DNA, 14 bp, D. melanogaster
tttggccacaactt

SEQ ID NO: 677627 - DNA, 13 bp, D. melanogaster
tttggccacaagt

SEQ ID NO: 677628 - DNA, 13 bp, D. melanogaster
tttggccacaatt

SEQ ID NO: 677629 - DNA, 13 bp, D. melanogaster
tttggccacagtt

SEQ ID NO: 677630 - DNA, 13 bp, D. melanogaster
tttggccacatgt

SEQ ID NO: 677631 - DNA, 14 bp, D. melanogaster
tttggccacgccca

SEQ ID NO: 677632 - DNA, 13 bp, D. melanogaster
tttggccacgttt

SEQ ID NO: 677633 - DNA, 13 bp, D. melanogaster
tttggccacttgc

SEQ ID NO: 677634 - DNA, 13 bp, D. melanogaster
tttggccacttgg

SEQ ID NO: 677635 - DNA, 13 bp, D. melanogaster
tttggccactttg

SEQ ID NO: 677636 - DNA, 13 bp, D. melanogaster
tttggccactttt

SEQ ID NO: 677637 - DNA, 13 bp, D. melanogaster
tttggccagaaaa

SEQ ID NO: 677638 - DNA, 13 bp, D. melanogaster
tttggccagaaat

SEQ ID NO: 677639 - DNA, 13 bp, D. melanogaster
tttggccagaagc

SEQ ID NO: 677640 - DNA, 13 bp, D. melanogaster
tttggccagaagt

SEQ ID NO: 677641 - DNA, 13 bp, D. melanogaster
tttggccagagtt

SEQ ID NO: 677642 - DNA, 13 bp, D. melanogaster
tttggccagcaaa

SEQ ID NO: 677643 - DNA, 13 bp, D. melanogaster
tttggccagcaac

SEQ ID NO: 677644 - DNA, 13 bp, D. melanogaster
tttggccagcaca

SEQ ID NO: 677645 - DNA, 13 bp, D. melanogaster
tttggccagccaa

SEQ ID NO: 677646 - DNA, 13 bp, D. melanogaster
tttggccagccac

SEQ ID NO: 677647 - DNA, 13 bp, D. melanogaster
tttggccagccag

SEQ ID NO: 677648 - DNA, 13 bp, D. melanogaster
tttggccagccga

SEQ ID NO: 677649 - DNA, 13 bp, D. melanogaster
tttggccagcgaa

SEQ ID NO: 677650 - DNA, 13 bp, D. melanogaster
tttggccagcggc

SEQ ID NO: 677651 - DNA, 13 bp, D. melanogaster
tttggccaggaca

SEQ ID NO: 677652 - DNA, 13 bp, D. melanogaster
tttggccaggact

SEQ ID NO: 677653 - DNA, 13 bp, D. melanogaster
tttggccaggatt

SEQ ID NO: 677654 - DNA, 14 bp, D. melanogaster
tttggccaggccaa

SEQ ID NO: 677655 - DNA, 13 bp, D. melanogaster
tttggccagtttc

SEQ ID NO: 677656 - DNA, 13 bp, D. melanogaster
tttggccataaaa

SEQ ID NO: 677657 - DNA, 13 bp, D. melanogaster
tttggccataaat

SEQ ID NO: 677658 - DNA, 13 bp, D. melanogaster
tttggccatcaat

SEQ ID NO: 677659 - DNA, 14 bp, D. melanogaster
tttggccatggcca

SEQ ID NO: 677660 - DNA, 13 bp, D. melanogaster
tttggccatgttt

SEQ ID NO: 677661 - DNA, 14 bp, D. melanogaster
tttggccatgtttt

SEQ ID NO: 677662 - DNA, 13 bp, D. melanogaster
tttggccattaaa

SEQ ID NO: 677663 - DNA, 13 bp, D. melanogaster
tttggccattgaa

SEQ ID NO: 677664 - DNA, 13 bp, D. melanogaster
tttggccattgca

SEQ ID NO: 677665 - DNA, 13 bp, D. melanogaster
tttggccattgtg

SEQ ID NO: 677666 - DNA, 13 bp, D. melanogaster
tttggccatttat

SEQ ID NO: 677667 - DNA, 13 bp, D. melanogaster
tttggccatttct

SEQ ID NO: 677668 - DNA, 13 bp, D. melanogaster
tttggccatttga

SEQ ID NO: 677669 - DNA, 14 bp, D. melanogaster
tttggccatttgtt

SEQ ID NO: 677670 - DNA, 13 bp, D. melanogaster
tttggccatttta

SEQ ID NO: 677671 - DNA, 13 bp, D. melanogaster
tttggccattttt

SEQ ID NO: 677672 - DNA, 13 bp, D. melanogaster
tttggcccaaaac

SEQ ID NO: 677673 - DNA, 13 bp, D. melanogaster
tttggcccaaaca

SEQ ID NO: 677674 - DNA, 13 bp, D. melanogaster
tttggcccacaca

SEQ ID NO: 677675 - DNA, 13 bp, D. melanogaster
tttggcccacatt

SEQ ID NO: 677676 - DNA, 13 bp, D. melanogaster
tttggcccatttg

SEQ ID NO: 677677 - DNA, 13 bp, D. melanogaster
tttggcccatttt

SEQ ID NO: 677678 - DNA, 13 bp, D. melanogaster
tttggcccctttt

SEQ ID NO: 677679 - DNA, 13 bp, D. melanogaster
tttggcccgaaaa

SEQ ID NO: 677680 - DNA, 13 bp, D. melanogaster
tttggcccgcttt

SEQ ID NO: 677681 - DNA, 13 bp, D. melanogaster
tttggcccggcca

SEQ ID NO: 677682 - DNA, 13 bp, D. melanogaster
tttggccgcaaaa

SEQ ID NO: 677683 - DNA, 13 bp, D. melanogaster
tttggccgccagc

SEQ ID NO: 677684 - DNA, 13 bp, D. melanogaster
tttggccgctgct

SEQ ID NO: 677685 - DNA, 13 bp, D. melanogaster
tttggccggaagc

SEQ ID NO: 677686 - DNA, 14 bp, D. melanogaster
tttggcctcaaaaa

SEQ ID NO: 677687 - DNA, 13 bp, D. melanogaster
tttggcctgagaa

SEQ ID NO: 677688 - DNA, 14 bp, D. melanogaster
tttggcctggccaa

SEQ ID NO: 677689 - DNA, 13 bp, D. melanogaster
tttggcctggcct

SEQ ID NO: 677690 - DNA, 14 bp, D. melanogaster
tttggcctggcttt

SEQ ID NO: 677691 - DNA, 13 bp, D. melanogaster
tttggcctggtct

SEQ ID NO: 677692 - DNA, 13 bp, D. melanogaster
tttggccttcaga

SEQ ID NO: 677693 - DNA, 13 bp, D. melanogaster
tttggcctttggc

SEQ ID NO: 677694 - DNA, 13 bp, D. melanogaster
tttggccttttca

SEQ ID NO: 677695 - DNA, 13 bp, D. melanogaster
tttggcgaaaaat

SEQ ID NO: 677696 - DNA, 13 bp, D. melanogaster
tttggcgacacaa

SEQ ID NO: 677697 - DNA, 13 bp, D. melanogaster
tttggcgacattt

SEQ ID NO: 677698 - DNA, 13 bp, D. melanogaster
tttggcgagagct

SEQ ID NO: 677699 - DNA, 13 bp, D. melanogaster
tttggcgataatc

SEQ ID NO: 677700 - DNA, 13 bp, D. melanogaster
tttggcgcaaaaa

SEQ ID NO: 677701 - DNA, 13 bp, D. melanogaster
tttggcgcatttt

SEQ ID NO: 677702 - DNA, 13 bp, D. melanogaster
tttggcgccaaaa

SEQ ID NO: 677703 - DNA, 13 bp, D. melanogaster
tttggcgccaaat

SEQ ID NO: 677704 - DNA, 13 bp, D. melanogaster
tttggcgctgcga

SEQ ID NO: 677705 - DNA, 14 bp, D. melanogaster
tttggcgctgcgag

SEQ ID NO: 677706 - DNA, 13 bp, D. melanogaster
tttggcgcttttg

SEQ ID NO: 677707 - DNA, 13 bp, D. melanogaster
tttggcggcattt

SEQ ID NO: 677708 - DNA, 13 bp, D. melanogaster
tttggcgtcgcaa

SEQ ID NO: 677709 - DNA, 13 bp, D. melanogaster
tttggcgttttta

SEQ ID NO: 677710 - DNA, 13 bp, D. melanogaster
tttggctaaaaaa

SEQ ID NO: 677711 - DNA, 13 bp, D. melanogaster
tttggctaaaaag

SEQ ID NO: 677712 - DNA, 13 bp, D. melanogaster
tttggctaaaact

SEQ ID NO: 677713 - DNA, 13 bp, D. melanogaster
tttggctaaaatg

SEQ ID NO: 677714 - DNA, 13 bp, D. melanogaster
tttggctaacaaa

SEQ ID NO: 677715 - DNA, 13 bp, D. melanogaster
tttggctaattgt

SEQ ID NO: 677716 - DNA, 13 bp, D. melanogaster
tttggctactgcc

SEQ ID NO: 677717 - DNA, 14 bp, D. melanogaster
tttggctactgccc

SEQ ID NO: 677718 - DNA, 13 bp, D. melanogaster
tttggctataaat

SEQ ID NO: 677719 - DNA, 13 bp, D. melanogaster
tttggctataact

SEQ ID NO: 677720 - DNA, 13 bp, D. melanogaster
tttggctataatt

SEQ ID NO: 677721 - DNA, 13 bp, D. melanogaster
tttggctatctgc

SEQ ID NO: 677722 - DNA, 13 bp, D. melanogaster
tttggctatttct

SEQ ID NO: 677723 - DNA, 13 bp, D. melanogaster
tttggctatttgc

SEQ ID NO: 677724 - DNA, 13 bp, D. melanogaster
tttggctcagtgt

SEQ ID NO: 677725 - DNA, 13 bp, D. melanogaster
tttggctcattta

SEQ ID NO: 677726 - DNA, 13 bp, D. melanogaster
tttggctcatttg

SEQ ID NO: 677727 - DNA, 13 bp, D. melanogaster
tttggctcttggc

SEQ ID NO: 677728 - DNA, 13 bp, D. melanogaster
tttggctctttgg

SEQ ID NO: 677729 - DNA, 13 bp, D. melanogaster
tttggctgatttt

SEQ ID NO: 677730 - DNA, 13 bp, D. melanogaster
tttggctgcaatt

SEQ ID NO: 677731 - DNA, 13 bp, D. melanogaster
tttggctgcactt

SEQ ID NO: 677732 - DNA, 13 bp, D. melanogaster
tttggctgcattt

SEQ ID NO: 677733 - DNA, 14 bp, D. melanogaster
tttggctgcatttt

SEQ ID NO: 677734 - DNA, 13 bp, D. melanogaster
tttggctgccaaa

SEQ ID NO: 677735 - DNA, 13 bp, D. melanogaster
tttggctgccact

SEQ ID NO: 677736 - DNA, 13 bp, D. melanogaster
tttggctgccagc

SEQ ID NO: 677737 - DNA, 13 bp, D. melanogaster
tttggctgccggc

SEQ ID NO: 677738 - DNA, 13 bp, D. melanogaster
tttggctgccgtt

SEQ ID NO: 677739 - DNA, 13 bp, D. melanogaster
tttggctgctgct

SEQ ID NO: 677740 - DNA, 13 bp, D. melanogaster
tttggctgctggt

SEQ ID NO: 677741 - DNA, 13 bp, D. melanogaster
tttggctgctgtt

SEQ ID NO: 677742 - DNA, 13 bp, D. melanogaster
tttggctgcttta

SEQ ID NO: 677743 - DNA, 13 bp, D. melanogaster
tttggctggcagc

SEQ ID NO: 677744 - DNA, 13 bp, D. melanogaster
tttggctggccaa

SEQ ID NO: 677745 - DNA, 13 bp, D. melanogaster
tttggctggccat

SEQ ID NO: 677746 - DNA, 13 bp, D. melanogaster
tttggctggggaa

SEQ ID NO: 677747 - DNA, 13 bp, D. melanogaster
tttggctgtcgca

SEQ ID NO: 677748 - DNA, 13 bp, D. melanogaster
tttggctgtgtgc

SEQ ID NO: 677749 - DNA, 13 bp, D. melanogaster
tttggctgttgct

SEQ ID NO: 677750 - DNA, 13 bp, D. melanogaster
tttggctgtttgc

SEQ ID NO: 677751 - DNA, 13 bp, D. melanogaster
tttggcttaaagt

SEQ ID NO: 677752 - DNA, 13 bp, D. melanogaster
tttggcttaattt

SEQ ID NO: 677753 - DNA, 13 bp, D. melanogaster
tttggcttacaaa

SEQ ID NO: 677754 - DNA, 13 bp, D. melanogaster
tttggcttacttt

SEQ ID NO: 677755 - DNA, 13 bp, D. melanogaster
tttggcttataat

SEQ ID NO: 677756 - DNA, 13 bp, D. melanogaster
tttggcttatcaa

SEQ ID NO: 677757 - DNA, 13 bp, D. melanogaster
tttggcttattta

SEQ ID NO: 677758 - DNA, 13 bp, D. melanogaster
tttggcttcaatg

SEQ ID NO: 677759 - DNA, 13 bp, D. melanogaster
tttggcttcactt

SEQ ID NO: 677760 - DNA, 13 bp, D. melanogaster
tttggcttcattt

SEQ ID NO: 677761 - DNA, 14 bp, D. melanogaster
tttggcttccaaat

SEQ ID NO: 677762 - DNA, 13 bp, D. melanogaster
tttggcttcctgc

SEQ ID NO: 677763 - DNA, 13 bp, D. melanogaster
tttggcttcggct

SEQ ID NO: 677764 - DNA, 13 bp, D. melanogaster
tttggcttctgct

SEQ ID NO: 677765 - DNA, 13 bp, D. melanogaster
tttggcttctggc

SEQ ID NO: 677766 - DNA, 13 bp, D. melanogaster
tttggcttcttgg

SEQ ID NO: 677767 - DNA, 13 bp, D. melanogaster
tttggcttgaaaa

SEQ ID NO: 677768 - DNA, 13 bp, D. melanogaster
tttggcttgaaat

SEQ ID NO: 677769 - DNA, 13 bp, D. melanogaster
tttggcttgccaa

SEQ ID NO: 677770 - DNA, 13 bp, D. melanogaster
tttggcttggaaa

SEQ ID NO: 677771 - DNA, 13 bp, D. melanogaster
tttggcttggctt

SEQ ID NO: 677772 - DNA, 13 bp, D. melanogaster
tttggcttgttga

SEQ ID NO: 677773 - DNA, 13 bp, D. melanogaster
tttggctttaaaa

SEQ ID NO: 677774 - DNA, 13 bp, D. melanogaster
tttggctttaaat

SEQ ID NO: 677775 - DNA, 13 bp, D. melanogaster
tttggctttaatt

SEQ ID NO: 677776 - DNA, 13 bp, D. melanogaster
tttggctttagtt

SEQ ID NO: 677777 - DNA, 14 bp, D. melanogaster
tttggctttagttt

SEQ ID NO: 677778 - DNA, 13 bp, D. melanogaster
tttggctttatgg

SEQ ID NO: 677779 - DNA, 13 bp, D. melanogaster
tttggctttatgt

SEQ ID NO: 677780 - DNA, 13 bp, D. melanogaster
tttggctttcaat

SEQ ID NO: 677781 - DNA, 13 bp, D. melanogaster
tttggctttcatt

SEQ ID NO: 677782 - DNA, 14 bp, D. melanogaster
tttggctttcattt

SEQ ID NO: 677783 - DNA, 13 bp, D. melanogaster
tttggctttcgag

SEQ ID NO: 677784 - DNA, 13 bp, D. melanogaster
tttggctttcggt

SEQ ID NO: 677785 - DNA, 13 bp, D. melanogaster
tttggctttctgg

SEQ ID NO: 677786 - DNA, 13 bp, D. melanogaster
tttggctttgaat

SEQ ID NO: 677787 - DNA, 13 bp, D. melanogaster
tttggctttgaca

SEQ ID NO: 677788 - DNA, 13 bp, D. melanogaster
tttggctttgatt

SEQ ID NO: 677789 - DNA, 14 bp, D. melanogaster
tttggctttggatt

SEQ ID NO: 677790 - DNA, 14 bp, D. melanogaster
tttggctttggcat

SEQ ID NO: 677791 - DNA, 13 bp, D. melanogaster
tttggctttggcg

SEQ ID NO: 677792 - DNA, 14 bp, D. melanogaster
tttggctttggctc

SEQ ID NO: 677793 - DNA, 13 bp, D. melanogaster
tttggcttttaaa

SEQ ID NO: 677794 - DNA, 13 bp, D. melanogaster
tttggcttttagc

SEQ ID NO: 677795 - DNA, 14 bp, D. melanogaster
tttggcttttagca

SEQ ID NO: 677796 - DNA, 13 bp, D. melanogaster
tttggcttttcaa

SEQ ID NO: 677797 - DNA, 13 bp, D. melanogaster
tttggcttttgcc

SEQ ID NO: 677798 - DNA, 13 bp, D. melanogaster
tttggcttttggc

SEQ ID NO: 677799 - DNA, 13 bp, D. melanogaster
tttgggaaaacaa

SEQ ID NO: 677800 - DNA, 13 bp, D. melanogaster
tttgggaaaagtt

SEQ ID NO: 677801 - DNA, 13 bp, D. melanogaster
tttgggaaatatt

SEQ ID NO: 677802 - DNA, 13 bp, D. melanogaster
tttgggaaatgcc

SEQ ID NO: 677803 - DNA, 13 bp, D. melanogaster
tttgggaaatgtt

SEQ ID NO: 677804 - DNA, 13 bp, D. melanogaster
tttgggaaattta

SEQ ID NO: 677805 - DNA, 13 bp, D. melanogaster
tttgggaaatttg

SEQ ID NO: 677806 - DNA, 13 bp, D. melanogaster
tttgggaagctgg

SEQ ID NO: 677807 - DNA, 13 bp, D. melanogaster
tttgggaattcta

SEQ ID NO: 677808 - DNA, 13 bp, D. melanogaster
tttgggacatcgt

SEQ ID NO: 677809 - DNA, 13 bp, D. melanogaster
tttgggacttccg

SEQ ID NO: 677810 - DNA, 13 bp, D. melanogaster
tttgggagttcaa

SEQ ID NO: 677811 - DNA, 14 bp, D. melanogaster
tttgggattgggat

SEQ ID NO: 677812 - DNA, 13 bp, D. melanogaster
tttgggatttctt

SEQ ID NO: 677813 - DNA, 14 bp, D. melanogaster
tttgggattttaca

SEQ ID NO: 677814 - DNA, 13 bp, D. melanogaster
tttgggattttct

SEQ ID NO: 677815 - DNA, 13 bp, D. melanogaster
tttgggcaaacaa

SEQ ID NO: 677816 - DNA, 13 bp, D. melanogaster
tttgggcaaatat

SEQ ID NO: 677817 - DNA, 14 bp, D. melanogaster
tttgggcagagtgc

SEQ ID NO: 677818 - DNA, 13 bp, D. melanogaster
tttgggcatttgg

SEQ ID NO: 677819 - DNA, 13 bp, D. melanogaster
tttgggcattttc

SEQ ID NO: 677820 - DNA, 13 bp, D. melanogaster
tttgggcattttt

SEQ ID NO: 677821 - DNA, 13 bp, D. melanogaster
tttgggccaaaaa

SEQ ID NO: 677822 - DNA, 14 bp, D. melanogaster
tttgggccaaaaag

SEQ ID NO: 677823 - DNA, 13 bp, D. melanogaster
tttgggccaaatg

SEQ ID NO: 677824 - DNA, 13 bp, D. melanogaster
tttgggccaaatt

SEQ ID NO: 677825 - DNA, 13 bp, D. melanogaster
tttgggccaacat

SEQ ID NO: 677826 - DNA, 13 bp, D. melanogaster
tttgggccaactc
